United States Patent 9,254,311 (MODIFIED POLYNUCLEOTIDES FOR THE PRODUCTION OF PROTEINS) - sequence listing, part 17

SEQ ID NO: 34534 - DNA, 4908 bp, Artificial Sequence
  Description of Artificial Sequence: Synthetic coding sequence
atgacctctgcccagtgtcccgcactggcgtgtgtgatgtcccccctacgattctggggcccctggccattgctaatgtggcagctcctctggttattggtgaaggaggcacaaccgttggaatgggtgaaggatcctctccagctcacaagcaaccccttaggaccccccgaaccttggagctcacattcttctcactttccgcgcgagagccctcacgcacccacccttccagccgacccatgggacttcgatcatctgggtccctcagcatcatcagagatgccagcacctccacaagaaagcacagaaaacctggttcccttcctcgatacttgggatagtgccggagaactgccattagagcccgagcagtttcttgcgagtcaacaggatcttaaagacaagttgtctcctcaagaacgccttccagtcagccctaagaaacttaaaaaggatcctgcacagaggtggtctctggctgaaattatcgggatcatccggcagttgtccacccctcagagtcagaaacagacgcttcaaaatgaatattcttctaccgatacaccctatccagggagcttgccacccgaactgcgggtgaaatctgacgaacccccgggcccatctgaacaggtcggtccttctcagttccacctggagccagaaactcagaacccagaaaccctggaggacattcagagctcctccctgcagcaggaggctcccgcgcagctcccccaactgctggaggaagaaccctcatctatgcagcaggaagctcccgcactgccaccagaatcctctatggagagtctgacgttacctaaccacgaagtgtccgtgcagccgccgggtgaggaccaggcgtactaccatctgcccaacatcaccgtcaagcccgcggacgtggaggtcaccatcacgagtgaacccacgaatgaaacggaatcaagccaagctcagcaggagacacctatacaattccctgaagaagtggagccaagtgccacccagcaagaggcgcccatcgagccccccgtgccaccgatggaacatgaactaagtatctctgagcaacagcagcctgtgcagccgtccgaaagtccccgggaagtggagtcatctccaactcagcaggaaacccccggccagccgccagaacatcacgaggttaccgtgagtccaccgggccaccatcaaactcatcacttggcctccccttctgtgtcagtcaagcccccagacgttcaactcaccatagccgcagagccgtctgctgaggtgggcacaagtctcgtccaccaggaggccacgacgcggctctctggtagcggaaacgatgtggagcctcctgcaattcaacacggaggaccaccactgctgccagaatcaagtgaggaagcaggacctttggctgtgcaacaggagacatccttccagtctccagagcctatcaacaatgagaacccaagcccgacccagcaggaagccgctgccgagcacccacagaccgcggaagagggcgagtcttcccttacgcaccaggaagctcctgctcaaaccccggaatttccgaacgtcgtcgtcgcacagcccccggaacattctcatctcactcaggccacggtccagccactggacctcggcttcacaattaccccagaaagtaagacagaagttgagctcagtcccacaatgaaagaaactcccactcagcccccaaagaaggttgtgcctcagctgagggtctatcagggcgttactaatcccacaccggggcaggatcaggcccagcatcccgtgtctccctcagtcaccgttcagctacttgatctgggtttgactatcacacccgagcctaccaccgaggtgggacacagtactccacccaagaggaccatagtgtccccaaagcaccccgaggtcactctgccccatcccgaccaagtgcagacccagcacagccacttgaccagagccaccgtgcagccactcgatttgggtttcactatcactcctaaaagcatgacagaagttgaaccctccactgcactaatgacaactgctccccctcctgggcatccagaggttaccctgccgccaagtgataaggggcaagcacagcactcccacctcacacaggctacggtccagccactcgacctggagctgaccatcactactaagcctaccacagaggtaaaaccttcacctacaacagaagaaaccagcacacagccaccagacctaggcctggctattatccctgagccaaccacagaaacgggccattctaccgccctcgagaagaccactgcccctagacccgaccgagtacagacccttcacagaagcctgacagaagtcacgggaccccctaccgaattagaacccgcccaagacagtctggttcagtctgaatcttatacccagaataaggccttgaccgcaccagaagagcacaaagcaagcacaagcacaaacatctgcgaactctgtacttgcggagacgagatgctttcctgtatagacctcaatccagagcaaaggctcagacaggtgcccgtgcccgaacccaacacgcacaatggcactttcacaattttgaacttccaaggcaattacatctcctacatcgatggtaatgtgtggaaggcttacagctggacggagaaactgattctgagagagaataatctgaccgagttgcacaaggacagttttgaggggctcctttccctacaatacctggatttgagctgcaataagattcagtctattgaacgtcatacatttgaacctttgccatttctcaagtttattaatctgagctgtaacgtgatcaccgagctgagctttgggacattccaggcttggcacggcatgcaatttttgcacaaactcatcctcaatcataaccctttgactactgtggaggatccatacctgttcaagttgcctgcactgaagtacttagacatgggcaccacactcgttccactaacaactttgaaaaacatcctgatgatgacagttgaacttgaaaagctcattcttcccagccatatggcgtgctgcctgtgtcagtttaaaaacagcatcgaagccgtttgtaagacggtgaaactgcattgcaactcagcatgtctcaccaacacaacacactgtccagaggaggcttccgtgggcaatcccgagggcgcattcatgaaggttctccaggcaagaaagaactacacatcgacagagctgatcgtggaaccggaagaacccagtgattctagcggaattaatctgtctggctttggcagtgaacaactggacactaatgatgagagcgacttcatttccacccttcgatatattctaccatattttagtgcggttaacctggatgtgaagagcctcctcctgccgctcattaagctgccgaccactggtaactcccttgccaaaatccaaaccgtaggacagaatcgccagcgggtcaaaagggtcttgatgggtccacgctcgatccagaaaagacacttcaaagaagtgggtagacagagcatcaggagagagcagggcgctcaggcttccgtcgaaaacgcagcagaagaaaagaggctgggatctcctgcacccagggaagtggaacagcctcacacacagcaaggacccgaaaagctggctggcaatgctgtgtataccaaaccgtcttttacccaggagcataaggccgctgtgagcgtcctgaagcctttctcaaagggcgcccccagcacctcctctccggcaaaggcactgccccaagtgcgggatcgctggaaggatctaactcatgcaatctcaaccctggaaagtgctaaggcccgggtcactaatactaaaacttctaagccgatagttcacgcaagaaaaaagtacaggtttcataaaactcgatcgcacgtcacccaccggacccccaaagtgaaaaagtctcctaaagtgcgtaagaaaagttacctttctagactgatgctggccaacagactcccattcagtgctgcaaaatctttgatcaattcaccttctcagggcgcattctcttcattgggtgacctctcacctcaggagaatcctttcctcgaggtctctgcccccagcgaacactttatcgaaaaaaataacaccaagcacacaactgcccgcaacgccttcgaagaaaatgattttatggaaaacactaatatgcccgagggcacaatcagcgaaaacaccaactataaccacccacctgaggcggacagcgccggaactgcctttaatcttggccctacagtcaaacagaccgagacaaagtgggaatacaataatgtcggtaccgatctctcacccgaaccaaagtcttttaactaccctttattgtcgagcccgggggatcagtttgagatccagcttacacaacagctccagtcactgatccctaataacaacgtaaggaggcttatcgcccacgtaattagaactctgaaaatggactgctccggtacccacgtacaggtgacatgcgcaaaactaattagtcgcacaggacacttaatgaagctcttgtcggggcagcaggaagtcaaagcctccaagatagaatgggacacagatcagtggaagatcgagaactacatcaacgaatcaactgaagcccagtcagaacagaaggagaagagcctcgagctgaagaaggaagttcccggctatggttacacagataagctcatcctggccttgattgtcaccggcatactgactatactaatcatcctgttctgccttattgtgatctgttgtcataggcgttcactacaagaggatgaggaagggttctctcgcgacagcgaagctccaaccgaagaggaagagtcggaggccctgccctag

SEQ ID NO: 34535 - DNA, 1701 bp, Artificial Sequence
  Description of Artificial Sequence: Synthetic coding sequence
atgaagatgcagaaagggaacgtgctgctgatgtttggacttctgctccatctcgaagctgcaaccaactccaatgaaacatcaacaagcgctaatactggctcatctgtgatttcctcgggagccagtactgccacaaactctggaagttcagtcacgtcaagcggagtgagcacagcgacaatctccggatcctccgtaacgagcaacggggtgtccatcgtgacaaattccgaatttcatactacttccagcggcatttccaccgctacaaactcagaattcagcacagcctcttctggcatttccattgcaacaaatagtgagagctcaactacctcaagcggagcctctaccgctacaaacagtgaatcctcaacacctagtagcggcgcttctaccgcaaccaatagtgagtcttccaccctgtcaagcggtgccagtacagccaccaattcagattcatcaaccacttcatctggcgcttcgacagccactaacagtgaaagctccaccacctcatctggagcgagtacagctacgaacagcgaatccagcaccgtgagttcgcgtgcctccacagccactaatagcgagagcagcacaaccagtagcggcgcaagtaccgccacgaactcagaaagcaggactaccagtaacggggccgggaccgccacgaactcagagtcctcaactacatccagcggggcaagtactgcaaccaatagcgactcatcaactgtaagcagtggagcctcaaccgctacaaatagcgagtcttccaccacttcttctggtgcatcaacagccaccaactctgaatctagcacaacctcgtcaggagcctccacggccaccaactctgacagtagtaccaccagctcaggggcaggtactgccacaaatagcgagagttctaccgtgtcatcggggataagtacagtcaccaatagcgagagttccacccccagctctggcgcgaatactgcgactaacagcgagagtagtactacatctagcggcgcgaacacagccaccaactccgaaagcagtacagtttcttccggcgcaagtacagctactaactcagagtcttcaaccactagctctggggtatcaaccgcaacgaactccgaatcctcaacaacatcatccggggcttctactgctactaactctgattcgagtactacaagctcagaggcaagtacggccacaaactccgaatccagtaccgtgagcagcgggatatcgactgtgaccaacagcgagagctccacgacatccagcggggctaacaccgcgactaatagtggaagcagtgttacgtcagctgggagtggaacagcagccctcactggtatgcacaccacgtcccactccgcaagcactgccgtatccgaagctaagccaggaggctcgctggtaccctgggagattttcctgattacactcgtctccgtcgtggctgctgtgggcttgttcgctggactgtttttctgtgtgaggaatagcctgagcttgaggaacacatttaataccgctgtttatcatcctcacggactgaaccatgggctggggccaggtccaggaggaaatcatggtgcgccccaccggccaaggtggtccccgaactggttttggaggagaccagtgagttctatcgctatggagatgtcaggacggaattcgggcccatag

SEQ ID NO: 34536 - DNA, 375 bp, Artificial Sequence
  Description of Artificial Sequence: Synthetic coding sequence
atgaccccgaatgagcatcctgccttcaaacacctgtttaataaagctcatctggcgccacctctgatacatttaacattgagcggccatagtacatgtttcagggagcaccgggtgggaggaaaagtgactgaccagcaggacccaaaggccgaggaattcttcctggtgcagaataaaatgaaatccctaccatgcttgctgctgtctacacagaccaggcagccatctgacttcagcattttctccccccctttcctaccattttactcaacgaagcctccgctgagctcttggccagtgcttaacgagctcttgggcacgccaccccgccgaggcggaggccgtgctgagggtttgctgacttcccaatag

SEQ ID NO: 34537 - DNA, 816 bp, Artificial Sequence
  Description of Artificial Sequence: Synthetic coding sequence
atgttcctaagcgaagagaagcttcattacagatctgcacgtactaaagaactagatgccctgttgggggacctgcactgcgagatccgggatcaagagacgctcctcatgtatcagctccagtgccaggtgctggcccgggccgctgtgctcacacgcgttctggatctggccagccgtctggatgtgcttcttgccctcgcgagtgcagcacgggactatgggtattctaggccacgctactcccctcaggtcttaggcgtgaggatccagaacggacgccaccccctcatggaactgtgtgcccgcacctttgtaccgaattcgacagaatgcggcggagataaggggcgcgtgaaagtgattacaggccctaacagtagcgggaagagtatctacctgaagcaggtgggactgattaccttcatggcccttgtcggctccttcgtcccagctgaggaagctgagatcggggctgtcgacgctattttcactcgaattcactcttgcgaatccatttctctcggactgtcaacttttatgatcgacctcaatcaggtggcgaaggctgttaataacgccaccgctcagagcttagttctgatagatgagttcggtaagggcactaacactgtcgatggactggcactccttgctgcggtgctgcggcactggttggctaggggaccaacctgtccccacattttcgtcgcaactaacttcttatccctggtccagctccagctgctgcctcagggacctcttgtacaatatctggattggcctagagtaagcggccaagaaggaggcgattag

SEQ ID NO: 34538 - DNA, 372 bp, Artificial Sequence
  Description of Artificial Sequence: Synthetic coding sequence
atgcagtctgaaaaaccacagggtctcttcctccagctgaatccaaatgcgtcatcgacagaaacacagctgctcgttccagcacttgaatctcgggacactcttcccccaacccattgctttatggccggaactgagtcccccctggggaacccctggcccttgtctctgccccccccgtgctggaccgggtgtgttctgccagccccaagggggcagcgcaagcccgggcctctggggctcagcattttcataagcctcgggaacaaacgacaccgcagtggcaaccatgtggtgcgcgaatccgagcaacctttatcacaaggcaaccctcatcagggctggggaccagacacacgcaagggcagatag

SEQ ID NO: 34539 - DNA, 102 bp, Artificial Sequence
  Description of Artificial Sequence: Synthetic coding sequence
atgctaaacttcgatatctcagctgcccctcgcaaaaccgcactaatgaagctggaaactatcattcacagcaaacttctgcaaggtcagaagacaaaatag

SEQ ID NO: 34540 - DNA, 102 bp, Artificial Sequence
  Description of Artificial Sequence: Synthetic coding sequence
atgctgaactttgacattagcgccgcccctcgcaaaaccgcccttatgaagttagaaactatcattcattcaaagttactgcaggggcagaagactaaatag

SEQ ID NO: 34541 - DNA, 2025 bp, Artificial Sequence
  Description of Artificial Sequence: Synthetic coding sequence
atgcagttctataccctgaagatcatcttgaatcataatccactcaccaccgtcgaggacccatatctttttaagctgccagcactaaaataccttgatatgggcactactctcgtacctctgacgaccctgaaaaatatattaatgatgaccgttgagctcgagaagctgatactgccctcccatatggcatgctgtctgtgccagtttaaaaactcaatagaggccgtgtgtaaaacagtgaagctccattgcaatagtgcctgtctcacaaacactacacactgcccagaggaagcgagcgttggcaatcctgagggggcctttatgaaggtgctgcaagctcggaagaactatactagcacagagctgatcgtggagccagaagagccaagcgactcgagcgggataaatttaagcggattcggctcagagcagttagacacgaacgatgagagcgattttatatctaccttgagatacatccttccgtacttttccgcagtgaatctcgatgtgaagagtcttctgcttcctctgatcaagctacctacgacaggcaacagcctcgctaaaattcaaaccgtaggccaaaaccgacaacgggtgaagcgggtgctgatggggccgcggtccattcagaaacggcacttcaaagaagtgggacgccaatccataagacgggagcaaggcgcacaggcctccgtggaaaacgctgccgaggagaaacgcctcggatcaccagctccacgggaggtcgaacaaccccatacgcaacagggccctgaaaaattggctggcaatgccgtgtatactaagccctcatttacgcaggaacacaaagccgctgtgagcgtgcttaagcctttttcaaagggtgccccgagcactagctcaccagcgaaggccttgcctcaagtgcgtgaccgctggaaagacttaacccacgctatttctactctggaatccgcaaaagcaagggtcacaaacaccaaaacaagtaaacccatagtgcatgcacggaaaaaatataggttccacaaaaccagatcacacgtaacacatcgtactccgaaggtcaagaaatcgcccaaagttcggaagaagtcctacctcagtcggctcatgttggccaaccgcctgccctttagcgcggcaaagagtctgattaattccccttctcagggagccttttctagcctcggggacctgtcgccccaggagaacccttttctagaggtttcagccccttcagagcattttattgagaagaacaatactaaacacactacggctcgcaatgctttcgaggaaaacgacttcatggagaacaccaacatgccggagggtacaattagcgaaaacacaaattacaaccatcctcctgaagcagattcagccggcactgcctttaatctgggccccaccgttaagcagaccgaaaccaaatgggagtacaacaacgtcggcacagacctatcccccgagcctaagtccttcaattatccgctcctaagttctccaggtgatcagttcgaaatccagctgacccagcagctgcagagcttaatccctaacaataatgtaagaagattgattgctcacgtcatacgtactttgaagatggactgctcaggcgcccacgtgcaggtgacttgcgcaaaactgatatctagaaccggccatttgatgaaattgttgtcaggccagcaggaggtcaaagcctccaagatcgaatgggacactgaccagtggaagattgaaaattacattaacgaaagcaccgaggctcagagcgagcagaaagaaaaaagcctagaactgaaaaaagaagtcccaggttacggttacactgacaagctgatcctagccctgattgtaacggggattttgacgatccttatcattttattctgccttatagttatatgttgccaccgcagatctcttcaggaggacgaagaagggttctcgagggactctgaggcccctacagaagaggaggagtcagaagctttaccttag

SEQ ID NO: 34542 - DNA, 4908 bp, Artificial Sequence
  Description of Artificial Sequence: Synthetic coding sequence
atgacgagtgcccagtgccctgctctcgcctgcgtgatgtcacccctccgtttttggggcccctggcctcttttgatgtggcagttactttggcttctagttaaggaagcgcaaccactggagtgggttaaggaccccctccagctaacctccaatccactgggccccccagaaccatggtcatctcatagcagccactttccccgtgaatccccccacgcccctacactccccgccgacccatgggattttgatcatctcggcccttccgcctcctcggagatgcctgcccctccccaggagtccacagaaaaccttgtccccttcctggacacctgggacagcgcaggtgagcttcctctagaaccggaacaatttctggcatcgcagcaggatttaaaggacaagctttctccacaggaaagactgccagtgagccctaaaaagctcaaaaaggatcctgcacaacgctggtccttagccgagattatcggaattatccgccagctctccaccccccaatctcagaagcagactctccaaaatgagtactcttctaccgacacaccataccccggttctctgcctccggagctgcgtgtcaaaagcgacgaacctccgggtccttctgagcaggtcggaccgtcccagttccacttggaacctgaaacccagaatcctgaaactcttgaagacatccagtcaagctccttgcagcaggaagcaccggcacagcttccacagctcctcgaagaggaaccgagctccatgcagcaggaggcaccagctctcccccccgaatccagcatggagtccctgacactgcctaatcacgaggtctccgtgcagccccctggagaagaccaagcctattatcacctgccaaacatcacagtcaagcccgcagacgtggaggtgacaatcacgtccgagccaactaatgaaaccgaaagttcacaggctcagcaggaaacaccaatccagtttcctgaagaagttgagccgtcagcaacgcaacaagaagctcccattgagcctccagtgccaccaatggagcatgaattgagtatatctgagcaacaacagccagttcagccatcagagtcaccaagagaagtcgaatcttcacctacccagcaggagacaccgggccagccccccgagcaccatgaggtgaccgtcagtcctcccggacatcatcagacacatcacctggccagcccatccgttagtgtcaagcctcccgatgtgcagctaacaattgccgcggagccctcagcagaagtggggaccagccttgtccaccaagaagctaccacaagattgtcgggctcagggaacgatgtggaacctcctgccattcagcacggtggcccgcctttgctccctgaatcaagcgaagaagcagggccattggctgtgcagcaagagacctccttccagtcaccagagccaattaacaacgagaaccccagcccaactcagcaggaggccgcagccgagcacccacaaactgcagaagagggagaatccagcctgactcaccaggaagcccccgcccagactcctgagtttcccaacgttgtggtcgctcagcccccggagcatagtcacctaacccaagctaccgtccagccgctcgatctgggattcaccattacgcccgagtccaagaccgaggtagagctcagccccaccatgaaagagacccccacccaaccacccaagaaggtcgtgccacagcttcgagtgtatcaaggggtgacgaatcccaccccaggacaagaccaagcacagcaccctgtttctccctccgttacagttcagctcctagatctggggttgaccattactcccgaacctaccactgaagtgggccatagtaccccaccaaaacgtaccatcgtcagtcctaaacaccccgaggtaacattacctcatccagatcaggtgcaaacgcagcactctcacctgactcgcgcaacggttcaaccattagacctcgggttcaccattacacctaagtctatgaccgaggtagagcccagcaccgcgctaatgactactgcacctccccccggccaccccgaagtgacgctgccaccgagtgacaagggtcaggcacagcatagccatctcacccaggcgactgttcagcccctggacctcgagctcactattactacaaaaccgacaaccgaggtaaagccgagcccaaccacagaagaaacttctacgcagccccctgacttaggactggcaattataccggaaccgactaccgaaacaggccactccacagcccttgagaagacaacggcccctcgaccagatagagtccaaactctgcaccggtccttgactgaggttacaggcccccctaccgagctcgagcccgcacaggattcactagtccagtccgaatcttacacccagaataaagccctgacagcccccgaagagcacaaggcatccaccagcactaatatttgcgagttgtgtacctgtggagatgaaatgctgagttgtatcgacctgaatccagaacagagactcagacaggttcctgtgccggaacccaacacccataacggcaccttcacgatactgaacttccagggaaattacatttcttacattgacggcaatgtgtggaaggcctacagctggactgagaaactcatcctccgggagaacaaccttaccgagctgcacaaggattccttcgagggactgctgagcctgcagtatttggaccttagttgtaacaagattcagagcatcgagcgtcacacctttgaacccctgcctttcctgaaattcatcaacctgtcttgcaatgttatcacagaactatccttcggcacattccaggcctggcatggcatgcagtttctgcacaaactgatcttaaatcacaatcctctgacaacagtcgaggatccatacttatttaagctaccagctttaaagtatctggacatggggacaactttggtgccactcaccaccctcaagaatatacttatgatgacagtggagctcgagaagcttattttaccttctcacatggcttgttgcctttgtcaattcaagaattccatagaggccgtgtgcaagaccgtgaagctgcactgcaacagcgcctgcctgaccaacaccacacattgtcctgaggaggcctccgtaggtaatccggagggtgccttcatgaaagttcttcaggcaagaaaaaactatacctctacggaactgatcgtggagcccgaagagccatcggatagctccgggattaatctctccggattcggctcggagcagctcgacaccaacgacgagtctgatttcatttcgacccttagatatatcctcccctatttttcagcagtgaacctcgacgtaaaatccttactgttgcctttgataaagcttcccaccaccggcaacagtctggcgaaaatccagacagtcggtcagaaccgccagcgcgtcaagcgggttctgatgggaccgcgatcaattcagaagagacattttaaggaagttgggcggcaatcaattcggcgggagcaaggcgcgcaggccagtgtggaaaacgccgctgaggaaaagaggctgggaagccccgctccccgtgaggtggaacaacctcacacccaacaaggtcccgaaaaactggctgggaacgccgtgtatacaaaaccatcgtttacccaggaacataaggccgcagtgtctgtcctgaaaccattttctaagggagccccaagcactagttcacccgctaaggcactacctcaggtaagagatagatggaaagatctcactcacgcaatcagcacgttggagtcagctaaggcaagagttaccaatactaaaacttccaagcctattgtacacgctcgaaagaagtatagattccataagacacggagccacgtaactcaccggactcccaaggtgaagaagtctccaaaagtacggaagaagagctacctaagtagattgatgttagcaaacaggttgcctttttccgcggccaaatcactcattaatagtccttcacagggagccttttcaagccttggtgacctgagtccccaagagaatcccttcctggaggtcagcgcccctagcgaacattttattgaaaagaacaacaccaagcacacaacggccagaaatgcgtttgaggagaacgacttcatggaaaacaccaacatgccagagggaaccatctccgagaatacaaactacaaccacccccctgaagccgatagcgccggaacagcttttaacctgggaccaacagtcaagcaaaccgagacaaagtgggaatacaataacgttggtaccgacctttctcctgaacccaaatccttcaactaccctctcctgtccagccccggggaccagttcgagatccaactgactcagcagctgcagtccctcatccctaacaataatgtccggcgtctgatcgcgcatgtgatccgtacactcaaaatggactgtagcggcgcccatgtgcaagtgacttgtgccaagcttatttcacggacgggacatctgatgaagctgctgagtgggcaacaagaggtcaaagccagcaagatcgagtgggacacggatcagtggaaaatcgagaactacattaatgagagtacagaggctcagtccgaacagaaagaaaagtccctcgagctaaaaaaagaagtgcccggatacggctacacagacaaactaatactggccctgatcgtgaccggcatattgactattctcataattctcttctgcctgattgttatctgctgccatcggagaagtttgcaagaggacgaagaaggtttctcccgggactccgaagctcctactgaggaagaggaatccgaagcactgccctag

SEQ ID NO: 34543 - DNA, 2262 bp, Artificial Sequence
  Description of Artificial Sequence: Synthetic coding sequence
atggaattccaccgagttgcccaggcgggagtagagctgttgtcttcaggggatccgcccgcttccgcaagccaatccgtagggatcatcggggtgagtcactgtacatggcacatcaacttccagggcaactatataagctatattgacggcaatgtgtggaaggcgtatagctggacagagaaactgatcctaagagagaataatctgactgagctccacaaagattcttttgaaggcttgctgtccctccagtatttaattttgaatcataatcccctgaccacagtggaggacccatacttgtttaagttacctgcccttaagtaccttgatatgggcaccacgttggtgcccttgactactttgaaaaacatcttgatgatgaccgtggagctcgaaaaactgattctcccaagccacatggcatgttgtctctgccaatttaagaattctatcgaagccgtgtgcaagaccgtaaagctgcactgcaactcagcatgtctgactaacactacgcattgccccgaagaagcaagcgtaggaaaccctgagggcgcgttcatgaaggtactgcaggcccgcaagaattatacctctacagagctgattgtcgagcctgaagagcccagtgacagctccggcattaatctgagcggcttcggtagtgaacaacttgatacaaatgatgaaagtgactttatttctaccctaaggtacattctgccctatttctcagctgtcaatctagatgtgaaaagcctgctgttacctttgattaagctgccaactacaggaaatagccttgcaaaaatacaaactgtcggacagaacaggcagagggtcaagcgggttctcatgggtcctcgatccatccagaagagacacttcaaagaggtgggacgtcagtcaatccgccgggaacagggtgcccaggcaagcgttgaaaatgccgctgaggagaagagactgggctccccagcgcctcgggaggttgaacaaccccatacgcagcagggtcccgaaaaactagccggaaacgcagtgtatactaaaccctcttttacccaagagcataaggccgctgtatctgtcctgaagccattcagtaagggcgctccttcaacaagcagccctgccaaggctctgccgcaagtgcgtgaccggtggaaggaccttacccatgccatcagtaccctggagtccgctaaggctcgcgtgactaacactaagacatctaagcctatcgtgcacgcccggaaaaaatatagattccataaaacccggtcgcacgtgacacatcggacaccaaaagtgaaaaagtcccccaaggtgagaaaaaagtcatatctcagcagattgatgctggccaatcggctcccgtttagtgcggcgaagagtctcatcaatagtccctcacaaggggccttttccagtctgggtgacttgagtccacaagagaacccctttctcgaggtatctgccccatccgagcatttcatcgaaaaaaataacactaaacatacaacagcaaggaacgcgttcgaagaaaacgattttatggagaacaccaacatgccagagggcactataagtgagaacaccaattataaccaccctcctgaggccgacagcgcgggtaccgcctttaacctgggcccgaccgtgaagcagactgagacaaagtgggaatacaacaatgttggcaccgatctttccccagagcctaaaagcttcaactacccattgctgtcttcccctggggatcaattcgaaatacaactgacgcagcaactgcagtccctgatccccaacaacaatgtgaggagactgattgcccatgttattcggaccctgaagatggattgttctggggctcatgtgcaggtcacatgcgctaaattgatatctcgcactggacatctgatgaagctgttgtccggtcagcaagaagtcaaagcctctaagattgagtgggacaccgatcagtggaaaatcgagaactatattaacgagtcgactgaggcgcagtctgagcagaaggagaaatctctggagctcaaaaaggaagtccccggctacggatacacagacaaactcattctggcccttattgtcacaggcattctgaccattctgatcattctgttttgtctgatagtaatctgctgtcaccgtagatctctgcaggaggacgaagaaggcttttcgagagattcagaggcccccaccgaggaagaggagagtgaggccctgccttag

SEQ ID NO: 34544 - DNA, 372 bp, Artificial Sequence
  Description of Artificial Sequence: Synthetic coding sequence
atgcagtctgaaaagccccaaggcctgtttctccaactcaaccctaacgcctccagcacagagacccagctcttggtgcccgcccttgaatcccgggatacactgcccccgacccattgtttcatggccggaaccgagagccccctgggcaacccttggcctctctctctgccccctccttgttggactggatgcgtgttgccggctcctagaggacaacggaagccaggccccctgggacttagtatatttatctcactgggtaataagcggcataggagtggcaaccacgtcgtgcgggaaagcgaacagcctctttcacaaggcaaccctcaccagggctggggccctgacacccgtaagggccgctag

SEQ ID NO: 34545 - DNA, 876 bp, Artificial Sequence
  Description of Artificial Sequence: Synthetic coding sequence
tcggccggtggcggaggagccgggagcaggctccaggcagagatgctccaaatggacctgattgatgcaacaggggactcaactcccgacgaacccgacgtgcatttctccaaaaaattcttgaacatattcatgagtggcagatctcggtcctccagtgctgaatcattcggcctgttcagctgcataatcaatagagaagaacaggaacagacacaccggacaatctttaggttcgtcccccggcatgaagacgagccagagctggaggttgacgatcccctgctggtcgagctccaggccgaggactactggtacgaagcatataacatgaggaccggcgccagggggtttttcacggcttattatgccattgaagtgactaaagaacctgagcacatggccgcccttgccaaaaattccgattgggtggatcagtttcgcgttaaattccttggttccgttcaggtgccctaccacaaaggcgacgtggttctcagcgctgcaatgcagaagatcgccactactaggagactaaccgtgcatttcaatcctccctcatcctgcgtgctagagatctcggtgcgaggcgtgaagatcggggtaaaagccgatgactcccaagaagcgaaggggaataagtgctcccacttttttcagctgaagaatatatcattccgaggctaccatcccaaaaacaacaaatattttggcttcatcaccaagcacctggctgatcatcgattcgcatgtcacgtgttcgtgtcagaggacagcaccaaggcgcttgctgagtctgttggtagggcatttcagcagtttcataagcagttcgttgagtacacgtgcccaacagaggatatctacctggaatag

SEQ ID NO: 34546 - DNA, 2055 bp, Artificial Sequence
  Description of Artificial Sequence: Synthetic coding sequence
atggcttgtctgggcttcctactccccgtggggttcctgcttctgatctctactgtagctggcggcaaatatggggttgcccacgtggtgtctgaaaactggtccaaggactattgcattcttttctccagcgattatattacgttaccaagggatcttcaccatgccccccttttgccgctgtacgatggcaccaaggccccgtggtgtccgggggaggattcaccacatcaagctcagcttcgtagtccttcgcagcgacctctgcgccagacgacggctatggtgatgaggggcaattgcagcttccacactaagggctggctggcacagggccagggagctcatggactcctaatagtttcccgcgtgagcgatcagcaatgttcagatacgaccctggcccctcaagacccaagacagcctcttgccgatctgactatccccgtggctatgcttcactacgccgatatgctggacattctgtcacacacacggggggaggccgtggttagagtggctatgtacgcaccacctgagccaatcatcgactacaatatgctggttattttcattctggccgtaggcacagtggcagctggagggtactgggcggggctgactgaggccaacaggttgcagcgtagaagagctaggaggggaggcgggcccggagggcaccaccaactgcaggaagccgcagcggccgaaggggcgcaaaaggaggacaacgaagatatccccgtcgattttactcccgctatgaccggggtcgtggtgactctctcctgtagcctgatgctgctattgtattttttttacgaccattttgtgtatgtcactatcggcatattcggcttgggagctggtatcggcctttatagctgcctgagtcccttagtctgtcgactctccctcaggcagtatcagcgcccccctcactccctttgggcctcactgcccctacccctgctgctgctggctagcctgtgcaccaccgtgatcatcttctgggttgcctaccgcaacgaggatcgatgggcatggctgctgcaagataccctcggcatctcatattgcctcttcgtgttacaccgcgtaagacttccaactctcaagaactgcagcagcttccttcttgccctgttggcctttgacgtgttcttcgtgttcgtgacccccttcttcacaaaaacgggcgagtctattatggctcaggtggctttgggccctgccgagagctctagtcacgaacggctcccaatggtgctgaaagtgcctaggctaagagtctctgccttaaccctttgctcgcagccgttttccatcctgggattcggtgatatcgtcgttccaggattcctcgtggcttactgttgtccttttgatgtgcaagtgtgtagtcggcaggtgtatttcgttgcttgtaccgtagcatacgcagtgggccttctggtcacctttatggctatggtgctaatgcaaatggggcaaccggcattgctttacctcgtgtcaagcaccttgctgaccagccttgctgtcgccgcttgtaggcaggaattgtcacttttttggacagggcaaggtagggccaagatgtgcggcctcggttgcgcgccgtctgccggtagccgtcagaagcaggaaggggcagccgatgctcacacagcctccaccttggaaaggggaacaagtcgcggagccggagaccttgattccaatccgggcgaggataccacggagatagtgacaatttcagagaacgaggctacaaacccagaggacaggtcagatagccccgagggatggagtgatgcccacctggaccccaacgaactgccttttatccctcctagggccagcgaagaattgatgccattaatgcctatggcaatgctcatcccactgatgcccctcatgcctcgtccctccgaactggggcacgtccatgcccaggcacaggcgcatgaaaccggattaccgtgggccggtctccacaagcggaaaggccttaaagtgcgcaaatctatgagcactcaagctcccctgtag

SEQ ID NO: 34547 - DNA, 372 bp, Artificial Sequence
  Description of Artificial Sequence: Synthetic coding sequence
atgcagtccgaaaagcctcagggtctgttcctccagttgaatcccaacgcctcatccacagaaacccaactgctggtaccggcactcgaaagtcgcgacactctgcctcctactcactgcttcatggcaggaactgagagtcctctgggcaacccctggccactgtcgttacccccaccctgctggactggctgtgttctccccgctcctcgagggcagcggaagccaggccctctgggtctgagcatcttcatatcccttgggaataagcgacatcgaagcggcaaccacgtggttcgagagagtgaacagcccctgtcacagggcaacccgcatcagggttggggccccgatacacgtaagggccgatag

SEQ ID NO: 34548 - DNA, 2025 bp, Artificial Sequence
  Description of Artificial Sequence: Synthetic coding sequence
atgcagttctacactttgaaaatcatcctcaaccataaccctcttaccactgttgaggacccctatcttttcaagttgcccgcgctcaagtacctcgatatgggaacaactctggtccccctaactaccctgaaaaacatccttatgatgactgtcgagctggagaaacttatcttaccttcacatatggcttgctgtctctgtcagtttaagaatagcatcgaagcggtctgcaagaccgtcaagctgcactgcaactccgcctgcttgacaaacactattcactgtcctgaggaggcgagcgtgggcaatcccgagggagcctttatgaaagtgctacaggccagaaagaactacacatcaactgagcttattgtggagccagaggaaccttctgactcttctggaattaacctttccggatttggctcagagcagctagacacaaatgatgagagcgatttcataagcacactccggtacattctgccttatttctcagcagtgaacctggacgtcaagtccctgcttcttccactcataaagcttcccaccacaggaaattcactcgccaagatccagacagtcggacaaaatagacagagagtgaagcgagtgctgatgggcccacggagtatccagaagcgccacttcaaggaagtcggccgccagagtatccggcgagagcagggcgcacaggctagcgtcgagaacgccgcggaggaaaagagattggggtctccagctccccgcgaagtcgaacagccccacacccagcagggtccagagaaacttgccggtaatgcggtctatacaaagccctctttcactcaggaacacaaagccgcagtgagcgtcctgaaaccattcagtaaaggtgcaccgtctactagctctcccgccaaggctctgccacaggtgcgagacagatggaaagatctaacgcacgctatatccatcctggagtcagccaaagcacgggtaaccaacaccaaaacatctaagcccattgtgcacgctcgtaaaaaataccgcttccacaagacacggagtcatgtgacgcatcgcactcccaaggtgaaaaaatcccccaaggtgcggaagaaaagttacctcagtcgcctaatgctcgccaatcgtctcccattctctgccgcgaaatccctgatcaatagtccctcgcagggagctttttctagtctgggagatctgtccccacaagagaatccgttcctggaggtatctgctccctcagaacacttcatcgaaaagaacaataccaaacacactacagctcgcaatgcgttcgaggagaacgacttcatggagaacaccaatatgcccgagggcactatcagcgagaacaccaattataatcacccccccgaggctgacagtgccggcactgcctttaacctcggtcctaccgttaaacagacggagactaaatgggaatataataacgtcggaacagatccttcacctgagccaaaaagttttaactaccccttgctgagctcaccgggggatcagttcgaaatccagttgacccagcaactccagagcctgatccccaataataatgtccgccgcctgattgcccacgttattagaactctcaagatggactgtagcggcgcgcacgtccaagttacatgtgctaaactcatctcacgtacaggccacctgatgaagttactatccggtcagcaagaggttaaggcctctaaaatagagtgggatacggaccagtggaaaatcgaaaactacataaacgaatctaccgaggcacagtcagagcagaaggagaagtcactcgagctgaagaaagaggtgcctggatatgggtacacagataaactgattctcgccctgattgtaaccggcattttgactatccttatcattctgttctgcctgatcgttatctgctgtcatcgtcggtcgttgcaggaggatgaagaaggattctccagggactctgaagctcctacggaagaggaggaaagcgaggctttgccttag

SEQ ID NO: 34549 - DNA, 393 bp, Artificial Sequence
  Description of Artificial Sequence: Synthetic coding sequence
ggtgccagatcgcctgggagtactcaccaaggatctctggcaagcggtgtgttacctattaaatgtagccatgttgaattcggcatgtggaagggtggtaggtcacacccattcctgccacactcctcccggtgcgccggtagtggtggccagctggactccatccttccacaccagtcccccgcctggggaccatggggctgtaaggacctttcttctggctttcccagctttctgaccagttctatcctctggaagagcgctgttgttcgagagcctcacatatctccccaccaagcaccaccctacaaaacaagcgattgtatcagagccatctccttccctgtctgcacaatccaccaagaaataatgaggggacactggcataagtag

SEQ ID NO: 34550 - DNA, 876 bp, Artificial Sequence
  Description of Artificial Sequence: Synthetic coding sequence
tccgccggaggaggaggcgccgggtcgcgcttacaggctgaaatgctgcaaatggacctaattgatgccacgggcgacagcacgccagacgagccggacgtccacttttctaagaaatttctgaacatttttatgtcaggaaggtcgcggtcgagttccgcggagagttttggcctgttttcctgtatcatcaaccgcgaagaacaagagcagactcacagaaccatttttaggttcgtgcccagacacgaagacgaacccgagctcgaagtggacgaccctctgctggtcgaattgcaggcagaggactattggtatgaagcttataatatgcgcacaggtgccaggggattcttcacagcctactacgccattgaggtgaccaaggagcctgagcatatggcagctctggccaagaattccgactgggtggaccaattccgggtcaagttcctggggtcagtgcaggtcccatatcataaaggggacgtagtgctgtcagcagccatgcaaaagattgcgaccacccgaaggttgacagtgcatttcaacccgccatcatcctgtgtcctcgagataagcgtgcgaggcgtgaagattggagtgaaagcagatgattctcaggaagccaaaggaaacaaatgttcccactttttccagctgaagaacatctcatttagaggataccatcccaaaaacaacaaatacttcggatttataaccaagcatttggctgaccaccgctttgcttgtcacgtatttgtatctgaagattctacaaaagcactggctgagtccgtgggccgtgcatttcagcagtttcataagcagttcgtcgagtacacctgtcccacagaagacatttacctggagtag

SEQ ID NO: 34551 - DNA, 1593 bp, Artificial Sequence
  Description of Artificial Sequence: Synthetic coding sequence
atgagtcttaagtggaccagcgtgtttctgttaatccaactgtcttgttacttctcctcaggcagttgtggcaaggtcctggtttggcctaccgagtactcacactggattaacatgaagaccatcctggaagagttggttcaaagaggtcacgaggtcaccgtgctgacgtcctccgcatccacgctggtgaacgcaagcaaatcaagtgctattaagcttgaggtctaccccacgtccctcaccaagaacgatctggaagactccctcctgaaaatccttgaccgatggatttacggggtctcaaagaataccttttggtcatacttttcccagctgcaggaactctgctgggagtactacgattatagcaataaactgtgtaaggacgccgtgctgaacaaaaagctcatgatgaaactacaggaatctaagtttgacgttattctggcagacgctctcaatccttgtggggagctgttggctgagttgttcaatatccccttcctatattcactgaggttctcagttggctatacgttcgagaaaaatggagggggatttctcttcccacctagttatgtccccgtggtgatgtcagaactgagcgatcaaatgatattcatggaacggattaagaacatgattcacatgctgtatttcgatttttggttccagatttacgatctcaagaaatgggaccaattttacagcgaggtgctaggtcgccccacgactctgtttgaaactatgggaaaggcagagatgtggctgatcaggacatactgggacttcgagtttccccgcccttttctgccgaatgttgactttgtgggaggtctgcattgtaagcctgctaaaccccttcccaaagagatggaggaattcgtacagtcctccggcgaaaatggaatcgtggtcttctcacttggaagtatgatctccaatatgtcggaggagagcgctaacatgatcgccagtgcactggcacagattccacagaaagtgttgtggcgctttgacgggaagaagcccaataccctaggctctaacacaagattgtacaaatggttgccccaaaatgatctgttggggcaccccaagactaaggcctttatcacacatggcgggacaaatgggatctatgaggccatctaccatggaattccaatggtcgggattccgctttttgccgaccagcatgacaacattgcacacatgaaggccaagggcgcggcactaagcgttgacattaggacaatgagtagccgcgatctgctgaacgcgctgaaatccgtcattaacgaccccgtttacaaagaaaatgtgatgaaactcagccgcatacatcatgatcaaccaatgaaaccattagaccgtgccgtgttctggattgaatttgtgatgagacacaaaggagccaaacatttaagggtagccgcccacaacctcacctggatccagtaccacagtttagatgtaatagcgtttcttttagcatgtgtcgctactgtcatttttatcatcaccaagttttgcttgttctgtttccggaaacttgccaaaaagggcaagaaaaaaaagcgcgactag

SEQ ID NO: 34552 - DNA, 102 bp, Artificial Sequence
  Description of Artificial Sequence: Synthetic coding sequence
atgcttaacttcgatatcagcgccgcccctcgcaagaccgccttgatgaagttggagacgattatccactctaagctgctgcaaggccagaaaactaagtag

SEQ ID NO: 34553 - DNA, 375 bp, Artificial Sequence
  Description of Artificial Sequence: Synthetic coding sequence
atgacgctgaatgagcacgcggcctttaagcatctgttcaacaaggctcatcttgctcctcccctgattcatctgacactgagtgggcattccacttgctttcgggagcacagagtagggggcaaggtgactgaccaacaggaccctaaggccgaagaatttttcttggtgcagaataaaatgaaatcactgccctgtttactgctgtccactcagaccgggcagccatcagacttttcaatcttttctccacccttcccacctttctatagcacaaagccgccgctgtcatcctggccgatcccaaatgagcccttgggcactcctccccggcgcggtcgaggccgcgcggaggggctgcttacttctcagtag

SEQ ID NO: 34554 - DNA, 474 bp, Artificial Sequence
  Description of Artificial Sequence: Synthetic coding sequence
atgcatccttggctgggcagcgctcttgggtttcctaagtgccgtggcatccacctgtgtgcttgcggcaacgggtggacccctggggagactctctcccagaacaaaaccgaaattaccaaaaacaaagtgacctgctggaggccacacggatgcgaacccaatacggggctgggttatcaaggttcacacacaagcaaatacaccttgttgccttggaatttattgaagactaagccactgcccccaagtcacggtaaggaggggggcaaagaggccaaggtgccatcaggtgacaattctgggcggggagaggtgccccgagcccaggagggccaggctgcctgcggaagggccgctagcggagatagccaggaaggaatgagaaggggctgcgaagagcgcgctacggcacagcgcccggccgtgagatctgctgaaactactgcacacggcacctggatctatccctag

SEQ ID NO: 34555 - DNA, 612 bp, Artificial Sequence
  Description of Artificial Sequence: Synthetic coding sequence
atgggcaatatttttgaaaagctttttaagtcacttttagggaaaaagaaaatgagaattctgattctgtctttagacacagctggtaaaaccacaattctgtacaaactcaaacttggtgagacagtgccggcagtgccgaccgtgggtttctgtgtagagaccgtcgagtacaagaataacacatttggagtatgggacgtggggtcccacttcaagatccgacccctttggcaacatttctttcagaataccaagggcgcccgcagcccgggaagcacacaccagggtagcttggcatcaggagtactccccatcaagtgttcccatgtggagtttgggatgtggaagggcgggcggtcacacccgtttcttccacacagttcgcggtgcgctggatccggtggccagttggactcaatccttccccatcaaagtcccgcttgggggccgtggggatgcaaagatttaagcagcggatttccgtcattcttgacgagctccattctgtggaagtcagccgtgtcctaccaactaccttcattgcacaactcctcacgtaactacgccggaagcttagcccagatgatgagacatctcctcgaggcctag

SEQ ID NO: 34556 - DNA, 1701 bp, Artificial Sequence
  Description of Artificial Sequence: Synthetic coding sequence
atgaaaatgcagaaaggtaatgtgctactgatgtttggtctactgctgcacctcgaggccgcgaccaactcaaacgaaacatcaacttccgccaatacagggagttccgttatatcctccggagcttccacagcaaccaatagtggcagcagtgtaacttcttcaggcgttagcaccgctactatcagtggcagtagtgtgacatccaacggggttagcatagtgacgaattccgagtttcacactacctcatctggtataagtaccgcgactaattcggagttttccacggcctctagtgggataagcattgctacaaactcagagagctctaccacgtccagcggcgcctccaccgcaaccaattccgagagttctacccctagcagcggagccagcacagccacgaactctgagagctccactctcagttcaggtgcgagcactgcaacaaatagtgactcttccacaacctccagtggcgccagtactgccacaaactccgaaagtagcaccaccagtagcggcgcaagcacagctaccaactcagagtcttccacagtatccagtcgggcatccacagccaccaattccgagtcatctacaaccagttctggcgctagtactgcaacaaattcagagtctcggacaacatccaatggtgcaggtactgccaccaatagtgagtcctccacaacgagcagcggcgcctcaaccgccacaaacagtgactcatcgacgacatctagcggagctgggaccgctacaaacagtgaaagcagcactacctcatccggcgcaagtaccgcgactaactctgagagtagtacaacaagctccggcgcgtcaacagccactaacagtgacagctcaacaaccagtagtggtgcaggaaccgccaccaatagcgaatcatctactgtgtcttctggcatcagcactgtgaccaacagcgagagcagtacgcctagttccggggcgaataccgcgactaatagtgagtccagtactacgagttcaggggctaataccgccacaaactcagaatcatccacagtgagtagcggggcatctacagccaccaacagtgagagtagcaccacaagtagcggcgtctcgacggccaccaacagcgaaagctcaaccacttcgtccggggcatccaccgccactaactcagatagttctactacttcatcagaggcatctaccgccaccaattccgagagctctaccgtgtcaagcgggatcagcactgtgacaaatagtgaatcctccacaacatcatccggggcaaatacagctaccaactccgggagcagtgtaaccagtgcaggtagcgggaccgcagctctgactggcatgcataccacctctcactcagcctccaccgcggttagtgaggctaagcctggggggtcattggtgccctgggaaatttttctgatcacacttgtgtcagttgtggccgcagttgggctgtttgctggactgtttttctgtgttcgcaactctctctccctcaggaacaccttcaatacagctgtctatcacccccacggcctgaaccatgggctcggcccaggccctggcgggaatcacggtgcgccacaccggcctcggtggtcccctaattggttctggcgaagaccggtttcctcgatcgctatggagatgagcggcaggaattctgggccttag

SEQ ID NO: 34557 - DNA, 4908 bp, Artificial Sequence
  Description of Artificial Sequence: Synthetic coding sequence
atgacatctgcacagtgccctgctctggcctgtgttatgtcccccctacggttctggggaccttggccactgctcatgtggcagctgctatggctgttagtaaaagaggcccagcccctggagtgggtgaaagaccccctgcagctaacgtcaaatccccttggtccaccagagccttggtccagccactcttcacacttcccaagggaatcccctcacgcccctaccctgcctgctgatccctgggatttcgatcatctgggccccagtgctagttccgaaatgcccgcccccccccaggagtctactgagaatcttgtcccattcttggatacttgggattctgctggggagctgcccctcgaacctgagcagtttctcgccagtcagcaggatttgaaagacaagttgtccccccaagaaaggctgccagtgtctcccaagaagctgaagaaggatcccgcccaacggtggagcctcgccgagataattggaataataaggcaattaagcacaccacaatcccaaaagcagacactccagaacgagtactcatccacggatacaccgtaccctggaagtttgccccccgagctccgtgtcaagtcagatgagcctccaggtccgtccgagcaggtcggcccgagccaattccacctggagcccgaaacacagaatccagaaacactcgaagacatccagtccagcagtctgcaacaggaagcaccagctcagttgcctcagttgctggaggaggagccttcttctatgcagcaggaggctccagcactccctcctgaaagctcaatggaaagtttgaccctacccaatcacgaggtaagtgtgcagccacccggggaggatcaggcttattaccatctgcccaacatcacagttaagcccgccgacgtggaagttacaatcacgtccgagcccaccaacgagacggagagcagccaggcccaacaagaaacaccaattcagttccccgaggaagtcgaaccctcggccacccaacaagaggccccaattgaacctcctgtgccaccaatggaacacgagctctcaatctcagagcagcagcagcctgttcagccaagcgagtctcctcgcgaagtagagtcaagtccaacccagcaggagactccaggacaacccccagaacatcatgaagtcaccgtgagcccgcccggacaccatcagactcaccatcttgccagcccatctgtttcagtgaagcctcctgacgtgcagcttacgattgccgccgagccgtcagcagaggtagggacaagcttagtccaccaagaggctactacgcgtctctcaggtagcggaaatgacgtagagcccccagctatacagcacggcggaccgccgcttctgcccgagtccagtgaagaagccgggccactagccgtccagcaggagacttctttccagtcacccgaacctattaataatgaaaatccctcgccaacacagcaagaggccgcagccgaacatccacagaccgctgaagaaggcgaatctagcctgacacatcaggaggcccctgcacaaactcccgagtttccaaatgtcgtggtagcgcaaccaccagaacacagccacctaacacaggccaccgtgcagcccctcgacctaggctttaccattactccagagagtaaaacagaagtggagctctcgccaactatgaaggagaccccaacacaacccccaaaaaaggtggtccctcaattgcgggtctaccagggcgtgactaaccccactcctggccaggaccaggcacaacaccccgtctctcccagtgtgacggtgcaactgttggacttggggctgacgataacaccagagccaacaactgaggtcgggcactctacaccgcctaaacgcacaatcgtgagtcctaagcatcccgaggttacgctccctcaccccgaccaagtgcaaacacagcacagtcatctcacgagggccaccgtgcaaccccttgatttgggattcactatcacccctaagtcaatgactgaggtagagccttcaaccgccctcatgactacggccccacctccaggccaccccgaagtgaccctgccaccatccgacaaggggcaggcacagcatagccacttgacacaagctaccgttcaacctctcgacctggagttgaccattacaacgaagcctacaaccgaggtgaagccttcgccgaccactgaagagacgagcacccagccacctgacctcgggttagcaatcatccctgaacctactaccgagaccgggcactcaaccgcacttgaaaaaaccacagctcccaggcctgaccgcgtccaaactcttcatcgcagcctgactgaggttaccggacctccgaccgagctcgagcccgctcaggactcattggtgcagagcgagagttacacacagaacaaggccctgactgctccagaggaacacaaggctagcacatcaacgaacatttgcgaattatgcacctgtggcgatgaaatgttgagttgtattgatctgaatccagagcagaggctcagacaagtccctgttcccgagcctaatacccacaatggcacctttaccatcctcaactttcaaggtaattacattagctatatagacggaaacgtttggaaggcttatagttggaccgagaagttgatcttaagggagaataacctgacggaattgcacaaggactcattcgagggactgctgtccttacagtacttagatctgagctgtaacaagattcagtctatcgagcgccatacttttgagccactgcccttcctcaagtttataaacctatcctgcaacgtgatcaccgagctctcatttggcaccttccaggcatggcatggcatgcaattcctgcacaagctgattctcaaccataacccactgacaaccgtcgaggacccctatctcttcaagctgcctgccttaaaatatttggatatgggaacgacactagttccattaaccacactgaagaacatcctgatgatgaccgtggaactcgaaaagctgatactccctagccatatggcatgttgtttgtgccagttcaaaaatagcatcgaagccgtatgcaagactgtgaaactgcattgtaatagcgcctgtttgaccaataccatccattgccccgaagaagcttccgtggggaaccccgaaggtgcttttatgaaggttctccaggctcggaagaattacacgtccactgagttgattgtggagccagaagaaccatctgacagctctgggatcaacttgtctggcttcggatccgagcagctggataccaatgacgagtccgacttcattagcacattaagatacattcttccatatttttctgccgtaaacctcgacgttaagtccctactgttgcctttaattaagttgccaaccacaggtaactccttggcaaaaattcagactgtgggccagaaccgccagcgtgtcaagcgggtgctcatgggaccccgctccatccagaagcgccactttaaggaggtgggcagacaatcaatcaggagggaacaaggggcacaggcctcggtagaaaatgctgctgaagaaaagaggctcgggtcccccgctcctcgtgaagtagaacagcctcacacacagcaaggcccggaaaaactggccggaaacgcagtctatactaagccttcatttacccaggagcacaaagctgcagtcagcgtgctcaagcccttcagcaagggtgccccatctacgtctagccctgcaaaagcgctgccccaggtgcgagaccgatggaaggatctgacacacgccattagcatcctagagtcggccaaggcgcgggttacaaatacaaaaacgtcaaagcctatcgtgcatgcacgcaaaaagtatcggttccacaagaccagatctcacgtaactcacaggacccctaaagtgaagaaatcccctaaggtgagaaagaaatcctacttgtcccggctcatgttagccaaccggctgccattttccgctgctaagagtctgattaattccccatcgcagggagcgttcagttcactcggtgatctgagtccccaggagaatccattcttagaagtatccgcaccttccgaacacttcatcgaaaaaaataacacaaaacacaccacagcgaggaatgcttttgaagaaaacgatttcatggaaaacaccaatatgcctgagggcaccataagcgaaaatacaaactacaatcaccctcctgaagcagattcagcgggaaccgcctttaacctcggccctaccgtgaaacagaccgaaaccaagtgggagtataataatgtgggaacagacccttcacctgagcccaaatcatttaattaccctctcctgtcctcaccaggagaccagttcgagatccagttgacccagcagttgcaatcgctgatcccaaataacaacgttaggcggctcatcgcacatgtgatccggacgctcaagatggactgctctggcgctcatgtacaggtcacttgtgctaaattgatctcacgcactgggcacctcatgaaactcctgtctggccagcaggaggtcaaggcatctaagattgagtgggacactgatcaatggaagatagagaactacatcaatgagagtaccgaagcgcagagcgagcagaaagaaaaatctcttgagcttaagaaggaggtcccagggtatgggtacactgataaattaatccttgcattgattgtcaccggcatcctgacaattctgatcattctgttctgcctgattgttatctgttgccatcgccgatccctgcaggaggatgaggaggggttcagccgggactcggaggcccctactgaggaggaggagtctgaagccttaccttag

SEQ ID NO: 34558 - DNA, 372 bp, Artificial Sequence
  Description of Artificial Sequence: Synthetic coding sequence
atgcagtctgagaagccccaggggctgttcctccagctcaatcccaatgccagttccacagagactcaactgctggtacccgcactggagtcacgcgacaccctgccccccactcactgctttatggccggtaccgagtcacctcttggaaacccgtggcccctgtccctgccaccgccgtgttggaccgggtgcgtgcttcctgccccccggggacagcgaaaacctggccccctgggactgtcaatcttcatctctctcgggaataagcgtcatcgatcagggaatcatgttgtgcgggagtccgagcagcccctgagccagggtaatccgcaccaggggtggggtccggataccagaaaaggacgctag

SEQ ID NO: 34559 - DNA, 2262 bp, Artificial Sequence
  Description of Artificial Sequence: Synthetic coding sequence
atggagttccatcgagtggcgcaggccggggtcgaactcctcagctcaggagatcccccggcatcagcttcacagtccgtggggatcatcggagtctctcattgtacatggcacatcaatttccaagggaattacatttcctatatcgacgggaatgtctggaaagcctactcttggactgagaaattaatcctgcgagagaacaatttgaccgagctgcacaaggacagcttcgagggcctgctgtcactgcaatatctgattctaaaccacaacccactgaccacagtcgaggacccgtatttgtttaaattgcccgcactgaaatatttggacatgggtaccaccctagttcctctgacaacgctcaaaaatatacttatgatgacagtggaactggaaaagcttatactgccctctcacatggcctgctgcctatgtcagttcaaaaactcaatagaggcagtctgtaaaacagtcaaacttcactgcaattccgcatgtctgaccaataccacacactgtcccgaagaggctagcgtgggcaatcccgaaggagccttcatgaaagttctccaggcaaggaagaactatacctctactgagctgatagtggaaccagaggagccatcggacagttcagggattaacctgtctggatttgggtcagagcagctggatacaaacgacgagagcgatttcatcagcactctaaggtacatactgccgtacttttccgctgtcaatttggacgttaagtcattgctgctaccactcatcaagctgccaaccaccggcaacagccttgctaagatccagaccgtgggccaaaatcgccagcgcgttaagcgggtgctaatgggaccacgatccatccagaaacggcattttaaggaggtgggcaggcaaagtattcggagagagcagggcgcgcaggcctcagttgagaatgccgcagaggaaaaacgcctgggaagccccgccccaagagaggttgaacagccgcatacacagcaggggcctgagaagcttgcaggaaacgcagtttacacaaagccgagctttactcaagagcacaaggcggctgtgagcgttctcaaaccattctctaaaggtgcacctagcaccagtagccccgccaaggccctgccccaggttcgggacaggtggaaggacctgacccatgcaatatctacactcgagtcagcgaaagcccgcgtcacgaataccaaaacctccaaacccatcgttcacgctaggaaaaagtatcgctttcacaagacaaggtctcatgttacccatagaacccccaaggtgaaaaagagccctaaagttcgaaaaaaatcctacctgtccaggctgatgctagcgaatagactacctttcagcgcagcaaagagcctaattaatagcccctctcaaggagctttttcaagcctaggcgacctctcacctcaggaaaatcccttcctggaggtctccgcgccatctgagcactttatagaaaaaaacaacaccaagcacacgactgctcgcaatgcatttgaggaaaacgactttatggagaatacgaacatgccagaaggcacaatcagcgaaaatactaactataaccatcctcccgaagccgactctgctgggacagctttcaacctgggtcctaccgtcaagcaaaccgaaacaaaatgggaatacaataatgtcggcacagacctttcacctgagcctaagtctttcaattacccactgctgtcatcacccggcgatcagtttgagatccagttgacacaacaactgcaaagtctgatccccaacaacaatgtccgccgactgattgcacacgtgatccggacattgaagatggactgcagcggaacacatgttcaggtaacttgcgccaagctgatatccagaacagggcacctgatgaagcttctgtcggggcagcaggaggtgaaggcttctaaaatagaatgggacaccgatcagtggaagatcgagaactacattaatgagagcaccgaagcccagtcagagcagaaggaaaaaagcctggagctaaagaaggaggtccccgggtatgggtacactgataagctgatcctggccttgatcgtcaccggaattctgactatactgataatcctgttttgtctgatcgtcatttgttgccaccgccgcagccttcaggaagatgaagagggcttttctcgagacagcgaggcacctactgaggaggaggagtcagaggccttgccttag

SEQ ID NO: 34560 - DNA, 378 bp, Artificial Sequence
  Description of Artificial Sequence: Synthetic coding sequence
atgggcaacatcttcgaaaaactgtttaagtcgctcctgggaaaaaagaaaatgaggatactcattctgagtctcgacaccgccggcaaaaccactattttgtacaaactaaagctgggtgaaactgtcccagcagtgcccaccgtggggttttgcgttgaaacagttgagtataagaataacacattcggcgtctgggatgtaggcagccactttaagatcaggccgctatggcaacatttcttccagaacacgaaggaactgagtgcatctcagttcgcacagttcattaaaaagctgtgcggtgtgacaggcactaacgacgaagctagtcccggctctctgacaagctatcccagtcatttacttgacaggtag

SEQ ID NO: 34561 - DNA, 102 bp, Artificial Sequence
  Description of Artificial Sequence: Synthetic coding sequence
atgctaaacttcgacatatctgcggctccacgcaaaaccgcactgatgaaactcgagaccatcatccacagtaaacttcttcagggccagaaaacaaagtag

SEQ ID NO: 34562 - DNA, 522 bp, Artificial Sequence
  Description of Artificial Sequence: Synthetic coding sequence
atgcccgccatgccatctcctctgtgtgcaccggcgagggtgtcacctagccccctgactgccgccccaccgttctgcagcctctctcctatcctgtgggtctctttaatattacttctcaccagtataagcaaatgttgcgagagcattttcaaatttatacagaatccatttacaagccactacttcccttgtagccatccgtcccagggcaagaggcggctacaccctggcatcctgcacagctttccaacagtttttcctacggcctccctggtgccacatctgagcatcctgttcagtgcacagcagccggaacgctcattccaacgcatgtcccctaccatgtctcatttcagcaagctttcaagcccttgccactccgagcaacgctcaaccccctttccacatccatctggactgccagccctggctacccccctgacttctctccagtttctctgcgtacagcctttttggctgctgcccccctcacggaacactgataacttcttgccttag

SEQ ID NO: 34563 - DNA, 876 bp, Artificial Sequence
  Description of Artificial Sequence: Synthetic coding sequence
agcgcaggaggcggaggggctggttccaggttgcaagctgagatgttacagatggatctgatcgatgcaacaggcgattccactcctgacgaacctgatgtccacttctccaaaaaattcctcaacatcttcatgagcgggaggagccgttcatcctcagcggaaagctttgggttgttttcctgcattatcaatagagaggagcaggaacagacacaccgaacgatatttcggtttgttccacggcacgaagatgagcccgagctcgaggttgatgatccactgctggtcgagctccaggctgaagactactggtacgaggcttacaatatgcgtaccggggcgcgggggtttttcaccgcatactatgctatcgaggtaacgaaggaacctgagcacatggcggctctggcaaaaaacagcgattgggttgatcagtttagggtcaaattcctcggatcagttcaggtgccgtatcacaagggagatgttgtgctgtctgcggccatgcaaaagatcgcaacaactcgaaggctcacagttcacttcaacccccccagttcttgcgtcttggaaatctctgttcgaggtgtgaagattggcgtgaaggccgatgactcgcaggaggctaagggtaacaagtgctcacacttcttccaactgaagaatatcagcttcaggggctaccatcccaaaaacaataaatactttggctttatcaccaaacacctggcagatcatagattcgcctgccacgtgttcgtcagcgaagactcaacaaaggccctggccgagagtgttggcagagcatttcaacagttccacaaacagtttgtagagtacacatgcccaacggaggatatttacttggagtag

SEQ ID NO: 34564 - DNA, 1272 bp, Artificial Sequence
  Description of Artificial Sequence: Synthetic coding sequence
atgatgtatcggccagacgtggtgcgcgctcgaaagagagtctgctgggagccttgggttataggcctcgtcatctttatctcactcatcgtgctggccgtatgtattggcctgaccgtgcactacgtcagatacaatcaaaagaagacatacaactactacagcacattatctttcacaactgataaactatatgctgagtttggccgcgaagcttcgaacaacttcactgagatgtcacagcgactcgagtcaatggtgaaaaatgcgttctacaaatctcctctccgggaagaattcgtaaaatcacaggttatcaagttttcacaacagaaacatggggttctggctcatatgctgctgatttgcagatttcatagcactgaggacccggaaacagtggacaagattgttcagctggtccttcacgagaagctgcaggacgctgttggaccaccaaaagttgatcctcagtccgttaagataaagaaaataaacaaaaccgaaacggactcatacctgaaccactgttgtgggaccaggaggtcgaaaactctcgggcagagtctgaggatcgtgggaggaactgaggtggaggagggcgagtggccttggcaggcttcactgcagtgggacggtagccaccgctgtggggccactctgattaacgcaacgtggttggtcagcgcagctcattgctttacgacctataaaaatcctgctcgctggacagccagctttggcgttacgattaagccatccaaaatgaaacgcggactgcggcgtataatagtacatgaaaaatacaagcatcccagccacgattacgacatctctctggccgagttgagctctccagtaccttacaccaatgccgtccacagggtatgtttacccgacgcctcttatgaatttcagccgggcgacgttatgtttgtgacaggtttcggcgccctcaagaacgacggttactcccagaaccatctgagacaggctcaggtgaccctgatcgacgctacaacttgtaacgagccacaagcctacaacgatgccatcacccccaggatgctctgcgcaggcagtctggaaggcaagacagacgcctgccaaggcgacagcggtggacctctagtgtcctccgatgcccgagacatctggtatttagctggtattgtaagttggggtgacgagtgtgccaagcccaataaaccaggcgtctatacccgcgtaactgccttacgcgactggattacttcaaaaacagggatttag

SEQ ID NO: 34565 - DNA, 375 bp, Artificial Sequence
  Description of Artificial Sequence: Synthetic coding sequence
atgaccccaaacgaacatccggccttcaagcacctgtttaataaggctcatctcgccccgcctctcattcacctcaccttgagcgggcactcgacctgtttcagggaacaccgagtcggaggaaaagttaccgaccaacaagatcccaaagctgaggagttctttctggtccagaacaagatgaaatccttgccgtgcctcctgttgagcacccagactagacaacctagtgatttcagcatattttccccgcccttcctgcccttttactccacaaaacctcctctgagcagttggccagtcttgaatgaactgttgggcacgccacctcggaggggaggcggacgggcggagggtttgctgacctcgcagtag

SEQ ID NO: 34566 - DNA, 339 bp, Artificial Sequence
  Description of Artificial Sequence: Synthetic coding sequence
tgtgacatacaaatgactcagagccctagtagtctcagcgcctcagtcggcgaccgcgtgaccataacgtgtagggcttcccagagcatctctagctacctcaactggtaccagcaaaagccagggaaagcacctaaactccttatctacgccgcctcttccctgcagtctggggtgcccagtaggttctccggtagcggctccgggaccgacttcacattgacgatctcctccctacagcccgaagattttgcgacatactactgtcagcagtcctactccacaccgccaaccgtccttcaaggcaccaggttgaagatttcgcgggtcgaggcatag

SEQ ID NO: 34567 - DNA, 384 bp, Artificial Sequence
  Description of Artificial Sequence: Synthetic coding sequence
atggagtttggtttgaattgggtcttcctcgtcgcaattattaaaggagctcagtgtgaggtgcaattggtggagtctggaggggggctagtgcagcccggaggaagtctacgcctgtcatgtccagatagcggttttacatttagcaaccactatatgagctgggtgaggcaagctccggggaagggcctcgagtggatcagttatattagcggtgattcaggctacacgaattatgctgatagtgtaaaggggagatttacaatctcacgcgacaatgcaaacaattcaccctacctgcagatgaactccctgcgcgccgaagatacagccgtgtattactgcgtgaagcatactgcccgggggaatcttcaattttattag

SEQ ID NO: 34568 - DNA, 315 bp, Artificial Sequence
  Description of Artificial Sequence: Synthetic coding sequence
atgacacagtccccatcatctttatcggctagtgtgggagaccgcgtgacaatcacctgccgagcgagccagtcaatctctagctaccttaattggtaccagcagaagcctgggaaggctcccaaactgctgatctatgctgcgtcaagcctccagagcggagtgcccagccggttcagcggtagtggctccgggactgacttcacccttacgatctctagcctccagcccgaggactttgcaacctattattgtcaacaaagctactccacgcctcccacggtgggcagcggcacctacttcaagctgaagtag

SEQ ID NO: 34569 - DNA, 348 bp, Artificial Sequence
  Description of Artificial Sequence: Synthetic coding sequence
atgttgtgggttcctgggagttctggggacgtggtgatgactcagtcgccactttctctgccagtgacgctggggcaacctgcttccatatcctgccgcagtagccagtcactggtgtacagcgatggaaacacgtatctgaattggttccagcagcgccctggccagtctcctagaaggctgatctataaggtgagtaactgggatagtggggttcccgatcgtttctctgggtcagggagcggtacggattttaccttaaaaattagcagggtggaggccgaagatgtaggggtgtactattgtatgcaaggcacgcactggccacctacagtggtccagccatag

SEQ ID NO: 34570 - DNA, 348 bp, Artificial Sequence
  Description of Artificial Sequence: Synthetic coding sequence
atgagggtccccgcccaactcctgggccttctacttttatggctgcggggagctcgctgcgacatccagatgacacagagcccctccagtctaagcgcaagtgtgggcgaccgggtgaccatcacgtgtagggcctctcagtctatctcttcatatctcaattggtaccagcagaagcctggtaaggcccctaagctgctgatctacgcagccagctcccttcagagcggagtgccttcccgcttcagcggaagtggaagcggcaccgacttcacattgacaatttcctcgttacaaccggaagactttgccacctactactgtcagcagtcgtacagcaccccctag

SEQ ID NO: 34571 - DNA, 432 bp, Artificial Sequence
  Description of Artificial Sequence: Synthetic coding sequence
atgtgggttcagactcatccaagttccgccagttacaaaagttgggggcctgggactgccgatacccacacgatgcggctgagtaggcggcccgagacgttcctgttggcattcgttctgctctgcactctgcttgggctcggttgccctctgcactgtgagatatgtacagccgctggaagtaggtgtcatggccaaatgaagacctgcagtagtgataaggacacgtgtgtgttgctcgttggtaaggcaacctcttccaaaaggatgtggcctggcacatggtggggagggggcgtttacctgcagggaggacgagattaccacgctgagggtggctcctcttggtttagcaggcgagaacgggggaagaagagcgttgagtcgcggaaggaaggtaagaccatcatgcgctggcgggagcaaaagtag

SEQ ID NO: 34572 - DNA, 939 bp, Artificial Sequence
  Description of Artificial Sequence: Synthetic coding sequence
ctcgccctgaggccaaggcggatggcaagtaacagacagaggtcactacggggtcccagccatccttcacacatggaggagcctttcttgcagatggttcaggcctcagaaagcctgccccctagccagacctgggcccagcgcgagtttttcctgcccagcgaatcttgggaatttccggggtttactcgccaggcctatcatcaactggctctgaaactgcctccatgcacagacatgaagagtaaagttagacagcgcctgattcatccctggaagggcggagcgcagcacacttggggattccacacatggctggatgtgtgtcggttgccagctacgtttcccacacaacccgacaggccctacgattctaacgtttggagatggctcaccgatagcaatgcccaccgctgcccaccaacggaacatcccattcctccaccatcttggatgggccagaacagcttcctgactttcattcactgctaccccacattcgtggacatgaagagaaagaaacaggtaatctttaggaccgtgaaagagctgaaggaggtcgaaaaactgaagctccgaagcgaagcacgcgcacctccactggacgcacaagggaacattcagccccccgcatcctttaagaagtatcgccatattagtgccggaggcaggtttgaacctcagggcctgcagctcatgccaaacccattccctaataacttcgcaaggagctggccatgccccaacccactgccacactatcaggagaaggtactcaagctcgccctgttgccctcggcccccctgagccaagacctgatacgagattttcagaccctgattaaagatcggaccgcactgccgttgcaccatctctccaaagcgcaagcttctaagtcccccgcccggaagagaaaaaggagacccggccacttctag

SEQ ID NO: 34573 - DNA, 456 bp, Artificial Sequence
  Description of Artificial Sequence: Synthetic coding sequence
atggccgtgagtcaaatgagcaaatggcggttgagtagggtgggtggttctcgaagcctcccagccgagatggaggtgctgggcgaggtctggtgtgttcgcgccgaggagcagcctatgacaggtctgggaatagtgtggcatagtccattgttggacaaggccctcgaaacgtggagccttcagcagcagccagacttctctttgggcctgggacacctgggactggggaccgacgccacctggatgcaatctttcccaggaagcggaggtgatgcccaagcaggaaccggcgtgtccggcctgctgcgactgtaccccaaccttttgtgcgacttcgggcctcgacaaggccccttgtgggctctgctcttggaaaaacgccaaatggccggcactggcgggagccccgcactgttagcgtggagaagcgcgtcgtggcgtgctctgggctag

SEQ ID NO: 34574 - DNA, 345 bp, Artificial Sequence
  Description of Artificial Sequence: Synthetic coding sequence
atggccgtctcccagatgagtaaatggcggttgtcacgggtggggggaagcaggtctcttccagccgaaatggaggtgcttggcgaggtgtggtgtgtcagggccgaggaacagcccatgacagggctgggaatcgtatggcactctccactgctggacaaggccttggagacatggagtttgcaacagcagccagacttctcccttggcctggggcacctggggctgggcctttatatactggcctcttacctgctgtgtccaagacagcccccctcacagccagacgggccatgcggatctccgaaccccgtgtcaggcgcgaaaaagactaccgtggcatag

SEQ ID NO: 34575 - DNA, 504 bp, Artificial Sequence
  Description of Artificial Sequence: Synthetic coding sequence
atgctgtgtccctgtattcaggaatcaactttcgaaacttgtttgtttatggcagttagtcagatgagtaaatggaggctgtcccgggtgggggggagcaggtccctgccagctgagatggaagtgctcggcgaagtatggtgcgttagagccgaggagcagccaatgactggactcggtatcgtgtggcacagccctttgctcgacaaagctctggagacctggtcactgcagcagcagcctgatttctccctcggcctgggtcatctcggtctcggtaccgatgccacatggatgcaatcattccctggtagcggcggggacgctcaggcgggaacaggtgtgagtggtctgttgcgtctgtacccaaacctgctgtgcgacttcggacctcgtcaggggccgttgtgggcccttctgttggagaagcgacagatggccgggactggcgggtccccagcattgttagcctggaggtccgcctcatggagggccctgggatag

SEQ ID NO: 34576 - DNA, 393 bp, Artificial Sequence
  Description of Artificial Sequence: Synthetic coding sequence
atgctatgcccatgtatccaggaatctaccttcgagacttgcctctttatggccgtgtcccaaatgagtaagtggagattgtcacgagtgggcggctcccgaagcctcccagctgaaatggaggttctgggcgaagtgtggtgcgttcgcgcagaagaacagccaatgacaggactgggtatcgtttggcactcgccactacttgataaggctcttgaaacctggtcccttcaacagcagcctgatttttcactgggactcgggcacctggggttaggactgtacattctggcaagctatctgctgtgtccaaggcagccccctagccaaccagacgggccttgcgggagtcctaaccccgtttcgggagcgaaaaaaaccacggtcgcatag

SEQ ID NO: 34577 - DNA, 2124 bp, Artificial Sequence
  Description of Artificial Sequence: Synthetic coding sequence
atggtagatcccgtcccggaggaagaaaaagctggcgcagagcctggcgactcaggtggggacgaggcggtggcctccgtgccaccggacagccagggagcccaggagcctgccgctagctccgcctctgcttccgccagcgccgccgtgccccgcaaggctgaagtgccatgcgcggctgctgaaggcgggagaagagaacagagccccctcttgcacctcgacctttttaacttcgattgtcccgaggccgaaggttctagatacgtgttaactagtcctcgcagtctcgaagcgtgcgccagatgcgccgttaagccagtcgaactgttaccacgggcccttgccgatctggttagggaagctccaggacgctctatgcgagtcgccacaggactttacgaggcttacgaggcagagcggcgcgcaaaattacagcagtgtagagccgaaagggaaaggattatgcgggaggagaagagaagactgttcacaccactcagcccagctgctgccgccgctgctgccgctgcggcggcgtcggctccatcagctggaagttcaagctcctgttcttctgcctctttgccagcttccccagcccctcgggccgcaagaaaggcttccccatctccctcctcggctcgaacccaacctccaccagcagggtccagaacgggcaggaaatctcactcgttagacagcctcagtagacggagggagggcgccctcagctccgagtctggtgcgtccagcagctcttattctggagaaagtctaagggaactcagatggccacccagagccagtgctcgcaatagctgcccggcaggatctgctagttcgaccactaacgcccctggaagaccttcagcgctgaccctggttccaatcactggaaggtcttttagcctgggcgatctgagtcactccccacagacagctcaacatgtggaaagaattgttcggcaggtgcgggctgagcgtggtctgcggggcgttcctgaacgcgatcggaagattgcggccctcatgttggcccgtcaccaagaagaacttctgctgttagagcagagagcagctgctcacgggcagtgggaactgcaaagagtgcacgccaagcagcgcagagagagggaagaacgggaaaagcagagagccttggagcaggggagaagggcgtgggcagcccaggtggaagagaggagagggcgacgtggacgtgaggagagggaagcagcgcgaaggcggcaacgacaatacgagcgctccgaggaaaggcgacgcgaactggcagagcgccaaggactcctgcggagggagcgagccgaaagagccgcaagggaagataggctgagaaaactacagcaggaacagaacttgaagcaaagggaagagggacttcaggagggaagagagagagcagagcagattcgaagggagcgggcacagagagctgcccgtgcaaagcagaggcaggagggccagctccaacgcgagaagagagaattgtcaagagccgagcgcgctcgtcacgaggccctgctccagggccggaccaggcaacagaggcaggagcgcgagggtctgcgttcttccctggaagcttctctcggacgtgcgcaggagaactatgagcatctcgttgagcagcgaactcgggagctcagggagagagcgcgcagggaggagctccagggccgtagagcgaaggaggccgctgagagaaaagaacgcgagcatcaggcacacctggaggcactggctagggccggagaacggagactgcagcatgctacgcaggtcgcagaagaagctgtgcaacagaaggcccgccgagtgggccaatcccggctggaaaaagagcgggcccagagagccaataaggagaaagtggaaagggacgaagactgtaggaggcgcgaactactgcaggcaattggccggaaactcgagcggagcgaacaactgacacgtgagcggagaagcgccttagagtccgccaggtccacagcccgtgcttctttccatgtgcgcgaaaaggtccgagaggagaccaatacgcggtcgtttgaccggatggtgcgcgaggcccagttgcatgcgagcctggaccgaaaatag

SEQ ID NO: 34578 - DNA, 198 bp, Artificial Sequence
  Description of Artificial Sequence: Synthetic coding sequence
atgtcggaacagaacatctgcaatcagaaggacaaaagcaccctcccattttgtcaagctcacctgtgtgaagaaaccacaaaccggctctgcgtctctaacaaagccgtctactccctggagtgtaagtgggccgagtcagagaacagagtaagcgaggggcggtggggacgaggttgttttatcggcgtggggtag

SEQ ID NO: 34579 - DNA, 477 bp, Artificial Sequence
  Description of Artificial Sequence: Synthetic coding sequence
atgcgggcaagcaggtcccccccatcacctcgcagatgtcatcaccaccatgaagccactggggcagcgtccggggcagcggcaggcggcccgggtgctggatgtgtggggctatgtagactagccctgactccctccgctcaggacggtagaaatagcacctttcagacctacaagaaggaggtctgcttaccccgtcattccatgcaccccgggccttgggctatctgttgcgagtgccagacgagatttggtggtcgcctgccagtgtctagagtggaagccgcactcccctactgggtccccctctcactgcgacctaggaagcaacacccctgttggatgcacgccgcagggaccaccgccggcggaagcgccgttatgtcagcctgttgcccttccagctccagcagccgccccccaactcggacttcgtatcgcttgctgcagagagtgtgttgtccttcagcctcgtag

SEQ ID NO: 34580 - DNA, 1668 bp, Artificial Sequence
  Description of Artificial Sequence: Synthetic coding sequence
atgaggcggccaagcaccgcgtctttgactcgcacaccgccacgtgcgtctcctacacggatgccttctcgggcctctctcaagatgacgccattcagggcctcactcacgaaaatggagtcaacagccctattgagaacactgccacgagcttccctgatgcgcacccccaccagagcttctctgatgaggacacccccacgggcttcaccgactagaaagccaccaagagcttctcctcggacaccgtcgcgtgccagcccaacgcgcaggctgcctagggcttctccaatggggtctccacatcgagcttcacctatgagaaccccaccaagggcctcccccactggcacacctagtacagcttcgcccacgggaactccgtctagcgccagtcctaccggcactcctcctcgcgcctccccaacaggcacgcccccgagagcctgggctactcgctcaccgtccaccgctagtctgactcggacacctagccgcgcctcactcactagatggcctccccgcgcctctcctacgcgaaccccaccgagggaaagtccccgcatgagccaccgagcatcaccaacacggacgccgccccgcgcctctcctacccgtaggccgccgcgggcaagtccaacaagaactcccccaagagaatcactaaggacatctcaccgcgctagccccaccagaatgcctcccagggcaagtccaacgcgcagacctccaagagccagccccacaggtagcccaccacgagcctcccccatgacccctcccagagcatcacctcggactccgccccgcgcttcccccacaacaactcctagtcgggcttcactcactaggaccccaagctgggcttcacccactacaaccccgagccgcgcctcgctgatgaaaatggagagcactgtatccattactagaacccctcctagggcgtcacccaccggtacacccagtcgcgcatcgccaaccggaaccccctcgagagctagtcttaccgggtcgcctagccgcgcaagtctgaccggcaccccctccagggccagtcttatcggcactcccagtcgcgcttcactgacagggacaccacctcgggcttcactgaccggaaccagtagcaccgcatcactgaccagaactccttcacgcgcctcgctcaccagaacacagtcgagctcctctcttacgcgcacaccctccatggccagccttactcgtactcctccccgggcttcattgaccaggactcccccaagggcctcactcacgcggacgctgcctcgcgcctcactcacaaggacccctccgagggcctctttaacccgaactccatctatggtgtccctaaagagaagccccagtagggcatccctcacccgtactccttcccgagcctcacttactatgaccccttcccgtgcctcactaacccgcacaccatctactgcctccctgacgggcacccctccaacagcatctcttactaggacccccccaactgctagtcttacacgttctcctcctacagccagtctcacgcgcactccatctacagcctcattgacaagaatgccttccaccgcaagcctgacgcgcaaaagcaacgtaaaccagcagtgccctgcaagtaccccttcctcggaagtgatttcgtag

SEQ ID NO: 34581 - DNA, 1719 bp, Artificial Sequence
  Description of Artificial Sequence: Synthetic coding sequence
atgcctgtctactgcaagtaccagttccacaaaacccccgtccacaagacaaaaggcgagccacacggcacccacgtgtacttccaagatataaatgtgatcttcctcggtgctctgcacccatctgatttgcgcgagtatcttgagggcccaccaatggtcgtcgaggtccacgaccgcgaccgtaaatccgaggagtgcagtcaaaagcctgtgctgtttggagaagaccctttggactcatatctgaatttccaggcgctgataagtcccagagaaactgaaaacaacccatttgagagccagaataagatgtggtacccttacggcatcgcccaggtaagctttgcggacctacttctgggccacaaatacttgaacctagcagttcccatccacagctgcgaggtccagccaacgcactgcggacaagatagtaggcgtaggaaagtcgtcgggctgggagtcccaagggatggtcaccagcatgggcccatgccacgcggcaactatttggaagccgattcccagctcaaacttcgcgtcgatatcgctgtccccctgagagcgggggctcgggctgctgatccggatttaggaggatcccagttcggaagaattatcttcgtgtttgatttcaagaaggtatccctgctccatagccttctgcaagatattactatgatcaacgccaaagccttgggactggatagttaccctgtcagaacattacagcaaatcctgtccgccttcaaagtgcgcgtccgggtgcaggagcagcagcacctcgacgttctgactggatttcatcttctcgacgggaagacacacttgttcatcttagagggactggccgaccaggggctccgccagctgtgggagaatcaccaatcctggatcccccggtccgaacacaggaaatataaagtgctctacaattcccagcttctcttcagatctcgactatatggggatctggaggctattctgtaccatgtgcatctgttccagcccaccgagttgcttctgcagcaggcagttttttttctaagggacactgaacggcggagagtttttcaggctctcgcgcgcatccatgacatctgctataattccacgaccttgtgggacgtgacagtccgcgacctcctgcctagtagtgcgatgatcaaagacctctctcaagaattcggcatgccattatcccaggaggaactgacagatgagaaactcttcgcacttccaccacagcctgcccctaacctcgaagactatcactcgcgcaacagcaccctgacactggagatacatgcgcatcaggagcccagaaaaaggttcacatacagccaagactatctcagcgcaatggtggaaccgcttgatctcaaggaggaggaaaagaaggcacagaagaaatcccggcaggcatggctcacagctcggggatttcaggtgactggactacagagcgataccgaatctagcttccaggaccttaaactgccgcccattaaagaactgaacgaggagtggaaagaaaacagcctctttgctaacgtgctggagccggtgcttgaccgcgaccgttggtcctgggaccgacatcacgtggatttcgacctttataaaaagcctccacctttcctggaactgttgccaagtcctgcccccaagcccgtgactgtgcggaaaaagaaggggaacagcccgatttcctag

SEQ ID NO: 34582 - DNA, 1719 bp, Artificial Sequence
  Description of Artificial Sequence: Synthetic coding sequence
atgcccgtgtattgcaaataccagttccataagacccccgttcacaaaactaagggagaaccacacggcactcatgtctattttcaggacatcaatgtcatatttctgggcgcgctccacccttctgacttgagggaatatctggagggcccacctatggtggtcgaagtccacgacagggataggaagtctgaggaatgttcccagaaaccagtgctcttcggcgaggaccccctagacagttatctaaacttccaggccctgatctctccgagagaaaccgagaacaacccatttgagagtcagaacaagatgtggtatccgtatggcatagctcaggtttccttcgcagatttgcttctcggacataagtatctaaacctcgcagtgcctattcactcctgcgaggttcagcctacgcattgtggccaagacagccggcggcggaaggtggtggggctcggcgtgcccagggatggccatcagcatggccctatgcccaggggcaactatcttgaggcagacagccagctaaaattgcgggtggatatcgcagtgccattgcgcgccggagcacgagccgccgatcccgatctcggtggctcccagtttggccggatcattttcgtctttgatttcaagaaggttagcctccttcactcccttttgcaagacattacaatgatcaacgctaaagccctagggctagactcctatccagttagaacactccaacaaatcttatccgctttcaaagtccgggtgagagtgcaggagcaacagcacctcgacgtgctcaccgggttccacctgctggacgggaagactcaccttttcatcttggagggattagctgaccaaggacttcgacagctatgggagaatcatcagagctggatcccccgcagcgagcatcgcaagtacaaagtgctgtacaactctcaactgctgttcagaagtcgcctatacggcgacctcgaggcaatcctttatcatgttcacctcttccagccaacagagctccttctgcagcaggctgttttttttttgcgggatacggagagaagacgcgtattccaggccctggctaggattcacgacatttgttacaacagtacaacgctgtgggacgtcaccgtgcgtgacttgttgccaagtagcgctatgatcaaggacctgagtcaggaatttggaatgcctctgtcacaggaagaactaactgacgaaaagctcttcgccctgcccccccagcctgccccaaacttagaggattaccactcacggaattccaccctgactctggagatacacgcgcaccaggaaccccgcaaaaggttcacatattctcaggattatctatctgcaatggttgagcctcttgacttgaaagaggaggagaagaaggctcagaaaaagagcaggcaggcctggctgactgcccggggattccaggttactggtcttcagtcggacacagagagctcattccaggacttgaaactccctcccatcaaggaactcaatgaggaatggaaggaaaattctctcttcgccaacgtgctcgaaccagtgttagaccgcgatcgatggtcatgggatagacaccacgtggactttgacctgtacaaaaagcctcccccctttctggaattactgccttcacctgccccgaaacccgtcacggttcgcaaaaaaaaggggaactcacctatcagctag

SEQ ID NO: 34583 - DNA, 390 bp, Artificial Sequence
  Description of Artificial Sequence: Synthetic coding sequence
atgcctgtttactgcaagtatcagtttcacaagactccagtccataagaccaagggcgagccccatggcactcacgtgtactttcaggacatcaacgttattttccttggggcactccatccttcagatctgcgcgaatatctggaagggccgccaatggttgtcgaagtccatgatcgagatcggaagagtgaagagtgctctcagaaacctgtactgttcggagaggacccccttgacagctatcttaattttcaagcgctgatatctccccgcgaaaccgagaataaccccttcgagagtcagaacaaaatgtggtacccttacggaatcgctcaggtgagctttgccgatctactgctcgggcacaagtacttaaatctcgcatag

SEQ ID NO: 34584 - DNA, 1068 bp, Artificial Sequence
  Description of Artificial Sequence: Synthetic coding sequence
ctaggcgttaagggcctcccactttacccagacccatctcgggtgccaggtacaaaaacccagaataacctggagtccgactatctggcccgtgacgggccaagctctaactcctcttttcacagttccgaagaggagggcactgaccttgaaggcgatatgttagactgcagcggaagtagaccacttttgatggagtctgaggaagaggacgaatcatgccgtccaccccccggcaagctgggtggggccgttcccttcgctcctccagaagtgtctcctgaacaggcgaaaaccgtacaggggggccgcaaaaatcagttccaggcttttacccagcccgccacagatggtctctcagaacctgacgtgttcgccatcgcaccctttcgatcctctcgagtccctaacgatgacatggatatattctccaaggcgcctttcgtctctaaaagctcaatggccccttcacagccagaagaatctgacgtcttcctgagggccccgtttaccaagaagaagagtatggaggagctcactgtgatccagtgcacttctcaggagctgcctgcccagactggcctcttgtcccagactggggatgtacccctaccagcaggtagagagagggctgtgtataccagcgtccaggcccaatattcaactgccggcttcgtgcagcagagcaacctgttgtcacactcagtgcaggctgccgatcatctggattcaatcagcccgcggggttcatgcttggaatcagggggtcattccaacgaccgaaacaagggaccgcagttgcaaaaagaagcagtgtctggaccaatggccggcaagcctttccggccccagagcttgtccaagtacagtagacattactcccccgaggatgaacctagccccgaagcccagccaatcgctgcatataagatcgtgtctcagaccaataagcaaagcattgccggttctgtctcgatcacttccctgtcctctaggacgacagagttgcccgccgctgaccctttcgccctcgcgccttttcctagtaagagcggcaagaagccctag

SEQ ID NO: 34585 - DNA, 462 bp, Artificial Sequence
  Description of Artificial Sequence: Synthetic coding sequence
atgcactatgtccacgtacatagggtaacaactcagccccgcaataagccccaaactaaatgccccagcggcgggcagtcacaggggccaagagggcagttcctggacactgttctcgcggcaatgtgcccaatcgcgatgctactgactgctgatccaggcatgccacccacctgtctttggcatacaccacatgcaaaacacaaggagcacctttccattcatctcaatatggtgccaaaatgcgtgcatatgcatgtgacacatactcacacaaactccggtagtcgctatgtaggaaaatatattctgctgataaagtggtcactggcaatgtactttgttcagggaagcactttgagtacagtaaccaaaatgtcacatggcaaagccctcccggacagtgatacttacattcagtttcccaatcagcagggaccacatacaccgtccataccgtag

SEQ ID NO: 34586 - DNA, 366 bp, Artificial Sequence
  Description of Artificial Sequence: Synthetic coding sequence
atgcagaagcagctcttgcctcttgctgctggccagcgctgtgattactcccagagggaatcctgttgccagagcccacacagggccgagtccgcaggtgaccggtctactgataacggcctacatcggggggccgagcgttctttctgctgtgcactggatccactacctaggcgacctccggcgggaaggagaggtagggatcggagctcaagtgcttgtcccggcgcacgggcacgggtatggcccccgggagcctgtgcctcctttcgtgactcccacaagcgctttattatgcggagaacagccctcttccacttcacgcccacctcctttcacctgaggtacaccctgcggaaattgtag

SEQ ID NO: 34587 - DNA, 384 bp, Artificial Sequence
  Description of Artificial Sequence: Synthetic coding sequence
atgctcccaagctccacacctggccctgggcacgctaccgaaacgtgtcccgcgccaccagggccggagagaagcccggcagccagggccccggccgcagccagtagtttgggtcccgtatctaccgcaggacgagcgccccgcggcctggacatgtcagctcaagagcccccacaagggcggaggtttcctattgaggcaggcgattcccgcggtcttgccgccgccccagagagtcaagatagtccagaagccgtagcgactgaacataaccccgtgcgaccgctgcggcggtgtccagggtgtcactgccttacgcttctccacgttccaatcgatgtgtatctcgcaatggggggcagccctagagcgcgtgcaacctag

SEQ ID NO: 34588 - DNA, 408 bp, Artificial Sequence
  Description of Artificial Sequence: Synthetic coding sequence
atggtgcctgccccgcctttcctgggcgtgctggagaatcccgtgccacagtgggacctgagtattctgggatccatccggataagggtctcccataccgaggttcaggggtccggcagttcgcgctctcccgaggcgctgagaaaggaaagtctcgaggtggagtggactctggtgctgctggcaattccccctagaattcaaccctcccagcaggacggcgggcctcccaaatgctgtgatcttctcagggccgctttacttgggcggcattgccccctctgtgtcccagcaggagaggtgttctctcagaaaagagataacgagcaggaccgaagtgagttcataggacagaccttgaaactgctcgttaagagaaatgtctctctagagctttcctgccgttag

SEQ ID NO: 34589 - DNA, 717 bp, Artificial Sequence
  Description of Artificial Sequence: Synthetic coding sequence
atgcctggtagaaccggcctggcaggcgaaatgcctgtgggctgggggcccggccgggccggagctagtgagccgaacgaaagcacatgtgcaccagaggctttagacggccaccttggagtggcgcggcgggagggaccaattctgggaactctattgggcaggggcaaagggcactgccaagccttatcacagctgggtcactgcccctcgccagcatggaataattactccggcatgatggacataggggtcgccccctcaagagtgggccctagcggccactgtggtgtgctgcggagccatagcaggcctggggagctggccgtcgtcatgaatcacaaggttccacgccatcgccccgtctcctcggtcgggactgagctgctctgggtgcgctgcgcccccaagatggtgcagctccccatttgttgtttgctgttaacccctgcaccaggaattgggccgagggcccacgggcacctccatacgaatcttgagacaaggggtcttcctcgagggactagggagtcccagcaggctgaaggtgagggagaggcaattcaagaaggaaggggcgcctgcaagagggcacagaggaaggagggggagggcccgagaggcccatgcgttgttagagccgggggggtaggttggggaacacggcaggtcgctggtgaaccacctctggttgattgctcgacagccggtacttag

SEQ ID NO: 34590 - DNA, 315 bp, Artificial Sequence
  Description of Artificial Sequence: Synthetic coding sequence
atgggcttgggcgaccgccgagggcggagacgcgccagcgcctcagctgcctttaggacagcctccagcagctcttgcaattgcagtcggtgctcatccgccgatactagatcatcaacctccatccctctggtgcctgataaattgtcctccggccgaaggggatccgccggatgtcgcgcaactcaggagctccagtgtcccagggggccctcacggctgccggggtccaaacgaggggcaagccacgcccctttcctgtcccggtatctggggttaggccatctcgacatgtcgcaggggcgaggcctgtag

SEQ ID NO: 34591 - DNA, 198 bp, Artificial Sequence
  Description of Artificial Sequence: Synthetic coding sequence
atgcccgcaaaaggtaaaaaaggcaagggccagggaaaaagtcacgggaagaagcaaaaaaaaccagaagtggatattctgagcccagccgcaatgcttaatctctactacattgctcacaacgtggctgattgtctccacttgcgtggcttccattggcccggagcacccaaaggaaagaagggcaggtcaaagtag

SEQ ID NO: 34592 - DNA, 645 bp, Artificial Sequence
  Description of Artificial Sequence: Synthetic coding sequence
gctactatggtgtggttctgtaactcagcagattgtcagttttccgtgttcgctttgacgaccatcggctggattctgtcgagcacgtcaacaggactcgtggaatggcgaatctggtatatgaaggatactagtttgtacccacctggcattgcttgtgtcggcatcttccgagtgtgtatctaccggcgccggactaatagcacaactaccaaattctgttacagatattcttaccaagacacttttctcccgttcgagataagcatggctcagaggttcctcctgaccgcaagtattttcggcttttttgggcgggcttttaatatgttcgcactcaggaacatgtcaatgagaatgttcgaagaagatacatataactcgtttgtggtcagcgggattctgaacattgcagccggcgtgttcaatctgatagcggtgcttcaaaactatgacgctgttataaactcacaaggaatcaccttcttgccctcgctgcagatgccgtttaagccggatgttcaggaggtgggtactgcaatacaggtggctggcatcggcgtgctgcctatgttgttgaccggcatgttctccttgttttataagtgccctcccatgctgtaccagatattcccgaccacatag

SEQ ID NO: 34593 - DNA, 345 bp, Artificial Sequence
  Description of Artificial Sequence: Synthetic coding sequence
atgtacacttctctgaaatcaacattcgtcgcatttgccgacggcaggggtacaactgagagcatgccatcacctcctctggcaaatagcaaccacgaatcccctgttaaccagctcgggaacatgcaaaatatgagacttggaccctcttttattcttacagggatttttctgggtaatggcagaaccgaggctagcccattttttaccgacgagttcgcactctcaaagatctttcctgaatataaacggaatctgttcggcaagtttcagactaatatggccttctctctagagctggaccctccatccttacttctgtccgtcgtactgtttatgttttag

SEQ ID NO: 34594 - DNA, 1086 bp, Artificial Sequence
  Description of Artificial Sequence: Synthetic coding sequence
atggctcctcagagggccggacctggcctgggtaagccttcaagcaaaaaaagtagggccttgaggggaggccccggagtcccacgggctcggcaacgcagccctcgtgccgccgcggagttgaatacagaggtccctaagcctagcgccaaagacgtagagatattagagcaggaatctgaggtgttggagccaagcgtcgaacaggatgccgaaagtcccggcttgtctacggcggctggattcgagagtccagaacccgggcgcgatgacccgggtccaagtgaggctcagagagccgaagtgcagggacagcacccccctccgggccccaaaacttcgagcagccgctccggtagcgaggcaccccacctcagattcccaccttgtcccgaggcaccccagcggcccccggaagaacgctttatggaaacacctatcgagcgcgaaatccggcggtcttgcgagagggaagagagcttacggagaagtagaggcctgagccctggccgggcaggccgggagctggtcgagctcagagtgagaccagtactgaacttgccaggtccaggtccagctttgcctcgggcattggaacgtgcaagggcgggcgcacagatgcagagggatattgaacgagaggcccaccggcaagccgcgcttgcgcgaccagcagtcccagaaccgcgtgctagatcccccccacagccacttggagaactaaagaggttctttgaagcagccgccgggtcaggctccagcgccggcgcgggagacggggccggaccgcagcggctcccagaacccgggggacgaccaagatccgccgtacagggaggatgtcgcgtgttaggatctgcacctcctccatttactccgtcactgctcgaacaggaagtccgggccgtgcgggaacgggagcaggaacttcaacgacagcgaagatcagtgtatggaacggcggaattcaaagagccaactccctccttaacggcctcccggggggacggcaaactcgtagtgatatggcccccccgaaggaaagtgagcgagaacggtcttgaacaagaagagcggaagccttag

SEQ ID NO: 34595 - DNA, 366 bp, Artificial Sequence
  Description of Artificial Sequence: Synthetic coding sequence
atgacggacagaaatagagacaagaagtccacctctccaagcaattcggacactgagatgaaatctgagcaactgcctccatgtgtgaatcccgggaatcctgtgttcagctgtatgctcgacccaaaaaccctacagacagctacctccctgagtaaaccgcagatgatcatgtacaagacgaactcaagtcattacggggaatttctgcctattcctcagttcttcccctgcaactatacccccaaggagcaagtttttagcagccacatcagggctaccggcttttatcagaacaatacactgaacactgcccccgatagaacacgaaccctggattttcctaacatccaacacactttgtag

SEQ ID NO: 34596 - DNA, 561 bp, Artificial Sequence
  Description of Artificial Sequence: Synthetic coding sequence
atggaacaacctaaggacggagccggcccagaggggaataatctttcattgccctctagtggcaccgaaccttggcctcccgcccccctcccagctccaccgcctctgctgcttaacagcactgatccaacacatctgggcctaccggaaagtgtggcctccgtaacggttcctatacgccttgacaccctgagttgcctgctgcatagtgctctcctcggagcatataccttccagcaagctctcccctcttgtccctgctgctctcaggcaggccactctcagcctggcgctgttcggcgcccaccacgcggcagaggaggttgggaggtcaggcacagaccgggctggggccgcgggctgcataggcgcgggctggggagagctgagcagcccgagagagggagggctggaggtccaggtgcgggtcctcggacgcctcccatgactcttccttcacctcccaccctgcctgcccaggacggcaagaaggaggcgagaggccccgagccacctctggagacacccctcgcagctgaagactgggaaacggaatactag

SEQ ID NO: 34597 - DNA, 357 bp, Artificial Sequence
  Description of Artificial Sequence: Synthetic coding sequence
atgcagtccctgcgcccagagcaaactcgcggtctcttggaacctgagagaactaaaacactgctgcctcgggaaagccgtgcctgggagaaaccaccccacccagcatgtacaaaagactgggaggctgtagaggtgggtgcttcgagccacgattccgatgaaaaagacctgtcatcacaggaaaccggcttatctcaagagtggtccagtgtcgaggaggatgacgaatcggagggatcgcaagggtttgtggaatggtcgaaggccccacagcagacaacaatcgtgctggtggtgtgcgtcctgttcctcttcctggtgctcacaggtatgccaatgatgtttcacatttag

SEQ ID NO: 34598 - DNA, 315 bp, Artificial Sequence
  Description of Artificial Sequence: Synthetic coding sequence
atgggcagaattccaggcggctgttcatctaaggctttcattggccgtgcgcagtggctcactccagtgattccggctctttgggaagccaaaggcttaaccctgctgtcccgcctggagtgtagtgacgtgatcatggaccattgcagtccacagcttaccgggctacggatgaaaggattcctggcacagactcctcctctagaattcccagtccaccagtaccaacccggggatcacgtccttattaaaagctggaagcgagagtcactgaatcaactgcggagaacaagcagcggcactctggatgagtag

SEQ ID NO: 34599 - DNA, 381 bp, Artificial Sequence
  Description of Artificial Sequence: Synthetic coding sequence
atgaagaagtggaagtcaaggctctttccgcgaccccctaattggctgtccggaaagtatctacgcctcccctccagcgccatgtttttgattgacttctgcctgtgcgtgccttggacaactccatttcaatgcaaaatcttgatggtagagtttatagtggggttctatgatttttgtttggctctcgaagttcagtataggacatcaaagttgttcctctgcggacagccaagtcccaggaggtctcttggcattcagcagcaagccttaaaactggcctgcctgagccctaccctactcgagagttcttcctgtgtggatccacccggcaacaccgccggtagccggatgccttccagttccaactgtattaagtag

SEQ ID NO: 34600 - DNA, 663 bp, Artificial Sequence
  Description of Artificial Sequence: Synthetic coding sequence
gttgaaggggaggcccctgggttgtttttgtcatctcaggagcagagggctcgcgacacagaaggaccacgccagggagatcttgaagccggattggggtgggggtggccgctgcaccctggttccaatcagggcgcaccaaggcagggcggatccatcggatcaggcacccgtccctgcccctgtcctcctctctctagggaggggggcgcgctggcctcgccacgagtggccctgtctcagctccaatgcggcttactgggcagtgccgagcagtctttcctgcagctagaacaggaaaatcattccctgaaacgccagaaccaagaactgcgcgagcagttaggggcattgctcggccccgggcagcagttcctccccttgtgcccagagcactcatcatgcaccgccttagcatggccgcctgacccggccggcactcaacctctgggaaatcgagctcctttgcagctcctgagacgcgaactgtgccagggacaggaagcgttcgtccagcagtcccaaaatgagctgcagcagatccggctttgctttgaacggaagaaaatggtcatcaccgaggtctgggacaatgtagctgaaatgcacatggctctgaacaatcaggcaaccgggttattggttgggccccatcgcgcgtag

SEQ ID NO: 34601 - DNA, 363 bp, Artificial Sequence
  Description of Artificial Sequence: Synthetic coding sequence
atgtatagcttcccaaccactgtcgtggaggaaatcctcagcctatctctccaattgatagcctttccaactgtctcatgcgagatccttcttgaaattactagtcagacaaacaagaagcagacgtgggagacctgctatgcccactctgctgaagagatcggcataatcgccggaaagaggatccataagactcaggcagtcccttacatctgctttctactcaggcaccagttcatctcccagtctagccatgtcagagtcgaagccctgtacagccttctgtttctgggtacgttgctgcaggtgggaaagggccaggaggtccttttgaaagacgccctacgcgccagagctccttag

SEQ ID NO: 34602 - DNA, 2568 bp, Artificial Sequence
  Description of Artificial Sequence: Synthetic coding sequence
atgtggtccactgggcccgaggctcgggacggagattcttcagtatcaagcggccggcttagctgcagttccggaggtcacgacgtctgtgtgtcatggaaggaaagacccccgcaggttcttggcccccagcagaggcctaggaagtcggatgcccgactcgagcaactcagggataagattcgggcacaggcctggcagcaaggctcttgcgccagcctggggaccagtgctccctccagtgctagtcggctgcacaaggcctcgactctcatgctcaggagaaagggccaggaggcgaagaatccaccacctgctcctgaatgctccggcttctcaatcctgtccgcagcggaaaggagggtagaagcaaaggcatctcacggccaagggcgagaactgagcagagtctcccagcatcaggtgccggtcctgcgggaaaaacccaaacgggttaaaagttcttcctgtaagcgagagaaaacacccaagctgccctcgccacgccgagcagcaaaagataaacacaaagacgaggactctgagctggtgggggtgtacgcgtggcggaaagggcaagcactggtacgatcactcctcgggcctccccccgtgctaagaaggcaccacagtaaagacccatctcgcgatccagctttgactgtcgacctaggcgactctgagaaggttattgcagccaaatgttctccagtttgcgcccagctgcccgatgccacctcagcctacagcgaccagcaggtatccggaaatacgccgtcactggcaagcttcgaccagcctgccaccatccagacggcaatggcaatattacaggatctgcgacaacagattcaagccgggttagaactggcccaagccagaaaaggcggccaggaactgggcccctcgaaaaggcgcctgcaagatgtggctggtcgcggctgctgccgggaccccaacgcccaaagctcgttctctaaaagcccttgggcaatgactgagaggaaacattccagcctagagcgcgctagatcagttcacacatgggaaccgtggagctcctccacggccagggagtcctgtcctcaacgcgcctggggagcccaggggcaggatcggagcttccagcgtcctgagagccctcacgagcgtttgggacatttcagtcaaagaccatggtctgcattagccggacaggcctgcagcccacagagagcgtggggagcacagcgtcaaggcccgagttctcagagaccaggatcaccccctgagaaaagatcccccttcccccagcagccatggtcggcagtggctacccagccctgcccacggagagcatggactgcttgcgagacatgggaggatcccgggcccagactgaggaatccacttgagaggccatcccctcccgcccaacgaccatggtcaagttcaggcgtgcagagggcaggcccccagggtaaaggcaggggcattggtagcccagtgagcgccgcaaaacatgcactcccacgccccactggttctttcccacagaacccattggggaaggaaaaggatactttgagaccatgtccccgatcccggggtctgttgggtccctcccattcatcagaatccctccgggagtttatgcgacagaaagcccaagctcggcggcgacaggctctcgaggaaaaggccagtgccctcaggacacgggagctgcggtcacggagattgcaggaggtataccggcaacaacgggaagctgtgctcggcagggccgtgcccgtggtgtcaaggacaaccccggggatagtgaccttcgttccatcaagcgcacaatctggtgggctggaggccagcggttctctggaatctccggttcttgagtggagtaaggtaacatccgggatggtcttgggcggacaagaggccccagggtctttctgtctgtgtttaaaccgggcctggaaccacgccgagaccctagacccacctggcatgggcggtccccaagacgggagagacgcccctgttctgctcagcgcctccccatccttgggcagcttggaactgcaggatctaactacaaggtatttacctagagggatgtgtatatatctcgatcctaaagaagcggaacacctggggacatcctcctccctccatctgcggcacaaacaggctcagctgcaggctctggagacgactgccaaggtgctgaagcagagggtggattccttaactgctaagctccagggtgccgaagccctggacactgtgcgggatcctgccgtcgggctgcttagatcttgcccccactctctccctgccgcgccaacccttgcgactcccaccctggctacccctgcatgcccaggcgctttgggccctaattggggtcggggggcacctggtgagtgggtgagcatgcaacctcagccgctgcttcctcccacttacttcctcgacggtgagactctcagctggggtccaagctgggagcaacagcaatcagtctcccccagagcacattgcgaatctaaaccaaggggcgtgtctcaggcacctctcctgctgtag

SEQ ID NO: 34603 - DNA, 2829 bp, Artificial Sequence
  Description of Artificial Sequence: Synthetic coding sequence
atggtggtgtcagccggcccctggagttccgagaaggccgagatgaatatcctggagataaatgagacactgaggccccagttagccgaaaaaaagcagcaattcagaaatctgaaggagaaatgctttctaacgcagctggctggatttcttgccaatcagcaaaaaaaatataaatatgaagagtgcaaggacctgattaagttcatgttacgaaatgagcgtcaattcaaagaagagaagcttgcagaacagctgaagcaagctgaggaactccgacagtacaaggtgctcgtgcacagtcaagaacgagagcttacccaattgcgagagaagcttcgggagggccgcgacgccagtcgctcgctttacgagcacttgcaggccttgctcacaccctacgagccagataagtcccagggtcaggacttgcaggaacaactcgcagagggctgccgtctggctcagcaccttgtgcagaaactgtcccctgagaacgatgaggacgaggacgaagacgttcaggtggaagaggctgaaaaagtccttgaatcgtccgcgcccagagaggttcagaaagctgaggagagcaaagttcccgaggattcgctggaagagtgcgcaattacatgcagcaatagccacggcccctgcgacagcaatcagccgcacaaaaacatcaaaattacctttgaggaggacgaagtgaactccacactagtggttgatagagaatccagtcatgatgaatgccaggatgctctcaacatactccctgtgcccggtccaacgtcgtcggctacaaacgtcagcatggtggtgtcagccggccctctcagttccgaaaaggcggagatgaatatactcgaaataaatgagaagctaaggcctcagctggccgaaaagaaacaacagtttcggaatctcaaagagaaatgcttcctcacccagctctccgggttccttgctaatcagcagaagaaatataaatacgaagaatgtaaagacctcatcaagtttatgctgaggaacgaacgacagtttaaagaagagaagctggctgagcaactgaaacaggctgaagagctccggcagtacaaagtactggttcacgcccaagagcgtgagttaacccagctgcgggagaagctgagagaaggaagggacgcgagccgttcactgaacgaacacctgcaggcactgctcacccccgacgagcccgataaatcgcaaggccaggacctgcaggagcagttagcagagggctgccgactggcccagcacctggtacaaaaactatcgccggagaacgataatgacgacgacgaagacgtccaagtggaagtggctgaaaaggtccagaagtcatccgcacctagggagatgcagaaagccgaggagaaggaagttccggaggacagcttggaggaatgtgctataacttattccaacagtcatggaagctacgactcgaatcagccacaccgcaagacaaagatcaccttcgaagaggataaggtcgacagtactctcatcggttcatcttcccacgtggaatgggaagatgctgtacacatcataccagaaaacgagagcgacgacgaggaggaagaggagaaaggaccggtgtccccacgaaatctccaggaaagtgaggaagaagaggtcccccaggagtcatgggatgagggatactccacgcttagcataccgcctgaaatgctggccagctatcagtcatactctagcacgtttcactctcttgaagagcaacaagtttgtatggcagttgacatagggaggcacagatgggaccaggtcaagaaggaggatcaggaggccactggacctcggttgagtcgcgagctccttgatgagaaaggcccagaggtccttcaggacagcttggatcggtgctattcgacccccagtggctgcctggagctgacagattcctgccagccctataggtccgccttttacgtgttggagcagcagcgagtcggcctcgctgtagacatggatgagattgaaaagtatcaggaagtcgaggaggaccaggatcctagttgcccaaggctttcacgcgaactgctggatgagaaggagcccgaggtcctccaggattcactagatagatgctactctacgccttcaggctacctagagctcccggatctgggccagccatactccagtgcagtgtactcccttgaggaacagtacttaggattggccctggacgtggatcgcatcaaaaaagaccaggaagaggaggaggatcagggacccccgtgtcctaggctctctcgggagcttcttgaggttgtggaacctgaggtgttgcaggatagcctggaccgatgctattctaccccgtcctcatgtctagagcaaccagacagttgccagccttacggtagctcattttacgctctggaggagaaacatgtaggtttctccctggatgtaggggaaatagagaaaaaaggcaaggggaaaaagagacgaggtaggcgttcaaaaaaggagaggcgaaggggcaggaaagagggagaagaggatcagaatccgccatgtccccgcctcaacggagttctcatggaggttgaagaacgcgaggtgctgcaggattccttggataggtgttatagcacgccttctatgtacttcgaactacccgactcatttcagcactatcggtccgtcttttacagcttcgaggaacagcacatctcgtttgccctgtacgtagacaatcgtttttttactctgactgttacaagccttcacctggtctttcaaatgggagtgatctttccgcagtag

SEQ ID NO: 34604 - DNA, 267 bp, Artificial Sequence
  Description of Artificial Sequence: Synthetic coding sequence
atggcggtctccactgaagaattggaggcgaccgttcaggaggttttggggaggctcaagtcccaccagttctttcagtctacatgggatactgtcgcctttattgtttttcttactttcatgggaactgtcctcttgcttctgctgttagtggtggctcactgttgctgctgcagctcacccggccccaggcgagaatctcccagaaaagtgtccccctggaaggaacgacccaagggcgttgacaacttagctctggagccctag

SEQ ID NO: 34605 - DNA, 267 bp, Artificial Sequence
  Description of Artificial Sequence: Synthetic coding sequence
atggcagttagtaccgaggaactcgaagcaacagtacaggaagttctcggtaggctcaaaagccatcagttcttccagtcaacctgggacacagtcgccttcattgtgtttctgacattcatgggcactgtcctgctattgctgctgctcgtcgtggcgcattgttgctgctgtagttcacctgggcctcgccgggagagtcctcgtaaagtgtccccctggaaggaaagacccaaaggcgtcgacaatttggccctggagccttag

SEQ ID NO: 34606 - DNA, 252 bp, Artificial Sequence
  Description of Artificial Sequence: Synthetic coding sequence
atggcggtttctaccgaggagctggaagctaccgttcaggaagtcctaggacgactaaaatcccaccaattttttcagtcgacgtgggatacggtcgcatttatagtgttcctcactttcatgggtaccgtactcctcctccttctgctggtcgtggcccactgttgctgctgctcctccccgggacctcggcgcgaatcccctcgaaaggaacgtcccaagggagtggacaaccttgcccttgaaccatag

SEQ ID NO: 34607 - DNA, 615 bp, Artificial Sequence
  Description of Artificial Sequence: Synthetic coding sequence
atgcagtcagcgcttgtcggaagttggcacaacaacggtttttacggtcactacagatcccaattcaagagcgagtccgccagggagtatcatctggccgctaaaccacaaccaccggccgtgttcctgcagcgatgtcaagaacctgcccaacgccatttcttttctaaacacgacaatagaactagcttcgacaaggggccatattgcctattgcagggaatcggacgccggaaagatctggagaggctgtggcagagacacacctttctgagatgggccccatgtgaaatcgagctgcgccagcaagggccgctcgagtcttcataccaagccgatttccgtcccggtccaggcctgtcggggctgcctcagcatctgattcattttgttcaggtccagccatcacacactcggactacttaccaacagaacttttgctgcccgtcacaaggtggccactacggcagctataaagtcggccctcaggccccagtgaccgatgtattgccagaccttcccggaattcctcgccccaagttgcttcaacactatttgcacgctggagtatcggagtgtctcaactggtcacgcgcgctgaacaaggacagttag

SEQ ID NO: 34608 - DNA, 1140 bp, Artificial Sequence
  Description of Artificial Sequence: Synthetic coding sequence
atgcagagcttccttactctactcaaggagcatgaggatacatgtgccccccccgccgaactcgtgactctcgccgggcggctgtgtagggattttcaagatgacttggcccagctgcagccacttgtgacagcaatcctcgactctcaactgagactccacctattagataacgcggatgtggccctggcctgcgcccgtgtgctcgaccagcaggagcagcagcaggctgcctgccgtctgctcgagggctgccaggtaccagggggatcccaggaactggtgcaactgtggaatgatatacattaccgcctcgtgatgcgaaggcttggcgtcgccgccctgacgcctgtccagaaattccgctgtaggaagcggaatccgcccccacccagcctttgcccagaggggttgaaaagccgaaatttccctagggaagtccgtgagaagctccataactttgccgtgggagtaaatactaacccatccaaagccgagagagaaaatctcgccttggagacatccctgacccccgaacaagtctataattggttcgcaaactaccgaagacgccagagagctctgcctcagcacatgaagcctgcccagcaggccaccgccgaggatcctggggcccgggagaggggacctgacctgttgcagcccagcggcaacccccgagtcgattccgggttcgtggacaggccacaatggtccgaagagagggaggagaaaggtcctccacagtccccacagactactcagggaccatgggagccactggctcttgctcctgatttccctgccgacgagactgtctccaaacctctcgacgtgtccggccaccctcaatctgtgcagctggaagagggactgggcaccagtagtggccgaacagagctgcgggtcggctccttcctggtaacacagccgcccttgcaggcaccagagttcattctaactcaaagtcctcccgagctggcacctgctccgagcgctttcccagggcccgtgagtgccatggaactgtctcaggcccttccaagttcccaggtccagtgtagtgattcacaggccagcggtgacgccttttggggcgcacgcatgctcctggaatttagcggcagcagccttggttag

SEQ ID NO: 34609 - DNA, 366 bp, Artificial Sequence
  Description of Artificial Sequence: Synthetic coding sequence
atgagtctccatggtatcctggcaagcgctggcaccattggcgccgtggccgcctggctgatgagctataagcccgcactgttcggctttctgtttttacttttgttgctctcgaactggcttgtgaagtacgaacataagctcactctgcctgaaccacagcaggatgagattctgcagcgactgctcttctctgagatgaagatgaaagtgctggagaatcagatgtttataatctggaataagatgaaccaccacggcagatctagtagacatcgaaacttcccaatgaagaagcaccgcatgcgaaggcacgaatccatctgccccaccctctccgactgcacctcctcttccccaagctag

SEQ ID NO: 34610 - DNA, 756 bp, Artificial Sequence
  Description of Artificial Sequence: Synthetic coding sequence
atggatacgactctgagaatggtgcggacagcttgtcaacatagggctccccaaatttctcataagacaggttgttcccatataagtatgcactccccaggtggcctgaccacaactaagatggccggtcctctccctagggtttctgactcgctgttctccgctatggaattagctaagatgtcagacatgaccaagctgcatcaagctgttgcagctggcgactattcattggtcaaaaagattctgaagaaagggctgtgcgaccccaattacaaggacgtggactggaatgaccggacaccccttcactgggcagccattaagggacagatggaggtcatccgtctgctgatcgagtacggcgcgcgcccttgcctggttaccagcgtgggctggacaccagctcattttgccgcagaggctggccacctgaatatcttgaagactctgcatgccctgcacgccgccatcgacgcacctgacttttttggggacactcccaaacgtatcgcacagatctacggacagaaagcatgcgtggctttcctggagaaagcagagcctgaatgtcaagatcacagatgcgcggcgcagcagaagggcctgccacttgatgagcgagacgaggactgggatgccaagaaaagagagctagagttatcactgcccagcctgaatcaaaatatgaacaagaagaacaagaagtcccggggcccgactcgccccagcaatacaaaaggcagacgtgtttag

SEQ ID NO: 34611 - DNA, 378 bp, Artificial Sequence
  Description of Artificial Sequence: Synthetic coding sequence
atgcctccccatccagctatctttttctactgtctgctccggcagggacttacaatgttacccaggctggtgctcaacttttgggcccaagccgtgcacctgcctagacctcccagggtcttaggactccaggccggcgggaccgccccagggcagaaaaaactgtttttaacaagccatttccccccagcctctccactgccactgtgtttttccctgcaacagaattttaaaaagcactcccctcgatctccgcctgggattttggggtcactctatcctggattttgctcccccattgcaacctctcctttcgcaaaaggcacaagaggactgagggtggtcggcagcagtggaagactctccgcatccagctag

SEQ ID NO: 34612 - DNA, 390 bp, Artificial Sequence
  Description of Artificial Sequence: Synthetic coding sequence
atggccgctgctacgtgggacaaagaatcaaagtgtcgccttagtaggggccactgtcaccatcgccgccaccagtcgttgccagtagggcttaccttacgatatagcgctcctgcttcacatcagcctaaatgttttacatccaaacatgggactcggccttcgcagcgcaaaccgtcgctaagagtctcgggccattactccccacattcactgttccctggacacggcaggcgaggagcctgcgtcgccagaagtcgccgctttgccggacacatgcaactaacctggaagctgaagagaaagaagccaggccgtaccgccagctcagaagagcacaaaaagcaggggagagggtgcgccggtcgccgcttgatcaagtcaacatag

SEQ ID NO: 34613 - DNA, 711 bp, Artificial Sequence
  Description of Artificial Sequence: Synthetic coding sequence
atgcacacatatgtgtattcttatacccgcatatgtattcatatgtatattcatatccatgcctacgcttatatttgtatcttcatatatactcatatgcacacctatgtgtactcgtacactagaatctgcatccacatgtatattcacatccacgcctatgcatacatatacgtatacagctatacacgcatctgtatccatatatgcatcttcatctatactcacatgcatacgtacatgtacatccacattcacgcatacgcatacatttatgtgtactcctacacaagaatttgtattcacatctgcgtattcatctgtacgcatgcctatatatacgtgtacagctacgtgcagtgtatgcacatgtgtatccacatgtacacgtgcatgcacatgtgcatcttcatttgtacacatgcttgcatttgcgtgttcacatccacccacgcgtgcatctgcgtgttcacctgtacacacgtatatatatcagtgtttacttgcacacacgtctatatttgtgtctttatctatatttgtatacatgtatatatccacatctacatttgcatacatatctgtgtatactcatatatacacatgtacacgtacatccacacgtatacgtacacttatacccagctgtttttcaatcacttgtcgatcgacgaacacagcctgttcctttatttgggatactgggaatag

SEQ ID NO: 34614 - DNA, 450 bp, Artificial Sequence
  Description of Artificial Sequence: Synthetic coding sequence
atgaggctgctaccccgaacgtctatcccgaggaggcagcctttctctagatggaggaagcagaatctgaagactcccgttagcctgaactgctcaaggtcgtgcaagctactcgagggccggggaatgcctgctatttttatcatcgcactgccgccaccaaacacaataggcggcccagcactaattattagtttgcaggtgtaccctgccgcccctgagcggcagcgccccgctcgccgcggccatgatgacgggggcgggtttgtgaaaactaaaatggggatttgccgggagaagaaggaacgttctgactgctattgtgtgtacattgagcgggaggacattagggactctattttgaagaaaacatgcacgctcaataattgttttgcggaaatgcttttaatctgtagcttcgccccagcaacactcccgcaacccctttag

SEQ ID NO: 34615 - DNA, 444 bp, Artificial Sequence
  Description of Artificial Sequence: Synthetic coding sequence
atgatatatgacggaaacaaccagttgttgaatgcatccaaggtgggggaagtactgagggggggcacacgacagatctactaccaagtagtgaactttagctcactgtggcctctgtataagtatgcagacaaactgcatgtaatactcctctataaaacgctccatcaactagtggtggagccggtgaaggtggcggcctggtactacgagtccgcgcgtcttctaaatacatatggccttcttggaatgaacgtggccggtatctcctggcatttgtacatttttcacctcgtttgtactgatacttcggtgtccagctcagccccacttccttgcccactgcctctaattcaccagatgctaatcatttttgtgtggcggctgcttagggcctgtctctactgcagcagcctggccctgattatctggagctattcttag

SEQ ID NO: 34616 - DNA, 1242 bp, Artificial Sequence
  Description of Artificial Sequence: Synthetic coding sequence
atgagaggcggacactcacctgcagcagccccagcgcatactgggggccgccgcgggggcggcgctcctgcaccgcaatgcgtacgctctcccgctgcactcagccggaggcatcagcccgggcgactgctgcttcatgtttgctctccagttccatggacgggtactgcgacagaaggtcagagtgtcggtacctgtctacccggtcagttcacacggccgttggacaggcaccgtcatcgaggttccgaatgctggcatctgtcctctggtagcgtgcatccttcccccgggccggcaccagcccagagagttagggtgctggcccccgtgttccgcatttgctcaccccttccccggacaggaacagctaccgagggtcaagagtgctggcatctgtcgtcaggcagcgttcacccttctcccggtccagctccaccgcagcgtgtgcgcagtgtgggtacatgcctccccgaccttttcactaggcctctggatagacatcgccatcgaggaagtgaatgctggcacctgtccagcggctccgtacatccatctcccggacccgctccacctcagcgcgtgagagtgctggccccagttttcaggatctgttcacctgtaccctggacaggtacagcaactgaaggacaatcagttggcacctgcctcccagatttattcaccaggccgcttgaccggcaccgacaccgtggttcagagtgttggcacttgtcatccggcagtgtccatccgtcccccgggtctgcccccgcgcagcgagtcagggttctggcccctgtgttccgcatctgttctcctgtgccctggactggaacagcgactgagggacagtctgtgggaacctgcctgcctgacctctttactcccagattggatagacacaggcaccgcggtagtgaatgttggcatctgtcgtccggttccgtgcacccttcacctggacccgcccccccccagagggtgcgcgtgctagctcccgtgttccgcatatgctcaccgctgccttggattggaaccggaacagagggacagtctgtgggcacctgtcttcccgatcttttcaccaggccacttgacagacacaggcatagaggcagcgagtgttggcacctatcctcaggatcagttcatccctccccggggctcgctccggcccagcgagttgagtgttggcacttaagttccggttctccctccctccctctcttcgtggagtag

SEQ ID NO: 34617 - DNA, 435 bp, Artificial Sequence
  Description of Artificial Sequence: Synthetic coding sequence
atgattcgggcagccctgcttgagcctcagccacctaagttgaagcaaagcagtcatttgtctccccaaggagctggtacaaccggagccggcccccataccccattaacctttctgtacttctttagacttgaactgctgcaagccgctctgcccccccagccgcctaaggtactggttagacagcctgggggaaaggactccctggcagaatcaccgtttgacctgtcaactggacggaatgcaccatgcggcggtgccttgggaaacctgcgacacctgcagtggggcggtgcctggccactgctgtttctcggtggaacctgggactctgtctaccaggctggatcaactttggcgctgggccgggtgtccgtgtcactgtttttcttcctcccaaacaaatttcatagccacccatctcgtcacttgtag

SEQ ID NO: 34618 - DNA, 366 bp, Artificial Sequence
  Description of Artificial Sequence: Synthetic coding sequence
atgaagggataccgcgataatgcagttgagagcaccttcacaagtaggttttacggatccgaaaaatggctgcagataacctatctgaaaacccagatgccttccgggagcgctggaaatatagaggacctcacatctttcttcatctttctgagacagtccctggcattgctaccacgtctggagtgtagcggtacaatctctgcccactgcaacttaagcctgccagggtcatctatcagccacgcatctgctttccgggtcgcaggcatcactggggtgcactgccgtacccagctgattttcgtgtacctggtcgagacaggctttcaccatatgctggcaaggatggtgagtattagctag

SEQ ID NO: 34619 - DNA, 399 bp, Artificial Sequence
  Description of Artificial Sequence: Synthetic coding sequence
atgcttagtccactgtggttgcagattagcaagaggcctagaccagaggtaagcgtgtctaacgcttgcttctcttctgctctgcctacctctaatccaaccagcctcactctgaaacatcacaatatttttgtgcttcgggtcgcactggagataattcagtactcagtccacggaggcaggaacagaaaaccactcgaagtgacctctcttgcatacagttgccctgaaaattggtggcaaaaacagattggtgtgcagcctcccgacgtgcatgcgtctgcactgtcccctaagccatgtgtttcctggagcaggccactctctctgctgtctagcactattctgttctggaaaacacacgacgaaagggccgatttctcgaagctccatagttag

SEQ ID NO: 34620 - DNA, 465 bp, Artificial Sequence
  Description of Artificial Sequence: Synthetic coding sequence
atggagattatgcctatgaacatcgtgagcattatctcacctttgatcgatgtgtctccaggacgtcgaggccggttaaaaaacgccggaggaggtattaggctggccgaacgggtgaatcgacgagccgaccggaatgtgctgcgcagggaaaagggactggccttaggtcgcgttacattccctcgggcaggccggggcagccgggtgagcgcccccgccagatcggagccaggccccgccgccgtcccagggggtgtacgtcgtgcagacgaccgcaagttccctcctggagcctcccagcccgcttttagaagcaggcgctttcaggcagcggctggcggacccagttacgcaaatgatcctacctctagcgcgaagccagtgaagcttttgccgcgcgagcgggccggactgaaagttactaatttctcccagtcccgagagcgcgaagggagcgcatag

SEQ ID NO: 34621 - DNA, 387 bp, Artificial Sequence
  Description of Artificial Sequence: Synthetic coding sequence
atgtcgtgtcaccaatcgccgttagtcttcgacgtgggccagtgcagacagcacgatctagcggggcaaattctaatctaccactcactgacccctgctggaccattggggaggccccctgacgtgccacatagcccacacctagccagtcccaccgggtctaggcagcgaaccgtcggtggaacctgtgatacagctctgttcctctgctcttgtttttcatcttccttctttagcctgctggtaacactgttcttttttacactgagtcctcataagactcgcaactttgtgattctgcttatcttcctctattccgtctgtctgcacactgatggctaccttagggccagcgagctttccttgcctccttccatcatttcgtag

SEQ ID NO: 34622 - DNA, 414 bp, Artificial Sequence
  Description of Artificial Sequence: Synthetic coding sequence
atgcttggagtggaagatctcgttggggccggaaggtggggccgcgggccagaaaatttgcccgattccggagggagactggccgaacaggcgctgcaggggccaagtcatcccttctcttgcttgcctccaccggagcagattctgggcgcttggcgcgccctcaaggaggagcttctgtccagagccccaagccaatttaccctgtgtaccgaggttcttcagtcctcaaacctctcacctactccagcagtgagccctttcgtgcagtcaagcgtcgagatggagaagtttctcgttcctttgtctatgttcttatctggagagcggacatggaaactgctattacaggtggattttcttaaccaaggaggagagtattacagaaattggcggaaaaggaggagaacatag

SEQ ID NO: 34623 - DNA, 1122 bp, Artificial Sequence
  Description of Artificial Sequence: Synthetic coding sequence
atgttccttgccgacgtgccgacctccttgcatttccaaagcatgctgaaatctcagtggcaaaacaagccctttgacaaaatcaaacccccaaagaaactgtcactcaagcacagggcgcccatgcccggttctctcccagacccagcgcgaaaagaccggcataagctggtgtccagctttctgacgaccgccatgctaaaacatcacacagatatgtctagctcaagctatttggccgctacacaccacccaccccattccccccttgtgaggcaactgagtacgtcgtctgatagccctgcgccagcatcaagctcctcccaggtgaccgctagcacttctcagcaaccggtccgcagaagaaggggagaaagttctttcgatataaataacatcgtaattcctatgagtgtggcagcaacgacccgcgtggagaaactgcagtataaggaaattctcactccatcttggcgggaagtggacttgcagagtctcaaagggtctccagacgaggagaatgaagagattgaggacctgtccgatgcagcttttgccgcgctacacgcaaagtgcgaggagatggaacgagcccgctggctgtggactaccagcgttcctcctcagcgccgagggtcgagatcctaccggtcttctgacggccgaactacgccacagcttggtagcgctaatccaagtaccccgcaacccgctagccccgatgttagttcctcgcatagtttatctgaatactcgcacggccagtccccaagaagccccatatcccctgagctccactccgctccactaacacctgtcgcccgcgacactcccaggcacctggcgagcgaggacaccaggtgttcgacccccgagctcggccttgacgagcagagcgtgcagccttgggagaggcggacatttccccttgcgcacagtcctcaggcagaatgtgaggaccagttggacgctcaggagcgcgccgcgcgctgcacccgacgcacaagtggcagtaaaacagggcgagaaacagaggccgctccaacaagcccgcccaccgtgcccctcaagtcacggcatcttgtggccgctgctaccgcccagaggcccacccacagatag

SEQ ID NO: 34624 - DNA, 3318 bp, Artificial Sequence
  Description of Artificial Sequence: Synthetic coding sequence
atggcggccatggcccctgccctaacagatgctgccgccgaggcccatcatatccgcttcaagctggcaccaccatcaagcacgctttcaccaggaagcgctgagaataatggaaatgccaatatccttattgcagcaaacgggacaaaacggaaggccatcgctgctgaagatccttccctcgactttaggaacaaccccacgaaggaggacctgggtaaactgcagcctctagtggcctcctatctttgttcagacgtcacttctgtgcccagcaaagagtccctgaaactgcagggagttttcagcaaacagacagtgctcaagtcgcaccccctgctttctcagagttacgagctgagggcagagctcttaggtcgccaacctgtgctggagttttcactggagaatctcaggacaatgaatactagtggccagactgcactgccccaagccccagtgaatggcctcgcaaaaaagctaacgaaaagttccacccatagcgaccacgataattctaccagcttgaacggcgggaagcgggccctgacctccagtgcactccatgggggagagatgggcgggtcagaatctggagacttgaaaggaggcatgactaactgcaccttaccacataggtccttggatgtcgagcatactactctctacagtaacaactctaccgcaaataaatcaagcgtgaatagtatggaacaacccgccttgcaggggtcaagccggctgtctcccggcacagacagctcttcaaacttggggggcgtcaagctggagggtaaaaaatcacccctcagctctattctgttttctgctctggatagtgatacccggataaccgctctcttgcgccggcaggcggacattgaaagtcgggcccgacgattacaaaaaaggctgcaagtggttcaagctaaacaggtcgaacggcacatccagcatcaactgggtgggtttctcgaaaaaaccctgagcaaactgcctaatttagaatccttacgccctaggtctcagctcatgttaaccaggaaggcagaggccgctctgcggaaagccgcctctgagaccaccacctctgaggggctgtctaacttcctaaaatcaaattctatcagcgaggagctggagcggttcaccgcaagtggtatcgcaaatctcagatgctcagaacaagcatttgattccgatgtgacagacagctcttccggcggcgagagcgacatagaggaagaggagttgactcgagccgaccctgagcagcgccacgtccccctgagacgacggtctgagtggaaatgggcagccgaccgtgccgcgattgtgtcccgctggaactggcttcaagctcacgtctccgacctcgagtatcggataaggcagcaaactgacatatacaagcagattagggcgaataagggtctgatcgtgctcggagaagtgccccctcccgagcacaccactgatttatttctacctctgtccagtgaggtcaagactgatcacggtactgataagctcatagagtctgtgtctcagcccctcgaaaaccatggtgccccaattattgggcatatttcagaaagtctctctacaaagtcatgtggcgctttacgcccggttaatggcgtcatcaatacactgcagcccgtcctcgctgatcatatccccggggatagtagtgatgccgaggagcagctccacaaaaaacagcgcctcaatctggtgtctagttctagtgatggcacttgcgtggccgccaggacaagaccagtgctgagctgtaaaaaacggcgattagtgcgccctaatagcattgttcctttgagtaagaaggttcaccggaattccaccattcgcccaggctgtgatgtgaatccttcctgtgcactctgtggcagcggttctatcaataccatgccacccgagattcattatgaagcacccctgcttgagcgtctgagccagcttgattcctgcgtgcacccagtgctggcatttccagatgacgtccccacctcattgcatttccagagtatgctgaaatctcagtggcagaataagccttttgacaaaatcaagcctccaaaaaagttgtccctgaagcacagggcccccatgccaggctctttgccagaccctgcaagaaaagaccgacataaactggtgtcctccttcctcacaaccgcaaagcttagccatcatcagaccaggcctgacaggactcacaggcagcacctcgacgatgtcggtgcagtcccaatggtggagcgggtcacggctcccaaagcagagcgcctgctcaatccaccgcctcctgtgcatgatcccaatcactccaaaatgaggctgagagatcatagctctgagcgatctgaagtgctcaagcaccatactgatatgagcagcagttcctatctcgcagccacacaccacccaccacactcacccctggtccggcagctgtccacaagctcagattcacccgcccctgcatcttcgagttcacaggtcacagcaagcaccagtcagcagccggttcgaaggcgaaggggcgagagttctttcgatatcaacaacatagtgattccaatgtcggttgccgctacaacccgcgtagagaaacttcagtacaaggagatactgactccttcgtggagggaagtcgacctgcagtcgcttaagggctctcctgatgaggagaatgaggagatcgaagatctgtccgatgctgcattcgctgcactgcatgccaaatgtgaggaaatggaacgggctagatggctttggactacctccgtgccacctcagaggcgaggaagcagatcctatcgtagttcagatgggcgcaccacaccccagcttgggtccgccaatccctccactccacaacctgcgagccccgacgtttcatcaagtcattctttgtcagaatattcacacgggcaatcacccagaagtccgatcagtccggaactacactccgcccccctgactccagtggccagagatacgccacgacacttggcttcggaagacaccagatgtagtactcctgaacttgggctcgatgaacagagtgtccagccctgggagaggcgtaccttcccactcgcccattctccgcaagccgagtgtgaagaccagttagatgcacaggaacgtgcagcaaggtgcacgaggaggacttctggatctaaaacaggtcgggagactgaagccgccccaacatctcctccgacagtgcccctcaaaagccgccaccttgttgccgcagccacggcgcagcggcccactcacaggtag

SEQ ID NO: 34625 - DNA, 486 bp, Artificial Sequence
  Description of Artificial Sequence: Synthetic coding sequence
atggggcaccgccccaacctgggccaacccccacatccaaacgcagtggcggcagctttacacgctagtctctgtcccgccaataggggcacttgtccgttaggtaagcccgggtaccctggctgcctctggttccagcctctcttgttattccccggttgcttgtgttctccagacggcccattcccacgagccgtcttcacttccgcaggtaaaggtccgctccaaactgacttggggcgaggcagggtgccccctcgtgaccaacagaccccaaaatccgggccttgcccgagagccccagtggcctccaatcgacaatccggtgggtcagccgtgagtgcccctctgagcggggccaggcgggcttggaaatctgccttcgcggcccctcccagaagccgattgcggccacagaagggggttccctggacagagaaacgtgcaaggggcgggggccgcgctgggccttgccggaggacatag

SEQ ID NO: 34626 - DNA, 372 bp, Artificial Sequence
  Description of Artificial Sequence: Synthetic coding sequence
atgcgctccgaaaagtccaagggctgttggcgagatggcggggatgcccacccaggagagaaggccagccagtcttctggtatcacaggagtgtcacacaggacaaggctaacgtccgtcctgctccgaaacactcaaagaaggaggcatagaagaggagaacaccatgtgatggttgataccgagatcggcgtattacagccacaggcaaaagagcttctggagcctccaggagacggaaggtgtaaggaactgattttttctcagagcctctggcgggagtgtggcccgggcgatacactgattcttgacttctggccaaccgagccatgtacccaagaagattttatctcgcaagtgtctttgcagtag

SEQ ID NO: 34627 - DNA, 630 bp, Artificial Sequence
  Description of Artificial Sequence: Synthetic coding sequence
atgctcagctcccagctttgctgcgtccatagcctcccccccacagccaatcccgccgcattatgctctttagcccaacagatgttcaccaacattagaagcccgtgttcaggcccccagggaagccctggattacctcggagaactcatattcatttgtggccacactctgctcacatgtactttctggttaccagcagcctgctcccttttcccctgatccagcctggttgtagccggacacgattcaaaactctttgctccctgagacacacttccgctccaaccgaagagggccacggccctgtaaggcgcccttgcggaatgcattgcctttctcacctaccacatcctaggggccgaccgcaggggcaccctactcatatgagaccagccttacagcaagcactgctgtcacacccttcattgctgctgccatggcgaagttcaccagactctgccgtacaggtaggcccgagcatgatcttgcggcgcattccgatggccgggcacctgtgctttccacactggccacagctgctggatagtagggactgctgcacgtatacctgcattaatacacccgttctaaactcccacatggtgcaggaaggggtttgcggtcagtag

SEQ ID NO: 34628 - DNA, 642 bp, Artificial Sequence
  Description of Artificial Sequence: Synthetic coding sequence
atgagccctaagtgcgctgagacagcccagcagctgcgctgcctcacagaaaacgtgcagagacccctgtgtccgactatgcccgcatggggccggccctccttaggtctattgcgggtcagtcctgcctgccagcctaagggcgggagaagctgcggatgttcacagcccctgctgaaagtaggactttgggtcgagatgtgggcagcatccggcaggcactcctacaagtgcattccagctctgagaacaacgtttctgttaccttctccattcctgcgaaccccgatgcagaagagggggcgtcagcttacaaaggaccgcgaggggtactgttcctggcacctgatgggatccatttgctgcatcccactggggtgctgcccaggatggattggtaaggagttggcagggcgactttcatctgtgctgaccacctggttaggcgggggacgcggggcttggcaggaacagagcgctggacccggcaactggggtctggtccatgtctgtactcatgtatgtgtgtgtgtacgagcctgttgggttgggcgcgaggaggcagtaaaaccccacccactcctgagtgccgcagtgctgctgtgtgttagcgccgccagaggctgccaccacaccagctag

SEQ ID NO: 34629 - DNA, 612 bp, Artificial Sequence
  Description of Artificial Sequence: Synthetic coding sequence
atggactccgcccctgccgggtcattctccgcttccagcttttttgatttgagtgttaccgtaacgagggcgaagaactcccggggcccctctagtagtccttccgagctccagggcgcccactgtctcacctcctctttggccgccgcctgctcagtagcatacagcgcattgtggtcttcatcccctctgagatcaccctggtcaatcagctctatcacaatgcctcggctttcttccgaagagagctcggccagcttgcttgccggcgccgatggacggccccccagactcctgtttctgcctttttgggtgaacctccttcgcctagtgcttttcttgaggcctaggcgccctctgcttggcttcctcgccgcccctcggtccgagcctgcttgccccgtgacttctcctgagagttgggcgtgcgtttcagaggcaggaggcgtgggcgcatcccctggggtaccagcctcagcggcttgtgttggtccatcctcctcctcgaggcggcttatctgtcttcgtaccctcgtgtcttgtgcccgcagcttccacagaaccttacagactccttccctgccaggcatatccctgggaatggctgcctag

SEQ ID NO: 34630 - DNA, 666 bp, Artificial Sequence
  Description of Artificial Sequence: Synthetic coding sequence
atggcagctgctggcccgttgtgtactgagcgagtttctgttctaagccagcccaatagcggggttgaagatcctacaccagcggggggaaggggccagggacgccgacggggaagggaagaattggagtcaattggagctggccctggagccagtgtgagaattctgcctgcactccgacccggactcggaggggtgtggggcgccggtgccgccagcctggtgttccaagccggcccggggagtagctggttgggttggcccgatctggacctggccctctataggggttgggcgtgccgcagcgaaggcactgcaaacgtggcttttccggggaccgccagccctggcttcagtagagcacggcagactcgggatctcaggaagccggccttgaaaacgcccagccataccgccagccagctagctgctgaagctggaaacccgagcggcggctgcccatctatgcgatgccagcgacgggtcggagccctggtccctacttggaagggaggctggagagatggatggtctgggtccgggggaagagcaaaggaaagaattctagctttttcctttcccgcaggggggggcattaggggtgagagagtgcaggcagctagtaatacgcgtatatgggaagagcccggaagcactcccaattag

SEQ ID NO: 34631 - DNA, 378 bp, Artificial Sequence
  Description of Artificial Sequence: Synthetic coding sequence
atgcagcccgttattagtgccctgaacattcagacacagacagtccagactcacccagcgccaagaaacacctctgagcactgcacattgccagcttgcgacgcacaggaggagcatagagacactgtagacggctctattgccagaaccgaaagcgcttctggagaaatatggcgccagacacatatggatggcgagcatcatgtgaatacgaaagccgagatcagtgtgatgtccgccaatcaaggggctcctcggatcaccagtaaacctcctgaagcacgacgcgaggcccgggatcgctcactgccttccgctttcagtctcagggggctaaccgacacgctgatcttgggtttttgtcctccagagctctag

SEQ ID NO: 34632 - DNA, 369 bp, Artificial Sequence
  Description of Artificial Sequence: Synthetic coding sequence
atgaaagtggctctcctgcggttctttagccctcccaacatgtccgtgactcataaagaagcccatgagcgcaagtgtcctgaaaaacctgagctttggaaagcagggtccactgtaccgctgaccgccccggagaagaccgaccccttccctctgtgtccccccttaagcctgacctgcccacaacagcagtcatgtatccctagcagctcccaggacgtcctgaactccctatgggtgagcagccattgcttacagttaaaaattagcaagactaaaacccactgcctcccaacccagaatgtcctgccctttctgttacccacaccagtcagcattgtgtgtcggcttcccggcctggatccatag

SEQ ID NO: 34633 - DNA, 459 bp, Artificial Sequence
  Description of Artificial Sequence: Synthetic coding sequence
atggaagcggaggcctggggttcccaggcaagagctgggctgggcgccgctgagaactgtcttgaaggtggaaaccaggcatttttgctggaaagggtcacaggtaccaagggccgcggccaaggtcaacccctggagcgcgccggtgaagagggagaagccggcggggatccgaggagagatcccggcgaagtcgtggcgaagagtagagttcgtgcaagaccccatctgtccctatatcccgcactgccaggtgtggctctggctcttctgtgctgtcccctccaagaccggtgcctcagattagtgcccgcttgcccaacggctggcccccagcacccacaggttctcccctgggcactgcagaagcagggcgtcgtgcggagcggcccatgggctactgaggaaatggtatggggaacgagaacgggggtgggcggacttacagccgtattttag

SEQ ID NO: 34634 - DNA, 879 bp, Artificial Sequence
  Description of Artificial Sequence: Synthetic coding sequence
atgcagccttctcgggaggcacttgaacttaggggactgcccaagagcgtctccacagtctccagcacaaagcctccactcacaacacctagctccacaaatccctctagacagctggccttggaggactgtgtgcagcttagggctgcgctggacctgggctacggaccggagtgttgttgccatcacttgcctgaagtggcccacaaaagttccgccagcgcaggagcaccctctgccagactcccattgcagccccactctctgggcacaaggactaaattaccaccttcactctgtctccccggacccggccgaacaagactgaccactgaaccgttcccaggagcccccttttgcagtgactcatgctctccagctctgtgctgtgtgctgttaacacctgggaggggccgtggctccgtggcacccttagggtcgagccaggacgggcgcggtggttgctgtcccacagatactgtaccagcagcccaggggatggacgcctcttggacagtcgcacctgcacaggaatggctgggacaccccttacaaagctgtccccagagtgcaagcagaggccacctaccacttcccttgcccaccccgaccaccccttgcatctctcagccacccggtcgccggtgtcgcccgcattgtggaaaggagttgtttagagctccaggcgccttgcattttctccctagaagacaccctgccgccgtgaggcacaggtggacacgcgcctgccccgagggaccccgcatgcacattcctcaagggtggctgctctcgtcaccttctttattaacagattggttctccatggactctttcaagccccccagcctggccagtggccagatctctaaaacctag

SEQ ID NO: 34635 - DNA, 900 bp, Artificial Sequence
  Description of Artificial Sequence: Synthetic coding sequence
atgccagaaggctctgtatccgcaatgcgcacctccccaaagagttcctggccgtggtgttgtagttggagctgtgcttggagctcctccagccctccctggcgctcccctcccagcgcgaccggcactctctgtaggagctgcagcctcgctccaagcggtgacctcgaagtactgaagagtcaggagacaggctgtcgggatccattgcaactgcccggactcctgggtccctgtgccttgagtcccatggtgggtagccctagcggcagagtgaaactggtcggtagacgctccgtggtgcagtgctctaggtgttgtatagatcccttaatcttctttgttttcgttttcatactcttttgttttgtgttcgaaatggagagttgcagcgtgactcaggcaggtgttcagtggtgcgacgacttgggtagcctccagccccctcctcccggcttctcctgtctcagtctcccagggtcatgggattaccgtcacccccccccccatcccgccaacttttgtatcttctccagggacgaagtaagcacacctactcaggctggcgtgaagcttttaactgcatctgacctccctacgctggcaagtcaatctgtggccataacgggagtgtctcatcatgcccagcccaaccctctaatcttttgtttcagttcttctactgttcgcaaggcgtttgaccgagggccccgccgttggcagcatggcggcggtctgacagtgtgggtcgtggtgaaggccctggaatctcagctgcagagggaggatgttgatctgcgggatggccagtgtcacttacacagacggctggaggctcccgcctggggaaacctcctgggtaaagaggggtccaagagagggacaatgaaacagaactag

SEQ ID NO: 34636 - DNA, 843 bp, Artificial Sequence
  Description of Artificial Sequence: Synthetic coding sequence
atgacgtctttgacccatggtatgcacctgacctcaagcacatcctgctcttgccaaagctccggaaccagtttcaccagttgctcctgccggagttccggaacgtcgtctacctctaggtcctggtggtcatctggaacgtcgagcaccagctgtagttggtggtcctcagggacctcatcgactttctgttcgtgctggtcttccggcactagctttacgtcttgtagctgttggtcctcaggaaccagctctacaccatgttcctgtaggagcagcggcacatcctctacctcatgttcctgctggtcctccggaacaagtagtacctcttggtcctgtaaaagcagtggtacatcttcgacctgttacatgtgtcttagctcaggaaccagttctacaagctacagctcctggtcgagtcagacaagttccacaagtagcatgtgtctgccttccagaacatccagtatattctatagctgcctgccccttggacaccatctgccattttgctccgtcagaccactcggtccaccaaccacctcgcccctcagcaatctgtggatcctctcccacccattctaccttggtggggtctggcctctgaacaatcatctgcatatgaacttgcttggctacttcaacaacctgcacctttggagtttggggctgcaaccccttccccctcctggctctccactcgttcacctgcctcctcctcctcttggctggccgctgctgagcgaactgctccaggacctcaaccagctcccttacccgctgcttcccgtcggtcctaggccacgtcctcctcatgtgttacttggcattttcatctag

SEQ ID NO: 34637 - DNA, 477 bp, Artificial Sequence
  Description of Artificial Sequence: Synthetic coding sequence
atgctggatgggggcaggaatgggagactgctggagttgtccagccttttgccagaaagaggcggcggtccatccctgtgtaggagtccagcaagcactgagaaagaggtaggcgcgtgtggcacactagcaagccttcgccgtggattgtggaagtgcagcttatgtcccgggcctgccctcctgcttggtgggtcctgctgtctaatctgctcactgtccctgctcctcctctccactcctaccttctttagcaggaatttcgagccgtccttcagcccctcccctatagagaagcctagcgccccttcatctgggcaatccagtcaattacagacccaggttcagcctccggccgagcgcggggctgcttctatgcctggtccagctagtctgccactgtctaccggcccaagccagcccctgcgttgttcaccaagggtcctatgctcaagggtcctggcactgagacggtag

SEQ ID NO: 34638 - DNA, 480 bp, Artificial Sequence
  Description of Artificial Sequence: Synthetic coding sequence
atggcaaccgttgacccagccggactggcacttcatcctgcatgtccccgtgtgtgggggccatcggaccaacaccgccctccgcaggaaggaagccacctgcctgcgagaaggcgcggtttggctagaaatcaatcttgtcagcaccccgatctcggacctcccgcgtcccgcactgaaaaagaaatgtcagccgtggccgccccaggttgtgccgctcttctccaaccccctcagcagaccagtgtgcagtcatttaagggtatgtctctgagtgttgaagctgggctctgcggagaaccggccggcaagctgctcggggaaggtggaggacagcgggaggcctctctcgtgggaaaaaaaggatgggagtggcggcgtcatagaggtagaaccctgtcagaggaagatcagggggcgcgccccttttcccctggttcctgcgccctgcggggagaccgcgaagggggaattggttag

SEQ ID NO: 34639 - DNA, 618 bp, Artificial Sequence
  Description of Artificial Sequence: Synthetic coding sequence
atgcgggaacctctgattcctccctgtaaagcggctagtcttagcgagcaggaacaggtgcggggagagtgtggcatgatgaccgcccaggggatccttggcccgaggggtaaatccaaattgcctgtgctgcctgacccccggttaatctgcagatacatgtgtagttgtagggaaattcccggagttatatcaacccctgtaccacatagcgcaggtcctcaggtgacaaggtttcacagtccatctccaccgcacataagcgagctttcgcagactctgcatgcacccttccaaggatcatggcccagaccctgccacgccctcagcggcccacgcgctatggttcctaaccaattgcacccagggacaccatgtcctgctcacgttcctcactcttgcaccatgcccgctgggacctgtcccctattcactggggcccccgcagccgctgaggcgggtctgaatcctggcccagcactaagggctccaacttcttgctccagttcaacctggccgaagccattcatgactgtgtgcctgctcccaacgtcttctatgctaaccagccctggcactggaggctgcatccgggcacggattctggaaccagcctag

SEQ ID NO: 34640 - DNA, 453 bp, Artificial Sequence
  Description of Artificial Sequence: Synthetic coding sequence
atggccgttacttttcagatgctggccgtccagcagagcacttcccacgctatccaaagttggcactctttacgcccatcgtgccaacgacggcccgactctagctgcactcggctgtccggcatgacaagcgctgcaacacggacctctgaaacggctatggacgcgactcggctctggggcacccgatggaaagtgaggacgagaagaatggtagcaagtaccagccgatttcaggcgaacgtagctgccaccaggaagcctagcaaagcggcgggctgctcgctgaacagtgttctggggaaacccgtgttgggcgagccagccttttgggacttgcccagtgttcctgtggccccggctactccatctgaggccgcagccccggaatcggagtgttggcgcgcccatcgcgatctgccatacccgagtggagatcttgccctacagtag

SEQ ID NO: 34641 - DNA, 528 bp, Artificial Sequence
  Description of Artificial Sequence: Synthetic coding sequence
atgaccagacctttacccgagtcaatccgcttgttgaggcacactggcctagtgcctccaacaccggtcccactcggataccctcatcagagcttcgtgtcgcaaccacacccattctcaaagcagccgagtccgtgccctcgccagtcaccgcagggagatttcgggtgggtgtcccctggtgcatcacgaagcattactggcccctcttctccagcagcccccagccttatttcgctgggaagtctcggctcacatttacaaggcgcacgtccccacccaaggcagtcaagtcttggcgacttcggccttgtgactcctggaaccccatgctgtcggttgtgcccccctttattacttccacagggccggcccccctgggtcctgtgcgccggagtatccaaggaattgggccccaatcccgtcctgccatctcccatagtcgaacagcgactcggccacggggctgacatggtaccgccaccagatcaggaggagtggaacgtagtgatgtcccagtccacatag

SEQ ID NO: 34642 - DNA, 528 bp, Artificial Sequence
  Description of Artificial Sequence: Synthetic coding sequence
atgacccgtcccctgcctgaatccattaggctgctccgccacactggactggtcccgccaacgcctgtccccttagggtacccacatcaatcatttgtttctcagccgcaccccttctccaagcagcccagcccttgtcccagacagagccctcagggagactttgggtgggtgtctcccggggctagcaggtccatcacaggccccagttcgcccgccgccccatccctgattagtctgggcagtctagggtcccacctgcagggcgcaaggcctcacccgagacagtctagcctgggagactttggtctcgtcacaccgggcactccctgctgtcggctttgtcccccactgctgctgcctcaaggcaggcccccttgggttctctgcgctggggtctctaaggaactggggccaaatcccgtactgccatccccaattgtcgaacagcggctgggccacggcgcggatatggtgccccccccggatcaggaggaatggaatgtggtaatgagtcagtctacctag

SEQ ID NO: 34643 - DNA, 591 bp, Artificial Sequence
  Description of Artificial Sequence: Synthetic coding sequence
atggctgcggcttccgttcctcctgaatcatccatcattcacccagcttctagtgccatcaaaagaacggacggcggccgtctggaactggaaatcagaattggcatattcgcccaattctggtcagcatgtctgttgttcccgcggtgttcacagccacgccagcctaggagctggggtcccagggtcaatgcttttgcgctgtggccggccacacgtcgtcctgctcacaccggccggagagtgacccccgccagagcttgttctcacacttccgggacaggtgccggccgcaaacggaagggtggagaaaccagctttcaacgagagtggtccgagaaccggcgggaaaaaggacagggtaaaataagatccccggccccagagcccgcagggggtgaggcctcaagttcacccgcccctgaagagagaggaccgtcccattgttcccaagcaaacgtttcccctgcatcatgtaccctacctggtaagaccaggattcactccctgtgccgtgagggaaacgccggcagaacccctagtcagccgccattatccggctataagacccccaacaagcgaaacctttag

SEQ ID NO: 34644 - DNA, 423 bp, Artificial Sequence
  Description of Artificial Sequence: Synthetic coding sequence
atggggttggaggcaaaaaattctccatgttgtcaccaacatggagacttcgtgccatatccaatcctgagtgcgcgagtgttccagcccgaagtggaggaggccactctggcggcccacgctatctcccatgactgcgtctgctctggcgggggggtgctgctcccacatgactggaggaacaattacatgatccttttgaacccacaggtgttggctgacgagcggggacaccagcggccagtagcgtttcttgcttacaaagtaaacggtcaatatataatggaaggttttgccagctcctttctgtttacaatgggcggcctgggatttattatgctggatcagtctaacgctcctaatattcctaaattgaatagatttttttttttctactctctggactctagcgtgagctattag

SEQ ID NO: 34645 - DNA, 462 bp, Artificial Sequence
  Description of Artificial Sequence: Synthetic coding sequence
atgcacctgaagaaccctcctaaccctccacatctacccccggtggaaagtgcccggaacaagacaattcttttacaacagctgtctgctctcccggatagtcctttgtgggggctgggtatgactcgggtattcctcgctgaccttaccgaagcaagcctcgcgttatgctcactgattagcctgaaatgcctgcctggcgactctggcaagagcgggaaagtgagccttggccttgctggctgcagcgggatccagacatccgtggccccaagctcccagcagcagaagacagcttcctgcggtacagggggacgttgttgcgggccccatccggcatcgccaaggaagggcgccggttcacattctaccgcacgcgcctggcctagcaagggcgaggctcagctattcagccctcctgcctccgcgggctgttccgggacccagcctggtgtgacctag

SEQ ID NO: 34646 - DNA, 549 bp, Artificial Sequence
  Description of Artificial Sequence: Synthetic coding sequence
atggcggtgacgggagtgcagtgctcagagcggtgtaagcagactagacgcgtggattccagtagcggaaagtggctcgccacaccactgatttgggaaaaactgaattggccctctagatctcagtcccagaatttacacccctttcgcatcctccccaacggcttgacacttccaggcgcccaagagcgtcctgggtatctgctggcagctctgccaaatccatgtgcaccaagaccctaccaagtccattgggtgcatgttgcggtactgattgccgtgcttttgcaacagctccctcagagtagatgcctgagactgcccctaccaggagggggcggtggccagcgcgcgctgcagggaagactgaagacccaggctggcaagaggggtgtgcgaaaaagaggggggtggcgcgagcgggaaagaccttctgccgaccccggagaaagggggctccgggttggtgcccaagtgcagaatcccagagcccctagaaagatattcgcaatccctgccacatcaaaagtgcaattacggcctatgtag

SEQ ID NO: 34647 - DNA, 435 bp, Artificial Sequence
  Description of Artificial Sequence: Synthetic coding sequence
atggccgatggcgggggtggaggcagtggtggcgccggaccggcttctacacgcgcctcacggggcctcttcgatagctttaggagagattgtaaggcagatgtggatacaaaaccagcttaccagaatttgtcacaaaaggccgataactttgtgtctacccatctggacaaacaagaatggaacccacccgccaacgataatcagctccatgacgggctccggcaatcagtggtccagagtgggagaagcgaggccggggtggatcgcatctctagccaggtcgtggaccccaagctcaaccacatttttcggccacagattgagcaaataatccatgagtttctggtcgcccagaaggaggcagccgttccagcactgccaccagagcccgaaggccaggaccctcccgctccctcacaggacacatcgtag

SEQ ID NO: 34648 - DNA, 861 bp, Artificial Sequence
  Description of Artificial Sequence: Synthetic coding sequence
cagcgctgctgccgctgctgctgtcgctgcccatgttgcggacagggcccacgctctggatgcaaaattccagctggcgacgcccgggtgcgtgacggggcagggggttcagtgcacctgtgtgccctcttcgggctcctgcctagagtttggctggaaagattctacccctgtctgtggccattagtcccaggaagaggtcagtgccgaccaggcgactcggctactaacaattcaacccagaaagtgcagaaagagacccaggggagattccacctgctgggcgacccctccagaaataattgcagcctgagcattagagatgcacggagacgggacaatggttcttactttttctgggtggcaagaggccgtactaagtttagttacaagtactcacctctgtctgtgtatgtcacagccctgacgcatcgccccgacatcctgatccccgaattcttgaaatccgggcacccatccaatttaacttgtagcgtgccatgggtgtgtgaacagggcacccccccgatattctcatggatgagtgctgcaccaacttccctcggacctcgtacactgcattcaagtgtcctgacgataattccacggccacaagaccacggcacgaatttgatatgccaggttacctttccaggcgcaggcgtcacaacggagcgcaccattcagttgtccgtcagctggaagagtggtactgtcgaggaggttgttgttctggctgtgggcgtggtggccgtgaaaatcttgttactgtgcctgtgtctcatcatcctctctttccacaagaagaaagccgtgagagcagtggaagtcgaagaaaacgtgtacgccgtcatgggctag

SEQ ID NO: 34649 - DNA, 834 bp, Artificial Sequence
  Description of Artificial Sequence: Synthetic coding sequence
atgcccgagagcgttacagtccaggaaggcctgtgcatctttgtgcattgttctgtgttctacctcgaatacgggtggaaggacagcaccccagcctatggtcactggttccgggaaggcgtctccgttgatcaagaaacgcccgtggcaactaataatagcacacaaaaggtccagaaagagacccaggggcgattccatctcctcggtgaccctagcagaaataactgctccctgagcatcagagatgcacggaggcgagacaatgggagctattttttctgggtcgcccgggggaggacaaaattcagctataagtactcccccctgtccgtgtatgtgaccgcactcacccatcgccccgacatcctcattcctgaatttctgaagtccggtcacccgtccaatttaacatgttccgtaccttgggtctgcgagcaggggactccccctatctttagttggatgagtgccgctcctaccagtctcggtccaaggacccttcattcctcggtcttaaccatcattccacgtccccaggaccacgggaccaatctaatatgccaggtcaccttccccggggccggggtcacaacagaaaggaccatccagcttagtgtgtcttacccacttatgaaccctgtcatagaggcatctctggaggatggcaccggcaagtccgggaccgtggaggaggtcgtcgtgctggccgtgggggttgttgccgttaaaattctgctgttgtgtctctgcttgatcatcttgtcattccataaaaagaaggccgtccgcgccgttgaggtcgaggaaaatgtgtatgccgtgatgggatag

SEQ ID NO: 34650 - DNA, 543 bp, Artificial Sequence
  Description of Artificial Sequence: Synthetic coding sequence
atggctgagtccctgccgttggagatgctgacttacatcctgtcatttcttccccttagcgaccaaaaggaggccagcctggtctcatgggcctggtaccgcgctgcccagaacgcactccgtgaatcactcggccttcggggaatctgttgcatttctctcacaaacctggatggatctctcgccagccatcaggtgctgcagagcgtggcatatcacctggggccgcacttgcagtctttgtctctgggcggcggatctccaactgaagcgtcctctgtggcattaatcctaggatgccctgctttatgcgtgctggatctctcagggtgtaacagtctcttcaccagtggaacactcctggcacaacccgaaatggctcagagcgtgcaacaggccctttccggtttgagagagctgaacctggctggcctcagggacctggcagatctgtcatttaaccagcttagcagctgcgccccgtctctggagagactgtctctggcctattgccatttaacttttgagttggggccagcctag

SEQ ID NO: 34651 - DNA, 702 bp, Artificial Sequence
  Description of Artificial Sequence: Synthetic coding sequence
atgcgccttcttcccctgctgaggactgtactctgggcagcatttctaggttcaccgctgcgaggaggctcaagcttaaggcacgtggtgtactggaattcgtcgaatccaagtctgcgtagagaggggtataccgtgcaagtgaacgtcaatgactatttggacatctattgcccccattacaacagttctggagttgggccaggagctggtcccggacctggggggggggcagagcaatatgtgctatacatggtaagccgaaacggatacaggacctgcaatgcatcacaagggttcaaaaggtgggaatgcaacagaccccacgcaccacattccccaatcaagttcagcgagaaattccagcgctatagcgccttctccctgggctatgaattccacgctgggcacgagtattactatatttccacaccaacacacaacctccactggaaatgcctacggatgaaggtgttcgtgtgctgcgcctccacatcccatagtggagagaaaccagtccctaccttaccccaattcactatggggcctaatgtgaagatcaatgtgctggaagactttgagggggagaacccccaggtgcctaagttggagaagtcaatatctggtacatctccaaagcgggagcatctcccacttgccgtgggcatcgccttttttttgatgacttttttggcctcttag

SEQ ID NO: 34652 - DNA, 495 bp, Artificial Sequence
  Description of Artificial Sequence: Synthetic coding sequence
atggaggacgagaggatactcgataatttgggcgcagagggccgccacgggtccgagtgggagtggaggagatggcactttggtggctgggtagaagaggagcataggcaccggtggccgaggggagtatggtctactgacaaaagcccgggaggggttcagccccagtgcctgtcccaggaagtatctgccctggtgagtgggactcagtcttctcttagaaacggccttggcgacaagtggtctgcatgctgcaccagggccctcggtcagatggaacagactaaacaaagtaagcgtagagcggggcgggaagaccggttctcagttgcactgggccgttgccgaggcaacgagcataagactttgtctcatgtgcctggagcttccgacgctgcccagaagcctcgagccaagccatgcagtcgcggaatcggtgcttccgtccttcttcagacaatgcacctctcctttatcactcttgggtttagatag

SEQ ID NO: 34653 - DNA, 1323 bp, Artificial Sequence
  Description of Artificial Sequence: Synthetic coding sequence
atgtctatgctggcagaaagaaggcggaaacagaagtgggcagtggatcctcagaacactgcctggtccaacgacgatagcaaatttggacagcgaatgttagaaaagatgggctggagcaaagggaagggcctcggtgcccaggaacagggcgcgacagaccacatcaaggtacaggtgaagaacaaccatttggggctcggcgccaccattaataacgaggataattggattgcacatcaggacgacttcaatcagctgcttgccgaactcaatacctgccacggacaggagaccacagattcctccgataaaaaggagaagaagtccttcagcctggaggagaagagcaaaatctccaagaacagggtgcattatatgaagtttacaaagggcaagagctggaaggccctgaccctctcccaaaaacgcccttatgtcgacgaagcggaacgcctccgcttgcaacatatgcaggactacccaaattacaaatatcggcctcggcgcaaaaaacaggcaaaacgcctctgtaaacgggttgaccccgggttcctcctctcctccctgtccagagaccagaacgccctgccagagaagaggtctggaagtcgaggggccctcggagagaaggaagatagaggggagtactcaccagggacagccttgccctcactgagaggatgctatcacgagggtccagcggggggcgggggaggtggcacccctagtagcgtggatacctacccttacggcttgcccacaccgcctgaaatgtctccattagacgtactagaacccgaacagacctttttttcctcaccttgtcaggaagagcacggacaccctcggcgcattccccatctcccgggacacccatattcccccgaatacgccccatcccctttgcactgctctcaccccttgggctcattagccctcggccaaagccctggagtgagtatgatgagcccagtgcctggatgcccaccttctccagcctactatagccctgccacataccatccactgcatagtaatctgcaggcacacctcggacagttatccccaccccctgaacaccctgggttcgacgcgttggaccagctgtcccaggtggagctgctcggcgatatggataggaatgaattcgatcagtatctgaataccccagggcaccctgattcagccacaggcgccatggctctgtccggccacgttcctgtctctcaggtgacaccaactgggccaactgaaacttccctgatctcagttctcgccgatgcgactgcaacatactataattcctatagtgtgagctag

SEQ ID NO: 34654 - DNA, 888 bp, Artificial Sequence
  Description of Artificial Sequence: Synthetic coding sequence
atgctgccagattttaagctgtattacaaagctacagttacaaaaactgcctggtataggtatcaaaatcgggatatcgatcagtggaatagaactgaaccaagcgaaatcactccacacatatacaactacctgatatttgacaagcctgagaagaataagcagtgggggaaggactcactgtttaataagtggtgttgggaaaactggctcgcaatttgcaggaagctgaagctggatccgttcttgactccatacacgaagatcaacagccggtggatcaagtatttgaacgtgcgccctaagactatcaagacagtcgaagagaacttaggcatcaccattcaagatatcggcatgggtaaagacttcatgtcaaagacaccaaaggcaatggccactaaggccaaaattgacaagtgggatttgattaaactgaagagtttttgtacagccaaagagacaactatcagagtaaatcgacagccaacaaagtgggaaaagatcttcgctacctattcatcggataaaggactgatctccagaatctacaacgaattcaaacaaatctataagaagaaaaccaataacccaataaaaaaatgggccaaggatatgaatcgacacttctcaaaggaagatatatatgcggccaaaaaacatatgaaaaagtgtagccccagcctcgctattagggaaatgcagatcaagactaccatgaggtaccatcttactcctgtacggatggctgtcatcaaaaaaagcggaaataacaggtgctggcgcgggtgcggcgaaatcggtacactcttacactgctggtgggattgcaaactggtgcagcccttgtggaagagtgtgtggcgctttctcagggacctcgaatag

SEQ ID NO: 34655 - DNA, 372 bp, Artificial Sequence
  Description of Artificial Sequence: Synthetic coding sequence
atgcagagcgaaaagccccagggcctgttcctgcagcttaatcctaatgctagctcaacagagacccagctgctagttcccgccctggagagcagagacactctgcccccaactcactgcttcatggctggaacagagtcacccctgggaaatccatggcctctttctcttcccccgccatgttggaccggctgcctccttccagcccctagggggcaaagaaagcccggtcctctcggcttaagtattttcatatctctggggaataagcgccacagatcaggaaaccatgtcgtccgagaaagcgagcagcctctctcccaggggaatcctcatcaaggctggggcccggacacaagaaaggggcggtag

SEQ ID NO: 34656 - DNA, 372 bp, Artificial Sequence
  Description of Artificial Sequence: Synthetic coding sequence
atgcagagtgagaaacctcagggtttgttcctgcagctgaaccctaacgcctcctcaaccgaaacccagctcctggtgccagctctggaatcccgcgacactctgccaccaactcactgcttcatggccggaactgagtctccgttaggaaatccctggcccctcagcctgcctccaccctgttggacggggtgcctgttaccagcccctcgcggacagcgaaaaccagggccccttggcctgagcatctttattagtctcggcaataaacgccaccgcagcggaaaccacgtggtgcgggagtctgagcagcctctgagccaggggaaccctcatcaagggtggggtccggacactcggaaagggcggtag

SEQ ID NO: 34657 - DNA, 855 bp, Artificial Sequence
  Description of Artificial Sequence: Synthetic coding sequence
atgttatctgtcgttgaaaatggcttggacccgcaagcagctatccccgtgatcaaaaaaaaactggtgggctctgtgaaggcactgcagaaacagtacgtctcactcgatatggtagtcacatctgaggacggtgatgcaaacactatgtgctcagcactggaagcagttttcatccacggcctgcatactaagcacatcagggccgaggctgggggcaaacggaagaagtctgcacatcaaaagcccctcccacaacccgtgttctggccccttctcaaagcagtcacacctaagcacattatttctgagctagagcatctgacgttcgtgaacatggatgtgggacgatgtcgggcttggctgcgtctcgcattgaacaacggcctaatggaatgctatctcaaactgttgctacaggagcaagctcggctgcagctccagcgaaaggaatcgcttgatagcatcagtcattccagtggctctgaagacatcgaggtacaccactcgggccataagattcgacggaaccagaagcccacagcttcctcgttatcgctggatacagcctcatcgagtcagctgtcctgctctctgaatagcgatagctgtttactgcaggagaatgggtcaaagtcacccgaccactgtgaggagcctatgtcttacgactctgatctcggcactgcaaatgcggaggactctgatcagtctctgcaggatatcaagatctttagctgggcccaatggttgactcccgttataccagccttgtgggaagccgaggctggcggctctcagtcccaagaaatcgagacttttctggccaacaccgttaagcctcatctttattag

SEQ ID NO: 34658 - DNA, 516 bp, Artificial Sequence
  Description of Artificial Sequence: Synthetic coding sequence
atggactggaccccccgactaccatctaggcacattatcagtgagcttgaacatctcacattcgtcaatatggacgtcggacgctgtagggcctggctgagactagcactaaacaacggattaatggaatgttaccttaagctgttactacaggaacaggccagactgcagttgcagaggaaggaatcattagactccattagtcactcttctggctctgaggacattgaggtgcaccactcaggacacaaaatacggcgcaatcagaagccgacagctagctccctgtctctagatacagcctcgtcaagtcaactgtcatgttccctgaactctgatagttgcctactgcaggaaaatggctcaaagagccctgaccattgcgaggagcccatgagctatgattcggatctgggcacggccaatgctgaggacagcgaccaaagcctacaggaaaagacaagggctggatctcagcggatgacaagcacagggctaccgggctccaacccctag

SEQ ID NO: 34659 - DNA, 576 bp, Artificial Sequence
  Description of Artificial Sequence: Synthetic coding sequence
atgccagccgcaattgcacccaaggatgatctctctattaggtttctgaaaccgtggttgggagaaggcattttactgagtggaggagacaaatggagcaggcacaggcgaatgctaacacctgccttccactttaacatcctgaagccctatataaaaatcttcaaccggtccgtgaacataatgcatgataagtggcagcacctagccagcgaggggtcatcccggctcgacatgttcgagcacatatcactgatgacgttggatagcctgcagaaatgcatcttttcattcgactcgcactgccaagagaggccatccgaatacatcgcgactatcttggagctgtctgcgcttgtagagaagaggaaccagcacattctccagcacatggatttcctgtactacctcagtcacgatggttggcggttccgtcgcgcctgccgtctggtccatgactttaccgatgccgtcattcaggagcgaaggcacaccctgcccactcagggaatcgttatcagtagccgcactaaaccctccccccgtctgtggatttctctcatgtgtttttgctag

SEQ ID NO: 34660 - DNA, 4098 bp, Artificial Sequence
  Description of Artificial Sequence: Synthetic coding sequence
atgagcagcggcagacgaagaggctccgcaccatggcactcctttagcaggttctttgcgccccgaagcccatcgagagataaggaagaggaagaggaagagaggccgggaacctcacccccaccagccccaggtaggtctgctgcctctgtggagaatgaaccaatgtctacatcccagaagaaggaaaatgtcctatcttcagaagccgtgaagatcaggcagtctgaggataagcgaaaccatgctgaaaagccggttacattgccagtccaggaggacccaaagaaggcctacgacctgagctcttcaaccagtgacaccaagattggagagagcgatcggcagcccaaagaaagttttttccaattcctcggtaacctctttaatatctcaggcaagagctccctgggagaggcaaagcaatcttcctttaaggatgaccaagacaaaactgagaaagatctccagaacccctctgaccaccatgaagacggtatcaagcgcgagcgggagatattctcgggatcactgcgcacgcagactcatcccacggaggagcaggactcaaatagtagtgaactctctgatgccttttccctggataccacacaggacagcgaccaagaaacaacgaatctcctgaagcaaattgacggcaaaccagaaaaacccagcgtcacatacgccacgtatcgcggcccgcgccacattggtaaatatctgaagcaacagacgggccttgctaccgtaaacacactggatcgggagaatgagagttccgatagtagcaccaatcgccacatcgatccagggtccgaaatcgaggcgggtgtgctcccgctgttactctctgcctccaccgactcctccatgaaagggaatctgctggaggggcccctggaggattctgattgttctaagaccagctttaataaggaaaactctttgacaaacaaccccgagctgcaaaacattgcaagctcaaacaacctcctcaacaagaacgcttgggggtccatagagcgcaatcgatcaagcccttcttctgtcacaaattccagctacgatggggagagcgattcacagcatcatttgtcctgtgagcctgtcagccagacgaaccgtaatttagtgtgttctgccttactgaccgggagcaatcacaggaaagtgccatgtagcccagatttccagcgagtcacaaccaccgagaacacaatcaaggaaaacagcactgtgatgagcaatagaaccctggtgcagagagaagagctggtagaacctcaaggccccgcaatctctgacttcagctgttccaaatcagacggctccgacacaaccgaacaggaaagcaccaatttaccatctcctaataagtctattcggcacgagcacctgcaactgccagagtctgaatgttcagacaagcagacgattgattcctcaagtaaacaggcagctacccacactaacattatcgccctgcagcgtcacgctgtcacggatacagaatttgtgaatgaggggaagcggctgagtgcgcaagacagccagaagaatgtggctgtccgggagataagacgagagacggagagtgctagtgccggggaaagtattgcgagctcccatgtgaaggccccagaagacaagatagaatcacttccgaaagacactgaccagtatttcgaaacaaaggctaagaagttggattttcgctcccacgataaaattccccacatccggatgaataagaaagacctcgctagcttaaactacatcagcgaaagcgcagttgtggcctctttgggaaacgagaacgctccagagctgaagttcgagctgaacagatcccacatttctgaaaccccgttggactccgaatcccctcaacaggctgaggtgtcgccagacgctaagacatctttaagcctcgattgtaagaaactcaacttcagtatcagcccccccacatttgtaagcggcgtcggcatgctatccaagcttgacatcccagacctaatgaatgaaggcagcccggtgccgatcgaaacaggcaatgtgaacatcgtcgggatttcctaccagcctaggaaatgtaaggaagaaaacgtgaagaatcacgtcgaagctgcgggccgtaagtccccaccgccttccttttgcctagaatacacatccgcaatcttcgaatttaaggaggttctgtctaatagcgaaaagtgtcaagtgttacccgggtccgaggctagtgggccacatctgactggcctcgaactgctatcattcgatagcggcaatctgagcaaggattgtagcagcatcctcagccaagacccgaaccgcgtggaactggtgtccagcaacactaaggccaacatgtccattatagagaagtcagactccctcagcctggaggccaaaacagcgaacatagtttctaaagccgagatcgatggccagaataatgtccttgttgaatctcacagtggcagggggaagaccatctccctgtccaaggtgtctttatctaaggtggaaccgaggaatatctcccaggacaagatgagtagctttcccctcaaaatcactcacgtccccgaaaagccaatcttgagcgagctaacattcttagaggtggagcaggggaaaaggtttcaaagtatcaatcacaatgagattggggaaaaatgctcagacgccggtcttaaagagaactgccaagcagaacttagccccgcagccagcaagtacgaggacaagcccgagcctgaggttgacgcactcggttctcccccggccctcctaaagagcaacatttcttggattttaccaccaatccatgacgagaaaataagccgccagatggcacaaaattgcgaggcccatacctgcgtcttccaccaatcactagacatctgtggaaccaaaaagatttccggacacagcgagatggctgaactctccctaaccaatatctcccccaagttccaggagaccgggtctatgaaagtgaactctccattcttggacagtgactcaagtttagagaagaactccagtgcctctgaagacagcagctttctgaaagtcccgtccgttctaaaattggagaaaaagtcctcttcttatagaaaaaaggagaatatccactttttgaacggggggatcgactctgttagctcctcatcaagttaccctgaggaagtgagtatgatcgtgaattcccataagccacaaaacaatcttgattcaatccaggttacaaaggatcttacccacgaaggtacgtctgtgaccaacctcctgtacccaacaacatcctacctggagtttgagactagtgtaagcattggaacggaagtcacaccttttcaggagcacttcggcatctacacaggaaagatttccatcgactttccaaccgcagcacaattcgacaatttagtcgaagccgagaccggagccgttgcgggacctgcagcatccgtaaactcgtcgggccagcagtgcagcgaggctagtgccgaacatatcgaagctcgaaggcgggcccacgatcagctgctcgacctgaagtcatccctgctgaagaaagctgatacacttatcggggaaatttttaatagcgtgcgcgaggagttgaagtttaaacacaccgtgtccacttgtcaggagcacatcgctatcgagggcataatgaacttgggcacactgaaagaggacatctcagagaagaatccatctgaggttacgttgacagaaattcaacagacggaaggactcgaggagcagggcatggagaacatgtccgaagtgaaggagaagccatgtgtgtcccctactgttggggagaagaatttgctggttgaccctaactccatgaatgtttcctgtctccttgaggataaagctcgtgaactcgttaatgagatcatctacgtggcccaagagaaacttaggaatgatacgtttgaagatactgaggatacttgggatagtgagttacaggctaacacatcgaaaatccttaatagcgatagcgtcaaaccgcatgacgtcgtccgcgaattcctcgtctctgaacagcccgtgtag

SEQ ID NO: 34661 - DNA, 372 bp, Artificial Sequence
  Description of Artificial Sequence: Synthetic coding sequence
atggctacccatcgctccacccttgccggctactctccctgttcttccccccagcgtgcagcaccaacgaggaatcaaaaggctgaaaaggcacgtaatcgacaggcttctcctatccccacacgactgcccagaaacccatcattggcttctaccggacggcaaggaacgccgatgtcccggaagaaacaaggatctgactgtcttgtgtacccggggcatccacccgggctgtggcctgtgatttcatgccacctggggttaagtgcactttcctcagagatctggacctccaattgtctgtgtctggctgctctgccctgcgacactgggctggaatcccttaccgtggtgtgttggtcgggcatatag

SEQ ID NO: 34662 - DNA, 375 bp, Artificial Sequence
  Description of Artificial Sequence: Synthetic coding sequence
atggttagggctacccggggctattgggaggctaagggcaaatggcaaacctggctgaggtttagaaagaagagctctaagtgcagagaggcgagaacatttccatcgtttaaatttctgaaagggagccagagctcattctcctctctcctgcagatgccgctccagagctttaccgctgcccatacctaccgccggaggaattctcctagccaaaaggatgaccgcgctctgggagccggagtgcccttggtgttagcagagtcgctggacgcttgcgaggttaagccggacctgggtaaggctgcactctggacactgctggcggtgcctcatacacaattggggttccttagaaagcagcaccgcctctag

SEQ ID NO: 34663 - DNA, 402 bp, Artificial Sequence
  Description of Artificial Sequence: Synthetic coding sequence
atgggctggccgctgagtctgtctccatccggcttcagagaggttgagtggggcatactgttcgtttggcaatggctactatcgtcttggcatctcagtccattccccgtgccaaccagcccatctactccctgtctcccctttctctgtcatccacttcccgtgctccacggcaactgtaccggtctgtccgtgtttgcctgtatgtgtgctccggtgtatacatgtatagagaggtacatctgcggagggagaggagagagggggggcggcggggtgaagttgcgggcatgttcccaggacaccgcccactggtctctcagcagcgccccttctgtgctggtgcggctgcgcgaggaaggtggaagagcactcgtgaagcctgactgtccctctctgtag

SEQ ID NO: 34664 - DNA, 534 bp, Artificial Sequence
  Description of Artificial Sequence: Synthetic coding sequence
atgactaccagcataagacagttcacaagttctagttctatcaaaggctcatcgggactgggtggtggaagttctaggaccagctgccagctgtctggcggcctgggcgcgggctcctgcagacccggctccgctgggggcttaggctcagccttgggcggtagcagttattcctcctgttactcatttggcagcggcgggggatatgggagtagctccttcgagggtgtggacgggctgctcgtcgggggcgagaaagccaccatgcagaacctgaatgaccggctcgccagctacttagacaaggtgcgggcactggaagaggcagatactgagctagaagtgaagatccgcgactggtaccaacgccaagcccctgggcctgcacgagattactcccagtactatcgcattatcgaagagttacaaaataaaccaccctggaccatgccaacatcctgctaccggatgacgatgcccatttggctgcttctcactagtgcccccaagtcttggcagaatgaggggcggtag

SEQ ID NO: 34665 - DNA, 981 bp, Artificial Sequence
  Description of Artificial Sequence: Synthetic coding sequence
atgcctcacctgcctctcgcgagcttccgcccacccttctggggactgagacattctcgaggactccccagatttcattcagtatcaacgcaaagtgaaccccacggttcccctatctcacggaggaatagagaggccaaacaaaagcgcctgcgagagaagcaggcgaccctggaggccgagattgctggcgagtcgaagtcccctgcagagagcatcaaagcatggaggcccaaggagctagtgctgtatgaaatccccacaaaaccaggcgaaaagaaggatgtgtctggtcccctccctcccgcgtatagccctcgctatgtggaagctgcttggtacccgtggtgggttcgagagggattcttcaagcccgagtatcaggccaggcttccacaggcaacaggtgaaacgtttagcatgtgtatccccccaccgaatgtgacaggatcactgcatataggacacgctctcaccgtcgccatccaagatgcactggtccgttggcacagaatgcgaggagatcaggtgttgtgggtgcccggctccgaccatgccgggattgctacccaggcggtcgtggagaaacagctctggaaggagcggggggtaaggaggcacgaattgtcgcgcgaggctttcctgagggaggtctggcagtggaaagaagctaaaggcggtgagatctgtgaacagctgcgtgccttgggcgcctcactagactgggacagggaatgctttactatggatgtgggttcatctgtggctgtgactgaagcattcgtacgcctttacaaagcgggcctcctttacaggaatcatcaactggttaactggtcatgtgccctcagatccgctatatccgacatagaggtggagaaccggccactacctggccacacccagttacgcctgccaggttgtccgacccctgttagttttggattactattttctgtagcattccccgtggatgggtag

SEQ ID NO: 34666 - DNA, 3192 bp, Artificial Sequence
  Description of Artificial Sequence: Synthetic coding sequence
atgccacatctacccctggcctcattcagaccacccttttggggcctgaggcactctagaggactcccaagatttcacagtgttagtacgcagtccgaacctcacggctcccctatctcccgcaggaacagggaggcaaagcagaaaagactacgggagaagcaagcgaccctcgaagcagagattgccggagaaagtaaatctcccgcagaatctatcaaggcctggcgcccaaaagaactcgtgctgtatgaaatccctaccaagccaggcgagaaaaaggacgtgagtggacctcttccgcccgcttacagccctcggtacgtcgaggcagcgtggtacccatggtgggtgagagaaggcttctttaagcccgaataccaagccagactgccccaagccacaggcgaaactttctcgatgtgcattccccccccaaacgtgactgggagcctccacatcggtcatgcccttaccgttgctatacaggacgcgctggtgagatggcaccgaatgcgaggtgaccaggttctgtgggtgccagggagcgaccacgcaggcatcgctacccaggcagtggtggagaagcagctgtggaaagagcggggagtacggcggcacgaattaagtagagaggctttcctgcgcgaggtctggcagtggaaagaggcgaaaggcggggaaatctgtgagcagctgagagccttgggtgctagtctggactgggatcgggagtgctttacaatggacgtaggctcctccgtcgccgtaaccgaagcctttgttcgactgtacaaagccggcctcctttaccggaaccatcagttggtcaattggtcatgcgcactcaggtccgccatttctgacattgaagtggagaaccgcccactgccaggccatacacagctgaggcttcctggttgcccgactcccgttagcttcggactgttgttctcagtagctttcccagtggatggtgaaccagatgccgaggtagtcgttgggacgacgagaccagagacactccccggagacgtggcagtggccgtccatccagatgacagccgctacactcatctgcatgggcggcagctgaggcatcctctaatgggtcagccccttccacttatcaccgactacgcggtacagcctcatgtcggtacaggggccgtgaaggtgacccctgcacactccccagccgacgccgagatgggcgcacggcatgggctgtcacctttaaacgtaatcgccgaagacggtactatgacttctctttgcggggattggctgcaggggttgcacaggttcgtggccagggagaagataatgtccgtgctgtcagagagagggctcttccgcggcttgcagaatcacccaatggtcttacctatatgtagccgatctggcgacgttatcgagtacctcctcaaaaaccagtggtttgtacggtgccaggaaatgggagcgcgcgcggcaaaagcagtggagagcggtgctctggagctcagcccatcttttcaccagaagaactggcagcattggttctcccatattggtgattggtgcgtcagccgccagctgtggtggggacatcagatcccagcttaccttgtcgtcgaggatcatgcgcagggggaagaagattgctgggttgtgggcaggtcagaggcagaagcacgagaggtggcagctgaactgactgggcgtcccggagcagaactcactcttgagcgagatcctgacgtcttagacacttggttctctagcgcactgtttccttttagcgcattaggatggccgcaggagacaccagatctagcccggttctatcctctgtcactgctcgagaccggctcagatctcttgctcttctgggttggcaggatggtgatgctggggacacagcttacagggcagctgcccttttccaaggtgctcctgcacccaatggtaagagaccggcaggggaggaagatgtcaaagagtctggggaacgtgctggatcctagggatatcatttcaggggtggaaatgcaggtactgcaggagaaattaaggtctggcaaccttgatccagcagaactggccattgtggccgcagcccaaaaaaaagattttccgcatggcatccctgaatgcggtacagatgcgttgagattcacgctctgcagccatggggtccaggctggggatctccacctgtccgtctccgaggtgcagtcctgcaggcacttctgcaacaaaatctggaacgcattgcggtttattctgaatgctttgggtgaaaagtttgtgccacagcctgcagaggaactcagtccatcctccccaatggatgcctggatcctcagtcgcctggctctcgccgcccaggagtgtgagcgcggattcttgactagggagctgtccctggtgactcacgccctccaccacttttggctacataatctttgcgacgtgtacctcgaagcagtgaagcccgtactctggcactctcctagacctctcgggccgccccaggtgctgttttcctgtgcggatctcgggctgaggttgctcgcacctctgatgcctttcctcgcggaggaactctggcagcggcttccgccccgtcccggctgccccccagctccttcaatctccgtcgcaccatatccctccgcttgctctttggaacattggaggcagcctgagttagagcggcgcttcagcagagttcaggaagtcgtgcaggtgctgagagccctgcaggcaacataccaactcactaaggctcgcccccgtgtactactgcaatcaagtgagccaggggatcagggcctctttgaagcctttctcgagcctctcggcactctgggatattgtggggctgttgggctgcttcctcccggtgctgctgcgcctagcggatgggcgcaagctcccctgagcgataccgcccaggtttacatggaacttcagggcctggtagatccccagattcagcttcccctacttgcagcaaggagatataaactgcagaaacagttggactctctgaccgccagaaccccatcggaaggagaggccgggacccagagacagcaaaaactatcgtccctccaattagaactcagcaagctcgataaggctgcaagccatcttcggcaattgatggacgaaccacctgcccctgggtcaccggagctctag

SEQ ID NO: 34667 - DNA, 348 bp, Artificial Sequence
  Description of Artificial Sequence: Synthetic coding sequence
atgcctcacctgccactggcctccttccgccccccattttgggggttacgtcattccagaggcctgcctaggtttcatagcgttagtacgcagagcgagcctcacgggtctccgatcagtaggagaaatcgcgaggctaagcagaaaaggctgagggagaagcaggcgaccctggaagcagagattgctggcgagtccaagagcccagctgagagcattaaggcatggcgccctaaagagcttgtactctatgaaattcctaccaagcctggggaaaaaaaggatgtttctgggcctctacctcctgcttatagccctcgctacgttgaggctgcgtggtacccttag

SEQ ID NO: 34668 - DNA, 2772 bp, Artificial Sequence
  Description of Artificial Sequence: Synthetic coding sequence
atgtgtattcctcctcccaatgttactgggtcactacacatcggccacgcactgaccgttgctattcaggacgccctcgtgagatggcaccggatgagaggcgatcaggtgctgtgggtgcccggatctgaccacgccggaattgcaacccaggctgtcgtggagaaacaactgtggaaagagcggggcgtgcgccggcatgagctctctagagaagcattccttcgcgaagtctggcaatggaaagaagctaagggaggcgagatttgtgaacagctgcgtgctctgggcgcgagccttgattgggacagggagtgtttcacaatggacgtggggagttcagtggctgtgactgaggcattcgtgaggctctataaagctgggctgttataccgcaaccaccaactagtgaactggtcttgtgccctccgcagcgccatcagtgatatagaggtcgaaaacagaccccttccaggccacacacagttacgcctgccaggctgccccacacccgtctcattcgggttgcttttcagcgtggcctttcccgttgatggtgagcctgatgcagaggtggtagtgggcactactcgccctgaaacattgccaggcgatgttgctgtggctgttcaccccgacgattctagatatacccacctgcatggacggcagctgcgccatccgctgatggggcaaccgctccctttaataactgattacgcggtgcagccccatgtggggacaggagctgtgaaagtgacccctgctcacagtccagccgacgctgagatgggagctcgacatggcttatctccgcttaacgtgattgcggaagacggcaccatgactagtctgtgtggtgactggttacagggcctccaccggttcgttgcacgtgaaaagattatgtccgtcctgtccgagagggggttattcaggggcctgcagaaccatcccatggtcctccccatctgtagcagatctggagacgtcattgagtacctcctcaagaaccagtggttcgtgagatgtcaggagatgggggcccgggccgcgaaagccgtcgagagtggtgccctggaactttcaccctcctttcaccagaagaactggcagcattggttctcacatatcggggattggtgcgtctctcggcagctatggtggggtcaccaaatccctgcttatctggtcgtggaggaccacgcccaaggcgaagaggattgttgggttgtcggaaggtccgaggctgaagctcgggaggtagccgctgagctgaccgggagacctggtgccgagctgaccctggaaagagatcccgatgtcctggatacatggttttcaagcgccctatttcctttctcagccctaggctggcctcaagagactccagacttagcaagattttatccgctgagcctgctggaaaccggctccgatttacttctgttttgggtggggaggatggtgatgctgggcacccagctaaccggtcagctgccgttctcgaaagttctgctgcatcctatggtgagagaccgccagggccgaaaaatgtcgaaaagtcttgggaatgttctggatccacgggatatcatatctggggttgagatgcagctgctccaggagaaactcaggagtgggaatttagacccggctgagctcgctatagtcgccgccgctcagaaaaaggatttcccccacgggatcccggagtgcggcacagacgcactcaggttcaccctctgctcacatggggtgcaggcaggggacctgcacctgagcgtcagtgaagtgcagtcgtgtcgccatttttgcaacaagatttggaatgcactgagatttatcctgaacgcactcggtgaaaagtttgtcccacagcccgctgaggaattaagccccagtagccctatggacgcttggattttgtcccgattagccttagcagcccaggagtgcgaaaggggcttcctgacaagggaactctcactggtaacacacgcactacaccatttttggttacataatctctgtgatgtttaccttgaagctgtgaagcccgtactgtggcactcaccgcgccccctcggtccaccccaggtgttgttcagctgcgccgacttgggcttacgtctactggccccactgatgccctttctcgcagaggaactctggcagcgcctaccaccccgcccagggtgcccacctgcccctagcatctctgtcgcaccctatccatcagcttgcagtctcgagcattggcggcagcccgagctcgaaaggcgattctctcgtgtgcaggaggtggtacaggtgctgcgcgcactcagagccacataccagctgaccaaagctaggccccgagttctgcttcaatcaagtgagcctggagatcaaggtctgtttgaggcctttcttgaaccacttggtacattaggatactgcggcgcggtggggctgttgccaccagggactgctgcaccgtctggctgggctcaggcccccctcagcgatacagctcaggtgtacatggagctgcagggactggtcgatcctcagattcagctgcccttgttggcagctcgccggtacaagctccagaaacagctcgattccttgactgccagaactccttcggaaggtgaggccgggacccagcgacagcaaaaactcagcagtctgcaacttgaattatccaagctggacaaagccgcctctcacttgcgacagctcatggacgagccgcctgccccagggagtcctgagctctag

SEQ ID NO: 34669 - DNA, 3282 bp, Artificial Sequence
  Description of Artificial Sequence: Synthetic coding sequence
atgggcggaaaggcctggccacgccgagccgtggggactgccggaggaccctgtgctgagcaaatctctgccccattccagaccctccttatgccccacctgcctctggcatcctttcggccaccattctgggggcttcgacactcccgggggctgccccggttccactcagtgtccacacagtccgagcctcacggctctccaataagtaggcgcaatcgcgaagcaaagcagaaaaggctgcgggaaaaacaggctacactggaggctgagattgccggcgagtccaagagccctgccgagagcatcaaagcatggcgccctaaggagttagtgctgtatgaaataccaacaaagcctggagagaaaaaagacgtgtcaggccctctgccaccagcttacagccctagatacgtcgaggctgcttggtacccctggtgggtccgcgaaggcttttttaaacccgaataccaggcaagactgccccaagcaacaggagagacattcagtatgtgtatacccccaccgaatgtgaccggctcactacatatcggacatgcactgaccgtggcaattcaagatgcactggtccgatggcaccggatgcgaggcgaccaagtcctgtgggtgccaggcagcgatcacgcaggtatcgcaacacaggccgtggttgagaaacagctgtggaaggaaagaggagtacgaaggcatgaactcagccgagaggcatttttacgagaggtatggcagtggaaagaggctaaaggcggggaaatttgcgagcaactccgggctctgggcgcgtctctcgactgggaccgggagtgttttaccatggacgtgggcagctcagtggccgttactgaagcctttgtgcgcttgtacaaagccggacttttgtatagaaaccaccaactggtaaactggagctgtgctctccgtagtgccatctccgacatagaggtggagaaccgccccttgccagggcatacacagcttcgcctaccgggttgtccaacacccgtcagctttgggctcctcttcagcgtggcctttcccgtggacggcgaacctgacgctgaagttgtggttgggacaacacggccagaaactctgcccggtgacgttgcagtggcagtccatcctgatgattcccgctatacccacctccatggccgtcaactgcggcatcctctaatgggtcagccgctgcccttgatcaccgactatgccgtacagccccacgtgggaactggggctgtgaaagtcacccctgcccactctccggctgacgccgagatgggagctagacacgggctgtctcctttaaatgttatagccgaagatggtacaatgactagcttatgtggggattggctacaaggacttcaccgatttgttgccagagagaagattatgtccgtcctgagcgagaggggactctttaggggtttgcagaatcaccccatggtgctgcccatttgcagccgtagtggcgacgtcatagagtacctccttaagaaccagtggtttgtgaggtgccaggaaatgggtgcccgagctgccaaagcggttgagtctggagctctagaactatccccttctttccaccagaagaactggcaacattggttttcccatatcggggactggtgtgttagcagacagctctggtgggggcaccagatccccgcatacctcgtggtagaggatcatgcacagggcgaagaagactgctgggtcgtggggcggtcagaagcggaagccagggaagtcgctgcggaattgactggacgacctggggctgaattgacgctggagcgggatcccgacgtgctggatacctggttttcttccgcactgttcccttttagcgccttaggttggccacaggagaccccagatctggcgagattctaccccctgtcactactagagaccggatctgaccttctcctattttgggtcggtcggatggtaatgttagggacgcagcttactgggcagctgccattctccaaggtgctgctacatcccatggtgcgagacaggcagggtcgcaagatgtccaaaagcctgggtaatgtccttgatccaagagatataataagcggggtggagatgcaggtgctgcaagagaagttacgcagcggcaacctggatccagccgagctggccatagtggctgctgcccaaaaaaaggatttcccacacgggatcccggagtgtgggacagacgcgctcaggtttacactctgtagtcacggtgtgcaggctggggatctgcatctgagcgttagcgaggtgcagagttgtaggcacttctgcaataaaatctggaacgcacttaggttcatcctcaatgctctgggagaaaagtttgtcccccagcctgcagaagaacttagtccatctagccccatggatgcttggattctcagcagactagcgctggccgcccaggagtgtgagagaggttttctcacacgcgagctttccctggtgactcacgcccttcatcatttttggctacacaatctctgcgacgtttatcttgaggcagtgaagccagttctctggcacagcccgagaccactcgggccaccccaagtcctcttcagttgtgctgacttgggactgcggttgctggcccccttaatgccttttctggccgaggaactctggcaaagattgccacctaggccaggatgtccccccgccccgtcaatttctgtggccccttatccaagcgcgtgtagcctggagcattggcgccagcctgaacttgagcgcagatttagcagagtgcaggaggttgttcaggttttgcgtgccctgcaagctacctatcagctgaccaaggcacgcccaagagtgctccttcagtcttccgaaccaggtgatcagggcctgtttgaggccttcttggaacccctcggcacactggggtactgcggcgcagtagggctgcttcctcctggagcggctgcgcctagcggttgggcgcaagccccactgtcggacacagcccaggtctatatggagctgcaagggcttgtcgatcctcagatccagttgcctcttcttgctgcgcgaaggtacaaactgcagaagcagctggactcactaaccgcccggaccccttctgagggagaagctggaactcaaagacagcagaaactatcttcactgcagctggaattgtcgaagctggataaggcggcctcccatttgcgacagctgatggacgaacctcctgctcctggatcaccagaactgtag

SEQ ID NO: 34670 - DNA, 2772 bp, Artificial Sequence
  Description of Artificial Sequence: Synthetic coding sequence
atgtgcatccccccaccaaacgtgactggcagcctccacattgggcacgcactgacggttgctatccaagacgctcttgtgcggtggcaccgaatgcgcggagaccaggtgctgtgggtccctggctcagaccatgccgggatcgcgacacaggcggtggtggagaagcagttgtggaaggagagaggggtaaggcggcatgaactctcacgggaggcttttctgagggaggtctggcagtggaaagaggccaaagggggcgagatctgcgaacagctacgggccttgggggcctcgctcgattgggatagggaatgctttacaatggatgtgggatcttccgtggccgtcaccgaagcttttgtcagattgtacaaggcaggcttgctctatcggaaccatcagctcgtcaactggagctgcgctctcagatctgccatcagtgatatcgaggttgaaaacagaccactgccggggcacacacagcttcgcctgcctggatgccctacacccgtgagctttggtctgttgttctctgtggcttttccggtcgatggagagccagacgccgaggtcgtggtcgggacaaccagaccagaaaccttgccaggagatgtcgccgtcgcggtccatcctgatgattctcgttatacccatttgcacggccgacagctgcggcaccccttaatgggccagcctttgcctcttattacagactatgcagtacaaccccacgtggggaccggggcagtgaaagtgacccccgctcattcacctgctgacgccgaaatgggcgccaggcacggtctgagccccctcaacgtgatcgctgaagacgggactatgacctcactgtgtggggactggctgcagggattgcatcgcttcgtggccagggagaagataatgagtgttctgtcagaacggggcttatttagaggactccagaaccaccctatggtgctccctatctgcagcagaagtggggacgtcattgagtatctgctgaaaaatcagtggtttgtgagatgtcaggagatgggcgctagggcagctaaggcggtcgaaagcggcgcgctggaactgtctccctccttccatcaaaagaattggcagcattggtttagtcacatcggggactggtgcgtctcccggcagctatggtgggggcatcagatcccagcgtacctggtggttgaggaccacgcccagggtgaggaggattgctgggtcgttggacgatccgaagcagaggcaagagaagtggctgccgagcttaccggccggcctggggcagaactcacactcgagagagaccctgatgtcctggatacctggtttagctcagcactgttccccttctctgccctcggctggcctcaggaaacccctgacctcgcaaggttttatcccttgtcattgcttgagacaggttcggacctgctgctgttctgggtgggtaggatggtgatgctgggcacccaactcacaggccagctgcccttcagtaaagtgctgctgcaccccatggtaagggatcggcagggcaggaaaatgagtaagtccttaggtaacgtgttagatccaagagacattatcagcggggttgaaatgcaggtgctgcaagagaagctcaggagcggcaaccttgacccagcggaactggcaatcgtagccgccgcgcagaagaaagactttccacatggtatcccggaatgcgggacagacgcactgaggtttaccctgtgcagtcacggtgtacaggcgggcgatctccatctttcggtgagtgaggtgcagagctgccggcacttctgcaacaaaatctggaatgcgttaagatttatcctgaatgccctgggagagaagtttgttccgcaaccagctgaagagctcagcccgagttcacccatggatgcctggatactatccagactggccctggcggcgcaggagtgcgaaagaggctttctgacacgcgagttgtctttagtcactcatgcactgcatcatttttggctccataacctgtgtgatgtctatctcgaggcagttaagccggtactttggcacagtcctagacctctgggtccaccccaggtgctattcagctgcgcagaccttgggttgcgactgcttgcaccacttatgcctttcctggctgaggagctttggcagcggctgccgcctcgtccaggttgtccgcccgcaccatccatatccgtagccccctacccttccgcctgttctctggagcactggcggcaacctgagctggaacggcggttttcgcgcgtgcaagaggtggtgcaggtgctcagggctctgcaggcaacttatcagttgacaaaggccagacctcgtgtgctgttacagtcttcagaacccggcgaccaggggctgtttgaagcctttcttgaaccattgggaactctcggctattgcggggccgtgggcctgctccccccaggagctgctgctcccagtggatgggctcaggctcctctgtccgatactgcacaagtgtatatggaactacagggactggttgacccacaaatccagttaccactgctcgccgcaaggagatacaaattgcaaaaacagctggatagtcttactgcaaggactccaagtgagggtgaagccggcacccagcggcagcagaagctctcaagcctgcaactggaactctccaaattagacaaagcagcctctcacctccggcagctgatggatgagcctcctgctcctggttcccccgagctgtag

SEQ ID NO: 34671 - DNA, 774 bp, Artificial Sequence
  Description of Artificial Sequence: Synthetic coding sequence
atgcctcatctgcctcttgcctctttccgaccgccgttttggggcttgcggcattctcggggactgccaagatttcattccgtttccactcaatctgagccccatggtagtcctatcagccgcagaaatcgagaggcaaagcagaaacgcctgagggaaaaacaagccacactggaggctgagattgctggagagagtaagtcgcctgcagagtctatcaaagcctggcggccaaaagagctcgtactgtatgaaatcccgacaaaaccaggagagaagaaggatgtttcgggacccttgcctcctgcttacagccctcggtacgtggaggcggcttggtacccgtggtgggtccgcgagggcttcttcaagcccgaataccaggcaagactgcctcaggcaaccggagagaccttttccatgtgtatccctccacctaacgtgaccggtagcttgcacattggccatgctctgacagttgcaatacaagacgcactggtccgatggcataggatgcggggggatcaggtgctttgggtcccaggcagcgaccatgccggtatcgccactcaggccgtcgtggagaagcagctgtggaaggagaggggagtaaggagacacgaactgagtcgagaagcgtttctgcgagaagtgtggcaatggaaggaagccaaagggggggaaatctgcgaacagctgagagccctgggcgcttcactcgactgggatagagtcttctatcatggatgctggctgctaagtggatgcgattag

SEQ ID NO: 34672 - DNA, 639 bp, Artificial Sequence
  Description of Artificial Sequence: Synthetic coding sequence
atgcccaccacttgccactgtgtggctatcactccaccggacagtggggggagcccaagtagccccgcaggcgggagtcccagtcccgcccctgctgccggcgccgccgagttaagcccagccactccaacagggagtgcaaaccccaccacctcgtcttgcgccggaggcacgcccgcagcatcgctccttcggtgggtgcgctcgtgttttctccgcttggacgatacaacaaaggacttccctcatgcactgcaatggaaaggccggtccccagaatgtacgcggctatgctttgtgagattggcacgatcagcgaaagctcggccgcactcaagccagcggaagggaagatggccggaatgtaccagtgcttgccggctgcggtctcaggacgccaccaacgttctaagtcactgtcggcacctgaacgggagatctcccgtgtgtaccaggcggtgcatggcgcggagcgcggggtgtagaaaaagtttgccgcactttagccaatggtatggtttcacaccgtcttgggctagatggtggaggagaaagcttgaagggagcgagaacatgcgccctcaacgcggtcaccgcaaagggtttagcccagaatgcgtgcggagttggttgtggtag

SEQ ID NO: 34673 - DNA, 1233 bp, Artificial Sequence
  Description of Artificial Sequence: Synthetic coding sequence
atgggagcggtgtcctgcaggcagggacagcacacccagcagggagagcatactagagttgccgtcccccataagcaggggggaaacattcgcggcccatgggcccgcggttggaaatctctctggaccggtctgggcaccattcgtagtgacctcgaggaactgtgggaactgcgagggcaccactacctccatcaggagagtctaaagccggccccggtgttggtcgaaaagcctcttcccgaatggcctgtaccacagtttatcaacctgttcctgcctgagtttcctatccggcccatccgaggacagcaacagcttaaaattctcggtcttgtcgctaaaggcagtttcggaactgtgcttaaagtattggattgcactcagaaagccgtgtttgccgtgaaggtcgttcctaaggttaaagtcctgcagcgggacacggtgagacaatgtaaagaggaagtttccatccagagacaaataaaccacccttttgtccactcacttggcgactcgtggcaaggcaagaggcacttgtttatcatgtgtagctattgctctacggatctgtactcattatggtccgccgtcgggtgctttcccgaggccagtattcggctgttcgctgccgaattggtgctggtcctgtgctacctgcacgacctgggcattatgcatagggacgtgaaaatggaaaacatattgctggacgagagagggcatttgaagctgacagattttggcctcagccgccacgtcccacagggggctcaggcttacaccatttgtggcacactgcagtacatggcccctgaggtccttagtggggggccatataaccacgcagctgattggtggtcgctcggcgtactactgttttctctggctactggcaagttccctgtggcagctgagcgcgaccatgtggccatgctggcctctgttacgcactctgactcagaaatccctgcttcattgaatcagggcctctcgctgctgctccacgaactgctgtgccaaaatccgctgcaccgtctgaggtacctccaccatttccaggtgcatccgtttttccggggtgtggccttcgaccctgaactgttgcaaaaacagcctgtgaacttcgtgaccgagacacaggccacacagccctcgtcggccgaaactatgccattcgatgacttcgattgcgatctggagagcttcttgctctatcctataccagcctag

SEQ ID NO: 34674 - DNA, 447 bp, Artificial Sequence
  Description of Artificial Sequence: Synthetic coding sequence
atgggggcagtgtcctgcaggcagggccaacacacccaacagggggaacatactcgggtggccgttccacacaaacagggcggtaacattcgcgggccatgggctcggggatggaaaagcctctggacagggctcggaactattcgatctgacctggaagagctctgggagctgcggggccatcattatctccaccaagaatcacttaaacctgccccggtcttggtggagaagcccttacccgagtggccggttcctcaatttattaatctgttcttacctgaattcccaatcagacccattcgaggccagcagcaactgaagatcctcggactggtggcgaagggcagtttcggcaccgtgctgaaggttcttgattgcacccaaaaggctgtgtttgcggttaaggtggttccaaaggtcaaggtgctgcagggcattccctag

SEQ ID NO: 34675 - DNA, 516 bp, Artificial Sequence
  Description of Artificial Sequence: Synthetic coding sequence
atgggggccgtaagctgccgacaggggcagcacacccagcagggcgagcacactagagtggcagttccacataaacaggggggtaatattcggggaccctgggctaggggatggaaatcgctgtggaccgggctgggtacgatcaggagtgacttggaagaactgtgggaattacggggtcaccattacctgcaccaagaatcactaaagccggccccagtgctcgttgagaagcctttgcccgaatggccagtccctcagttcattaacctgttcctgccagaatttcctatccgtccaattcgtggccagcaacagctgaagatacttggcctcgtggccaaaggaagctttggcacggttctgaaagtgcttgattgcacccagaaggccgtgttcgccgtaaaagttgtgccaaaagtaaaggttctgcaacgtgatacggttcggcaatgcaaggaggaggtgagcatacaagtgattagtatgacttgggctagctgcattgaaatgtag

SEQ ID NO: 34676 - DNA, 516 bp, Artificial Sequence
  Description of Artificial Sequence: Synthetic coding sequence
atgggagctgtgtcctgccggcaaggacaacacacgcaacagggtgagcacactagggtcgcagtgccccacaaacagggtgggaatattagaggcccatgggcccgcggatggaagagcctgtggaccgggctgggaacaattaggagcgaccttgaggagctatgggagctgcgaggtcatcactacctgcatcaggaatcactgaagcctgcgccagtcctggtcgaaaagccactaccagagtggcctgtcccacagttcattaatctgttcctccctgagtttcccattagacccattaggggccagcagcagttaaaaatcctgggactcgtggctaagggctcgtttggcacagttctgaaggtcctggattgtacccaaaaagctgtgttcgcggttaaggtggtccccaaagtgaaagttttacaaagagataccgttaggcagtgcaaagaagaggtctccattcaagtgatctcaatgacctgggctagttgcattgaaatgtag

SEQ ID NO: 34677 - DNA, 441 bp, Artificial Sequence
  Description of Artificial Sequence: Synthetic coding sequence
atggctgcaagccgactggagttaaacctcgtgcggctcctgtctagatgcgaagccatggcagccgaaaagcgcgaccctgatgaatggagactggagaagtatgtgggggcactggaggacatgctgcaggccttaaaggtgcacgcgtctaagccggcatccgaggtgattaacgagtactcctggaaggtcgacttccttaaaggcatgcttcaagccgagaaactgacctctagcagtgagaaggctttagccaatcagttcttggcccccggccgtgtccctacgacagccagggaaagggtgcctgccactaaaactgtgcatcttcagtcaagagctaggtatacatccgagatgcggtcggaactcctgggaaccgcagaagctgagcctgagatggacgtgcggaaaagaactccttgtcatacccattag

SEQ ID NO: 34678 - DNA, 780 bp, Artificial Sequence
  Description of Artificial Sequence: Synthetic coding sequence
atggccgcctccaggctcgagttgaaccttgtacggctgttgtcacgctgtgaggctatggctgctgaaaagagggaccctgacgagtggagactcgaaaagtatgtcggggcactggaagacatgctacaagcactaaaggtccacgcatctaaaccggcctcagaggtcattaacgaatattcctggaaagtcgacttcctgaaagggatgctccaggctgagaagctgacctcatcaagcgagaaggccctcgcaaatcagttcttggccccaggcagagtccctaccaccgctcgggagcgcgttcccgctaccaaaacagtgcatctgcagagccgcgcgcggtacactagcgaaatgcgctccgaactcctgggtacagccgaggcggagcccgagatggatgtcagaaaacgtaccggagttgctggaagccagcctgtgtccgagaagcaactggccgccgagctggatctggtcctgcaaagacatcagaatcttcaggagaagctggccgaggagatgttggggcttgcccgatcattaaagacaaataccctggcggcccaatctgttatcaagaaggataaccagaccctcagccattccctgaaaatggccgaccagaatctggaaaaactgaagaccgagagcgagaggctggagcaacacacccagaaaagcgtgaattggctgctctgggccatgcttataattgtttgcttcatctttattagcatgatcctgttcattcggataatgcccaagttgaagtag

SEQ ID NO: 34679 - DNA, 2661 bp, Artificial Sequence
  Description of Artificial Sequence: Synthetic coding sequence
atgcgccccgattgtaactctcagaagccttcccaggccctctccatcagagacacgagttcaaaagacccgtggccggacattgagccacaacttcctgctactcccgctgccgtttggggggtgtttactttcagctggcggggagccggggccctgggtccgcgcagaggtcctcggagactaaacaataagcggggcgccgccaaacgccaggaagataaaaccatgtcgaaagggccgggcccgggtggttctgccgcctcctcagctccccccgccgcgacagcccaggtccttcaagctcaaccggagaaaccccagcattacacttacctgaaagagtttaggacagagcaatgtcctttattcgtgcagcataaatgcacacagcaccgtccatacacttgtttccactggcactttgttaaccagaggcggcgccgctctatccgcaggagagacggcaccttcaattatagccctgatgtttactgtactaagtatgatgaggcaacaggactttgccctgaaggcgacgagtgtccttttctgcataggactaccggcgataccgagcgcaggtaccatcttagatactacaagaccggaatctgcatccatgagaccgattcaaagggcaactgtacaaagaacggcctgcactgtgcattcgcccacgggccgcatgacttgcgctcccctgtgtacgacatccgtgagctgcaggctatggaagccctgcagaacgggcagacaaccgtagaggggtcaattgaaggccagtctgctggagccgcttcccacgccatgattgagaagatcttaagcgaagaaccacgctggcaagagacggcctatgtgcttggcaattataaaaccgagccctgcaaaaagccaccacggttgtgccggcagggctacgcttgtccatattatcacaactcaaaggataggcggagatcaccccgaaagcacaagtaccgctcctcaccatgcccaaacgttaagcacggggatgaatggggtgatcccggcaaatgtgagaatggcgatgcgtgtcagtattgccatacaagaacagagcagcagtttcacccagagatatacaagagcacaaagtgtaacgacatgcaacaaagtggttcctgtccgcgtgggccattctgtgccttcgctcacgtggaacagcctcctctgagcgacgatcttcaaccatccagcgccgtgtcaagtcctacacagcccggacctgtcttgtacatgcccagcgccgcgggggattccgtgcccgtcagtccttcatcccctcacgcccccgacctgtccgcactgctttgccgtaactcctctctgggctccccatctaacctgtgcggcagcccacccggttcaattaggaagccgcctaacctcgagggaatcgttttccccggagaaagtggacttgctcctggtagttacaaaaaggcccctgggttcgaaagagaagatcaagtcggcgccgagtacttaaaaaactttaagtgtcaggcaaaattgaaacctcattcgctggaaccccgtagtcaggaacagccgctgctgcagcccaagcaggacatgcttggtattctgcctgccggatcccccctgactagctcaatttcatccagtataacatcaagtcttgccgccacacccccatcccccgtcggtacctcgtcagtgcctggaatgaacgctaacgccttacccttttatcctacatcagatacagttgagtccgttatcgagagcgcgctggatgatttagatctcaacgagtttggagtcgctgccctggaaaagacctttgataatagcactgtccctcaccccggtagtatcaccatcggggggtccctgctccagtctagcgctcctgttaacattcccgggagccttggaagctccgcaagttttcattccgcctctccctcgccccccgtgtctctgtctagccatttcctgcagcagccacaggggcacctgagccagtctgagaacacattcctcggaacttccgctagccatggaagtttagggctcaacgggatgaactctagtatttgggaacacttcgccagcggctcgttcagccccggaactagccccgcattccttagtggccctggcgcagctgagctggctcgactgcgccaggagttggatgaggctaactccacaataaagcagtgggaggaatcttggaaacaggcaaagcaggcatgcgacgcctggaaaaaggaagctgaggaagccggcgagagggcttccgcagcaggagctgagtgtgaactagcacgagagcagagggacgccctggaggtccaagttaagaaacttcaggaagagttagagaggctgcatgcaggaccggaacctcaggcccttcccgccttttcagatctcgaggcactttcactgtcaacgctgtatagtctccagaaacagttgcgcgcccacctggagcaggtggacaaggctgtgttccacatgcagtcagtgaagtgcttgaaatgtcaggaacaaaagcgtgccgtccttccctgtcagcacgccgctctttgcgagctatgtgctgaaggctctgaatgtcctatctgccagccagggagagcgcacaccttgcagagctag

SEQ ID NO: 34680 - DNA, 510 bp, Artificial Sequence
  Description of Artificial Sequence: Synthetic coding sequence
atggtgagctccaagggactgtggaaagaacggccatcagctcacacatctgagtgcttttccacaacagcctgtcccgtggccttcatcttactggtgtggaactcgcaaacaccagctggcctacaatccctctgcactggacgccacccatccttgagcgctcgggctcaacgcgccgggccacgcgcctcccgcgaggaggggacattctggacggaaagggtgggtcaagaaagatggctgattcggagcggatcgagccagaatgaaagccaagaggatcagggtgcagggctgatctctcaggccggactcaaagcggacaaccgacgggagtctagtacatgggcgaatgaagtcgaggaccgtcgaccacaatgtactccggctctgaatctcacgccgtcccaccctcatcccccacatagtctgaccaccttcctcaggtccgtcattggcatccagattcctcctggcctcgtggctgcaggtggaaccgttgcttag

SEQ ID NO: 34681 - DNA, 510 bp, Artificial Sequence
  Description of Artificial Sequence: Synthetic coding sequence
atgggatcctctaagggcctttggaaggaaaagcctagtgctcacacttcagagtgcttcagcaccaccgcttgtcccgtggcctgcatcttactggtttggaattctcagacgcccgcagggttgcagtcattatgtaccggtcgacatcctagcctgtccgcaagagctcagtgggccggccccagggcttcacgtgaggaggggactttttggactgagcccgttggccaggagagacggctgatcaggagcgggtcgtctcagaacgagtcgcaagaagaccagggcgccgatctcatatctcatgagggtcttaaagcagacaatcagcgagagtcttcaacctgggccaacgaggtcgaggaccggaggccgcagtgcacttccgccctcaacctgacgccttctcacttacatccaccacaccctctgactacgttcttccgcaatgtcatcggaataaaaattcccccgggtcttgttgcgatggggggcacggtagcctag

SEQ ID NO: 34682 - DNA, 972 bp, Artificial Sequence
  Description of Artificial Sequence: Synthetic coding sequence
atgaaaaatgttgactctgacgatctggtgactgggaccttacctaagctgaaaagttccaaggagtggctggagcccaagcccctatgcttcatggaggtcctagcgaaagaggacacggaggctgccatccagtcaatcttatataaggaaaattctgtaatcaaagagttagacaagtatctccagcaccatgcttttctgaatgcccgccgtaaagagatgctctacaagcgctgggtcgactgtgtggccgatcccttgcagaaaaagatcatcgaaaaagtttgctcccacaaaaaaataaagaaacggagacagggcgagctggacggattcctgaagcatgttaataagaagggaaatgcatttatcgaacactacgatccgaaagaatacgaccctttttatatgtccaagaaagacccaaatttcctaaaggtgacaatcccaccattccacgaccctttaaagaaggcgcagtacgacaaagacaacgagaagaggacattactccagtgcgagactgggaagatctactcgattaaggagttcaaggaagtagagaaggtgcagctccactctaggttcccccagattagcaattcacggcacttcatcactcctaacgaatggctgaaacttcccacacgatatatcgagtcggagttttgtagacggcgcaggctgaaggtgaaagtgaatttcaacgattgtagttttgaccttaagccgctggcgcgtgccccttacctgctcgaatctcaggaggaagagaagaccgtcatatataaaaataaaggtagcagttttctggaaagggaacctctgtgttatcaggaaggcaataatccttccgctaaggaagccatatccgaaggctacttctctagtctgagtctgcaggaacgggaagaggatcaagacggttcccctagcccaagactagggctcttgaagctggagctctag

SEQ ID NO: 34683 - DNA, 2592 bp, Artificial Sequence
  Description of Artificial Sequence: Synthetic coding sequence
atgctggaaagttatgtcaccccgatcctcatgtcatacgtgaacaggtatatcaaaaacctgaagccttccgatttgcaactcagcctgtggggaggagatgtcgtgctctctaaactggagctcaaacttgacgttctagagcaggagttgaaactcccttttacctttttgtccggacacattcacgagctccggatccatgtcccttggaccaagctcggctctgaacctgtggtgatcactatcaacaccatggagtgtattcttaagttgaaggacgggatacaagatgatcacgagagctgtggttctaattcaaccaaccgcagtactgccgagtccaccaaatcctctattaaacctaggcggatgcagcaggcagccccaacggatcctgatctcccccccggttacgtccagtcactgattcgccgcgtggtgaacaatgtgaacatcgtgatcaacaacctgatattaaaatatgtggaagacgacatcgtgctaagtgtgaatataacaagcgctgaatgctatactgttggcgagctgtgggaccgagcgttcatggacatttcagcaacggacctagtgttgagaaaggttatcaactttagcgactgcacagtgtgtctggacaaacgtaatgcctctggtaagattgaattctatcaggatcctctgctctataaatgctcctttcggacaaggctgcactttacatacgagaacttgaactccaagatgccgagtgtgatcaagatacacactctggtagagagtctgaaactgtctattacagatcagcagttacctatgttcattcgtatcatgcaactgggcatcgcgttgtactacggggagatcgggaacttcaaggagggagagatcgaggatctcacttgtcacaacaaagatatgcttggtaacatcacgggctcagaggatgagacaaggattgatatgcagtaccccgcccagcacaagggccaggagctttattcccagcaggacgaggagcagccccagggctgggttagttgggcctggagttttgtcccggccatcgtctcttatgatgacggcgaggaggacttcgtggggaacgaccctgcctctactatgcaccagcagaaggcccagacattaaaggacccgatagtttcgattggtttctactgtaccaaggctaccgttaccttcaagctgaccgagatgcaggtggaatcatcttactactcccctcagaaagtcaagagtaaagaagtcctctgttgggagcaagaggggaccacagtagaggcgctcatgatgggcgagccatttttcgactgccaaatcggctttgtgggttgcagagcaatgtgtctgaagggcatcatgggggtcaaagatttcgaggagaacatgaatagatctgaaactgaggcttgcttctttatctgtggggataacctgtctacgaaaggcttcacatatctgacaaactcactgttcgactacagaagcccggagaacaatggaacccgtgctgaattcattctggacagcactcaccacaaggaaacctacaccgaaattgcaggaatgcagcgatttggagccttctatatggactatctctatactatggagaatacaagtggtaaaggcagcaccaaccagcaggatttctcttccgggaagagcgaggacctgggaacggtgcaggagaaatccaccaagtcgctggtaataggccctttagacttccgcctcgattcttcggccgtccacaggattctcaaaatgatcgtatgcgcgctggaacacgagtacgagccgtactcaagattgaaatcagacatcaaagacgagaatgagaccatcctgaacccggaagaagtggccctactggaagaatacatcccgactagacacacctcggtgaccttgctgaagtgtacatgcaccatttctatggctgagttcaacctcctcgaccacctcctacccgttatcatgggtgagaagaactccagcaatttcatgaatacaaccaacttccaaagcctgcgcccactgccctccatcagaatcctggtcgataaaataaatcttgaacattctgttcctatgtacgccgagcagctagtccatgtggtatccagtttgactcagccatcagataatctgctccattactgttatgtgcattgttatctgaagatctttggcttccaagctgggttaacatcactggattgtagcgggagttactgtctccctgtgcctgtgattccttccttttcaactgccctgtacggcaaactgctgaagttgccaacatgttggaccaagcgtagccagatagcaattacagaggggatatttgaacttccaaacttgactatccaagcaactagggcccagacgctactgctgcaggcaatataccagtcctggtcccatctgggcaatgtgagctccagcgcagtgatcgaagctctgatcaacgagatcttcctctccatcgaaattggctcctgttatgttgctcaggtcgatctcgaactccttgcatctaatgaccctcctacatcgacctcgtag

SEQ ID NO: 34684 - DNA, 11994 bp, Artificial Sequence
  Description of Artificial Sequence: Synthetic coding sequence
atgctggagtcctacgtaacccctatccttatgagttacgtgaaccggtacatcaagaacctgaagccttcagaccttcagctgtcactgtggggaggtgacgtagtgttgagtaagcttgaactcaagctggatgtgcttgaacaggaattaaagctgcccttcacattcctgagtggccacatccacgagcttagaattcacgtcccttggaccaagcttggatccgaacctgttgttattaccattaatactatggagtgcattctgaagctcaaggacgggatccaagacgaccacgaaagctgtggaagcaatagcacgaaccgctctacggccgagtcaaccaagtctagcatcaaaccccggagaatgcagcaggcggcgcccacagaccctgatctccctcccgggtacgtacagtccttaataaggagagtggtcaataacgttaacatcgtcattaacaacctgatcttaaagtatgtagaggacgatatcgtcctgtctgtaaacattacctccgccgagtgttacactgttggcgagctgtgggacagggccttcatggatataagtgctacagacctcgtactcaggaaagtcatcaattttagtgattgcactgtgtgcctggacaagagaaatgcatcgggcaaaatcgagttttatcaggatccgctcctgtacaaatgctcattccgaaccaggctgcactttacatacgagaatctgaatagcaagatgcctagtgtgatcaaaatacacactctggtggagtctctgaagctctctatcaccgaccagcagttgccaatgttcattcgaattatgcagctgggtattgccttgtattacggcgagataggcaactttaaagaaggcgagattgaagatttgacttgccacaacaaagacatgttaggcaacatcaccggctccgaagatgaaacccgtattgacatgcaatatcctgcccagcacaaagggcaggagctatattcccagcaagatgaggaacagccccaaggttgggtctcctgggcatggagttttgtccctgcaatcgtaagttatgatgacggagaggaggatttcgtagggaacgaccctgcctcgacgatgcaccaacaaaaagcacaaactcttaaggatcctatagtttcaatcggtttctattgcactaaagccaccgtcaccttcaagcttaccgaaatgcaggtggaatcctcctactactcaccacagaaggtgaaatctaaggaagttctgtgttgggagcaggagggcacaacggttgaggctctgatgatgggggaacccttcttcgactgtcagatcggatttgtgggatgcagggcaatgtgcttaaaggggatcatgggggtaaaggactttgaggagaatatgaatagaagcgaaactgaagcttgttttttcatctgtggagataacctgagtacaaaagggttcacctatctgacgaattctctctttgactaccggagtcctgagaacaacgggactcgtgccgaattcatactggattctacccaccacaaggagacttatacagaaatcgccggtatgcagcgattcggagcattctacatggattacttgtacacaatggaaaacacgtcagggaaaggttccacaaatcagcaagatttttcctccggcaagtcagaagacctcggcactgtccaggagaaatcaaccaagtctctcgttatagggcctctggacttccggctcgacagctccgctgtccaccgcattctaaaaatgattgtgtgtgccctggagcatgagtatgaaccatactctagacttaagagcgatattaaagacgagaacgagactattctgaatcccgaggaagtggctcttttagaggagtatataccgactcgccataccagtgtgactctgttgaagtgtacctgcactataagtatggctgagttcaacttgctcgatcacctgttacccgtgataatgggggagaaaaatagcagcaacttcatgaacactaccaatttccagtctttgcgccctttgccatcaattcgcatcctggttgataaaatcaacttggaacactccgttccaatgtatgccgaacaactggtccacgtcgtgtctagtctgacacagccctccgataatttgttgcattattgctacgtgcattgttacctgaaaatttttgggtttcaggccggccttacttccctggattgctccggttcctattgccttcctgtaccagtgatccccagcttctccacagccctgtatggaaaactgctgaagctgccaacgtgctggacaaagaggagtcagatcgctatcacagaaggaattttcgaactgcctaatctgacaatccaggcaacgagagcccagaccctgcttttacaagcaatatatcagtcttggtcccacctgggaaacgtgagtagtagcgcagtgattgaagccctaattaacgagattttcttgtccatcggcgtgaaatcgaaaaacccacttcccaccttggaaggcagcattcagaatgttgagctgaagtattgctctaccagcctcgtgaaatgcgctagtgggactatgggcagcatcaagatttgtgccaaggcacccgtcgattccggcaaagaaaagctaatccccctactgcagggcccctccgatactaaggacctacacagtactaagtggctcaatgagagccgcaaacccgagtctttactggctcctgacctgatggccttcacaattcaggtgccccaatatatcgattactgtcacaattcgggtgccgtgctgctgtgtagcatccaaggtctcgctgtgaacattgatcctatcctgtacacctggctgatctaccagcctcagaagagaaccagcagacacatgcagcaacagccagtggtcgccgtccctctggtgatgcctgtttgtagacgtaaagaggatgaagtgtctatcggctcagcgccactggctaaacagcaaagctaccaggcctccgaatatgcatctagccccgtgaagaccaagactgtcacggaaagtagaccacttagtgtgcccgtaaaggcgatgttaaatatctccgaaagttgccgttctcctgaggaacgtatgaaagaatttataggtatcgtctggaatgccgttaagcatctgacacttcagcttgaggtgcagtcatgctgtgtgttcatccccaacgactctcttcctagcccaagcactatcgtcagcggcgacatcccggggaccgtccggtcatggtatcacggacagacgagcatgccaggaaccctggttctttgtcttccccagatcaagattatttctgcaggccacaaatacatggagccacttcaggagattcccttcgtgatcccaagacccatacttgaggagggcgatgcgttcccttggaccatcagcctccacaatttcagcatctacacactgctggggaagcaggtcactctgtgtctggtggagcccatggggtgcaccagcactctggctgtgacctctcagaaactgctggccacagggcccgatacccgacacagcttcgtggtatgcctgcacgttgatctcgagagcttagagattaagtgctccaatccacaggtgcagctcttctatgagttaacagacatcatgaataaggtgtggaataagatccaaaagaggggtaacttgaacctgtcccccacttcacctgagacaatggctggccccgttcccaccagtcccgtaaggtcatctattggaactgcgccgccggacacatcaacttgctcgccttctgctgatatcgggacgaccacagagggcgattcgatccaggcgggggaagagagccccttttccgacagtgtgactctggagcagaccacctctaatatcggaggcacatctgggcgcgtaagcctatggatgcagtgggtgttgccaaagattacaatcaagttattcgcccccgatcctgaaaataagggcacagaggtctgtatggtctctgagctcgaggatctcagtgccagtatagatgtgcaggatgtatacacaaaagttaagtgtaagatcgagagcttcaatatcgaccactaccgatcccgaccaggagagggctggcaaagcggtcacttcgagggggtcttccttcagtgtaaggaaaagagcgtgactaccactaagctgcttgatggcactcatcagcagcacgggtttctgtctttgacatacacaaaggctgtcaccaagaatgtgcgtcataaactgacatcacgcaatgagaggagatccttccataagctttccgaaggcttaatggatggttctccccattttcttcatgaaatattgctctctgctcaggccttcgatatcgtgctgtacttccctctgctcaacgccatcgcttccatttttcaggcaaagcttccaaagacacagaaggagaagaggaaaagccctggccaaccgatgcgcacacacaccctgacatctaggaacctgcctctgatctatgtcaacacctctgtcattagaatcttcattcctaaaacagaagagatgcaacctacagtcgaggccaatcaagcagccaaagaagatacagtagtattaaagataggaagtgtggccatggccccccaagccgacaacccgcttggccgttctgttctacggaaggacatttatcagcgggcactaaatcttggcatccttcgggaccccggcagcgagattgaagaccgacagtatcaaatcgacctgcaaagtatcaatattggaacagcacagtggcaccagctgaagccagaaaaggaatccgtgagcggcggagtggtgaccgagactgagcgtaatagccagaatcctgccctcgaatggaacatggcatcatcgattcggcgtcatcaggaacgcagggcaattctgacaccagtactgacagatttctccgtcagaatcacgggtgcccctgccgtcatttttactaaggtggtaagtccagagaacttgcacacagaggagatcttagtgtgcggtcactctttggaagtcaacatcactaccaacctcgatttcttcctgagcgtggcccaggtgcaacttctacatcaattgatcgtggcaaatatgacgggtcttgagccatctaataaggctgccgaaatttctaaacaggagcagaagaaggtcgacattttcgacggaggaatggctgaaacctcttcccgatattcgggggcccaggattccgggatcgggagcgacagcgtgaagatcagaattgttcaaatcgagcagcactcaggagccagccagcatcgaatcgctaggccatcaaggcaatctagtattgtcaaaaacttaaacttcattccctttgacatctttatcaccgcctctcgcattagcttgatgacgtacagttgcatggccctgagcaaatccaagagccaggagcaaaaaaacaacgaaaagactgacaagtcttcactgaatctgcctgaagtcgacagcgacgtggctaagcctaaccaggcctgtatctcaaccgtcaccgcggaggatctgctgcggtccagcatttctttcccctcggggaaaaagatcggggtcctgtccttagaaagcctgcacgcttctaccagaagtagtgctaggcaagctttgggcatcaccatcgtacggcagcccggccgtcgcggaacaggtgacctgcaactggaacccttcctatattttatagtgagccagccatctctactactctcctgccaccatcggaagcagcgtgtagaagtgagtattttcgacgccgtgctgaagggggtcgctagcgactataaatgtatcgacccagggaagaccctgcccgaggccctagattattgtacagtctggttgcagacagttccaggagagatcgacagtaaatccggtatcccgccatcttttattactttgcaaattaaagactttctcaacgggccagctgatgtgaacctggatatctcgaagcctctgaaggccaatctgtctttcaccaaattggaccagattaatctctttctgaaaaaaatcaagaacgctcattcactagcccattccgaggagaccagcgccatgagcaataccatggttaataaggatgacctccccgtctctaaatactatagaggtaagctgtcgaaacctaagatacatggagacggcgtgcagaaaatatctgctcaggaaaacatgtggagggcagtatcctgtttccagaagatcagcgtacaaaccacccaaatcgtgataagcatggagaccgtgccacacacctccaagccatgtctcctggctagtctgtctaatctgaacgggtccctctccgtaaaagccactcagaaggtcccaggcattattctaggctcgtccttcctcctatccatcaacgacttcctgttaaagacgtccctgaaggagcgcagcaggatcctcatcggaccctgttgcgctacagcgaacttggaggcgaagtggtgcaagcattcaggcaatcccgggcctgaacaatccatccctaaaatctctatcgacctgagaggcgggttgcttcaagtcttctggggccaggagcacctcaactgtctggtgttgttacacgagctgttaaacggctatctgaacgaggaggggaactttgaggtgcaggtcagcgagccagtgccacagatgagctctccagtggaaaagaaccagacatttaagtccgagcagagttctgatgacctgcggacgggactgtttcaatatgttcaggacgctgagtctcttaaactccctggggtgtatgaggtgctgttctataatgagaccgaggactgcccaggtatgatgctgtggagataccctgaaccacgggttttaactctggtccggataacccctgtcccatttaacacgacagaggacccagatataagcactgcagatttgggggatgtcctgcaagtcccctgtagcttagaatactgggacgagctgcagaaggtcttcgtggctttccgcgaatttaacttatcagagtctaaggtgtgcgagctccagttgcccgatatcaatctagtgaatgatcagaagaagctcgtgtccagtgacctgtggcgaatagttctgaattcatcgcagaatggcgcggacgaccaaagttccgcgtcagagtccggatctcagagcacatgtgatccgttggtgacaccaactgcgctggcagcctgtactcgtgtggacagctgctttacgccttggtttgtgccttctctttgcgtctcctttcaatttgcccacctggagtttcacctttgtcatcacctggatcagctcggcactgctgctcctcagtatctgcagccgttcgtctccgataggaatatgccgagcgaacttgagtacatgatcgtctcctttcgggagccgcacatgtacctaaggcagtggaataacggcagtgtttgccaggagatacagttccttgcccaagcagactgcaagctgctggaatgccgcaacgtgacaatgcaatccgtggtcaagcctttctcaatctttggccagatggctgtctctagtgacgtggtggaaaagctgctggattgcaccgttattgttgacagtgtgtttgtcaatttgggccagcatgttgtccatagcctgaacaccgccattcaggcatggcagcagaacaagtgccccgaagtggaagaactggttttctcgcacttcgtgatttgcaatgacacccaggagacactcagatttgggcaggttgacacagacgagaacatcctacttgctagcttacacagccaccagtacagctggcgttcccataaatccccacagcttctgcatatctgcatcgagggatggggcaattggaggtggtctgagccttttagcgtggatcatgccgggacttttattaggacaatccagtataggggacgtaccgcttcactgatcatcaaagtccagcaactgaatggggttcaaaaacagattatcatctgcggccgccaaatcatatgctcttacctgtcccaatctatcgagctcaaagtggtgcagcattacataggccaggatggacaagccgttgtgcgcgagcactttgattgcctgacagctaagcagaagctgccctcatatattctggaaaataatgaattaacggagctctgcgtaaaggccaaaggagacgaggactggagccgggacgtgtgtctcgagagcaaggctccagaatactccattgtgattcaagtgccaagttccaacagttctatcatttatgtctggtgtacagttctcactctagaacccaactcccaggtacagcagcgtatgattgtgttctctccgttatttattatgagatctcatcttccagaccctatcattatccacctggagaagcgatcactcggcttgtccgagactcaaattatcccaggtaagggtcaggagaagcctttacaaaacatcgaacctgacctggtgcatcacttgacattccaggcccgcgaggaatacgatccctccgactgtgcggtgcctatttccacaagtttaatcaagcagatcgcgactaaagtgcaccccgggggtacagtcaaccagatcctagacgagttttacggaccagaaaagagcttgcagccgatctggccctacaacaaaaaagactctgatcggaacgagcagctgagtcaatgggattctccaatgcgggtgaaactgagtatttggaaaccatacgtacgcaccttgcttatagaattgctcccctgggccctgttgataaatgagagcaaatgggacctttggttgtttgaaggcgagaaaatagtcctccaagtcccagcggggaagatcatcattccccctaatttccaggaggcctttcaaatcggcatttactgggccaacactaatactgtacacaagagcgttgcaattaagttagtgcataatctaaccagccctaaatggaaagatggaggcaacggagaggtagtcactctcgatgaggaggcttttgtagacaccgagatcaggctgggcgcgttccccggtcatcaaaaactctgtcagttttgcatatccagtatggtgcaacagggcatccagatcatccagatcgaagataagacaacaataatcaacaacactccgtatcaaatcttctacaagccacaactaagtgtctgtaatccccattccggaaaagagtatttcagagtcccggactctgctacattctccatatgtcccgggggcgagcagccggccatgaaaagcagctcactaccctgctgggacctgatgccagatataagtcagagcgtgctggacgctagcttgctccagaaacagatcatgctggggtttagccctgcccctggcgccgactcgtctcagtgttggtcactccccgccatcgttagaccagagttcccaagacagagcgttgcagtacctttgggcaattttcgcgagaatgggttctgtacacgcgcaattgtacttacttatcaggaacacctgggcgttacgtatctgaccctgtccgaagacccatcacctagggtaataattcacaaccgctgtcccgtgaagatgctgattaaagaaaatatcaaggacatccccaaatttgaagtgtactgcaaaaagatcccatcagagtgcagcatccatcatgagctgtatcatcagatatcatcctaccctgattgcaaaaccaaggatttactcccaagcctcctcttgcgagtcgagccactggacgaggtgaccaccgagtggtctgacgctatagacattaacagccagggaacacaggtggtctttttgacaggctttggctacgtgtacgtggatgtcgtccaccagtgtggcacggtgtttattaccgttgcccctgagggaaaggccggccccattctcactaacacaaaccgggcccccgaaaaaatcgttacatttaagatgtttatcacacagctgtcactggctgtgtttgatgaccttacacaccataaagcgtcagccgaattgctcagactgacgcttgacaatatctttctttgtgtagcgcccggagctggaccattgcctggggaagaacctgtggccgccttgttcgaactctattgtgttgagatttgctgtggtgacctccagctggacaatcagctgtacaacaaatcaaacttccactttgctgtgttggtttgccaaggcgagaaagctgaaccaattcagtgctccaaaatgcaatccctgcttatttctaataaggaactggaggagtacaaagagaagtgcttcattaaactctgtattacactgaacgaaggaaagtctatcctgtgcgatataaacgaattctctttcgagctgaaaccagctcggttgtacgtggaagatacttttgtgtactatattaaaacactctttgatacgtacctaccgaactcaagactggctggccactctacacacctgagcggcggcaagcaagtcttgccaatgcaggtgacccagcatgcacgagccttggtaaatcccgtaaagctgcgcaagctagtgattcagcccgtcaacctcctggtctctatacacgcctccctgaagctgtatattgcatccgatcacacaccactgtctttcagtgtctttgagaggggccctattttcaccaccgccagacagctcgtccacgccttggccatgcattatgccgccggagccctttttcgcgctggctgggtggtaggctccctcgacattttgggctcacctgcttcactggtgcgatcgatcgggaacggagtcgcagattttttccgactcccttatgagggcctaacacgggggcccggcgcctttgtttccggcgtgagcaggggtaccacgagcttcgtgaagcacatctccaaaggaacacttacatctattactaatctggctacttcccttgcacgaaatatggacagactgagtttagacgaagaacactataaccggcaggaggaatggagacgccagctgccggagtccctgggagaaggtctcaggcaggggcttagcagactggggatttcgctcctgggagccattgccggcatcgtggaccagcctatgcagaatttccagaagacttcagaggcccaggccagtgctggacacaaggcaaagggggtcatttcgggcgtggggaaaggcataatgggcgtctttaccaaaccaatcggcggggcggccgagttagtatcacaaaccggctatggcattctccacggagcgggactgtcacagttgcccaagcagcggcatcaaccctccgatctccacgcggaccaggctcctaattcccacgtcaaatatgtttggaagatgctgcaatctctgggccggcctgaggtgcatatggccttggacgtggtgctggtgcgagggagtggccaggagcatgaagggtgcctgttactcactagcgaggttctctttgtggtgtctgtgtctgaggacactcagcaacaggcgttcccggttaccgaaatcgactgtgcacaagattccaaacagaacaaccttctcaccgtacagttgaaacaacctcgggtagcgtgcgacgtggaagtggatggtgtccgggagagactgagcgaacagcagtataatcggttggtggactacattacaaaaacgagttgtcatctcgctccttcatgcagctcgatgcaaataccatgccccgtcgtggctgccgaacccccgcccagcaccgtgaagacctatcactaccttgtcgatccccactttgcacaggtgttcttgagcaagtttaccatggtcaaaaacaaggccctgcggaaaggattcccttag

SEQ ID NO: 34685 - DNA, 12069 bp, Artificial Sequence
  Description of Artificial Sequence: Synthetic coding sequence
atgttggagagctacgttacaccaattttgatgagctacgtgaaccgttacatcaaaaatctcaagccctcagatctgcaactgagtctatggggaggcgatgtggtccttagtaaactcgagctgaagctggatgttctggagcaggagctcaagctgcctttcacatttctgagtggccatatccacgaactgaggatccacgtgccttggactaaattaggttctgagcccgtagtgataacaatcaatactatggagtgcattctgaagcttaaagatggcatccaggacgaccacgagagctgcggtagcaattccactaataggtctactgccgagtcaacaaaatctagtattaaacctcgtagaatgcagcaggccgcgcctaccgatccagatctgccacctggatatgtgcaatctctcattcggagagttgtaaacaacgtcaatattgttattaacaacctaattctgaagtacgttgaggatgatattgtgctgtctgtcaacatcaccagcgcagagtgttacaccgtgggcgagctctgggatagagcattcatggacatctctgctactgatctggttctcaggaaggtgatcaacttcagcgattgtactgtgtgtctagataaaagaaacgcatccgggaagattgagttttatcaggatccacttctctataagtgtagctttcgcaccaggctgcactttacctatgagaacctgaacagcaagatgcctagcgttatcaagattcataccctggtggaaagtttgaaactttcaattacagaccaacagctccctatgttcattcgtataatgcagctgggcatcgcgctgtattacggcgagatcggcaatttcaaggagggcgaaatcgaggatcttacctgtcataacaaagatatgcttggaaacataacaggatccgaagatgagaccagaattgatatgcagtatcccgcccagcacaaaggacaagagctgtattcacagcaggatgaagagcagcctcaaggctgggtaagctgggcttggtcttttgttccagctattgtgtcttatgacgacggcgaggaagactttgtgggaaacgacccagccagcaccatgcatcagcagaaagctcaaaccctgaaagatcccattgttagtatcggtttttattgcaccaaggctacagtcacctttaagctgacggagatgcaagtcgagtcgagttattatagcccgcagaaagtgaaatctaaagaggtgttgtgctgggagcaggaaggtacaacggtggaggccctgatgatgggtgagcccttcttcgactgccagattggtttcgtgggatgtagagcaatgtgcctgaaggggatcatgggcgtgaaagacttcgaagagaacatgaaccgatctgaaactgaggcatgcttcttcatctgcggggacaacctctcgactaagggttttacatacttgactaattccctgtttgactatagaagccccgagaataacggaacccgggcagagttcatcctggattcaactcaccacaaggagacatacacagagatagccggtatgcagcgatttggagctttctatatggattacctctacacaatggagaatacatcagggaaggggtctaccaaccaacaggatttttccagtggcaagagtgaagacctgggaacagtgcaggaaaagtccacaaagtctctggtcattggtccactggatttcaggctggactcaagtgcagtgcatcgcattctgaaaatgatcgtatgtgccctcgaacacgaatatgagccttatagccgacttaagtctgatattaaggacgaaaacgagaccatcctgaaccctgaggaagtagctctgttggaggagtatatccccacacgacacacaagcgtaacactcctcaagtgtacctgtacaatcagcatggccgagttcaaccttctggatcatctgcttccagtgatcatgggtgaaaagaactcttccaactttatgaacacaacaaactttcaatcccttcgaccgcttcccagcattcgtatactcgtggataaaataaatctggaacattccgtgcccatgtacgcggagcagttggtccacgtcgtgtcttctttgacgcagccttccgataatctccttcactattgctacgtgcactgttaccttaagatcttcggatttcaggccggtttgaccagcttggactgttccgggtcatattgcttgccagtacccgtgatcccatcctttagtacggctctgtatggaaaattactgaagctcccaacttgctggacaaagagatctcagatcgccattaccgaggggattttcgagctcccaaaccttacaatacaggcgacacgagcgcagactctgcttctgcaggccatctatcagtcttggtcgcatcttgggaatgtctcctcctccgctgttattgaagctctcattaatgagatatttctaagcattggcgtcaaatctaaaaatcctctccctaccctggagggcagcatacagaacgtagagcttaaatattgtagcacgagtctggttaagtgtgcctccggcacaatgggtagtatcaaaatttgtgccaaagcccctgtcgatagcgggaaggagaagctcattccgctactgcaagggcctagtgacactaaagatctgcacagcactaagtggttgaatgaaagtcgtaagccagagagccttctcgcccctgacctaatggcattcactattcaagtgcctcagtacatagattactgtcacaactccggagcggtgctgctctgctcaattcaaggcctggccgtcaacattgaccctattttatatacctggctgatatatcagcctcagaagcgcacatcccgccatatgcaacagcagccagtcgtggcagtgccactggtcatgcctgtctgtcggcggaaagaggacgaggtctccattggaagtgcaccccttgccaagcagcagtcctatcaagcctccgaatacgcaagctcacccgtcaagactaagacagttactgagtctagacctttaagtgtgccagttaaagccatgctgaatatctctgaatcttgcagaagccccgaagagagaatgaaggagttcatcggtattgtctggaacgccgtgaagcacttgaccctccagctggaggtccagtcatgttgcgtgtttatccctaacgactctctgccttccccttccacgattgtgtccggggatatcccggggaccgttcgttcctggtatcacggccagacttcaatgcctgggaccctggtgctgtgcctgccccaaatcaagataatatccgccggacataaatacatggaacctctacaggaaatcccattcgtcatacctcgccccatccttgaagagggggatgcctttccttggacgatctctctgcacaatttctccatttacacgctattgggaaaacaggtaaccctgtgtctggtggaacccatggggtgcacctccaccttagcagtgacgtcgcaaaagctgctggctacggggccagatactcggcattctttcgtggtatgcctccatgtggatcttgagtccctggagatcaagtgctcaaatcctcaggtacagctgttttatgagctgaccgacatcatgaacaaagtctggaacaagattcagaagaggggtaatttaaacctgagccccaccagtcccgaaactatggcaggccccgttcctactagccctgtgaggagcagtattggaacagccccaccagacaccagtacttgctcgccttctgctgacatcggcacaaccactgagggagactccattcaggccggcgaggaatccccgttttctgattctgtgaccttggagcagacaacctcaaacatcggtggaacgtcaggccgtgtcagtttatggatgcagtgggtcctgccaaaaattactattaagctgttcgcacccgatccagagaacaaaggtaccgaggtctgcatggtttcagaattagaggatttaagcgcgtcaattgacgttcaagatgtgtacactaaggtgaaatgcaaaattgaaagtttcaatatagaccactaccgatcaagtttgggcgaggaatgttggagtttaggccagtgtggcggtgtttttctcagctgtactgacaaacttaaccggcggacactgcttgtgaggcccatttccaagcaggaccccttcagcaactgcagcggcttcttcccaagtacaaccacgaagctcctagacggtacgcaccagcagcacggattcctcagcctgacctatacgaaagccgttaccaagaatgtccgccacaaactgacgagccgaaacgagcggcgtagttttcataagctcagcgagggactgatggacggcagcccccactttcttcacgagattttgctttccgcccaggcctttgatatcgtcctgtacttccctctgcttaacgctatagctagcatttttcaggcaaagctgcccaagactcagaaagaaaagcggaaatcgcctggacagccaatgaggacacatacgcttacttcccgcaaccttccgctgatatacgtgaacaccagcgttattcgtatttttatacccaagactgaggagatgcagcctaccgttgaggcaaaccaggccgcaaaggaagatacagtggtactgaagatcggaagcgtcgcaatggcacctcaggctgacaatcccttaggacggtcggtgctgcggaaagatatatatcagcgagctctgaacctcggcattctccgagaccctgggtcagaaattgaggacaggcaataccagatcgatttgcagagtataaacatcggtaccgcccagtggcaccagctaaagccagagaaagaatcagtctctggaggggtagtgacagaaaccgaacgtaatagtcagaatccagccttggagtggaacatggctagctccatcaggaggcaccaggagagaagggccattctcacgcctgtgctgacagatttcagcgttcgcatcacaggcgctccagctgtgatttttactaaggttgtctctccagaaaacttgcacacagaggagatcctcgtctgcgggcactccctggaggtaaatatcacaactaatcttgattttttccttagtgtcgcacaggttcagctgctgcaccaactcatcgttgctaatatgactggcctggagccttccaataaggcagctgaaatttccaagcaggaacagaaaaaagtggacatcttcgatggcggcatggctgagacctcttctaggtactccggggctcaggatagcggcatcggctcggacagcgtcaagataaggattgtgcagattgagcaacatagcggcgcatctcagcatagaattgcacgcccctcaaggcagtccagtattgttaaaaaccttaactttattccttttgatatttttatcaccgcgtctcgaatctctcttatgacctacagctgtatggccctgtctaaaagtaagagccaggaacagaaaaacaacgaaaaaaccgacaagtcgtccctaaacctgcccgaggtggactccgacgtagccaaacccaatcaagcctgtatctctactgtcaccgccgaggacctcttgcgttcatctattagcttccccagcggcaaaaaaattggtgttttgtctctcgagagcctacacgcatccacccggtcgtctgcccggcaggccctgggaataacaatcgtgcggcagcccggtaggaggggaacaggtgacttacaattggagcccttcctctatttcatagtgtcgcaacccagcctgctgctttcttgccaccaccgaaagcagcgggttgaggtgtctatctttgatgcggtcctgaagggagtggcctctgactacaaatgcatcgaccccggaaaaacgctaccagaggccctggactactgcacagtttggttacagactgtcccgggcgagattgacagcaagagcggcattccgccatcatttattaccctacagataaaagacttcctgaacggccctgcagacgtgaatctcgacatcagtaaacccctgaaagcaaatctgtcattcacgaaattagatcagattaacctgttcctgaaaaagattaagaatgcgcactctctagctcactctgaggagacctctgccatgtcgaataccatggtgaacaaggatgacctgcctgtttctaagtactaccgtggcaaactgtcaaagccgaagatccatggcgatggggtgcagaagatcagcgcccaagaaaatatgtggagggcagtgtcatgttttcagaagatatccgtgcaaacaacacagattgtgatctccatggaaaccgtcccgcacaccagtaagccttgcctgctcgcaagcctgagcaatttaaatggcagtctgtctgttaaagccacccaaaaggtacctggaatcattctggggagcagctttctgctgagtatcaacgattttctgctgaagaccagtctgaaagagaggtcaaggatcctgatcgggccatgctgcgccactgccaacctggaagcgaaatggtgcaaacatagtggcaaccctgggccagagcagtctatccccaaaatcagtattgacctacgtggaggactcctccaggtgttctggggtcaggagcatctaaattgtcttgtactgctgcacgagctcttgaatggctatctcaatgaagagggtaatttcgaggtccaggtttctgaaccagtgcctcagatgtcctcaccggtggagaagaaccagacctttaagtcagaacaatccagtgatgacctccgtaccggcctgtttcaatatgttcaggatgctgagagtctcaaactgcctggcgtctatgaggtattattctataatgaaacagaggactgccccggaatgatgttgtggagatacccagagccacgcgttctcacgctggtacgaatcactccagtgccatttaataccactgaggaccctgacataagtacagcggatctgggggacgttctgcaggttccgtgtagtctagagtactgggacgagctccagaaggtcttcgtggcgttcagggagttcaatcttagtgagtcaaaagtctgtgagctacagctgccagacatcaacctggtcaatgatcaaaaaaaactagtgagctccgacctgtggcggatcgtcttgaacagcagccagaacggcgctgatgatcagtcgtcagccagcgaaagcggatcacaatctacatgcgaccctctagtgacgccaactgccctggctgcatgtacacgagtcgactcttgtttcacgccttggtttgttccatccctgtgcgttagctttcaattcgcacacctagagttccatctatgtcatcacctagatcaacttggcacagccgctcctcagtatctgcagccgtttgtgtcagacagaaacatgccatcagagctggagtacatgatagtctcttttcgtgagccgcacatgtatctgaggcagtggaacaatggaagcgtctgtcaggaaatccagtttcttgcacaggcggactgtaagttactcgagtgcaggaatgtgacaatgcagagtgtggttaaaccctttagcattttcggccagatggcggtctcttccgacgtggtggaaaaactattggattgcaccgtgatcgttgacagcgtgttcgtgaatctggggcagcatgtggtccacagcttgaatacggccattcaggcatggcagcagaataagtgtcctgaagtggaagagctcgttttttcccatttcgtgatttgcaacgatacacaggagacgttgcggttcggacaggtcgacaccgatgaaaatatcctgctcgcctccctacattcacaccagtactcttggcgatcacataaaagcccacaattgctccatatttgtattgaggggtgggggaactggaggtggtctgaacctttctctgttgaccacgccggaacatttattagaactattcaataccggggccgaactgctagccttataatcaaagtgcaacagctaaacggcgtgcagaagcagatcattatttgcgggagacagatcatttgctcctacctctctcagagtatcgaacttaaggttgtgcagcattatatcgggcaggatggccaggcagtcgttcgggaacattttgattgtctgaccgcaaaacagaagttgccaagttacatcctggagaataatgagctcacagagctgtgcgttaaggccaagggtgacgaggattggtccagggatgtgtgcctcgagagtaaggcccccgagtattctatagtcatacaggttccctcctctaactcgtcaatcatttacgtgtggtgtaccgtgctgacactagagcctaatagccaggtgcagcaaaggatgatcgtctttagcccactgtttattatgcgttcccacctgcctgacccaataatcatccatcttgaaaaacgatctctgggcctgagcgagacacagataattccagggaaagggcaagagaagcctctccaaaatatcgagcccgatctcgtgcatcaccttactttccaagcaagagaagagtatgacccatcagactgcgctgtccctatttcgacgtctctaatcaaacagattgcaactaaggttcatcccggaggtaccgtaaatcagatcctcgatgagttttacggtcccgagaagagcctccagcccatctggccatataataaaaaggattctgaccgtaacgagcagctgagccagtgggactctcccatgcgggtgaaattgtcaatttggaagccgtatgtacgcacccttttgatcgaattactcccctgggctctgttaatcaatgaatcaaaatgggatttgtggttatttgaaggggaaaaaatcgtgctgcaagttccggccggcaaaattatcatcccacctaactttcaggaggccttccagattggtatttattgggctaacacaaataccgtacacaaatcggtggcaataaagctcgtccacaatttgacatctcctaaatggaaagatggcgggaatggagaggtggtgacgctggacgaagaagcgttcgtagacaccgaaattcgcctgggggccttccccgggcaccaaaagttatgccagttttgtatcagcagcatggtccagcagggtatccagattatacagattgaagataaaaccacgataatcaataacacaccttaccagattttttataagccgcagttgtctgtttgcaacccgcactcaggtaaggagtacttcagggtaccagatagtgctaccttctctatttgtccagggggggaacagccagcaatgaaaagttcgagcttgccttgctgggacctgatgccagatatctctcagtccgtgctggatgccagcctgctccaaaagcagataatgctagggttcagtcctgctcccggagccgactcttcccagtgttggtccctgccagcaatagttagacctgaatttcccagacagtcagtggcagtgccgctgggtaacttccgggagaatggattctgcactcgtgccatcgtgctcacctatcaggaacatctgggtgtgacttatttgacactgagcgaggaccctagcccccgggtcattatccataacaggtgcccagtgaagatgctgattaaagagaacatcaaggatatccccaagttcgaggtgtactgcaaaaagattcctagcgagtgttctatacatcacgagttataccaccagatatcttcttatccggactgtaagaccaaggatctcctcccgtcactgctgttgcgtgtggagcctttagacgaggtcactactgagtggagcgatgcaatcgacatcaactcccagggcacgcaagtggtattcttaactggattcggatatgtgtatgttgacgttgtccaccagtgcgggaccgtgttcatcacggtggcgcctgaaggaaaggctgggccaatcctgaccaatactaaccgcgcccccgagaagatagtgacctttaaaatgttcatcacacagctgagcttggccgtttttgacgacctaacgcatcacaaagccagtgccgaattgcttagattaactcttgacaacatctttttgtgcgtggcccctggcgcaggccccttgccgggcgaagaaccagtggcagcgttattcgagctgtactgtgttgagatctgctgtggcgatttgcaactggacaatcaactctacaataagtcaaatttccactttgcggtgctggtctgtcagggggaaaaggccgaacccatacagtgctcaaagatgcagagcctcctcataagcaataaagagctggaggaatacaaggaaaaatgctttattaagttgtgtatcactctgaatgagggaaaatcaatactttgtgatataaatgagtttagtttcgagctgaagcccgcaagactctacgtagaggacacttttgtttattatatcaagacactattcgacacttatctgcccaatagcagactggcgggacatagtactcacttatcaggcgggaagcaggtgttgccgatgcaggtgacgcaacatgctcgagctctcgtgaacccagtaaaactgcgaaagttggtgattcagcctgtcaaccttctggtgtctatccacgcctcactgaagttatacattgccagcgaccatacccctctgagcttttccgtgttcgaacgtggtccaatcttcacaaccgctcggcagctggtccatgctctggcaatgcattacgcagctggagccttattcagagctggctgggttgtggggagtctggacattctgggctctccagcttcactcgtaaggagtattgggaatggcgttgccgacttttttcggttaccgtacgaaggcttaactcggggccctggagctttcgtcagtggcgtgagtcggggcaccacttcttttgttaagcacataagcaaagggacactcacatccattaccaatttggctacttcactggcccgtaacatggatcgactgtcactcgacgaggagcactataaccgacaggaggaatggagacggcaattgcccgaatcactcggagagggccttaggcaggggttgagccggcttggaatcagtctcctgggcgctattgccgggatcgtagatcagcctatgcagaattttcagaagacgagcgaagctcaagcatcagccggccataaggccaagggcgtgatttccggagtaggaaagggaatcatgggagtatttaccaagcctatcgggggcgctgctgagctggtatcacaaaccggctacggcatcctgcatggcgcaggtttgtcgcagctgcccaagcaacggcatcagccatctgatctccatgcagatcaggccccaaacagtcacgtcaagtatgtctggaagatgctccagtcactcggtcgcccagaagtgcatatggcactggacgtagtcttagtccgcggtagcggacaagagcacgagggttgcttactgctcacatcggaggtattgttcgtagtcagcgtcagcgaggacacacagcagcaggctttccccgtgaccgagatcgactgtgcccaggactctaagcagaacaacctgctgactgtacaactgaagcagcctagagtagcgtgcgacgttgaggtggacggcgtccgcgagcgactctccgaacagcagtataaccgtttagtcgactatataacaaagacatcttgtcatctggctcccagctgttcatccatgcaaatcccatgccccgtggtcgccgccgagcccccccctagcactgtcaaaacttatcattacctggttgacccacactttgcacaggtctttctcagtaagttcactatggttaagaacaaggcactgaggaaggggtttccctag

SEQ ID NO: 34686 - DNA, 4284 bp, Artificial Sequence
  Description of Artificial Sequence: Synthetic coding sequence
atgctggagagctatgtgacacccatcctgatgagttacgtgaaccggtatattaaaaatctgaagcctagtgacctgcagctgtctctttggggaggggatgtcgttctgtccaagctcgaattgaaattagacgtactggaacaagaactaaagctgccatttacatttttgtccggccacattcatgagctcagaatccatgttccctggacgaagttgggctccgagcctgtcgtaatcaccatcaataccatggagtgtattctgaaattgaaggacgggattcaggacgatcatgagtcctgcggtagcaacagtaccaaccgatcaacagccgaaagcacaaagtcctcaatcaaacctcgtcgaatgcagcaggccgcccctactgatccagacctgccccccggctatgttcagagtctgatccgcagagtggtcaacaacgtcaacatcgtgatcaacaatctgattcttaagtacgtcgaggatgacatagtgttgagcgtgaacatcacgagcgccgagtgttatactgtcggcgaactctgggatagagcttttatggatatttcggctacagacctcgtgttgcgcaaagttatcaattttagtgactgtacagtttgtctggataagcgcaacgcctcgggcaagatcgaattttaccaggacccactgctttataagtgtagcttcaggacccggctgcatttcacttatgagaacctcaattccaaaatgccctcagtcatcaagatccataccttagttgaaagcctgaagctgagcataactgaccagcagctaccaatgttcattagaatcatgcagctggggatagccctctattatggagagatcggaaattttaaggagggcgagattgaggatctcacctgtcataataaggacatgttagggaatattaccgggtcagaggatgaaacacggattgatatgcaatatccagcacagcataaaggtcaggaactttactctcagcaggatgaagagcagccccagggctgggtgtcttgggcctggtcttttgtccccgccatagtgtcatatgacgacggtgaggaggacttcgtgggcaatgatcccgcatcaacaatgcaccagcagaaagcccagacgctaaaggatcctattgtgagcatcggattctactgtaccaaggccacagtgacctttaaactgacggaaatgcaagttgaaagttcttattatagcccccagaaagtcaagtcaaaagaggtgctgtgttgggagcaagagggcacaacagtagaggctttgatgatgggggaaccgttctttgactgccaaatagggtttgttggctgtcgggcaatgtgtctgaagggcattatgggggtgaaagacttcgaggaaaacatgaacagaagcgaaacagaggcctgcttctttatatgcggagataacttgtccaccaaaggtttcacctacctgacaaattccctcttcgattacaggagccctgagaacaacggaacgcgtgctgaatttattctagacagcacacaccacaaagaaacttacactgagattgcaggaatgcagcgttttggagccttttacatggactatctgtatactatggagaacaccagcggcaaaggttctaccaaccagcaagacttttcttctggtaagtccgaagacttaggtaccgtccaggagaaatctactaaatctctggtgataggaccactggactttagacttgacagttcagccgtgcatcgcatcctaaaaatgatcgtgtgcgcccttgagcatgagtatgagccctacagccgtcttaagtcggacattaaggatgagaacgaaaccattcttaatccagaggaagtggctctcctggaggagtatattcctactcggcacacctctgtgacgctgctcaaatgtacctgtacaattagcatggccgagtttaatttgctggaccaccttctgcctgtgataatgggagaaaagaactcatcgaattttatgaatacgaccaattttcagtcactccgccccctcccgagcattcgaattctcgtcgataagatcaatctcgagcatagtgtgcccatgtatgctgagcagctggtgcacgttgtctctagtcttacccagcccagcgacaacctgctgcattactgctacgttcactgttacttgaagatttttggcttccaggccggcctgacatcgctggactgctcgggatcatactgcctgcccgttcccgtgatcccaagtttctctacagccctctatggaaaacttttgaagctgcccacttgttggacaaagaggagccagatcgctattaccgaaggcattttcgaactgccgaacctcacaattcaagctacaagggcacaaacacttctcctgcaggctatttatcagtcctggagtcacttgggaaacgtgtctagcagtgccgtcatcgaggcccttatcaacgaaattttcctttcaattggtgtaaaatctaagaatcctctgccgacgctagaggggagtatacagaatgtggagttgaagtactgctctacctctctagtaaaatgcgctagtggcactatggggtccattaagatttgtgccaaggccccagtggattcaggcaaagaaaagcttatccccctgcttcaagggccaagcgataccaaggatcttcacagtaccaagtggcttaatgaatctcgcaaacccgagtcacttctggcccctgatctgatggcctttacgatccaagtgcctcagtacattgattattgtcacaactctggcgctgttctgctttgttcgatccaggggctcgccgtcaatatcgatccgatcctgtacacgtggctcatctaccagccacagaaacgtacttcaaggcatatgcagcagcagcccgttgttgcggtgcccttggtgatgccagtatgcagacgaaaagaggatgaggtcagcatcggctcagctcccctggccaagcagcagtcctatcaggcctcagagtacgcaagctctccagtgaagaccaaaacagtgactgaatccagaccgttgagtgtgcctgtgaaggcgatgctgaacatttccgagtcctgtaggtctccagaggaaagaatgaaggagttcatcgggatagtgtggaacgccgtgaagcatctcacccttcagcttgaggttcagtcctgctgcgtctttatacctaacgattcactgccaagcccatcgaccattgtcagtggagatatccccgggactgttaggagctggtaccacggccagacctctatgcctggtacacttgtgctttgtttgcctcagataaagataatatccgccgggcataaatatatggaaccacttcaggagattccgttcgtgatccctcggccaatccttgaggagggcgacgcatttccctggacaatctccttgcataactttagtatctacacactacttggcaaacaggtaacactttgcctcgttgagcccatggggtgcactagtacgctcgccgtcacgtcccagaagctcctcgccaccgggccggatactaggcacagtttcgtagtatgtctgcatgtcgacctagaaagcctggagattaaatgtagcaacccgcaggtgcaacttttttatgagctgaccgatattatgaataaggtgtggaacaagatccagaagaggggcaacctgaacttgagccccactagtccagaaacgatggctgggccggtcccaacgagtccggtacgctccagtatcggcactgctccgcccgatacctctacatgctcgccaagcgctgatataggaactactacagagggcgatagcatacaagccggcgaagaaagccctttttcggattcagtgacgctggagcagacaactagcaatattgggggtacatcaggccgggtcagcctgtggatgcagtgggtactgccaaagatcaccatcaagctcttcgcaccagacccagaaaataagggaactgaggtctgtatggtgtccgaactggaagatctctcggcttctatagatgtccaggacgtgtatacaaaagtgaagtgcaaaatcgagtcttttaatatagaccactacaggagccggccaggtgaagggtggcagtcaggacactttgagggcgtttttctgcagtgcaaagaaaaaagtgtgccctgggggagggtgctggtgttcggagccatgtggaggtgcttgccgtttctttattag

SEQ ID NO: 34687 - DNA, 1248 bp, Artificial Sequence
  Description of Artificial Sequence: Synthetic coding sequence
atgctcgaatcttatgtcacccccatcttgatgtcttacgtcaatagatatatcaaaaatttaaaacctagtgacctacagctctcactgtggggaggagacgttgtgcttagcaaacttgagctgaagttggacgtgctggaacaggaactcaagcttccattcacattcctgagcgggcatatccatgagctgaggatacatgtcccatggacaaagcttggctccgaaccggtagtgattacgattaacacaatggaatgtatcttaaagttgaaagacgggattcaagacgatcacgaatcttgcggttcaaactcaaccaataggagcactgctgaatctaccaaatcatcaattaagccgcgtaggatgcaacaggctgcaccaacggatccggacctgccacccgggtatgtgcagtccctgattcggcgcgtcgtgaataatgttaacattgttatcaacaacctgattcttaaatacgtggaggatgacattgtcttaagcgtcaatatcaccagcgccgagtgctacacggtcggcgagttgtgggaccgcgcatttatggatatctccgccacagatttggtcctcaggaaggtaattaacttctccgattgcaccgtgtgcctcgataagcgaaatgcttccgggaaaatcgagttctaccaagaccctctgctgtacaagtgtagtttcagaacgcgtctgcatttcacatatgagaacttgaactcaaagatgcccagcgtgattaaaattcacacactcgtagagtcattgaagctgagtataaccgatcaacagctgcctatgttcatccggatcatgcagcttggtattgcactttattacggcgaaatcgggaatttcaaggaaggcgaaattgaggacctaacatgtcacaacaaggacatgctgggcaacattacgggatcagaggacgagacacggatcgacatgcagtatcctgcccagcataagggccaggaactctatagccagcaggatgaagagcaacctcagggatgggtgagctgggcctggagctttgttcccgcgatcgtatcctatgatgatggcgaggaagatttcgttggtaatgaccccgcttcaaccatgcaccagcagaaagctcagactctgaaagatcccatcgtcagtatcggcttctactgtacaaaggcaacggtgacgttcaaggtggggttattctcttgttgcctgtatttgtatcagctgtag

SEQ ID NO: 34688 - DNA, 11133 bp, Artificial Sequence
  Description of Artificial Sequence: Synthetic coding sequence
atggtactggaaagcgtcgtggccgatctactcaacagattcctaggcgattatgtggaaaacttaaacaaaagccaactgaagctaggaatctggggcgggaacgtggcactggacaatctccagattaaagagaatgccctgagcgaactggacgtgcccttcaaagtgaaggcaggccagatcgacaaactgaccctcaagatcccgtggaagaacctgtacggggaagctgtggtagccaccctggagggcctgtacctgttggtggtccctggagcttcaattaaatatgacgctgtcaaggaggagaaaagcctgcaggatgtaaaacagaaggaactctcaaggatagaagaggcccttcagaaagcggccgaaaaggataaacccaaggaggccaagaaagatacatttgtggagaagttggccacacaggtgatcaagaacgtgcaagtgaaaatcacggatattcatattaaatatgaagacgacgtgaccgacccaaagcgccccctcagctttggagtaacactgggggaattgtcgctgctgacagctaacgaacactggacaccttgtattctaaacgaggctgataagattatttacaagctgatacggctggatagcctttccgcctactggaatgtgaattgcagcatgagctaccaacgttctcgggagcaaattctggaccagcttaaaaatgagatacttactagtggtaacatcccgccgaattatcaatacattttccagcctatttctgcctcggctaagctgtacatgaatccctacgctgaatctgagctgaagactcctaagctggactgcaatattgagattcaaaacatcgcgatcgagcttactaagcctcagtacctctctatgatagaccttctggaatccgtcgactacatggtccgtaacgcaccctacagaaaatataagccatacctgcccctgcacacaaacggacgtagatggtggaagtacgctatcgattccgtgttagaggtccacattcggagatatacacagatgtggagttggagcaatatcaagaaacacagacagctgctcaaaagctacaaaatcgcttacaaaaataagcttacccaaagcaaggtctctgaggaaattcagaaagagatccaagatttagaaaaaacgctggacgtgttcaacatcatactggctcgacagcaagcccaggtggaggtcatacgttctggacagaagttgcgcaagaagtccgctgacaccggcgagaaacgaggtggctggttctccggactctgggggaaaaaagaaagcaagaaaaaagatgaggagtccttgattcccgagaccatagacgatctgatgacacctgaggagaaagataaactctttacagccattggctattcagaaagcacccataacctgactcttccgaagcagtatgtcgcccatatcatgacgcttaagctcgtgtcaacctcagttaccattcgggaaaataagaatattcccgagatcctgaagatacaaataatcggcctcggcactcaggtgagtcaaaggcccggcgcccaggccctgaaagtcgaggccaagttagagcactggtacattacaggactgagacagcaggacatagtaccaagcctggttgcaagtatcggggatacaacttccagtctgctgaagattaagttcgaaacaaatcccgaagacagccccgcagaccaaaccctcattgttcaatcccagcccgtcgaggtgatctatgatgccaagacagtgaatgcagtggtggagtttttccagagcaacaaggggttggacctcgagcagattacctcagcgacactgatgaagttggaagagattaaggagagaacggccaccggcttgacgcacataatcgagacaaggaaggtcttagaccttcgaatcaatctcaagccatcctacttggtcgtgccccaaaccgggtttcaccacgagaagtccgaccttctgatcttagactttggcactttccaattgaactccaaagaccagggtctgcaaaaaaccaccaactcatctttagaggagataatggataaggcatacgacaaatttgacgtggaaattaaaaacgtgcagttgctcttcgcgcgggccgaggagacctggaaaaaatgtcggtttcaacacccttccactatgcacatactccaacctatggatatccatgttgagctcgccaaggccatggtggagaaggacatacggatggccagatttaaggtttccggcgggctgcccttaatgcatgtgagaatttctgatcagaaaatgaaagatgtgctctacttgatgaattctatccccctgccgcagaaaagctccgcccagtcccccgagcggcaagtcagttcgattcctatcatcagcgggggaactaaagggctgctggggacttcactcttactggacaccgtggagagtgagtccgacgatgaatacttcgatgccgaagatggagagccgcagacttgcaagtcaatgaaggggtctgagctcaagaaagctgccgaggtgcccaacgaggagttaattaatctgttattaaaattcgagattaaagaggtcattctggagtttacgaagcagcagaaggaagaggataccatcttagtctttaatgtcacacagctgggaaccgaggctactatgcgcacgttcgacctaaccgttgttagttacttgaagaagatctctctggactatcatgagatcgaaggaagcaagagaaaaccgcttcatttaatatcaagcagtgacaagcctggcctggatctgctgaaagtagaatatatcaaggccgacaaaaacggtcctagcttccagacggcatttgggaagacggaacagaccgtgaaggtcgcgttctcctcactgaatcttctcctgcagactcaagcgctggtcgcctctataaattatttgaccaccatcatccccagcgatgatcagtcgatcagcgtcgctaaggaggtacagatttcaacagagaaacagcagaaaaatagcaccctgccgaaggctatcgtgagtagcagagacagtgatattatcgactttcggttatttgctaagctcaatgctttttgcgtaatcgtatgcaacgagaaaaataacattgccgagatcaagattcagggtttagattccagtttgtcactccagtctcgcaagcagagtctgttcgcacggctcgaaaacataattgtgaccgacgttgaccctaagacagtgcacaaaaaggctgtgagtattatgggaaatgaagtgttccgttttaatcttgacctctaccccgacgcaacggaaggggacctttataccgatatgagtaaggtcgacggcgtcttgagtctgaacgtcggatgtattcagatagtgtacctgcataagttcctgatgtctttgctgaacttcctgaacaactttcaaacggctaaggagagcctcagcgccgcaactgctcaggcggcggaacgtgcagcaacatcagttaaggacctggcccagaggtccttccgagtgtccatcaatattgacctgaaagcccccgtgattgtgatcccacagagttccatatcaaccaacgccgttgtcgtggatctggggttaattcgagtgcataatcaattttctcttgtgtctgatgaagattatctcaacccacctgtgattgatcgaatggacgttcagctcactaagttgacactgtatcgtacagttattcagcccggaatttatcacccagatattcaactcctgcaccccataaacctcgagtttttggtgaacaggaaccttgccgcttcttggtaccataaggttccagtcgttgagataaagggacacctggacagtatgaacgtgtcactgaatcaggaggatcttaatctcctgtttcggatcctcactgagaatctctgtgagggaaccgaggatttagataaagtaaagcccagggtgcaagaaaccggtgagatcaaagagcctcttgaaattagcattagccaggatgtccacgatagcaagaacaccttgaccaccggggtggaggaaataagatcagtggacatcatcaatatgctgctgaatttcgaaatcaaagaagtcgtggtcacactgatgaagaagagcgaaaaaaagggcaggcctctccacgagctcaacgtcctgcagctgggcatggaggctaaagtcaaaacctacgacatgacggcaaaagcctacctgaagaaaattagcatgcagtgcttcgacttcacagactctaaaggcgagcccctgcatatcattaattcttctaatgtcaccgatgagcccctgctcaaaatgctgcttaccaaagctgattcagatggccctgaatttaagaccatccatgacagtactaaacagagattaaaagttagcttcgccagcctggatctcgtcctgcacctagaggccttgctgagcttcatggactttttgtccagtgcagccccgttctctgagccatccagctcggagaaagaaagtgagttgaagccccttgtgggggaatcccgcagcattgccgtgaaagccgtcagtagcaatattagccagaaagatgtgttcgacttgaagattacagccgagctgaacgcctttaatgtgtttgtgtgcgatcagaagtgtaatatcgcagatatcaagatacatgggatggacgcttccatctccgtgaaaccgaagcagactgatgtctttgcaaggttaaaggacatcattgtgatgaacgtcgatctgcagtcaatacataagaaagccgtgagcatattgggggacgaagtcttccggttccagctcactttatacccagatgccactgaaggcgaagcatacgccgacatgagcaaagttgatggtaaactgtcctttaaagtgggttgtatacagattgtctatgtccacaaatttttcatgagccttctgaatttcctaaataatttccagaccgccaaagaggccctcagtaccgcaacagtgcaggctgctgagagagcggcgtccagtatgaaggatctcgctcagaagagttttcggctgctgatggatatcaacttaaaggctccagtgataattatcccccagtcttcagtgtccccgaatgcggtaattgccgatttgggcctgatccgtgtggagaataagttctccctggtgccaatggaacactattcccttccacccgtgattgacaaaatgaacatcgaattgacccagcttaaactgtctaggactattctacaggcaagtctgccacagaacgacattgaaatcctgaaacctgtcaatatgttgctgagcatccagcggaacctggctgcggcctggtatgtccaaatccccggcatggaaatcaaagggaagcttaagccaatgcaggtggccctgagtgaggacgacctcaccgttctgatgaagatcctgcttgagaatctcggcgaggcttccagccaaccctcccctacacaatcagtccaagagacagtgagagtgagaaaagtggatgtgtctagtgtgccagaccatcttaaagaacaggaggactggaccgacagcaagctgtccatgaaccaaatagtcagcttgcagttcgacttccattttgagagtctgagtatcattctgtataataatgatataaatcaagagtctggcgtggcattccataacgattcctttcagttaggtgagttgaggcttcatcttatggccagctccgggaagatgttcaaggatggatctatgaacgtgtcagtgaagctaaagacctgcaccctggatgatctccgcgagggcatcgagcgcgctacaagcaggatgatcgatcgcaagaatgatcaggataataattcctctatgatagacatctcatacaagcaggataaaaatggatcccagatcgacgctgtgctggataaactgtacgtctgcgcgtctgtcgaattcctcatgaccgtagcagacttctttatcaaggccgtccctcaaagtccagagaatgtggctaaggagacacaaattctgccaagacagacagctactggaaaagttaagattgagaaagacgacagcgtcaggcctaatatgacactgaaagctatgatcactgacccagaagtggtgtttgtcgcttcgctgaccaaggccgatgccccagccctgactgcgtctttccaatgtaacctttccctcagtacctctaagctggagcaaatgatggaagccagcgtcagagatctcaaggtgctggcttgtcctttccttcgtgaaaagcgagggaaaaacattactaccgtgcttcaaccatgctcactgttcatggagaaatgcacctgggccagcggcaagcagaacataaacattatggtgaaggagttcatcattaagatttcacctatcatactgaacactgtgctaacaatcatggccgccctgagtcccaagaccaaagaggatggatccaaagatacttctaaggaaatggaaaacctgtgggggattaaaagtatcaacgactataacacttggtttctgggagttgatactgccactgagataaccgaaagttttaaaggaatcgaacattctctgattgaagagaattgcggagtagtggtggagagtattcaggtaaccctggagtgcggcttgggtcacaggactgtgccactgctgctcgcagagtcaaagttctccggcaacattaaaaattggacctcccttatggccgccgtggctgacgttacactccaggtccattattacaacgagattcacgcagtgtgggaacccctgatcgagagggtggagggaaaaaggcagtggaacctgcgactggatgtgaaaaagaatcctgtccaggacaagagcctcctccctggcgacgattttatccccgagccacagatggcaattcacatttcctccgggaacacgatgaatataacaatctccaagagttgcttaaacgtcttcaacaatctggcgaaaggcttttcagagggaaccgccagcacattcgattacagcctgaaggatagagctcctttcactgtcaagaacgctgtcggtgttcctattaaggtcaaacccaactgcaatctgcgagtgatgggctttcccgagaaaagcgacatttttgacgtagacgccggacaaaatcttgagctcgaatacgcctcaatggtgcccagtagccaaggtaatctaagtatcttgtcccggcaagagtcaagcttttttacactaaccatcgtgccgcacggttacacagaagttgctaacatccctgtggccaggcctggccgacgcttatataacgtccggaacccaaacgctagccactctgacagcgtcctggtgcagatagacgcaactgaggggaacaaggtgatcacccttaggtccccacttcagatcaagaatcacttctctatcgccttcattatttacaagtttgtgaagaatgtgaagctgctggagaggatcggcatcgcaagacccgaagaggaatttcacgtgcccttggatagctaccggtgtcagctgtttattcaacccgccgggattctcgaacatcaatacaaagaatctactacatacatctcctggaaagaagagcttcaccgcagtagagaggtccgctgtatgctgcagtgcccaagtgtggaggtgtccttccttcctttgattgtgaataccgtcgcacttccagatgagttgtcctacatctgcacccacggggaggactgggacgtcgcttatataatacatctataccccagcctgaccctgaggaatcttctgccttattccttgcgctatctgttggaagggaccgccgagacgcatgaattggcagaggggtccaccgctgacgtgctccactcccggattagtggagaaattatggaactggttctggtgaaatatcagggcaagaattggaacggccacttccgcatcagagacacccttccggaatttttccccgtttgttttagtagtgacagcaccgaggttacaaccgtggatttatcagtgcacgtccggagaataggcagccggatggtgcttagcgtgttctccccctactggctcataaataaaacaacaagagtgctgcaatatagaagcgaggacattcatgtaaaacaccctgctgacttcagggacattattttgttctcattcaagaagaaaaacatttttacgaaaaacaaagtgcagttgaaaattagcactagtgcttggtcctcctcgtttagcctcgacaccgtgggatcttacggatgcgtgaagtgtcctgcaaacaatatggagtatctggttggagtttctattaagatgtctagctttaatctcagccgtatcgtcaccctgactccattctgcactatcgccaacaagagcagtctggagctggaggtaggagagatagccagcgatggatcgatgccgaccaacaagtggaattacatagccagcagcgaatgcctaccgttttggccagagtcattatctgggaagttgtgcgtgcgcgtagttggatgcgaaggttcaagtaaaccattcttctataacagacaggataatggaactctgctgtcactagaagatctgaatggaggcatactcgtcgatgtgaatactgccgaacattccacggtaatcacttttagtgattaccatgagggaagcgcgcctgcattaatcatgaaccatactccatgggacatcctaacctacaagcaatctggctccccagaagagatggtgctcctccctcgtcaggctcgactgtttgcatgggctgatcccacaggtaccaggaaattgacctggacctatgccgccaatgtcggagaacatgacctcctcaaggacggctgtggtcaatttccatacgacgccaacattcagatccattgggtgtctttcttagacggacgccagcgggtcctgctgtttacagacgacgtcgccttagtctctaaagctctgcaagcagaggagatggagcaggcagactacgagattaccctctccctacacagtttgggattatccctcgtgaataacgaatcaaaacaggaagtatcgtatattggaattacctcttccggcgtagtttgggaagtaaagccgaaacagaagtggaagcccttctcccaaaaacaaatcatcctgctggaacaaagttatcagaagcaccaaatatcccgcgatcatggctggatcaaattagataacaacttcgaggtcaatttcgataaagaccctatggaaatgcggttgcctatcaggagtcctatcaagcgggactttctgagcggcatacagatcgagttcaagcagagcagccaccagagaagcctgcgtgctcgactgtattggctgcaggtagacaatcagttgcctggggcgatgttcccagtggtgttccatcccgtcgcccctccaaagagtattgccctggattctgaacccaaacctttcatcgacgtgtctgtgataactcggtttaacgagtactccaaagttcttcagttcaaatattttatggttttgattcaggagatggctttgaaaatagaccagggctttctcggagctataatcgcattgttcactcccacaacagacccagaggcggagcgccgacgcacaaagctcatccagcaggacattgatgcactgaatgcggaactgatggagacaagcatgactgatatgagcatattaagctttttcgaacacttccacataagtccagtgaaactccacctatcactgagcctcggcagtggaggcgaggagtcagacaaggagaagcaggagatgtttgccgtacactccgtgaatctattgctgaagtctatcggggcgactctgactgatgtcgacgacctcatcttcaagcttgcgtattacgaaatccgctatcagttctataaaagggaccaattgatatggtcagtagtgcgccattacagtgaacagtttctgaaacagatgtacgtactcgtgctggggttggacgtcctgggcaacccgttcggtctaattcggggactatcagagggtgttgaggctctcttctacgagccatttcagggcgctgtgcaggggccagaggagtttgcggaagggctggttattggcgtgcgctctctctttggccacaccgtcggaggtgccgctggcgtcgtcagccgcataaccggcagcgtgggaaaagggcttgctgcaatcaccatggataaagagtaccagcagaagagaagagaagagctgagtaggcagcctagagatttcggagacagcctggcgaggggggggaaggggtttctgcgcggggtcgtaggcggggtgacaggaattattacgaagcctgtggaaggggcgaagaaagagggcgcagctggcttcttcaagggaattggcaaagggttagttggcgcggtcgcacgtccgactgggggcattgttgacatggccagctctacctttcaggggatccagcgagccgctgaatctactgaggaagtgtcatcactgagacccccccggctgattcacgaggatggaattataagaccctatgacaggcaagagagcgagggatctgacctgctggagaatcatatcaagaaacttgaaggcgaaacctacagatatcactgtgcaatccccggctccaaaaaaacaattcttatggttactaaccgcagggtgctttgtatcaaggaagtggagattttaggtctcatgtgcgttgactggcagtgtccgtttgaggacttcgtgttcccaccttcagtttcagaaaacgtgctcaaaataagcgtgaaagaacaggggctgtttcacaaaaaggactcggcgaaccaggggtgtgtgagaaaagtatacctcaaagatacggccacagccgagcgcgcctgtaacgctattgaagacgcccagagtacgcggcagcaacagaagttgatgaagcagtcgagtgtgcgacttctcagaccgcagctaccatcctag

SEQ ID NO: 34689 - DNA, 11262 bp, Artificial Sequence
  Description of Artificial Sequence: Synthetic coding sequence
atggtcctggagagcgttgtggccgacttgctgaaccgctttctcggcgattacgtggaaaacctcaataaaagtcaactcaagcttggtatctgggggggtaatgtcgccctggataacctgcaaatcaaggagaatgccctttccgaattggatgtgccctttaaagtcaaggctggtcagatcgacaagctcactctcaagatcccctggaagaacctgtatggtgaggctgtcgtcgccactctcgaggggttataccttctggtcgtacccggtgctagcatcaaatacgacgccgtcaaggaggagaaaagcttgcaggacgtgaaacaaaaggaattgtcccgaatagaggaggctctgcagaaggcagctgagaaaggcactcactccggtgagtttatatacggtttggaaaacttcgtgtacaaagatataaaacctggcaggaaacgaaaaaagcacaaaaagcactttaaaaaaccctttaaaggactggacagatcaaaggataagcccaaggaggctaaaaaagatacctttgtcgagaagcttgccacccaagtgatcaagaatgttcaggtaaaaatcactgacatacacattaaatatgaggacgacgtcaccgaccctaaaagacccctgtcctttggagtgacacttggcgaactaagcctgcttaccgctaacgagcattggaccccttgtatcctcaatgaagcggacaaaattatatataaattgatccgtttggactcgctcagcgcatactggaatgtcaactgcagcatgtcttaccagaggtcacgcgaacagattctggaccagttgaaaaacgagatcctcacctccggaaacatacctccaaattaccagtatatctttcagccaatcagtgcaagtgccaaactgtacatgaatccctacgcggagtctgagctgaagacaccaaagctggactgtaatatcgagattcagaacattgctatagagctgaccaaaccccaatacctttcgatgatcgacctgctggaatctgtggactacatggtgcgcaacgccccttaccggaagtataaaccttatcttcccctgcataccaatgggcggagatggtggaagtatgcgatcgacagtgtgttagaagtccatatccgacgatatacccagatgtggagctggagcaatataaagaagcatcgtcagctgttaaaaagctataagatcgcatataagaataaacttactcagtccaaggtctccgaagaaatacagaaggaaattcaagacttagaaaaaacacttgatgttttcaatatcattctggcgcgccagcaggctcaggtcgaggtcatcaggtctggtcagaaactccgtaagaagtccgccgacacaggggagaagcgcggcgggtggttttcgggactatggggaaagaaggagtccaagaagaaagatgaagagtccctgattccagaaaccatcgacgacctcatgacgccagaagaaaaggacaaactgttcacagccatcggctacagcgagtccacccacaacttgactctaccaaaacagtacgtagctcatattatgacactgaaactcgtctctacgtcagtgaccattagagagaataagaatatcccagagattttaaagatccagattattggactcggtacacaggtaagtcagaggcctggtgcccaggccctgaaggtggaggcaaaactggaacactggtatattaccgggcttcggcagcaggacatcgtgccctctctggtggcatccataggtgatactacctcttccttattgaaaattaagttcgaaactaatcccgaggactcaccggcggaccaaaccctcatcgttcagtcgcagccagtggaggtcatctacgacgcgaaaaccgtgaacgccgtagtggaattctttcagtccaacaaaggcctggatctggagcaaattacgtccgcaacactgatgaagctggaagagattaaagaacggactgccaccggactgacccacattatcgagactaggaaagtcctcgatttgagaattaatctgaagccctcatatctggtggtgcctcaaaccggcttccaccatgaaaagagtgatctgttaattttggacttcggtactttccagctgaattcaaaggatcaagggctgcaaaagacaacaaacagttctctggaggaaattatggacaaggcatacgataaattcgatgtggagatcaaaaacgtacaactactgtttgcccgagccgaggagacgtggaaaaaatgtagattccagcaccccagtactatgcacatcctccagcccatggacattcatgtcgaacttgctaaagccatggttgagaaggacatcaggatggcgagattcaaggtctccggaggactcccactgatgcacgtgagaatctcagaccagaaaatgaaggatgtgctgtatctaatgaactcaattccactgccacaaaaatcaagtgctcagagccctgaacgccaggtgagtagcataccaataatatctggaggcacgaaggggctgctgggaacctccctactgttggatacagtggaatcagaatcggatgatgagtactttgatgcagaggacggcgaaccacagacatgcaagagcatgaaagggagcgaactgaagaaagcagccgaagtcccgaatgaagagttgattaacttactcctcaaattcgagatcaaagaggttatactggagtttacaaaacaacaaaaagaggaagacacaatcttggtctttaacgtgacacagcttgggactgaggccacaatgcgcacctttgatctgacagtggtgagctacctgaagaagatctcccttgactaccatgagattgaggggagcaagcggaaacccctgcacctgatatccagctcggacaagcccggactggacctgcttaaggttgaatacattaaggcagataaaaatgggccctcgttccaaaccgcatttggaaagacggagcaaactgttaaagttgcctttagctcgctcaacctgttgcttcagacgcaagcactggtcgcatcaataaactatctgacaactatcatcccaagcgatgaccaatcgatcagtgtggcaaaggaagtgcagatttctaccgagaaacagcagaagaactcaacactgccaaaggcgattgtgagctcccgagatagcgacattattgactttagactgttcgcaaagcttaatgccttctgcgtcattgtgtgtaatgagaagaacaatattgccgagatcaagatccaagggctcgacagcagtttaagtctgcagtctaggaagcagtccctgtttgcgcggctggagaacataattgtgacagacgtcgacccaaagaccgttcataaaaaggcagtcagcatcatgggcaatgaggttttcaggtttaatctggatctataccctgacgccactgaaggggatctgtacaccgacatgagtaaggtagacggagtcctctctttaaatgtaggatgtatccaaatcgtatatttgcataaatttcttatgagcctactgaatttcctaaacaacttccagaccgcgaaagagagtctgtcagctgctactgcccaagccgcagagagagccgccacgtctgtcaaggacctggcccagagatcgttccgggtgtcaattaatattgacctcaaagcgcccgtaatagtgatcccccaatcaagcatatcaacgaatgcagtcgtcgtcgacctcggcctcattagggtgcacaaccagttttcactggtatctgacgaagactacctgaatcctccagtgattgaccggatggatgtgcagctcaccaaattgacactgtatagaactgtaattcagcctggcatctatcatccagatatccagttgctgcaccccataaacctcgagttccttgtcaatagaaacctcgccgcctcatggtaccataaagttccagtggtggaaattaaaggacatctggacagcatgaacgtgagtctgaatcaagaggacctgaatttgctcttccgcattctgacggagaatttgtgcgagggcaccgaagatcttgacaaagtcaaaccaagggtccaagaaacaggtgagattaaggagccactggaaatatccatcagccaagacgtacacgactccaagaacaccctgaccactggggttgaggagattcggtccgttgacattattaacatgctgctaaatttcgaaatcaaggaggttgtggtcacattgatgaaaaagtcagaaaaaaagggaagaccattgcatgagctgaacgtgttgcagctggggatggaagcaaaagtgaagacctacgacatgaccgccaaagcttacttgaaaaagatttccatgcaatgcttcgactttactgactccaagggagaacccctacacatcattaattccagcaatgttacagacgagcctttgctgaagatgctgctaacaaaagcagactccgacgggcctgaatttaagactattcatgatagcaccaaacagcggctcaaagttagtttcgcaagcctggatctagtcctccacctcgaagccttgctctctttcatggacttcctgtcgtcggctgcacccttttccgagccctcctcctcggagaaggaaagcgagcttaaaccgctggtgggggaatctcgcagtatcgcagtgaaagccgttagctccaacatatcgcagaaggatgtgtttgacttaaaaatcactgcggagttaaacgccttcaacgtcttcgtttgcgaccagaagtgcaatattgcagatattaagatccatgggatggacgcctctattagtgtgaaaccgaagcagactgacgtctttgcccggctcaaggacatcatcgtgatgaatgtcgacctgcagtctattcacaaaaaagccgtctctattctgggggacgaagtctttcgatttcagctgacactctacccagatgcaaccgagggcgaggcatatgcagatatgtccaaggtcgacggaaaattgagctttaaagtgggctgcatccagattgtctatgttcacaagtttttcatgtcgttattgaatttcctcaataattttcagactgcgaaagaagccctgtcaacagctactgttcaggccgccgagcgggccgccagcagcatgaaagatttggcgcagaaaagcttccgactgctcatggacattaatttgaaggctcctgttatcattattccgcagagttctgttagtccgaacgccgtgatcgcagacctgggtctgatccgggtggaaaacaagttttcattggtgccaatggagcactattcgcttcccccagtgattgacaagatgaacatagaattaacccagttgaagctatctagaactatcctgcaggcgagtctgccgcagaatgacatcgagatcctgaagccggtgaatatgcttctttctatacaacggaacttagctgccgcctggtacgtgcagattcccggaatggaaatcaaaggcaaattaaaacctatgcaggtcgccctcagcgaggacgacttgaccgtgctgatgaaaatcctgctggaaaaccttggggaagcctcatcccagcctagtcccacccagagtgtgcaggaaaccgttcgagtgcggaaggtcgatgtgagcagcgtccccgaccacctgaaggagcaggaagattggactgatagcaaactcagcatgaatcagattgtcagcttgcaattcgattttcatttcgagtccctgagcattattttgtataacaatgatatcaatcaggagagtggggtggcgtttcacaacgactccttccagctgggcgaactgcggttgcatctcatggcctcttctgggaaaatgtttaaagacgggagcatgaacgtatcagttaaactgaaaacgtgtaccctggacgatctcagagaagggattgagcgcgccacgtccaggatgatagatcgaaagaatgaccaagataataactcgtcaatgattgatatatcatataagcaggacaaaaacggaagccagattgacgcggtgttggataaattatacgtttgcgcgtcagtcgagttcctgatgacagtggcggatttttttatcaaagccgtcccccagagccccgagaatgtggccaaggaaacgcagattctgcctcgtcaaacagccaccgggaaggtgaaaattgagaaggacgactccgtccgcccaaacatgacactgaaggcaatgatcacggatcctgaagttgtgtttgtcgcaagtctgactaaggcagacgctccagccctgacggcgtcttttcaatgcaacctcagcctcagcacgtcaaagttagagcagatgatggaggcttcagtgcgagatcttaaggtgctagcctgccccttcctacgagaaaagagagggaaaaatatcacaactgtgctacaaccctgctctctgttcatggagaagtgcacgtgggcctccgggaaacaaaatattaatataatggtcaaggagttcataattaagatcagccctattatcctcaataccgtcctgacaattatggcggccttgtcgcctaagacgaaggaggatggcagtaaagacacttcaaaggagatggaaaacctttggggaatcaagtccatcaatgattacaacacttggtttctcggggtggacaccgccaccgaaattaccgagtctttcaaaggtatcgagcacagcctgattgaagaaaattgtggggtggtggtcgagtcaatacaagttactcttgaatgcggattgggtcaccgcacagttcctctgctcctggcggagagcaagtttagcggaaacatcaaaaattggacatccctcatggcagccgtggctgacgtgactttacaggtgcattattacaacgaaatccacgccgtttgggagccgctgattgagcgcgtggagggtaaaagacagtggaaccttaggctcgatgtcaaaaagaaccccgtgcaagataagtcactgctccctggggatgactttattcctgagccacagatggcaatccatatatcttccggcaacacgatgaacattacaatctcaaagagttgtctgaacgtcttcaacaaccttgctaaaggcttttccgaggggactgcatccacctttgactatagtctcaaagaccgagccccctttaccgtgaagaacgcagtgggagtacccattaaggtgaagccaaattgtaacctgcgcgtcatggggtttccggagaaatctgatattttcgatgtcgacgctgggcaaaacctcgaacttgagtacgccagtatggtgccgagctcccagggaaacctgtccatcctgagccggcaagagagcagcttctttaccctcacgatcgtgccgcacggatatactgaggtcgcaaacattccggtagcccggccagggcgccgtctctacaacgtgcggaatccgaatgcctctcactccgatagtgtacttgttcaaattgacgccactgaagggaataaggtgataactcttaggtcacctttgcaaatcaaaaaccacttttcaatcgcgtttatcatctataagttcgtgaaaaacgttaaacttttggagcggatcgggattgcacggcctgaggaggagttccatgttcccctcgactcatatcgatgccagcttttcatacaacctgccgggatacttgaacaccaatacaaagagtcgaccacatatattagctggaaggaagagttacatcgctctcgggaggtgagatgtatgctacagtgcccatctgtcgaggtgagtttcctgccattgatcgttaataccgtggccttaccggacgaactgagctatatctgtacacatggcgaggattgggatgtcgcttacatcatccatttatacccgagcctcacacttagaaatctgttgccgtactccttgaggtatctgctggagggcacagccgagactcatgagcttgctgaagggtccacagcagacgtcctccacagccggatttcaggagagattatggaacttgtgctggtaaagtaccagggaaagaactggaatggacattttcgaattagagatacactgccagagtttttccctgtatgcttcagcagcgattcgaccgaggtgactactgtggatctgtcagtccacgttaggcgaatcggatctaggatggtcctgagcgtctttagtccatattggctgattaataaaactacaagagtcctgcagtaccggtctgaggacattcacgtcaaacaccctgccgacttccgggatatcatcctttttagctttaaaaagaaaaatattttcacaaagaacaaggtccagctcaagatttccacatccgcatggtcctcttccttctccctcgacacagtcggcagttacgggtgtgtcaagtgtccagccaataacatggaatatctcgtgggagttagcatcaagatgtcttcctttaacctgtctcggatcgtaaccctgactccgttctgtactatcgcaaataaatctagcctagaactggaggtgggcgagatcgctagcgacggctccatgcccacaaataagtggaactacattgcttcgagcgaatgcttgccgttttggcccgagtctttgagcggaaaactgtgtgtacgagtcgtgggatgtgagggcagttccaagcctttcttctataatagacaggataacggtactctgttgtctctcgaagacctcaatggaggaatcctggtggatgttaacaccgcggagcacagtaccgtgattacctttagcgattatcatgagggttctgcgcctgctctgatcatgaatcacactccttgggatatacttacatacaagcagtcaggatctcccgaagaaatggttctgctgccgaggcaagcaaggctgttcgcttgggcagaccccactgggactcggaaacttacttggacctacgccgccaatgtgggcgagcatgatctgctcaaagacggatgcggacaatttccctacgatgcaaacattcagattcattgggtgtcctttttggatggcaggcagagggtgctcctgttcacggacgatgtcgctctggtatcgaaggctctccaggctgaagagatggaacaggctgattacgaaattaccttgtctctgcattcacttgggctatctctggtgaacaacgaaagcaagcaggaggtgagctatatcggcataaccagtagcggtgtggtgtgggaagtgaaacctaaacagaagtggaaacctttcagtcagaagcagattatcctgttagagcagtcctaccagaaacaccaaatcagtagggatcacggatggatcaaactggataataacttcgaggtgaacttcgataaggatcctatggagatgaggctccctatacgatcgcctattaagagagatttcctcagcggtatacagatcgagttcaaacagtcatcccaccaaaggagcttgcgcgcaagattgtactggctacaagtggacaatcaacttccaggcgcaatgtttcctgtcgtgttccacccagtggctcctccgaaatccatcgcactagacagtgagccaaagcctttcatcgatgtgagtgtgattacccggttcaacgagtactccaaggttctgcagttcaagtattttatggtgctgatacaggagatggccttgaagatcgatcaaggattcctcggtgctatcatagccctgttcacaccgacaactgaccctgaggccgagaggcgaaggacgaagttgatacagcaagatatcgacgccctcaatgccgaactgatggaaactagcatgactgatatgtcaattctgtccttcttcgaacatttccacatctcacctgtcaagctgcatttatctctctcccttgggtctgggggcgaagaatccgataaggagaaacaggagatgttcgctgtgcatagcgttaacctcctgctgaagagcatcggggccactctcactgatgtggacgacctgatattcaagctcgcatactatgagatcaggtatcagttttacaagcgcgatcagctgatatggagtgttgtgcggcactatagtgagcagttcttaaagcaaatgtatgttcttgtactaggactggatgtgctcggtaatccattcgggttgatccgtgggctgtctgagggggtcgaggcattgttctacgaacctttccagggcgcagttcagggcccggaagaatttgctgagggactggttatcggcgtgcgatcactgttcggccacactgtggggggagccgccggcgtagtgagtaggatcactggcagcgttggcaagggacttgctgccattacaatggacaaggaataccaacagaagagacgggaggaactcagcagacagcctagggatttcggcgacagcctcgcaaggggggggaagggattcctcagaggggtcgtgggcggtgtgacagggatcattacgaaacctgtggaaggggctaaaaaagaaggagccgcggggttctttaaagggattggcaagggccttgtgggcgcggtggctcgcccaacaggcggcatcgtggacatggcatcttcaaccttccagggcatccagagagctgccgagtcaaccgaggaggtctcatcactgagaccaccacgtctcatccatgaggacgggatcattcggccttacgatcgccaagaaagcgaaggaagtgacctccttgagaaccacatcaagaagctggagggagagacatatcgatatcattgtgctattcccggctccaaaaagaccatactgatggtgacaaatcgacgtgttctgtgtatcaaagaagtagagatcctcggtcttatgtgtgtggattggcagtgtccttttgaggatttcgtcttccctccgtcagtctctgaaaatgtgctgaagatttctgtcaaagagcagggtttgtttcataaaaaggatagtgcgaaccagggatgcgtgcgaaaagtctatctgaaagataccgccacagccgaacgcgcctgcaatgctattgaagacgcccagagcacaagacaacagcaaaaactgatgaagcagtcaagcgtgagacttttgaggccccagttgcctagctag

SEQ ID NO: 34690 - DNA, 10887 bp, Artificial Sequence
  Description of Artificial Sequence: Synthetic coding sequence
atggtcctggaaagtgtcgtagcagatttgctgaaccggtttctgggggattacgtggaaaacttgaacaagagccagttaaaattggggatctggggaggaaacgtggcattggacaatctccagattaaggaaaacgccctcagcgaactggacgtgcccttcaaggttaaagccgggcagatcgacaagcttactttaaaaatcccgtggaagaacctctatggagaagccgtagtggctaccttagaaggactgtacttactagtagttcccggagctagcatcaaatatgacgccgtaaaagaagagaaatcacttcaggacgttaagcaaaaggaactgtcacgcatagaagaggccctccagaaggccgctgaaaaaggtacccactccggcgaatttatttatgggcttgaaaactttgtttacaaggatattaaaccagggcggaaacggaagaaacacaaaaagcacttcaagaagccattcaaagggttggatcgctccaaagacaaacccaaggaggccaagaaagacacattcgtagagaaactggccacccaggtcatcaagaacgtccaggtcaagatcaccgacatccacatcaagtacgaagatgatgtcacagatcccaaacgaccactgagcttcggagtgaccctgggggaattgtcccttctgaccgcgaacgagcactggactccatgtattctcaatgaagcagacaaaatcatctataagttgattcgcctcgattcgctctctgcctattggaatgtgaactgttctatgagctatcaacgctccagagaacaaattctcgatcagctcaagaatgagattttgaccagtggaaacatcccgccaaattaccaatatatattccagcccatttcggcctcagcgaaactctacatgaacccctacgctgagagcgaattgaagaccccaaagttagactgtaacatcgaaatccaaaatattgccattgagctcaccaagccccagtacctgagcatgatcgacttgctggagagtgtggactacatggtccggaatgcaccatatagaaaatataagccgtatttaccgcttcacactaacggcaggcggtggtggaagtatgccattgacagtgtcctcgaagtccatataaggcggtacactcagatgtggtcatggtccaatatcaaaaagcataggcaacttctaaagtcatataagatcgcatacaagaacaagctgacgcagtcgaaggtctccgaggagatacagaaagaaatccaggacttagaaaaaacattagatgtctttaatataattctggcaagacaacaagctcaggtcgaggttatccgctcagggcagaagctgagaaaaaagagcgccgatacgggagagaagcgcggcggctggttttctggactctggggaaaaaaagaatcaaagaagaaggacgaagaaagcctgatccccgagactattgatgacctgatgaccccagaagaaaaagataaattattcacagctatagggtatagtgagagtacccacaacctgacactgcctaaacagtatgtggcgcatattatgaccctgaaattagtgagcacttccgtaaccattagagagaacaagaacattcccgaaatcctcaagatacagatcatcggtctcggaactcaggtgagccagcggccgggcgcgcaggctctgaaggtcgaagccaagctggagcattggtacatcaccggcctgagacagcaggacatcgtgccatccctcgtcgccagtatcggagacaccacaagttcactactgaagatcaaatttgaaacaaatccggaggactcacctgccgaccaaacactcatcgtacagtcccagcccgttgaggtgatctacgacgctaaaacggtaaacgcagtggtagagtttttccagtcgaacaagggtctcgacctggaacaaattacttctgccactcttatgaagctcgaagagattaaggagcggaccgccacggggctcacccacatcatcgagaccaggaaggtactggacttaaggataaaccttaagccatcctacttagtagttccgcaaacaggcttccatcatgaaaagagtgatttactgattctggacttcggaaccttccaactgaattcaaaggaccagggcctccagaagactactaacagcagtttggaggaaatcatggacaaagcatacgataaatttgatgtggagataaagaacgtgcaactgctttttgcgagagcagaagaaacgtggaaaaagtgcagattccagcatccctccaccatgcacattctccagcccatggacatccatgtggagctggcgaaagcaatggtcgagaaagatattcgaatggcaagatttaaggtctctggtggtctgcccctgatgcatgtgaggatatcagaccagaagatgaaggacgttctctacctgatgaattcgattcctctgccacagaaatccagcgcgcagtcccctgaacgacaagtctccagtattccgatcatatccggaggtaccaaaggactactaggaaccagcctcctgctggacaccgttgagagcgagtcagacgacgagtacttcgatgccgaggatggcgagcctcaaacctgtaagtcaatgaagggcagtgagctgaaaaaggcagctgaggtgcctaacgaagagctcattaatctgctcctaaaattcgagattaaggaagtaatcctggagttcacgaagcagcaaaaggaggaagataccattctggtctttaacgtcacccaactgggcaccgaggccacaatgcggaccttcgatctgacggtcgtgtcgtatctgaagaagatatctctggactaccatgaaatcgaggggagtaagaggaaacctctgcacttgatatcttccagcgacaaacctggactggacctcttgaaagtcgaatacattaaagctgacaaaaacggcccatcatttcaaaccgcgttcggcaaaactgagcagacagtgaaggttgctttttccagcctcaatctcctgttacagacccaagcactggtggcctctatcaactatctcaccactatcattccctcagacgaccagtccattagtgtcgccaaagaggtccagatctccacagagaaacaacaaaagaattctacactgcctaaggcaattgtctcctctagggacagtgacattatcgacttccgcttgttcgccaagctgaatgccttctgcgttattgtttgcaacgagaagaacaatatcgctgaaattaagatccagggccttgattcatcactgtcactccaatcaaggaagcagtccctgttcgcccgcctggagaacattattgtcactgatgtggatcccaagacagtacataagaaggctgtgtctattatgggcaacgaggtttttagatttaatctggacctctatcccgacgcaaccgagggagacttgtatacagacatgtcaaaggtcgacggtgtgctatccctgaacgtgggttgtatacagatcgtctacctccataaatttctgatgtccctcctgaattttctgaacaacttccagaccgcaaaggaaagcttatccgcggcgacagcccaggccgcagagcgagctgcgacatccgtgaaggatcttgcgcagcggagctttcgggtttctatcaacatagatcttaaggccccagttatcgtgatcccccagagctcaatcagtaccaatgccgtggtcgttgaccttggccttatccgggtccacaatcagttctccctagtgagcgatgaggactaccttaatcccccagtgatcgaccgcatggacgtccagttaacaaagctgactctgtatcggacggtaatccagcccggcatttaccatcctgacatccagttgctgcaccccattaatcttgagttccttgtcaaccgaaacctcgccgcgtcctggtatcataaagtaccagtggttgagatcaaggggcacctggactccatgaatgtgagccttaatcaagaagatctgaacttgttattcagaatcctgactgagaatctgtgcgagggaacagaggatctggataaagttaaaccacgagttcaggagaccggagagataaaggagcccctcgagatcagcattagccaagatgttcatgactcaaagaatactcttacaaccggagtggaagaaatacgcagtgtggacattatcaacatgctacttaactttgaaattaaagaggtggtcgtcaccctgatgaaaaagtctgaaaagaaagggcggcctctacatgagttaaatgtcttgcagctggggatggaagcaaaagtcaagacctacgatatgacagccaaagcatatctgaagaagatttcaatgcagtgctttgacttcaccgacagtaagggcgaacctctgcacattattaactcctctaatgtgactgatgagcccttgcttaaaatgctcttgaccaaagctgattctgatggaccagaatttaaaacgatacacgattccaccaagcaaaggctcaaggtgtcttttgcctcactcgatctggtacttcacctggaggccttgctcagttttatggattttttgtcgtccgcagccccatttagtgaaccatcgagttcagagaaggaaagtgaactgaaaccgctggtcggcgaaagccgaagtattgcagtcaaagctgtcagctcaaatatctcccagaaggatgtttttgacttaaaaataacggctgaactgaacgctttcaacgtgttcgtatgcgatcagaagtgcaacatcgccgacatcaagatccatggtatggatgcatctatttctgtcaagcctaagcagactgacgtgttcgcgagactgaaggacataattgtgatgaacgtagatctgcagagtattcacaaaaaagctgttagcatcctcggtgatgaggtatttaggttccagcttacactgtatcccgacgcaaccgagggcgaggcctatgccgatatgtctaaggtagacgggaaattgagtttcaaagtgggatgcatacagatcgtgtacgtgcacaagttctttatgtccctgcttaatttcttgaacaatttccagactgccaaggaggctttatcgaccgccacagtgcaagccgctgagagggcagcttcctctatgaaggacttagcccagaaatccttcagactcttaatggatattaatttgaaggcccctgtgattatcatccctcaatccagtgtgtcaccaaacgccgtcatcgctgaccttggtctcattagagtggaaaataagttttcgctggttcccatggagcactattctctacccccagtgatagacaagatgaatatcgaactaactcagcttaagctgtccagaacgatattgcaagctagcctgcctcaaaacgacatcgagatcctgaaaccggtgaacatgctgttaagcatccagaggaacctggcagcagcttggtatgtgcagataccaggcatggaaatcaaagggaaacttaaacccatgcaggttgctctgtccgaggatgatctgaccgtcctgatgaaaatccttctagagaacctgggagaggcttcctcacagcctagcccaacgcagtcagtgcaggagacagtccgagtgcggaaagtcgatgtgtcaagtgtcccggaccacctcaaagagcaagaagattggacggatagcaaattgagtatgaatcagatagtctccctgcagtttgacttccacttcgaaagcctatcaataatactttacaataatgacattaatcaagagtccggtgtggcttttcacaacgatagttttcaactgggtgaactcagactccatttgatggcctcatcgggaaagatgttcaaagatggaagtatgaatgtgtctgtaaagctaaaaacatgcacgctggatgacttgagagaaggcatcgagagagctacctcccgcatgatcgataggaaaaatgatcaggataacaactcctcaatgattgacatttcttataaacaagataaaaatggttcccaaattgacgcggtgctggataagctctatgtctgtgcaagcgtcgagtttttgatgactgttgcggatttcttcattaaagcggtgccccaatctccagaaaacgtggccaaggaaacacagatacttcctagacagactgccactggcaaagtgaaaatcgaaaaagacgattcagtccggcccaatatgactttaaaagctatgatcacggaccccgaagtggtatttgtggcttcactgactaaggcggatgcccccgctctgaccgcctcttttcagtgtaatctcagtttgtcaacctccaagctagaacagatgatggaggccagcgtgcgcgacttgaaggttctggcctgtccctttctgagagagaagagaggtaagaacataactacagtgctgcagccttgctccctcttcatggagaagtgtacttgggctagcggcaaacaaaacatcaacatcatggttaaagaattcattatcaaaatttccccgattatccttaacaccgtgctgaccatcatggctgctctttctccaaagacaaaagaagatggtagcaaagacacctccaaggagatggagaacttatggggcattaaaagcattaacgactataacacttggtttttaggagtggacactgctaccgaaatcactgaatcgttcaaaggcatcgagcactcactgattgaagaaaactgtggcgtcgtcgtggagtccatacaggtgaccttggagtgcggactgggccacaggacagttccgctgctcctcgccgagagtaaattcagcggcaatattaaaaattggactagcttaatggcagctgtcgccgacgtgacacttcaagtgcactactacaacgaaatccacgctgtctgggagcctctgattgaaagggttgagggtaaaagacagtggaacctgcgtctggatgtcaaaaagaaccccgtgcaggacaaatccttgctgcctggcgacgatttcatcccagagccacaaatggccatccatatctcttccggaaacaccatgaatattacaatcagtaagagttgtctgaatgtgtttaacaacctggccaaaggtttcagtgaggggacagcctccacatttgactattcactgaaggatcgggcacccttcacagtcaagaacgccgtcggagtgcccattaaggtgaaacctaattgcaatctgagggttatgggttttccggaaaagtctgacattttcgatgttgatgctggccagaacctggaattagagtatgcaagcatggtcccctccagccaagggaacctgagtatcctcagtagacaggaatcgtcctttttcactctgactatcgttcctcacgggtacaccgaggtggccaatatacctgtcgctcgaccagggaggcggctgtacaacgtcaggaaccctaatgcgtcacatagtgatagcgttctcgtgcaaatcgacgccaccgaagggaataaggtgataactttgagaagcccccttcagatcaagaaccacttttctatcgccttcattatttataagttcgtgaagaacgtgaaactcttggagcgtatcggcatcgcccgccctgaagaggagtttcatgtgccactggactcctacagatgccagttattcattcaacctgccggaattctggagcaccagtataaagagagcaccacttatatttcttggaaggaggagctgcatcgcagtcgcgaagtgcggtgtatgctccaatgtccttcagtcgaggtatccttcctcccactgattgtcaataccgttgccttacctgatgagctgtcatatatatgcacacacggcgaggattgggatgtcgcttatattatacatctctatccgtccctgaccttacggaacctgcttccatactcactgagatatctgttagagggcacagccgaaacccatgagctcgcagaaggcagtactgcggatgtcctccattccagaatttccggcgaaatcatggagctggtcctggtcaagtatcaggggaagaattggaatggccacttccgcattcgcgatactttgcctgagttctttcctgtgtgcttttcaagcgattccacagaggtgaccaccgtggatctcagcgtgcacgtgcgccgcattgggagtaggatggtcctgtccgttttcagcccctattggttgattaacaagaccacccgagtcctccagtaccggtctgaagatatccacgttaaacaccccgccgattttcgcgacatcatcctcttctcttttaagaagaaaaatattttcactaaaaataaggtgcaactgaaaatctcaacgtctgcctggtcttcctctttctccctggacacagtggggtcatatggctgtgtgaaatgtccagctaacaacatggaatatcttgttggcgtgagcattaagatgtcgtccttcaatctttctcgcatagtgacccttactcctttctgcactattgccaataaaagcagtctggaactcgaggtgggcgaaatcgcctcagacggaagcatgcccaccaataagtggaactacatagccagctctgagtgcctgcctttctggcccgagtccctgtccgggaaactatgtgtcagagtggtgggctgcgagggctcctctaaaccttttttctacaatagacaagacaacggtacattactgtcactcgaagatctcaacggcggtattttggttgatgtgaacactgccgagcatagcacagttattacattctccgattatcatgaggggagcgcccccgccttgatcatgaaccacacaccatgggatattttaacctacaagcaaagtgggagtccagaggagatggttcttctgccacgccaggcacgtttgtttgcctgggccgaccccacgggaaccaggaagctgacatggacatatgcagccaatgtcggagagcatgacctacttaaggacggctgcggtcagtttccttacgatgccaatatccaaatccattgggtttctttcctggatggacggcaacgagtgctgctttttacagatgatgtcgcgcttgtgagcaaggctctgcaggcagaagaaatggaacaggctgactacgagatcactctgtcactgcacagcctgggccttagtcttgtaaacaacgagtccaagcaggaagtgtcttacattggtatcacatcgtccggtgtagtgtgggaggtgaaacctaagcaaaagtggaagcccttcagccagaagcagatcatcctcttggaacaatcttatcagaaacaccagattagccgggaccatggatggatcaagctggataataactttgaagtgaacttcgataaggatcctatggaaatgcgtttacccatacgatcacccattaaacgcgattttcttagtggtatccagattgagtttaagcaaagctcccatcagcgaagtttaagagccagactgtactggctgcaggtggataatcagctgcccggggcaatgttccccgtggtgttccaccccgtcgcccctcctaagtccatcgccctggatagcgaaccaaaaccattcattgacgtctccgtgatcactcggtttaatgaatattcgaaggtcctccagttcaagtacttcatggtcctgatacaggaaatggcattgaagattgaccagggcttccttggggccattattgcccttttcacccctacgactgatcctgaagccgaaagacgtcgtacaaagctgattcagcaggatatagacgcgcttaatgcagaactgatggagacatcaatgacagacatgtccattctgtctttcttcgagcacttccacattagccctgtgaagctccacttgagtctctcattgggatccggcggtgaagaatcggataaagaaaagcaggaaatgtttgctgtgcactcagtaaacctgttgttaaagtcaatcggcgccaccctgacagacgtcgatgatctgatttttaagttagcatattacgagattagataccaattttacaagagggatcagcttatctggtctgtcgttagacactactctgagcagtttctaaagcagatgtatgttctggtgctggggctggacgtgctgggcaacccattcggactgattcgcggactctccgagggggtggaggctctgttctacgagccctttcagggcgcagtccagggacctgaggagtttgccgaaggcctcgtcattggtgtgaggagtctctttggtcatacggttggcggagccgctggcgtggtgagccgaatcaccggaagcgtcggaaaagggctcgcagccatcacaatggataaagagtaccagcagaagagaagggaggagctaagccgacaaccaagagatttcggcgatagtctggcacgcgggggcaagggctttctgcggggcgtggtgggcggagtgacaggaatcatcacgaaaccagtggagggtgctaagaaggagggagcagctggcttcttcaaagggatcggcaaaggcctcgtaggtgccgtggcccggcctacaggtggaatcgtggatatggccagttcaacttttcagggcatccagagggccgcggagagcacagaagaagtgagcagcctgcggccaccaagacttattcacgaggacgggatcatacgcccatacgacagacaggaatccgaggggtccgacctcctggagcaggagttagaaatccaggaatag

SEQ ID NO: 34691 - DNA, 10758 bp, Artificial Sequence
  Description of Artificial Sequence: Synthetic coding sequence
atggtcctggaatccgttgttgctgaccttcttaaccggttcctgggagactacgtggagaatctgaataagagccagctgaaactgggaatatgggggggcaatgtggccttagacaaccttcaaataaaggagaatgccctcagcgaactggacgtaccatttaaagtaaaagcgggacagatcgataagttaacactgaagatcccctggaagaatttgtacggggaagccgtggtggccacactcgaaggattatacctgctcgtggtccccggtgcgtccattaaatatgatgccgtcaaggaagagaagagcctacaagatgtgaagcagaaggagctctccaggatcgaggaggccctccagaaggccgccgagaaggataagcctaaagaggccaagaaggacacattcgtggagaagttggcgacccaggtgatcaaaaacgtgcaggtaaagatcacagacattcacattaaatacgaagacgacgtgactgatcctaagcgcccactgagtttcggagtgacactcggggaattatctcttcttacagccaatgaacactggaccccttgcattttgaatgaggcggataagattatttacaagctcatccggctggattccctgtctgcctactggaacgtcaattgcagtatgtcctaccaacggagccgagagcaaattctggaccagctgaaaaacgagatcttaacttctggaaacatccctcccaactatcagtacattttccagcccatctccgcttctgccaagctctatatgaacccttatgctgagagcgagctaaagacgcctaagctggactgtaacattgagatacagaacattgcaattgaactgacaaaaccacagtacctgtcgatgatcgacctcttggagagtgtcgactatatggtcagaaacgcaccatatcgcaaatataagccctatttgcccctccatacaaacggacgccggtggtggaaatacgcaatcgattccgtgctggaggtacacatcagaaggtacactcagatgtggtcatggtccaacattaagaagcacagacagctgctgaagtcttacaaaatagcttataaaaataagctgactcagtcgaaggtttctgaagaaatccaaaaagagattcaagacttggagaagactctcgatgtcttcaacatcattcttgcccgccaacaagcccaagtggaggttattagaagcggacagaaactgcgcaaaaagtcggccgatacgggcgagaaacgaggtggctggttttcagggctatgggggaaaaaagagtcaaaaaagaaggacgaggagtcgctgattccagaaacaattgatgacctgatgactcctgaggagaaagacaagctgtttactgctatcggttactccgagagcactcacaacctgaccttacccaagcaatacgtggcccatataatgacactgaagttggtgagcacatctgtgacaatccgcgaaaataaaaatatcccggagattctcaagatacagatcattggccttgggacccaggttagccagcgcccaggcgcccaggcgctgaaggtcgaagccaaattggaacattggtatattactgggctgcgacagcaggacatcgttcccagtttggtcgcttcaattggtgacacgacgagctccctcctcaaaattaagttcgaaacaaaccccgaggacagtccagccgaccagactttaatcgtacagtcccagccagtggaagtgatctatgacgctaagaccgtgaacgctgtggtcgagtttttccaatcaaacaaaggacttgatctcgaacagatcactagcgccacccttatgaaactggaggaaattaaagaacggacggcaaccgggcttacccatattattgaaacccggaaagtcctagacctgcgaattaacttaaaaccttcctacctagttgttccccagacaggttttcaccatgagaagagcgatctgctgatcctcgattttgggacctttcagctcaactctaaggatcagggactacagaagactacaaactctagtctcgaagagatcatggacaaagcctacgataagttcgatgtagaaatcaaaaatgtacagctgctcttcgctcgcgccgaggaaacctggaagaaatgtaggttccagcatcccagcacgatgcatatactccagcccatggacatacacgttgaactcgccaaggccatggttgaaaaggacatccgcatggcccgctttaaagtttccggcggtctgcccttgatgcatgtgcgcatatctgatcagaaaatgaaagatgtcttatacctgatgaattcaatacctctacctcagaagtcttccgctcagagtcccgaacgccaggtgagtagcattcctattatctccggggggaccaagggactcttggggactagcttactcctggacacggttgagtcggaatcggatgacgaatattttgacgcggaagacggggagccccagacgtgcaaaagtatgaagggcagcgaactgaagaaagcagccgaggtcccaaatgaagagctgatcaacctccttttgaaattcgaaatcaaggaagtaattttggagttcaccaagcagcaaaaagaagaggacactattctcgtgttcaacgtgacccagctcggaactgaagcaacaatgaggacctttgacttgactgttgtgagctatttgaaaaaaatctccctggactaccacgagatcgagggatctaaaaggaagccgctgcatttaatttccagttccgacaagcccggactggatctgctgaaggtggaatacatcaaagccgacaaaaacggaccaagcttccagaccgccttcgggaaaaccgaacagacagtcaaagttgccttctcttccctcaacctgcttctccagactcaggccctggtagcgtccatcaattatctgaccacaattatacctagcgacgatcagagcatcagcgtggccaaagaagtgcaaatttccactgagaagcagcaaaaaaattcaacgttacccaaagccatcgtctcgagccgcgacagtgacataattgacttccgcctgtttgctaaactgaacgcattctgcgtgattgtgtgtaacgaaaagaacaacatcgccgaaataaaaattcaaggtctcgacagcagcctgtctctacagagtcggaaacagtccctcttcgctaggctggagaatatcatagtcactgacgtggaccccaagaccgtgcacaagaaagcagtctctattatgggtaatgaggtctttcggtttaatttggacctgtatcccgacgcaaccgagggcgatctgtatacggatatgtctaaagtggatggagtcctgtcactgaacgtcggatgtatacagatcgtttatctacataagttcctaatgtcccttctgaacttcctgaacaatttccaaacggccaaggagtctctctcagctgccacagcacaggccgccgaaagagcagctacgtcggtcaaagatctcgctcagcgatcctttcgggtcagtattaatatcgacctaaaggccccagtaatcgtcatacctcaatcctccatctcaaccaatgcagtcgtggttgaccttggactaatcagggtacataatcaatttagcctggtaagtgacgaagactacttgaacccccctgtaattgaccggatggatgttcaactgaccaaactgacattataccgaaccgtaattcaacctggaatttaccatcccgacatacaactactccaccctattaatctggagtttctcgtgaaccgcaatctggccgcctcctggtaccataaggtgcctgtagttgagatcaagggtcacctcgatagcatgaacgtaagtcttaaccaagaagatttgaaccttctgtttagaatactgaccgagaatttgtgcgaaggcactgaagatctggacaaagtgaaaccccgggtgcaagaaaccggggaaatcaaggaacctctggagatttctataagtcaagacgtgcacgacagtaagaacacccttactaccggggtggaagagattcgcagcgtcgacataatcaacatgttgcttaacttcgagatcaaagaggtcgttgtcaccttaatgaaaaagtccgagaaaaagggtcgacccctccacgagctcaatgtgctgcagctgggaatggaggcaaaggttaagacctatgacatgaccgctaaggcttatcttaaaaaaatctccatgcagtgctttgactttacagactcaaagggagagcctctgcacatcataaacagttcgaacgtaacagatgagcccctcctcaaaatgttgctgacaaaagccgactcagatgggcccgagttcaaaactatacacgatagcactaaacagcgcttgaaagtgtctttcgctagtctcgaccttgtgttacatcttgaagcacttctcagctttatggattttctgagttctgccgccccattctcggagccttcctcctccgagaaggagtcggagttaaaaccactggtgggggagagcaggagcatcgcagttaaggcggtgtcctctaacatcagccagaaagacgtgtttgaccttaaaatcaccgctgagctgaatgcatttaatgtatttgtgtgtgatcagaagtgcaacattgctgacattaaaatccatgggatggacgcatcaattagcgtgaagcctaagcagactgatgtgtttgcacgtcttaaagacatcattgttatgaacgtggatctgcagtcaatccataaaaaggcggtaagcatactaggggatgaagttttccgctttcagcttaccctctacccagatgccaccgagggagaggcctatgccgatatgagcaaagtggacggcaagttgagctttaaggttggatgcattcagatcgtgtacgtccacaaattcttcatgagtttgctgaactttctgaataacttccagaccgcaaaggaagctctgtccaccgccacggtgcaggctgccgagagggctgctagctctatgaaagatctagctcaaaagagttttagactgctcatggacatcaatctgaaggcccctgtgatcatcatccctcaaagttcagtttccccgaacgccgtgatcgccgatctgggtctgatcagagtggagaataagttttcactcgttccaatggagcattactctctgcccccagtcatagacaagatgaatattgagttgactcagctgaaactctccagaactattttacaggcctcgttgccccaaaatgacatagagattcttaagccagtgaatatgctgttgtccattcagagaaacctggccgcagcgtggtatgtgcaaatacctgggatggagattaaagggaaactcaagcctatgcaagtcgctcttagcgaggacgacctgacagtgcttatgaaaatactcttagagaacctaggagaggcctcatctcaacccagcccaacacaaagcgtgcaggagactgtccgggttagaaaggtggatgtgagttctgtaccagatcacctgaaggagcaggaagactggacagactccaaactgagtatgaatcaaatagtgtctttgcaattcgacttccatttcgaaagcctctccattatcttgtacaataatgacatcaaccaggaaagcggcgtggcattccacaacgactcgtttcaactcggggagttacggctgcacctcatggcgtcctcgggcaagatgttcaaagatggttcaatgaatgtaagcgtgaagcttaaaacctgtacactggatgaccttcgtgaaggaatcgagagagctactagccggatgatcgatcgcaagaatgatcaggacaataatagtagtatgatcgacatatcctacaagcaggataagaatggctctcaaatcgacgcagtgctcgacaagctgtatgtctgcgctagcgtggaattcctgatgacagtcgcggattttttcataaaggcagtaccacagagtcctgagaacgtagctaaggagacccaaatcctgcctcgccagactgcaaccggcaaagttaagatcgaaaaagacgacagcgtgcgtccgaacatgacactcaaagcgatgatcacagaccccgaggttgttttcgtcgcctctctgacaaaggctgacgcccccgcattgaccgcatcatttcaatgtaacctctccctgtcaacgtcgaagctggagcaaatgatggaagccagtgtcagggacctgaaggttctggcatgcccctttctgcgggagaagcgcggtaagaatatcacaactgtgctccagccctgctctctctttatggaaaaatgcacctgggcctctggaaaacagaacatcaacattatggtaaaggaattcattatcaaaatttccccaataattctcaataccgtgcttactattatggctgccttgagcccaaagacaaaggaggacggttctaaagatacatctaaagagatggaaaatttgtggggaattaagagtatcaatgactacaacacgtggttcttaggcgtggacactgccacagagataacagaatccttcaagggaatcgagcactccctgatcgaggaaaactgtggggttgtagtggaaagcatccaagttacactggagtgcggtctaggtcataggaccgtgcctctgctgctggccgagagtaagttcagcggtaacattaaaaattggacctcactgatggctgcagtcgcagacgtgaccctccaggttcattattacaacgagatccacgccgtgtgggaacccctcatcgaacgagtggagggcaagagacagtggaatctcaggttagatgttaagaagaacccagttcaggacaaaagcttgcttcccggtgatgatttcatcccagagccgcagatggccatccacatctcatccggtaacaccatgaacatcaccatctccaaatcttgcttaaacgtcttcaataacctcgcgaaagggttctccgagggaaccgcctcaacctttgattacagcttaaaagatagggcccctttcacagtgaagaatgccgtaggggtgcccatcaaggtcaagccgaactgcaaccttcgggtgatgggattccctgaaaaaagcgacatctttgacgtggacgcagggcaaaatctcgagttggagtatgcaagtatggtgcctagcagccagggtaacttgagtatactctccaggcaggaaagttccttttttactctcacaattgtgccccacggctacaccgaggttgcaaatatccctgtagccaggccaggacgcaggctgtacaatgtcaggaaccctaatgcctcccactctgatagtgtcctcgtccaaatagacgccacagagggtaacaaagtgataacactccgctcgcctcttcaaatcaaaaatcatttcagcatcgcctttatcatttacaaattcgtgaagaacgttaaactgctcgagcggatcggtattgcacgtccggaagaggaatttcacgtacccttggactcctataggtgtcagctctttatccagcccgccggaatcctggagcaccaatacaaggagtccactacttacatctcctggaaggaggaacttcaccggagcagagaagtccgctgcatgctgcaatgcccttctgtggaggtcagctttttgccattgatcgtgaatacagtggccttgccagacgaactgtcctacatatgcacacacggtgaagattgggacgtggcgtatattattcatctgtatcctagcctgacactgcggaacctccttccatacagtctccggtacctgctggaaggaaccgcggaaacccacgagctggcggaaggctctaccgcagacgttcttcatagcaggattagtggcgagattatggagctggtactcgtgaagtatcaaggaaaaaactggaacggccatttccgtataagagacaccttgccggagttctttcccgtttgttttagcagtgattctaccgaagttacaacggtcgacctaagcgtgcacgtccggcgaataggcagccggatggtcctctccgttttttccccttattggcttattaataagaccacaagagtgttacagtacagaagcgaagatatccacgtaaaacacccggccgattttagagacattattctcttcagtttcaaaaagaagaatattttcacaaaaaataaagttcaactgaaaatctcaacatccgcctggagttccagcttcagtctggacacggtgggctcctacggctgcgtgaagtgtcctgccaataacatggagtacttggtcggggtaagcattaaaatgtcttccttcaatttatcccgcatcgtgaccttgacaccattttgtaccattgctaacaaatcttcattggaactcgaggtcggcgaaatcgccagcgatggcagcatgcctaccaacaaatggaattacatcgcttcttctgagtgtctcccattctggcccgagtccctgtccggcaaactatgcgtccgcgttgtcgggtgcgaaggcagtagcaagcccttcttttacaaccgccaggataatggaactcttctctcactcgaggatctgaatgggggaattctcgtcgacgtcaataccgccgagcacagcacagtgatcacattctccgactaccacgaggggtctgccccggctctgatcatgaaccacacgccctgggatattctgacatacaaacaatccggaagcccggaagaaatggtactgctgcctagacaagcccggctcttcgcatgggccgaccccacaggcacccggaagcttacatggacttatgccgcaaatgttggggaacacgacctactgaaggatgggtgcggccaatttccgtacgatgcaaacattcagattcattgggttagctttctcgatggccgccaaagggtgctcctgtttactgatgacgtcgccctggtgtctaaggctctgcaggcggaagagatggaacaggcagactacgagatcaccttgtcacttcacagcttgggtctcagcctggtcaataatgagagtaagcaggaagtatcttatataggtatcactagttcaggggtggtatgggaggtaaaaccgaaacagaagtggaagcctttttcccagaagcagattatcctcctagagcagagctaccaaaagcatcagataagtcgagatcacggatggatcaagctggacaacaactttgaggtcaattttgataaggaccctatggaaatgaggctgcccattcgctcacccataaagcgcgactttctatcggggatccagattgaattcaagcaatcttcacaccaaagatcactccgcgctaggctgtactggcttcaggttgacaatcagctgccaggcgccatgttcccagtggtgtttcatccggtagcaccacccaaatccattgcacttgactcagagccaaaaccattcattgatgtcagcgtgatcaccaggttcaacgaatactcgaaagtgcttcagtttaagtacttcatggtgctgattcaggaaatggcactgaaaatcgatcaaggctttttgggggccattatcgcactttttacacctactacggatcctgaagcagaaagaaggaggaccaagctaatccagcaagacattgacgctctgaatgcggagttgatggaaacttcaatgacagacatgagcatcctcagcttttttgaacactttcacatcagccccgtcaaactgcatctttcacttagccttggctctggcggcgaggagtcggacaaagagaagcaggagatgtttgcagtacacagcgtaaacctgctcttgaaatctatcggagcaaccctcaccgatgtcgacgatctgattttcaaactcgcctattatgagattcggtatcagttctataaaagagatcagttaatctggtcagtcgtccgccactattctgagcagtttctcaagcagatgtatgtgctagtgttggggctcgatgtgctggggaatcctttcggcctgattcggggactgtctgagggagtggaggccctgttctacgaaccttttcagggtgcggttcagggacctgaagagttcgccgaaggcttagttatcggagtgcgcagcctgtttggccacacagtcggaggagcagccggagttgtgtctcggataacaggctccgtgggcaaaggactggccgccattactatggataaggagtatcagcagaaaaggagggaagagctgagtaggcagccgcgtgacttcggcgatagtctggcacggggagggaagggttttctgaggggggtggttggaggagtgaccggcatcatcaccaaacccgtggagggtgctaaaaaggagggggccgctggattctttaaagggattggcaaaggtctggtgggcgcagtagctcgccccacaggaggcatcgttgacatggcttcctcgaccttccaaggaatacagcgcgcagcagagtcaaccgaggaggtctcctccttaagacctcctcgtctcatacacgaggacggcatcatcaggccatacgacagacaagaatccgagggctccgatcttctggaacaggaactcgaaatccaggaatag

SEQ ID NO: 34692 - DNA, 13092 bp, Artificial Sequence
  Description of Artificial Sequence: Synthetic coding sequence
atgctggagggtctggtggcatgggtgctgaacacttatttagggaagtacgtcaacaacttgaataccgatcaattgagcgtggccctcctcaagggcgcagtagagctggagaatcttccgcttaagaaggacgcattaaaagaactcgagctgccttttgaggtgaaggccggcttcattggcaaggtgaccttgcagattcctttttacagaccccatgtggatccttgggtgatcagtatctcttctcttcatttaatcggggctccagagaaaatacaagacttcaatgacgagaaggagaagttgctcgaacgggagcgcaagaaggcactgttacaggccctggaggagaaatggaagaacgataggcagcaaaaaggggaatcctactggtactctgtaacagctagcgttgtgaccaggatcgtggaaaacatcgagcttaaaattcaggacgtccacctgcggtttgaagacggtgtgacgaacccctcgcacccatttgcattcggaatttgcatcaagaatgtgtccatgcagaacgctgtcaatgagcccgtgcaaaagctgatgaggaaaaaacagctggatgtggcagaattcagcatatactgggatgtggattgtacgctgcttggcgacctcccccagatggagctgcaggaagccatggcgcgctccatggaatccagaagtcatcactatgtcttagaacccgtttttgcttctgcacttcttaagcgcaactgtagcaagaagcccttgcgctccaggcactctcctcggatagactgcgacatccaactggagactattcctcttaagcttagccagctgcagtaccgacagatcatggaattcctcaaggagctggaacgaaaggagaggcaggtgaagttccgacgctggaaacctaaggtggctatttccaagaattgtcgcgaatggtggtacttcgcattaaatgcgaatttatacgaaatccgtgaacagagaaaacgttgcacgtgggatttcatgctccatcgggcacgggacgctgtctcttacacggataaatactttaataaactcaaaggcgggctcctcagcaccgacgataaagaggaaatgtgcagaatcgaagaagaacagtcctttgaagagctgaaaattttgcgtgagttggtgcacgatagattccacaaacaggaagagctggcggaaagtctcagagaaccgcagttcgactcaccaggagcgtgccctggggctcccgagcctggtggagggagcggcatgctgcaatatctgcagagctggtttccgggatggggtggctggtatggacagcagacgcccgagggtaatgtggtcgagggcttgtcagctgagcagcaggagcaatggatcccagaggaaatcctcggaacagaggaatttttcgacccaacagccgacgcatcctgcatgaacacttacacaaagcgggaccatgttttcgccaagctcaacttgcagctgcagcgaggaaccgtcacgctccttcataaggaacagggcaccccccagatgaatgagtcagcgttcatgcagcttgagttttcagatgtcaagcttttagccgaatctttgcccaggaggaattcatcactgctgtccgtgcgactgggcgggttgttcctccgcgacctggccacagaggggaccatgttccctctcctagtcttccccaacccacaaaaagaggtggggcgtgtcagccaaagctttggcctgcagactacgagtgccgatagaagcgaccactacccagccgcggatcccgatggcccagtgttcgagatgctttacgagagaaatccagcccacagtcacttcgaaaggagactgaatgtatctactcggcccctaaacatcatctacaacccccaggccatcaaaaaggtagctgattttttttacaagggaaaggtgcacacctccggatttggctatcagtccgaactcgagctgagagtcgcagaggctgccaggcgtcagtacaataagttgaagatgcagacaaaagccgaaatccgccagactctcgacagacttctcgttggagatttcatcgaagaatccaaaagatggactgtgcgactcgacatttccgcccctcaggtaatcttccctgacgactttaagttcaagaacccagtcctagttgtggttgatctgggccggatgcttttgacgaacactcaagacaatagcagacgaaaaagccgcgacgggtcagcctcggaggaaacgcagttctccgacgacgaatataagacccctcttgccactccacctaacacaccaccaccggagtcaagctccagcaacggcgaaaagaccccccctttttcaggcgtcgagttctccgaggaacaattacaggctcacttgatgagtacaaagatgtacgaacgctacagcctgtcttttatggacctgcagatcatggtgggccgcgtgaaagataactggaagcacgtgcaggacatcgacgtaggtcctacccatgtggtggagaagtttaatgtccacttgcagctcgaacgtcgactgatctataccagcgaccccaagtaccctggggccgttttgagcgggaacctcccagatcttaaaattcacatcaatgaggacaagatttccgcactcaaaaattgtttcgctcttctgacaacacctgaaatgaagacctctgacactcagatcaaagagaagattttccctcaagaggaacagaggggcagcctgcaggactcggtaatgaatcttacccaatcgattgtgctgctcgagcagcacactcgggaggtacttgtggagtcccagctcctcctggcagaatttaaggttaattgtatgcaactcggtgtggagagcaacggccgctatatttcagtgttgaaggtatttggcactaacgcgcattttgtcaagcgaccttatgatgctgaggtgagcctgacagtgcatggcctcctcttggttgacacaatgcaaacctacggtgccgatttcgatctgttaatggcttcgcacaaaaatctgtcatttgatatccctacaggatccctccgtgactcacgcgcccagtcacccgttagtggtcccaatgtggcccatctcaccgacggagcaaccctcaacgaccggagtgcgacgtccgtgtccctcgataaaattctcaccaaagaacaggagtcactgatcaaactagaataccagttcgtgagttcagagtgtccctccatgaatcttgattctacactccaggtgatttcactgcaggttaataacctggacattattctgaaccctgaaacaatagtagaattaattggatttctgcagaagagtttcccaaaagagaaagacgacttatccccacaacctctgatgacagatttcgaacgatccttccgcgaacaggggacttaccaaagcacctacgaacagaacaccgaggttgccgtggaaatccaccgattaaatcttctcctgctcaggaccgtgggcatggcgaatcgcgagaagtatgggcgcaaaatagccacggcgagtattggcgggaccaaggtgaacgtgtctatgggcagcacgttcgatatgaatgggagccttggttgtctgcagctcatggatctgacgcaagacaacgtgaaaaaccagtatgtggtgagcatagggaatagtgtgggctacgaaaacatcatatccgatattgggtacttcgagtcagtgttcgttaggatggaggacgccgcgttgactgaggctctctcatttacttttgtagaaaggagtaaacaagaatgcttccttaacctgaagatggcgtcactgcactacaatcactccgccaaatttctgaaagagcttactctctcaatggatgagctggaggaaaactttaggggaatgctgaaatctgcagccactaaagtcacaacagtcctagccacgaaaaccgcagagtattcagagatggtgtccctgttcgaaaccccgcgtaagacacgcgagccatttattctcgaggaaaacgagatctatggcttcgacctggcaagtagtcacctcgatactgtgaagttgattctgaacattaatatcgaatccccagtcgtgtcaattccccggaaacccggaagccccgaactgctcgtcggccatttgggacagattttcatccagaatttcgttgcaggagacgacgagtccaggtcagatcgcctccaggtcgagatcaaggatataaaactgtactcactgaattgtacccagcttgctgggagggaggcggtgggaagcgaggggtctcggatgttttgcccaccaagtggtagtgggtcagcgaatagtcaggaagaggcccacttcacaagacacgacttctttgagtcccttcacagaggccaggcctttcatattctgaataacacaactattcagtttaagttggagaagatccctattgagagggagagtgaattaacgttcagtttaagccctgatgatctggggacatcatctatcatgaagattgaaggcaagttcgtgaacccggtgcaagtggtgctggccaaacatgtgtacgagcaggtgctacagactctggataaccttgtgtattccgaggacctgaacaaataccccgctagcgcaaccagctccccctgcccggactcccctcttccgccactctcaacatgtggcgagtcatcggttgagcgcaaagagaatgggctgttttcacatagcagtctctcaaatacttcacagaagtccctgtccgttaaagaggtgaaatccttcacccagattcaagccacgttttgcatttccgaactgcaggttcagctgtccggcgatcttactttgggagcccagggcttagttagccttaagttccaggacttcgaagtggaatttagcaaggaccatccccaaactctgtccattcaaatcgcactgcattccctcctgatggaggatcttttggaaaagaatccagactcaaaatacaaaaatctgatggttagcagaggagctccaaaaccaagtagcctggcccagaaggagtacctgtcccagagttgtccatcagtgtcaaacgtggagtaccccgacatgcctagaagcttgccgtcacacatggaagaggcaccgaacgtgtttcagctctatcaacgacctacatccgcatctcgcaagaagcaaaaagaggtgcaggacaaagattaccctctgactccgccaccgtccccgactgtggacgagccaaagatactggttggaaaatctaaattcgatgactccctcgtccacatcaacatctttctcgtggataaaaaacaccccgaattttcttcaagttacaatagggtcaatcggagcatagacgtcgatttcaactgtttggacgtgctcataaccttgcaaacctgggtggttatcctggatttctttgggatcggctcaactgctgataatcacgccatgcgactcccgccagagggcatactccataacgttaagcttgaaccccacgcgagcatggaaagcgggttgcaggatccagtgaacacaaaattagatctgaaagtccattccctgagtctggtgctgaacaagacgacatccgaactggccaaggcaaatgtgtctaagctggttgcccacctggaaatgatagaaggagacctcgctcttcagggaagtataggctcgttgtctctgagcgatttgacatgccatggcgagttttaccgcgagcgctttaccaccagcggcgaagaggccctgattttccaaacgttcaaatacggaaggccagatccactactccggagagaacatgatatccgagtgtcgctacggatggcctcggtacagtacgtgcacacacaaaggtttcaggcagaggttgtggccttcatccaacattttactcagctccaggacgtcttggggcgtcagagggctgcgatcgaagggcagacggtccgcgatcaggctcagcgatgcagtcgggtgttattggacatagaagccggagcgcctgttttgctgattcctgaatcctccagatctaataatctgattgtcgcaaatctagggaagcttaaggtaaaaaacaagttcctgtttgctgggttcccgggtaccttctcattacaggataaggagagcgtccccagtgctagtcccacgggaatacccaagcatagtctgcggaagacaaccagtacagaggagccccgcggaacacactcacaagggcagttcacaatgcctctggccggaatgagcctgggctccttaaaatctgagtttgttccatccacatctacgaagcagcaggggccccaacctacactgagcgtaggacaggaatctagttctcccgaagatcatgtctgcttgcttgactgcgtggtagtcgacctgcaagatatggacatattcgcagccgagcgacacccccgcgaatacagcaaagccccagaggattcctccggcgacctcattttcccttcatattttgtgaggcagaccgggggttcattgctgaccgaaccttgccgcctgaaactccaagtggagaggaatctggacaaggagatcagccacacagtccctgacataagcatccacggaaatctgtcttccgtgcattgcagcctagatttgtacaaatacaagctgatcagggggcttttggaaaacaacctgggcgaaccaattgaggagtttatgagaccgtatgaccttcaagatccccgtatccataccgtactgagcggcgaggtgtatacgtgcatgtgctttctgattgacatggttaacgtgagcctggagctgaaggatccaaagagaaaagagggtgctggaagtttggcacggttcgatttcaagaaatgcaaactgctatacgagagcttttccaatcagacgaaatcaattaatctggtctctcactctatgatggcttttgataccaggtacgctggacaaaaaaccagcccagggatgacgaacgtgtttagctgtatcttccagccggccaagaattcgtccacgacacagggatctattcagatcgagcttcactttcgctccacgaaggatagcagctgcttcactgtcgtactgaataatctgagagtatttctcatcttcgactggttactcttagtccatgacttcctacacactcctagcgatataaaaaagcagaaccatgtgacaccctctcgacatcggaatagcagttcggaaagtgccattgttccgaagactgtgaagtcaggagtcgtcacaaagcggagcagtctgccagtgtcaaatgagcgccatctcgaggtcaaagtcaacgttaccggaactgagttcgtcgtgatagaagacgtttcctgtttcgatactaacgccatcattctcaaaggtaccaccgtgctaacgtacaaaccccggtttgtcgatcgcccatttagcgggagtctgtttggcatcgaggtattctcatgtaggctgggaaacgaacacgataccgcactctctatcgtcgaccccgtgcagatccaaatggaactggtggggaactcgagttaccagaactccagcggacttatggacgccttcaatagtgaagatttcccccccgtgctagaaatccaactgcaggctctggacatacgactgtcttacaacgacgtgcaactctttctggcaatagcaaagtcaattccagagcaggctaacgctgccgtgcccgactcagttgcccttgagtccgattctgtgggcacttatctgccaggggcctccagagttggggaggagatcagggaaggtacaaggcacaccctggaccctgttctagagctccagttagctcgcttgcaggagctggggtttagcatggatgactgccggaaagccctgcttgcctgtcaaggtcagctgaagaaggccgcctcctggctgtttaaaaatgccgagcctcttaaatctctgtcattggctagcacatcccgagactcacctggcgcagtggccgcccctctgatttccggtgtggagatcaaggctgagtcagtgtgcatctgtttcatcgatgattgtatggattgcgacgttccattggctgagctaacctttagtcgacttaacttcctccaaagagtgaggacaagccccgaaggctatgcacacttcaccctgtcgggagactactacaatcgcgcgctgagcggctgggaaccattcatcgaaccttggccctgctcagtgtcttggcagcagcaggccgctagcaggctccatcctcctcgactcaagctcgaggcaaaggctaagcccagactggacatcaacatcaccagcgtcctgatcgaccagtatgtaagcacaaaggaaagctggatggcagactattgcaaggatgacaaagacattgaatccgcaaagtccgaagattggatgggcagtagtgtggatccgccatgctttgggcagactgaagttaaaacaccgaagagaagacagccatttgttccttttgccctgaggaaccacactggttgtactctatggttcgcaactctgacaacaactcctacccgggctgccctgagtcacagtggctccccaggcgtggtgcccgagggcaatggtacttttttagatgatacacacaacgttagcgagtggcgagaggtactgacaggcgaggaaattccttttgaattcgaggcccgcggaaaactgaggcatcgccatacccatgacctgagaatacaccagttgcaagtccgggttaacggttgggaacaggtgtctccagtgtccgtggataaggtcggaactttttttcgttatgcggcccctgacaaaaacagctcatcttcaaccatcggctcaccgagtagccggaccaacattattcaccctcaggtgtatttctcgtcactcccacccgtgagagtggtcttcgccgttaccatggaggggagcgccagaaaagtgattactgtgagatcagcgttgatcgtgagaaatcgtctggaaacccctatggaattgcggcttgactcaccaagtgctccagataaacctgtagttctaccagccataatgcccggcgacagctttgcggtgccgctgcatttaacctcgtggcggctccaggctcggcctaaggggcttggggttttcttctgtaaggctcccatccactggacgaatgttgtgaagactgcagagatttcgtcgtcaaaacgggaatgtcattctatggatacagagaagagtcggtttttccgattctgtgtcgctattaaaaaggaaaactatcccgactacatgcccagtaacatcttctcagattcagcaaaacagattttcagacagccaggccacaccatttatctccttcccacagtggtgatctgcaacctgctgccatgtgaactcgatttttatgttaagggcatgccaataaatggaaccctcaaacccgggaaggaggcagcactgcatacagccgatacaagccagaatatcgaactcggcgtctctcttgagaatttcccactatgtaaggagctcttgattccacccggcacgcagaactacatggtccgaatgaggctgtacgatgtgaataggagacaacttaacctgactatccggatcgtatgtcgggctgaaggctcattgaagatttttatcagtgcaccatactggctaattaacaaaaccggtctaccactcatttttcggcaggataatgcgaaaaccgacgcagccggccagttcgaggaacacgagctcgctcgtagtctgtctcctcttctgttctgctatgccgataaagagcagcctaatctgtgtacaatgcggatcggacgaggcatccaccccgagggcatgccagggtggtgccagggattttcactggatggtggatccggcgtgcgagcattgaaagtgatccagcagggtaacaggcccgggctgatctataacatcggcattgacgttaagaagggtcgcggccgctacatcgatacttgcatggtgatcttcgcgcccaggtacttattagataacaagtccagtcacaagctggcctttgcacagcgggaatttgcaagaggccaagggaccgccaatcctgagggatatatttccactctccccggaagctctgtggtgttccactggcccagaaacgattacgaccagcttctgtgtgtgagactgatggatgttcccaactgcatctggagcggcggctttgaagtgaacaaaaataactcattccatattaatatgcgggacaccctcggcaaatgtttttttttgcgggtcgagatcacactgagaggagcaacctacagaataagcttctctgatacagaccagcttcccccgcccttcaggatcgataatttttctaaggtccctgttgtgttcactcagcacggagtggctgaacctcgactgcggactgaagttaagccgatgacaagtcttgactatgcctgggacgaacccacgctgccacccttcattacactcacagtcaaaggcgcgggttcttccgagatcaactgcaacatgaatgacttccaggataatagacagctgtattatgagaacttcatatacatcgccgccacctatacattttctggcctccaagagggcacaggcaggccagtcgcatctaataaagcaattacgtgtgctgagctcgtcctcgatgtgtcccctaagacacaacgggtgattctgaagaagaaagagcctgggaaacgctctcaactttggcgcatgacgggcaccggcatgctggcacatgaagggagtagtgtgccacataatcctaataagccttctgcagcacgttctacggaaggctccgcgattctggacatcgccggcctggctgcggtcaccgataaccgttacgagccccttatgctgcggaaacctgaccgtaggaggagtaccacgcagacctggtcctttcgggagggtaagctgacctgtggactccacggcctagtagtccaggccaaaggtggcttgtcagggctattcgacggggccgaagtagtactggggcctgacacttctatggagcttctgggtccagtgccgcccgaacaacagtttatcaaccagaaaatgagacccggcagcgggatgctgagtatacgagtgataccggatgggcctacacgtgccctccagatcaccgacttctgccacagaaagtcatcaaggtcctacgaggttgacgaactcccagtgaccgaacaggagctgcagaagctgaagaatcctgacacggaacaggagctcgaagttctggtgagattggagggagggattgggcttagcctgatcaataaggtgcccgaggaactggtgtttgcatcactgactggcattaatgtgcattacacccagttggcgaccagtcacatgttagagctttccatacaggacgttcaggtggataaccagctaataggcactacacaaccctttatgttgtacgttactccgctatctaacgaaaacgaggtaattgaaacaggacccgctgtgcaggtgaatgctgtgaaatttccaagcaagagtgccctcacaaatatttacaagcatttaatgataacggcccaacgctttacagtccaaattgaggaaaagctgctgctaaagctgctttccttctttgggtatgatcaggccgagagcgaggtggagaagtatgacgagaacctgcacgaaaaaaccgcagagcagggaggaacaccgattaggtactattttgaaaatctgaagatttcgattccgcaaataaagctgtccgtgttcacatctaacaaactccctctcgatttaaaggctctgaagagcactctgggcttccctctaatacgattcgaggatgccgttattaaccttgacccttttacaagggtccacccctatgaaacaaaagagtttataattaacgacattctgaaacacttccaggaggagctgttgtcccaggctgctaggatattggggagcgtagatttcctgggcaatcccatgggccttctgaacgacgtcagtgagggcgtcacaggcctgatcaagtacggaaacgttggaggactgattagaaatgtgacacacggtgtgagtaattcggcagcaaagtttgctggcacactgagcgacgggcttgggaaaactatggataacaggcatcaatctgaacgcgagtacatcagatatcatgcggcaacatctggcgagcacctcgtggccggcatccacggtctcgctcatggtatcatcggaggactgaccagcgtgattacatccacggtggagggggtcaaaacagagggtggggtctctggcttcatatctgggttaggaaaggggttggtgggcactgttacaaaacccgtcgccggcgccttagattttgccagtgagaccgcccaagccgtgagagataccgccaccctcagcggcccacggactcaagcacagcgtgtgaggaagcctagatgctgcactggtccacaaggcctgttgcccaggtactcagagagccaggccgagggccaggaacagctgttcaaacttacggacaacattcaggatgagtttttcatcgccgtcgaaaacattgactcttactgtgtcctcatttcttcaaaggctgtctattttttgaagtctggggactatgtcgatcgcgaggctatctttctcgaggtgaaatacgatgatttgtatcactgtctggtgagcaaggatcacggcaaggtgtacgttcaggtgaccaagaaagctgtctctactagctccggggtgtccattcccggccctagccaccagaagcctatggttcatgttaaaagcgaggtgctagccgtaaaactgtcccaggaaatcaattatgcaaaatctctctactatgaacaacagctgatgttgcggctttcagagaaccgagagcagcttgagctggactcctag

SEQ ID NO: 34693 - DNA, 13167 bp, Artificial Sequence
  Description of Artificial Sequence: Synthetic coding sequence
atgcttgagggcttggttgcttgggttctcaacacttatcttggcaagtatgtaaacaatctgaacactgatcaactctccgtcgcactgctgaagggagccgtcgagttggaaaacctcccactgaaaaaagatgcgcttaaggaactagaactgccctttgaggttaaagcgggttttatcggcaaggtgaccctgcagatccccttctacaggccccacgtagacccttgggtgatttcaatctcaagcctacatcttatcggagctcccgagaagatccaggatttcaacgacgagaaagagaagttgctcgagagagagagaaagaaggcacttctgcaggcccttgaagaaaagtggaaaaacgaccggcagcagaagggggagtcctattggtactctgtcacggccagtgtcgtcacgaggattgtagaaaacatcgagcttaaaatccaggacgtgcacttaagatttgaggatggagtgactaatcctagtcaccccttcgcctttgggatatgtatcaagaacgtctccatgcagaatgcagtcaacgagccagtgcaaaagcttatgcgaaaaaagcagctggatgtcgcggagtttagcatctactgggatgtggactgcacactcttaggggatctgccgcagatggagctccaggaggccatggcccggtccatggagtcccgttcacatcattacgtgctagaaccagtgttcgcctcagcgctgttgaagaggaattgctccaaaaagcctctgaggtctcggcactcccctcggattgattgtgacattcagcttgaaaccataccgctcaagctgagtcagctccagtacaggcagatcatggaattcctgaaggaactcgaacgcaaagagaggcaagttaaatttcgacggtggaaacctaaagttgctatatctaagaattgcagggaatggtggtattttgcattaaatgccaatctgtacgaaatcagagagcagaggaaacggtgtacctgggattttatgctccaccgagcccgcgatgccgtgtcctacacggacaagtactttaataaattaaagggaggccttctgtcgaccgacgataaggaagaaatgtgcaggattgaggaagagcagtccttcgaggaattaaagatcctcagagagctggtgcacgaccgatttcacaagcaagaggaactagcagaatcactgagagagccacaatttgattctcctggcgcttgtccgggtgcacctgaacctggcgggggaagtggcatgttgcagtacttacagtcttggtttccggggtggggcggttggtacggccagcaaacacctgaagggaatgtcgtagaaggtctgtccgcggaacaacaggagcaatggattcctgaggagattctgggaaccgaagaattctttgatcccaccgcggacgcctcctgcatgaacacatatactaaacgtgaccatgtgtttgctaaactcaaccttcagctgcagcggggcactgtgaccctgcttcacaaagaacagggtactccgcagatgaacgaatcggcctttatgcagcttgagttcagtgatgttaagctgctcgcagagagcttgccacgacgaaactccagcctgttgagcgtgcgcttgggtgggctgtttctcagggacctggctaccgaaggtacaatgttcccactgttggtgttccccaacccccagaaggaagtcggacgcgtgtcacagtcatttgggcttcagactacttctgcagaccggagtgatcattacccagccgctgatcctgacggcccggttttcgagatgctgtacgagcgaaatcctgcccatagtcacttcgagaggcgtctgaatgtcagtacaagacccttgaacatcatatataatcctcaagctatcaagaaggtggcagattttttctacaaggggaaagtccatacctcaggattcgggtaccagagcgagctggagctgcgcgtagctgaggctgcgcgtcgccagtataacaagctcaagatgcaaaccaaagctgagataaggcagactctggatcgactgctcgtcggagacttcattgaagagtccaagcggtggacagtacgtttggatatctcggcccctcaggtgatcttcccagacgacttcaagttcaagaatcccgtgcttgttgtggtcgacttgggccgtatgctgctgacaaatacgcaggacaattccagaagaaagagcagagatgggagtgcttccgaggaaacccagtttagtgacgacgagtacaagactcccctagcgactcctcccaatactccacctcctgagagtagttcttccaacggcgaaaaaacccccccgttctccggggtcgagtttagtgaagagcagcttcaggcccacctcatgtcaacgaaaatgtatgagagatactccctgtcatttatggacctccagataatggtcgggagagtgaaagacaactggaagcatgtccaggatatagacgttgggccgacacacgtcgttgagaagtttaatgtgcacctccagctcgagaggcgtctaatctacacaagcgatccgaaatatccaggcgctgtgctgtccgggaacctgcctgacctgaagatccatatcaacgaggacaaaatttccgcccttaagaactgtttcgccctgctgaccacacctgaaatgaagacatctgatacacaaatcaaggagaagattttcccccaagaggaacaacggggttcgttgcaggactctgtgatgaatttgacacaaagtatcgtgctgcttgaacaacatactcgagaagtgctggtcgagagtcagctgttactggccgagtttaaggtgaactgcatgcagttgggggtggaaagcaacggtcgctatatctcagtcttaaaagtttttgggaccaacgcccactttgtgaaacggccgtacgacgccgaggtaagtttgaccgtgcatggtctcctactggtcgatactatgcaaacgtacggcgcggactttgacttgctaatggcgtcccacaagaatctgagcttcgacattccaaccggctccctccgcgactcgcgcgcgcagagtcctgtatcgggaccgaatgtcgcacacctgacagatggcgctacgttgaatgacaggtccgccacaagcgttagcctcgataagattcttacaaaagaacaggagtccctcatcaaactagaatatcagtttgtgtcatccgagtgtccaagtatgaatctagacagcactctacaggtgatttccctgcaggtgaacaacttggacattattttgaacccggaaaccatagtggaactcattggtttcttacagaagtctttccccaaggagaaggacgacttgtcaccccaaccattaatgaccgattttgagaggtcgtttagggagcaggggacctaccaatcaacctatgagcagaataccgaggtggccgtggagattcacagacttaacttgctacttcttcgaactgtggggatggcaaatcgcgagaagtatggacgaaagattgccacggcctccatcggaggcacaaaggttaacgtttcaatgggatccacctttgacatgaacgggtcgctgggctgcctccagttaatggacctgacgcaggacaatgtcaagaaccagtacgtcgtgtccattgggaatagtgtgggctatgagaacattattagcgacatcggatacttcgagtcggtatttgtcagaatggaagacgccgcgttaactgaggctttgtccttcacattcgtcgagagaagtaagcaggagtgctttctgaacctgaaaatggcctcgctgcactacaatcattccgctaaatttctcaaggagcttactttgtcaatggatgagttagaagaaaatttccgggggatgctcaagtccgccgccaccaaagttacgaccgtcttggctaccaagacagcggagtactcagaaatggtctccctcttcgaaacaccccggaagacgagagagccattcattttagaagagaacgagatttacggattcgacctggctagctctcacttggacaccgttaaacttatactgaatattaacatcgaatcccccgtggttagcattccccgaaaacccggatctcccgaactgctggtgggacacctcggccagatcttcattcagaacttcgtagctggcgacgatgagtcacgcagtgatcggctacaagtggagatcaaagatatcaaactatacagtctcaactgcacacagctcgccggtcgtgaagcagtaggcagcgaaggttctcggatgttctgtcctccctccggctccggatctgccaacagccaggaggaagctcacttcacacgccacgatttttttgagtccttgcacaggggtcaggcttttcatatcctgaataacacaacgatccagttcaagctggaaaaaatcccgatagagagggagtcggaattgactttcagtctgtcacccgacgatcttggcaccagctcaatcatgaagattgaggggaagttcgtgaaccctgttcaggttgttcttgccaagcacgtatacgaacaagtgctgcagacactagacaacttagtttattcagaggacctaaacaaatatcccgcatccgcaacatcgtccccttgtccagactctccactgccaccactcagcacatgcggggagagctctgttgaaagaaaagaaaatggactgttcagccattctagcctttccaacactagtcagaaatccctcagcgtcaaagaagtgaagagtttcactcagatccaggcaacattctgcattagcgagctgcaggtccaattatctggcgacctcacactgggagctcagggccttgtgagtttgaagttccaagacttcgaggtggagttctcaaaggaccacccacagaccctgtcaatccagatagcccttcattctctactgatggaagacctactggagaagaaccctgattcaaagtataaaaatcttatggtgagtagaggtgcccccaagccctccagtctggcacaaaaggagtatcttagccagagctgtccctccgtgtcaaatgtggagtatcccgacatgcctcgttcactgccatcacatatggaggaggcccctaacgtctttcagctgtaccagcgaccaactagtgcttcccggaaaaaacaaaaagaggtgcaggacaaggactatcccctgaccccacccccaagcccgaccgttgatgagcccaagatcctggttggcaaatccaagtttgacgatagcttggtgcacataaatatattccttgtcgataaaaaacaccccgaattctcctcctcttacaaccgagtgaatagaagcatcgacgtcgactttaattgtctggatgtcctgattactctccaaacatgggttgtaattttggattttttcgggataggcagcacagccgataatcatgctatgagactgccccccgaggggatcttgcataacgtgaagctcgagccacatgctagtatggagagcgggttgcaagacccagtgaacaccaaattggatctgaaagtgcattccctttccctggtgctgaacaaaacaacgtctgagctcgcgaaagccaacgtatctaagcttgttgctcacttagaaatgatcgaaggggatttggcccttcagggcagcatcgggtccctctcattgagcgacctcacatgtcacggtgagttttatcgcgagcgttttacaacctccggggaggaagccctgatctttcagacattcaagtatggcaggcccgaccccctgctgcggagggagcacgacattagggtttctttacggatggccagtgtgcagtatgtgcatacacagcgcttccaggctgaagttgtggcctttatccaacatttcacacagcttcaggatgtgctgggccggcaaagggcagctatcgaggggcagacggtgcgagatcaagcacagaggtgctccagggtgctcctggacatcgaggccggcgctcccgtactactcattcccgaaagcagtaggtctaacaacctgatcgttgcaaatctgggtaagctgaaggtcaagaacaagtttttatttgcgggattcccaggcaccttcagcctgcaagataaagagtctgttcccagcgcgtcacctacaggcataccaaagcacagtctcagaaagactactagcacggaggagcctcgcgggacacactcccagggacagtttaccatgcccttagccgggatgtccttgggctccttgaagtccgaatttgttccctcgactagtacaaagcagcaaggacctcagccaactctctccgttgggcaggagagtagttcccccgaggatcacgtgtgccttctggactgtgtggttgtagacctgcaggatatggacatcttcgcagccgaacgacacccccgagagtattctaaggcaccagaggatagctccggcgatctgatcttcccatcgtactttgtgcgtcagaccggaggaagcctactgactgaaccttgccgtctcaaactccaggtggagcggaatctagataaagaaattagtcacaccgtccctgatatttcaatccatggcaacctgtctagcgttcattgcagcctcgatctctataaatacaaacttatacgcggcctgctggaaaacaacctaggggaaccaatcgaggaatttatgcgcccttatgacctccaggatcctagaatccatacagtgctatccggtgaggtctacacttgcatgtgtttcctcattgacatggtaaatgttagcttagagctcaaggaccccaagagaaaggaaggcgccggatcgctagctaggttcgactttaagaagtgcaagctgttgtacgaaagcttcagcaatcagactaagagcattaaccttgtttctcattccatgatggctttcgacacacgttatgccggacagaagacatccccaggtatgaccaacgtgttcagctgcatctttcagcccgctaaaaacagttcgaccacccaggggtctatccagattgagctccattttcgctccaccaaggattcttcttgtttcactgttgtcctcaataacttgagggtgttcctcatcttcgattggctgctgttagttcatgatttcttgcatacccccagcgacattaaaaaacaaaaccatgtaacaccgtcgcggcaccgaaattccagttcagaatccgctatagtgcccaaaaccgttaagtctggtgtcgtcacaaaacggagcagcctccccgtttctaatgagcgccatctcgaggtcaaagtgaacgtgactggtaccgaatttgtggtgattgaagatgtatcttgcttcgacacaaacgctataattctaaaggggaccactgtgttaacctacaagccgcgctttgtggataggccgttttccgggtccctgttcgggatagaagtgttctcgtgtcgcctgggtaacgagcatgacaccgcgctttccattgtcgatccagtccagatccagatggaactggtggggaatagtagttatcagaactcatccggtctgatggatgcctttaactctgaagattttccgcccgtgctggaaatacaactacaagctcttgacattcgcctttcatacaatgacgtgcagctgttcctggcaattgccaaaagcatcccagagcaagctaacgctgcagtaccggatagcgtggctctcgagagcgactcagtcggcacctacctcccgggtgcttcccgtgtgggagaggagatcagagaaggcacccggcacaccctcgaccccgtgctagagcttcagctggcccgactccaagagctcggattcagcatggacgactgcaggaaagccctgctagcctgccagggccagctgaagaaagccgccagctggctgttcaagaatgcagaaccattaaaatcacttagtctggcttccacctctagagactcccccggagccgtggctgcccccctgatctccggagtggagatcaaagccgaaagcgtgtgcatttgttttatcgacgattgtatggactgtgatgttccacttgctgagctgactttttcacggcttaacttcttgcaacgggtgcgaacctctccagagggctatgcccatttcaccctcagcggcgactactataatagggccctgagcggatgggagccctttattgagccttggccttgctccgtgtcctggcagcagcaggcagcctccagactgcatccacctcgcctgaaactggaggcgaaagccaaacctagattagacattaatatcacctcagtgctcatcgatcagtacgtgtctacaaaggaaagttggatggccgattattgtaaggatgacaaggacattgagtcagcgaagagtgaggattggatgggcagctctgtagaccctccctgctttggacagtccttaccgttggtctatctccgcacccggagtactgcctctctgaccaacctggaacatcagatttatgctagagctgaggtgaagacacctaagcggagacagcctttcgtcccgtttgctttacgcaaccacaccggatgcacactctggtttgccaccctgacaacaacccccactagagcagccctaagtcactccggctctccaggcgtcgtaccagaaggaaacggcacgtttcttgacgatacacacaacgtttcagagtggcgggaggtgctgactggggaagagatcccatttgaatttgaggcaagggggaagctgcgccatcgccatacacatgatctacgaattcaccaacttcaggtgcgcgttaatggatgggagcaggtttcccccgtgtcggtagataaggttggcacattcttccgatacgccgcgccagacaaaaactcatccagttctacaatcgggtcacccagcagtagaacgaacatcatacatcctcaggtgtacttcagttccctccctcctgtccgtgtggtgttcgctgtaacaatggaaggcagtgctaggaaggtgattactgtgcgctccgctctgatcgtacgcaatagactggagacccctatggagctacgactcgactctccaagtgcacccgataaacctgttgtgctgcccgccatcatgccaggggactcctttgcagtccccttacacctgactagctggcgtcttcaagctagacccaagggacttggcgtgtttttttgtaaggctcccatccactggacaaatgtagtcaagactgctgaaatcagcagttccaagagagagtgtcacagtatggacacagagaaatcccgctttttcagattctgtgtagccattaaaaaggagaactacccagactatatgcctagtaatatcttttcagactctgctaagcagatatttcggcagcctgggcatactatttacttactaccaacagttgtaatatgtaatctgctgccttgcgagcttgacttctacgtgaaggggatgcccatcaatggcactctgaagccggggaaggaagcagctttgcacacagctgacacctcccagaatatcgaactgggcgtatccctagagaattttccattatgcaaagaattgctgatacccccaggcacccaaaactatatggtaagaatgcgtttatacgacgttaacagacgtcaattgaatctcaccattaggatcgtctgcagagcggagggatccctcaagatcttcatttcagccccctactggctcatcaacaagaccgggctgccactaatctttaggcaggataatgctaaaaccgacgccgccgggcagtttgaagaacatgaactggcacgttccctctcacccctgctgttttgctacgccgacaaggaacagcctaacctgtgtaccatgcggatcggaagaggaattcatccagaaggtatgccagggtggtgccagggctttagcctagacggcggctctggagtgcgtgctctgaaagttattcaacaggggaacaggcccggcttgatttacaatattggcatcgatgtgaagaagggcagaggaagatacatagacacctgtatggtgatctttgctccgcgctacctccttgataataaatccagccataaactggcgtttgcccagcgcgagttcgcccggggacagggaaccgccaaccccgaaggctacattagtaccctgccaggctcaagtgtggtcttccactggccacggaatgattacgaccaactcctatgtgtaaggcttatggacgtaccaaactgtatctggtcaggaggctttgaagtgaacaagaacaactccttccacatcaacatgcgggataccttaggcaagtgctttttcctgcgggttgagatcaccctcagaggggccacctaccgaatatccttctccgataccgaccagcttccccccccttttcgtatcgataacttctctaaagtgcccgtagtgttcacccagcatggagtggccgagcctagactgaggaccgaagtgaagcctatgacttccctcgactatgcctgggacgaaccaaccctccctcctttcatcacactgaccgtcaagggtgccggcagttctgaaatcaattgcaacatgaatgactttcaggataatcgacagctgtattatgagaactttatctatatcgcggctacatatacattctctggtcttcaagagggaactgggcggcctgtggctagtaataaggctattacttgcgctgagctcgtgctggacgtatctcctaaaacccaacgcgtgattctgaaaaagaaggagccagggaaacgttcccaactgtggaggatgactgggacaggaatgctggctcatgaggggtcttcagtgcctcataaccccaataaaccgtccgcagctaggagcaccgagggctctgcgattctggacatagctggcctggctgcagttacagacaaccggtacgaacccctcatgctgcgcaagcctgatcgtcgccgatcaacaacacagacatggtcctttagggaaggcaagctgacatgcggactgcacggactagtggtccaggccaaaggaggattgtctggcctgttcgacggtgccgaggtggtcctcggccccgacactagcatggagcttctgggccctgtgccccctgagcagcagttcatcaatcagaagatgcggcccggcagcggtatgctgagtatccgcgttatccccgatggtcccactagagccttgcagatcaccgacttctgccatcggaaatccagtcgtagctatgaagttgatgagctgccagtgacggaacaggagctgcagaaactcaagaatcccgatacagagcaggaacttgaggtcctagtaagactggaaggcggtattggcctaagcctgatcaacaaggtgccagaggaacttgtttttgctagtttgacaggtataaacgtccactacacacaactggcaacctcgcacatgctcgaactctctatccaagatgtgcaggttgataaccagctgattgggaccacccagccatttatgctctacgtaacaccgttgagcaatgagaacgaggtaattgagactggtccagccgtccaggttaatgctgttaagttccccagcaagtccgccttaaccaatatatataagcatctgatgataaccgcccagcgcttcacagtccagatcgaggaaaagttactcctgaagcttctaagcttttttggctacgaccaggctgaatccgaggtggaaaagtacgatgagaacctgcacgaaaagacagctgaacagggcggcacccctatcaggtactactttgaaaatctgaaaatcagcatcccccaaattaaattgtcggtgttcacctctaataaactgcctctggacctgaaggctctcaagtccacactggggtttccactcatcagatttgaggacgctgtcatcaatctagacccattcacgcgcgtgcatccttacgaaactaaggaatttataatcaatgatattctgaagcacttccaggaggagcttctatcccaggccgctagaatcctcgggtccgtcgacttcctgggaaacccaatggggctcctcaacgacgtgtctgagggggttacgggcctaatcaaatatggcaacgtgggaggacttattcgaaatgtgacacatggcgtcagcaacagcgctgcgaagttcgccggcaccctctccgatggcctaggtaaaacaatggacaacagacaccagagtgaacgagaatatatccgataccatgctgcgacctctggcgagcatctcgtggctgggatccacggcctagcgcacggaattattggcggcctcacctcagtgattacctcgactgtggagggcgtgaaaactgaaggaggggtctccggcttcatcagtggcctgggaaagggtctggtgggaactgtcacgaaacctgttgctggtgcccttgattttgcaagtgagaccgctcaggcagtccgggatacagccacattgagcggcccacgcacgcaggcgcaacgcgtgcgtaagcctcgctgctgcactggccctcagggcctccttcctaggtacagcgagagtcaggcggagggtcaggaacagctttttaaactcacagataatatacaagacgagttctttatcgcagtggagaatatagattcttactgtgtcctcatctcttcaaaggccgtgtacttcctcaagtcaggagactacgtggacagggaggccatttttttggaggtgaagtacgatgacctttaccattgcctggtctccaaagaccatggcaaggtgtacgtgcaggtgactaagaaggccgtatctaccagctctggcgtgagcataccaggaccgagccaccaaaaaccaatggtccacgtcaagagtgaagtgctcgccgtgaagctctcccaggaaataaattacgctaagagcctgtactacgagcaacagttaatgctccggttgtcggagaatagggagcagctcgagctggacagctag

SEQ ID NO: 34694 - DNA, 579 bp, Artificial Sequence
  Description of Artificial Sequence: Synthetic coding sequence
atgctgctcgaagagaccggcctgactccccaggaaacctgcctgagcccaagaagacctcacaggtggcagaggacacaagctcagcgggtgcggaagcctcgatgttgtacggggccacaaggtctgctccctaggtatagtgagagccaggccgagggacaggagcaattgtttaagcttactgataatattcaagacgagttttttatcgccgtggagaacatagactcatattgtgtcctgattagcagcaaagccgtgtacttcctgaagtcaggcgattacgtggaccgcgaagccatctttctggaagtgaagtacgacgatctttaccattgcctggtcagtaaggatcatggaaaagtgtatgttcaggtcacgaagaaagcggtgtccacttcatctggcgtcagtatccctggcccgtcacaccagaagcccatggttcacgtgaagtctgaagtcctggccgtcaaactttcacaggagatcaattatgctaaatcgctttactacgagcagcagctcatgttgagactctcagaaaaccgtgaacagcttgaactggacagctag

SEQ ID NO: 34695 - DNA, 1161 bp, Artificial Sequence
  Description of Artificial Sequence: Synthetic coding sequence
atgcgcggagagaaattaagtaaggcgcttaagtccactctgggctttcccttgattaggttcgaggatgccgtgattaaccttgatcctttcaccagagtccacccatacgagaccaaggagttcattatcaacgacattttaaaacacttccaggaagaactgctgtctcaggctgccagaatacttggctcagtagatttcctcggtaaccccatgggtctgctgaacgatgtttccgagggagtgactggactcatcaagtacggaaatgtgggaggtttgataaggaacgtcacgcacggggtctcaaactctgctgcaaagtttgccggaacactctcagatgggctagggaagacaatggacaatcgccaccaatcagagagggagtacatcaggtatcatgccgcaacatctggcgagcatctcgtggctggaatccacggcctcgcccacggtatcatcggcggcttgaccagtgtgataacatctacagtagagggtgtgaagactgaagggggcgtgtccggctttatttcgggtctcgggaagggtctggtcggcactgtgaccaagccagtggccggagctctggacttcgctagtgagactgcccaggctgtgagggacaccgctacactgagcggcccccgcacacaggctcagcgcgttagaaagcccagatgctgcaccgggccacagggcctactacctaggtattcagaatcacaggccgagggccaagagcaactgttcaagcttacagacaatattcaggacgagttcttcatcgctgtggagaatatcgatagttactgcgtcctcatcagctcgaaggccgtgtacttccttaaaagtggagactacgtggaccgggaggccatttttctggaggtgaaatacgatgacctgtaccactgcctagtctccaaggatcacggcaaggtttatgtacaagtcaccaagaaagctgtttccacctccagtggagtgagcatccccggaccaagccaccagaaacctatggtccacgtcaaatctgaggttctggctgtgaaactcagtcaggagatcaactacgctaagagtctttactatgagcaacaactcatgctgcggttatctgaaaacagggaacaactggaactggatagttag

SEQ ID NO: 34696 - DNA, 378 bp, Artificial Sequence
  Description of Artificial Sequence: Synthetic coding sequence
gagttcatcgaagagctgcttagtccaccattcggtggcctcgttgcatttgtgaaggaagcagaagcgctcattgagcggggccaggcagagagactccggggggaagaagcccgcgtgacgcaactgatccgaggttttggcagtagctggaagtctagtgtcgaatccctatcccaggacgtcatgaggtcttttaccaattttcgcaacggtacgtcaattatccaaggggctttaacacagctaatccaactatatcacaggttccatagagtcctatcccaacctcaactgcgtgctttgcccgccagggcagagctgatcaacatccatcatctgatggtagagttaaaaaagcataaacctaacttctag

SEQ ID NO: 34697 - DNA, 378 bp, Artificial Sequence
  Description of Artificial Sequence: Synthetic coding sequence
gagtttatcgaagagctgctctcacctccctttggggggttggtagctttcgtcaaggaagctgaagccctgattgagaggggacaggctgagcgtctccgcggcgaggaggcccgcgtgacccagttgatccgagggttcggcagtagttggaagtcttcagtggagtccctgtcacaggacgtcatgcggtctttcaccaactttcgcaatgggacctccatcatccaaggagcactcacccaactgatccaactgtaccacagattccacagggttttgtcccaaccgcagctgagagccctgcctgcccgagctgagttgattaatatccaccacttgatggtcgagctaaagaaacacaaacccaatttttag

SEQ ID NO: 34698 - DNA, 1797 bp, Artificial Sequence
  Description of Artificial Sequence: Synthetic coding sequence
atggagcaaatgctcggagcgtttcagtctgatctgtcaagcattagcagcgagatccgtaccctgcaggaacaatccggagctatgaatattcgtctcaggaacaggcaggctgtgcggggcaaactgggcgagttggtagatggtctggtggtcccttccgcgctggttacagctattcttgaagcccctgtaactgaaccacggttcctcgagcaactccaggaactggacgctaaggctgccgccgttagggagcaagaggctagagggactgccgcttgtgctgatgttagaggcgtcctggaccgactccgcgtcaaagctgttacgaaaatccgggagttcattctgcaaaaaatctactccttccgtaagccaatgacgaactaccagatcccccagaccgccttgctgaagtatcgctttttctaccagttcctgctgggtaatgaaagagctactgcaaaagaaatccgggatgagtacgtggaaacgctctcaaagatttatctgtcttactaccgaagttacctgggtagactaatgaaggtgcagtacgaagaagtggctgagaaagacgacctgatgggcgtcgaggataccgctaagaaaggttttttcagcaaaccctccctgaggagcagaaacactatctttaccctgggtacacgggggagcgtcatctcccccacagaattggaggcccctatcctcgttccacatacagcccagcgtggtgaacaaaggtaccccttcgaagctctttttagatcacagcactatgcgctgctggacaacagttgtagggagtacttgttcatttgcgaattttttgtggtgagtggacccgcagcgcacgacctctttcacgcagtaatggggaggactttaagtatgacgttgaaacacctggacagctacctcgccgattgttatgatgccatcgcggtctttctgtgtattcacattgtcctgaggttcaggaacatcgctgccaagcgagacgtgccagccctcgatcgatattgggaacaggtcctggccctgctatggccaagatttgagctgatattggaaatgaacgtccagagcgtccgctcaaccgaccctcagaggctggggggtcttgataccaggccccactacattactcgaaggtacgcagagttctcaagcgccttggtttcgatcaaccaaacaatccctaacgaaaggaccatgcagctcctcggccagcttcaggtcgaggtcgaaaatttcgtgctgcgggtggcagccgaatttagttcccggaaagaacagttggtgttcttgataaacaattacgatatgatgctgggggttctgatggaaagagccgccgatgacagcaaggaggtagagtcattccaacagttacttaatgcacggacccaagagtttatcgaggagctactgtcaccccccttcggcgggcttgtagcgttcgtcaaggaggcagaagccttgatagagagaggccaagccgaacggctgcggggcgaggaggcccgcgtgacacagctgattcgaggctttggaagcagctggaagagcagcgtcgaaagtctctctcaggatgttatgcgatctttcacaaacttccggaatggaacatctattatccagggggcccttacccagctaattcagctctaccaccgatttcatagggtcctcagtcagccacagctccgcgccctgcccgcacgggccgagctgataaatatccaccatttgatggtggagctcaagaaacataaaccgaatttttag

SEQ ID NO: 34699 - DNA, 1797 bp, Artificial Sequence
  Description of Artificial Sequence: Synthetic coding sequence
atggaacagatgttaggcgctttccaaagcgaccttagctcgatcagcagcgaaatccgcacattacaggaacagtccggggccatgaacattcgcctacgcaacagacaggccgtgaggggcaagttgggtgagctggttgacgggctggtggtgccctctgcactcgtgaccgccatcctcgaggctccggtgactgagcctcgcttcctcgagcagttgcaggagttagacgcaaaggcagctgccgtcagagaacaggaggctaggggaacagcggcatgcgcagacgtccgcggcgtattggaccggttgagggttaaagcagtgacaaagatcagagagtttattttacaaaagatttattcatttagaaagccaatgacgaattatcaaatcccacaaacagccctcttgaagtaccgctttttctaccagtttctgctcggtaatgaacgcgccaccgccaaggaaataagggacgagtacgtcgagaccctgtcgaaaatctacctgtcctactacaggtcttacctagggcgcctaatgaaggtgcaatatgaagaagttgccgagaaggatgatctgatgggcgtggaagacacagcgaaaaaggggttctttagcaagccctctctcaggtcacgaaataccatttttacccttggcactcggggctccgtgattagccccacagagctggaagcccccatcttggtcccccacacggcccagcggggcgagcaacggtacccctttgaggccttgtttagatcacagcactacgcccttctggataattcatgccgggagtatcttttcatttgcgagttttttgtggtgtctgggccagccgcccatgatcttttccacgccgtgatgggccggacactgtctatgaccctcaaacacttggactcttatctggccgattgctatgatgctattgcggtgtttctgtgtatccacatcgtgctgcgctttaggaacattgccgccaagcgtgacgttcctgccctggataggtattgggagcaagtccttgctctgctgtggccacggttcgagctcatcttagagatgaatgtgcagtccgtgcgttccacagacccacagagacttgggggcctggatacacgtccacattatatcactaggaggtacgcagaattttcaagcgcattggtgtccatcaaccagacaattcccaacgaaaggactatgcagttacttggccagctgcaagtggaggttgaaaatttcgtcctgagggtagccgccgagttcagctccagaaaagaacagctagtgttcctgatcaacaactacgacatgatgctcggagtgcttatggagcgggctgcggatgactccaaggaggtcgagtccttccaacagctcctcaatgccaggacccaagagtttatagaggagctgctatctcccccttttggtggccttgtggcctttgtgaaagaggccgaggcccttattgaacgcgggcaggccgaacggctgcgcggggaagaggccagagttacgcagttgatccgcggcttcggatcttcgtggaaatctagcgtcgaaagcctttcacaggacgtgatgcgctcgttcacgaactttaggaacgggacctctataattcagggggctttgacccagttaattcagctatatcatagattccatcgggtcttaagccagccccagttaagagccttgcccgcccgcgcagaactgattaatatccaccatttgatggtggagctcaaaaagcataagcccaatttctag

SEQ ID NO: 34700 - DNA, 2106 bp, Artificial Sequence
  Description of Artificial Sequence: Synthetic coding sequence
atggaagaagaggaggggcctttggccggcggccctgggctgcaggaaccccttcagcttggagagctggacattacttccgatgagttcatcctggacgaagtggacgtacatattcaagctaatttggaggatgagctggtgaaagaggccctgaaaactggggtggatttaagacattactcaaaacaagtcgagctcgaattgcaacagatcgaacaaaagagtatcagggactacatccaggagtccgagaatattgcttctctgcacaaccagattaccgcatgcgacgctgtccttgaaagaatggagcagatgttgggtgcttttcagtccgacctgagttccatcagcagcgagataaggaccctccaggagcagagcggggcaatgaacattcgtctaagaaaccgccaggcagtcaggggcaagctcggggagttggtcgacggcttggtcgttccatctgcactggtcaccgcaatccttgaagcccccgtcacggagcctaggtttctcgaacaactacaggaactggatgctaaggcagcagccgtcagagaacaagaggctaggggaaccgccgcgtgcgctgatgtgcggggcgttctcgacagactgagagtgaaggctgtcactaagattcgagagttcattctccaaaagatatactcattccgcaagcccatgactaactaccagatcccacagaccgcgcttttgaagtacaggttcttttaccaatttctgctgggtaacgagcgagcaacggccaaagaaatccgcgacgagtacgtagagaccctttccaagatctacctaagctactatagatcttacctcggccggctgatgaaggtccaatacgaggaggtggccgagaaggatgacctgatgggtgttgaggacacggcaaagaaagggttcttctcgaaaccgagtctgcgttcacggaacaccatctttacactcggcacccgcggcagtgttataagtcccaccgaacttgaggctcccattctggtgcctcacacggcacagcgtggtgagcaacgttatcccttcgaggctttatttcgctcccagcattacgctctgctagataattcttgcagagagtacttgtttatctgtgaattcttcgtggtgagcggaccagctgcacacgatctctttcatgcagtcatgggacgcactctctcgatgaccctgaaacatctggattcctatctggcggattgctatgatgctattgcagtgttcctctgtatacacatcgtgttacgctttcgcaacattgctgctaaaagagatgtcccggccttggatcgatattgggagcaggttctggccctgttgtggccgagatttgagctgattctagagatgaacgttcaatcagtgcgtagcacagacccccaaaggctcggaggcctggacactagacctcactatatcacccggaggtatgcggaattcagtagcgcgctggtttcaattaaccagactatccctaatgaaagaacgatgcagctgctgggacaactgcaagtggaggtggaaaatttcgtgctgcgagtagcagcagaattctcgagcagaaaagaacagctggtgttcctgatcaacaactacgatatgatgctcggagtgctcatggagagagctgcagatgatagcaaagaggttgaaagcttccagcaattgttaaatgctaggacccaagaatttatcgaagaacttctgagcccacctttcggaggactcgtggcattcgttaaagaggccgaggcgcttattgaacgcgggcaagctgagcggttgcgcggcgaggaggcgcgggtgacacagttaattcgcggattcggctcctcctggaaaagtagcgtggaatctctgtctcaggacgtgatgcgctcttttacaaacttcagaaatggaacgtctataatacagggagccctgacccagctgatccagctgtaccacaggtttcatcgcgtcctcagccagccacagctgcgggctttgccagctcgcgccgaactgataaatatccaccaccttatggtcgagctgaaaaagcataaaccaaatttctag

SEQ ID NO: 34701 - DNA, 2106 bp, Artificial Sequence
  Description of Artificial Sequence: Synthetic coding sequence
atggaggaggaggagggacccctggccggaggcccagggctacaagaaccccttcaattgggggagctggacatcacttcagatgaatttatccttgacgaagtggatgtgcatattcaggccaatctagaagacgaactcgtcaaggaagccttaaagacgggtgtggacctgcgccattactcaaagcaggtagagcttgagctacaacagattgagcagaaatctattagggactacatccaggagtctgaaaacattgcgtctctacacaatcagatcactgcttgtgatgccgtcttggagcggatggaacagatgctgggcgccttccaatccgatctgtcctctatatcatcagaaataagaaccctgcaggaacagtctggggctatgaatatacgactgaggaatcgacaggccgtgcgggggaagctgggtgagctcgttgacggactggtcgtgcctagcgctttggtaacagctatcttggaagcgcccgtcaccgagcctcggttcctggagcagctgcaggagctcgatgcgaaagctgcagccgtgagagaacaggaggcacggggcacagccgcctgtgctgacgtgagaggtgtcttggaccggttgcgggtcaaagctgtgacaaagattcgggaatttatcctccagaagatctatagttttcgaaagcccatgacaaactaccagatcccacagaccgctctgctcaagtatcgtttcttttatcagtttctacttggaaacgagcgtgccactgcgaaagagatccgggacgagtacgtcgaaacactcagtaagatctacctgagctattatagatcatacctcggacgcttgatgaaggtgcagtatgaggaagtagctgagaaggatgacctcatgggtgtcgaagatactgcaaagaaaggcttttttagtaaaccctctttgcgatctaggaacacaatcttcacccttggcactcgcgggtcagtgatcagcccaactgaacttgaagctcccatcttggttccgcacacagcgcaacgcggagaacaacggtacccctttgaggccctgtttaggtcccagcattacgctttgctcgataacagctgccgagagtacctgttcatttgcgaattttttgtggtctcaggccctgccgcccacgacctgttccacgccgtgatgggtcgaacattgtctatgactctcaaacatttagactcatatttggcggattgttatgatgctatagcggtattcctgtgcatccacattgtgctcaggtttcggaacatagccgccaagcgcgacgttccagccttggaccggtactgggagcaagtacttgcattgctttggccgagattcgagctcatcctcgagatgaacgtgcagtcagttcggtccactgacccacagagattggggggtctggataccagaccacattatatcacacgtaggtatgccgagttctcaagcgcccttgtgagtatcaaccagaccattcccaatgaaaggacgatgcagttactcgggcagctgcaggtggaggtagagaacttcgttctaagagtggcggctgagttttcatctcggaaagagcagctggtgttcctcatcaacaactatgatatgatgctgggagtgctgatggaaagagcggccgatgactccaaggaggtggaatcatttcaacagcttctgaatgctcgcacccaggagtttatcgaggaactgctgagccctccgtttggtggcctagtggcctttgtgaaggaggccgaggcactcattgagaggggacaggcagaacgactgcggggggaggaagctcgcgttacacagttaatcaggggcttcggttcgagctggaagagttcggttgagtctcttagtcaggacgtgatgagatctttcacaaatttccgcaacggtaccagtatcatccaaggcgcactcacacagctgatacagctttaccaccggtttcaccgggtcctgagtcagccacagcttagggctcttccggctcgggcagaactgattaacatccatcacttaatggtggaactgaaaaaacacaaaccgaacttttag

SEQ ID NO: 34702 - DNA, 1797 bp, Artificial Sequence
  Description of Artificial Sequence: Synthetic coding sequence
atggagcagatgttgggcgcctttcagtccgacctcagttccatttcttcggaaattcgtacccttcaggagcagagtggtgcgatgaatatcaggctgcgcaacagacaggctgtccggggcaaacttggagaactcgtcgacgggctcgtggttcccagcgccttggtgactgccatactggaggcccctgtgaccgaaccacggttcctggagcagcttcaggagctggacgctaaggcagctgccgtcagagagcaggaggcacgaggtacagccgcttgtgctgacgtccggggagtactagataggttacgggtgaaggccgttaccaagataagggaattcatcctgcagaaaatctattcctttaggaagccaatgacaaactatcaaatcccacagacggccctcttaaaatatagattcttctaccagttcttgctgggcaacgagcgggcaaccgccaaagagatccgagacgaatacgtggagactttgagcaaaatttacctgtcgtattaccgttcctatctgggtcgtctgatgaaggtgcagtacgaagaagtcgccgagaaggacgacctgatgggggtagaggataccgcgaaaaaagggttcttctctaagccctcactgaggagccgaaataccatattcacactgggcactaggggatcagtcattagtccaaccgaactggaggcccccatactcgttccccataccgcccaaaggggagaacagagataccctttcgaggcattgtttagatcccaacactacgccctactggataactcatgccgcgaatacctattcatatgtgaatttttcgttgtctctggacctgccgcgcacgatctttttcacgctgtgatgggccggactttgtcaatgactctcaaacatctggatagttatctggcagactgttacgacgctatagcagtttttttgtgtattcacatcgtcctgaggtttcggaatattgctgccaaacgcgacgtcccagcgttggaccggtactgggagcaagtgctcgcactgttgtggcccagatttgaactgatcctggaaatgaacgtgcagagcgtaaggagtacagacccccagcgcctgggtgggctggacactagacctcactacattactcgccgttatgccgaattctcaagcgcattggtatccataaatcaaacaatcccaaatgaacgcaccatgcaacttctgggccaattgcaggtggaggttgagaatttcgttctgcgggtagccgcggagttcagtagccggaaggaacaattggtctttctgatcaacaattatgacatgatgctgggcgtgctgatggaacgggccgctgacgacagcaaagaagttgaaagtttccaacagctactgaacgctcgcacccaggaatttattgaggagttgctgtccccccctttcggaggccttgtggcgttcgtgaaggaagccgaggccctgattgaacgcgggcaggcagaaagactacggggggaggaagcacgcgtgacacaacttattcgcggcttcggatcttcatggaaatccagtgtcgaaagcttgagtcaggacgtgatgaggtcctttaccaatttccgaaacggaaccagtatcatacagggagcgttgactcaactgatccaactgtaccatcggtttcaccgcgtgcttagccaaccacaactccgggctctaccagcaagagccgagttgatcaatatacatcacctgatggttgagctcaaaaaacacaaacctaacttctag

SEQ ID NO: 34703 - DNA, 2106 bp, Artificial Sequence
  Description of Artificial Sequence: Synthetic coding sequence
atggaggaggaagagggacccctcgcaggcggtcccggtctgcaggaacctcttcagctcggcgaactcgacattacaagtgacgagtttatcctggatgaagttgatgtgcacattcaggcgaatctggaggacgaactggtgaaagaggcactcaaaaccggcgtggacctacggcactactcaaaacaggtagagcttgagctacaacagattgagcagaagagtatcagagactatattcaagagagcgagaatattgcctccctgcacaaccagatcaccgcttgtgatgctgtactggagagaatggagcagatgctgggcgctttccagtctgatctgtcctccatatccagcgagatacgtacccttcaagaacagtctggagcaatgaatattaggttacgtaacaggcaggccgtgcgtgggaagttgggagaattggtagatggattagtcgtccccagcgctctagtgactgctatcctagaggctcccgtgacagaaccaagattcctggaacagttgcaggagctggatgccaaagcggctgccgttcgcgaacaggaagcgcggggcacagcggcatgtgccgacgtgcgtggcgtgcttgatcggctccgagtgaaagccgttacaaaaattagagagtttattcttcaaaaaatttactccttccgcaagcctatgacgaactatcagattcctcagactgcactgctgaagtacaggtttttctaccagttcctactgggaaacgagcgtgcaaccgctaaggagatcagagatgagtacgtggagacactttcgaagatctacctcagctactaccgctcatacctggggcgactaatgaaagtgcagtatgaagaggtggccgaaaaagatgacctcatgggcgttgaggataccgcaaagaaggggtttttttctaaaccttcattgagatctcgtaataccatctttacactgggaacacgcggctccgtgatcagccctaccgaacttgaagcgcctatcttagtgccccacactgcgcagaggggagaacagcgctaccctttcgaggctttatttcgatcccagcattacgcactcctcgacaactcttgccgggaatacttatttatctgcgagttcttcgttgtgtctggacctgccgctcatgacctgttccatgctgtcatgggccggacactttcaatgactctgaaacatctggatagctacctcgcagactgttacgacgccatcgctgtctttctttgtatccatatagtactccgctttcgaaatatcgccgctaagagagatgttccagccctcgataggtactgggaacaggtactggccctcctgtggcccagattcgaactgatattagagatgaatgtgcaatccgttagatccactgacccacagcgactgggaggcctggatacacgaccccattacatcacacgacgctacgccgaattcagctctgccctggtcagcataaaccagaccatccccaacgagcggaccatgcagcttctgggccaattacaggtggaagtggaaaacttcgtcctgcgcgttgctgccgaattctcctcgcgcaaggaacagcttgtctttttgataaacaattacgatatgatgttgggggtgctgatggagcgagcagccgatgattcaaaagaggtggaatcctttcagcaactgctgaatgcacgaacccaggagtttattgaagaactgctcagcccacccttcggcggcctggtggctttcgtgaaggaagcagaggcactcattgagcgggggcaggcggagagactccggggagaggaggcacgcgttacccagcttatcaggggattcggtagctcttggaagtccagcgtggaaagcctgtctcaagatgtaatgcggtcctttacaaattttagaaacggaaccagcatcatacaaggcgcattaactcaactgatacagctgtatcatcggttccatagagtcctaagtcagccccagctacgagcccttcccgccagggcagaactgatcaacattcaccatctaatggtcgaactgaagaagcacaaacctaacttttag

SEQ ID NO: 34704 - DNA, 2013 bp, Artificial Sequence
  Description of Artificial Sequence: Synthetic coding sequence
atgatggaggaggaagagctcgagttcgtggaagagctggaggcagtgctgcagcttacccctgaggtgcagctggccatagaacaggtcttcccatctcaagatcctctggatcgcgccgattttaacgccgtcgagtacataaatacgctgtttcctacagagcagagtctggccaatatagacgaagtggtcaataagattagattgaagattcgtaggctggacgacaacattaggaccgttgtgaggggccagactaatgttggccaggacggtagacaggttaaggaaataactcgtgatatcaagcagctcgaccatgcaaaacggcaccttactacatccatcacgactctgaatcatctgcatatgctggcgggtggagtggatagcctggaggctatgacccgtaggagacagtacggcgaggtggccaacttactgcagggagtcatgaatgtcctcgaacacttccacaaatatatgggaattccacagatacgtcagctgagtgagcgggtaaaagccgctcagaccgaacttggacagcagattcttgctgacttcgaagaggcatttcctagtcaggggacgaaaagaccaggcgggccatccaatgtacttcgcgatgcttgtctggtggctaacattctggacccaaggataaagcaagaaatcattaagaaatttattaaacagcacctgtcagagtatctggtgctttttcaggaaaaccaagacgtcgcatggctggataagattgatagacgctacgcttggatcaagagacagttagtcgattacgaggaaaaatatggacggatgtttcctagagagtggtgtatggctgagcggatcgctgtcgaattttgccacgtgacccgcgcggaactggcaaagataatgcgcactcgggcgaaggaaattgaggtgaaattgctgctgtttgccatccagcgcaccaccaactttgagggttttctagcaaaacggtttagtggatgtacccttaccgatgggacactgaagaaacttgaatcaccccctccgagcaccaatcccttcctggaagatgagccaacacctgaaatggaagaactcgccaccgagaagggagatctggatcagcctaagaagcctaaagcccccgataacccattccacgggatcgtatccaagtgcttcgagccacatttgtacgtgtatattgaaagccaggataaaaatctcggtgagctgattgaccgtttcgtagctgacttcaaggcccagggtcctcccaagccgaacactgatgaaggtggagccgtcctaccaagctgcgcagatctcttcgtttactacaagaagtgcatggtgcagtgcagccaacttagcaccggtgaacctatgatagccctgacgaccatctttcagaagtacttgagggaatatgcatggaaaatcttatcgggaaatctacctaagactacaacctcttccggcgggctgacaatatcgtccctgctgaaggaaaaagagggtagtgaagtggccaaatttacgcttgaggaactctgtctgatctgtaatatcctctcaaccgcagagtactgcctcgctactacacaacagcttgaggaaaaacttaaggaaaaggtagatgtcagcctgatagaacggattaacctcacaggcgaaatggacaccttttcaacagttatctctagctctatccagctgctggtccaagatttagatgccgcatgtgatcctgccctgactgctatgagtaagatgcagtggcagaacgtggaacatgtgggcgaccagtccccttacgtgactagcgtcatcctccatattaaacaaaacgtgcccattattagagataacctcgccagcacgcggaaatatttcacccagttctgtgtcaagtttgccaactcttttatacccaaatttattacccatctgtttaagtgtaaacccatctcaatggtaggagcagagcaggtgagatggacctag

SEQ ID NO: 34705 - DNA, 1644 bp, Artificial Sequence
  Description of Artificial Sequence: Synthetic coding sequence
atgatggaggaagaggagctggaattcgtggaggaacttgaggcagtgctccaactgacacctgaggttcagttggccatcgagcaagtcttcccctctcaggatcctctggaccgagccgacttcaacgctgtggaatacattaatacgctattccccaccgaacagagtctcgcaaacatcgacgaagttgttaacaaaattcgcctgaaaatacgaaggctggacgacaatatccggactgtggtgcggggacagactaacgtggggcaagatggaagacaggccttagaagaggcccaaaaggcgatccagcaactgttcggcaagataaaggatattaaagataaagccgagaagtctgagcagatggtgaaagaaatcacaagggacattaaacagctggaccacgcaaagcgacacctcaccacatccatcactactcttaaccatctgcacatgctggcaggaggcgtcgactcactggaggctatgaccagacgcaggcagtacggcgaagtcgcaaacttgctgcagggcgtgatgaacgtactggagcacttccacaaatatatggggatccctcagatcagacaactctctgagcgggtgaaggccgcacagaccgagctcggacaacagatccttgctgactttgaggaggccttcccaagccagggaacaaaggtggcatggctggataaaatcgaccgtcgctacgcctggataaagagacagctcgttgactacgaagagaaatacgggcgcatgtttccccgcgaatggtgtatggctgaaagaattgcggtggagttttgtcatgtcactcgagcagaactcgctaaaataatgagaacccgcgcaaaggagattgaggtcaagctgctgctgttcgccatccagcgaacaaccaactttgaaggctttctggctaagcgattttctgggtgcaccctcactgatggtaccctaaaaaaactggaatcccctccgccgagcaccaaccctttcctagaagacgagccaacgcctgagatggaggaactggctaccgaaaaaggagacctcgaccagcccaagaagccaaaggcccccgataatccattccatgggattgtgtcgaaatgctttgagccccacctctatgtttacattgaatcacaggataaaaacctgggagaactaattgataggttcgtggcggacttcaaggctcaggggccacccaaacctaacacagatgaaggcggtgcggtgcttccgagttgcgccgaccttttcgtgtactataagaaatgcatggtgcagtgttctcagctttccactggcgagccaatgattgcgctgaccacaatttttcaaaaatatctgcgagagtatgcatggaaaatactgagcggaaacttacctaagacgaccactagttcaggaggactgacgatctcatctctgctgaaggagaaggagggttcggaggtagctaaattcaccctcgaggaattgtgtctgatttgtaatatcctgagtacagctgagtattgcctcgccacgacccaacaactcgaagaaaaactgaaggagaaagtcgatcgccatttgcaacagtactctgctgccggttctggatccggttgttgtttgtag

SEQ ID NO: 34706 - DNA, 1269 bp, Artificial Sequence
  Description of Artificial Sequence: Synthetic coding sequence
atgatggaagaagaggaattggagttcgtagaagaactagaagccgtgcttcagctgacacctgaggtccaactcgcaattgaacaggtgtttccctcccaagatccgctggatcgtgccgacttcaacgcagtcgaatatatcaacaccctctttcctaccgaacagagtctggctaacatcgacgaggtagtaaataagatccgcttgaaaatccgtcgtctggatgataacatccgaactgtggtccggggccagaccaatgtcggacaggatggtcgccagaaaaagttagagagcccaccacctagcactaacccgtttctggaggacgaacccacgcctgaaatggaggagttagcaacggagaagggagatcttgaccagcctaaaaaacccaaggcaccagataacccatttcatgggatagtgagcaaatgtttcgagccccacctctatgtgtacattgagtcccaagataagaacctcggagagttaatagacaggtttgtggccgatttcaaagcacaggggccacctaagccgaataccgatgaggggggagccgtgctgccttcatgtgccgatctgttcgtgtattacaagaagtgcatggtccagtgttcccaactcagtaccggtgagcctatgatcgccctgacaaccattttccaaaaatacctgcgcgagtacgcgtggaagattttgtctggtaaccttccaaagactacaacttcctcaggagggcttacaatcagctccctgctcaaggaaaaagaggggagtgaagttgctaaatttaccctggaggagctctgtctgatatgcaacatcctgtccacagctgaatactgtctagccacaacacaacagctggaagaaaagttgaaagagaaggtcgacgtcagcctgatcgagcggatcaaccttacaggagagatggatacgttttctacagttatctcctctagtattcaactgttggtgcaggatctggacgcagcatgcgacccggccctgacagccatgagtaagatgcaatggcaaaacgtcgagcacgtaggggaccagagtccatacgtcaccagtgtcatccttcacattaagcagaacgtaccaataattcgcgacaacctcgcctcaaccaggaagtacttcacccagttttgcgttaagtttgcgaactcttttattccaaagttcatcacacatctgtttaagtgcaagcccattagtatggtgggggcagagcaggttaggtggacatag

SEQ ID NO: 34707 - DNA, 2499 bp, Artificial Sequence
  Description of Artificial Sequence: Synthetic coding sequence
atgatggaggaggaggaacttgaattcgtcgaggaactggaggccgtcctccagctgacacccgaggttcagttagcaatagagcaggtgttcccttcacaggaccccctggatcgtgccgacttcaatgccgtcgagtatatcaacaccctgttccccactgagcagagtctggctaatatcgatgaagtggtcaacaagattaggttgaaaattaggaggctggatgataacattagaactgtggtgagaggccaaactaatgttggccaggacggccgccaggcactcgaagaagcccagaaggctatccagcagctatttggaaaaataaaggacattaaagacaaagcagagaagtctgagcagatggtaaaagaaattaccagagatatcaagcaattagatcatgccaagaggcacctgactacttccatcacaacattaaaccacctacatatgttggccggcggggttgactccctagaggctatgactagaagaaggcagtacggagaagtagcgaatctgctacagggtgtgatgaacgtgttggagcattttcataaatatatgggaatccctcagatccgacagctgtcggaacgagttaaggcggcacagaccgagctggggcagcagatacttgcggacttcgaggaggctttcccctctcagggcacaaaacgaccagggggtccaagcaacgttctaagagatgcctgtcttgtcgctaatatcttagaccctcggattaaacaggaaattatcaaaaaattcatcaagcagcaccttagtgaatatctcgtccttttccaggaaaaccaggacgtagcatggctagacaagatagacagacggtacgcctggattaaaaggcagcttgtggactatgaagagaagtacggacggatgtttccgcgcgagtggtgcatggccgagcgaattgccgtcgagttctgtcatgtcacacgggccgagctggccaaaattatgcggacccgagctaaagagatagaagtaaagcttctgctgttcgccatccagagaactactaatttcgagggcttcttggcaaaacgcttctctggctgcaccctgactgacgggacattaaaaaaactggaatccccaccgccctccacaaatccctttctagaggatgagcccacacctgaaatggaggagctggctaccgagaaaggtgatttggaccagccaaaaaagcccaaagctccggacaacccgtttcacggaattgtgtcaaagtgcttcgagccacatctttatgtttatattgaaagccaggataaaaatctgggcgagctgatcgataggtttgtcgcagattttaaagctcagggacctccaaagcctaataccgacgaaggcggagctgtgctcccatcctgcgctgatttgttcgtgtactacaaaaagtgtatggtgcagtgttcccagttgtctaccggcgaaccgatgatcgccctaactacaatctttcagaagtaccttcgcgagtatgcttggaaaattctctcgggcaacctccccaaaacaaccacatcatctgggggccttactatttccagcctgctgaaggagaaggagggctcagaggttgcaaagttcacactggaggaactgtgcttaatctgcaacattctgtcgaccgcagagtattgcctcgctacaacccaacagttggaagaaaagctcaaggagaaggtggacgttagtttgatcgaacgcatcaacctgacaggggagatggatacgttctctactgtgatatcttccagtatacagttgcttgtgcaggacctcgatgcagcctgtgatcctgccctgacagccatgtctaaaatgcaatggcagaacgtcgaacatgtgggcgatcagtccccctatgtaacatccgttatcctccatattaagcagaatgttccaattatccgcgacaatctggcttctactaggaagtattttacccagttttgtgttaagttcgcaaacagtttcattcctaagttcattactcaccttttcaagtgcaaacccattagtatggtgggagccgaacagcttctgctggacacacactctcttaagatggtgcttctcgatctgccatcaattagttcccaggtggtgcggaaggcccccgcatcctacactaagatagtggtgaaggggatgactcgagcagagatgatattaaaagtcgtcatggcgccccatgaaccacttgtagttttcgtggataactacattaagctgttgacggattgcaacaccgaaactttccagaaaatcttagacatgaagggtctgaaaagatcggagcagtcctccatgctggaactgttacgtcagcgacttcctgcaccacctagcggcgctgaaagttctggatcactgtctttaaccgcacctacacccgagcaagagtcctctagaattagaaaactagaaaaactgataaagaagcgcctgtag

SEQ ID NO: 34708 - DNA, 1506 bp, Artificial Sequence
  Description of Artificial Sequence: Synthetic coding sequence
atgttttctcttatcgtgaaagctgcacaaactgagctagggcagcagatcctggccgactttgaagaagcgtttccatcacaaggtactaagcggccagggggcccaagcaatgtgcttcgggacgcttgcctggttgctaacattttagaccctcgcattaaacaagagatcatcaagaaatttatcaagcagcatttatccgagtacttggtgctgttccaggaaaatcaagatgtggcctggctggataaaattgatcgacgctacgcttggatcaagcggcagctcgtggactatgaagagaaatatgggcgcatgtttcctcgcgagtggtgtatggccgagaggatcgcggtagagttttgtcatgtgacaagagccgagctcgccaagataatgaggactagagcgaaggagattgaggtgaagctcctgctttttgcaatccagaggaccactaacttcgaaggctttttagctaagcgctttagtggatgcaccctgaccgatgggacacttaagaagcttgagtccccacccccatccacaaacccatttctcgaagacgagccaacaccagagatggaggaactggctacagagaagggcgacctggatcagcctaagaaaccgaaagctccggataaccccttccacggcatagttagcaagtgctttgagccccacctttacgtgtatatcgagagtcaggacaagaacctgggagagctgattgaccgcttcgttgctgacttcaaggctcaggggcctcctaaaccaaacaccgatgaaggaggagcagtgctaccatcttgcgccgacttgttcgtgtattacaaaaagtgcatggtgcaatgctcccagctctctacaggggagcccatgatcgccttgaccacaatcttccagaagtacctcagagagtatgcttggaaaatccttagcggtaatctgcctaagactaccacgtcaagtggaggcttaacgatcagtagcttgcttaaagagaaggagggctcagaggtcgctaagtttactctggaagaactgtgtctcatttgtaatatcttgtctaccgccgaatactgcctcgcgaccacacagcaactagaggagaaactcaaagaaaaggtagatgtttcgctcatcgagcggatcaatctgactggcgagatggatactttttccacagtaatcagttcatccatacaattgttagttcaagacttggatgccgcttgcgatcctgccttgacagcaatgagcaagatgcaatggcaaaatgtggaacacgtgggggaccaaagcccatatgtcacttccgtaatcctccacattaagcagaacgtgcctataattcgggacaacctggcatccacacgaaagtactttactcagttctgtgtcaagttcgccaattctttcatcccaaaattcataacccacttattcaagtgcaaacctattagcatggtgggcgccgagcaggtgcgatggacatag

SEQ ID NO: 34709 - DNA, 387 bp, Artificial Sequence
  Description of Artificial Sequence: Synthetic coding sequence
atggttctcctggacctcccctcaatctcgtcacaagtggtgagaaaagcccccgcaagctatactaaaatagtcgtcaagggtatgacgagagctgagatgattcttaaggtagttatggcaccacacgaaccactggttgtgttcgtggataattatatcaagctcctgacagactgcaatactgagacattccagaaaattctggacatgaaggggctgaagaggagtgagcaatcctctatgctggagctactgaggcagcgactgcccgccccaccttcaggagccgaatcctcaggttctctgtctttgaccgcccctaccccagagcaggaatcgagtcggatcagaaagctcgaaaaactaatcaaaaagcggctgtag

SEQ ID NO: 34710 - DNA, 2934 bp, Artificial Sequence
  Description of Artificial Sequence: Synthetic coding sequence
atggcctcatcgcacagcagttctcctgtgcctcagggctctagtagtgatgtcttctttaaaattgaagttgacccttccaaacacatacgccccgtgccatcattgcctgatgtttgtcccaaggagcctaccggtgattcacactcattgtatgtggcgccctccctcgtgacagatcagcaccggtggaccgtgtaccattccaaagtgaatttgcctgcagccctcaacgaccctcggctggccaagcgcgaatcagatttcttcacaaaaacctggggccttgacttcgtggatactgaggtgattcccagcttctatctgcctcagatttctaaagagcattttacggtttatcagcaggagatatctcagagagagaaaattcacgagcgttgcaaaaacatctgtcctcctaaagacacattcgagaggacccttcttcacacccatgataagtctagaactgaccttgagcaggtgcccaaaattttcatgaagcccgatttcgccttggacgatagtcttacctttaatagcgttctgccctggtcacattttaataccgcagggggaaagggcaatagggacgcggcttcaagtaagctgttacaggagaagcttagccactacctcgacattgtcgaagtgaatatcgcccaccagatctcacttaggagcgaggctttttttcatgccatgacctctcaacatgagctgcaagattacctcaggaagactagccaagccgtcaagatgttacgcgataagatcgcacagattgataaggtaatgtgcgagggctcgttgcacatcctacgactggcactgacaagaaacaattgcgtgaaggtttacaataaactgaaattaatggccacagtccaccagacccaacctaccgttcaggtgctgttgagcactagcgagtttgtgggagcactcgacctcatcgccaccacacaagaggtactccaacaggagctccaggggattcattccttccgtcatctagggtctcagctctgcgagcttgaaaagcttattgacaagatgatgattgctgagttttcaacctactcacattcggaccttaatagaccgttagaggacgactgccaggtgctggaggaagaacggctgatcagtctggttttcgggttgcttaagcagcgcaagctcaacttcctagagatatacggggaaaaaatggtgatcaccgctaaaaatatcatcaagcaatgtgtgatcaataaagtgtctcagacggaggagattgacacagatgtcgtcgtaaaactggccgaccagatgcgcatgttaaacttcccccagtggtttgacctcctgaaagatatcttctctaagtttaccatctttttgcagagagtgaaggccaccttaaatatcattcatagcgtggtgctgtccgtgcttgataagaatcagcggacacgggagcttgaggagattagccagcagaaaaatgccgcaaaggataactccctcgatactgaagtggcttacttgatacatgagggtatgtttataagcgacgcttttggagaaggagaactgacacccattgccgtggacacaaccagtcaacgaaatgcgtctcctaactcggaaccgtgctcaagtgattcagtttccgagcctgagtgcaccactgactccagctcaagcaaagaacacacttcgagcagtgccatccccggcggggtagacatcatggtgtccgaagatatgaaactgaccgattccgaactgggaaaacttgcgaacaatatccaagaactactctacagcgcttccgacatctgccacgatagggccgttaagttcctgatgtcaagggcaaaggatggttttctggagaagctgaacagcatggaattcatcaccctgtcgaggttgatggagacattcattttggataccgaacagatctgcggtcggaaatctactagtctgcttggggccctgcagtcacaggccatcaaatttgtgaacaggtttcacgaagaacgcaagactaagctaagtctgcttctggacaatgaacggtggaagcaggctgacgtaccagcagagttccaggatctggtcgactcactcagtgatgggaagatagccctccccgagaagaaatccggagcaaccgaggagaggaagcccgcggaagtgttgattgtggaggggcagcagtacgccgttgtcgggaccgtgctgctgctgattagaattatactcgaatattgccagtgcgtggataatataccttccgtgactactgacatgctgacccggctgagcgatctactaaaatatttcaacagtcggtcctgccagctggtgctcggcgctggcgcattgcaggtggtggggctcaaaactatcactacgaagaacttagcactgagtagccgatgtcttcaactaatcgtgcattacataccagtgatccgtgcgcattttgaagcacgccttccgcccaagcagtacagcatgctgagacatttcgatcatattactaaggactatcacgaccatattgctgagatttccgctaagttagttgccattatggactcactgttcgataaacttttatcaaaatacgaggtgaaagctccggtaccatccgcatgtttcagaaatatctgtaagcagatgaccaagatgcatgaagccattttcgacctacttcccgaggaacaaacccagatgctgttcctgcgtataaatgcttcctataaactgcacctgaagaagcagctctcccatctgaacgtaatcaatgacggcggtccccagaatgggctggtgacggcagacgtggccttctatacgggcaacctccaagcactaaagggactgaaggacttggacctcaatatggcggagatctgggaacaaaagcgatag

SEQ ID NO: 34711 - DNA, 2901 bp, Artificial Sequence
  Description of Artificial Sequence: Synthetic coding sequence
atggcctcaagccattcaagttcccctgtcccccaaggctcctcctctgatgtcttctttaagatagaggtagatccaagcaagcacattaggccggtaccgtcccttcccgacgtgtgtccaaaggagccaactggcgactcccatagtctgtatgtcgcaccatctctggttacggaccagcataggtggactgtctatcattctaaggttaacctgccagcagcccttaacgatccccggcttgcaaaacgcgaatctgatttttttaccaagacctgggggctcgattttgtggacactgaggtgatccccagcttttacttgccacagatcagtaaggagcacttcactgtctaccagcaggagatctctcagagggaaaaaattcacgagaggtgcaagaacatctgccctcctaaagatacctttgaacgcacactgctgcatacccacgataagtcgcgaacggatctcgaacaggttcccaagattttcatgaagcccgacttcgctctggatgacagtctcactttcaattctgtgctcccatggtcccattttaacacagctggcggcaaggggaacagggatgctgcaagctctaagctgctccaagaaaaattatcacactacctggacattgtcgaggttaacatcgcccaccagatctctctgagatcagaagccttcttccacgcgatgacttcccaacacgagcttcaagactacctccggaagaccagtcaggccgtgaaaatgttaagagataaaatagcccaaatcgataaggtgatgtgtgagggttccctgcatatcttacggttagctctgacaagaaacaactgtgtgaaagtgtataacaaactcaagctgatggcaaccgtgcatcaaacccaacccaccgtccaggttttattaagtacatcggaattcgttggagctctcgacctcatcgccactacacaggaggttctccagcaagagttgcagggcatacattcgtttagacacctgggaagtcaactttgtgagttagaaaaactgatcgataagatgatgattgccgagttcagcacatattcacattctgatctgaatcgccctcttgaggatgattgtcaggtgctggaggaagaacgactcatctcccttgttttcggtctgctgaagcaaagaaaactgaatttcctggagatctatggggaaaaaatggtcatcacagccaagaacattatcaaacaatgcgttatcaataaggtgtcgcagaccgaagagattgacacagacgtggtggttaagctggctgaccagatgcgaatgctgaattttcctcagtggtttgacctgctgaaggacatattctccaagtttaccatttttttgcagcgggtgaaggcaactctgaacatcattcatagcgtagttttgtcagtactcgacaagaatcagagaacccgagaattagaggagattagccaacagaagaacgccgctaaagataattcgctcgacaccgaggttgcttaccttatacacgaagggatgtttattagcgacgcatttggcgagggcgagctcactcccatcgctgtcgacactacttcgcagagaaatgccagcccgaattctgaaccatgttctagtgacagtgtgtccgagcctgaatgtactacagattcatcctcttccaaagaacacacatcaagtagcgctatacctggcggagtggacatcatggtttctgaggatatgaaactgacggatagtgaacttggaaagttagcaaacaatattcaagaactgctttattcagcttctgacatatgtcacgaccgggcggttaaatttctgatgtcccgggcaaaggatggatttctggaaaaactgaattctatggaattcattaccctgagtaggttaatggagacgttcattttggacaccgagcagatctgtggaaggaaatccacctccctgttaggagcgctgcagtcccaggccattaagtttgtgaaccggttccacgaagaacgaaaaaccaaactgtcccttcttttagacaacgagcgatggaaacaggccgatgtacctgcggaatttcaggacttggtggattcactgtcagacgggaagattgctctgccagagaagaaatcgggcgctacagaggagcgtaagcctgcagaagttctaatcgtggaaggtcaacagtacgctgtggttggcacggtcctgctactaattagaattattctcgaatactgtcaatgtgtggataatattccttccgtaacaactgatatgctgaccaggctcagcgatctcctgaaatactttaactctcgttcttgtcagttggtgttgggggccggcgccttgcaagtcgtcggcttgaagactataactacaaagaatctggccctgtctagcagatgtttgcagctaatagtccattatattccggtgataagggcccatttcgaagctagacttcctcccaaacagtattctatgctgagacacttcgatcacattactaaggattatcacgatcatatcgccgaaattagtgcaaaactggtggcaattatggattctctgtttgacaaactcctttccaaatatgaagtgaaggccccagttccatccgcatgctttagaaacatctgtaagcagatgacgaagatgcacgaggctattttcgatctgctgccagaagaacagacacaaatgctcttcttgagaatcaatgcgagttacaaattacacctgaagaagcaactgtctcatctgaatgtcataaacgatgggggccctcagaacggactggtgaccgccgacgtagcgttctatacaggcaatctgcaggctttaaaaggcctgaagatctggatgtag

SEQ ID NO: 34712 - DNA, 2898 bp, Artificial Sequence
  Description of Artificial Sequence: Synthetic coding sequence
atggcaagttcgcactccagtagcccagttccacagggctcttcctctgacgtgttttttaagatcgaggtagatccctccaaacacattcgacccgtgccatcgctacctgacgtctgtcccaaggagccgacggtgacggaccaacacagatggaccgtctaccattccaaggttaatctgccggctgcgcttaatgaccctaggctggccaaacgcgagtccgattttttcaccaaaacctggggcctcgactttgtggacaccgaggttattccttcgttttacttgccccagattagtaaagaacactttacggtctatcagcaggagatttctcagagagaaaagattcacgagcgctgtaagaatatctgccctccaaaagacaccttcgagcgcacccttctgcatacacatgataagtcacggacagatctagaacaagtcccgaagatttttatgaaacccgacttcgctctcgacgacagcctgactttcaatagcgtcttgccctggagccactttaacactgctggtggcaaaggcaatagagacgcagctagctctaaactcctccaggagaagctgagtcactatcttgatattgtggaggtcaacatagctcaccaaatttctctgaggtccgaggctttttttcacgcgatgacatctcagcacgaactgcaggactatcttcgtaaaaccagtcaggccgtcaagatgctacgggacaaaatcgctcagattgataaggtcatgtgtgagggctccttgcatatcctgcggcttgcccttacgcgcaacaactgcgtgaaagtgtacaacaagctcaaactgatggctaccgtacatcagactcagcccacagtgcaggtgttattatccacaagcgaatttgtgggagccctggacctgatcgcaactacccaggaagtgttgcaacaggagctgcaaggaatccacagctttaggcacctaggatctcagctttgcgagctcgagaagcttattgacaaaatgatgattgcagagttctcaacatacagccatagtgacctgaatagacctctggaagatgattgccaagtcctcgaagaggaacgcctgattagcctggtcttcggcctcctgaaacaaaggaagctgaatttcctcgaaatttacggggagaagatggttattacggccaagaacatcattaagcaatgtgtaatcaacaaggtcagccaaaccgaagagattgatacggacgttgtagtgaagctagctgatcaaatgaggatgctcaacttcccccagtggttcgatctgcttaaggacattttcagcaagttcactatcttcctccagcgtgtgaaggccactttgaatattatacactccgtggtgctgtctgtcctggataagaaccaacggacccgggagttggaggagatttctcagcagaaaaacgcagccaaggataactccctggatactgaggtggcttacctgatccatgaggggatgtttattagcgacgcttttggcgagggggagctgactccaatcgctgttgatacgaccagtcagcgcaatgcctctcctaacagcgagccgtgcagcagcgacagtgtatcggagccagaatgcactactgacagttcatcctcaaaggagcacacttcttcatccgctatcccgggcggcgttgacataatggtgtccgaggatatgaagctcaccgattctgaattaggaaaactggctaacaacattcaagaactgttgtacagtgcctcagacatttgtcatgatcgagcagtcaagttcctgatgtccagagccaaagatggatttctggaaaagttaaacagtatggaatttatcaccctgagccgcttgatggagaccttcatcctggacaccgaacagatatgcggccgcaagtcaacgtcccttctcggggcactccagtctcaggcgatcaaattcgtgaataggtttcatgaggagagaaaaacgaaactgtctctgctgctggacaatgagagatggaaacaggcagacgtccccgcagagttccaggatttggttgacagtctgagcgacggcaagatcgcactgcccgaaaaaaagagtggggccaccgaggagcggaaacctgccgaggtcctgatagtggaaggccagcaatatgccgtggtggggactgtccttctcctaatccgcattattttggaatactgccagtgcgtcgacaacatcccaagcgttaccacagatatgcttacgcggctgagcgaccttctcaaatactttaactcgcgctcgtgtcaactggtattgggagccggcgcactgcaagttgtcggtctaaagactatcacaacaaagaacctagcgctgtcaagtaggtgcctccagcttatagtccattacatccctgtgatacgcgctcacttcgaggctaggctgccgcccaagcagtacagcatgcttcgccatttcgaccacattacaaaagattatcatgatcacatagccgagatatccgctaagctcgtggctattatggactctctatttgataagttactgtcaaaatatgaagtcaaggcccctgtgccgtctgcgtgttttcgaaatatctgtaagcaaatgactaagatgcatgaggctatattcgacctgctacccgaggagcagacgcagatgctgttcctccgtatcaacgcgagctacaaactccatttaaaaaaacagctgtcacacttgaatgtgattaatgacgggggcccgcaaaacggtctggtaaccgccgacgtcgccttttacacaggtaatctccaggcactcaaaggcctgaaggaccttgatttaaacatggccgaaatttgggagcagaagcggtag

SEQ ID NO: 34713 - DNA, 2898 bp, Artificial Sequence
  Description of Artificial Sequence: Synthetic coding sequence
atggcatcttcccacagctcctcccccgtgccacagggcagttccagcgacgtgttcttcaagatagaagttgatcctagcaagcacatacgccccgtgccatcgttgccagatgtctgtccaaaagaacctacagtgacagaccagcatcgttggacggtttatcattccaaggttaaccttcctgctgctctgaatgaccccagattggccaaaagggagtcagacttcttcaccaagacctggggtctcgatttcgttgataccgaagttatcccctcgttctatctgccccagatatccaaagaacatttcaccgtgtatcagcaggaaatatcccagcgcgaaaagatccatgagcgatgcaaaaatatctgtccaccaaaagacaccttcgagcgcacattgctacatacccacgacaagagtcggactgacttagagcaggtcccaaagatctttatgaaacctgattttgcgttggacgacagcctgaccttcaactctgtcctgccatggagccacttcaacaccgcaggtgggaagggcaaccgcgatgctgcttcttccaaactgctgcaggagaaactgagccattatcttgatattgtggaggtcaacatagctcaccaaatttcgctgaggtccgaagcctttttccacgccatgacaagtcagcacgagctgcaagactatctccgaaagacgtcccaagcagtcaagatgcttcgggacaaaattgctcaaatcgataaagtgatgtgtgaaggatctctgcacatccttcggctggccttgacccggaacaactgcgttaaggtctacaacaaactcaagctcatggccacagtacaccaaacccagcccactgtgcaggttttgctttcaacctcagaattcgtcggggcactggacctgattgctaccacccaggaggtactccagcaggagcttcagggtatccactcctttcgccatttgggcagtcagctttgcgaactcgaaaagctgatcgataaaatgatgatcgctgagttcagtacctactcccattcagacctgaatagaccactggaagacgattgtcaggtgcttgaggaagagcggctcatatctttagtgttcgggctcttaaagcaacggaaactgaatttccttgaaatctatggggagaagatggttatcactgccaaaaatatcattaaacagtgcgtgattaataaggtgagccaaactgaagagatcgacaccgacgtagtcgtaaagctggccgatcaaatgcgcatgctgaacttccctcagtggttcgatctccttaaagatattttttctaagttcactatctttctacagcgggtcaaagctacgcttaatatcatccatagtgttgtccttagcgtcctggataagaatcaaaggactcgcgagctcgaggaaataagccagcagaaaaatgcagccaaggataattccctcgacaccgaagtcgcttacctcattcatgagggaatgtttataagcgatgcatttggcgagggggaacttaccccaattgccgttgacactacctcacagcgaaacgcctctcccaactcggagccatgcagcagtgactccgtgtccgaacccgagtgcaccacagactcgagtagctcgaaggaacacactagctctagcgccatccctggcggggtggacattatggtgagtgaggacatgaagttgacagacagtgagcttgggaagcttgcaaacaatatccaggagctgttgtacagcgccagcgacatctgtcacgatcgagcggtgaagtttctgatgtctagagcgaaggatggtttcctggagaaactgaacagtatggaatttatcaccctgagtagacttatggaaacctttatccttgacacagaacagatctgtggaagaaagtccacaagcctgttgggggcactccagagccaggcaatcaagtttgtgaaccggttccatgaggagcggaagacgaaactgagcctgctgctggacaatgagcgctggaagcaggcagacgtgccagctgaattccaggacctggtggatagtttatctgacggcaaaatagctctacccgagaaaaagagcggggctactgaagaaagaaagccggcagaggtcctgatcgtagaaggacagcagtacgccgtggtaggaactgtcttgttgctaattcggataatcctcgaatactgtcagtgtgtggacaacatccctagtgtgacaactgacatgctgaccaggctgtccgacctgttaaagtactttaattcacggtcatgccaactagtgctcggggctggcgcattgcaggtagtaggactcaagaccataactaccaaaaacctcgccctgtcctctcgatgtctccagttaattgtgcattatatcccagtgatacgggcgcatttcgaagcccgtttgcccccgaagcagtattctatgctgagacattttgaccatattaccaaggactaccacgatcatattgccgaaataagtgccaaactggttgcaatcatggacagcctttttgacaagctgctctccaaatatgaggtgaaagctcccgtaccttctgcatgttttagaaatatctgtaaacagatgacaaaaatgcacgaagccattttcgacctgctgccggaagagcaaacacagatgctgttcctgcgcattaacgcttcctacaagttgcatctgaaaaaacagctgtcccacttaaatgttatcaatgatggagggcctcagaacgggctggtgaccgccgacgtggctttctatacgggtaatctgcaggccctcaaaggcctgaaagacctcgacctaaacatggctgagatatgggagcagaagagatag

SEQ ID NO: 34714 - DNA, 4287 bp, Artificial Sequence
  Description of Artificial Sequence: Synthetic coding sequence
atggaaaacgaaccagaccacgagaatgtggagcagtccctctgcgccaagactagtgaggaggagcttaataaatcttttaacttggaggcatcactgtctaaattttcttatattgatatggacaaagagttggaattcaagaacgatctcatcgacgacaaagaatttgacattcctcaggtggacacgccacctacactcgagtccattctcaatgaaacagatgatgaggacgaatcttttattctggaagaccccacattactcaacatcgacaccattgacagtcattcgtatgacacttcctctgttgcctcttccgattccggtgacaggaccaacctgaaaaggaaaaagaagttgcccgactccttctctctacatggatcagtcatgagacactcactgttgaaggggatatctgcacagatcgtgtcggctgccgacaaggtcgatgccggtcttccaacagccattgctgtgtctagcctcatcgccgtgggaaccagccacgggctggccctaatattcggaaagtaccagaaccaggccctgagactctgcctcggctcaacaagcgtaggtggccaatatggtgcgatctcagcactctccattaataacgattgtagtcgcctcttatgtggatttgccaagggccagataacaatgtgggatttggcgtccggaaagcttttgcgatccatcacggacgcccatccacccggaaccgcaattctccacataaaatttaccgatgatcctaccttggccatctgtaacgacagcggcggtagcgtattcgagctgacatttaaaagggtgatgggagtgagaacctgtgagtctagatgcttgttcagcgggtcgaaaggcgaggtgtgctgcattgaaccactgcatagtaagcctgaactcaaggatcaccccataacacagttctctcttctggccatggcctccctgaccaaaattcttgtaataggactgaagccaagcctgaaggtctggatgaccttcccttacggccgcatggatcctagttccgtccccctcctagcctggcacttcgtagctgtccagaattatgtgaaccccatgttggccttctgtaggggagatgtcgtgcatttcctactggtgaagcgggacgagtcgggggcaattcacgtgaccaaacagaagcacctacacctttactatgatctgataaatttcacttggataaacagtcggacagtggtgttactggacagcgttgagaaactccatgtgattgaccgacagacccaggaggagctggaaacagtggagatcagcgaagtacagctggtttataactcctcgcactttaagagtttagccaccggcgggaacgtttcccaggctctggccctggtcggtgaaaaagcgtgctatcagtccattagctcatacggcggccaaatcttttacctggggactaagagtgtgtacgtcatgatgctcaggtcgtggcgggagcgagtcgaccatctcctgaagcaagattgtcttacagaggctctggctctagcatggtcttttcatgagggaaaggctaaggccgtcgtgggtttatcgggggatgccagcaaaagaaaagccattgtggccgacaggatggttgaaattctgttccactatgccgatcgagcactgaagaaatgtccggaccagggaaaaatccaggttatggaacagcactttcaggatatggtgcccgtcatcgtagactactgtcttcttctgcagaggaaggatctgctgttttcccaaatgtacgataaactgtcagagaactctgtggcaaagggagtatttcttgaatgcctggaaccttatatcttgtctgataagctggtggggatcacaccccaagtgatgaaagacttgattgtccacttccaagataaaaagctgatggaaaatgtggaagctctcatcgtacacatggacattactagtcttgacatacagcaggtggtgctcatgtgttgggagaataggttatatgacgctatgatttatgtgtacaacaggggtatgaacgagtttatttcccccatggagaagctctttcgagttattgccccgcctctcaatgcggggaaaaccctgactgacgaacaggtggtgatgggaaacaagctcctggtgtatatctcttgctgcctggccggaagagcctaccctttgggcgacatcccggaagacctagtgccactcgtaaaaaaccaggttttcgagttcctgatccgcctgcacagcgccgaggcgtccccagaagaggagatctatccatacatcaggaccctgctgcactttgatacacgggagtttttaaatgtgctggctttgacattcgaggattttaaaaatgacaagcaggcagtggaataccagcagagaatcgtcgacatcctgttgaaggtgatggtggagaattcggatttcacccccagtcaggttggatgcctctttactttcctcgcacggcagctcgctaagccagataacaccttgtttgtgaatcgcactctattcgaccaggtgctcgagtttctgtgttccccggatgatgactcgcgccatagtgagaggcagcaagtgctcctcgaactgcttcaagcaggtgggattgtgcagttcgaagaatcaagattgatacgtatggccgaaaaggcagaattctatcagatttgcgagttcatgtacgagcgcgagcaccaatacgataaaattattgactgctatctgcgggatcctttgagggaggaagaggtctttaattacatacacaatatcctgagcatacctgggcacagtgctgaagagaagcagagcgtttggcagaaggctatggatcacatcgaggaactggttagcttgaaaccctgtaaagccgccgagctggtcgccacacatttttccgggcatatcgagacagttatcaaaaagcttcaaaatcaagtgctcttattcaaatttttacggagcctcctcgaccccagggagggaatacacgtgaatcaggaacttctgcagatctctccgtgtatcaccgagcagttcattgagctcctgtgtcagttcaatccgacgcaggtcatagagaccctgcaagtcctcgagtgttaccgtctggaggaaactattcagattacgcagaagtaccagctccatgaagtgacagcctacttgcttgagaagaaaggagatattcatggagccttcttaattatgctggagagactccagtctaagctgcaggaagtgacacaccagggtgagaacacaaaggaagatccttccctaaaggacgtggaggataccatggtggagaccattgccctgtgtcagagaaactcacacaacctaaatcagcaacaacgggaggcactgtggtttccccttctcgaggcaatgatggcccctcagaagctttcttccagcgcgatcccccaccttcactccgaggctctgaaatcactaactatgcaggtcctcaactccatggccgcatttattgcactaccttccattctgcagcgtattttgcaggatccagtttatgggaaaggtaagttaggggaaatccaaggactgattttgggcatgctggacactttcaattacgagcagacactcttagagacgactaccagtcttttgaaccaggatcttcattggtccctttgcaatctgcgggccagcgttacccgtggactcaaccctaagcaggactactgcagcatctgtctccagcagtacaagcgtagacaggagatggcagacgagatcattgtgttctcctgcggccacttgtatcatagtttctgcctacaaaacaaggaatgtaccgtggagttcgagggacaaaccaggtggacctgctataaatgttcctcttcaaataaggtcggaaagctgtctgagaattcatcagagatcaagaagggtaggattactcccagtcaggtcaagatgtcaccttcctatcaccaatctaagggagacccaacagcaaagaagggtacttctgaaccggtgttggatccacagcagattcaggctttcgaccaattgtgccgcttgtataggggctcttctcgcttggcgctgctgactgagctgtctcaaaacagatcctccgaaagttacagacctttctctggtagccagagcgcccccgcattcaatagcatctttcaaaacgagaatttccagctgcaactaatccctcctcctgtgaccgaagattag

SEQ ID NO: 34715 - DNA, 609 bp, Artificial Sequence
  Description of Artificial Sequence: Synthetic coding sequence
atggaaaacgaacctgatcatgagaatgtggagcagagcctgtgtgccaagacatcggaggaagagttaaataagtctttcaaccttgaggcaagcctgagcaaatttagttatatcgacatggacaaggaactcgagtttaaaaacgatcttattgacgacaaggagtttgacatccctcaggttgatacccctcccacactagagtctatcctcaacgagacggatgacgaggacgaatcattcatccttgaggacccaactcttctgaatatcgacactatcgactcccacagttatgacacttctagcgtagcctcctcggactcaggggatagaactaaccttaaacggaagaagaagctcccagacagttttagcttgcacggaagtgtcatgaggcattctctcctcaaaggaatctctgctcaaattgtatctgcggctgataaggtggacgccggcctgcctactgccatcgccgttagctcccttatcgccgtcggcacgtcccacggccttgccctcattttcgatcagaatcaggccttgaggttatgcctgggatctacaagtgttgggggccaatacggcgcaatatctgcctag

SEQ ID NO: 34716 - DNA, 4281 bp, Artificial Sequence
  Description of Artificial Sequence: Synthetic coding sequence
atggaaaatgaacccgaccatgaaaacgtggagcagagtctgtgtgccaagaccagtgaggaggagcttaataaatccttcaatctggaggcctcgctgtctaaattctcctatatcgacatggacaaagaattggaattcaaaaatgatctaatcgacgacaaagagtttgatattccacaggttgacaccccacccacattagaatcaatactcaatgaaactgatgacgaagatgagtcctttatactggaggatcccacgctgcttaatatcgataccattgacagccactcatacgatacctcttcagtggcgtccagtgattcaggtgatcgaacaaatttgaagaggaagaaaaagttgccagactcgttctccctgcacggtagtgttatgaggcactctctcctgaaaggcatctccgcccaaatcgtgtcggcagctgacaaagtggacgcaggtttgcccacggccatagccgtctccagccttatcgcagttgggacatcccatgggcttgcattgatattcgatcaaaaccaggcgctgcgtttgtgcttgggttccacctctgtgggaggccagtacggcgccatttcagccctgagcatcaataacgactgcagccggctgctttgtggattcgcaaaaggacagattacaatgtgggacctggctagcggcaagttactccgcagcattacagacgctcaccccccaggaaccgcgatcttacatatcaaatttacagatgacccaaccctggccatctgcaatgattccgggggatcagtgtttgaactgacattcaaacgcgtgatgggcgtacgcacctgtgagtcacgatgcctgttctcggggtctaaaggcgaagtctgttgtattgagccgctgcactctaaacccgaattgaaagaccatccgatcacccagttctcattgctcgccatggcatcactcacgaaaatcctggtgatcggactgaaacccagtttgaaggtctggatgacattcccctacggtagaatggatccttctagtgtgcccctcctggcttggcactttgtggctgtacagaactatgtgaatcctatgctggctttttgcagaggagacgtggtccactttttgctggtaaagcgcgatgaatccggagcaatccacgtcaccaagcagaagcatctccacctgtattacgatctgatcaatttcacatggataaactcccgcaccgttgttttgttggattctgtggaaaagctgcacgttatcgacaggcagacgcaggaagaactcgagacagtggagatcagcgaagtgcagctcgtgtacaactcaagtcactttaagagcctagccacaggaggcaatgtttcacaggcactggcattagttggcgagaaggcgtgctatcagtccatcagttcctatggaggccagatcttttacctgggcacaaaaagtgtgtacgtcatgatgcttcgctcttggcgcgagcgggttgatcacctactgaagcaggactgtttaacggaggctctggccctcgcctggtcgtttcacgaaggaaaggccaaagccgttgtgggtctaagtggcgatgcctcgaagcgtaaggcaatagttgcagatagaatggtagagatactgttccactatgccgatagggctctgaaaaagtgtccagatcagggaaaaattcaggtgatggagcagcatttccaagatatggttcctgtgattgtggactattgtctcctcctgcagaggaaagacctactcttctctcagatgtatgacaagctgtccgaaaactcagtggctaaaggggtgttccttgagtgccttgagccgtatatcctaagtgacaagttagtggggataaccccacaggtcatgaaggatctcattgtacactttcaggataagaagcttatggaaaatgtggaagcgctgattgtccacatggatataacctccctggacatccaacaggttgttctgatgtgttgggaaaatcgtttgtacgatgccatgatctacgtgtataatcgaggcatgaacgaatttatttcccctatggagaaactgtttagggttatagctcctcctttgaatgctggcaaaactctcacagatgaacaggtggtgatgggaaataagctactagtctacatctcctgttgtctggctgggagggcttaccccctaggggatataccggaagacctggtgcccctggtgaaaaaccaggtctttgaattccttatcagactgcacagcgctgaggctagtcccgaagaggagatatatccttatatcaggacactcctgcactttgatacacgtgaattcctaaacgtgctcgctctgaccttcgaggactttaagaacgacaagcaggcggtagagtaccagcaaaggatagtggacattcttcttaaggtaatggttgagaatagcgattttaccccttcacaggttggctgtttgttcacctttctggcacgacagttggccaagcccgataacaccctcttcgttaacagaaccctgtttgatcaggttctcgagttcctctgctctcccgatgacgatagccgccatagcgagcggcagcaggtgctgttggaactgctgcaggcaggggggatcgtacaatttgaagagtctcgcttgattagaatggccgagaaagccgaattctaccagatttgtgaatttatgtatgaacgagagcaccagtatgataaaattattgattgttatctcagggatcctctaagagaggaggaggtgtttaattatattcacaatattctaagtatcccaggtcattcagccgaggagaaacagagcgtctggcaaaaggccatggaccacattgaggagcttgtgtccttaaagccttgtaaggctgccgagctggttgccacccacttttccggtcacatcgagaccgtgataaagaaacttcaaaatcaagtcctgctttttaaatttctccgttcactgttggatccgcgggagggcattcacgtgaatcaggagctgctgcagatcagtccatgtataacagaacagtttatagaactgttatgccagtttaaccccacacaggtcatcgaaactctccaagtgttagagtgttatcgcctcgaagagactatccagataacgcagaagtaccagttgcatgaggtgacggcatatctgctggagaaaaaaggagatattcatggcgcattcctaataatgctggaacggctccagagcaaattgcaggaagtaactcaccagggagaaaatacaaaggaagacccgtcgctcaaagatgtcgaggacaccatggtggagacgatcgctctctgtcaaaggaattcacacaacctgaaccagcagcagcgcgaagcattgtggttccccctccttgaggccatgatggcaccccagaagctgagttcatctgctatcccacacttgcactctgaggcccttaaatcactgacaatgcaggttctgaactcgatggcagccttcatcgctctccctagcattctccaaaggattctgcaggatcccgtgtatggtaagggaaagctgggagaaatccagggactcattttgggcatgctcgataccttcaattacgagcagaccctactggaaacaactacctcacttctgaaccaggatctccactggtccctctgtaacttacgtgcaagcgtcaccagggggctgaatcccaagcaggactattgcagcatttgcttgcagcagtacaagcgtcggcaggagatggcagatgagattatcgtcttttcctgtggacatttatatcattcattctgtttgcagaataaggagtgcacggtggagttcgaagggcaaacacgctggacatgttataagtgcagttcttcgaacaaagtcggaaagctgagtgaaaactcatcagagattaagaaaggccgtatcacaccatcacaggtcaagatgtctccctcatatcatcaaagtaagggtgatcctacagcaaagaaaggcacttccgaaccggtgctggacccacaacaaatccaggcatttgaccagctgtgcaggttgtatcgcggctcgtcgaggctggcactactcaccgaattgtcccagaacaggagctccgagtcctatcgaccattttccggttcacagtccgccccagcctttaatagtatcttccagaatgagaacttccaactgcagctgatccctcctcccgtcactgaggactag

SEQ ID NO: 34717 - DNA, 4287 bp, Artificial Sequence
  Description of Artificial Sequence: Synthetic coding sequence
atggagaacgagccggatcacgagaatgtggaacaatctctgtgcgccaaaaccagtgaagaggaactaaataaatcattcaacctcgaagcatcactcagtaaatttagttatatagacatggacaaagaattagaattcaagaatgatctgatcgacgacaaggagttcgacatcccacaggtggatactccgccgactttagaatctatcctgaacgaaaccgatgatgaggatgagtcttttattcttgaagaccccaccttgcttaacattgacactatagacagtcatagctacgacacctcttccgtcgcctcttctgatagcggcgataggacgaacttaaagaggaagaagaagcttcctgactctttctctctgcacggttctgtgatgaggcacagcctgctgaaaggcatctcagcacaaatagtgtctgccgcagacaaagtggacgcggggctgccaactgcaattgccgtttcgtctctcatcgcagtaggaacaagtcatggcctggcactaatcttcggaaaagaccagaaccaggcgctgaggttgtgtttaggaagcacctccgtaggggggcagtacggagctattagtgccctttctataaataacgattgctctcggctcttatgtgggttcgctaaaggtcagattaccatgtgggacctcgcttccggcaaattactaaggtcgattaccgatgcacatccccccggaaccgccattctgcacatcaagttcactgacgatccgaccttggctatttgcaatgactctggcgggtctgtgttcgagctgacctttaaacgcgttatgggagtacgtacatgtgaaagccgctgtcttttttctggatccaaaggggaagtatgctgcattgagccattgcatagcaagcccgagcttaaggatcatccaatcactcagttcagcttgctggccatggccagcctgaccaagattctggtgattggacttaaaccctccctcaaggtgtggatgacgttcccatacgggagaatggacccaagctctgtgcccctgctcgcttggcatttcgtagccgtccagaattacgtcaatcccatgctggccttttgtagaggggatgtagtgcatttcctgcttgtgaagagagacgaatcaggcgccatacatgttactaaacagaaacatttacacttatactacgatctgatcaattttacctggatcaactcccgaactgttgttcttctcgacagcgttgagaaactgcatgtcatcgatcggcagactcaggaggaactcgaaaccgtggaaattagtgaggttcaacttgtgtataacagcagccacttcaagagtctcgctacggggggcaacgtaagccaggcgttggccctggtcggcgaaaaagcgtgctatcaatctatctcgtcatacgggggccagattttttacctcggcacaaaaagcgtttacgtcatgatgctcagatcatggcgggagagggtggatcacttgctgaaacaggattgcctgacggaagcgttggctttagcatggtcttttcatgagggaaaagccaaagctgtggtaggactaagtggtgacgcatccaagcgaaaggcaatcgtggcggatcgaatggtagaaatcctgtttcactatgccgatagagccctgaaaaagtgccctgaccagggcaagattcaggtgatggagcagcactttcaagacatggtccccgtaattgttgactactgtctgctgctgcagcggaaagatctacttttttcccagatgtatgacaaactaagcgagaacagcgtggctaaaggagttttcctagaatgtctagagccttacattctctcagataagctggtgggaataactccccaggtcatgaaggacctgattgtccactttcaggacaagaaattgatggaaaatgtggaggccctgatcgtgcacatggacatcaccagccttgacatccaacaagttgtgctcatgtgttgggagaacagattgtacgatgccatgatttacgtgtataataggggaatgaacgagttcatctctcccatggaaaagctcttccgggtcattgcgcctcctctgaacgcgggtaagacactgaccgacgaacaagtcgtaatgggcaacaaattgctcgtctacatctcatgctgcctagctggtcgcgcctatccgttgggcgatatcccagaggacttggtgccattagtaaaaaaccaggtgttcgagtttcttattcggctgcattctgctgaggccagccccgaggaggagatatacccttacattcgcacactcctacactttgacaccagggagttccttaatgtcttagcactgacttttgaggattttaaaaatgataaacaggcagtggaataccagcagagaatagtagatattctgctgaaggtgatggtcgaaaatagcgacttcacgccctcccaggtgggctgcctttttacctttcttgctcgccagttggccaagccagacaacacgctcttcgtaaacagaacgttgtttgatcaagtcctggagttcctctgctcccctgatgacgacagtcggcactccgaacgacaacaggtcttgctggagctgctccaagctggcgggattgtgcaattcgaggagagccgcctgattcgcatggctgaaaaggctgagttctatcagatctgtgaattcatgtacgagcgggaacaccagtatgacaagataatcgattgttatctgagggatcctctgcgcgaagaggaggtctttaactacatccataacatactttcaatcccaggtcattcagctgaagagaagcagtctgtttggcagaaggccatggaccatattgaagagttagttagcctaaagccttgtaaagctgcagagttggtcgctacacacttttcgggacatatcgagacggtgatcaagaagctccaaaaccaggttctactgttcaagttcttgagaagcctcctggatccccgggagggtattcacgttaatcaggaactgctccagataagtccctgcatcaccgaacagttcatcgagttgctctgtcagttcaatcctactcaagtaattgagactttgcaagtgctcgagtgctaccgactggaggagacgattcagataactcagaagtaccagctccacgaagttaccgcctatctcctcgaaaagaagggggacattcacggagcgttcctgattatgctggaaaggcttcagagtaaactccaggaggtcacacaccaaggagaaaataccaaggaagacccatccttgaaagatgtggaggataccatggtagaaactatcgcactgtgccagcgcaattcccataatttgaaccaacagcagcgcgaggccttgtggttccctctgcttgaggctatgatggctccccagaagctgagctcttcagcaatcccacacctgcatagcgaagccctgaagagtctgacaatgcaggtgctaaactccatggccgcctttattgcactccccagtatcttgcagagaatcctccaggaccctgtctacggaaagggcaaactaggtgagatacagggactgatcctgggcatgctggatacattcaactatgaacagactctgttggagactaccaccagtctcctgaatcaagacctccactggagcttgtgtaacctacgcgcctccgtcacacgcggactgaatccgaaacaggattattgttccatatgtctacagcaatataagcggcggcaagaaatggcagacgagatcatcgttttttcatgcggtcatctctaccatagtttctgcctgcagaataaagaatgcaccgtagaattcgagggacagacaaggtggacctgttacaaatgttcatcctctaataaggttggaaaactcagcgaaaatagttccgagattaagaagggaaggataacaccatctcaggttaaaatgtccccatcttatcaccagtcaaaaggagatcctacagccaagaaggggacaagcgaacctgtgttggaccctcagcaaatacaggctttcgatcaactttgccggctgtaccgtggtagttccaggctggcgttactgacagagctgagccaaaatcgtagctcagaatcatataggcccttctcagggagccagtctgcaccagcctttaattccatttttcagaatgaaaatttccagctgcagctcatcccaccaccagtgacagaagattag

SEQ ID NO: 34718 - DNA, 423 bp, Artificial Sequence
  Description of Artificial Sequence: Synthetic coding sequence
atggagaacgagcccgatcacgaaaacgtggagcagtccctgtgtgctaaaacttctgaagaagaactgaataaatccttcaacctcgaggcctctctaagcaagttttcctacatcgatatggacaaagagctagaattcaagaatgatcttatcgacgataaggaattcgacatcccccaggtggatactcctcccaccctggaatcaatcctcaatgaaacggacgatgaagacgagtccttcattcttgaggatccgacactcctgaacatcgacacaatcgattcacactcatacgataccagtagtgttgcctcaagcgatagtggggacagaactaacctgaagagaaagaaaaaattgccggactcgttctctttacacggctccgttatgaggcattctctgctgaaagggtag

SEQ ID NO: 34719 - DNA, 366 bp, Artificial Sequence
  Description of Artificial Sequence: Synthetic coding sequence
atggagaacgagcccgaccacgaaaatgttgagcagtctctgtgcgccaaaacttccgaagaggagctcaacaagagctttaacctggaggcaagcttaagcaaattttcgtatattgacatggacaaagaactcgagtttaagaacgatctgatagacgataaggagtttgacattccgcaggtggacaccccgcccaccttagagtccattctgaatgagaccgatgacgaggacgagtcctttattctggaggatccgacactattgaacatcgacaccatcgacagccacagctacgatacatcttctgtggcctccagcgattccggggaccgcacaaatctgaagagaaagaagaagtag

SEQ ID NO: 34720 - DNA, 4011 bp, Artificial Sequence
  Description of Artificial Sequence: Synthetic coding sequence
atggagaacgaaccggaccatgaaaacgttgaacagtccctctgcgctaagacgtccgaagaggagcttaacaagtctttcaaccttgaggcctccctgtccaaattctcttacattgacatggacaaagagttagaattcaagaatgacctcatcgacgacaaggagttcgacatcccacaggtagatacaccccctaccctggaaagtatcctgaacgaaacagacgacgaagacgaaagcttcatactggaagatcccacattactgaacattgatactatcgattcacacagctatgacacatctagcgtcgcatcctctgactctggggatcgcacaaatttgaaaagaaagaagaaattgccagactccttctctttgcacgggagcgtaatgaggcattctctactaaaaggcatttctgcacagattgtcagtgcagctgataaagtcgacgcgggtttgcccacagcaatcgccgtgagctccctaatagccgtaggaacctctcacgggctggcattgatattcgaccagaaccaggctctgcggttatgtctgggcagcacttcagttggcgggcagtatggggccatcagtgccctgagtattaataatgactgctccagactactgtgtgggttcgctaagggacagatcactatgtgggacttggcaagtggcaagttgctgcggtcgatcactgatgctcatcctcccggcactgccatccttcacatcaagttcaccgacgatccaacccttgccatctgtaatgattctggtggttccgttttcgaacttacttttaagcgagtgatgggcgtccggacttgcgagtcaaggtgtctgttctctgggagcaaaggtgaggtgtgctgtatcgagcccctgcactcaaagccagagttgaaggaccaccccataacacagttctctttactcgcaatggcctctttgacaaagattctggtaattggtcttaagccttcacttaaggtgtggatgactttcccttacggacgtatggatccttcatccgtgcctttgctggcatggcattttgtcgccgttcagaactacgttaatcccatgctggccttttgtagaggggatgtggtgcatttcttgctggtcaaaagggatgagtctggtgctatacacgtgaccaaacagaaacacctgcacctttattacgatctgatcaattttacctggatcaactcccgaactgtcgtgctcctggactccgtggagaagctgcatgttatcgaccgccaaacccaggaggagctggaaacggtggaaatcagcgaggtccagttggtatacaacagcagtcatttcaaatctctggccacaggcggtaacgtgtcacaggccttagccctggtcggagaaaaagcttgctatcaaagcatctcttcatacggaggacagatcttttacttgggcactaagtcagtgtacgtcatgatgcttaggtcctggcgcgagagagtcgaccatctcctcaaacaggattgtctcactgaagccctggcactggcctggtcgtttcatgaagggaaggcaaaggccgtggtgggcttgtcgggcgatgccagcaaacggaaagctattgtggccgaccgcatggtagagattctgtttcactacgcagacagggcattaaagaagtgccccgatcagggaaagatacaagtgatggagcaacatttccaagtggttttgatgtgctgggagaaccgcttatacgatgccatgatatacgtgtataaccgtggtatgaatgaatttatcagcccgatggagaagctctttcgcgtaatagcccctcctctcaatgcaggcaaaacactcacagatgaacaggtcgttatgggcaacaaactgcttgtttacatcagttgctgcctggctggaagagcttatcctctcggtgacattcctgaggatctggtgcctctcgtgaaaaaccaggtttttgagttcctcatccggctgcacagcgcagaggcgtctccagaggaagagatatacccctatatcaggaccttgctgcactttgacacccgagaattcctgaatgtcttagccctcactttcgaggactttaagaatgataaacaggctgttgagtatcaacagcgaattgttgacatacttctgaaagtgatggttgaaaattcggactttacgccttcccaggttggctgtctgttcacattcttagcccggcaacttgcgaagccagacaacaccctgttcgtcaataggaccttgttcgatcaggtgttagaatttctgtgttccccagacgatgactccagacactccgagaggcaacaggtgctgcttgagctcctgcaggccggaggaatcgtgcagttcgaagaatccaggctcatccgtatggccgagaaagcagaattttaccagatctgtgaatttatgtatgagcgagagcaccagtacgacaagattatcgactgttatctccgcgaccccttgagagaagaggaggtgtttaattacatacataatattctgtccattcccgggcatagcgctgaggagaagcagtccgtgtggcaaaaagccatggatcacattgaggagctggttagtctcaaaccatgtaaggctgctgagcttgtcgcaacccatttcagcggtcatattgagaccgtgatcaaaaaattacagaatcaggtgctgctgtttaagtttctccgatccttgctggatccacgagaaggcatccatgttaaccaagagctgttacaaatctccccttgtatcaccgaacagttcattgagctcctgtgtcagttcaatcccacacaggtgatcgaaacattgcaagttttagaatgctacagacttgaagagaccatccaaatcacccagaagtaccagttgcatgaagtgaccgcttatttactggagaaaaagggagatatccatggggcattcctcattatgctggagagacttcagagtaaactgcaggaagtgacccatcagggagagaataccaaggaggatccatccctaaaagatgtggaggacacaatggtagagactatcgcactgtgccagagaaactcgcacaaccttaatcagcaacagcgcgaggccttgtggtttccgctcctcgaagccatgatggcaccccagaaactgagttcatcagccattcctcatctgcatagtgaggcactgaagagcctcactatgcaggttctgaatagtatggctgcctttatcgctctccctagtatactgcagcggattttgcaggacccagtgtatggcaaaggtaagttaggcgaaattcagggtctaatcctgggcatgctggataccttcaattacgaacagacattactggagactacaacatctctgctcaaccaggaccttcattggtctttatgtaatctgcgggcctccgtgacacggggactgaaccctaaacaggattattgttctatctgtctgcaacagtataagcgtcggcaagagatggccgatgagatcatagtgttctcgtgtggtcacttatatcattccttctgtctgcaaaataaggaatgtactgttgagttcgaaggacagactcgctggacttgctacaagtgtagttcctcgaataaggtggggaaactgagcgagaattcttcagaaattaagaagggcaggattaccccatcgcaggtcaaaatgagccccagctaccaccagagtaagggcgacccaaccgcaaagaaaggtacctccgaacctgtgttggacccacagcagattcaagcattcgatcagctctgccggctttaccggggaagttctcggctcgctctgctgacagagctatcgcaaaaccggtccagtgagagttatcgacctttcagcggcagccagtcggcgccagcctttaattccatttttcagaacgagaatttccagctgcagttgatccctccacctgtcacagaggattag

SEQ ID NO: 34721 - DNA, 225 bp, Artificial Sequence
  Description of Artificial Sequence: Synthetic coding sequence
atggaaaatgagcccgaccacgagaatgtggagcagagcctgtgcgcaaaaacctctgaggaggagctgaataaatcctttaacttagaggcttctctgagtaaattttcctatattgacatggacaaggagctagagtttaagaatgatctgatcgatgacaaagaattcgatataccacaggttgacactccccccacgctggaaagtattctgaacgaatag

SEQ ID NO: 34722 - DNA, 741 bp, Artificial Sequence
  Description of Artificial Sequence: Synthetic coding sequence
atgagccctaaaccccgcgcttccggcccacctgctaaagccaaggaagcaggtaaacgcaagtcctcttcgcagcctagcccaagcgatccaaaaaaaaaaaccacgaaagtggccaagaagggaaaagccgtccgaaggggtagaagggggaagaaaggagctgcgactaaaatggcagccgtcaccgcccctgaagcagagtccggcccagccgcccctgggccttctgatcagccttcccaggagcttcctcagcacgagttaccccccgaggagcccgttagcgagggcacacagcatgacccacttagtcaggagtcagagcttgaggaacccctgagtcaggagtcagaggtggaagagcctctgagtcaggaatctcaggtggaagaacctctttcccaagagagcgaggtggaggagcctctgtcgcaggagtctcaggtcgaggagccactctctcaagaaagcgaggtagaagagcccttatctcaggagtcagaggtggaggagcccctgtcacaggagtcgcaggttgaagagcccctctctcaggaatccgaggtcgaggagcccctctctcaggagtcccaagtagaggaaccattgtctcaggaaagcgaaatggaggaacctctgagccaggaaagtcaggtcgaagaaccactgtctcaggagtcagagatggaggaaccgttgtcccaggaaagtgagatggaggagctgcctagtgtgtag

SEQ ID NO: 34723 - DNA, 378 bp, Artificial Sequence
  Description of Artificial Sequence: Synthetic coding sequence
atgagtccaaagccgcgggctagtggacccccggcgaaagctaaagagaccggcaaaagaaagtcatcatcccaaccctccccgtccggccctaagaaaaaaacgacaaaggtggccgagaagggagaggcagtgcgcgggggccgccggggcaagaagggcgctgccactaagatggccgccgtgactgcccctgaggcagaaagtggaccagccgctcctggaccttccgaccagccaagtcaggagctgcctcagcacgagctgccaccggaggagcccgtgtccgaaggtacacagcatgacccgttatcacaggagtccgaactggaggaacccctgagcaagggaagacccagcacccctctcagtccatag

SEQ ID NO: 34724 - DNA, 2109 bp, Artificial Sequence
  Description of Artificial Sequence: Synthetic coding sequence
atgacgtcccgcaatcagttggtgcaaaaggtcctgcaggaactccaggaggctgtcgagtgtgaaggcctggaagggctgatcggagccagcctggaggctaagcaggtgctgagtagttttactctgcctacatgtcgagagggaggccccgggttgcaggtgctggaggtggacagtgtagcactgagtctgtatcctgaggacgcaccacggaacatgttacctctggtgtgcaaaggggaaggtagcctgctgttcgaggctgcctccatgctgctttggggggatgccggcttgtcactagagctgagagcccgcacagtcgtggagatgctacttcatcggcattattatctccagggtatgattgactccaaggtgatgctgcaggcagtgaggtactccctgtgttccgaggagagtccagaaatgacaagtctgcctccagcgacgctagaggctattttcgacgctgatgtcaaggcgagctgctttccctcttccttctcaaatgtgtggcacctctatgcccttgcctccgttctgcagcggaacatctactccatctatcctatgaggaacctcaagatccgcccttactttaatcgggttatccggccaagaagatgcgatcatgtgccttccactctgcacatcatgtgggctggtcagcctctcactagccacttctttcgccatcagtacttcgcccccgttgtgggactggaggaggtagaggccgaaggggccccgggcgtagcaccagccttgcccgcccttgcccccctcagtagtccagcgaagactctcgagcttttgaatcgagaacctggactgtcttacagccatctgtgcgaacgttacagtgttaccaagtccacattctaccggtggcgccgacagagccaggaacatagacaaaaagtagctgcgaggttcagcgctaagcacttcctccaagattcctttcatagagggggggtcgtccccctgcagcagtttttgcagagattccctgagatcagtcgctccacgtattatgcgtggaaacacgagctgttggggtccggaacctgtcccgccttgcctccccgggaggttctgggtatggaggaacttgaaaagctccctgaggaacaggttgctgaggaggaactagagtgttctgccctggccgtgagctctccagggatggtcctcatgcagagggcaaaactgtacctagaacactgcatctcgttgaatacgctggtgccttaccggtgtttcaagaggagattccccggtattagcagaagcacctactacaactggcgaagaaaagcactccgtcggaaccctagcttcaaaccagcccccgctctgtctgccgccggtactccccagttagcatctgtgggggagggggccgtgattccctggaagagcgaggccgaagagggggctggtaatgcgacaggtgaggatccccctgccccaggcgaactgctacccttgcgcatgcctctgagccggtggcaaaggcgattgagacgggccgccaggcgccaggtactctccggccacctgccattttgtcggttcaggctgaggtaccccagtctctccccatctgccttttgggtatggaaaagcctcgcgcggggatggccacgggggttgagcaagctgcaggttcctgtaccaactctcggaaaaggtggacaggaggccgaggagaaacaggaaaaagaagcgggtagagacgtgaccgctgtgatggctccacccgtgggcgctagctcagaagatgtggaagggggtccttccagggagggggccctccaggaaggagcgacagctcaaggccagcctcacagcggcccacttttatcccagcccgtggtggctgccgccgggggccgagacgggcggatgttagtcatggatatgatcgctactactaagtttaaagctcaggctaaactatttctacagaaaaggttccagtcgaagtctttccctagttataaggagttctccgcactgttccccctaacagccaggagcacctactacatgtggaaaagggccctgtatgatggccttaccctggtcgacggatag

SEQ ID NO: 34725 - DNA, 252 bp, Artificial Sequence
  Description of Artificial Sequence: Synthetic coding sequence
atgacttccagaaaccagctcgtgcaaaaggtgctgcaagaactccaagaggcagtggagtgtgagggccttgagggtctgattggagcgtctttagaagccaaacaggttctgagctcctttacactgccaacctgccgggagggaggcccaggtctgcaggtcttggaagttgacagcgtcgccctgtctctctatcctgaggatgctccccggaacatgctgcctctggtgtgtaagggcgaggggtag

SEQ ID NO: 34726 - DNA, 1260 bp, Artificial Sequence
  Description of Artificial Sequence: Synthetic coding sequence
atggcaaaagagggagtggaaaaggccgaagagaccgagcaaatgattgagaaagaagccggcaaggaacctgctgagggtggaggcggtgatggatcgcacaggctcggtgacgcccaagaaatgagggcggttgtgctggccggcttcggtggccttaacaaattgcggttgtttcgcaaggcaatgcctgagcctcaggatggagagctgaagattcgggtcaaagcttgcggcctgaacttcatcgatctgatggtgagacaaggaaacatagacaatccgcccaaaaccccactggttccgggcttcgagtgttccgggatcgttgaagcactgggtgacagcgttaaggggtacgaaatcggggatcgcgtcatggcctttgtcaactacaatgcctgggccgaggtagtgtgtacacccgtggaattcgtttacaaaatccctgacgacatgtcttttagcgaagccgccgctttccccatgaactttgtgacggcctatgtgatgctctttgaagtagcaaacttgcgcgaggggatgtctgttcttgtacacagcgcgggcgggggggtcgggcaagctgtggcgcagctgtgtagcacagtgcctaacgttacagtcttcggcactgcctcaacttttaagcatgaggctattaaggactcagtcactcacctattcgacagaaacgcagactacgtacaagaagtgaaacgcattagtgctgagggagtggacatcgtgctggactgcctctgcggcgacaacactggaaagggcctgtccctcctgaaaccgctgggcacatacattctttacggctcatcaaacatggtgacaggggaaacaaaatcgttcttttcgttcgccaagagttggtggcaggtggaaaaggtgaacccgatcaagctgtacgaagaaaataaggttattgccggcttcagtctgcttaaccttctttttaaacaggggagagccgggctcatacgcggcgtggtcgagaaattaatcggcctctataaccagaagaaaattaagcctgttgtggattccctgtgggccctggaggaggtcaaggaggccatgcagaggattcatgatcggggcaacatcggtaaactgatcctggacgttgagaagaccccgacacctctgatggccaatgacagtaccgagacaagtgaggccggtgaggaggaagaggaccacgagggggactctgaaaacaaggagcgcatgcctttcattcagtag

SEQ ID NO: 34727 - DNA, 648 bp, Artificial Sequence
  Description of Artificial Sequence: Synthetic coding sequence
atggtcttactaacaatgatcgccagggtggcagatggcctgcctttagcggcctctatgcaggaagacgaacagagtgggagggacctacagcagtaccagagtcaggccaaacaactgttccgcaaattgaacgagcagtccccgacacgttgtactttagaagccggagcaatgacatttcactatattatagagcagggtgtgtgttatctcgtgttgtgtgaggctgcatttcccaaaaagctcgccttcgcatacctggaagatctccacagcgagtttgatgagcaacatggaaagaaagtgcccacagtcagcagaccctattctttcatcgagttcgacacattcattcagaagacaaaaaagttgtacatcgattcacgagcccggcgcaatcttgggtctattaatacggaactgcaggatgtgcagagaattatggttgcaaatattgaagaggtgctgcagcgaggggaggccctgtcagccctcgattcaaaagctaacaatctcagcagtttatcgaagaagtaccgacaggacgccaagtacctgaatatgagaagtacatacgccaaacttgccgccgtggctgtattctttattatgcttatcgtgtacgtgcgcttttggtggctttag

SEQ ID NO: 34728 - DNA, 873 bp, Artificial Sequence
  Description of Artificial Sequence: Synthetic coding sequence
atggaaacacctctagacgtcctctctcgggcagcatcgctcgttcacgctgatgatgaaaagcgggaggcagcccttcggggggagccacgcattcagacattgcccgtggccagcgccctgtccagtcaccgtactggcccacctcctatctctccctccaagaggaagtttagtatggaacccggagatgaggatcttgattgtgacaacgatcatgtgagcaagatgtcccggatattcaacccacacttaaataagactgctaacggggactgtcggcgggaccctagggaacggtcaagatccccgatcgaacgggccgttgcgccaactatgagtctgcacgggagccacctgtacacgagtttgccttcacttggactcgaacagccactagccctaacaaagaacagtcttgatgcgtcaaggccagccggactttcacccactctcacgccaggggagcgacagcagaatcgaccaagtgttattacgtgtgccagcgcgggtgcacgaaattgtaatctgagccactgtcccatagctcatagcggatgtgcagcacccggtcctgcttcataccgcaggccccccagtgctgccacaacgtgcgatccagtcgttgaagaacactttagaagaagcctgggcaagaattacaaagaaccggagcctgctccaaattctgtgtccatcaccggtagtgtcgacgatcattttgccaaggcactgggcgatacgtggttgcagatcaaggcggctaaagatggagcatcctcgagccctgaatctgcttcacgtagaggccaaccagccagtccctccgcccacatggtatcccactcccactccccatcagtggtcagctag

SEQ ID NO: 34729 - DNA, 888 bp, Artificial Sequence
  Description of Artificial Sequence: Synthetic coding sequence
atgactgaaaatacacattttgacaagattcccgaatcttgcgcactcaagtcttggaggcacccaggcctccatcatggcgaggccgccctgagaggcgagccacgtatccagacccttcccgtcgcttccgccctgagttcacaccgaaccggcccaccccccatatccccgtccaagcgaaagttcagcatggagcccggcgacgaagacctggactgtgataacgatcacgtctcaaaaatgtcgaggatcttcaacccccatctgaataaaactgccaacggcgactgcaggcgagatcccagggagaggtcaaggtcccctatcgagcgcgcggtggcacctacaatgagtttacacggctctcacttgtatactagcctgccatctctgggacttgagcaacctcttgccttaaccaaaaattctctggacgcttcgagacctgctgggctatccccgacactgaccccaggtgagagacagcaaaatagacctagtgtgataacctgtgcaagcgcaggcgcgaggaattgtaacctgagtcactgccccatagcacattccggctgtgccgcacccggcccagctagttacagacggcccccatcagctgccacaacatgcgatcctgtggtagaagagcatttcaggcgttcccttggcaagaactacaaggagccggagccggcccctaatagcgttagcatcactggcagcgtggacgaccactttgccaaggcccttggggatacttggctacagatcaaagcagctaaggacggggcatccagctccccagagagcgcctcccggcgaggtcaacccgcgtcaccgtcagcacatatggtcagtcattcccactccccttccgttgtttcctag

SEQ ID NO: 34730 - DNA, 510 bp, Artificial Sequence
  Description of Artificial Sequence: Synthetic coding sequence
atggagacccccctggacgtcctgagtcgggcggcgtccctggtacatgctgatgacgagaagcgggaggctgctctccgtggggaacctcgcatccaaacccttccagtagcatccgccctttcttctcaccgaactggtccccccccaattagcccgtcaaagagaaaattttccatggaacccggcgacgaagatttggactgcgacaacgaccatgtatcaaaaatgagtaggatcttcaatccgcacttaaacaagactgccaatggagattgccggcgcgacccccgggagagatcccgaagccctatcgaacgggccgtggctcccacaatgagcctgcacggctctcacctgtataccagcctcccttcattgggactcgagcaaccactagccctaactaaaaacagtctggatgcatctcgtcccgcagggctttctccaactcttactcccggggagcggcaacaagtcggactgtgcttggggggatggcgagggtag

SEQ ID NO: 34731 - DNA, 603 bp, Artificial Sequence
  Description of Artificial Sequence: Synthetic coding sequence
atggagacgccactggacgttctttctagggcagcttcactcgtgcacgccgatgacgagaaacgagaagcagccctccggggagaacctcgaatccagaccctgcctgtggcttctgccctcagcagccaccgcaccggcccaccgcccattagcccctccaaacgcaagtttagcatggagcccggcgacgaggacctggactgcgacaacgaccatgtgtctaagatgtcgagaatcttcaatccgcatctcaataaaacagcaaatggagattgtcggcgcgatccccgggagcgcagccgaagtccgatcgaaagggcggtagcccctacaatgagcttgcatggtagccacctttacacctccctaccaagcctgggactggagcagcctctggcccttactaaaaactctctggacgctagtcggcctgcgggcttgtcccctaccctgacacctggggagagacaacaaaacaggccttctgtaatcacatgcgctagcgctggagcccgtaattgcaacctgagtcactgtcctatcgcccacagcgggtgcgccgctcccggaccagcttcttataggagacctccaagttag

SEQ ID NO: 34732 - DNA, 384 bp, Artificial Sequence
  Description of Artificial Sequence: Synthetic coding sequence
atggagacccctctggatgtcctcagtagggccgcctctctcgtgcacgcggatgatgaaaagcgcgaggcagctttgcgcggcgagccccggatacagacactccccgtggctagcgctctgtcatctcatcggaccggcccacctcctatatccccgtctaagcggaagttttctatggaaccaggcgatgaagacctggattgtgacaatgatcacgtttctaaaatgagccgcatcttcaacccacacctcaataaaactgcgaacggagactgccgaagagacccgcgagagcgatccaggtcacccatcgagcgggccgtggcccctactatgagcctccatggaagccacctgtatacttcgctgccgtccctgtag

SEQ ID NO: 34733 - DNA, 891 bp, Artificial Sequence
  Description of Artificial Sequence: Synthetic coding sequence
atgctttttatgaagatggacctactcaattatcagtatctggataagatgaacaataacatcggaatcctgtgctatgagggggaggccgccctccggggggaaccacggatccaaaccctccccgtggcctctgcactgtcatcccaccgaactggcccccctcctatttcaccttccaagcgtaaattctcaatggagcctggtgacgaagatttagattgtgacaatgaccacgttagtaagatgtctcgcatcttcaacccacacttaaataagacagcaaatggagactgccgacgagaccctcgggagaggtcccggtcgccaattgagagggccgttgcgcccacaatgtctctgcatggatcacatctgtacacaagcctcccgtcacttggccttgagcaaccacttgccctgacaaaaaattcgctggacgcctcccggcccgcaggcctgtctcccaccttgacccccggcgagagacagcaaaatcggccttctgtgattacatgcgcctcagccggggccaggaactgcaacctgagccattgtcccatcgctcactccgggtgtgctgcaccaggacccgctagctacagacggccaccatcagcagcaacaacctgtgacccggtcgtggaagaacacttccgtcgatccctcggcaagaactataaggagcctgaacctgctcccaactcagtctcaatcacggggtcagtggatgatcattttgctaaggctctgggcgacacatggctccaaatcaaggccgccaaggacggggccagttcgtccccggagtccgcttccagaaggggccagcctgccagcccatccgcccacatggtttcacacagccacagtccctccgtcgtctcctag

SEQ ID NO: 34734 - DNA, 675 bp, Artificial Sequence
  Description of Artificial Sequence: Synthetic coding sequence
atggagactccactggacgtgctgtctcgagcagcgtccctggtccatgccgacgacgaaaaacgtgaagccgctttacggggcgaaccacgaatacagacacttcccgttgcctcggccctctcctctcacagaaccggtccgcccccaatctcaccttcaaagaggaaattctccatggagcccggggatgaggacttggactgtgataatgatcatgtctccaagatgtccaggatcttcaacccccaccttaacaaaaccgcgaatggggactgcaggagagacccacgcgaacgttccagatcacccatcgaacgggccgttgcaccaaccatgtccctgcacgggagtcacctgtataccagcttaccttcgcttggtctggagcagcctttggccctgaccaaaaatagcctcgatgccagccgccccgctggtctctcccccacattaacacccggagaaaggcagcaaaacaggccctccgtgatcacgtgcgctagtgctggggcccggaactgcaacctgagtcactgccccatcgcccatagtggttgtgctgctcccggcccagcctcttataggcgaccgccgagtgctgccacgacctgcgacccagtggtagaagagcacttccggcggtctctcggcaaaaactataaggaaccgtag

SEQ ID NO: 34735 - DNA, 621 bp, Artificial Sequence
  Description of Artificial Sequence: Synthetic coding sequence
atgaacaagaccgcaaacggcgattgccgtagggacccacgggagaggagtcgcagtccaatagagcgggccgttgctcccacgatgagccttcatggctctcatctatacacttcactgccctccctcgggctcgaacagcctctggccctgacaaagaactctctcgatgccagccgtccagctggactcagtccgaccctgactcccggagagcgtcagcagaatcgaccctccgtgattacatgcgcttcagccggtgcccggaactgtaatctgtcccactgccccatagcgcatagcggttgtgccgcacccggaccagcctcttatagacgacccccatccgccgctacaacttgcgaccccgtcgtggaggagcacttcagacgatcacttggcaaaaattacaaagaacctgagccagcccctaactcggtctccatcaccgggagcgtcgacgatcatttcgcaaaggcacttggcgacacttggctgcaaattaaggccgcaaaggatggagcatctagctctccggagtccgcgtcccggcgaggccaaccagcgagcccatccgcacacatggttagccattctcattccccgtccgtggtgtcttag

SEQ ID NO: 34736 - DNA, 633 bp, Artificial Sequence
  Description of Artificial Sequence: Synthetic coding sequence
atgataaaagtgaggaataaaactgccaatggggattgccgacgggaccccagagagaggagccggagccccattgaacgcgcagtagcccccaccatgtcgctgcatggcagccacctttatacatccttgccatccctggggctcgagcagccattggcactgaccaagaacagtctggatgctagtaggcctgctggactttcccccacactcacacccggggaaaggcagcagaatagaccgagtgtgataacatgtgcatccgccggcgcgagaaactgcaacctgagccactgccctatcgcacacagcggctgtgccgcaccgggccccgcctcatataggagaccgccaagcgcggctacaacctgtgacccagtggttgaggaacattttagacgtagtttgggcaagaattacaaggaacccgaaccagctccaaattcagtcagcattactggctcggtcgacgaccacttcgccaaagcgctcggagacacttggctgcagataaaagcggcgaaagacggcgcctcttccagccctgagtccgcctctcgccgcggacagcctgcatctccctccgctcacatggtttctcacagccacagccctagtgtggtctcctag

SEQ ID NO: 34737 - DNA, 906 bp, Artificial Sequence
  Description of Artificial Sequence: Synthetic coding sequence
atggcatccagatacgtggccgtgggtatgattcttagtcagaccgtcgtgggagttcttggctcattctcggtgctgctccactacttgagtttctactgcaccggttgtaggctcagatccacagacctcatagttaaacacctcatcgtagccaacttcttagccctcagatgtaagggcgtgcctcagaccatggccgccttcggagtcaggtatttcttgaacgcactgggctgcaaacttgtgttttatttacacagagtggggcggggagtttcaatcgggaccacatgcttgctgtccgtatttcaggtcattacggtttcatcacgcaagagcagatgggccaagctcaaagagaaggccccaaagcatgtggggtttagcgtgctcttgtgctggattgtgtgcatgctggtgaacattatttttcccatgtatgtaacgggaaagtggaactacacgaatatcacagtcaacgaagacctgggctattgttcagggggcgggaataataagatcgctcaaaccctgagggccatgctgctatcctttcctgacgtgctgtgcctgggtctgatgttgtgggtgtcatcttcgatggtgtgcattctgcacaggcataagcagagggtgcagcacatcgatcgttcgaacctgtcaccccgggcctcccctgaaaaccgtgctacacagtcaatcctgattctggtctcgactttcgtgtcaagctatacgctttcttgcctatttcaggtctgcatggcactgttagacaatccaaactcattgctggtcaacacgtcagcccttatgagtgtatgctttcctacgctttcccctttcgtgctcatgagctgcgacccaagcgtgtatagattttgcttcgcatggaaaaggtag

SEQ ID NO: 34738 - DNA, 2178 bp, Artificial Sequence
  Description of Artificial Sequence: Synthetic coding sequence
atgccaccttttctgcttctcgaggctgtgtgtgtatttctgtttagccgggttccaccttcattgcccctgcaggaagtgcatgtctcgaaagaaaccattggcaagatctctgcggcatccaagatgatgtggtgcagcgcggctgtcgatatcatgtttctactggatgggtcaaactctgttgggaagggaagcttcgaaaggtctaaacactttgctatcacggtgtgtgatggcctagacatctcaccggagagagtgagggtcggcgctttccagtttagctcgaccccccacctggaattccccctagattccttctctacccagcaggaggtgaaagccaggataaagaggatggttttcaaagggggacgcacggagacagaacttgcccttaagtacctgcttcaccgcgggttgcctggcggacggaatgctagcgtcccgcaaatccttattatcgttaccgatggcaagtctcagggggatgtggctctgccctccaaacaactcaaggaaagaggtgtgacggtgttcgccgtgggggtacgctttccacggtgggaggagttgcatgccttggcgtccgagccacgtggtcagcacgtactgctcgccgaacaggttgaggatgccactaacggactgttttccacactctccagctctgcaatttgcagcagcgccactcccgattgtcgggtggaagcccacccatgtgagcacaggaccctggaaatggtgcgcgaatttgctggaaacgccccttgctggcggggttctcgtcgtacactcgccgtgctggctgctcattgcccattctacagctggaaacgcgtgttcttaactcaccccgccacgtgctatagaaccacttgcccaggtccctgcgactctcagccctgtcaaaacggcgggacgtgtgtgccagagggcctcgacgggtatcaatgtctttgtccgcttgccttcggcggagaagcaaactgtgcactgaagctgagcctggaatgtcgagtagatttactcttccttctggacagctcagctggcactaccctcgatggcttcttgcgagccaaggtattcgtaaaacgcttcgtaagggccgttctctcggaggacagcagggccagagtgggcgtggcaacctattctcgggagctgctggtggccgtcccggtcggagagtaccaagatgttcccgatctcgtttggtccctcgatgggatcccctttaggggtggccctactttgactgggtcagctttacggcaggcagctgaacggggattcggttccgcaactcgtactgggcaggacaggcctaggagggttgtggtactcttaaccgagtcccactcggaagatgaagtcgccgggcctgctcgacatgctcgagctcgggagctcttgctactcggagtaggtagtgaggcagtacgggccgagctcgaggagattactggaagtcccaagcacgtcatggtgtacagtgacccacaggatctttttaatcagatcccggaactgcagggaaagttatgctcccggcagcgcccaggttgtaggacccaggccctggacttagtgtttatgctggacacatctgcaagcgtgggtccagaaaacttcgcccaaatgcagagctttgttaggtcctgtgcgctgcagtttgaggtcaatcccgacgttacccaggtcgggttagtcgtgtacgggagccaggtgcagaccgcttttggcctggatacaaagcctacacgggcagccatgttgagagccatcagccaagccccttatctgggcggggtgggctccgccgggacagctctgctgcacatttatgataaggtaatgaccgtccagcggggagcaagaccgggggttcctaaagccgtcgtggtgttaacaggggggcgcggtgctgaggacgcagctgtccccgcccagaaactgaggaacaatgggatctcagtcttggttgttggcgtggggccagtgctttcagaagggctgagacgcttagcagggcccagagattcactgatccatgtcgcagcttacgccgatctacgctatcatcaggacgtgctgatcgagtggctctgcggcggagagtggggcaacccacacccacagggctgtcctcacggacgtccctcagcatag

SEQ ID NO: 34739 - DNA, 1251 bp, Artificial Sequence
  Description of Artificial Sequence: Synthetic coding sequence
atggccacaaaaggtatgaggctcaaaagcactaaggaagttttccccctagcccatgtctgtaacgacacaaataaaatgactctcataaacccacaaggcgccaaacttaacatatacaagcggaaggtcgaacaggccatacaatcctacgagaaacggttaaacaagattgtgtggcgagctctttcacaggaagagaaagaaaaactggacgcaaataagcctattcagtatctagagaataagaccgtgctaaatcaagcgttggagaggctcaactggccgatctccctgaaggagctgagcatgctagagtccgagatactcgcagggaaaatgtacattcaacaagccatggagctgcaggaagccgctaagaagaattacgctaataaggctccgggggaacaacaaaaattacaaggcaacccgacaaagaagaccaagagtaagcggcccgaccctctgaagggccagaaggtgatagccagatgtgacgaaaatggcttctattttcccggggtggtaaaaaagtgcgtgtcccggactcaggctttggtagggtttagttacggggatactaaagttgtgagcactagcttcatcaccccagtagggggagcaatgccttgtcctctcctccaggtgggcgattacgtttttgcaaagattgtcatccctaagggattcgacttttacgtgcctgctatcgtgattgctcttccaaacaagcacgttgcgaccgagaagttttacactgtgctgaagtgcaataatcggagagaattttgtcctcggtcggcactcatcaagatcagccagaataaatacgccctatcatgttctcatataaagtcacctccaatccccgaagaccctgaggttgaggatgtggaagccagaaattctgcctttctgttttggcctctgaaagaggctgatactcaagatagtagggaaccacggcgcgagaagccaagacgtaagaagcgccctgcgaagcaacctcttcaacaggcagcccctagcgatagcgacggaagtagccacgggatcagcagccatgggtcatgtcaagggacacatcctgaacccagaacagcccacttacattttcccgccgccggaaggctcggactttccagccacgccatcatcgcgactcccccaccccgggccgccctcccttgcacactgcaggctactcactcatcaaaagggttgcggtctgtgccggaaacactctag

SEQ ID NO: 34740 - DNA, 1875 bp, Artificial Sequence
  Description of Artificial Sequence: Synthetic coding sequence
atggaaaaatccggaccatcgagcaccatctcggagcagcagctgcaaagacaggaagggtggattaatactaagactgacctcgccgaacagagcttgattagctccgaaaagtggctccagctgcacggtttgaagtctaacaagctcaccctgaagcagatcctgagccagatcggttttccacattgtgaagactacgtcgcctccctcggtagaccggtcgcaagtaggtatgctgatggattattccctcagctctatagagccgaggacggcagagtatacaaccttacagccaaatcggaattgatttatcagttcgttgagcatctcacccaggcagtggaatcctacaaacaaagaatggactggctcacatccaaatctcggcaaatctttggggtcatcttggagcaatgcgttacgatagtcctggatttcggcgggattctggagggagagctggatctttgtagagaagctctaacaatggtgcttcaggagcaagtagcccacatcaccgaattcaatatcatccgagtttcccaagagccagtgaaatggcaggagaacgcaacaccagtgacagagcagtctattgccacagccatctcatgggtcgagaagctcactgtcgaactgacagtttctgaggcaggcaggcttgatgcacttctggaggccggacgcgataagacgatcgagagcatctactactttgtggtgggggacgttccagaagaaagcaaagagcttttgctccagagagccctggagataccctgtcctgtgtacactgtgtccttcaatgcgcggggtgagggcacaatcgcttttctcaaagacctgagtgccaagactcattcaagattccatgcttttgcggagcgtactgagtgcgtggagtttcctgccttcagtactaaagatggtgataacgtcatgacgtggaactctcggaagctgaagggcaagttgcctccaggggccggggtccgcgaagacgtctttcttgtgtggcaggaaatggaggaggcttgttcaaccttggctcagattcagaggctggtcgctgagcccccaaaacctgatgtagcaactgtcgactgtgaatccgagacaacctcggtggagatagccagtaatccagaagacacttgggacagtaaaacttggctgcaaaaatacggcctgaaggcccagaaattgtccctgtatgatgtcttagctgactgctccttcaggcatgcagacggggtcgtggacatcaaggcaaaacccgagaatgagtccgttcagacgtctgcggaaacaaacaagaagaccgtgcatgccaaatattgcagtaggtttgtacacgccccatggaaagatggaagtttagtgcacgttaacattaccaaggagaaatgcaagtggtactctgaaagaatccatacggctctcgcaaggataagaaggcgtattaaatggctgcaggacggctcacagagcctgtttggcaggctccataacgattgcatttacatcctgattgacacatctcacagcatgaaatcaaagctggacctggtgaaggataaaataatccaatttattcaggagcagctcaaatataaaagcaaattcaactttgtaaaatttgacggacaggcagtggcctggagagagcagctcgcagaggtaaatgaggacaacctcgaacaggcccaatcctggatacgagacataaaaatcggttcctccaccaacaccctgtccgccctgaagactgctttcgccgataaagaaacccaagctatctacctgctgaccgacggccggcctgatcagggcacaagctctcacttgctgttaacggcggccgtgtag

SEQ ID NO: 34741 - DNA, 1428 bp, Artificial Sequence
  Description of Artificial Sequence: Synthetic coding sequence
atgtggagattgtggggcgacctgtggctgcttgggatgcttatggtctgctttcattcttccactgagcagaagatggcagaatatacgatggtcagccaggagcccgtcaaatggcaggagaacgccactcccgtgaccgagcagtccattgccaccgccatttcctgggtggagaaactgactgtggagctgactgtaagtgaggcaggcaggttggatgcactgcttgaggcagggcgagataagaccatcgaaagcatctattactttgtggtcggtgatgtgcccgaagagtccaaagagttgctcttgcagcgggccttggagattccttgccctgtctatactgtgtcgttcaacgctagaggagaaggcaccattgccttccttaaagacttgtccgccaaaactcattcccggttccacgctttcgctgaacgaactgagtgcgtcgagtttcccgccttctccacaaaagacggcgataatgtgatgacttggaacagccgtaaactcaagggcaagctaccccctggtgctggcgtacgcgaggatgtctttcttgtctggcaggaaatggaggaggcgtgtagtacactcgctcaaattcagaggttggtcgctgagccccctaaacctgatgtagcaacagttgactgcgaatcagagactacgtccgttgagatagcctccaatcctgaggatacatgggactctaaaacatggttgcaaaaatacgggctgaaagcacagaaactcagcctgtacgatgtcctagccgactgcagcttcagacacgctgacggagtggtagacataaaagcaaagcccgagaatgagagtgtgcaaacaagtgctgagaccaataaaaagacagtacacgccaagtactgctcccgctttgttcatgccccgtggaaggatgggagtttagtacacgtgaatatcactaaggagaagtgcaagtggtacagtgagagaattcatacagctctcgcccgcattcggcggcgaataaagtggttacaggacggcagccagagcctgttcggccgcctccacaacgactgtatatatatcctgattgacaccagccactcaatgaaatctaaactggacctcgtgaaggacaagattattcagttcattcaggagcaactgaaatacaagtctaagttcaatttcgtaaagttcgacgggcaggctgtggcgtggcgtgagcagttggcggaagtgaatgaagataacctggagcaggcccagtcttggattagggatattaaaatcgggtctagcaccaatacgctgtctgccctcaaaaccgcgtttgctgacaaggagactcaggctatctatctcctgactgatgggagacctgaccagcagcccttcaaagagggggtcagcgtgttaagccatcgctag

SEQ ID NO: 34742 - DNA, 3885 bp, Artificial Sequence
  Description of Artificial Sequence: Synthetic coding sequence
atggaaaagtcagggccatcttctacaattagtgagcagcagctgcagcggcaagagggctggatcaacaccaaaacggacctggccgaacagtcactgatcagtagtgagaagtggcttcagctgcatggtctaaaatctaataagctcacactcaagcaaatcctcagccagattggcttcccccactgtgaagactatgtagcatccttggggcgacccgtggccagccgttacgcagacggcctgtttcctcagctgtatcgggccgaggacggacgagtgtacaacctcaccgcaaagtccgagctgatctaccagttcgtagagcacctgacacaggctgtggagagctacaagcaacgtatggactggctgacttcaaaatccagacagatctttggcgtgattctggagcagtgcgtcacaatagtgcttgacttcggaggaatccttgaaggcgaattagatctgtgccgcgaggccctaacaatggtcctccaagagcaggtggcacatataactgagtttaacattatacgggtgagccaggagcccgtaaagtggcaggaaaacgcaacccctgtgacggaacagtctatcgctaccgccatttcatgggtggaaaaactcacagttgagctgactgtgtctgaggccggtagactggatgccctcctggaggctgggcgtgataagacaattgaatccatctattactttgtggtgggggacgtaccagaggagagcaaggagttgcttctacagcgagctctggagattccctgccctgtttataccgtatccttcaacgcacggggcgagggcaccattgccttcctcaaggacctctcggctaaaactcattctagattccacgcgttcgctgagaggacggaatgcgttgagtttcccgcgttcagcaccaaggatggcgataacgtcatgacgtggaacagtagaaagctgaaagggaaacttccacccggtgctggggtgagggaagacgtgtttctcgtctggcaagagatggaagaagcttgcagcactctcgctcagatccagcggctagtcgctgagccacccaaaccagacgtggctaccgtggactgtgagagcgaaaccacctccgttgaaatcgcaagcaatcccgaggacacctgggatagtaaaacatggttgcagaaatacggactgaaagcgcagaaactcagtttatatgacgttctcgcggactgctcttttcgacatgccgatggggtggtggacatcaaggcaaagccggagaatgagtctgtccagacttcggctgagacaaacaagaagaccgtgcatgcaaaatattgcagcagatttgtgcacgccccctggaaagacggcagcctggtgcacgtaaacattaccaaggagaaatgcaagtggtattccgagaggatacataccgcactagccagaatcaggcgtcgaataaagtggttgcaggatggatcccaatcactttttggcagactccataacgattgtatatacattctaatcgatacaagtcacagcatgaagagtaaacttgacctcgtgaaggataagattatccagttcatccaggagcaactgaaatataaatccaaatttaatttcgtgaaattcgatgggcaagctgtagcttggcgcgagcagctggcagaggtgaatgaggataatctcgagcaggctcaaagctggattagagacatcaaaatcggtagctccacaaatacgctgtcagctttaaagactgcattcgcagacaaggagactcaagcaatttacctcctaacggatgggcgcccagaccagcctcccgagactgtcattgaccaggtcaaacggtttcaggagatcccaatttatactatatcttttaattataacgacgagattgccaacagattcctcaaagaagttgcggcattgactggtggcgagtttcacttctacaattttggctgcaaagatccgaccccaccagaagctgttcagaatgaggatctgacactgctggtgaaggagatggaacagggacacagtgatctcgagaaaatgcaggatctgtattccgaaagcctcatcatggactggtggtacaacgctgaaaaggatggagactccaaacatcagaaggagatctgctccatgatcagcaccccagaaaagtgtgctaagcctcagtccgatgtggatagcacgcagacgagcagcttaaacatgctcaaggggccttggggcttatcggatcagaaagtgcagaagaagaaagtattgcacgcggaaagcactaagacaagcctgttgcgcagccagatgagctctctgcgttcttctgcctgcagcgagcggaaagatggactttctaacgcaagctcaaggaggactgctttgtcagataaggaaatgtccatcctactggcggaagaatggctggacgataagagctcagagaaggtcaccagagagggatctcaagtttatgaccacgactcctctgacgtgagttcggagaattggttgaagacctacggtctggttgccaaaaagctcaccctgatggacgcattgagcgtcgccgcagttccccattcctcaacatatgtgcccgtgctggacaagcacgtagtatcaaaggtgtttgacgaggtctttcctctggcccatgtctgcaatgatacaaataaaatgacccttattaacccacagggagctaaactcaatatatacaagagaaaagtagagcaggctatacaatcctacgaaaagaggctgaacaagatcgtgtggagagcactgtcacaggaagagaaagaaaagctcgacgcaaacaagcccatccagtacctcgaaaataaaaccgtcctcaaccaggcactcgaaaggctgaactggccaatctccctgaaggagctcagcatgctagagagcgagattttagcaggcaagatgtacattcagcaggccatggagctgcaagaggctgccaaaaagaactatgccaataaggcaccgggggagcagcagaaactgcaaggcaacccgactaaaaaaacaaagagtaagagacccgatcctctgaaaggtcagaaagtcatcgctcggtgcgatgagaacggcttctactttccaggcgtggtgaaaaagtgcgtatcaaggactcaggctctagtcggattttcctacggagacacaaaggtggtaagcaccagttttatcacccctgtaggaggcgccatgccttgccccttgctgcaagtcggagactatgtatttgctaagatagtcatccctaagggatttgatttctacgtacctgccatagtcatagcgcttccaaataagcatgtggccaccgagaaattttatactgttctaaagtgcaacaacaggagagagttctgtcctaggagtgcattgatcaagatcagccagaacaagtatgccttatcttgtagccacattaagtccccgcccatccccgaggaccctgaagtggaagacgtggaggcccggaactccgcttttctcttctggcccctgaaggaagctgatacgcaggatagccgcgagccccgaagggaaaagcccaggcggaagaagcgcccagccaaacagccacttcagcaagcggcgccaagcgactcagacggaagctctcatggaatttcaagtcacgggtcctgtcaagggactcatcctgaaccccgcaccgctcacctacacttcccagccgccgggaggctggggctatcgtcccacgccattattgcaactccaccgccaagggcagcacttccttgtacactgcaggccactcacagttcaaaaggactgcgctccgtgcccgagaccttgtag

SEQ ID NO: 34743 - DNA, 3729 bp, Artificial Sequence
  Description of Artificial Sequence: Synthetic coding sequence
atgcccggactgtactgtccaagctcatggactcccctgcccctcaccgactcctgggtgcgcgcatgcgcaaacggcccgtgcctgtctgtacgggcgcgcctgacttacagaaacccccagccacagccagttgacggagtgttcgtgtaccccctggctgaagctgaggtggtgtcagggttcgaagctgaggcagcaggacgtagggtgagtttccagttgcaaagccgccgacgctcgcaggccgcttgctgtcgcgccttgggacccgggctgggcacacccaccccaaggcgatgcgcccagggccacctggtgttggacctcgcgcaagcccggagcacactggtgctgcccacgggaataatagcagcagcaggaacaatgacggtgacccttcacagttcaagagagctgccaagtagacctgacggcgtactgcatgttgcccttccaactgtcctgacaccccttgcgccaccaggaccgccaggcccgcctcggcctccagggctgtgcgatgactccccaacatcttgcttcggcgtcggatccctgcaggaagagggcctggcttgggaggaactggccgctccccgcgatgtcttctcgggccccgctcggtgtccagctccttacaccttcagctttgaaatgctggtgacaggaccttgcctgcttgcgggtctcgagagcccctcacatgctctaagggctgatgcacccccccatgcttcatctgctgctactatctgtgtaacgctggccgaggggcaccactgcgatcgcgccttggaaattctgctgcaccccagtgaaccccatcagcctcatcttatgttagaaggcggctcactgagctcagcagaatatgaggcccgagtacgggccaggagagatttccagcggctacagaggagagactcggatggcgatcggcaggtgtggtttctgcagcgccgcttccataaggatattttactgaaccctgtactagccctgtcattctgtccagatctgtccagcaagcctggccacctgggtactgccactcgcgaactcctgtttctgctcgactcatcttcggttgcccacaaagatgccattgtgctggcggtgaagagccttcccccgcagacactaatcaacctcgctgtgttcgggaccctagtccagccgctgttccccgaatcacgtccctgctctgacgacgcagtacagctgatctgtgaatccatcgagacgttacaggtgcccagtggcccacctgatgtcttagcagcactcgattgggccgtcggacagccccagcacagagcctatcctcggcagttgttcctgctgaccgcagcatctcccatggcggctacgacacaccgtactctggaactcatgaggtggcacaggggcaccgccaggtgcttctccttcggcctcggaccgacgtgccatcagcttttgcaagggctctctgctctcagtagagggcaggcctactttctcagacccgggcagcgcctccaaccaatgctggtgcaggcactcaggaaggcactggagcctgcactatccgacatttctgttgattggttcgtccctgatactgtcgaagctctgctgaccccccgcgaaatcccagctttgtatccaggcgatcagctgttgggctactgctcactatttcgggtcgatggattcagatcgaggccccctggcggacaggagcctggttggcaatcttccgggggctcggtatttccaagtccggaagaagcaccctcagccgcatctcctgggaccgagccaacaggcacatcagagcccttaggaaccggtacagtgtccgccgagctttcttccccatgggcagctcgggatagcgagcagtctaccgacgcgctgaccgaccccgtgacggaccctggccccaatccctccgacacggcaatttggaggcggatctttcaaagcagctacatccgcgagcagtacgttcttactcattgctccgcctcccccgaacccggtccaggctctactggtagcagcgagagcccaggctcccagggaccaggaagccctgagggttcagctcctctggagccccctagtcagcagggttgtagaagcctggcctggggagagccggcaggcagccggtcatgtcccctgcccgcccccacacccgccccattcaaagtgggagccctttccaccgaagtgctgggaaggcagcacagggccgcactggccggtcggtccctctcttcccctcccggacgcgcaaatcaggtacccggacgtccaagaaaaccttccctaggagccatactggatgggccgtctcctgagcccggccagcagttaggacagggcctcgacgacagcggcaacctcctgtctcctgctcccatggactgggatatgctgatggagcctccctttctgttcactgcagtccccccctctggggagctcgccccacccgctgtccccccacaggcccctcggtgccacgtggtcatccgtgggctctgcggtgagcaaccaatgtgttgggaggtgggagtgggactcgagactctctggggaccaggtgacggatcccaacctccttcaccacccgtgcgcgaagctgcctgggaccaagcacttcaccgcttgacggctgctagcgtggttcgggacaatgagcagctggcactacgcggaggagccgaaacaacagccgacagaggacacgcacggagatgctggctgagggctctgcagacatctaaggtatcgtccgccccatcctgctttacttgcccagtcgccgttgatgccaccaccagagaagtcctccccggggctctgcaggtttgcagttccgaacctgctgagccccctggcaccccgccggcttctcacagtcatctcgatgccgctcccctcccaacggtggtgtactccaaaggattgcagagaggcagcccagctggcgcatgggattctgatcagaatgggaattccaagagagctctcggggacccagcaacacccactgaaggcccaagacggcccccacctcggccaccatgccgcttgtccatggggaggagacataagctgtgcagtccagaccccggacaagccaacaattcagaaggcagtgatcacgactatctccctctggtgcgcttacaggaagcccctggctcctttcgactggatgcaccattttgcgccgccgtgagaatcagtcaggaaaggctttgcagagcatccccattcgccgtccatcgggcttcgctctctcccacatccgcatctttgccctgggccctactaggccctggagtcgggcagggcgactccgctaccgcttcttgcagtccttccccctccagtggcagtgagggacctggtcaggtggacagtgggcggggatccgacacagaagcctctgaaggcgctgaaggattgggaggcacggatctgcgaggtcgcacctgggccacagcagtagctctagcgtggctcgaacatcgctgtgcggcagcttttgacgaatgggagttgactgcggcaaaggcagattgctggcttagggcccaacacctgcctgacggacttgacttggcagctctcaaagcagctgcccggggtctgtttctactgttacgccactgggatcagaatctccagctccacttactttgttattcccccgctaatgtgtag

SEQ ID NO: 34744 - DNA, 2676 bp, Artificial Sequence
  Description of Artificial Sequence: Synthetic coding sequence
atgcttccaaccgaggtgccacagtctcatcctggtccctctgctttactgttactacagctgttgctgcctcctactagcgcgttcttccctaacatttggtcattactcgcagcacctggatccataacccatcaggatttgactgaggaggcagccctcaacgtcaccctgcagctctttctcgagcagccaccacctggtcgacctccactacgccttgaagactttcttgggcggaccctccttgccgacgacttgtttgctgcctatttcggcccaggctcaagtaggcgattccgtgctgccctcggagaagtaagccgggctaacgcagcccaggatttcttgcccacgtcacggaacgaccccgacctgcactttgatgcagaacgacttggccagggcagagcgagactcgtgggggccttgcgtgagaccgtggttgccgcccgtgccttagaccacacccttgcccggcaacgcttaggcgccgctctccacgccctccaagatttttacagccacagcaactgggttgaactaggagaacagcagccccacccccatttgctgtggcctcgtcaggaactacagaacttggcccaagttgccgacccaacctgcagcgattgtgaggagttgagctgcccaaggaactggcttggattcaccttgctgaccagtggctacttcggcacccatccaccaaaaccccctgggaagtgcagccacggtggacacttcgataggtccagtagccagcctcctcgcggcgggattaataaggatagcactagcccgggattttctccccaccatatgctccatctgcaggcagctaaactcgctttgttggctagtattcaggccttctcattattgagatcaagactcggtgatagagacttttccaggctgctggacatcacacccgctagtagtctctcttttgtgctggacacaaccggatcaatgggggaagagataaatgctgccaaaatccaggcgaggcaccttgttgagcagcgacgggggtcaccgatggagcctgtacactatgtgctggtgccctttcacgacccaggcttcggccccgtcttcacaaccagcgaccctgactctttctggcaacaactgaatgaaatccacgccctgggaggcggcgacgaaccagaaatgtgcctatcagccctgcagcttgcgctgctccatacaccacctttgagtgacattttcgtgttcactgatgcctcccctaaggacgcctttctgaccaatcaagtggagagccttactcaagagcgacgctgtagagttacattcctggtcacggaagataccagccgggtacaagggcgggctaggcgggagatcctgagccctctgagatttgagccgtacaaagccgtggccctcgctagtgggggggaagtgatcttcactaaagaccagcatattcgagacgtagctgccatcgtgggcgaaagtatggctgcactcgtcacgcttccactcgaccctcccgtggtggtgccaggccagccgctcgttttcagtgtggacggtttgcttcagaagattaccgtaaggattcatggagacatctcatcattttggattaaaaatccagccggagtctctcagggtcaagaagagggaggcgggccattgggccacacaaggcggttcgggcagttctggatggtgacaatggatgacccacctcaaacgggcacatgggaaatccaggttactgccgaagatacccctggagtgagagtgcaggcccaaacttcgcttgacttcttatttcactttgggatcccaatggaggacggtccacacccggggctataccccctgacacagcccgtagccggcctgcagacccagcttcttgtggaagtgaccgggctggggtcccgagccaacccaggtgaccctcaacctcacttctcccatgtgattcttcggggagtacctgagggagccgaactgggtcaggtgcctttagaaccagtgggcccacctgaaaggggtttgttggcggcatcactctcccccactctgctgagtactccccgcccctttagcctcgaactaattggtcaagatgccgccggccggcggctacaccgggctgctcctcaaccgagcaccgtcgtgcctgtgcttctggagctgtctggacctagcggttttctcgctccaggctccaaggtgccactctccctcaggattgccagtttctccggaccgcaagatctagacctacgaaccttcgtcaacccaagctttagcttgaccagtaacctgagccgcgctcatctggaactaaatgagtccgcttgggggcgactttggcttgaggtacccgatagcgccgccccagattctgtggtgatggtgacagtgacagcaggcggccgggaagccaatccagtgcctccaacccacgccttcctaaggttgctggtctcagcgcctgcaccccaggacagacataccacacctacagggagtagtgaccccatcctgacaactgcaacccccgctttctcacctttcacattagtcgcccaggggagagctggggccggactcgctgccggctcaccttggtggggaaccgtcgggggagtgttactgcttctggggttggcctcatggtag

SEQ ID NO: 34745 - DNA, 2067 bp, Artificial Sequence
  Description of Artificial Sequence: Synthetic coding sequence
atgctgcctacggaagtaccacagtctcatcctggcccaagcgccctactgttgctgcagctcttgcttccgcccacctccgccttcttccccaacatttggagcctccttgccgctccgggttccatcacccatcaagatctgacagaggaagccgcactcaacgtgaccctgcagctctttttggaacagcctcccccgggtcggcctcctctgagactggaggattttctcggcaggacactgttggcggatgacctgtttgccgcttattttggccccggctcctcaaggagatttcgggccgctttaggagaggtgtcgcgagctaacgcagctcaagactttcttcctaccagtcgaaatgatccagatctccacttcgacgccgaacgtctgggtcagggtagggcgcgtttagtgggagccctaagggagacggtggtcgccgctcgtgccttggatcacactctagcgcgtcaaagactcggagcagctctgcatgcgctgcaagacttctactcacactccaattgggtcgagcttggagagcaacagccccacccgcacctgctttggcccaggcaggagctccagaacctcgcacaagttgctgatccaacatgttccgactgcgaagagctgtcatgcccccgcaattggctgggattcactcttttaaccagtggatacttcggtacacatccaccaaagcctccagggaaatgtagccacggcggacattttgaccgcagttcatctcagcccccaaggggcggcatcaataaggactccacctcccctgggttcagtccccaccacatgttacatctccaggccgcaaagcttgcgctccttgcatcaattcaggccttcagcctgctaaggagccgtctgggcgatcgcgatttcagccgcctattggatatcacccctgcttcctcactgtccttcgttctcgataccacaggcagtatgggcgaggagatcaacgccgcgaaaattcaggcaaggcatctagtcgaacagcgccgggggtctcccatggagcctgtccactacgtgctagtgcccttccatgacccgggcttcggccctgtgtttacaacctccgatccagatagcttttggcagcagctcaatgagattcacgccttaggcgggggggatgagccggaaatgtgcctcagtgctctacaactggcccttcttcataccccccccctatccgatatattcgtgttcactgacgcgtcgcccaaagatgctttcctgacgaatcaggtagagagtctcacgcaagaaaggcgatgtcgcgttaccttcttggtgaccgaggatacaagccgcgtgcagggcagagctaggcgcgaaattttgagcccactgcgctttgaaccctacaaagccgttgctttggccagcgggggagaggtaatttttaccaaggaccagcacatccgcgacgtggcagccatagtgggggagagcatggcggccctggtgaccttacctctcgatccacctgtggtcgtgccaggacagcctctggtgtttagcgttgacggattgttgcagaagataacagtcaggatccatggggacataagctccttttggatcaaaaaccctgcaggggtgagccagggacaggaggagggaggcggccctttagggcacactcggcgctttggccaattttggatggttaccatggatgatcctcctcaaactggcacctgggagatccaggtgaccgccgaagatacccctggagtcagggtccaagcccagactagcttagactttctattccatttcgggatacccatggaagatggtccccatcctggattataccctcttacacagcccgtagccggcctgcaaacccagctattggttgaaagtcaatcttggggttcgagtgcagctttccttcccagacatccctctagagggcccagaggatgcaggaccaggcccggtgccctgggtgccagaggcacgagcggtgcgcgatcccctaggtcactggctgtagcccacgcagcagtcaacccatag

SEQ ID NO: 34746 - DNA, 2559 bp, Artificial Sequence
  Description of Artificial Sequence: Synthetic coding sequence
atgctgccaaccgaagtgccacagtcccaccccggcccttcggctctgctactgttgcagctgctactgcctcccactagcgccttcttcccgaacatttggagcctgctggcagcccctggctctataacccaccaagatcttaccgaagaggctgctcttaatgtgaccttgcagctgttcttggagcagccaccgcccggtaggccacccctccgtttagaagatttccttggacgcactctcctcgcagacgatctattcgccgcatattttggtcccgggagttcaagaaggtttcgcgcggcactgggagaggtatcaagggccaatgcagcgcaggactttctccccacctcacggaatgatccagatctccatttcgacgcggagaggctgggccagggcagagcccggctcgtgggggccctcagggaaacagttgtggccgccagagcgctcgatcacaccctcgctaggcaacgcttgggggctgcactccacgccctccaggacttctatagtcactccaattgggtggagttgggagagcagcaaccccacccccacctgctgtggccccggcaagaactccagaatctggcccaggtggcagacccaacctgtagtgactgtgaagagctgagctgcccaaggaactggctcggctttacactgcttacaagcggctatttcgggacccacccaccaaaaccgcctgggaagtgctctcacgggggccacttcgatcggagtagctcccagcctccaaggggaggaattaacaaggattctactagcccggggttctcaccacaccatatgctacatttgcaggcagccaaactcgcccttctggcgtccatacaggcgttcagtctcctgcgctcgcggctgggagacagagacttctcgcggttactggatattacaccagccagctctctgagctttgttctggatactacaggatcgatgggtgaagagatcaacgctgcaaagatccaggctaggcatctggtcgaacaacgccggggctctcctatggaacccgtgcactacgtcttggtacccttccacgaccctggattcgggcccgtgttcaccaccagcgatcccgattcgttctggcagcagttgaacgaaattcatgccttggggggtggcgacgaaccagagatgtgtctgtcagctctgcaactagctctactccacacaccccccctgtctgatatcttcgtatttacagatgcctcacctaaagacgcctttctgaccaatcaggtggaatccttaactcaagagagacgttgccgcgtgactttcctggtcacagaggatacatctagagtgcagggacgtgccaggagagaaatcctgagccccctgcgctttgagccatacaaagcagtggctctggcctctggtggcgaggtgatttttactaaggatcagcacatacgtgacgtggccgctatagtgggagagtcgatggcggcgctggtgaccttacccctggatccaccagtggtcgttccggggcagcctctggttttctcagtggacggcctgctgcagaagatcactgtacgcattcacggagacattagtagcttctggatcaagaacccagccggcgtctcccaaggtcaggaggaagggggaggtccgcttgggcacacaaggcggtttggccagttttggatggtgacgatggacgacccccctcagactggcacatgggagatccaagtgaccgccgaagataccccaggggtgagggttcaggcacagaccagcttagatttcctgttccacttcgggatccccatggaggacgggccgcacccaggactgtaccccctgacccagcccgtggcaggactgcagacacagctgcttgtggaagtgacgggactcggaagtagagcaaaccctggcgatccgcaaccacattttagccacgtcattttaaggggagtgccagagggagccgaactgggccaggtgcccctagaacccgtagggcctccagagcgcgggctgttagcagcgtctctcagtcccacccttcttagtactccgaggccctttagcctggagctcattggtcaggacgccgctggaaggagactgcatagagccgcacctcagccaagcaccgtcgttccagtgctgctcgaactgagcgggccatcggggtttctggcacccggatccaaggtgccgctaagcctccgcattgcatcctttagcgggccccaagacctcgatttgaggacctttgtcaaccccagcttcagtctgacgtctaatcttagcagggcccatctggaactcaacgagagcgcttggggccgactttggctcgaggtgcctgactcagccgccccagactcagtcgtgatggtcaccgtgaccgccggagggcgtgaagccaatccagttcctcccacccacgcctttctaagattgctcgtttccgcaccagccccccaggttaggaaccactacttcccatctcaaggtcctgctcatcacccatataggcttatttag

SEQ ID NO: 34747 - DNA, 2835 bp, Artificial Sequence
  Description of Artificial Sequence: Synthetic coding sequence
atgagtctgacgattcgggcacccagcgtggattataggaacactcttggcttatgtgggacatttgacgaaaaccccgagaacgacttccacgataagaatgggatgcagatagaccaaaacttcaacaattatgtggcttttataaacgaatggcgtatactgcctggtaagtcgatgtctgacacactgccggtgtccatgacctcccccggtaagccgagctattgttcttgcagcctggacactgcggcttatccctcgtcagaggatctggactccgtgagcagaagtgagattgctctaggctgtaaggatctgaaccatgtgtcgctgagctctctgatacccgaactagacgtcacgagcgagtatatcaattccgacactctggtaagagaaatcaacaagcacacttctccggaggaatataatctgaatcttttccttcaggagaaaaagcatatcaatctgacaaaactaggtttaaacgtgcagaaacaccccggtaatgaaaaggaggattctttgcaatatctggccaacaaaaaatatacgcagggtagaggctctcatagccaggagatgaggtataaccgacaaaacagatggaagcggcagaacttccacgagttccctcccctgttcgcttttccctcactgtcgcagaccgatctcgaagagctcacatatttctttccagaagatcacgccgaggacgtgcagcaggagttctttccatcctggcccaccccaagcgggttgactgagtactctacccttaccctttgtcaggaaaccttggcaaattcctctataggtcggctttgtctcgctttcctcggaaagcggctggatagcgtcatagaaatgtgtgtgaaagatgtgctgttgaaagatgaccttagttgggccgaagccggagtcgcgctgcttgaaaatgaatgcgaaaagcgaatagttgaggaaggaaagtacaacactgaagagtacggcacctctattgaggacatcctgagcgtgctgaagtgccctaatctgtgctcagggaacggacagtgtatggagtgggggtgtgcatgctccccttctttcagcagctacgactgtagtgatagctacgacaaagcacctgagataacagaactcggcaacgctgggttctgcgacgtacaaaagtacaattgcatgatggttcgcgtcttcggcaagggtttcaaagagctgcctagtatcaaatgtgaagtgaccaaactccagtacaacagcagtgagtggatgcccggggaaccaatctacacacagacagtcttccacaattcacgagctgtggactgccaattaccaacagatgttcagcagttcgacaccatggatctggtgggaggaaaacctaccgggaagtggcagttaaaggtgtctaatgacggctataaatttagcaacccaaagataaccgtcatctacgacggggcatgccaggtgtgtggcctgtacaaaaacgattcctgcaccatcaaggaaaacgtgtgcatcattgacggactctgttacgtggagggcgataagaatccaacttcgccttgcctgatttgtcgcccaaagattagtcggtttacatggtcctttctggagaataaccagccgcccgtgatccaagccctgcaagacaagctgcagaccttttacggagagaatttcgaatatcaatttgtggccttcgacccagagggatccgacatacattttacgctggactctgggcccgaaggggcatccgtgtcaagcgcagggctgtttatgtggaaaaccgatctactgacaactcagcagatcacagtgagactgaacgacgattgcgatgccgagacccgcgttacgattgaagtgaccgtcaagtcttgcgattgcttgaatggtggttcctgtgtgagcgaccggaatttttctcccggaagcggcgtgtatctttgtgtctgtctgcctggctttcacggcagcctatgcgaggtcgatatctccggatgtcagtctaacccctgcggtctcggttcctacatctctggattccactcctactcctgtgactgtccacctgagctgaaagtcgaaacccagttcgttaatcagttcacgacccagacagtcgtgctgacccggtcagataaatcagtcaacaaagaggaggacgataaaaacgcacaagggcggaaaagacacgtgaaacctacttcgggcaacgcctttacgatctgtaagtacccctgcggcaaatctagggaatgcgtagctcctaacatctgcaaatgcaagccaggctatatagggtctaactgtcagaccgccctgtgcgaccccgattgtaagaaccacggtaagtgtattaagccaaatatttgccagtgcttgccaggtcacggaggcgccacttgtgatgaggagcactgcaacccaccctgccagcacgggggaacgtgtcttgccggcaacctgtgtacatgcccgtacggcttcgtgggtccgcggtgcgagaccatggtttgtaatcgacactgcgagaacgggggacagtgcctgactcctgatatttgccagtgtaagccgggctggtacggccccacgtgctccactgccttgtgcgaccccgtgtgtctaaatggcggctcttgtaataagccaaacacttgcctgtgtcctaacggcttctttggggaacactgccaaaatgctttctgccaccccccctgcaagaacggcggacattgcatgagaaataatgtgtgtgtgtgccgcgaggggtacactggtagacgtttccagaaaaggcacctctag

SEQ ID NO: 34748 - DNA, 513 bp, Artificial Sequence
  Description of Artificial Sequence: Synthetic coding sequence
atgccaggtggagcctgtgttctggttatcgccctcatgttcctggcctggggggaggcccaagagtgttccccagggggccatcagttcctcagaagcccctatagatccgtccggtttgattcatggcacctgcagcagtccgccgtgcaggacctgatatgcgatcattccttgtccccgggatggtacagattcttaattttggacaggcccgccgagatgcctacgaaatgtgtcgagatgaaccactgcggaactcaggccccaatctggctttctctgagggacagcgaaaccttgccaagccctggtgagatcaaacagctcactgcctgcgctacctggcagtttttattctcaactacaaaagactgctgcctgtttcagattccggtaagcgtccgcaattgtggaaatttttcagtttatttactacagcccacccaaggctgcatgggatattgcgccgaaggcttttttgccaaaattgtgaagagcccccacacgtag

SEQ ID NO: 34749 - DNA, 4524 bp, Artificial Sequence
  Description of Artificial Sequence: Synthetic coding sequence
atgaccacagttgtagtccacgtggatagtaaggctgaactgaccactctgctcgagcagtgggaaaaagagcacggctccgggcaggacatggtacctattttaactagaatgtcacagctcatcgagaaggagacggaggaatataggaagggtgatcctgatccattcgatgacaggcaccccgggcgagccgacccagagtgcatgctcggccacctcttaaggattctattcaagaatgatgactttatgaacgccctggtgaatgcttacgttatgacttctagggaaccccccctgaataccgccgcctgtagacttttgcttgacattatgccagggttggaaactgccgtggtgttccaagagaaggagggcattgtcgaaaatctctttaagtgggcccgcgaagctgatcagcccctgcgcacctattcaactgggctcttgggcggagccatggaaaaccaggacatagccgcaaactacagggacgagaacagccagttggtagcaattgtcctgcgccgtttacgcgaactgcagctgcaggaggtcgccttgaggcaggaaaacaaaaggccttccccgcgtaaactcagttccgagccgctgctgcctttagatgaggaagcagtagatatggactacggtgatatggctgtcgacgtggtggacggagatcaggaagaagcttcgggcgatatggaaatctcattccacctggacagcggccacaagacttctagtcgtgtgaactctaccaccaaaccagaagatgggggactcaagaagaataagagcgccaagcagggtgacagggagaatttccgcaaagcaaagcaaaaacttggcttcagttcctcagatccagacaggatgttcgttgagctgtctaattcgagttggtcggaaatgtccccgtgggttatcggaacaaactacaccctatatccaatgacccccgccattgaacagaggctgattctgcagtacctcacaccactgggcgaatatcaggagctactgcctattttcatgcagctcggctctagagagctgatgatgttttatatagacctcaaacagactaatgacgtcttattgacgttcgaagctctgaaacatctggcctctctactcttgcacaataagttcgcaacagagttcgtagcacatggtggggtgcagaaattgttggagatcccacgcccgtcgatggccgccacaggggtatcaatgtgtctatactacctaagctataaccaggatgccatggaacgagtatgcatgcatccacataatgttctatcggacgttgtcaattatacattatggctcatggaatgcagccatgcgagcggttgttgtcacgcaaccatgttctttagtatctgctttagctttagagcagtgctggagttgtttgatagatatgatgggctgaggaggctagttaatctcatctccacgctggagatcctgaatcttgaggaccaaggagctttgctgtctgatgacgaaatattcgcatccaggcagactggcaagcatacttgcatggctctccggaaatactttgaagcgcatttggcaataaagctcgaacaggtgaagcagtctctgcaacggaccgagggaggaatccttgtgcacccacagcccccctataaggcatgctcatatactcatgagcagatagtggagatgatggagtttctaatcgagtatggtcctgcacagttatactgggagcccgccgaggtgttcctcaaattaagctgcgtgcagctgctgctgcagctcatatctatcgcttgtaattggaagacatactacgcgagaaatgacaccgtccgtttcgccctggacgtcctcgctattcttacagtggtacctaaaatccagctccagctcgccgagtcagttgacgtgttggacgaagcaggctctactgtgtccaccgtcggcatttctatcatcctgggcgtcgccgagggggagttctttattcatgatgcagaaatccaaaagagtgccctccaaatcatcataaattgcgtgtgtggccctgataatcgtatcagttccatcgggaagttcatttccggaacaccccgccgaaagctcccccaaaatcccaagtcttccgaacatacactggctaaaatgtggaatgtggtgcagtccaacaacggtatcaaggtactgctgagtctactttcgattaagatgcccataactgacgctgatcaaataagggcactggcttgcaaagctcttgtcgggctctcacggtcgtctaccgtgagacagattatatcaaagcttccattattcagctcctgccagattcagcagctaatgaaggaaccagtgctgcaagataagcgcagcgaccatgttaaattttgtaagtacgcagcagagttgattgaacgagtctcagggaagccccttctgattgggaccgacgtgtccttagccagactgcagaaggcagacgtcgtggcccagagtcgcatttcttttcccgaaaaggaactccttctgctgattcggaatcacctcatcagcaagggcctcggcgagactgcaactgtattgaccaaagaggccgacctgcctatgaccgccgcgtcacacagtagcgcttttacacctgtgaccgccgctgccagtcctgtgagccttcctaggactccccgtattgccaacggtattgccacacgactggggtcgcatgctgcggtcggcgcctcagccccgtccgcccctacagcgcatcctcagccacgaccgccccagggccctttggccctcccgggaccttcttacgcaggtaatagccctctgatcgggcggatttccttcatccgagaacggcctagcccatgcaacggacgcaagatcagggtccttcggcagaagtccgaccatggcgcttattcacagtctcctgcaatcaaaaaacaacttgatcgacatctaccatcacctccaacactagacagtattataacagaatacctgcgggaacagcatgcaaggtgtaaaaacccagttgctacatgtcccccattcagtctgtttacacctcaccagtgtcccgaacccaaacaacggcgtcaggccccaataaactttacttccagacttaaccggagagctagcttccccaagtacggcggggtcgacggggggtgtttcgacagacatctcattttttctcgattcaggcccatctcggtatttagggaagcgaatgaggacgagtccggttttacttgttgcgccttcagcgctcgcgagcggttcctcatgctggggacttgtacagggcagcttaagctgtacaacgttttttctggccaggaggaagcaagctataattgccacaatagtgccataacccacctggagccgtcgagagatggttcactcctgctcacttcagctacatggtcacaacccctcagcgcattgtggggcatgaagagcgtgttcgatatgaagcactcatttaccgaggatcattacgtcgaattctccaagcacagtcaggaccgggttataggtacgaagggagacatcgcccacatatacgatattcagaccggcaataaactgctcaccctgttcaacccagacctggccaataactataagcgaaactgcgcaacattcaaccctaccgatgacctggtgctcaatgatggggtgctgtgggatgtccgatctgcacaggccatacataaatttgataaatttaacatgaatatctctggcgtctttcatcccaatggtctcgaggtcataatcaacaccgagatctgggacctccggacattccacttgcttcatacagtccccgccctcgaccagtgtcgcgtggtcttcaatcatacgggtaccgttatgtacggcgcaatgctacaggcggatgatgaggatgacctgatggaggaaaggatgaaatctccattcggcagctcattcaggacttttaacgctactgattataagccgatcgcgaccatagatgtgaagagaaacatttttgacctctgtacagatacgaaagactgttatctggctgtcattgagaatcagggaagcatggacgcattgaatatggacactgtctgcagattgtacgaggttggacggcagagactggctgaagacgaggacgaagaggaagaccaagaggaggaggagcaggaggaggaagacgacgatgaggacgacgatgacacagacgacctggatgagctcgacacagatcagctactggaggcggaactggaggaggacgataacaatgagaacgccggcgaggatggggataatgactttagcccatctgatgaagaattagctaatctactcgaagaaggagaggatggagaggacgaggacagtgatgctgacgaagaggttgagctgatcttgggcgacacggacagctcagataattctgacctggaggacgatatcatcctctccctcaacgagtag

SEQ ID NO: 34750 - DNA, 4524 bp, Artificial Sequence
  Description of Artificial Sequence: Synthetic coding sequence
atgacaacagttgtcgttcatgtggacagtaaagccgaactgacaacactcctggagcagtgggagaaggagcacggttcaggacaggatatggtgcccattcttaccagaatgtctcaactcatagagaaagaaaccgaggagtaccgaaaaggggatccagacccattcgatgatagacatccaggtagagcagaccccgagtgcatgctgggtcatttgctgcggattctcttcaaaaacgacgatttcatgaacgccctggtcaacgcctacgtcatgacgagcagagaaccccctcttaacactgccgcgtgcagactcttattggacatcatgcctgggctcgagacagccgttgtgtttcaggagaaagaaggcatagttgaaaacctgttcaaatgggcccgcgaggccgatcagcccctgcgcacatactctaccggtctgctcggaggcgcaatggagaaccaggacatcgctgcaaactatagagacgagaactcacagttggtggccatcgtgttacgtagactgcgcgaacttcagctacaggaagttgcattgcgtcaagaaaacaagagaccgtcaccccgcaaattgtcatccgaacctctcctgcctctcgacgaggaggccgtggacatggactatggcgacatggctgtggatgtggtcgatggcgaccaagaggaggcaagcggggacatggaaattagtttccacctagactctggacacaaaacatcatcacgcgttaactcaaccacaaaaccagaggatggtggactcaagaaaaacaagagtgcaaagcagggggacagagagaactttcggaaggccaaacagaagctcggcttcagcagcagtgatccagacagaatgttcgtagaacttagtaactcttcgtggtcagaaatgagtccgtgggttattgggaccaactacactctttatcccatgacaccagccatcgagcagcgactcatattgcaatacctcaccccactgggggagtatcaggagctgctgcccattttcatgcagctaggatcccgtgagcttatgatgttttacattgacctcaagcaaaccaacgatgtcctgttaacctttgaggcactgaagcacctggcaagcttgcttttgcacaacaaattcgctacggaattcgtggcccatggaggcgtgcagaagctactggaaatcccccgcccatccatggccgccacaggcgtctccatgtgcctctactatctgtcctacaatcaggacgctatggagcgcgtttgcatgcatccacacaacgttctgagtgatgtagtcaactacaccttatggcttatggaatgctcccatgcctccggctgttgccatgccactatgttcttctctatctgtttcagcttcagggccgtgttggagctcttcgatcgctacgatggactgaggcggctggtgaatctgatttctacacttgagatcctgaacctggaagaccagggagcccttctgagtgacgatgagatcttcgcgagccgtcaaacaggtaaacatacctgtatggccttgcgcaagtacttcgaagcacacttggctatcaagctggagcaggtgaaacagtccctccagagaactgaggggggaatactcgtgcaccctcaaccaccttacaaagcttgcagctatactcacgagcagatcgttgagatgatggagtttttgattgaatacggccctgcacagctgtactgggagcccgccgaggtgtttctgaagctgtcctgcgtgcagctcctgctccagctcatatcaatcgcatgtaattggaagacctattacgcaagaaacgataccgtacgctttgcccttgatgttctggcaatccttaccgtcgtccctaaaattcagttgcagctggccgaaagcgtagacgtgctcgatgaggcgggcagcaccgttagtaccgttgggatttctatcatactaggagtggcagaaggagagttcttcatccatgacgccgagattcagaaaagtgccctccagatcattattaattgtgtatgcggccctgataatcggatttcatccatcggcaaatttatatcagggaccccacgccgcaaactaccccagaaccccaaaagttctgaacacacattagctaagatgtggaatgtagttcaaagtaacaacggaatcaaagttctgctcagtctgctgtccattaaaatgccaatcacagatgccgaccagatcagggccctggcttgtaaagccctcgtcggcctttcaaggagtagtaccgttcgacaaatcatatcaaagctaccactgttttccagttgtcagattcagcaacttatgaaagagcccgttctgcaggataagaggagcgatcatgtgaaattctgcaagtatgcagcagagctcatcgaacgagtctcgggcaagccattgctgataggcaccgatgtctcccttgctcggctgcaaaaggccgacgtagtagcccagagccgcatctctttccccgaaaaagaactgctattgctgatccggaaccatctaattagcaaaggcctcggcgagacggccaccgtcttgactaaggaagccgatctgcccatgacggctgccagtcacagtagtgcctttacccctgtgacggccgcagcctctccagtttcactgcctcgcactccaagaattgctaatggaattgccactcgtttgggttcccacgctgctgtaggggcttcagccccaagtgcgcccactgctcacccacagcctaggccgccacagggtcctctggctcttcccggcccctcgtatgctggtaactcacccctaattgggcgtattagttttattagggagcgtccctccccctgtaacggccgtaaaatacgtgtgctgcgccagaaaagtgatcacggggcctattcacagagtccagcaatcaagaagcagttggatcggcacctgccgagcccgccaactcttgatagcatcataactgaataccttagggagcagcatgctcggtgcaaaaaccccgtggctacgtgccccccattctctctattcactccccaccagtgtccagagccaaaacagaggaggcaagctccgattaacttcactagccgactgaacagacgcgcctcatttcctaagtatggtggtgtcgatggaggctgctttgatcggcatcttatctttagcagatttcgtcccatatccgtcttccgcgaggcaaacgaggatgaaagcggattcacctgttgcgcatttagtgcccgcgagaggttcctgatgctcggaacttgcaccggtcaattgaagttgtataacgtatttagtggtcaggaggaggcctcatacaattgtcacaatagcgcaattactcacctggaaccctccagggacggcagcttattattgacatctgctacctggtcccagcccctgagtgcgctttggggcatgaaatccgtcttcgatatgaaacactctttcacggaagaccactatgtcgaatttagtaagcacagccaagacagggtcattggtaccaaaggtgacattgcacatatctatgatatacaaacaggcaacaaactactcacgcttttcaaccctgatctggccaataactacaaaagaaactgtgcaacttttaatcctaccgacgacctggtactaaacgatggcgtgctgtgggatgttcggtcagctcaagcaattcataaattcgataagtttaatatgaatatctccggtgtttttcatccaaatggcctggaggtgattattaataccgagatctgggatctccgtacattccatctgctgcatactgttcctgccctggatcaatgcagagtcgtttttaatcataccggaactgtaatgtatggcgctatgctgcaggccgacgatgaggacgacctcatggaagaaagaatgaagagcccattcgggtcttcatttcgcacgtttaatgcaactgactataaaccaatcgctacaatagacgtaaaacgcaacatcttcgacctttgcactgacactaaagattgttatttagctgtgatagagaatcagggttctatggacgcactcaatatggacactgtctgcagactgtatgaagtgggtagacagcggctcgccgaggacgaagacgaagaggaggatcaggaggaggaagagcaagaggaagaagatgacgatgaggacgacgacgatacagatgatttagatgagctggatactgaccaactgttggaggctgagcttgaagaggacgacaacaacgagaatgccggagaagatggggataatgactttagccccagtgatgaggagctggctaacctgttagaggagggcgaagatggcgaggacgaggatagcgatgccgacgaggaagtggagctgattcttggggatacagattccagcgataattccgatttggaagatgacataatactgtctcttaacgaatag

SEQ ID NO: 34751 - DNA, 984 bp, Artificial Sequence
  Description of Artificial Sequence: Synthetic coding sequence
atggcggagctgcccggaccattcttatgcggggctctcctcggttttctatgcttgtccggattggccgtggaggtcaaggtgccaacggagcccctttccacccctttgggcaagactgcggagctgacatgcacatattccacatccgtgggcgacagcttcgctctggagtggagcttcgttcagcctggtaagccaatctctgaatctcatcccattttgtatttcaccaatggacacttgtaccccactggatccaagagtaagcgggtttcactactgcagaatcccccaacagtgggagtggctaccctgaagttgactgatgtccatccaagcgatactgggacttacctgtgccaggtgaataaccctcccgatttctacaccaatggtctcggtttgatcaatctcacagtgttggtgcccccctctaatcctctctgttcccagagcgggcagacctccgtcgggggctcaacggcacttaggtgtagcagctcagagggggcaccaaaacctgtgtacaactgggttcggctgggtactttccctactcctagccctggaagcatggtgcaggacgaagtgagtggccagttgattctaactaacctgagtctgaccagctctggcacttaccgctgtgtggccacaaatcagatgggatcagccagttgcgaactgactcttagcgtcacagaaccctctcaggggcgggtagccggggcgctcattggcgtgcttctcggagttctcctcctctccgtagccgccttttgtctcgtgcgcttccagaaagagcggggaaaaaaacccaaagagacttacggaggctcggacctgagagaggatgccattgcgccagggatttctgaacacacttgcatgagggcggattctagtaaagggttccttgagaggccatctagtgctagtacagtaaccacaacgaaatctaaattgcctatggtcgtgtag

SEQ ID NO: 34752 - DNA, 855 bp, Artificial Sequence
  Description of Artificial Sequence: Synthetic coding sequence
atggcagaactgcctggacctttcttatgtggcgctctgctgggcttcctgtgtttatctggcctggcagtggaggtaaaggtccccacagaaccgctcagcactcccctcggcaagactgctgagctcacctgtacttatagcactagtgtgggggactcttttgctctggaatggtcattcgtgcagcctggaaaaccgatttccgagagccaccccatcctctatttcactaatggccacctgtacccaacgggctctaagagtaagcgggtatccctgttacaaaatcccccaaccgtcggagtcgccacattgaagctcacagatgtccacccctccgacaccggcacctacttatgtcaggtgaacaatccccctgacttctatactaatggcctgggactaatcaatctgacagtgctggtccccccatccaaccctctctgcagccagtctggacagacatctgtgggaggcagcacagccctgcggtgctcttccagtgaaggggctcccaaaccagtgtacaattgggtccggctgggtaccttccctacgccttctcccggaagcatggttcaagacgaagtgtctggacaactgatacttaccaatctctccttaacatcctctggaacctaccggtgcgtggccactaaccagatggggtcagcatcttgcgagctgacactgtccgtgactgagccatcacagggacgggtagcaggtgccctgataggagttctgttgggagtgttgctcctgagtgtcgccgcgttctgtttggtgcgatttcagaaagagaggggtaaaaagcccaaagagacctatggggggtccgacctccgatag

SEQ ID NO: 34753 - DNA, 363 bp, Artificial Sequence
  Description of Artificial Sequence: Synthetic coding sequence
atggactggaactggcgcattctttttctggtggttatcgctgctggggctcagagccaggttcagttggtccagtctggcgcagaggtgaagaagccaggagccagtgtaaaggtgtcatgcaaggcaagcggctacacaataacctcttattgcatgcactgggtgcaccaggtacacgctcaaggactggaatggatgggcctggtttgcccttcagatggctcaacatcttacgcgcagaaatttcaggccagagttacaatcacccgcgacactagcatgtccacagcatatatggaactttccagcctgagatcagaagacacagcaatgtattactgtgttcgtgatacaatgtag

SEQ ID NO: 34754 - DNA, 564 bp, Artificial Sequence
  Description of Artificial Sequence: Synthetic coding sequence
atgggagcccctcttgccgtcgccctgggtgcattacactatctcgcgctcttcctccagttggggggggctaccaggcccgcagggcacgcaccgtgggataaccacgtctcaggtcatgcgctgttcactgaaacaccccacgatatgaccgcccgtaccggcgaagacgtggagatggcttgttcttttcgggggagtggtagtccatcctacagcctggaaatccagtggtggtacgttcggtctcatcgcgactggacggacaagcaagcttgggcctccaatcaggtcgttaaggtggtgggctctaacattagtcacaaactgaggctctcccgcgtgaagccgaccgatgagggcacatatgaatgtagggtgattgacttctccgatggaaaggctcgtcaccacaaggtcaaggcttatctgcgagttcagcctggagagaacagcgttctacacctgcctgaggcccctcccgctgcccccgctccgccccctcctaaaccaggcaaggagctccggaagcgaagtgtggatcaggaggcctgttctctctag

SEQ ID NO: 34755 - DNA, 615 bp, Artificial Sequence
  Description of Artificial Sequence: Synthetic coding sequence
atgggagcgcctttggcagtcgccctcggcgctttgcactatttggccctgttcctgcagctaggaggcgcgaccagaccggccggacatgccccctgggacaatcatgtgtccggacatgccctctttacagagaccccacacgacatgaccgcgcggactggggaggacgtagagatggcctgcagcttccgcggcagcggcagcccatcctacagccttgagatccagtggtggtatgtgagaagccacagggactggacagacaaacaggcttgggcttctaatcagctgaaggcctctcagcaggaggacgctggcaaggaggctacgaagatttctgtggtcaaagtcgttggttcaaacatcagccataaactgcgtctgagtcgcgtgaaacccaccgacgaagggacatacgaatgcagggtgattgatttttccgacggaaaggcaagacatcataaagtcaaagcttacctgagggtgcagcctggcgaaaactcagtgttacacttgcctgaggccccaccagcagcgcccgctcctccacccccaaagcctggaaaagagctgcggaaaagatctgtagaccaggaggcatgctccctttag

SEQ ID NO: 34756 - DNA, 450 bp, Artificial Sequence
  Description of Artificial Sequence: Synthetic coding sequence
atgggcgccccactcgccgtggcactcggagctctgcactacctggccctttttcttcagctcgggggggcaacgcggccggctggccatgctccatgggataaccatgtttccgggcacgccctctttacggagacgcctcatgacatgacagcccgcactggcgaggacgtggaaatggcttgtagttttcgaggatcagggtccccctcctactcactggaaatacagtggtggtatgtcaggagccaccgagactggaccgacaagcaggcttgggcaagcaaccaagtggttaaggtggtgggcagcaatatctctcataaactgcggttaagccgagttaaacctaccgatgagggcacctacgagtgccgcgtgatcgactttagtgacggcaaggcccgccaccacaaggtgaaggcctatcttagagtccagccaggctag

SEQ ID NO: 34757 - DNA, 858 bp, Artificial Sequence
  Description of Artificial Sequence: Synthetic coding sequence
atggaacagcgcaatagattaggcgccctcgggtatctgccacccctgctactgcacgcgcttttgctgtttgtggctgatgccgcctttacagaagtcccgaaagacgttacagtgcgcgaaggtgacgatatagagatgccatgtgccttcagggcctccggggctaccagctatagcctggaaatccagtggtggtacctgaaggaacctccccgggaacttttacatgagttggcccttagcgtgcccggagcacgaagcaaagtcaccaataaggacgccactaaaattagtacagtgcgagttcaaggcaacgacatatcgcacaggttgaggttgtcagccgtgcgattgcaggacgagggggtctacgagtgtcgtgtaagtgactacagcgatgacgatacccaggaacataaagctcaggccatgctaagagtcctgagccgctttgcaccacctaacatgcaggccgccgaagccgtctcccacattcagagttccggccctcggcgtcatggaccggcttccgcagctaatgcaaacaacgcaggggcagcatcacgaacaactagcgagccaggccggggtgataaatctccccctccagggagtccccccgctgcgattgatccagccgtgcccgaagccgcagccgcctcagccgcacacactccaaccacaacagtggcagccgccgccgccgcttcatctgcttcaccaccaagtggccaggctgtgctgcttcgtcagcgccacggttccggcacgggccggagttatactactgatcctctacttagcctgctattactggctttacataagtttctaaggttacttctcggacattag

SEQ ID NO: 34758 - DNA, 2034 bp, Artificial Sequence
  Description of Artificial Sequence: Synthetic coding sequence
atggccaaggtgaacattactcgggatctgattcgcaggcagattaaagagaggggcgccctttcttttgagcggcggtatcatgtgacagacccctttattagaaggctcggcttagaggcagagctgcagggacattctggctgtgtcaactgtttagaatggaacgagaaaggagacctccttgctagcggcagtgatgatcagcacactattgtgtgggatcctctgcatcataagaaacttctgagcatgcacacgggccacaccgccaatatcttctctgttaagttcctcccgcatgccggcgatcgcattctcatcacaggcgccgctgattccaaagttcacgtgcatgatctcactgtgaaagagaccattcacatgtttggcgaccacactaaccgggtaaagaggatagccacagctcctatgtggccaaatacgttctggagtgccgccgaggacggattgattaggcaatatgatttacgtgagaatagtaagcactcagaagtgctgattgatctgacggagtattgtggccaactcgtggaggctaagtgtctgactgtcaatccacaggataataactgcctggcggtgggggcctcagggccttttgtccggctgtatgatatacgcatgatccacaaccatagaaaatctatgaagcagagcccctccgccggcgtgcacaccttctgtgaccgtcagaagccgctccctgatggggcagcccagtattacgtggccggccatctgccggtaaagctgccggattacaacaacagattgcgtgtcctcgttgccacgtacgtgaccttttccccaaacggaaccgagctgttagtgaatatggggggggagcaagtgtatctcttcgacctcacctataagcagcgcccatacacctttctgctgcccaggaaatgccactcctccggcgaagttcagaatggcaagatgagcacaaatggggtttccaatggtgtctccaacggtctgcacctccactccaacgggttccgattgcccgagagtcgtggacatgtttcaccccaggtcgagcttcctccatacctggagagagtaaagcagcaggccaacgaagccttcgcctgccaacagtggacgcaggctattcagctttattccaaagctgtgcagagagcaccccacaatgcaatgctgtacggcaatagggccgccgcatatatgaaacgtaaatgggatggcgaccactatgacgccttacgtgattgcctgaaggcaatcagcctaaacccatgtcatcttaaggcccatttcaggctggcgcggtgtctttttgaactgaagtacgtggctgaggcacttgaatgcttggatgactttaaaggaaaattcccagaacaggcacactcaagtgcttgtgatgcccttggcagggacattacagcagccctattctcaaagaacgatggagaggaaaaaaagggccctgggggaggcgctcctgtgcgcctgcgatctaccagccgcaaggatagtatttcagaggacgagatggtgctccgggagcggtcttacgattaccagtttaggtattgcggacattgcaacactacgacagatattaaggaggcgaatttctttgggtcaaatgcccaatatatcgtgagcggcagtgatgatggttctttttttatctgggaaaaagagaccaccaacctagtgcgggtacttcagggcgatgagagcattgtgaactgtcttcagccgcacccatcatattgctttctagcaacctcaggtattgatcctgtcgtgcggctgtggaatcccagacccgagtcagaagatctgaccgggcgggttgtcgaggatatggaaggggcatcacaggcaaaccagcgccggatgaacgctgacccgctagaggttatgcttcttaatatggggtatagaatcaccggcttaagttctgggggagctggggcttctgacgatgaggatagtagcgagggccaggtacagtgtagaccatcctag

SEQ ID NO: 34759 - DNA, 2031 bp, Artificial Sequence
  Description of Artificial Sequence: Synthetic coding sequence
atggccaaggtgaatattacacgggatctcatccgaaggcagatcaaagaaagaggcgccctgtcatttgaacggcgataccatgtcacagatcccttcattcgcagactgggtcttgaggccgagctacagggccacagtggctgcgttaattgcctcgagtggaacgagaaaggagatctgctcgccagtggtagtgatgaccaacacacaatcgtgtgggacccgcttcaccataagaaacttttgtccatgcataccgggcataccgccaacattttcagtgtcaagttcctgccccacgccggggatcgcattcttattactggcgctgcagactctaaagtgcatgtgcatgatcttacagtcaaagagaccatacatatgtttggcgaccatacaaaccgggttaagcgcatcgcaacggccccaatgtggcccaacaccttctggtccgccgccgaggacgggttgatccgtcagtatgatcttagagagaacagtaagcattctgaagttctgatcgacctaaccgagtattgtggtcaacttgtggaggctaagtgccttacagtgaacccgcaggacaataactgccttgcagtgggggcctctggcccattcgtgaggctctatgacattaggatgatccataatcaccgcaagtcaatgaagcagagcccctctgccggggtgcacaccttttgcgaccggcagaagcccttgcccgacggagcagcccaatactacgtggccgggcatcttcccgtcaaactaccagactacaataatagattgagagttctggtggcaacatacgtgacatttagtcctaacggcactgagttgctggtgaatatggggggggagcaggtgtacctttttgacctgacttataaacagaggccgtacacatttttgctgccacgcaagtgtcacagcagcggagtgcagaatggtaaaatgtccacaaatggggtctcgaatggagtgtccaatgggttacatcttcactccaatggttttcggttgccagagtcaagagggcatgttagcccccaagtcgagctgcctccgtacctggaacgggtcaagcagcaggctaacgaggcgttcgcttgtcagcaatggacccaggccatccaactgtattctaaggcagtccagcgggcccctcacaatgccatgctgtacggtaatcgggcagcagcgtatatgaagaggaagtgggatggggatcactacgacgcactgagagattgtctaaaagccataagtcttaacccatgtcacctgaaggcacacttccgactagctcgttgcctctttgagttgaaatacgttgccgaggccctcgagtgcctagacgacttcaaaggcaagtttcctgaacaggcacactctagtgcatgtgacgctctgggacgcgacatcacagccgcacttttctctaagaacgatggcgaagagaaaaaaggaccgggcgggggtgcgccggttcggttgcggagtacttctaggaaagattctataagcgaggatgaaatggtgttgagagagaggtcttacgattaccagttcaggtattgcgggcactgtaacaccaccaccgacatcaaagaggccaatttttttgggtccaacgctcaatatatcgtgagcggatccgatgatggcagctttttcatctgggaaaaggaaactactaatctcgtgagggtccttcaaggtgacgagagcattgtgaactgcctgcagcctcacccgtcgtactgtttcctggccaccagtggtatagaccctgtggtgcggctctggaacccacgtcctgaatctgaggatttaactggcagagtggttgaagacatggagggggcatcccaggctaaccagaggcggatgaacgccgacccactcgaggtgatgctgctgaatatgggataccgaatcaccggattatcctcaggtggggccggcgccagtgacgatgaggactcatctgaagggcaagtccagtgtcgcccgtcttag

SEQ ID NO: 34760 - DNA, 1203 bp, Artificial Sequence
  Description of Artificial Sequence: Synthetic coding sequence
atggccgccgaaattcaacccaagccccttacccgaaagccgatattactgcagaggatggagggatcacaagaggtcgtgaacatggcagtaatagtgccaaaagaagaaggcgtgatctccgtcagtgaggacagaacagtgagggtgtggcttaagagagacagcggccagtattggccttccgtgtatcatgctatgccaagcccctgctcctgcatgtcattcaatcctgagacccggcgattatcaatcggcctggacaatggcacgattagcgagttcattctctccgaagattacaacaagatgacgccggtgaaaaactatcaagctcatcagagtcgggttacaatgatcctcttcgtgctcgagctggagtgggttctgagtaccggccaggacaagcagtttgcttggcactgttccgagagtgggcagagattgggagggtaccgcacaagcgctgtggccagcggtctccagttcgacgtcgagacgagacatgtcttcatcggcgaccactcagggcaagtaaccatcttgaagcttgagcaggaaaattgtacgctcgtgaccacattcagaggacataccggcggggtgacagcactgtgctgggatcctgttcaacgcgttcttttcagtggctcgagcgatcacagcgtgatcatgtgggacattggcggccgtaaaggtactgcaatcgagctgcaggggcataatgacagagtgcaggctctaagctacgcacaacacacacgtcaactgatcagctgcgggggagatggagggatcgtcgtgtggaacatggacgtggagaggcaggaaactccagaatggctcgacagcgactcttgccagaaatgtgaccaacccttcttttggaatttcaagcagatgtgggattcaaagaagattgggctgaggcaacaccactgtagaaagtgcggcaaagctgtctgtgggaagtgctcgtctaaacggagttcaatccctttaatgggattcgaatttgaagtgcgggtctgcgatagctgtcatgaggccatcaccgatgaggaaagggcacccacagccaccttccacgattccaagcataacatcgtccacgtacatttcgacgctactcgcggctggttgctaacctccggaaccgataaggtgatcaagctgtgggacatgacccctgtggtgtcatag

SEQ ID NO: 34761 - DNA, 1266 bp, Artificial Sequence
  Description of Artificial Sequence: Synthetic coding sequence
atggcctcttttcccccaagggtgaatgagaaggagatcgtgcgcctccgcacaattggtgaactactggcccccgccgccccttttgacaagaagtgtggtcgcgagaattggaccgtcgctttcgcacccgacggatcttactttgcttggagccaagggcatcgtacagtaaaacttgtgccctggtcacagtgcctgcagaactttctcctgcatgggacgaaaaacgttaccaactctagttctctgagactcccaaggcagaacagcgacggaggtcaaaaaaacaagcctcgcgagcacattattgactgtggggacatagtctggtccctggcctttgggtcaagcgtccccgagaaacagtctagatgcgtgaatatcgaatggcaccgatttcgatttgggcaggatcaactgcttcttgccactgggttgaataatggccggatcaagatctgggacgtctatactggtaaattgctgctcaacctggttgaccacacagaggtcgtcagagacctgacttttgcacctgatggatcgctaatcctggtttcagccagccgagacaagaccctgagggtgtgggacctgaaagatgacgggaatatgatgaaggttctgcggggccaccaaaattgggtgtattcatgcgctttctccccagactcctccatgctgtgctccgtgggagccagtaaggcagtgtttctgtggaatatggataaatatacaatgattcgtaaacttgaaggacaccaccatgacgtcgtcgcgtgcgactttagcccggacggggccctgttggctaccgcgtcgtacgacacgagagtgtacatatgggatcctcataatggagacattctgatggaattcggccacctgtttccaccccccacgccaatctttgctggtggtgccaacgatcgctgggtgaggagcgtatctttttctcacgacggcctgcatgttgccagtctggctgacgataaaatggttcggttttggaggattgacgaggattacccggtgcaggtggctcccttgtctaatggtctatgttgcgcgttctctactgacggatccgtgttagcggcaggcacccacgacggttcggtttacttttgggccactcctcgccaggtgccctctctgcagcatctctgcaggatgtcgatccgccgtgtgatgcccacgcaagaggttcaggagctgcccatcccctctaagctcttagagttcctcagctacaggatttag

SEQ ID NO: 34762 - DNA, 828 bp, Artificial Sequence
  Description of Artificial Sequence: Synthetic coding sequence
atggcatcctttccacctagagttaacgagaaggagattggaaagctgcttctgaacttggtggatcataccgaggtagtgcgggacttgacctttgccccagatggctccctgatcttggtttctgcatcccgagacaagacattgcgtgtatgggacctgaaggatgatggaaatatgatgaaagtacttaggggtcatcagaattgggtgtattcctgcgccttctctcccgatagctccatgctgtgttcagtcggcgcaagtaaagcagtgttcctatggaacatggacaagtacaccatgatccgcaaactggaaggccatcaccacgatgtggtcgcatgtgacttttcaccggatggtgctctgctcgctacagcctcctatgacacacgggtctatatatgggaccctcataacggcgacattctgatggagttcggccacctgttccctccccctacacccattttcgctggcggcgctaatgacagatgggtgagatcagtgagctttagccatgatgggctccacgtcgcgagcctggccgacgacaagatggtgagattttggagaattgatgaggattacccagttcaggtcgctcccctctccaatggactatgttgcgccttttcaacagacggctcagtgttagctgccggtacacatgacggctccgtgtatttttgggcgacaccccgacaggtgccatccctgcaacacctctgtcgcatgagtataagacgggtgatgccaacgcaggaagtgcaggagctgcctatcccgtcgaaactgctggaatttctttcctaccggatctag

SEQ ID NO: 34763 - DNA, 642 bp, Artificial Sequence
  Description of Artificial Sequence: Synthetic coding sequence
atggcatcctttcctcctcgggttaacgaaaaggagatcgatggctcatacttcgcttggtcacaaggtcataggactgtgaaacttgtgccttggagtcagtgcttgcagaacttcctgctgcacggcacgaagaatgtcacaaatagcagttctctgcggcttccaagacagaattcggatggtggacagaagaataagccccgagagcatatcatcgactgtggtgacatcgtttggagtcttgccttcggatcttcagtccctgagaagcagagtagatgcgtgaatattgagtggcatcgcttccgcttcggtcaagatcagcttctgcttgccaccggcttaaacaatggccgcatcaagatctgggacgtctacactggcaagctcctgctgaatttggtcgaccacacagaggtagtgcgggatcttactttcgctcccgatgggtccctaattcttgtttcagcctcccgagataaaacactaagagtctgggatctcaaagatgacggcaatatgatgaaggtactccgcggacaccagaattgggtgtactcatgcgccttcagcccagattcgtccatgctttgtagcgtgggcgcatccaaggcagtagtggccgctattctggtatag

SEQ ID NO: 34764 - DNA, 1215 bp, Artificial Sequence
  Description of Artificial Sequence: Synthetic coding sequence
atggaagctggtgaggaaccgctgctgcttgcggagttaaagccagggagacctcatcagtttgactggaagagcagttgcgaaacatggtccgtggctttctcccctgatggctcatggttcgcttggtcccaggggcactgcattgtcaagttgattccgtggcccctggaagaacagttcatccccaaaggttttgaggctaaaagtcgatcatccaagaacgagacgaaggggcgaggtagccctaaggagaagaccctggactgcggacagatcgtgtggggcctagccttttccccatggccatcaccaccaagtcgcaagctgtgggcaaggcatcatcctcaagtgccagatgtgagctgtctcgtcctggctacaggcctcaatgacggccagatcaaaatctgggaggtgcagaccggactcctgttactcaacctctccgggcatcaggacgttgtgagagacctgtcattcaccccatcgggcagtctaatcctcgtgtctgcatctagagacaaaactctccgcatttgggatctgaataagcatgggaaacagatccaggtcctaagcggtcacctccagtgggtgtattgttgctctatctcgccggactgctctatgttgtgctctgcagccggagagaagtccgtttttctgtggtctatgcgctcttataccctgatccgcaaactggagggacatcaatcgagcgtggttagctgcgacttctcgcctgacagcgcattgctggtgacggcatcatatgacacaaatgttatcatgtgggacccctatacaggggagaggctgagaagcctccaccacactcaggtggatccagcaatggacgacagcgacgtccacatctcaagcctgcggtctgtttgctttagtcccgagggcctgtacctggctacagtagccgatgatagactgttgcgtatatgggcgttagaactcaaaacacctatcgcctttgcccccatgacgaatggactctgttgcacgttctttcctcatgggggagtgattgccaccggcacaagggacggccacgttcagttttggacagcgcctcgggttctgtcgagtctgaagcatctctgccgtaaagcgttacgctccttcctaacaacttatcaggtgttggctctgccaattcctaaaaaaatgaaggagttcctcacctatcgtacattctag

SEQ ID NO: 34765 - DNA, 540 bp, Artificial Sequence
  Description of Artificial Sequence: Synthetic coding sequence
atgagatcttataccctgattaggaagctggaaggtcatcagtcttctgtcgtctcttgcgacttcagcccagacagtgctctgctagtgacagcctcctacgacacgaatgtaattatgtgggatccatacaccggagagagattaaggtcgcttcaccatacccaggtcgatccagccatggacgatagtgatgtgcatatttcctccttgaggtccgtttgctttagtcctgagggtttatatctcgcgactgttgctgacgaccggttgctccggatctgggcgctggagttgaaaaccccaattgcgttcgctccaatgaccaacgggctctgctgcacctttttcccccatggcggggttattgccacaggcacgcgcgacggccatgtgcagttctggacggctccgcgcgtcctgtccagtctcaagcacctgtgcaggaaggcattgaggtcgttcctgactacctatcaggtgctggccctcccgattcctaagaagatgaaagagtttttgacctatcggaccttttag

SEQ ID NO: 34766 - DNA, 585 bp, Artificial Sequence
  Description of Artificial Sequence: Synthetic coding sequence
atgctttgtagtgctgcaggagaaaagagcgtctttctgtggtcgatgcgttcctacacccttatccggaaacttgagggtcaccagagctctgtcgtctcatgcgacttttcccctgatagcgccctcctggtaaccgccagttacgacacaaatgtgatcatgtgggacccctacacaggggagcgactcagaagtctccaccatacacaggtggaccccgctatggatgactccgacgtgcatattagttctcttaggtctgtgtgttttagtcctgaggggctgtatctggcaactgtggcagacgataggctgcttaggatctgggctctggagctgaagactcccatcgccttcgctccaatgactaacggattatgttgcacatttttcccgcacgggggggtgatcgccactggcactcgggatggtcacgtccagttctggaccgcccccagggtgctgtcctctttgaagcacttatgtcgcaaagccctgaggtcatttttgaccacctatcaggttctggcgttacccatcccaaaaaagatgaaggaatttctcacctacaggactttctag

SEQ ID NO: 34767 - DNA, 1458 bp, Artificial Sequence
  Description of Artificial Sequence: Synthetic coding sequence
atggccgctgtgtggcaacaagtgctggctgtcgacgccaggtataacgcctaccgcacccccacttttcctcagtttaggacacagtatatccgcagacggtcccagctgctaagagagaatgcaaaggccggacatccccctgccctgaggcggcagtatctcaggttgcgaggccaactcctaggacagagatacgggcccctaagcgaacccggtagtgctcgcgcctacagtaacagcattgttaggtcctctcgaaccaccctggatcgtatggaggatttcgaggatgaccctagggcccttggagccagaggccatcgccgctctgtgagccggggctcataccaactccaggcccaaatgaatcgcgccgtctacgaggaccggccccccgggtcagttgttcctacttccgctgcagaggctagcagagccatggccggggacactagcttgtccgaaaactatgccttcgcagggatgtaccacgtattcgatcaacacgtcgatgaggcagtgccccgggtgcggtttgccaacgatgaccgccatcggctcgcatgttgtagcctcgatggctctatctcattgtgtcagttggtgcccgcgcctcctaccgtcttaagagtcttgagaggccacaccagaggagtgtctgacttcgcctggtccctctcgaatgatatcctagtcagtacgtctctagatgccactatgagaatctgggcatctgaggatggccggtgtattcgagagattcccgatcccgacagtgccgagctgctatgctgcacatttcagcccgtgaacaacaatttgactgttgtggggaatgcaaaacataatgtccatgttatgaacatatccactggcaagaaggtgaaagggggctcctctaagttgacgggcagggtcctagccctgtctttcgacgctccaggccgcctgctttgggccggcgacgatcacgggtcggtgttttcatttctgtttgacatggccactggcaagctgaccaaggccaaaaggctggtggttcacgaaggtagccctgtgacatctatatctgcccggagctgggtgagccgggaagcgcgagaccccagtcttctgatcaacgcgtgtctgaataaattgttgttgtacagggtcgtggataacgagggaaccctgcagttaaagagaagttttccaatagaacagagttctcacccagtgcgctcaattttctgccccctgatgagctttaggcagggtgcttgcgtggtgaccgggagtgaagacatgtgcgtacatttctttgacgtcgaaagagctgcgaaagcagctgtcaataagttacagggtcattctgctccggtcctcgatgtcagtttcaactgtgacgaatcactgctggccagttccgatgcttctgggatggtcattgtctggaggcgcgagcagaaatag

SEQ ID NO: 34768 - DNA, 1299 bp, Artificial Sequence
  Description of Artificial Sequence: Synthetic coding sequence
atggccgctccaatggaagtggcagtgtgtaccgactcagccgcaccaatgtggagttgtatcgtgtgggaactgcactcaggagcaaacttgcttacctaccggggcggccaggcaggtcccagagggcttgctctcctcaatggcgaatatctgctggcagcccagctgggcaagaactatatcagcgcctgggagctgcaacgcaaagaccaactccagcagaaaatcatgtgcccgggccctgtgacctgtctcacagccagccccaacggcctctacgtgctggccggcgtagccgagtctatccatttgtgggaggtgtctacaggaaatctacttgtgatccttagcagacattatcaggacgttagctgtctgcagtttacgggggattcctcccacttcatttcaggcggaaaggactgtcttgtcctggtctggtcactttgcagcgtgttgcaggccgacccttcccgtattcccgcccccaggcacgtgtggtcgcaccacgcgctgcctatcaccgacctccactgcgggtttggcgggcccctagcacgggtcgctacctcctctctggatcagactgtcaagttgtgggaggtctccagcggcgaactactgctcagtgttcttttcgatgtctctatcatggctgtgaccatggacttggccgaacaccacatgttttgcggcggaagtgagggctcaatttttcaggtggatctttttacatggccaggacagcgcgagcggagcttccaccccgaacaggacgccggaaaggtgtttaagggtcaccggaatcaggtgacatgcctgtccgtctctactgatggctccgtgctgctgtccgggagccatgacgagaccgtccggctctgggatgttcaaagcaaacaatgcataagaacggtggcccttaaagggcctgttacaaatgccgcaatcttgctggcgcctgtcagcatgctgtcatccgacttcaggccatctctgccactcccgcacttcaacaagcacctacttggcgccgaacatggtgatgagccacgccacgggggtcttactctgcgtttagggcttcatcagcaggggtcagagccctcgtacctggatcggacagaacagttgcaagccgtcctctgttcgactatggaaaagtctgtcctggggggccaggaccagctgcgagtcagagtcacagagttagaggacgaggtgcggaacttaaggaagatcaatcgcgatctgttcgacttttcaacacggtttattaccaggcctgccaaatag

SEQ ID NO: 34769 - DNA, 1746 bp, Artificial Sequence
  Description of Artificial Sequence: Synthetic coding sequence
atggctacggaggggggcggcaaggagatgaacgagattaagacccagttcaccaccagggaaggcctttataaactcctaccccacagcgagtacagcaggccaaacagggttcccttcaattctcagggtagtaaccccgtgcgtgtgtccttcgtcaatctgaatgaccagtcgggaaatggtgaccgcctgtgtttcaatgtcgggagggagctgtatttctacatttataagggagtaaggaaagccgcagatctgtccaagccaattgataaacgcatctacaagggaacccagcccacctgccatgattttaatcatctgactgctacagcagaatctgtaagtctcctggtgggcttctccgccggacaggtgcagctcatagaccctatcaagaaggaaaccagcaaattattcaatgaagagaggcttatagataagtcacgagtgacgtgcgtgaagtgggttccagggagtgagtccttatttctggtagcgcatagtagcggcaacatgtacctgtataatgtagagcacacctgtggtactacagcccctcactatcagctgctgaagcagggcgagtctttcgccgtgcacacatgtaagtcgaagtctactcggaatcctcttctaaaatggacggtaggggagggggctctaaatgagttcgctttcagccccgacggcaaatttctcgcttgcgtcagccaggacggctttctcagagtgttcaacttcgacagtgtcgagctgcacgggactatgaaatcatactttggtgggctgctgtgcgtttgctggtcgcccgacggcaagtatatcgttactggaggggaggacgatttagtaacagtgtggagttttgtcgattgcagagttatagcgcgaggacacggacataaatcttgggtttcggtagtcgctttcgacccttatacgacctctgttgaagagggcgaccccatggagtttagcgggtcggacgaagactttcaagatctcttgcactttgggcgcgaccgcgccaattccacacaatccaggttatctaagaggaacagtaccgattccagacctgtatccgtgacctataggtttggcagtgtggggcaggatacgcagctctgcctctgggatctgaccgaggacatcctgttcccacaccagcccctcagtcgcgctcgaacccatacaaatgtcatgaacgccacctctccccccgcaggctcaaatgggaacagcgtgacaacccccggcaatagcgtgcctccacctcttcccaggagtaatagtctcccccactctgcagtctctaacgccggttctaaatccagtgttatggacggcgctatagccagcggtgttagcaaatttgctacactgtctttgcacgatcgcaaagaacgccatcacgaaaaagatcacaagagaaatcactccatgggacacatctctagcaagtcttctgacaaattgaatctcgtcactaagacaaagacagaccccgccaagaccctgggcacacctctgtgcccaagaatggaagacgtgccactgctagaacccttgatatgcaagaaaattgcgcacgagcggcttactgtgctgatttttttggaggactgcattgtgactgcctgccaggagggctttatctgtacttggggcagaccaggtaaggtgggctctctcagctctcccagccaagcctcctcacccggaggcacagtagtctag

SEQ ID NO: 34770 - DNA, 1710 bp, Artificial Sequence
  Description of Artificial Sequence: Synthetic coding sequence
atggctacagagggcggtggaaaggaaatgaatgaaatcaagactcagttcaccacgcgtgaaggactatataagctgctcccccactctgaatactcacgcccaaaccgagtgccctttaacagtcagggctcaaacccagtccgggtctctttcgtcaatctgaatgaccaatctggcaatggggataggttgtgtttcaacgtaggtagagagctttatttctacatttacaagggagtgcgcaaggctgccgacctctcaaagccaatcgataagcggatttacaagggcacacagccaacctgccacgacttcaaccatttgactgcgaccgctgaatctgtgagtctgctggtggggtttagcgcaggacaggtgcaattgatagaccccataaaaaaagagactagcaagctatttaacgaggagcgcctcattgataagagccgagttacctgcgtcaaatgggttcccgggagcgagtcccttttcctggtagcccattcctcaggcaacatgtacctgtacaacgtagagcacacatgtggaaccaccgcgcctcattaccagctgctgaagcaaggcgaaagcttcgccgtccacacgtgcaagagtaagtccaccagaaatcctctcttgaagtggaccgtgggcgaaggcgccttaaacgaattcgccttttcccccgatggaaaattcctggcatgcgttagtcaggatgggttcctgagggtgtttaattttgattctgtcgaactgcacggaaccatgaagagctatttcgggggcttgctgtgcgtgtgttggagcccggatggcaaatacatcgtgaccgggggagaagacgatctggttactgtttggtcattcgtggactgtcgcgttattgcccgcgggcacgggcacaaatcgtgggtgagtgtagtggctttcgacccctataccacaagtgtggaggagggggacccaatggagttcagcggtagtgatgaggacttccaggatctgctgcacttcgggcgcgatagggcaaatagcacccagagtaggctctccaaacgaaattctacagattctaggcccgtgagtgtcacctaccggttcgggtccgtggggcaggacacacagctatgtctctgggatctcacggaggacattcttttcccccaccaaccactgagtcgggcaaggactcatacaaacgttatgaacgccacttctccacccgccggtagtaacgggaattccgtgaccacacccggcaactctgtaccacctccactgcccaggtctaattcgttgccacactccgctgtgtccaacgccggctccaagagttcagtaatggatggggccatcgcatctggagtgtctaagttcgccactctatccctgcacgatcgcaaagaaaggcatcatgagaaagatcataaacgcaatcatagcatggggcacattagtagtaagtctagcgataaactaaatctggtgactaagaccaaaactgatcccgctaagactctgggtacccccctttgcccgaggatggaagacgtcccactcctggagcctctgatctgtaaaaagattgcgcatgaacgcctgaccgtgttgatatttctcgaggattgcattgttactgcttgccaggaagggttcatctgcacctggggcaggcctggcaaggttgtgtcctttaacccctag

SEQ ID NO: 34771 - DNA, 1536 bp, Artificial Sequence
  Description of Artificial Sequence: Synthetic coding sequence
atgaatgagattaagacccagtttacaacccgcgaaggcctgtacaagctgctcccccactctgaatactcccgcccaaaccgagtgccctttaacagccaggggagcaatccagtgagggttagtttcgtcaatcttaacgaccagtccggcaatggggatagactctgcttcaatgtgggacgggaattgtacttttacatctacaagggagtgcgcaaaaggctgattgataagtccagggtgacctgcgtgaaatgggttcccggcagcgaaagcctcttcttggtcgctcactctagcggtaatatgtatctgtataacgtggagcacacttgcggaacgaccgctccccactatcagttgttgaagcagggtgagtctttcgcggtccacacctgtaaaagtaaatccacccgcaatcctctgcttaaatggaccgtgggcgaaggagctctcaacgaattcgcatttagtcctgacgggaagtttctcgcctgcgtgtcacaggacggtttcctccgggtttttaatttcgattccgttgagctccatgggacgatgaaatcctattttggcggtctcctgtgtgtgtgctggtcacctgatggcaagtacattgtgaccggtggggaagacgacctcgtcacagtgtggtccttcgtagactgtagagtcattgcacggggccacgggcataagtcttgggtaagcgtcgtcgcgttcgacccttacacaaccagtgtcgaggaaggtgatcctatggaattcagtggctccgatgaggatttccaggacctgctgcacttcggtcgtgatagggccaatagcactcagtcgcgcttgtcaaagagaaattctactgactctagacccgtttcggtcacctatcgttttggctccgtcggacaagacactcagctctgtttatgggatctgaccgaggatatactttttcctcaccagccactgagtcgggccaggacccacacgaacgtcatgaatgccacctctcctccggccgggtctaacggcaatagtgtgaccacccctggtaattccgtccctcctccccttcctagaagcaactcgctacctcattcagcggtatctaatgcggggtccaagagttccgtgatggatggcgcaatcgcctccggtgtatcaaaattcgccactttgtcattgcatgaccggaaggagcggcatcacgagaaagaccataaaagaaaccatagtatgggccacatcagctcaaaatcgtccgacaagctgaatctcgtgaccaagacaaaaacagacccggcgaaaacactgggcacaccactgtgcccacgcatggaggatgttcctctgctggaaccccttatctgcaaaaagattgcccacgaacgtttaaccgttctgattttcctggaagactgtatcgtgaccgcgtgccaagaggggttcatctgcacatggggtcggcctgggaaagttggatccttaagcagcccgagtcaggccagctctccaggtggcacagtggtgtag

SEQ ID NO: 34772 - DNA, 1338 bp, Artificial Sequence
  Description of Artificial Sequence: Synthetic coding sequence
atgtgggcaggtagctgtacaagcatctctacgcgcggtagtgctcggcagtcccatgagcggctcatcgataagtcaagagtgacctgtgtcaagtgggtccctggatccgaatcactgtttctggtggcccacagcagtgggaacatgtacctgtacaacgtagagcacacatgcggaacaacagcgccccactatcagctgctgaagcagggcgaatccttcgcggtacatacatgcaaaagcaagtcaactagaaatcctctcttgaagtggacggtcggggaaggagcactgaatgaatttgcgttctcacctgacgggaaattcctggcttgtgtctcccaggacgggttcttaagagttttcaacttcgattccgtggaattgcatggcacaatgaagagttattttggcggactgctgtgcgtgtgctggagccctgatggtaagtacatcgtgaccgggggagaggacgatctggtcacagtgtggagctttgtggattgtagggtgatagcccgcggccacggccataaatcctgggtttcagtggttgcctttgatccctatacaaccagcgtggaggagggcgaccccatggaattttccggaagcgatgaagactttcaagatctgttgcacttcgggcgtgatagagccaatagcactcagtcgagactgtctaagagaaactccaccgatagcagaccagtttcagtgacctataggttcggatccgtcggccaggacacgcagttgtgtctgtgggatctgacagaagacattctattcccacaccaacccctgagccgtgcccgcactcataccaatgttatgaacgccacaagtccccctgctgggtctaatgggaacagtgtgacaacaccgggcaactcagtacccccacccctcccgcgcagcaattccctgccccattccgccgtgagcaatgcaggaagcaaatccagcgtcatggatggggcaattgcctcaggtgttagtaagtttgcaactctcagtctccacgacagaaaggagagacaccacgaaaaggaccacaaacggaaccacagtatgggccatattagctctaagagctcagataaacttaatctcgtaacaaagacaaaaaccgatcccgcaaaaacactgggcaccccactgtgtcctcgcatggaagacgtgccattactggagccactcatttgtaaaaaaattgcccatgaacggctgactgtgctcattttccttgaggactgtatcgtcaccgcctgtcaggagggctttatatgtacctggggacgcccaggaaaagtcgtttccttcaatccatag

SEQ ID NO: 34773 - DNA, 1803 bp, Artificial Sequence
  Description of Artificial Sequence: Synthetic coding sequence
atggccaccgagggaggtggcaaggaaatgaacgagattaagactcagttcacaaccagagagggactttataaacttctcccgcactctgagtactcacgccccaatagggtcccttttaattctcagggatccaaccccgtcagggtgtctttcgtcaatttgaatgaccagagcggcaatggcgataggctttgttttaatgtgggacgcgagttatatttttacatttataagggggtgcgaaaggccgctgacctgtcaaagccaattgataaacgcatctataaaggcacacaacctacatgtcatgacttcaatcatctgaccgctaccgcggagtctgtgtctctgctagtcggattttccgctggacaggttcagctcattgaccccattaaaaaggagacatccaaactgttcaacgaagagaacagctgtcagcatctgtggaaagtagattggaacgaggaacgccaaaatgaagggagcaaaacatccgaggaggcacttgtgacagtgcagcgccttattgacaagtcacgcgtgacatgcgtcaagtgggtgcccggaagcgagagtctctttctggtagcccatagctcaggtaacatgtatctgtataatgtcgaacatacttgtggaacgacagcaccacactaccaacttctgaagcagggggaaagtttcgcggttcatacatgtaagtccaagagcacacgcaaccctctcttgaaatggactgtgggagagggggccctgaacgagttcgcatttagtcccgatggtaaatttctggcctgtgtttcgcaggacggctttttgagggtgttcaacttcgatagcgtggagctgcacggaaccatgaagtcctacttcgggggactcctgtgtgtctgctggagtcctgacggaaagtatatcgtgaccggcggagaggatgacttggtcacagtgtggtccttcgtagactgcagggtgatcgcaaggggtcatggtcataagtcctgggtcagcgtggtggcgttcgacccctacactacgtccgtggaggagggagaccccatggagttttccggctcagacgaggacttccaggacctcctgcacttcgggcgcgatagagccaacagcactcagagtagactgagcaaacggaatagcacagactctcgaccagtaagcgtcacttatagattcggttccgtgggacaggacactcaactgtgcttatgggacctcactgaagacatcctgttcccccatcagcccctgtcccgagcccgtacacacacaaatgtcatgaatgccacttctccacctgcaggaagcaatggcaacagtgtgaccacccccggaaattccgttcctccgccccttccaagatccaattctctcccacattccgcagtgtccaatgcgggatctaaatcttcggttatggatggggctatcgcttctggggtcagcaagttcgctactttgagcctgcacgaccgtaaagagagacaccatgaaaaggaccacaagagaaaccatagtatggggcatattagttcaaagtcctctgataagttaaacctggtaactaagacaaaaactgacccggccaagaccttgggaacccctctttgcccgaggatggaagatgttcctttgctcgagcctctcatctgtaaaaagatagctcatgagaggctgaccgtactgattttcttggaagactgcatcgtgactgcatgccaggagggatttatatgtacctggggacgccccggtaaggttgtaagtttcaatccctag

SEQ ID NO: 34774 - DNA, 939 bp, Artificial Sequence
  Description of Artificial Sequence: Synthetic coding sequence
atgaagagttatttcggaggattgctgtgcgtgtgctggtctccggatggtaaatatattgtgacaggaggcgaagacgatctcgttactgtttggagtttcgtggactgccgggtgatcgctcgaggtcacggccacaaaagttgggtcagtgttgtagcattcgacccgtacacaaccagtgttgaggaaggagaccctatggaattctcgggttcggatgaagatttccaggaccttctccactttggaagagatcgtgccaactccacacaaagcaggctgtcgaaaagaaactcgactgacagtcggcctgtttctgtgacctaccgcttcggctctgtgggacaagacactcagttatgcctttgggacctgacggaggatatcctgtttccacaccagccgttgtctcgcgctagaacgcataccaacgtgatgaacgcaacgtctccgccagccggtagcaacggtaactctgtgacaaccccaggaaacagcgtgcccccccctctcccccgatccaattccctgccacactctgctgtgtcaaatgcagggagcaagagttccgtgatggacggagccattgcaagcggcgtcagcaaatttgccacattgtcattacatgatcgtaaggagaggcaccacgagaaagatcacaaacgtaatcactcaatgggccacatctcctcgaagtcatccgataagttgaacttggttacaaagacgaagaccgaccccgcaaaaacattgggaacacctctctgcccacgcatggaggacgtgcccttgcttgaaccactgatttgtaagaagattgcacacgaacggttgaccgtgcttattttccttgaggattgtattgttactgcatgccaggaaggatttatttgtacctggggaagaccaggtaaggtggtgagctttaatccttag

SEQ ID NO: 34775 - DNA, 1191 bp, Artificial Sequence
  Description of Artificial Sequence: Synthetic coding sequence
atgtacctttacaacgtggagcacacatgtggtacgaccgcgccccattaccagcttctgaagcagggcgaatccttcgccgtgcacacgtgtaaatccaagagcacaagaaacccactgttgaagtggactgtgggagaaggagcgcttaacgaattcgcgttctctcctgacggtaaattcctagcatgtgtgtctcaggatgggttcctgcgggtattcaattttgacagtgttgagcttcacggcactatgaaaagttacttcggggggctcctgtgcgtctgttggagcccagacggcaaatatatcgttacaggaggcgaagacgacctcgtgaccgtttggtcatttgtggattgcagggtgatagcaagggggcatgggcataaatcatgggtgtctgtggtcgcttttgacccttacactaccagtgttgaggaaggggatcccatggagtttagcggttcagatgaagattttcaagatcttctgcattttggaagagatcgggcgaatagcacacagagcaggctgtccaagcggaattctactgatagcagaccagtcagtgtgacctacagattcggctccgtcggccaggatacccagctgtgcctgtgggatctcaccgaggacattttgttcccacatcagccgctgtcccgggcaaggacacacacaaatgttatgaacgctacttcgccccctgcggggagcaatggcaattctgtgacgaccccagggaacagcgtgcctccaccactgcctcgaagcaacagcttgcctcacagtgccgtgagcaacgcgggatccaagtcatctgtgatggacggagcaattgcttccggcgtatccaaatttgctacactaagcctgcacgacagaaaggaacggcatcacgaaaaagatcataaaaggaatcactccatgggacacatcagctctaaaagcagtgataaactgaacttagtcactaaaactaagactgacccagccaaaactctggggacgccattatgtccacggatggaggatgtacctctcctcgagcctctgatttgcaagaaaattgcacatgagcggctgaccgtcctgattttcctcgaagactgtatagtcaccgcgtgtcaagaaggtttcatttgcacatggggcagaccaggcaaagtcgtgtccttcaatccatag

SEQ ID NO: 34776 - DNA, 1527 bp, Artificial Sequence
  Description of Artificial Sequence: Synthetic coding sequence
atggccaccgagggaggcggtaaagagatgaacgaaattaaaacccagttcaccacacgcgagggcctctacaaactgctaccccactcagagtactccagacctaacagggttccgttcaacagtcagggcagcaatcctgtgagagtttcctttgtgaatctgaatgatcagagcggcaatggagacagactttgtttcaatgtgggacgagagctgtatttctatatctataagggcgtacgcaaacgcctcatcgataaatctagagtcacttgcgtgaaatgggtacctggctccgagagtctgtttctggtagcccattcctcggggaatatgtacctgtacaatgtggaacatacttgtggaactaccgccccccactaccagctcctcaaacagggcgagtcattcgccgtccatacttgtaaatccaaatcaacaagaaaccccttgctaaaatggacggttggtgagggggccctcaacgagttcgcgtttagtcccgacggcaaatttttggcttgcgtatctcaggatgggtttctccgcgtttttaattttgactcagtagagcttcacggcacgatgaaaagctattttggtgggctgctgtgcgtttgctggagccctgacggcaaatacatcgtgacagggggagaagatgacttagtgactgtgtggagctttgtagactgccgggtgatcgcacgcggccacggccataagtcatgggtgtctgtggtagccttcgacccctatactacctcagtcgaagaaggagaccctatggaattctccggctcggacgaggatttccaggatcttttgcacttcggacgggatcgggccaattcgacgcagtcgcggctcagtaagaggaattccactgacagccgaccagtgagtgtcacctacagatttggtagcgtgggacaggatacccagttgtgcctttgggatcttacggaggacatcttgttcccccaccagccgctttcacgagcccgcacgcacacaaacgtgatgaatgcaacaagccctccagccgggtccaatggcaattcggtgacgacccctggcaactccgttcctccaccgttgccacgttcaaattcactgccccacagcgctgtctccaatgcaggcagcaaaagctcagtcatggacggggccatcgcctctggcgtgagtaaattcgcgacactctcacttcacgacagaaaggagcgtcatcacgagaaggaccacaaaagaaatcattctatgggtcacatttcaagcaagagttctgataaacttaaccttgtcacaaagactaaaacggatcccgctaagacccttgggacacctttgtgcccacgcatggaggatgttccattgctggaacccctgatctgtaagaaaatagcacacgaaaggctgacagttcttattttcctggaagactgcattgtcacagcctgccaggaagggtttatctgtacctggggaaggcctggcaaggtggtgagcttcaacccatag

SEQ ID NO: 34777 - DNA, 588 bp, Artificial Sequence
  Description of Artificial Sequence: Synthetic coding sequence
atggctacagagggcggggggaaggagatgaatgagatcaaaacccaattcacaaccagggaagggttatataaactacttccacattcagagtacagtcgacccaaccgcgttcccttcaacagccaagggagcaacccagtgagagtttccttcgtgaacttgaacgaccaatctgggaatggcgatagactgtgtttcaacgtagggcgggaactttacttttatatttacaaaggcgtgagaaaagccgccgacctctccaagcccatagacaaaagaatctacaaaggcacccagcccacctgtcatgacttcaatcatttgaccgcaacagcggagtcagtatccctgctggtcggattctcagcgggacaggtacagctgattgaccccataaagaaagagactagtaagcttttcaacgaagagaactcttgtcaacatctctggaaagtggactggaatgaggagaggcaaaacgagggctcaaagacttcagaggaggcactggtgaccgttcaaccagccgagcacttttgtcggcaagaggaccgcatgcagggggtgctgcaggatcagaactag

SEQ ID NO: 34778 - DNA, 1563 bp, Artificial Sequence
  Description of Artificial Sequence: Synthetic coding sequence
atggctactgaggggggcggcaaggaaatgaacgaaatcaagacacagttcaccaccagagagggattgtataaacttcttccacattccgagtatagccgaccaaacagagttccctttaactcgcagggcagcaatcctgtacgcgtctcattcgttaacctcaacgaccagtcaggtaacggcgaccgactctgtttcaacgtgggtcgggagctgtatttctatatatacaagggcgttcgcaagagacttatcgataagagcagggtcacatgtgtcaaatgggttcctggaagcgaatccctgttcctggtggctcacagctctggaaatatgtatctgtacaacgtagagcatacatgcgggacaacggcacctcactatcagcttctgaaacaaggggaaagctttgccgtgcatacctgtaagagcaagagcacccgcaaccccttgctgaaatggactgtgggtgaaggtgctttgaacgaattcgcgttctcacccgacggaaagttccttgcgtgcgtttctcaggacggcttcctgagagtatttaactttgacagcgttgaacttcacggtactatgaaatcgtatttcggggggctgctatgtgtttgctggtctccagatggcaaatatatcgtgacaggaggagaggatgacctggttacagtctggtctttcgtggattgcagagtgattgctagaggtcatggacacaaaagctgggtttccgtggtagccttcgacccgtatacaactagtgtggaggagggcgatccaatggagttcagcggatcggacgaggacttccaggatctcctccactttggcagagatagggctaatagcacccagagtcgactgagcaagcgaaattccactgacagccgcccagtgtcggttacttacaggtttggaagcgttggacaggatacccagctttgtttgtgggatctaacggaagacattttatttccccaccaacccttatctagggctaggacacatacgaacgtaatgaatgccacctctccacccgccggaagcaacggcaattccgtgacaacaccagggaacagcgtgcccccgcccttgccacgatctaattctctgccacacagtgccgtgtccaatgctgggagcaaatcttctgtaatggacggcgccatcgcaagtggcgtgagtaagttcgccacactctctcttcacgaccggaaggagaggcaccacgagaaagaccataagcggaatcatagtatgggtcatatcagtagtaagtcttccgacaaacttaacctggtcacaaaaacaaaaacagatcccgctaagaccctgggaactcctctgtgcccaagaatggaagatgtccctctacttgaaccactgatctgtaagaaaattgcacacgagaggctgactgtgctgatctttttggaagactgcatagttacagcatgccaggaaggctttatatgtacatgggggagacctgggaaggtaggatcactttcctctcctagtcaggctagcagtcctggaggaacagtggtgtag

SEQ ID NO: 34779 - DNA, 2763 bp, Artificial Sequence
  Description of Artificial Sequence: Synthetic coding sequence
atgggcaagaagcgaactacaagcggcgaagggcgggaacggcagcggctgcctgctcggaggtttcggacgaccagccctgcggctctacgcgccgactcagtagatggcggatccctgctggcgccactcttagggctgaccgaccgcgcatttagcgactgtccggatctagccgacggcgcgatggagaagatgagtcgcgtgaccacagccctaggaggctccgtgttaacaggtcgtacaatgcattgccatctggatgcccccgccaacgccattagcgtgtgccgcgacgccgcccaggttgtcgtcgctggacggagtatatttaaaatctatgcaatcgaggaagaacaatttgtcgagaagctgaatctgagggtggggaggaagccctcactcaatttgtcctgcgcagacgtggtttggcatcaaatggacgaaaacctgcttgcaactgctgctacaaacggtgtggtggtgacttggaacttgggaagaccgtccaggaacaagcaggatcaactttttaccgagcacaaacggacagtgaacaaagtgtgcttccatccaaccgaagctcacgtgttgctgtctggttctcaggacggattcatgaagtgtttcgacctgcgaaggaaagactcagtcagtaccttcagcggagaagcgacagaggcgggaccaagagagtgggctatggcaggctgtgtccccatcttacccgtgctaagctgtcggattttacggctgcaccacagcttcgcccatgggccaatgcaagacgccgagtctacagctaatgacgccagggaaagttggggatgcccactgtatccgctaggcctgtgcagcggacctcaggcaggtcaaagtgagagcgtccgggacgtgcagttctcgatccgtgactattttacctttgcgtcaacctttgaaaatggcaacgtgcagctctgggatatccgaagaccagatagatgcgaacgcatgtttactgctcacaatggccccgtgttctgctgtgattggcaccccgaggaccgggggtggctggcgactggcggtagggacaagatggttaaggtgtgggacatgaccacacatcgcgctaaggagatgcactgtgtgcagactattgcttcagtggcgagagtcaagtggcgcccagaatgcagacatcatttggccacctgctctatgatggtcgaccacaacatttatgtctgggatgttcgcaggccttttgtgcctgccgctatgttcgaggagcatcgcgatgtaacaaccgggatcgcatggagacatccccatgatccttcatttctgctcagcggatcaaaagacagctctctgtgtcagcacctcttcagagatgcgtcacagccagtagagcgcgcaaaccccgaaggattgtgctacggactttttggggaccttgcgtttgccgccaaggagagtctcgtggcagcagaaagcggacgcaagccttacaccggtgataggaggcacccgatcttttttaaacgaaaattggaccccgccgaacctttcgcagggctcgcctcaagcgccttgagcgtgttcgagaccgagccaggcggtggcggtatgcgctggttcgtagacacggcagagcgctatgctcttgcaggacgcccactggccgaactctgtgatcacaacgctaaggtcgctcgtgagctgggaagaaaccaggtagctcaaacatggactatgctacggatcatctattgttctcccggactagtgcctaccgccaatctgaatcacagcgtgggaaagggtggcagttgcgggctgcctctgatgaacagtttcaacctcaaagacatggctccggggctgggtagtgagaccaggttagacagatccaagggcgatgcccggagcgacacagtactgctggacagcagtgccacattaattaccaacgaggataatgaggaaactgagggatctgacgtgcccgcagattatctgcttggagatgtagagggtgaagaggacgagctatatcttctggatccagaacacgcacacccagaggatccggagtgcgtcttgccccaggaagcctttcctctgagacatgaaatcgtggacacgccgccaggtccggaacaccttcaggataaggccgactccccacacgtgtcagggagcgaggcggatgtggcttcactggctcctgttgactctagtttctcactactgagcgtctcacacgccctgtacgactctaggcttccccctgattttttcggagtgcttgtgcgcgatatgcttcatttctacgccgagcagggagacgttcagatggccgtgagcgtcctgattgttttgggggagcgggttaggaaggatatcgacgagcaaacccaggaacactggtacacaagttatatcgatctcctccagcggttcagattatggaatgtaagtaacgaagtggtaaagcttagcactagccgggccgtaagctgcctgaatcaggccagcaccactctacacgtgaattgcagtcactgcaaacggcctatgagcagccgcggatgggtgtgtgaccggtgccacagatgtgcatctatgtgcgccgtgtgtcatcacgtggtcaaaggcctctttgtttggtgccaaggttgctctcatggaggtcatctccaacacattatgaagtggttagagggatcctcacattgtcccgccgggtgcggacatctctgtgagtattcctag

SEQ ID NO: 34780 - DNA, 2373 bp, Artificial Sequence
  Description of Artificial Sequence: Synthetic coding sequence
atggagaaaatgtcccgggtgaccaccgccctgggtggctctgtactgaccggcagaaccatgcactgtcaccttgacgctcctgccaatgctatctcagtgtgccgcgacgctgcccaagttgtggtggctgggcgcagcatctttaagatttatgccatcgaggaggagcagtttgttgagaagttgaatctgcgcgtgggacggaagcctagcctgaacctatcatgcgcagatgtggtttggcaccagatggatgaaaatttgctggccacagccgctacgaacggggtggttgtgacatggaatctgggcagaccctcccgcaacaaacaagatcaactgttcaccgagcacaaacggacggtcaacaaagtgtgttttcatccaactgaggcccacgtcctattgagtggctctcaggatgggtttatgaagtgcttcgacctgcgcaggaaggattccgtgtccacgttcagcggccaatcggagagtgttagagatgtgcagtttagtataagggactacttcacttttgcatctacatttgagaatgggaacgtccagttgtgggacattaggagacccgatcggtgcgagcgcatgtttacagcccataacggccccgtgttctgctgcgactggcatccagaggatcgtgggtggctggcaaccggggggcgagacaagatggtgaaggtttgggacatgaccactcatcgggccaaggagatgcactgtgtccagaccattgcctccgttgccagggtgaaatggcgccccgaatgcagacaccacctggctacttgctccatgatggtggaccataatatctatgtttgggacgtgaggaggccttttgtaccagccgctatgttcgaggaacaccgagatgtaaccacaggtatcgcttggcgacacccacacgatcctagttttttacttagtgggtccaaagatagcagtctctgccagcatctattccgggacgcttcgcaacccgtagaaagggcaaatcccgaaggactctgttacggattgtttggggacctggctttcgccgcaaaagaatctttggtggctgccgaatctggccgcaagccgtataccggagatcgccgccatccaatctttttcaaaagaaaactagatcctgctgagccctttgccggtctggcgtcctctgccttatccgtgttcgagaccgaaccaggtggcggtggaatgaggtggtttgtggatactgctgagagatatgccctggcagggagacctctggccgagctctgcgatcataatgcaaaggtggctcgggaactgggcagaaatcaagttgctcagacttggaccatgctccggatcatttattgttccccaggcctggtacctactgctaacctcaatcactctgtaggaaagggggggtcatgcggtttgccgctgatgaattctttcaatctgaaggacatggcccccggcttaggctctgagacacgtctggatcggagtaagggggatgcgaggtctgacaccgtcctgctggactcctctgcgaccctgataacgaacgaggacaacgaagagaccgaagggtccgatgtcccagccgattatctgctaggcgacgtggagggggaagaagatgagctctacctactagacccagaacatgcccacccggaggaccctgagtgcgtcctcccccaggaagcctttcccttgaggcacgagatcgtggacacccccccaggccccgagcatctgcaggacaaggccgacagcccccacgtcagcgggagtgaggccgatgttgcctctcttgcccctgtggactcaagcttctcccttttgtccgtaagccacgccctatatgactctcgacttccccctgattttttcggcgtgctcgtacgggacatgcttcacttctacgccgaacagggtgatgtccagatggccgtcagcgtcttgattgtactcggagagagagtacggaaggacatcgacgaacaaactcaggagcactggtatacttcctatattgatttactgcaacgtttccgattgtggaatgtatcaaatgaggtcgtgaagctctccacctctcgcgctgtatcctgcctcaaccaagcttcaacgacattacacgtgaattgcagccattgtaagcgcccaatgtcctctcgtgggtgggtgtgtgataggtgccaccgttgcgccagcatgtgcgctgtgtgccaccatgttgttaaggggttattcgtgtggtgccagggctgttcgcacggtgggcatctccaacacataatgaaatggttggagggaagttctcattgtcccgcggggtgtgggcatctctgtgagtacagttag

SEQ ID NO: 34781 - DNA, 1635 bp, Artificial Sequence
  Description of Artificial Sequence: Synthetic coding sequence
atgaccgcaagaacactgtccttgatggctagtctggtggcatacgatgatagtgattctgaggccgagaccgagcatgcaggaagctttaacgccactggtcaacaaaaggatacatccggtgtggcaagacctcccggccaggacttcgcttcgggcacactggatgtgccaaaggcaggagcccaaccgacgaagcatggctcttgcgaggatcccggcggctaccggttgcccttggctcagctgggccgaagtgattggggttcctgtccctcacagcgcctgcagtggcccgggaaggaacctcaggtgacgttcccaattaaagagccatcttgctcctcactctggacttcccatgtcccagcctcccatatgccactggccgccgcccgttttaaacaagtcaagctgagtcgtaatttccccaagagctcatttcacgcccagagcgaaagtgagactgtggggaagaatggctcctcattccaaaagaaaaagtgtgaggactgtgtcgtgccttacactccccggcggctgcgtcaacggcaggccctgtcaactgagaccggtaagggtaaggacgtagagcctcagggaccgccggccggtcgggctcctgccccactatatgtgggcccaggtgtgagcgagttcattcagccgtacttgaattctcactacaaggagacaactgtgccgcggaaagttctgtttcacttacgggggcaccgtggccctgtaaacacaatccagtggtgccccgtgctctccaaatcccacatgttgctctctacttcgatggataaaacctttaaagtgtggaatgcggtcgattctggccactgtctgcagacctacagcctgcacacagaagcagttagggcagcgcgctgggccccttgcggaagaaggatactgtccggcggttttgactttgccctacatctcacagacctggaaacaggaactcagcttttctccggtagaagcgattttaggattaccacattaaagttccacccaaaagaccacaacatctttttgtgtgggggctttagcagcgagatgaaggcttgggacatacgtactgggaaagtcatgaggagctataaggctacgatccaacaaactctcgatatactgtttctccgcgaaggaagcgagttcttgagcagtacagatgctagtacaagagattccgcagacaggacgatcatcgcttgggattttcgcacctcagccaagatcagtaaccaaatcttccacgaaagattcacgtgcccatctctcgctttacacccccgcgaacccgtttttctggctcagactaatggtaattatctggccctcttctccaccgtctggccgtatcgtatgtctaggcgccgaaggtatgagggacacaaggtggagggatactctgtcggctgtgagtgctcacctggaggcgatctacttgtgactgggagtgcagacggacgagtgctgatgtactccttcagaacggcctctcgtgcctgcaccttgcagggccacactcaagcctgcgtaggtactacttatcacccagttctgcccagcgtgcttgcaacttgtagttggggtggcgacatgaaaatctggcactag

SEQ ID NO: 34782 - DNA, 1635 bp, Artificial Sequence
  Description of Artificial Sequence: Synthetic coding sequence
atgactgcccggaccctcagcctgatggcgagtctggtagcttacgacgacagcgattccgaggccgagacggagcacgcgggctcgtttaacgccaccggccagcaaaaggatacaagcggtgtggctagacctccaggtcaggatttcgccagcggcacacttgatgtaccgaaggccggggcccagcctacaaaacacggctcttgtgaggaccccggcgggtaccgtttgcctttggcccagctggggaggtccgactggggcagttgtccatcccaacggttgcagtggccaggcaaagagccgcaagtaacttttcccattaaagagccctcttgtagcagtctgtggacctctcacgtccctgcctctcatatgcccttggctgcagctaggttcaagcaggtgaaattgagccgtaacttcccaaaaagctcattccacgcccagtctgagtccgagaccgtcgggaaaaatggttccagctttcaaaaaaaaaaatgcgaggattgtgtcgtgccttacaccccaagacgccttaggcaacggcaggcactctctacagagacgggaaaaggcaaagacgtggaaccgcaggggccacccgctggacgggcaccagcccctctgtatgtcggtccaggcgtatcagaattcattcagccctacttaaactctcactataaagaaaccaccgtaccccggaaggtgctattccacctgcggggccaccgcggtcccgtgaatactattcagtggtgccccgtgttgtcaaaatcacacatgcttctgtctactagcatggataagactttcaaagtctggaacgccgtcgacagcggccactgcctccagacctattcactgcacacagaggcagttcgggccgcaaggtgggcaccatgtggtagaaggatattatccgggggcttcgactttgctctccatctcactgatctcgagactgggacccaacttttttctggccgctccgactttcgtatcaccacactaaagttccatcccaaggatcataatatcttcctgtgtggggggttttcttctgaaatgaaggcctgggacatcagaactggtaaggtgatgcgatcttataaggccaccattcagcagactttggatattctttttttgcgcgaaggaagcgaatttctgtccagcacggatgcgtcgacgcgcgacagcgcagaccggaccataattgcatgggatttccggacttctgccaagatcagtaaccagatcttccacgaaagatttacttgccccagcttagccctgcacccccgagagccagtttttttagcccaaacaaacgggaattaccttgctctgtttagtacagtgtggccctaccgaatgagtagacgacgccgctacgagggtcacaaggtggaaggctacagtgtgggttgtgaatgctcccccgggggcgacctgctcgtgactggatcagccgacgggagggtgctgatgtattctttccgtactgcaagtcgtgcctgcacactccaaggacacacccaggcgtgtgttggcactacttaccatcccgtcttacccagtgtgttggctacttgctcctgggggggtgacatgaagatttggcactag

SEQ ID NO: 34783 - DNA, 864 bp, Artificial Sequence
  Description of Artificial Sequence: Synthetic coding sequence
atgcccgctctgtgtctggtgctgtgttggttccagggactacttggcgaggtgtggaacgcggtagacagcggtcactgtctgcaaacgtattctctgcacacagaggccgtgcgggcagcacgctgggcaccctgtgggcgcaggatcctgtctggagggttcgactttgccctccatctgaccgaccttgagactggcacacagttgttctctggtcgctcagacttccgaattacaacactgaaattccacccaaaggatcacaacatattcctgtgtggaggattttcatcagagatgaaggcctgggacatacggaccggaaaagtcatgcggtcctacaaggcaaccattcagcaaaccttagatattctattcttgcgcgaaggttcagaatttctctccagcacagatgcttctactcgagactctgcagaccgcacaattatcgcttgggatttcaggacctcagctaagattagtaaccagattttccatgagcgctttacctgcccatccctggctctacatcccagagagcccgtctttctcgcgcagaccaatggcaattatttggcactctttagtaccgtatggccgtaccgcatgtcaagacgcaggcgctacgagggacacaaggttgagggctactcagtcggctgcgaatgcagccctggaggggacctgctggtcacgggctctgctgacggtcgtgtgctgatgtactctttccgtaccgccagccgcgcctgcactttgcaggggcatactcaggcctgcgtcggcacaacataccaccccgtgctgccgtccgtccttgcaacctgcagctggggcggggatatgaaaatctggcactag

SEQ ID NO: 34784 - DNA, 1635 bp, Artificial Sequence
  Description of Artificial Sequence: Synthetic coding sequence
atgacggctaggaccctttctttaatggcttcacttgttgcctacgatgacagcgactctgaggcagagactgaacacgccggtagctttaatgcaaccggtcagcaaaaggatacatccggcgttgctcggccaccaggacaggactttgcaagcgggacactggacgtgccaaaagcgggagctcagcctaccaagcatggatcatgcgaggacccgggaggatacagactgcctctggcccagctggggcgctccgactggggatcctgcccaagccaacgcctccagtggccgggcaaagagccccaagtgacttttcctattaaagagccttcatgcagctcactgtggacaagccacgtccctgcaagtcatatgcccctagcagcagcacgtttcaaacaggttaaactctctagaaactttcccaagtcttcctttcatgctcaaagtgaatccgaaacggtgggaaagaacgggagctcattccaaaaaaaaaagtgcgaagattgcgtagtaccctacaccccacgccgcctcaggcagcgacaggccctgtctaccgaaaccggaaaaggaaaggacgttgagcctcagggaccacccgctggtcgagctcctgcccccctctacgttggcccgggcgtgtctgagttcatccagccctatctgaactctcattataaggaaacaacagtgcctcgaaaggtgctcttccacctgaggggacatagaggcccggtcaatactattcaatggtgtccagtgctgagcaaatcccacatgctgctcagcaccagcatggacaagacgttcaaggtctggaacgcagttgactcgggacactgtctgcagacttattcactccacacggaagccgtcagagcggctcgctgggctccttgcggccgaaggattttgtccgggggtttcgacttcgcgctccacctcacagacctggagactggcacccagctcttcagcggccgcagtgactttaggattaccaccttaaagttccaccccaaggaccataatatctttttgtgcgggggcttctcatcggaaatgaaggcctgggacattcgcacgggtaaagtaatgcggtcatataaagccactattcagcagactctggatatcctgtttcttagagaaggtagcgagttcctatcctcaacagatgccagtacaagagatagcgcagaccgaaccattatagcttgggacttccgcacatccgctaagataagcaaccagatcttccatgagcgcttcacttgccctagcctggccctgcatccacgggagcctgtattcttggcacaaaccaatggcaattacttggcattgttctccaccgtgtggccctaccggatgagccgcaggaggaggtacgaaggacacaaggttgaaggttacagtgttggttgcgaatgtagtcccggcggagacttgcttgtgactggatctgcagatggccgcgtcttaatgtacagctttcggacggcttcacgcgcatgcaccttgcagggtcatactcaagcctgcgtgggcacaacttatcatccagtcctgccaagtgtcttagcgacttgttcttggggcggggatatgaagatttggcactag

SEQ ID NO: 34785 - DNA, 2574 bp, Artificial Sequence
  Description of Artificial Sequence: Synthetic coding sequence
atggagaacccacaggacatctttagtagcaacggagggtgcctgtctgacatcgtcatcgagaagtatctggtggagtccaaggagtcagtctctcatgtacaactggcatgttccatgcaagactgcgcctttcccctggatgggaccgaattgtgtatctggaatactaaggatccatcacatcagctcctgatccttcggggtcaccaccaaccaattaccgcaatggcattcggaaacaaagtaaaccctcttttaatttgcagcgcaagcctcgattatgtgattatgtggaatcttgatgagtgccgagaaaaagtcctccagggcctcgtccctcggggaaccgtgatgggtagtctgctgggcaaagttctttgccttcagctgagccttgacgatcacgtagtggctgtgtgcgccggtaacaagattttcatgttggatatagaacaacgctttagtgtgacatacatcgaacgaccagacgtgaataatcgccataaggtccctcctccgactttcctgcacaccttcagccagacccaagccgtgcgcgccgaactccagggacacctgggacctgtcactgccgtcgagttctgtccttggagggccgggactcttattagcgccagcgaagaccgggggttcaaggtatgggaccactgtactgggtcactcatctactcctccagcgtgctgagcgcctatcccctgctgtccttgtttattgatgccgagtctcgccaactggttacgggttgtgccgacggacagctctggatcttctcactcatggatggacaccattatcggcgcgtcgcaagagtggatttgagaaaaaaaactgagactttttctaccaggagagtaaagagtggcctgtgttctcagccagaagaaagccagttgccttcaaccagcgccctgggcaaaggggagcaggtggaagtgactttccctgtgttgagacttgcgccctgtgacctgtccctgatccctaacagcgcatgtgggtgcctctcaagtgagaataccagatgcgtgtggatcggaagctccgtgggcctttttgtgttcaacttggccaatctcgaagtggaagccgctttgtactacaaagattttcagagcctgtctattctactggccggcagctgcgccctccggaatcggaccgccgatcagaaggtcctctgcctcctggcttctctcttcgggggaaaaattgcagtgctcgaaatcaatcccgcggccctcgtccgtgctcagcagtgcccttccatgggtcaatcgttaagcgttccggcaagtagctgcgtgctgccgacatcgcccctgtacctgggcattgccaaagagaagtctacaaaagccgcctccgagcagcggcgcgcagcccgcaacgtgatgaaagatcaacggttggtatttcactcgaaggtgcgtagctcaggctacgccagcgctccccacgtgactatgttcagcccaaagactaatattaaatcagaaggaaagggaagcagtaggtccagaagctcttgcgccagagaagcctacccagtggaatgtgcagttcctaccaaaccaggaccccaagtggccgctgccccaacctgcacacgagtttgctgtatccagtactccggtgatggtcagtggctggcctgcggacttgcgaaccacttactgcttgtgtttgacgcctccctcacgggcaccccagccgtattctctggacacgacggagcagtcaatgctgtctgctggtcgcaggacagaagatggctgctgtcagccgccagggatggcacactaagaatgtggtcagcaagaggagccgaattggctctgttattggggaaggacatgttcagtaaacctattcagagcgcccagttttactacattgacgcatttattctgctaagcagcggaccagagttccaattgctgaggtatcacattgatacgtgtaaggatgagatcaaaagatataagcaaaaaagtaagagcaaactcatctgccggctcagcacgacaggcgccgtcgacatgacttctctgtctgcagttaacgatttttatagtcacatagtactggcagcgggccgaaatcgtaccgtggaagtgttcgacttgaatgccggctgcagtgccgcagtgatcgcagaagcacatagcaggcccgtccaccagatctgccaaaacaaaggctccagttttacaacacaacagcctcaggcctataacctattccttacaactgcgattggtgatgggatgagattgtgggatctgcgaacgctgcgctgtgaacgccatttcgaggggcaccctacccgcggctatccttgcggtatagctttttcaccttgcggccggttcgccgcatgcggggcggaagatcgccacgcgtatgtgtacgagatgggcagctccacattttcccacaggctggcaggccacacagatacggtgactggtgttgccttcaacccatcagctcctcagctcgccactgcgactttggatggaaagctccagttatttctggcagaatag

SEQ ID NO: 34786 - DNA, 546 bp, Artificial Sequence
  Description of Artificial Sequence: Synthetic coding sequence
atggagaatcctcaggatatcttcagctccaatggcgggtgccttagtgacatcgtgattgaaaagtatctggtcgaatcaaaggagtcagtttcccacgttcagctggcatgtagtatgcaagactgcgcatttcccctggacggtactgagctgtgcatttggaacaccaaagacccaagccatcagcttctgatccttaggggacaccatcaacccatcactgcaatggccttcggaaacaaggtgaaccctttgctgatctgctctgcttcactggactacgttataatgtggaacttggacgagtgcagagagaaagtgttgcaagggttggtcccgagaggaacagtgatgggaagccttctcggaaaggttctgtgtctccagttgagcctggatgaccatgttgtcgccgtgtgtgcaggaaataagatttttatgctggatatcgaacatatcctgttttcagtctatagcctgatgcagaaagctggcagttggagtcctggggtcttaacagctagcttcggtagctccgtgtag

SEQ ID NO: 34787 - DNA, 2193 bp, Artificial Sequence
  Description of Artificial Sequence: Synthetic coding sequence
atggaaaaccctcaggacatcttttcctctaacggtgggtgcttaagtgatatcgtgatcgaaaagtacctggttgagtcaaaggagtcagtaagtcacgtccagctcgcatgcagcatgcaggactgtgcctttcccctcgatggcactgagctctgtatctggaacacgaaagatccaagccatcagttactaatcctccgcggccatcatcagcctattacagccatggccttcggcaacaaagtgaaccccctgctgatctgtagtgccagtttagattacgtcatcatgtggaatctcgacgaatgtcgagagaaagtgctgcaggcctatcctttacttagcttatttattgacgccgaatccagacagctggtaacggggtgcgcggacggccaactgtggatcttcagcctgatggacggacatcattaccggcgggtagcacgggttgacttgaggaagaaaaccgagacattctccactaggcgggttaagagcggcctctgctctcagcccgaggaaagtcaactgccctctacatcagcactagggaagggtgagcaggtcgaagtgacgttccccgtgctccggcttgccccatgtgacttgagcctgattcctaactcagcatgtggatgtctgagttctgagaataccaggtgtgtttggatcgggtccagcgtgggcctctttgtattcaacttagcaaatctcgaagtggaagcagctctttactataaagatttccaaagtctgtccattctcctcgccggatcctgcgccctccgcaacagaacagctgatcagaaggtcctctgtctactggcttccctttttgggggcaagattgccgtgctggaaattaaccccgcagcacttgtccgggcgcaacagtgtcctagcatggggcagagtctaagcgtgcccgctagcagctgtgtcttaccgaccagccccctttatctgggcattgccaaggagaagtccaccaaggcggcttccgaacagcgtcgggctgcacgtaatgtgatgaaagaccaacgtctggtgttccattctaaagtccggtcttccggttatgcatcagcgccacatgttaccatgttctcgcccaaaacaaacatcaagtcagagggtaaaggcagctctcggtctagatcatcttgtgcccgcgaggcctacccggtagaatgcgctgtcccgaccaagcctggcccccaggtcgccgctgcacctacttgcacacgagtgtgttgtatacagtattcaggggatggacagtggttggcttgcgggctcgccaatcacctgctgcttgtgttcgacgcgagtctgacagggacgcctgccgtgtttagcggccacgatggggctgtgaacgctgtctgttggagccaggataggagatggctcctatcggccgcaagggacgggacactccgcatgtggagtgccaggggagccgaattagcgcttctgcttgggaaggatatgttctccaaacctatacaaagcgcccagttctattatatcgacgcttttatcctcctgtcatctggcccagaatttcagcttttgaggtaccacatcgatacatgtaaggatgagataaagcgctacaaacaaaaatcaaaatctaaactgatttgcagactgtccaccaccggagccgtcgatatgacaagtctgtccgcagttaacgatttttatagccatatcgtattagcggctgggcgcaacagaactgtggaggttttcgaccttaatgccgggtgtagcgccgccgtgattgccgaggcccattctcgccctgtccatcagatttgtcaaaataaaggttcatcatttactacgcagcagccccaagcctacaacttgttcttgacaactgccatcggcgacggaatgcgcctctgggatctaagaacattgaggtgtgagcgccatttcgagggccacccaaccaggggttatccgtgtggaatcgcgttcagtccttgtgggcgctttgccgcttgcggagctgaggaccgccatgcctatgtatatgaaatgggctcctccaccttctctcacaggctcgctggacacaccgatacagtcaccggagtcgctttcaacccctccgcaccccagcttgctacagctactcttgatggaaaattgcaactatttctggctgaatag

SEQ ID NO: 34788 - DNA, 2688 bp, Artificial Sequence
  Description of Artificial Sequence: Synthetic coding sequence
atggaaaacccacaggacatcttttcctcgaatggggggtgtctgtccgacattgtgatcgagaaatatcttgtggagagcaaagaaagcgtgagtcacgtgcagctcgcctgctcgatgcaagattgcgcctttcctctggatggaaccgaattatgtatctggaacacaaaggacccatctcaccagctactgatactgcgagggcaccatcagcctattaccgccatggcctttggcaacaaggttaacccattgctgatctgtagtgcttcccttgattatgtaatcatgtggaacctggacgaatgtagggaaaaggtgttgcagggcctggtgcctcgcggaaccgtgatgggaagtctactgggcaaggtcctctgcttgcaattgtctcttgacgaccatgtggtggctgtgtgcgctggcaacaagattttcatgctggatatagagcagaggttcagtgtgacctacatcgaaaggccagatgtgaacaaccgtcacaaggtgcccccgccaacatttctgcacacattcagccagacccaggctgtgcgggccgagctgcaaggccacttaggtcctgttactgccgtcgagttttgcccatggcgcgccgggacactgatctcagcctcagaagaccgcggatttaaggtgtgggaccattgcacaggctccctgatctacagctcttcggtcctgtccgcttaccccctgctgtccctctttattgatgcagagagtcggcagctggtgactggctgtgcagacggacagctatggatattctcactcatggacgggcatcactatcggagagtggccagggttgacctgagaaaaaagacggagactttctccacccgcagagtaaagagtgggttgtgttctcagccagaggagtcccagctgccaagcacctcagcgctgggcaagggcgagcaagtggaggtgacgttcccagtactccgcctggccccgtgtgacttgtctctcatccccaatagtgcgtgtggctgcttgagttccgaaaacacacgttgtgtgtggatcggatcatctgtcggcttattcgtgtttaacttggcgaatttagaggtcgaggccgccctttactacaaagacttccagagcctttcaatcctgctcgcgggctcttgcgcattgcgaaatcgaacggcagaccagaaagtgctctgcttactagctagtcttttcggtgggaagatcgctgttcttgagatcaaccctgccgccttggtgagagcccagcagtgccctagcatgggtcagagtctttctgttcctgcatcttcatgtgtcctacctactagtccgttataccttggaatcgctaaagaaaaaagcacgaaggcggccagcgaacaaaggagggctgctaggaatgtgatgaaagaccagcgactcgttttccattcgaaggtaagaagcagcgggtacgctagtgccccacacgtgaccatgtttagtccaaagacaaatattaagtcggagggcaagggttcttccagatcaaggagttcctgcgcccgtgaggcctatccagttgaatgcgcggtccccactaaaccgggacctcaggttgctgccgccccaacctgcacccgggtgtgctgtatacagtactcaggtgacggacaatggcttgcctgcggcctggcaaatcatctcttgctcgtcttcgacgcttccctcactggcactccggccgtctttagcggccatgacggagccgttaatgcagtttgctggtcacaagacaggcgctggctgctgagcgcagcgcgcgatggaacactccgcatgtggtccgctcgaggcgctgagctggccttgctactcggcaaggatatgtttagcaaacctatccagtctgcgcaattctactacattgacgctttcatcctcttatcaagtggcccggaattccagctgctgaggtaccacatcgacacgtgcaaggacgaaattaaacggtacaaacagaagtcaaaatctaagttgatttgtaggctttccaccacaggcgcggtggatatgactagcttgtcggccgtcaatgacttctattctcatattgtgctggctgccggcagaaatcggactgtcgaagtcttcgatctaaatgctggctgcagtgctgccgttattgccgaggctcactcgcgccctgtgcaccagatatgtcagaacaaagggagttcattcaccacccagcaaccgcaggcctacaacttgtttctaaccaccgctatcggcgatgggatgcgcctgtgggatctgcgcacactgcgatgcgagagacacttcgagggccatcctacacgagggtacccttgcggcattgccttctctccttgtgggcgttttgccgcctgtggagctgaagaccggcacgcttatgtatatgagatgggatcctccaccttctctcaccgattggcaggtcacacggacactgtgactggtgtcgcctttaacccttctgcaccccagatggaaagccgttctgtggctcacgccggggtccaatggcacgacttggggagcctgcagccgcctccgtcgaggtttaaacagttcttctgtctatccttaccaagttcttgggactactccttgccccagctaccctggatggtgaattccagctccttctag

SEQ ID NO: 34789 - DNA, 267 bp, Artificial Sequence
  Description of Artificial Sequence: Synthetic coding sequence
atggagaacccccaggacatctttagttccaacggagggtgtctctctgacatcgtgattgaaaaatatcttgtggagtctaaggagtccgtgtcacacgtgcagctcgcatgctcgatgcaggattgtgcgtttcccctggacggcactgagctttgtatttggaacaccaaggacccatctcatcagctgttgatccttaggggccatcaccaaccaattaccgcaatggccttcgggaataaagttaaccccctgcttatatag

SEQ ID NO: 34790 - DNA, 1101 bp, Artificial Sequence
  Description of Artificial Sequence: Synthetic coding sequence
atgctgcttctgcgttgccagcttaagcaagcacccccccagaaagtaagcttccgcttctgcgttgttatgggtaagcagcagagtaagttaaagcattcaacctacaaatacggtcccgacgaaattattgaggaacggatccagaccaaagcctttcaggagtattctcccgcccatatggacacagtgagtgtagtggcagccctgaactcagacctgtgcgtcagcggggggaaggataaaaccgtggtcgcttacaactggaagaccggcaacgtggttaagcgattcaagggccacgaacacgaaattacaaaagttgcttgcatccctaagagcagtcagttcttcagtgccagtagggacaggatggtcatgatgtgggatctacacgggtcatctcagcctcgtcaacagctgtgcggtcacgcaatggtggtgacagggttggcagttagcccagattcaagccagctctgcacaggttcgcgggacaacacactgctgttgtgggatgtggtgacagggcagagcgtcgagcgggcctctgtcagtaggaatgtagtaacccacttatgctgggtgccgagagagccgtacatccttcagacttcagaggacaagaccctccggctatgggactcccgaggtctccaggtcgctcacatgttcccagctaagcagcatatacagacgtattgcgaagtgagtgtggatggccacaaatgcatttcttgctcaaacggcttcggtggcgagggctgcgaggccaccctgtgggatctcaggcaaactaggaatcggatctgcgaatacaaaggacacttccagacagtggccagctgcgtttttctgccacgcgctctggccctcatgccgttaattgccacatccagccacgactgcaaggtgaaaatttggaaccaggatactggggcttgtctctttactctttctttagatgggagcggaccactcacaagtcttgctgtcggagacgcaatctctcttctgtgcgcttcctttaatagaggaatccatctgctacgaatggatcattcacagggcctcgaacttcaggaggtggccgcgttttag

SEQ ID NO: 34791 - DNA, 1104 bp, Artificial Sequence
  Description of Artificial Sequence: Synthetic coding sequence
atgctgctcttgaggtgccagctaaagcaagcgcccccccaaaaggtttcgtttcgcttctgtgttgtaatggggaagcagcaaagtaagctaaaacattcgacttataaatacgggcggccagacgagataatcgaggagcgcatccaaaccaaggcttttcaagagtacagcccagcccatatggacactgtgtccgttgtggccgctctcaacagcgacctgtgcgtgtctgggggaaaggacaagacggtcgtcgcctacaactggaagacaggcaatgtggttaaacgcttcaagggacacgagcatgagatcactaaagtggcctgcattccaaagagcagccagttttttagcgcgtccagggatagaatggttatgatgtgggatctgcatggctcctctcagcccagacaacagctctgtggtcacgccatggtcgtaaccggtctcgccgtgtctccagacagttctcagctgtgcaccggtagcagggacaatacccttctcctttgggatgtagtgacaggacaatccgtggagcgggcaagcgtgtctagaaatgtggtcacccatctgtgttgggttcctcgcgagccttacatcctgcaaacctcagaggataaaaccttgcgcctatgggattctcgcggcctgcaagtcgctcacatgttccctgcaaagcagcatatccaaacatactgtgaagtctccgttgatggacataagtgtatctcctgttcaaacgggttcgggggtgaggggtgcgaagcgactctgtgggatctgcgccagacccgcaaccgcatatgtgaatataaaggccacttccaaaccgtcgcatcctgtgtctttcttcctcgagcccttgctctgatgccactgatcgccactagtagtcatgattgtaaggtgaagatttggaatcaggacactggggcatgcctcttcaccttgagtttggatgggtcaggtccacttacgtccctggccgtcggcgatgctatctctctgctttgtgcctctttcaatcggggaatccacctgcttcgaatggatcactcccagggcttagaactccaggaagtggccgcattctag

SEQ ID NO: 34792 - DNA, 729 bp, Artificial Sequence
  Description of Artificial Sequence: Synthetic coding sequence
atggtgatgatgtgggaccttcatggatccagtcagcctcgtcaacagctctgcggtcacgctatggttgtgaccgggctggccgtgtctcctgactcgtcacagctgtgcacaggttcacgcgataatactttactactctgggacgttgtgacaggacagtccgttgaacgagctagcgtcagccggaacgtagtcacccacttgtgttgggtcccccgggaaccgtatatccttcagacgagcgaagacaagaccctgcggttgtgggacagccgaggcctacaagtcgctcacatgttcccagctaaacagcacatccagacttattgtgaagtatcagtcgacggacacaaatgtatatcctgcagcaatgggtttggtggagaagggtgcgaggccacgttgtgggatctacgccagacacgcaatcggatctgcgagtataaagggcactttcagactgtagcatcctgcgtgttcctccctagagcgctcgcactgatgcccttgatagctacttccagccacgactgtaaagtgaaaatctggaatcaggatacgggcgcctgtttgtttacactgtcactcgacggcagtggccccctcacgtctctggccgttggcgacgctatttccctgctttgtgctagctttaacagaggcattcatctgttgcgtatggaccactcacaaggactggaactccaagaggtggctgctttttag

SEQ ID NO: 34793 - DNA, 4011 bp, Artificial Sequence
  Description of Artificial Sequence: Synthetic coding sequence
atggccacagagatcggtagtccgcccagatttttccacatgccacgttttcaacatcaagcccctaggcagcttttttacaagagaccagacttcgcccagcagcaggcgatgcaacagctaaccttcgatggtaaaagaatgcgcaaggccgtcaatagaaaaactatagattacaatccatccgttattaagtatctggaaaacaggatctggcagcgcgaccagcgggacatgcgcgccattcaaccagatgctggatattacaatgatctggtgcccccgattggcatgctgaataacccaatgaatgccgtgacaacgaagttcgtccggacttcgacaaataaggttaaatgcccagtgttcgtggtgaggtggacacccgaggggaggcgccttgtaacaggagcatcatcgggcgaatttacactgtggaatggactgacctttaatttcgagactatcctccaggcccatgacagtccagtgcgggcaatgacttggtctcataatgacatgtggatgcttacagccgaccatggtggctacgttaagtactggcagagcaatatgaacaacgtcaagatgtttcaggcccacaaggaggcaattcgagaggctagcttttctccgaccgacaacaagtttgctacatgtagtgacgacggcactgtgcggatctgggatttccttcgctgtcatgaagaacgcatcttgcgcggacacggggccgatgttaagtgcgtagattggcatcctacgaaaggactggtcgtaagcgggtcgaaggattcccagcaaccaattaaattctgggatcccaagactggccaatctcttgctaccctgcacgcccataagaacaccgtgatggaagtcaaacttaatctaaacggaaattggctgctgactgcctcccgggaccacctgtgtaagctctttgatataaggaatttaaaggaagaactccaggttttccgggggcacaagaaggaggccaccgccgttgcatggcatcctgtacacgaaggcctgtttgcttcaggtggatcagatgggtcccttctgttctggcatgtgggagttgaaaaggaggtcggcggtatggaaatggcccatgagggcatgatttggtcgctggcatggcacccactggggcacattttatgcagcgggtcaaacgatcacacctcaaaattctggaccagaaatcggcccggggacaagatgagagacaggtataacctcaacctgttgccaggcatgtctgaggacggtgtcgaatacgatgacctagaaccaaatagcctagcggttatacctggcatgggtatccccgaacagctcaaactggcgatggagcaggagcaaatgggaaaagacgagagcaacgagatcgagatgacaatcccgggtctggattggggcatggaagaggtgatgcaaaaagatcagaagaaagtgcctcagaagaaagtaccgtacgccaaacccatccccgcccagttccagcaggcctggatgcagaacaaggtccctattcccgctcccaacgaggttctgaatgaccgcaaggaagatatcaaactggaagagaagaagaaaacgcaagccgaaatcgagcaggagatggctaccttgcagtatactaacccacagctgctcgaacagctgaaaattgaaagattagcacagaagcaagtggagcaaatccaaccaccccccagctccggaacacccctactcggtcctcagccgtttccaggacagggtccaatgtcccagatcccacaagggtttcagcagccccacccctcacagcagatgccaatgaacatggcccagatgggcccacccggtccacaaggccagttcagaccccctggacctcaggggcagatgggacctcagggccctccccttcatcagggtggaggaggcccacagggttttatgggcccacaaggaccacagggccctccgcagggtctaccacgaccgcaagatatgcacggccctcaagggatgcagagacatccgggcccacatggacccctgggcccccagggcccgccgggacctcaaggtagctctggccctcaggggcacatgggaccgcagggaccaccaggaccccaaggacatatcggacctcagggaccacctgggccccaaggccacctggggccccagggccccccaggaactcaagggatgcagggaccacccggacctcggggtatgcaggggcccccccacccgcacggaatacaggggggacccggttcacagggaatacagggtccagtctctcagggacccctgatgggactcaaccctcggggaatgcaaggtccacctggaccgagggaaaaccaggggcccgcaccacaaggcatgatcatggggcacccaccgcaggagatgagagggccccatccaccagggggcttgctcggacatgggccccaggagatgagaggtccacaggaaattagagggatgcaagggccaccccctcagggcagcatgttaggccctccacaagaactgcggggaccaccaggatcacagtcccagcaaggacccccccagggatctctaggaccgccacctcagggcggtatgcagggcccccctggcccgcagggtcagcagaatccagcccgggggccacaccccagccaagggcccataccgttccagcagcagaagactcctctgttaggtgatgggcctcgtgcgccatttaaccaagagggccaaagcactggtcccccacctcttatccctggactgggccagcagggagcccaaggtcgaatcccccctttgaatcccggccagggacctggcccaaataagggcgactcacgcgggcctccaaaccatcacatgggtccaatgtcggaaaggcgacatgagcagtccgggggcccagagcacggccccgagcgaggaccttttcgcggtggacaggattgccgaggacctcctgatcgacgaggtccccacccggatttccctgacgactttagccgtcccgatgacttccaccctgacaagagatttggccacagactgcgtgagttcgagggtcgtggtggaccactgcctcaagaggagaaatggcgaaggggtggccccggccctcccttccctcccgaccatcgcgagtttagtgaaggagacggaagaggcgctgcgcgcggacctcccggggcatgggaaggccgtcggcctggagacgagcgctttccacgagacccggaagatccgcgcttccgcgggcgcagggaggaatctttccggcgaggcgccccaccacgacacgagggtcgtgcccctcccagaggcagagatggctttcctggccctgaggatttcgggccagaagagaatttcgatgcatccgaagaagcagcacgcggtcgggacctgaggggtcgcggtagaggcactccacgcgggggcagaaaggggctgttaccaacacctgatgagtttcccagattcgagggcggcagaaagccggacagttgggacgggaatcgagaacctggtccgggccatgagcactttcgagacaccccaaggcccgaccacccacctcacgatgggcattcccccgcttcccgagagcgaagtagtagcctgcagggcatggacatggcctctctgccgcctcgtaagcgcccatggcacgatgggccaggcacaagtgagcatcgcgagatggaggcccctggcgggccttccgaagaccgcggaggaaagggccgcggaggacctggccccgcacagcgggtgcccaaatctggaaggagctccagcctggatggagagcaccacgatggataccacagggatgagcccttcgggggaccccctggttcaggcacaccctccagggggggaaggtctgggagcaattgggggagggggtcaaatatgaatagcggaccacctagaaggggcgcctcaagaggcggcggtcgtggacgctag

SEQ ID NO: 34794 - DNA, 774 bp, Artificial Sequence
  Description of Artificial Sequence: Synthetic coding sequence
atggcaaccgaaattggttccccgcctcggttctttcacatgccaaggtttcaacaccaagctccgcggcagctgttctacaaaaggccagattttgctcagcagcaggccatgcagcaattgacattcgatgggaagcgaatgaggaaagctgtcaatcgtaaaaccattgattataatccctccgtaatcaagtatttagagaatcgaatatggcagagggatcagagggatatgagggctatccagccagacgcagggtattacaatgatctcgttccccccatcggcatgttaaataatcctatgaacgcggttaccactaagtttgtgcgtaccagcactaataaggtgaaatgcccggtatttgtggtgagatggacccctgagggacggcgtttggttacaggggcctctagtggagagttcacgctgtggaatggcctgacctttaatttcgaaactattcttcaagcccatgatagccccgtacgcgccatgacatggtcgcataatgacatgtggatgttaacagctgaccatggagggtacgtgaagtattggcaatcaaacatgaataacgtgaagatgttccaggctcacaaggaggcgatcagggaggcctctttctctcccaccgacaataagtttgcgacctgttccgacgatggcacagttagaatttgggacttccttagatgccacgaggagcgcatactacgggatacatgctttcaccattgtcgttgctactttctgtctgtcaagcgctag

SEQ ID NO: 34795 - DNA, 357 bp, Artificial Sequence
  Description of Artificial Sequence: Synthetic coding sequence
atggccaccgaaatcggaagccccccacgattcttccacatgcctcgatttcaacatcaggccccacgccagctgttctataagcgcccagattttgcacaacaacaggctatgcagcagctcacatttgatggcaagagaatgaggaaggctgtgaaccggaaaacaatcgactataatccaagcgtgatcaagtaccttgaaaacaggatctggcagcgtgaccagagggatatgcgggcaattcagccggacgcaggctactataacgatcttgtaccgccaatcggtatgctgaacaatcccatgaatgctgtgacaaccaagtttgtccggacctccacgaacaaggtctag

SEQ ID NO: 34796 - DNA, 981 bp, Artificial Sequence
  Description of Artificial Sequence: Synthetic coding sequence
atggccaccgagattggctctcctccacgtttctttcacatgccaagatttcagcaccaagcccccagacagctgttctacaagagacccgatttcgcacagcagcaggctatgcaacaactcacgttcgacggaaaacggatgcgaaaggcagtgaataggaagacaattgattataacccgtcagtaattaagtacctcgagaaccgaatttggcagagagaccagcgcgacatgcgcgctatccagcctgatgcaggctactataacgacctcgtacccccaattggaatgctgaacaatcctatgaacgccgtcactacaaaattcgtccgtacctccacaaacaaggtgaagtgtccggttttcgttgtgcgttggactcctgagggacggcgacttgttaccggggcgagttcgggggaattcactctgtggaacggcctgacttttaactttgaaaccatccttcaggcgcacgatagtccagtcagagccatgacatggtctcataatgatatgtggatgctcacggctgaccacggcggatatgtgaagtattggcagtccaatatgaacaacgtcaaaatgttccaggcccacaaggaggccatccgtgaagcccgcttcatccacaatataccttttagcgtagttcccatcgtgatggttaagctcttctcaaagtgtattcttggcgctgaaatgcatggtctgtgtcagtttctagggaattttctgcacccaatcaacacgatctttttttttgtattcacccattcccctttttgctggcacctgtcagaagtggtactatccagatatcagccactgcagtacgtgagagacgtcctctctgccgctttttgtaccggatttctattttccttcatgattaataatgtatacaccctctttctgtttattatttactgtgttcgacaggagtactttatcccaaacaaggaattttcactgtag

SEQ ID NO: 34797 - DNA, 1485 bp, Artificial Sequence
  Description of Artificial Sequence: Synthetic coding sequence
atgcccaccgagagcgcaagctgttccaccgcccgccagaccaagcaaaaaaggaagtctcactccctgtcaataaggcgcactaactcttccgagcaggaaaggacaggactgcctagagacatgctcgaggggcaagattccaagcttccctcatccgtgaggtcaaccttgcttgagctcttcgggcagatcgaacgggaattcgaaaacctgtatattgaaaacctggagcttagacgcgaaatcgacacactgaacgagcggctcgctgctgaaggacaagccattgatggagctgaactttccaaaggccagctcaaaactaaagcatctcatagcactagccagctcagccagaaactcaaaacaacctacaaggctagcacctccaagatagtaagctcttttaagaccaccaccagccgcgctgcttgccagctggtcaaggaatatatcggccacagagacggaatttgggatgtctctgttgcaaagacccaacctgtggtcttaggaacagcctctgctgatcacaccgcactgctgtggtccatcgagacaggcaagtgcctggtgaagtacgccggtcatgtcgggtctgttaacagcattaagtttcaccccagcgaacaactcgctttgacagcctcaggggatcaaaccgcacatatttggagatatgctgtacagctccctacgcctcagcctgtcgctgacacatctattagcggggaagatgaggtggaatgttctgacaaagacgaacctgatctggacggggatgtgagctccgactgtcctacgatcagggttcctcttacatctctcaaaagccatcagggagtcgtcatcgcatctgactggctcgttggaggaaaacaagccgtcacagcctcttgggaccgtaccgcaaatctctacgatgtagagacctctgaacttgtccactccctgacaggccacgaccaagagctcacacattgttgtacgcaccccacacagcggctggtcgtcacctcttctagagataccactttccgcctttgggacttccgcgatccatctattcattccgtgaatgtgtttcagggccacacagatacggtgacctccgcggtgtttacagtcggagacaacgtggtgtctggcagtgacgatagaaccgtgaaagtgtgggatctgaaaaatatgcgcagtcctatcgctaccataagaactgactctgctatcaaccgcatcaatgtgtgcgtggggcagaagatcattgcactgccccatgataacaggcaggtgaggttgttcgacatgtcaggagtgagactcgctagacttccacgctcctccagacagggacatagacgtatggtttgctgtagcgcttggtccgaagaccatccggtctgtaacctctttacctgtggctttgaccggcaggctatagggtggaatatcaatattccagccctgctacaagagaagtag

SEQ ID NO: 34798 - DNA, 1485 bp, Artificial Sequence
  Description of Artificial Sequence: Synthetic coding sequence
atgccaacagaatccgcaagctgctccactgcaaggcagacaaaacagaagagaaagtctcatagtctctcaatcagaaggactaattcttcggaacaggagcggactgggctgcctcgtgatatgctggagggccaggactccaaacttccttcctccgtgcggagcaccctgttggagttattcggtcagatcgaaagagagttcgagaacctgtacatcgaaaaccttgagcttagacgcgagattgacactctcaacgagcgcctggcagccgagggccaagccattgacggcgctgagctgagcaaggggcagctgaaaacaaaggcctctcatagcacaagccaactatctcagaaactgaaaacaacttataaagcctcaacatcaaagattgtcagctcctttaagacaacaacttctagggctgcgtgccagctggtgaaagaatacatcggtcaccgcgacggaatctgggatgtgtccgttgctaagactcagcccgtggttctcggaacggcctccgcagaccataccgccttgctctggtccatcgaaaccggaaaatgcctggtgaaatacgccggacacgtaggtagtgtgaatagcattaaattccacccctcggaacaattagccttgaccgcgagcggggatcagacagctcacatttggaggtacgctgtccaactacccaccccacagcccgtcgccgacaccagtatctcaggcgaggacgaggtggaatgcagcgataaagacgaacctgacctcgatggtgatgttagcagtgactgtcccaccatccgcgtcccccttacctcacttaaatcccaccagggcgtcgtgattgcgtccgattggctcgtcggcggcaaacaggccgtaaccgcttcttgggaccgaactgctaacttatacgacgtcgagacgtcagagttggtacacagcctcaccggacatgatcaggagctgacccattgttgcactcatcctacgcagcgactcgttgtaacatcatccagggataccacgtttcgtctgtgggactttcgggatcctagtattcacagcgtgaacgtattccaggggcacactgatacggtgacctccgccgtgtttacagtgggtgataacgtcgtctctgggagcgacgacagaactgtgaaggtgtgggacctgaagaacatgagatccccaattgctaccattaggacagactccgccatcaatagaataaacgtgtgtgttggacagaagataatcgccttaccccatgacaatcggcaggtgaggctgtttgacatgagcggtgttcgcctggccagactgccgcgcagcagtagacaggggcatcgccgcatggtatgttgcagcgcctggtccgaggaccatccagtctgcaatctgttcacctgtggtttcgacagacaagccatcggatggaatatcaatatccctgccctgctacaagaaaagtag

SEQ ID NO: 34799 - DNA, 750 bp, Artificial Sequence
  Description of Artificial Sequence: Synthetic coding sequence
atgccaactgaaagcgccagttgcagtacagcaaggcagacaaagcagaagcgtaagagccactcactgagtatacgccgcaccaatagctctgaacaggaaagaactggcctccctagagatatgctggaagggcaggactccaaacttccaagctcggttcgatcaacacttcttgagctttttggacaaatcgagcgggaattcgagaacttgtacattgaaaacttggaacttcgacgagagatcgatactttgaacgaaagacttgcggcagaagggcaggccattgatggggcagagctgagcaagggacagctaaagactaaggcctctcactccacaagccaactaagccaaaagctcaagaccacatacaaggcctctacgagtaaaattgtgagtagcttcaagacaaccacctctcgtgcagcctgtcagttggtgaaggagtacatcggccatagagacggcatctgggacgtgtcagtcgctaagacacagccagtggtgctgggcacagcttccgccgaccacaccgcgctgctctggagtatcgagacagggaaatgcctggtcaagtacgccggacacgtgggttctgtcaactccatcaaattccatccaagcgaacaactggcattgacagcttctggagaccaaactgctcatatctggaggtatgccgtgcagttgcccaccccccaaccggtagccgatacctccgtgtctacttttccttatctgtag

SEQ ID NO: 34800 - DNA, 630 bp, Artificial Sequence
  Description of Artificial Sequence: Synthetic coding sequence
atgtcttcggactcagaatgggacagatcagcatgtagtgactccaagctgcctagttccgtgaggagcaccctcttagagttatttggccagatagaacgagagttcgaaaatctctacatcgagaaccttgaattacggcgggaaatagacacccttaacgaacgactggcggctgaaggacaggccatagacggcgccgagctgagtaaaggccagctgaaaacaaaggcttctcactccaccagccaactgtctcagaaactcaaaaccacctataaggccagcaccagtaagattgtgagttctttcaaaactaccacctcacgcgccgcttgccaactcgtaaaagagtacatcggccatagagacggaatttgggacgtatcagttgcaaaaacccagcctgtcgtgttaggaacggccagtgccgatcatacggcccttctgtggagtattgaaactggcaaatgtctcgtgaaatacgccggacacgtaggcagcgtgaactccataaagtttcatccttccgagcagttggcgctgactgcaagcggcgatcagaccgctcatatctggcgctacgccgttcagcttcctacaccccagcccgtcgccgatacatcctag

SEQ ID NO: 34801 - DNA, 945 bp, Artificial Sequence
  Description of Artificial Sequence: Synthetic coding sequence
atgaactctggagttcccgcaacactcgccgtcagacgggtcaaatttttcggacagcatggtggagaagtcaacagcagtgcgttctcacccgatggtcagatgttactgacaggttcagaagatggatgcgtgtacggctgggagacccggagcgggcagttgctttggcgcctaggaggacacaccggacctgtcaagttctgccgtttctcaccagacggccatctgtttgcgagcgcttcttgtgactgcaccgtccgtctttgggatgtcgcgagagccaagtgtcttagggttctgaaaggtcaccaaaggagcgtcgagactgtttctttcagtcccgactctcggcaactcgcaagcggcggttgggataaacgcgttatgctctgggacgttcagtctggccagatgctgaggctattggttggacaccgggacagcatccagtcatctgacttctcccctactgtaaattgcctcgccacaggcagctgggattctacagtgcacatctgggatctgcgaatggtaacacccgctgtgagccaccaggccctggaagggcatagcgccaacatttcttgtttgtgttacagtgcttctggactactggcatccggtagctgggacaagacaatccacatctggaaacccactacctccagtctgttaatacagcttaagggacacgtgacatgggtgaagtcaattgcattctcccccgacgagctgtggctcgcctccgcgggttactcgcggatggtgaaggtgtgggattgcaacactggcaagtgtctcgagacccttaaaggggttttagacgtggcccacacctgtgcctttacgcctgatggaaagatattggtcagtggtgcggccgatcagactagacgacaaatatcgcggactagcaagtctccaagagaccctcagacttag

SEQ ID NO: 34802 - DNA, 1380 bp, Artificial Sequence
  Description of Artificial Sequence: Synthetic coding sequence
atgcttcgctggctgatagggggaggaagagagccgcagggcctcgcagaaaagtcccccctgcaaacaatcggtgaggagcagacccagaacccttatacagagctcttggtgctgaaagcccaccacgacattgtgcgcttcctggtacagctcgatgactaccgtttcgccagtgccggcgacgacggcattgttgttgtatggaatgcccaaaccggggaaaagttactggagctgaacggacacacacaaaagatcacagctataattaccttcccttccctggaaagctgtgaagagaaaaatcaactgatcttaacagcatcagcagatcggaccgttatagtgtgggacggtgatactactagacaagttcagcggatttcatgctttcaatcgacagttaagtgcctgacggtgctgcaacggctagatgtttggctttcaggcggaaacgacctgtgtgtgtggaaccgcaaactggacttgctgtgtaaaacatcccacctgtccgacactggcataagtgccctggtggaaatacccaagaactgtgtcgtggccgctgtcgggaaagagctcattatatttagattggtagctcccaccgaagggtcacttgagtgggatatcttagaggtcaagaggttgctcgatcaccaagataacatactgtcacttatcaatgtcaatgatctgagcttcgtgaccggctcacacgttggagaattaatcatttgggatgcccttgattggactatgcaggcctacgagcggaatttctgggatccaagtccgcagttagacacacaacaggaaatcaagctctgtcagaaaagcaacgacatctccatccaccactttacctgcgacgaggagaacgtattcgcggctgtaggcagagggctgtatgtgtatagcttgcagatgaagcgcgtgatcgcttgtcagaagaccgctcacgactcgaatgtgcttcacgtggcacggctgcctaatcggcagttaatctcatgttccgaggatggctctgtccgcatttgggagctgagagaaaaacaacaactggcagctgaacctgtgccaaccgggttcttcaacatgtgggggttcggtagagtgtccaagcaggcttctcaacctgtgaaaaagcagcaggagaacgctacctcctgctcccttgaactaatcggggatttgataggtcacagttctagcgtagagatgtttctctactttgaggatcacggcctcgtaacgtgctctgccgaccacctgattatcttgtggaaaaatggggaacgggaatcaggcctccggagtttaagactattccagaagctggaagaaaacggggacctctatctggcagtatag

SEQ ID NO: 34803 - DNA, 618 bp, Artificial Sequence
  Description of Artificial Sequence: Synthetic coding sequence
atgcaggcatacgagcggaacttttgggacccttctccacaactggacacccaacaagagataaaactgtgccagaagtccaatgatatatctatccaccattttacctgtgacgaggaaaacgttttcgctgcagtgggacggggtttgtatgtgtatagccttcagatgaaaagagtcatcgcatgccagaaaacggctcatgattccaatgtcctgcacgtcgccaggctgcccaaccgtcagctcatttcctgtagcgaagacggctcagtgcggatttgggagctacgggaaaaacagcaacttgcagcggagcctgtgcccaccggcttctttaatatgtggggttttggccgagtgagcaagcaagcctctcagccagtgaagaaacaacaggagaacgccacatcttgttcgctcgagttgatcggtgacttgatcggccatagttcaagcgtagaaatgttcttatactttgaagatcatggactagtgacttgctccgcggaccatctgattatcctctggaaaaatggcgaacgcgagagcgggctgagatctttacgactgttccagaagcttgaggaaaacggagacctgtacttagctgtgtag

SEQ ID NO: 34804 - DNA, 1086 bp, Artificial Sequence
  Description of Artificial Sequence: Synthetic coding sequence
atgacccagcagccccttaggggagtcacgtcgcttcggtttaaccaggatcagtcgtgtttctgttgcgcaatggagactggggtcaggatttataacgtcgagccgctgatggagaaaggacacctagatcacgagcaggtcggatccatgggcctagtcgagatgctgcataggagcaacctactggcattagtaggcggtggttccagtcctaaattttctgagatctccgcagtgctgatttgggatgatgcgagagagggaaaagatagcaaagaaaagcttgtcttagaattcacctttaccaagcctgtgctgtccgtgcgaatgcggcacgacaagatagtcatcgtgttgaagaatcgcatatacgtctacagtttcccagataatcctcgtaaactgtttgaattcgacactagagataatccaaaaggcctgtgtgacttatgcccctctctcgagaagcagctgctggtctttcccgggcacaaatgcgggagcctgcagcttgtcgatcttgccagcactaagccaggtacctcttcagcccctttcaccatcaatgcgcatcagagcgacatcgcctgcgtcagtctgaatcagcccggaaccgtagttgccagcgcctctcaaaagggcaccctgattcgtctttttgatactcagtcaaaggagaaattagtggagttgcgtcgaggaacagacccagccactttgtattgcatcaatttttcgcacgatagtagcttcttgtgcgccagctcagataaaggcacagtgcatatcttcgcgctcaaggatactcgacttaacagaaggtccgccttggcacgggttgggaaggtggggcctatgatcgggcagtacgtggactcacagtggtctctggccagctttactgtccctgctgagagcgcttgtatttgtgcattcgggcggaacacatctaagaacgtcaactccgttatcgccatttgcgttgatggcaccttccataagtacgtgtttacccccgacgggaattgcaatcgagaggctttcgatgtttatctcgatatctgcgatgacgacgatttctag

SEQ ID NO: 34805 - DNA, 1833 bp, Artificial Sequence
  Description of Artificial Sequence: Synthetic coding sequence
atggagactgcccccaaaccgggcaaggatgtgcccccaaagaaagacaaactccaaactaagcgaaaaaagccgaggcggtactgggaggaggagaccgtccccaccaccgccggcgcctccccaggcccacctagaaacaagaagaacagggagcttcgcccccagcgtcccaaaaatgcatatatactgaaaaaatctcggatcagtaagaaaccacaagtccccaagaagccacgagaatggaagaatccagaaagccaacgggggctgtctggcacgcaggacccgttcccaggccctgctccagtgcctgtggaagtcgtgcagaagttttgccgcatcgacaaaagtcgcaagttaccacattccaaagctaaaacaaggtcaagattggaggtcgccgaggccgaggaagaagagaccagtatcaaggcggcccggtctgagcttctgctcgcggaagagcctgggttcctcgaaggagaagacggcgaagataccgccaaaatttgccaggccgacattgttgaggccgttgacatagcatccgccgccaagcacttcgacctaaaccttcgtcagttcggcccttaccggctcaattattcccggacgggcagacacttagcattcgggggcagaagaggtcacgtagccgctctggactgggttactaaaaagctgatgtgtgagatcaatgtgatggaggcggtgagggatatccggtttctccacagcgaggcactgctcgcagtggctcaaaataggtggttacacatttatgataaccaaggcatcgaactgcactgcattaggcgctgtgacagggttacccggcttgaattcctcccatttcattttctcctggcaacggcgagcgaaactggctttctgacctacctcgatgtgtccgtggggaaaatagtggccgctttaaacgctcgggccgggcggctcgatgtcatgagccagaacccgtacaacgctgttattcatctgggacacagtaacggcacggtctcactgtggtctcccgcaatgaaagagcctctggcaaagattctgtgccatcgcggaggcgtaagagccgttgccgtcgattccacaggtacatacatggccacctccggactagatcatcagctaaaaatattcgatctaaggggaacctaccagcccctctctacaaggactcttccgcatggggcaggccatctggcctttagtcagaggggtctattagtggccggcatgggtgacgttgtcaatatttgggcaggacagggcaaggccagcccaccttctctcgaacagccctaccttactcataggctaagcggaccagtgcacggcctccagttctgccccttcgaggatgtcctgggcgtgggacacactggcgggattacatccatgcttgtgcccggggcaggtgaacccaatttcgacggtctggagtcgaacccctaccggagcaggaagcagcgacaggagtgggaagtcaaagcgctcctcgagaaagtacctgcagaactgatctgtcttgaccctcgcgccctggccgaagttgatgttatcagtctggaacagggcaagaaagaacagattgaacgcctgggttacgatcctcaggctaaggccccattccagccaaagcctaagcagaaaggacgctctagtacggcctcgctggttaaacgcaagcggaaggtgatggatgaggagcatcgcgataaagtccgccagtctctgcaacagcaacaccacaaagaggccaaagcaaaacccactggcgcaaggccaagcgccctcgatagattcgttagatag

SEQ ID NO: 34806 - DNA, 1833 bp, Artificial Sequence
  Description of Artificial Sequence: Synthetic coding sequence
atggagactgcacccaaaccgggcaaggatgtgcctccaaagaaagacaagttgcagacgaaaagaaagaagcctcgtaggtattgggaggaagagactgtcccaacaaccgcaggagcctccccaggtccccctcgaaacaagaaaaacagggagctccgaccccagcggcctaaaaatgcctacattctcaagaagtcccgtatttccaaaaaaccccaggtcccaaagaagcctcgcgagtggaagaaccccgaaagccagagagggttgtctggcgctcaggatccatttcccggccctgccccagttcccgtcgaggtggttcaaaagttttgccggattgacaagtcacggaaactgccacactcaaaagccaagaccaggtcacggctcgaggtcgccgaggcagaggaggaggagacatctatcaaagcggcccgctctgaactacttttggctgaggagcccgggtttcttgagggggaggacggcgaggatactgctaaaatctgccaagccgacatcgtggaggccgtcgatatcgccagcgcggccaagcattttgatctgaacctgaggcaatttgggccctacagattgaactactctcgcactgggcggcatctggcatttggaggcagaagaggccacgtggctgccctggactgggtcacaaaaaagctgatgtgtgaaataaatgtgatggaggccgtgcgcgatatccggtttctccactcagaggcgcttttagccgtggcccaaaatcggtggctgcacatttatgataatcagggaatcgaactacattgtattagacggtgcgaccgcgtgacccgtcttgaattcctcccattccactttctgttagccaccgctagtgaaacaggcttccttacatatctggacgtgtccgtgggcaaaatagtagctgctttaaacgctcgcgccgggcgactggatgttatgagtcagaatccctacaatgccgtgattcatctggggcatagtaacgggaccgcctcactgtggagtcctgccatgaaggaaccactcgcgaagatcctgtgtcaccgcggcggcgtgcgggctgtggcagtcgattccacaggaacatacatggccacttccggactggatcaccaactgaaaatcttcgatctccgcggtacatatcaacccctgtctacccgtacactgcctcacggcgctggtcacttggcattctcacagcgcggcttgcttgtcgctggaatgggcgacgttgtaaacatctgggctggccaaggcaaagcatcccctcccagtctggaacaaccctatctcacacatcgactctcgggtccagtgcacgggctgcagttctgcccttttgaggacgttcttggtgtgggccacacaggtgggatcacatcaatgctggtgcccggcgcgggagagccaaatttcgacgggctcgagagtaatccttaccgcagtaggaaacagcgtcaggaatgggaagtgaaggccctcctcgagaaagtacccgcagaattgatctgtctcgatcctcgagccctcgctgaggtggacgttatttcactggagcagggcaaaaaggagcaaatcgaacgattgggctacgacccacaggcgaaggcaccttttcaacctaagcccaaacagaaaggacggagttctacagcgtcactagtcaagcggaagagaaaagtgatggacgaggaacatcgggataaggtgcgccagtccctgcagcagcagcaccacaaagaggccaaagccaaaccgacaggggctcgcccctccgccctagaccgattcgtacggtag

SEQ ID NO: 34807 - DNA, 969 bp, Artificial Sequence
  Description of Artificial Sequence: Synthetic coding sequence
aaaagtcgcatttctaagaagccacaggtgcccaaaaaacctagggagtggaagaaccccgagagccaaagagggctgtcaggggctcaagacccctttcctggtcctgctccagtccccgttgaggttgtgcagaagttttgtagaatcgacaagagtcgaaaactgccgcattcgaaggcaaaaaccaggtcccgcctagaggtggcggaagctgaagaagaggagacgtcaatcaaagcagcccgctctgaactactcctggcagaagagcctggtttcttggagggggaagacggagaagatactgctaaaatctgccaggccgacattgttgaagcagtggacatcgcatccgcagctaagttcgggccttaccggctcaattactcccgcaccggaagacatttagcgttcgggggaagaagagggcacgtcgccgcacttgactgggtaaccaagaagctgatgtgcgaaattaacgtgatggaggcggtgcgtgacattcgcttcttacacagtgaggctctgctcgccgttgcccagaacagatggctgcacatctatgataatcaggggattgaactgcactgtatcagacgctgtgacagagtgacccgccttgaatttctgccctttcactttctcctcgcaaccgcctcagaaacaggatttctgacctaccttgacgttagtgtcggcaagatcgtcgcggccctgaacgccagagctggccggttggacgtaatgagtcagaatccttataacgcagtgattcacctgggccactctaatggtactgcatccctttggagccccgcaatgaaggagcctcttgccaagattctctgccaccgagggggggtccgcgctgtggctgtggacagcacaggcacctatatggcaacaagcggactagaccaccagttgaaaatttttgatctccgcgggacgtaccaaccactgtag

SEQ ID NO: 34808 - DNA, 1833 bp, Artificial Sequence
  Description of Artificial Sequence: Synthetic coding sequence
atggagaccgcgccaaaaccgggaaaggatgtacctcccaagaaagataaactccagacgaagcgcaaaaagcccagacgatactgggaggaggagaccgtgccaacaaccgcaggagcgtccccaggcccaccacggaacaagaaaaatcgggagctcaggccgcagagacctaagaacgcctacatattgaaaaagagccggatatcaaaaaaacctcaggtgcctaagaagccccgcgagtggaagaatccagagtcgcagaggggcttgtccggggctcaggacccattccctggacctgcccctgtgccggtcgaagtcgtccagaagttctgcaggattgataagtctcggaagttgcctcactccaaagctaagaccaggtctagattggaagtggccgaggctgaagaagaagagacctcaatcaaggctgcccgctctgagctactgctggctgaggagcccgggttcctggaaggcgaggacggagaggacacagccaagatttgtcaggctgacatcgtagaagctgtggatattgcttccgcagctaaacatttcgatctgaatctccgacagttcggaccctatcgtctgaactacagcagaaccggccggcacctcgcctttggcggacggcggggtcacgtggccgcgttagattgggtgaccaaaaagcttatgtgcgaaattaacgtgatggaggcagtccgcgacattcgcttcctgcacagcgaggccctgctggccgttgctcagaacaggtggctgcacatctacgacaatcaaggcattgagcttcattgcattagacgctgtgaccgcgtaactagactggaatttctgcccttccatttcttactcgcgacagcaagcgaaacaggcttcctcacctacctggacgtttctgtgggaaagattgtggcggccctgaatgcacgtgccgggcggctggatgtgatgagccaaaatccttacaacgccgttatccacctgggtcacagcaacgggacggtgagcctgtggtcacctgcaatgaaagagccccttgctaagattctgtgccaccggggtggagtcagggctgtcgcagtggattccaccggtacctatatggccaccagcgggctggaccaccagctgaaaatctttgaccttcgtggcacctatcaacctttatcaacacggactttgccgcatggcgctggccacttggctttctcacagagagggcttcttgtggctggaatgggcgacgtagtgaatatttgggctggacagggaaaggcttcacctccttcattggaacaaccctaccttacacacaggctctccgggcccgtccatggcttacagttctgcccatttgaagacgtgttgggcgtgggacacacaggcggtatcacctcaatgctggtaccaggcgctggtgagccaaactttgatgggctcgagagcaatccctaccggtctagaaaacaacgccaagagtgggaggtcaaagcgctgttagaaaaggtgcctgccgagctcatctgtcttgacccacgtgccctggccgaggtggatgtaatatcgctggaacagggtaagaaggaacaaattgagcggctcggatatgacccccaggccaaagccccctttcaacccaaacccaagcagaagggcaggagttctacggcctccctggtgaagcggaagcggaaagtgatggatgaggaacacagagataaagtaagacaaagcctacagcagcaacaccataaagaggcaaaggcaaagcctactggagctcgccccagtgcgctggacaggttcgtaagatag

SEQ ID NO: 34809 - DNA, 1833 bp, Artificial Sequence
  Description of Artificial Sequence: Synthetic coding sequence
atggaaaccgcacccaagccagggaaagacgtcccacctaagaaggacaaattgcagactaaacgcaaaaagccacgacgttattgggaagaggaaaccgtcccgaccactgctggcgcaagccctggacccccgaggaataaaaaaaacagagaactgcgcccacagcggcctaaaaacgcttacatcctgaaaaagtctcggatttcaaagaaaccccaggtccctaaaaagccgagagaatggaaaaaccctgaatcccagcgcggcctgtctggtgcccaggacccatttcctggtccagctcctgtccccgtggaggtggtccagaaattctgcagaattgataagtcgaggaaacttccgcattctaaggcgaagactagatctcggcttgaagtcgccgaagcggaggaagaggaaacaagcattaaagcagcgcgtagcgaactgctacttgcggaggaacccggttttcttgagggagaggacggggaggataccgctaaaatctgccaggcagatattgtggaggcggtcgatattgcctccgccgccaagcactttgacttaaatctgcgacagttcggcccgtatcgactgaattactcacgcaccggacgtcacctggcttttggtgggcgaaggggtcacgtggcagccttggactgggtgaccaaaaaactgatgtgtgagataaatgtcatggaagctgtccgcgacatccgatttctccattcagaagccttgctcgctgtcgctcagaacagatggttgcacatttacgataaccaggggatcgagctgcactgcatacgtaggtgtgatagggtgacacggttagagtttctcccttttcattttttgctggcaactgcttccgagaccggcttcctgacctacctggatgtgtccgtcggaaagattgttgcagccctcaacgctcgcgccgggcgccttgacgttatgtcacagaacccctacaatgctgtgattcacctcgggcactccaacgggactgtgtctctgtggagtccagcgatgaaagagcctctagctaagatactttgtcataggggaggtgtgagggctgtagccgtggattccactggaacctatatggccaccagcggccttgatcatcagcttaaaattttcgatctccgtggaacttaccaacctctcagcacacggacactccctcatggtgcaggtcacctagctttttctcagaggggcttgttagtggcaggcatgggcgatgttgtcaacatttgggcaggccaagggaaggcttcacccccctcccttgagcagccttacttaactcacagactcagcgggcccgttcacggactccaattttgtcccttcgaggatgtactgggagtgggccatactggcgggatcactagcatgctagtcccaggcgcaggcgagcccaacttcgatgggctggagtccaacccataccgcagccggaaacagcgccaagagtgggaagtgaaagcgctgctagaaaaggtgcccgcggaactgatctgtctcgaccctagggccctggccgaagttgatgtgataagcttagaacagggcaagaaagaacaaatcgagcgtctgggttatgacccgcaggccaaagccccattccagcccaagcccaaacaaaaagggcgatcctctaccgcaagtctggtcaaacgcaaaaggaaggtaatggacgaagagcaccgtgacaaggtgaggcagtccctacagcaacaacaccataaagaggcgaaggctaagcccacgggtgcaagaccctcggccctagacagattcgtgcgatag

SEQ ID NO: 34810 - DNA, 969 bp, Artificial Sequence
  Description of Artificial Sequence: Synthetic coding sequence
aagtcacgcatcagtaagaaaccgcaagtgcccaaaaagcctcgcgaatggaaaaaccccgagtcccagcgaggcctcagtggggcacaggatccgttccccggccctgcgcctgtgccagtggaagtagtccaaaagttttgcagaatcgataagtccagaaagttgccacatagtaaggctaagactagatctaggcttgaggtcgctgaagcagaagaggaggagacctctatcaaggcagccaggtccgagttgctgctagccgaagaaccaggtttcctggagggggaagacggcgaggatacggccaaaatatgccaggcagatattgtggaggccgttgatatcgcttccgccgccaaatttggcccttaccgtttgaattatagccggaccgggcgacacctcgcctttggggggcgacgcggacatgttgcagccttggactgggtgaccaagaagctgatgtgtgagattaatgtcatggaggctgtaagggacatcagattcctgcactcggaggctctgcttgcagttgctcagaaccgctggttgcacatatatgacaaccagggcatcgagctgcactgtatcaggaggtgcgatcgcgttacccgcctggagtttttgcctttccatttcttgctcgctaccgccagcgagaccggctttctgacctatttggacgtgtcggtgggcaagattgtcgccgcactgaacgctagggcaggccgcctggatgtgatgagccagaacccatataatgccgtgatacacctgggtcacagcaacggcacagtgagcctctggtcgcccgctatgaaggagcccttagccaagatcttatgccatagaggcggagtcagagccgtcgcagtagattctacaggtacctatatggctacatcagggcttgaccaccagctcaaaatcttcgatctcagaggcacgtaccagcccctgtag

SEQ ID NO: 34811 - DNA, 969 bp, Artificial Sequence
  Description of Artificial Sequence: Synthetic coding sequence
aagagtcgcatctccaagaagccccaagtgccaaagaaacctagggagtggaaaaatccagagtcgcagagagggcttagtggcacccaggacccattcccagggcccgctccggtgcccgtggaagtggttcaaaagttctgtaggatcgataaatctcgcaagctgccccactcaaaagcaaagactcggtccagactggaagttgcagaggccgaggaagaagaaacctctatcaaggccgctagaagcgagctgctgctggctgaggagcctggtttcctggagggcgaggacggcgaagacacggccaaaatttgtcaagcagatatcgtggaggccgtggacattgcgagtgccgcaaagttcggcccctatcggctcaactactcaagaaccggcaggcacctggcgttcggcggaagaagaggccacgtggcagcgcttgattgggtgacaaagaaactcatgtgcgaaattaatgtaatggaggccgttagagatattcggttcctgcactcagaggctctcttggctgtagcgcagaataggtggctgcacatttatgacaatcaaggaatcgaactccattgcatacgcaggtgcgatagagtgacccgcctggagtttcttccctttcattttctgctcgctaccgccagtgagaccggattcttgacgtacctggacgtttctgtgggcaaaatcgtcgcagctctgaacgctcgggcgggcagactggacgtgatgtcacagaatccttataacgctgtgatccatctcggacacagtaatggaaccgtaagcctttggagtccggccatgaaggagcccctggccaagatcctctgtcacagaggaggcgtgagggctgtcgcagtggacagtacgggtacttacatggctacaagcggactcgatcaccaactgaagattttcgacctgcgaggtacctatcagcctctgtag

SEQ ID NO: 34812 - DNA, 969 bp, Artificial Sequence
  Description of Artificial Sequence: Synthetic coding sequence
aaaagccgcatatccaagaaaccccaggtgccgaaaaagccaagggagtggaagaatcccgaaagtcagaggggcctcagtggcgcccaggaccctttcccaggaccagcccccgtgcccgtggaggtggtgcagaagttttgcagaatcgataaatcaagaaaactgcctcactcaaaagccaagacaaggtctaggctcgaggtggcagaagctgaggaggaggagacgtcgatcaaggctgctaggtccgaattgctgcttgccgaggagccggggttcttggaaggtgaggatggcgaagatactgccaagatttgccaggccgatatagtggaggctgtggatatcgcctctgcagcaaagtttggaccttataggctaaattattctagaactggaagacacctcgcatttgggggtaggaggggccacgttgccgcactggactgggtgaccaaaaagctcatgtgcgaaatcaatgtcatggaggctgtccgtgacatcagatttctgcattccgaggcactactggcggttgctcaaaaccgatggctacacatctacgataatcagggaatagagttgcactgtattcgaagatgtgacagagtcactagattggaatttttacccttccatttcctgcttgccacagcctccgaaacgggctttcttacctatctggacgttagcgttggaaaaattgtggccgccctcaacgccagggctggacggctggatgtaatgtctcagaacccctataatgccgtcatccacctaggccattccaatgggacggtgtctctgtggtcgcccgcaatgaaggagccgctggcgaagatcttgtgtcatcggggcggggttcgcgccgtagcagtggattcgacaggcacatacatggctacctcaggtctcgatcatcagctcaaaatctttgacctacgtggtacctatcaaccgctgtag

SEQ ID NO: 34813 - DNA, 969 bp, Artificial Sequence
  Description of Artificial Sequence: Synthetic coding sequence
aaaagccggatttcgaaaaagccacaagtacccaaaaaaccccgggagtggaaaaacccggaaagccagaggggtttatcgggtgcgcaggaccccttccctggccctgcccctgttccagtcgaggtggtgcagaagttctgccggatcgacaagagccgcaaattgcctcatagcaaggccaagaccagaagccgacttgaagtggccgaggctgaagaggaggagaccagcatcaaagccgccaggtcggaattgttattagctgaggaacccggatttctcgaaggggaagacggagaagacaccgccaagatctgtcaggctgacatcgtcgaggccgtggacattgcaagtgctgcaaagttcggcccatataggcttaattacagtcgcacaggccgtcatctggccttcgggggtcggcggggacatgtggccgcactggattgggtgaccaaaaagctcatgtgtgaaataaacgtaatggaggcagtgagagatatcaggtttttacacagtgaggcgctcctggcagtcgcacagaacagatggctacacatttacgacaaccagggcatagaactgcattgtatccgccgctgtgatcgggtgacacgcttagagttcttgccatttcattttcttcttgcaacggcctcagagaccggctttttgacctatctggatgtcagcgtcggcaaaatcgtggcagccctgaacgcgagagccgggcggcttgacgtcatgtcccaaaacccctacaatgcagtaatccatctgggacattcgaatggtactgtgtcactctggagccccgccatgaaggaacctctggcgaaaatcctgtgccatagagggggagtgcgggctgtggcagtggacagcacaggaacgtatatggctaccagtgggctcgaccaccaattgaagattttcgacctgcgcggcacatatcaaccgctgtag

SEQ ID NO: 34814 - DNA, 1833 bp, Artificial Sequence
  Description of Artificial Sequence: Synthetic coding sequence
atggagacggcaccaaaacccgggaaggacgttccgcccaaaaaagataaactgcagactaaacgtaagaagcccagaaggtactgggaggaggagactgtgccaacaaccgccggagcatctccaggacccccacggaataagaagaatagggaattgcgaccgcagagacccaaaaatgcttatatcttgaaaaaatcacgcatttctaagaagccccaggttcccaagaagccaagggagtggaagaacccagaatctcagcgggggctgtctggcgcccaagacccttttcccggacctgctccagttcctgtggaggttgtacaaaaattctgtcgcattgacaagtccaggaagctgccccatagcaaagctaagacaaggtctaggctcgaggtagctgaggcagaagaagaggagacttctataaaggcggcccggtcagagttgctgctggcagaagagcctggcttcctcgagggcgaggatggcgaagatacggcgaagatttgtcaggccgacatagtggaggccgttgatattgctagtgccgcaaagcactttgaccttaacctgagacagttcggaccctatcggctgaactattctcggaccggtagacatctggccttcggtggtagaaggggccacgtggctgcactggactgggtgacaaagaagcttatgtgcgaaatcaacgtcatggaggctgtgcgagacataaggtttttacatagcgaagcccttcttgccgtggcccagaacaggtggctgcatatttatgacaatcaggggattgagttgcattgtataagacgctgtgacagagtcactcggctagagtttttgcctttccactttttgctggcaacagcgtccgaaactggctttttgacatatctcgacgtgtcagtgggaaaaatcgttgccgctctcaacgcaagggccggtcggttagacgtgatgtcccagaatccatataacgccgtcattcacctgggacacagcaacggcacagtgagcctctggtctccggccatgaaggaaccgctggcgaagatactctgccaccggggcggagttcgggccgtcgccgtcgacagtacaggtacatacatggcgacaagcgggctcgatcaccagctcaaaatatttgatctccggggcacataccagccgcttagcacacggactctaccgcacggagccggccacctagccttcagccagcgcggccttttggtcgccgggatgggggacgttgtgaacatctgggctgggcaaggtaaggcaagccccccttctttggaacaaccctatctgactcatcgcctctccggtccagtccatggtctgcagttctgtccttttgaggacgtccttggggtgggccatacaggtggcattacctccatgctggtgccgggggccggtgaaccaaattttgacggcctcgaaagtaacccttacagaagtcggaaacagcgccaggaatgggaggtcaaagcactgctcgagaaggtgcctgccgagttaatctgcctggaccctcgcgccctcgcagaagtggacgtgatctccctggagcaaggcaaaaaagagcagattgaaagactgggttatgatccacaggctaaagctcctttccagccaaaacctaagcaaaagggtaggagtagcacagcctctcttgtgaaaaggaagagaaaggtcatggacgaggagcacagggacaaggtgcgtcagagtcttcagcagcagcatcataaggaggccaaggcgaagcctacaggcgcgcgtcctagcgcgctggaccgcttcgtgcggtag

SEQ ID NO: 34815 - DNA, 2676 bp, Artificial Sequence
  Description of Artificial Sequence: Synthetic coding sequence
atgacggccgaggaaaccgtgaacgtgaaggaagtggaaattatcaagctgatccttgacttcttgaactctaaaaaacttcatatcagtatgctggctttggagaaagagagcggtgtgattaacgggctgttcagcgatgatatgctatttctccgctttcgttatatcatcctcaaacagaagttcctcgaagccctatgtgtgaacaatgccatgagtgccgaagatgagccccagcacttggagttcactatgcaggaggcggtacagtgcctgcatgccttggaggagtactgcccctcgaaagacgactattccaagctgtgcctgctgctcaccctgcctagactgaccaaccacgccgagttcaaagattggaatcccagcaccgcccgggtccattgttttgaggaagcctgcgttatggttgctgagttcatcccagccgacagaaaactgtcagaggccggcttcaaggcctccaataacaggctattccagctcgtcatgaagggtctcctttacgaatgctgcgtcgagttctgccagagcaaggccaccggggaggagattacggagagtgaggtgcttttgggaattgatctactgtgtggcaacggatgcgatgacctggacctatcactactgtcctggctgcagaatctcccctcaagcgtgttttcatgcgctttcgaacagaagatgctaaatatacacgtggacaagctcctcaaacccacaaaggctgcctacgccgacctactgactccactgatcagcaagctatctccatatccaagcagccccatgagaagacctcagtcggccgacgcgtatatgacgcgtagccttaatccagccctggacggactgacttgtgggctgacttctcatgataagcgcatctcagaccttgggaacaaaacttctcctatgagtcattcctttgccaacttccattatcccggcgtgcagaaccttagcagatctttaatgctagagaatacggagtgccattccatctacgaggaaagccctgagagagatactccagtcgacgcacaaaggcccattggaagcgaaatccttggccagtcgtccgtgagcgagaaggaacccgccaacggggcccaaaatcccggccctgccaaacaggagaaaaacgaactgcgggatagcacggaacagtttcaggagtattatcgacagagactgcgctaccagcaacacctcgaacagaaagagcagcagcgccagatctaccagcaaatgttgctggaaggaggcgtgaaccaagaggatgggcccgaccagcagcaaaaccttacagaacagtttttgaacaggtctattcagaagctgggcgagctgaatattggaatggatggtctggggaacgaagtgagcgcgctgaatcagcagtgcaacggctccaaaggcaatggctccaatggctcgagcgtcacatccttcaccactccaccccaggattctagtcagcgactgacgcatgatgcttcaaatattcatacttccaccccacggaaccctggctcgacaaatcatatcccatttttggaggagtctccctgcggcagccagatttcctccgagcattccgttatcaaaccacctttgggagactctcctgggtctcttagccgcagcaagggggaggaagacgataagagtaaaaagcagtttgtgtgcatcaacatcctagaggatactcaggcagtacgggcagtggcttttcatccggcgggcggtctgtatgccgttggctccaactccaaaacgctgcgcgtatgcgcctatcctgacgtcatcgacccttccgcgcacgagactcctaagcagcccgtggtgcgcttcaaaaggaataagcatcacaagggctcaatctactgtgtagcctggtcaccttgtgggcagctactagccacaggctcaaatgacaaatatgtgaaggtgttgcctttcaatgccgagacgtgtaatgccaccggcccagatctggaattttctatgcacgatggcacaatcagggatttagcattcatggagggtcccgaaagcggaggtgcaatcctcatttcagcaggagctggcgactgcaatatttacacaacggattgccagcgtggccagggtctgcacgccctatcaggccacaccggccatatcctggccctgtacacctggagcggctggatgatcgcgagcgggtcccaggacaagacagtacgtttctgggatctcagagtgccttcctgcgttagagtcgtgggcacgacattccatggtactggctccgccgtggcctctgtggccgtcgatccatcgggtagactgctggccactggacaggaagacagcagttgcatgttgtatgatatacggggtgggaggatggttcaatcttaccatccgcactcctctgacgtgagatccgtccggtttagtcctggagcacattacctcctcaccggtagctacgacatgaagattaaagttactgacctgcagggagatttaacgaagcagctaccgattatggtcgtgggcgaacacaaagacaaagtcatacagtgtaggtggcacacccaagacctaagttttttatcttcaagcgccgaccgaaccgtaactctgtggacttacaacgggtag

SEQ ID NO: 34816 - DNA, 2676 bp, Artificial Sequence
  Description of Artificial Sequence: Synthetic coding sequence
atgaccgctgaggagactgttaatgtgaaggaagtggaaatcattaagctaattctagactttctgaactccaaaaaactgcacattagcatgctcgctctggaaaaagaatctggagtgattaacggactgttcagcgacgatatgttgtttctacgtttcagatacattatcctgaaacagaagtttctggaggcactttgcgtgaacaacgcgatgtcggccgaagacgaaccacaacaccttgagtttacgatgcaggaggccgtgcagtgtctgcatgccttagaggagtattgccccagcaaggacgattactccaaactctgtttgctgctgaccctaccaaggctgactaaccatgctgagtttaaggattggaacccatctactgcccgcgtgcattgctttgaggaggcttgcgtgatggtcgccgaattcattccagcagatcgtaaactgagcgaggccgggttcaaagcatccaataacaggctgttccagctcgtcatgaagggcttgctgtatgagtgctgtgtggagttttgccagtcgaaagcaaccggagaggagattacggaatcagaggtacttctgggaatcgatctgctctgtggcaacggctgcgatgatctcgacttatcccttttgtcctggctgcagaacttgccctctagcgtcttttcatgtgcgttcgaacagaaaatgctgaacatccacgtagataagctcctgaagcccacaaaagccgcatatgcagacctgctgaccccgttgatctccaaactctccccgtaccccagcagccctatgagacgcccacagtctgccgatgcgtatatgacacggtcactaaatccagctctggatgggctgacatgtgggctcactagccatgataagagaatatccgacctcggaaataagaccagtcccatgtcacatagtttcgccaattttcactacccaggcgttcagaacctgagcagaagccttatgctggagaataccgagtgccactccatttacgaagaatctcccgaaagagatacgccagtggacgcacagagacccattggatccgagatccttggccagagcagcgtgtcagagaaagaacccgcgaatggggctcaaaatcccggacctgcgaagcaggagaagaacgaactgcgcgactcaaccgaacagttccaggaatattatcgccagaggctgcgttatcagcaacatctggagcagaaagaacaacagcgtcagatctaccagcagatgctgctggagggcggagttaaccaagaggacggacctgatcagcagcagaatctaacagagcagtttctgaataggtcaattcagaagttaggggagctgaatatagggatggatggactgggcaatgaagtcagcgccctgaaccagcagtgtaacggatctaaaggaaatggcagtaatggtagctcagtcacgagtttcactaccccgccacaggactctagccaaaggctcacccatgacgcatccaacattcacaccagtacccccagaaaccccgggtcaaccaaccatattccctttctggaagaatccccctgcggaagtcagatctcttctgagcacagtgtgataaaacctcctctaggtgattctccgggatctctcagccgtagcaaaggtgaagaagacgacaagtctaagaaacaatttgtttgtataaacatcctcgaagacacccaggcggtccgagcagtggctttccaccctgccggagggctgtatgcggtggggagcaactctaaaaccctgagggtctgcgcctacccagatgtgattgacccttcagcccatgagactcctaaacaaccggtagtgcgatttaaacgcaataagcaccataaaggcagcatatactgtgtggcatggtctccttgtgggcaactgctggccactggatccaacgacaagtatgttaaggtgctgccatttaatgctgagacttgcaatgcgacagggccggatcttgagttcagtatgcacgacggaactattcgtgacctggcttttatggaaggcccagagagcgggggcgccatcctgatctcagccggggccggtgattgcaatatatacactactgattgccagagagggcagggcctccatgccctcagtggtcacactggtcacattctggcactatacacatggtctggctggatgattgcttccgggtcccaggacaaaacggtccgcttctgggacctcagagtgccctcctgcgtgagggtagtgggtactacatttcacggcactggatctgccgtggcttctgtggcagtggacccgagcggaagacttctcgccactggccaggaagactcctcttgtatgctatatgacatccgcggcgggcgcatggtccagagttatcaccctcattcttctgacgtgcgtagcgtcaggttttcgccgggggcccactacctgctgactggctcttatgacatgaagattaaagttactgacctgcagggcgatctgaccaaacagttgcccatcatggtcgtgggcgagcacaaggataaagtaatccaatgtagatggcacactcaggatctgtcctttctctcatcatcggccgaccgaacggtgacgctgtggacttacaacggttag

SEQ ID NO: 34817 - DNA, 2760 bp, Artificial Sequence
  Description of Artificial Sequence: Synthetic coding sequence
atgactgctgaggaaacggtgaacgtgaaggaggtggagatcatcaaattaatcttggatttcttgaatagtaagaagctacatattagtatgctggcccttgaaaaagagtcgggggttatcaacggcttgttttctgatgatatgctctttctcagacagttaatcttggatggtcagtgggacgaggtgctgcaatttatccagcccctggagtgtatggagaagttcgataagaagcgatttcgttacataattctgaagcagaagtttctagaggcgttgtgtgtcaacaatgccatgagtgctgaagacgaacctcagcacctggaatttactatgcaggaagcggtccaatgtctgcacgctctcgaggagtattgtccatctaaggacgactacagtaagctatgtctattgctgacccttccccggctgacaaatcacgcagaattcaaagattggaacccttccactgcccgggtacactgtttcgaagaagcgtgtgttatggtggccgaatttattcctgccgatcgcaaacttagtgaggccggatttaaggcttccaataatcggttgtttcagctcgtcatgaaggggttgctgtatgagtgctgcgtagaattctgccagtctaaggcgactggtgaggagatcactgaaagcgaggtgctgctcgggatagacctcttgtgcggcaatggatgtgacgaccttgatctgagtctgctgtcatggctgcaaaacttgcctagttcagtattcagctgcgcattcgagcaaaagatgctgaacattcacgtggataaacttctcaagccaacaaaggctgcttatgctgatctgctgacccctctgatctctaagctgtccccttatccatctagtcctatgcgtcggccacagtccgccgatgcttatatgacacggtcattaaatcctgccctagatgggctcacgtgtggcctaacatctcatgataagaggatcagcgacctggggaacaaaacttccccaatgagtcattcttttgcaaactttcactacccgggtgttcagaatctgtcccgtagtcttatgctcgagaataccgaatgtcacagcatttacgaggaatctccagagcgtgatacccccgtagacgcacagagacccatcggctcagaaatacttggtcagtccagtgtttccgagaaggagccagctaacggcgcacagaaccctgggccagcgaaacaggaaaaaaacgagctgagggatagcaccgaacagtttcaggaatactataggcagcggctgcggtatcagcaacatcttgagcagaaggagcagcagagacagatctaccagcagatgctgttagagggaggagtgaatcaggaggacggccctgaccagcaacagaatcttaccgagcagtttcttaatagatcaattcagaaactgggagaactcaacatcggcatggacggcctggggaacgaagtctccgctctgaaccagcagtgcaatggatccaaggggaatggatcaaatggcagttccgtcacctccttcaccaccccccctcaggacagctcacagcgtcttacacacgatgccagcaatattcacacatccacgcctcgcaatcccggttcaaccaatcatatcccattcctggaagaaagtccatgcgggagccaaatctcctctgagcattccgtgattaaaccacctcttggagactctccaggatctctttcgcgcagcaaaggagaggaggatgacaagagcaagaagcagtttgtgtgcattaacatcctagaagacactcaggccgtgagagctgtcgccttccacccagccggggggctatacgccgtgggatccaatagcaaaaccctgcgggtctgcgcctatccagacgtgattgacccctcagcccatgagacgcccaagcagccagtggtcaggtttaaacgtaacaaacaccacaagggttcgatttactgcgtcgcatggtctccctgtgggcagctgttagctacaggatccaacgataaatatgtaaaagtgctgccttttaacgcagaaacgtgtaatgcaactggccctgatttagaattttctatgcatgacggcactatcagggacctcgctttcatggaaggccccgagtcagggggtgcaatcctcatttctgcaggcgctggggattgtaacatttatacgacagattgtcagcggggacagggtttgcatgctctttccggccacaccggacatatcctggccttgtatacgtggtccgggtggatgattgcatctggtagccaggacaaaaccgtacgcttctgggacctcagagtacccagctgcgtgcgcgtagttgggacaacgttccatggtaccggctccgccgtcgcttccgtcgcggtggaccctagtggccgcctgcttgctaccggacaagaggattcgagttgcatgctgtacgacattcgaggcggtagaatggttcaatcttatcacccacatagcagcgatgtgagaagtgtgcggttttcgcccggcgcccactacctgcttaccggaagctacgacatgaagatcaaggtgacagacctacaaggcgatcttacaaagcaactccccatcatggtcgtgggtgagcataaggacaaggtgatccagtgtaggtggcacacccaagacctcagttttctgtcttcctcagctgaccgcaccgtgactttatggacttacaacggctag

SEQ ID NO: 34818 - DNA, 2763 bp, Artificial Sequence
  Description of Artificial Sequence: Synthetic coding sequence
atgaccgccgaagagacagtcaatgtgaaagaagtcgagattattaaactcatcctggatttcttgaatagcaaaaaactccacatctccatgctcgcactcgaaaaggagtctggagtgattaatggcttattctccgacgacatgctctttctgcgacagctaatattagacggccagtgggacgaggttctccagttcattcaacctctggagtgcatggagaagttcgacaaaaaacggttcaggtatattattctgaagcagaagttcctggaagctttgtgcgtcaataatgccatgtccgctgaggatgaaccccagcacctggagtttacaatgcaggaagccgtgcaatgcctgcatgctttggaggagtattgcccctcaaaggatgactatagcaagctttgtcttttacttacactcccccggttgaccaatcacgccgagttcaaggactggaacccttcgactgccagggtgcattgcttcgaggaggcatgtgtgatggtagccgaatttatcccagctgaccgcaaactctccgaggcaggatttaaggctagcaacaatcgtctgttccaactcgtcatgaagggcctcctgtacgaatgttgtgttgagttttgtcagagtaaggctactggtgaagaaatcacagagtccgaagtcctgctcggaatcgatcttctttgcggaaatggctgtgatgacctggacctctcccttctgtcctggctgcagaacctaccttcttctgttttctcctgtgcattcgaacagaagatgttaaatattcacgtcgataagctgctgaaacccacgaaagctgcgtacgctgatcttctcacgccccttatctctaaattatctccctaccctagttcaccgatgaggagaccccagagcgccgatgcatacatgacgcgctctctgaaccccgctctggatgggctgacttgcggcctcactagccacgacaagagaattagcgacctgggaaataagacaagcccaatgagccatagcttcgccaacttccactacccgggcgttcagaatttatcacgttcactgatgctcgaaaacaccgagtgtcattcaatttatgaggaatccccagagcggagcgacaccccagtcgatgcccagcgccctattgggtccgagatactgggccagtcttctgtgtccgagaaagagcctgcaaacggcgctcaaaatcccggtcccgcaaagcaggagaaaaacgagctcagggacagcaccgagcagttccaagagtattacaggcaaagactgagataccagcagcatctcgagcagaaggaacaacagaggcagatttaccagcagatgctgctggaaggaggtgtgaatcaagaagatgggcctgatcagcaacaaaacttaactgagcagttcttgaatcggagtatccaaaaacttggggagcttaacattggtatggacggattggggaacgaggtctccgccttgaatcagcagtgcaacgggagcaaaggcaatggatctaacggctcatcagtgacatcctttaccaccccaccacaggacagctctcaacggttaacccacgacgccagcaatatacacacctcaactcctcgtaatcccggctccaccaatcacatcccgtttctcgaggagtcaccctgtgggtcacagatctcttccgagcattccgtaatcaaaccgccacttggcgactccccagggtctctgtcaaggtcgaaaggtgaggaggatgacaagtctaagaagcaattcgtatgcataaatatattggaggatacccaggcagtcagggctgtggcttttcatcccgccgggggtttatacgccgttggcagcaactccaagacactacgggtctgcgcgtatcctgacgtcatagacccctccgctcacgagacccccaagcaacccgtcgtgaggttcaaacggaacaaacaccataagggaagtatttactgtgtggcatggagcccttgtggccagttgttggcaaccggcagcaatgacaagtatgtgaaggttctacccttcaacgccgaaacatgcaatgcgactggaccagatctagagttttccatgcacgacggcactattagagacctcgcatttatggaaggaccggaaagcggtggagcaattctcatctccgccggcgctggagactgcaacatctacacaactgattgccagagaggacagggtctgcatgccctcagtgggcacacaggccacatccttgcactctacacatggtcaggttggatgatagccagtgggagtcaggacaagacagtgcggttctgggatttgagagtcccttcatgcgtgagagtcgtgggaaccacttttcatggaacaggaagtgccgtcgccagtgttgccgtggacccctcagggaggctgctcgccaccgggcaggaggattctagctgtatgttgtacgacatcagagggggtcgcatggtgcagtcctatcatccccactcttccgatgtaagatccgtgaggttcagtccaggagctcactacctattgaccggttcctatgatatgaagatcaaggttaccgatcttcagggcgacctgacgaagcagctgcctatcatggtggtgggtgagcataaagataaggtgatccaatgtcgatggcatacacaagacctttcttttctcagttctagcgccgacaggacagtgacactatggacttacaacggctag

SEQ ID NO: 34819 - DNA, 2784 bp, Artificial Sequence
  Description of Artificial Sequence: Synthetic coding sequence
atgacagccgaagaaactgtaaatgtcaaggaagtggagattatcaagctgatactggatttcttgaactccaaaaagctccatatctcgatgctggctctggagaaggaatccggcgtgatcaacggcctgtttagtgacgacatgctgttcctgcgtcagctgatactggacggccagtgggatgaagtgttgcaattcatccagccactcgagtgtatggagaagttcgataaaaaacgatttagatacatcatcttaaagcagaagtttctagaagccctgtgcgtgaacaatgccatgtcagctgaagacgagccacagcatgtgcgctttcttttcctcaaactggagttcacaatgcaggaggctgttcagtgcctgcacgccctggaagagtattgtcctagcaaagacgattatagcaagctgtgcctgcttctcacactccctcgattgacaaaccatgctgagtttaaggactggaatccctccaccgcacgagtgcattgttttgaggaggcatgtgtgatggtggcagaatttatcccagctgatcgcaagctgtccgaggccgggttcaaggcctccaataacaggctgtttcagcttgtgatgaagggactactttacgagtgctgcgttgagttctgccagagcaaagctaccggcgaggaaattaccgaatcagaggtcttgctgggtatcgatttgttgtgcggcaatgggtgtgacgacttagatctgtcactgctctcatggctacaaaacctcccatcttccgtgtttagttgtgcctttgagcaaaaaatgcttaacatccatgtagacaaattactgaagcctactaaggctgcatacgctgacctgctaacacccctaatcagtaaactgtccccctaccccagctcccccatgaggcggcctcagagtgctgatgcatacatgacccgcagtctgaaccccgcgcttgatggcctgacttgtggattgaccagccatgataaacgaataagcgatctggggaacaaaacttcccctatgagccactcattcgccaattttcattacccaggcgtgcagaatctgtcaaggagcctaatgctggaaaacactgaatgccacagtatttacgaggaaagccccgaaagatccgatacacccgtggacgctcagcggcccatcggctccgagatactggggcaatcttcggtttcagaaaaggagccagccaatggcgcccagaaccccggcccagctaaacaagagaaaaatgaactgcgtgactccacagaacagtttcaggagtactaccgtcagcgtctgcgataccagcagcatctggagcagaaggaacagcagcgtcagatctaccagcagatgctcctcgagggtggagtgaatcaagaagatggtcctgaccagcagcagaatctgactgagcagtttctgaataggtcaattcagaaattaggggagctcaatatcgggatggacgggctcggaaacgaggtctctgctctgaaccagcaatgcaatggtagcaaaggaaatggcagtaatggctcttccgtgactagcttcactactcctccccaagatagcagtcagcggctcacccatgatgcatccaatatacacactagcacacctcgtaatcccggcagtaccaaccacataccatttctagaagaatcaccctgcggcagccaaatctccagtgaacatagcgtgattaaacctcccctgggtgactcgcccgggagcttatcccgatcaaagggcgaagaggatgataagagtaaaaagcagttcgtgtgcattaacatcctagaagacactcaagccgtccgggcagtggctttccaccctgcgggtggtctgtatgccgttggtagcaatagcaaaacgttacgcgtctgcgcgtacccagacgtgattgacccttctgcacacgaaacccccaagcaacccgtggtgagattcaaaagaaataagcaccataaagggagcatttactgcgtggcttggtctccgtgtggtcagttgctggctacagggagcaatgataagtatgtgaaggtgttgccctttaacgcagagacatgcaatgcaaccggcccggatcttgaatttagcatgcatgatggtacaattcgggatttggcattcatggagggtccagaatctggcggagctatcctcatcagcgcaggtgccggcgattgtaacatatataccaccgactgtcagcgcggtcagggtctccacgctttaagcggacacacaggccatattcttgcattgtacacttggtcaggctggatgattgcaagcggctcgcaagataaaaccgtccggttttgggatcttcgagttccatcatgcgttcgcgttgtggggacgacctttcacggcactggaagcgctgtagcgagcgtcgctgttgatcccagtggacggctccttgccacaggccaggaagacagtagttgcatgctgtacgacatcaggggaggccgcatggtgcagagctatcacccgcattcttccgacgtgagatcagtgagattctctcccggcgcacactacctgctgacaggaagttacgacatgaaaataaaagtcaccgatctacagggagatttgactaagcagctcccaattatggttgtgggcgaacataaagataaagtcattcagtgtaggtggcacacgcaggacctgtcattcctgtcatcttctgctgataggacagtgaccctgtggacttacaacggctag

SEQ ID NO: 34820 - DNA, 321 bp, Artificial Sequence
  Description of Artificial Sequence: Synthetic coding sequence
atgaccgctgaagaaactgtaaacgtgaaggaggtcgagatcattaaattaatattggattttctcaacagcaagaaactgcatattagcatgttagcactggagaaggaatcgggggtgataaacggactcttcagcgacgatatgctcttcctgagacaactgatactcgacggccagtgggacgaggtcctgcagttcattcagccactggagtgtatggagaagttcgataagaagcgattccggtacatcatcctcaaacagaagttcctggaggccctttgcgttaacaatgcaatgtcagccgaagacgagtag

SEQ ID NO: 34821 - DNA, 522 bp, Artificial Sequence
  Description of Artificial Sequence: Synthetic coding sequence
atgacagcagaggaaaccgtaaatgtaaaagaagtggagatcattaaactcatccttgactttctgaactccaagaaactccatatcagcatgctggccctcgaaaaggagtctggagtcatcaacggcctctttagcgatgacatgcttttcctgaggcagctgatcctcgatggccagtgggatgaagtgctccagtttatccagcctttggagtgcatggagaaattcgataagaaacggtttcggtatatcatcctgaagcagaagtttctagaggcactttgtgtcaataacgcgatgtctgccgaggacgagcctcagcatctggaattcactatgcaagaagctgtccagtgcctccacgccctcgaggagtactgcccctcaaaggacgactacagtaaactatgcctgctgctgactctgccacggttaacaaaccatgctgagttcaaggattggaaccctagcactgcccgagttcattgtttcgaggaagcctgcgtgatggtggcttag

SEQ ID NO: 34822 - DNA, 2094 bp, Artificial Sequence
  Description of Artificial Sequence: Synthetic coding sequence
atggcttggcgggaaaaatccaagaaacgccttaacatgacgtcgtttaatatagcccaagggatccacgctttcgattaccatagtagactgaacctgatcgcgacagctggtatcaacaacaaggtgtgcttgtggaacccctatgtggtgtcaaaacccgtgggagtgctatgggggcacagtgctagcgttatcgccgtccagttctttgtggagaggaaacagctattctccttttctaaagataaagtgttgcgcctttgggatatccagcaccagctatcaatccagcgtattgcgtgttcgttcccaaaaagtcaggattttcgatgtctatttcacttcgacgaagctcatggaaggctattcatcagcttcaacaatcagttggccctcctcgccatgaagagtgaagcgagtaaacgagttaagagtcacgaaaaggccgtcacatgtgtcctttataattccatcttaaagcaggtaatctcaagtgataccggatctaccgtttctttctggatgattgacaccggacagaagattaagcagttcacgggttgccacggaaacgcggagatttctactatggcactggatgcgaatgaaacgcggttactcacggggtctaccgatggaaccgtgaagatttgggattttaacgggtactgccaccacacccttaatgtagggcaagacggggcagtggatatctctcagattttaattctgaagaagaagatcctagtgacaggatgggagcgggctatcaccgtgtttcgacctcagaactttaaccagttcttcatacagccggaagagtggaagggaggcatccagcatcatgacgatattttgtgtgcagcctttttacccccacaaactctcgtaaccggtagctacgacggagaaatcgtcttatggaacaattccacagaaaatgcccaccacgtgctgcaccctgattaccagcggctcttgaaatcaaagctggacacaaaaccccagaagctcctgagcgccggaaggagccagccctcacatcccatggccgatcatagcaccacaggcgtgaggaactttgagattgacactgagggtaaaaatgcggtgatgcgtctttgcttcctcaaggcacggaaaaacaccgccgtgacagggggtgcaaacttagtgagctgcgggggatctggatatgtccgcttctgggatatctataaaaagcaactactagctgagtttcttgcccactccggagtcggctcgataattatgtccactgacaagatgaacaggtacctgaccacgggtgatctcgatggttggctgaaaatttggaatatcgaggagtattgcctcaactcttccaagaacaagattaccaaagctcccacccttattcgctcatttcagcctcacgaagacagaatcagctcactagagatgtgtgagcctggaggccagctcttgatcatctcatcctccgctgattgctcaatctgtgtaaccggggtgtgcaacgctccagtttggatcttcggccaggcgaaacattggcacattgaaaactgcctgtttctccccaagagagataccaacctcgtggagtctgagattcagaaagagattagccttttctcaaaagaggagagttgtttagacccgaccgagcattctcttctcaacaaaaaaaataaggatgattcaacgtataacgttcgcccgagcgaagacattaacctggacatcaaatacaaggagcgatccacttgtatgaaagagacacaaaagccctattatggcgaggtaatcaaaaagtccttttccaccttccgctcacttaatattggggctctcgaggaactgccagaggtgaacaaaccagcgtttctgcttgatccggagaaatactttcgcaaggagccagaagaagaacggccccaaatacttgaagcaccgtctttgtttaagaccttaaaagctgtcttcgacgagaagaatttattccctaaagaaatactccatcacgaaagaaaagctaagcaactctgccaggagaagtcctgcgaagtaaagaaaaataagaaatag

SEQ ID NO: 34823 - DNA, 1989 bp, Artificial Sequence
  Description of Artificial Sequence: Synthetic coding sequence
atgaccatcaactgggctgaactgctttcaggctgccacaaatgctgtcatatattggagcataagctgcaccagggcgactgggttcgacaggtgacttacaatgccagtcttgatgccataatcagtagtaccacgtctaatactaacagcgtggtgatggcttggcgcgagaagtccaagaagagattaaatatgacgtcatttaatattgctcagggaatccatgcgtttgactatcacagccgtctgaatctcattgccaccgcaggaatcaacaataaagtgtgcctttggaatccttacgtcgtcagcaagccagtcggtgtgctctggggtcattctgcctctgtaatcgccgtacaattctttgttgagaggaagcagcttttctcattttccaaggataaggtgctgcgcttatgggatattcagcaccagttatccatccagcgaatcgcctgctcatttcctaaatctcaggacttccgatgtttgttccacttcgacgaagcacatgggcggctgttcatctctttcaacaatcaactggcattactcgcgatgaagtccgaagcgtctaagagagtcaagagtcatgagaaagccgtgacttgcgtgctgtacaactccatcctcaagcaggtgattagttccgacactgggagcaccgtatcattttggatgatcgataccgggcagaagattaagcagttcacaggctgccatggcaacgccgaaatttcaactatggcactggatgccaatgagacccgcctgcttactggtagtactgatgggaccgtgaagatatgggactttaatgggtactgccaccataccctgaacgttggccaggatggggcagtcgacatcagccagatcctcattcttaaaaagaaaattttagtcaccggctgggaacgttacgattacgcgagttggaagacaatcggcagggcaattaccgtgtttcggcctcagaattttaatcagttctttattcaacctgaagaatggaaaggtgggatccagcatcatgatgacattttgtgcgccgcttttcttccgccacaaacacttgtgaccggcagctacgatggcgagatcgtgctgtggaataattccaccgagaatgcgcaccacgtactccaccctgactaccagcggcttttgaaatcaaagctggatactaagcctcagaagctcttatcagctggaagatcacaaccgtcacatccaatggccgatcactcaacgactggcgtgagaaactttgagatcgataccgagggcaagaacgcggttatgcgcctctgtttcctgaaggccaggaaaaatacagcggtaactgggggcgctaacctggtctcttgtggcggctctgggtacgttcgattttgggacatttacaagaagcagctcctcgccgaattcttggctcacagcggcgttggatccataatcatgagcacggacaagatgaaccgctacctcactacaggtgacctggatggctggctcaagatttggaatatcgaggaggaatcttgcttggaccctaccgagcattctctgttgaacaaaaagaacaaggatgacagcacatacaacgtccgtccaagtgaagacattaacttagacataaagtataaagagcggtcaacctgcatgaaggagacacagaagccgtactatggcgaggtcatcaaaaagagtttctctacctttagatccctgaacatcggtgctttggaagaactaccagaggtcaataagcctgctttccttctcgatccagaaaagtacttccggaaagagcccgaggaagaacgcccgcaaattctggaagcaccgtccctgttcaaaactctcaaagcagtgtttgacgaaaagaacctctttcctaaggaaattctccaccatgaaagaaaagctaaacagttatgtcaagagaagtcctgcgaggtgaagaagaacaaaaaatag

SEQ ID NO: 34824 - DNA, 2949 bp, Artificial Sequence
  Description of Artificial Sequence: Synthetic coding sequence
atgaaagagcccgacgaccaggacactgacggagagaaaagcgtgacctccaagtcagatggcaagaaaagcctccgctctagcaagagcgagtccaggtccccagtgcaggaggataacacctttttggaagatgacactgatgagacattcaccaagggagaggggtcttacctcgaagaggattctgatgaggagaggctcgaaggttctctgtcttcattccagtatggggacctacagagtaccacagtgcctcagcagacacctgcccccgcagttgaagaggccgaggaagaggtgaaaaagaaaatttcagaatcctttttttacgactacatggagctagcgagtatgccattcgtgacactggactccaacatcccactcgacttgttgaccctggtacactcattcgggtacgactgtagaaaaagagccaatctgcagctccttgatgactccatcgcgatttatatagcgggtaaccaactcatctttctcaatttgaaaacaaaagaacagatatacctgcgatcttccagcggcgaaggcattggggttatcggcgtgcacccccacaagacgtatttcacagtggccgagaaaggatcttttccagatatcataatctacgaatacccttcacttcggccgtaccgtgtgttgcgcgatggcactgaaaaaggttacgcttacgttgacttcaactattcgggaaatcttctcgcgtccgtgggatccaatcccgactacactcttactatttggaattggaaggaagaacagcctattttgcggaccaaggccttcagtcaggaggtttttaaagttacatttaaccctgataaagaagaacagctgaccacaagcgggtcggggcacattaaattctgggagatggctttcacattcacaggcctgaagcttcagggctctctcgggaggttcggcaagaccatcaccacggatatcgaaggctacatggaactgcccgacggcaaggttttaagcggaagtgagtggggcaacatgctcctatgggaaggtggcttaatcaaggttgagctgtgccgcggaacgtccaaatcctgccacaatgggcccatcaatcagatcatgctgtacgagggagaggtcatcacagtgggttctgatgggtacgtcaggatttgggacttcgaaactatcgacacagcggatgtgatcgacgaaaccggtctgctcgagatcgaacctattaacgagttacaggtggacaagaatgtcaacctcttctctatgataaaaatgaacgaaaccggcaacaatttctggcttgctcaggacgccaacggggccatttggaagctcgacctgagcttcagcaatatcactcaggacccagaatgcctctttagcttccattccggggcgattgaggccgtggcagtgagtccactgacttaccttatggcaaccacagccctggactgctccgtcaggatctacgattttgcctcaaaaacccccctcgcccagatgaaattcaaacaaggaggaacagcactggtatgggtcccacggatggtgaacttcactggggcgcagatcattgtcggtttcgaagatggcgtcgtgcgcatccttgagctgtatgacccgaaggggctcacaatctttgccggtaggaagaaaattctggatgctgacatccaattaaaacaagtgtttaaaccacataccgcttgtgtcaccgcactggcctacgagcgggacggagaaatcctcgcgactgggtctaaagaccagacggtgttcttcttcgaggttgagcgcgactataaacctattgggtacattaacacccctgggcccgtctgccaattaatgtggtctccaatgagccatcccgagagtactcttctcatcatttgcgagaacggatacatcctagaggcgcccctgcctacaattaaacaggaggaggacgatcatgatgtggtgagctacgagattaaggatatgtgcattaaatgtttccatttctccagcgttaaatcaaagatcctgaggctcatcgagattgaaaagcgagagcggcaacgggaattgaaggagaagattcgggaggaaagaagaaataagcttgctgccgaaatgggagaggatggcgaaaaagagtttcaggaagaggaggaagagaaggaagaggaagaggaagaagaagagcccctgcccgagatcttcatcccatctactccaagccccattctgtgcgggttttattcggagccaggaaagttttgggtgtctttgggaggatatgattcaggcttcctgtatcactgcgaattccccccttgtgatgagagctctgatttcaaagagcagaaagacgaacctatagacgtgcgttacttggccgatacagaagacaatccaattcagacgattacatttaatatcaataaggttatgatgttttgcggaatgaagaacggggctattcgagtttatgtactgaaccaaaatgacccgagtttgacctctctcgtcgattattggcattttaacatgcacgataataattacggatgtattaaatctattgccaatagctttgacgataggtttttggtaactgcaggagctgatgggaacatattcgttttcaatatcttttcggagtttatgctgaggaaggatatgaaagccaaggtgccatctccccgattcgggatcgaaacggagccaatccccgaggatatagaagaccctaaagcctacagtatcgagaacgcaaggaggaaaagggaacacgataaactgatgaaggaagtgggagagattaaggcacgcaaaagggagcaaatcaaagccctgaggagcgagttctgtaacctgctcgagatgaatgagaagcttcctaagcacatgcagtttaaaagaacggtcagccttatctag

SEQ ID NO: 34825 - DNA, 1206 bp, Artificial Sequence
  Description of Artificial Sequence: Synthetic coding sequence
atgaagttgagcgatctccatcacgtgaccctgttccaagagattctcttgttgaagaatttcgaaaagcaggaaaacatccttcaggagagagtgaattcactagacaaggaagaacaatatatgcagtggaagattaacgagaccctgaaggagatggaagaaaagaaaaacgagatcaccaaactgcaagaacaggagaaagctctgtatgcaggcttccaggcagccattggggagaacaacaagttcgcaaactttctaatgaaggtcctcaagaagaagatcaagagagtcaagaagaaggaagtggaaggtgacgctgacgaggacgaagaatcggaggagagcagcgaggaagagtcctcgcttgagagcgacgaagacgaaagtgagagtgaagatgaggtcttcgatgactccatctgccctactaactgtgatgtcgccctattcgagcttgccctccacttgcgggagaagaggttggacattgaggaagctcttgtggaggagaagaagattgttgacaacctgaaaaaggagtatgacactctgagcaaaaaggtgaaaatcgtcgcaaccaaccttaatgccgccgaggaggccctcgaagcctatcagcgggaaaagcagcagcggctgaatgagctgctggtggtcataccactgaaattgcaccagatcgaatatgttgtgtttggcgaaataccgtccgacctatccgggaccctggtgttcagcaaccatgccctgaggcgcctgcaagaacgaatccatgagttacaggaagaaaattctaagcagcagaagctgaacaaggaatggagggaacgaaggaaacagctcattcgcgaaaagcgggagatgaccaagacaattcacaagatggaagagactgtgaggcaattgatgatatcaaagtttggtcgggtggttaacttggaagctctgcagaccctgtcagtgaataccaccttagaagagttaaagattcgcaaattgagaaaggaactggccaacgctaaggagatgaaaatgtgggaagagaagattgcccagatgcgctgggagctgatgatgaaaacaaaggaacacacccgaaagctttatcagatgaatgacttgtgcatagaaaaaaaaaagttagactcccgactcaatacactgcaaaaccagcagaacccaggtaacggcctgagttag

SEQ ID NO: 34826 - DNA, 5565 bp, Artificial Sequence
  Description of Artificial Sequence: Synthetic coding sequence
atgaaggagccagatgaccaggataccgatggagaaaagtccgtcactagcaagagtgacggtaaaaagtcactgcgctcaagcaaatcggagtccagatctccagtccaggaagacaacacattcctcgaggatgacacggacgagaccttcactaaaggagaagggagttatttggaggaggatagtgatgaagaacggctcgaaggctccctgtcgtcctttcagtatggcgatctgcagtcaaccaccgtgccgcagcagacacccgcccccgccgtagaggaggctgaggaggaagttaagaagaagatttctgaatcttttttctacgattatatggagctcgcttcaatgcctttcgtcacgctggactccaatatccccctggacctactcaccctcgtgcactccttcggatacgactgcaggaaacgcgctaatctgcaactcctcgacgacagcatcgcaatatacatcgctggaaaccagctgattttcctgaacctgaagaccaaggaacagatctatctgcggtcctccagcggcgagggaataggcgtaattggagtccacccacacaagacatacttcacagtcgccgagaagggatcctttcctgatataatcatatacgaatatccatctctccgtccttaccgtgttctacgggatggcactgagaaaggctacgcctacgtggatttcaattattctgggaacttactagcatcagtcggaagtaatccagattacaccttgaccatttggaattggaaagaagaacagcccatcctaaggacaaaagccttttcccaggaagtgttcaaagtgacgtttaaccctgataaggaggaacagctcactacgtctgggagcgggcacatcaagttctgggaaatggcgttcacatttacagggttgaagctgcagggcagtcttggcagatttggtaaaaccatcactaccgacatcgagggatacatggagctccccgacggcaaggttctgtctggcagcgagtggggcaatatgctgctgtgggagggaggcctaatcaaggtggaactgtgccgaggcacctccaagagttgccacaatgggccaatcaatcagataatgctgtacgagggcgaagtaattacggtcgggagcgatggttacgtccggatctgggatttcgagacgatcgataccgctgatgttatcgacgagacaggcctgctggaaatcgagccgatcaatgaactacaggtggataagaacgttaacctcttctcaatgataaagatgaacgagactggcaacaatttttggctggcccaggacgcaaatggggcaatctggaagctggatctgagtttcagcaatatcacccaggatcccgagtgtctgttcagcttccatagcggggctatcgaagctgtggccgttagcccacttacataccttatggctacaacagctctagactgtagtgtgagaatctacgactttgcctctaagactccactggcacagatgaagtttaaacagggtggcacggcactcgtatgggtgcccaggatggtaaatttcaccggtgcacagataatcgtcggcttcgaagacggcgtggtacgaatcttggagctttacgatcccaaggggttaacaatattcgccgggaggaaaaagatcctcgatgctgacatccagttgaaacaggtgtttaaacctcataccgcctgtgtcactgccctggcttatgagcgcgatggtgagatcctcgctaccggatctaaggatcagacagtgttcttttttgaagtggaaagagactacaaaccgatcgggtacattaatactcccggaccagtctgccagctaatgtggagtcctatgtcccacccagaatctacgttgttgattatatgcgaaaacgggtatatcttagaagctcccctccctaccattaaacaagaagaagacgaccatgatgttgtcagctatgagattaaggacatgtgcatcaaatgtttccacttttccagcgtcaagtccaagattctgagactcatcgagatcgagaagagagagaggcagcgcgagctcaaggaaaagatacgcgaggaaaggagaaataagcttgccgctgagatgggtgaagacggcgaaaaggagtttcaggaagaggaggaagagaaggaagaggaggaagaggaggaggaaccactgcccgagatcttcatcccgtcaacaccgtctccgatactgtgcggtttttattctgaacctgggaaattttgggtgtcgctgggcggttatgacagcggtttcctataccattgtgagtttccaccatgcgacgagagctctgatttcaaggagcagaaagacgagcccatcgatgttcggtatttggctgatacggaggataatccaatccagactatcactttcaacatcaacaaggtgatgatgttctgtggtatgaagaatggtgcgatccgggtgtacgtgctgaaccagaacgatccctcgctcacatccctggtcgattactggcactttaacatgcacgataataattatggttgcatcaagtccatagccaatagttttgacgaccgctttctggtgacagccggggccgatggtaatatcttcgtttttaatattttctcagaatttatgttgcgcaaggatatgaaagccaaggtgcctagccctcggttcggtatcgaaaccgaacctatccctgaagacatcgaagacccaaaagcttattccatagaaaacgcacggcgaaagcgcgagcacgacaaattaatgaaggaggtgggcgagattaaagcccggaaacgagaacagataaaggccctaaggagtgaattctgcaacctgcttgagatgaacgaaaaactgccaaaacacatgcaatttaaacgcacagatttcgacgttgatagccagatacgtgcggaaatgcatagaaagaccgcttttaagattcaacaggtggaaaaagagttggcgtgggaaaaggagaagcacgagctaggtctaatgaagttgaagaaccggtttagggatcccctcgaaagcgacacaattgtggttcatgccatactgtcagatcacaaaatctccagctatcgacttgtgcagccctcgaaatacagtaagtttaaaagagcctcacaatctgagcgaaaacccagtaaactggatcgctttgaaaaggaaggacccggaaggaaggactcgcaacgcgatgccggcggcagtgtgactatccaagaggagagcataatcgaaaaaggcaagaaatttcgccctaaaacattgtccgagattatagtagaaaaccagattgaaaagacccggaagctcattctgaaggctgagcgcgcccagctgaagattcagcagaggaagaaggaatgggaagaactatataagtccaagcccggagacgactatgaggaccctaaagacctgcaggccatcaaagaagctcaggtatacatgggagatttcaacctgaagacagccccagactataagatccctgaacacatgcgaatcaacgcagcgaaaaaggaggaggagttggggcacctggatagcctagttcacggtaataaaagacacatgaacaaatgtattctcagcctcagagaccttaaggtagcagtggtggaggaaatccaatgcctagtacaggagttaaaaaatatccagtctactcttcacatctccaagcatatacccatacctaagatcccacaaatccacccagaagaagtgccggagaagcgtttccagtatgacgaagagacattactgaacttcaaacaacaacagatgaaatccaaagatgagaagtcgccgggcgtggagcagaccggctctgggggccctgtcggcggatttctcaagctgtcctcacgtaaagacggagatctaaccacacgtgacagtattagtcgttccagtaaagccagtacctttagcctcgatatcccgaaatgcctggagttcgagaaagcagagcccaccgacgtagaattggagattatgaagcgggatgaaatcaaacatgtctacatgcagcagtacctggttaacagaatcaaggagctggtagtaacctttgacgcggagctccggttgctgaggcaccagaaactcaagctcgacactcagatgaagctgtccgaccttcatcatgtcaccctctttcaggagatcctgttactgaagaatttcgaaaagcaggagaatatcttacaggaaagggttaatagcctcgataaggaggagcagtacatgcagtggaaaattaacgagacactcaaggaaatggaagaaaaaaagaatgagattaccaagctgcaagagcaggagaaagctctatatgcaggctttcaggccgccatcggtgaaaataacaagtttgcgaattttctcatgaaagtccttaagaagaaaataaagagagtgaagaagaaggaagtggaaggagatgccgacgaagacgaggagagcgaggagagctctgaagaggagagcagcctggagtctgacgaggatgaatcagagtcagaggacgaggtatttgacgactcaatttgtcctaccaactgcgatgtggcgttatttgagcttgcattgcacttgcgcgagaagagactcgatattgaggaagccctagtcgaggaaaaaaaaatcgtggacaacctaaaaaaggaatacgatactctgtcaaagaaggtgaaaattgtggccactaatttgaacgctgctgaagaagctctggaggcgtaccagcgcgaaaagcaacaaagactcaatgaattgctggttgtcattcctctgaagctgcaccagatcgaatacgtggttttcggagagattccctccgacctgtctggcaccctggtgttctccaaccatgctttgagacggctacaggaaagaattcatgagctgcaggaagaaaacagcaagcagcagaagctgaacaaagaatggagagaacggcggaaacagctcattcgtgagaagagggagatgacaaaaactatccacaaaatggaggagactgtgcggcaactgatgatcagcaagttcgggcgggttgtgaatctcgaagcattacagaccctgagcgtgaatacaactctggaggagctgaaaatacgcaagcttcgcaaagagctggcaaacgcgaaagaaatgaaaatgtgggaagaaaaaatcgcccagatgaggtgggaactcatgatgaaaacgaaagagcatacaaggaaactgtatcagatgaatgatctgtgtatagagaagaaaaagctggatagcaggctcaataccttgcagaaccagcagggcaatgccttccagggtccccgggaagctgacgtggttgctcgtgaggaggtgactgagctgattcagctccaggcggagcgcatatccgccctcaaagaggaaatcgccctactcagaagaaagggtagcctgattctccctcctattcagagcccaagagagaaggaaattcagccggccgacctatag

SEQ ID NO: 34827 - DNA, 255 bp, Artificial Sequence
  Description of Artificial Sequence: Synthetic coding sequence
atgaaggaacccgacgaccaagatacggatggagagaaaagtgtcacaagcaaatctgatgggaagaaatcccttcgatcctccaagtccgaaagccggagtcccgtgcaggaggataacacgttcctggaggacgacactgatgagacgtttacaaaaggcgaggggtcctatctggaagaagattcagacgaggagcggctggagggttccttgtcatcgtttcaatatggagacctgcaatccacaacctag

SEQ ID NO: 34828 - DNA, 1077 bp, Artificial Sequence
  Description of Artificial Sequence: Synthetic coding sequence
atggcagttaaatggacaggtggtcatagttctcctgtgctatgtctgaacgcctccaaggagggcctgctggcctccggtgcagagggcggggatttgacggcctggggggaggacggcactccactcggacatacgcgattccagggtgcagacgatgtcacatccgtcctattcagtcccagctgcccaacaaagctctacgcgtctcatggagaaacaatatctgtgctcgatgttaggtcactgaaggacagcctggaccatttccacgtgaacgaggaagaaatcaactgtttgtccctgaatcagacagaaaacctgttagcctccgccgacgactcaggcgcaataaaaatcctggatctggaaaacaaaaaggtgatccgttcacttaaaagacattctaatatctgcagcagcgtggcatttcggccacagcgtccgcagtcgctggtttcctgcggcttagatatgcaggtcatgctctggtcacttcaaaaagctagacccctatggattactaacctgcaggaagacgagacagaagagatggagggccctcaatcacctggtcaactcctcaatcccgcgctcgcacactccatttcagtggcaagctgcgggaacatcttcagctgcggtgccgaagacgggaaagtccggatctttcgtgtgatgggggttaagtgtgagcaggagctgggctttaaaggtcacacatcgggagtgagccaggtgtgctttcttccagagtcctacctgctgctgaccggcggcaatgacggcaagatcaccctttgggatgccaattcagaagtcgaaaagaagcagaaatctcccactaaaagaacgcacaggaagaagccaaagcgcggcacttgtactaagcaaggcgggaataccaacgctagcgtgaccgacgaggaagaacacggcaacattttgccaaagctgaacatcgagcatggcgagaaagtgaactggctgcttgggactaaaattaaggggcaccagaatattcttgtcgcagatcaaacgtcttgtatctccgtgtatccgctgaacgagttctag

SEQ ID NO: 34829 - DNA, 465 bp, Artificial Sequence
  Description of Artificial Sequence: Synthetic coding sequence
atggccgtgaaatggactggtggtcactcctcaccagtgctgtgcttgaacgcttcaaaggaggggcttctggcctccggggcagaaggaggggatctgaccgcttggggcgaggatggaactcctctgggacatactaggttccagggtgctgacgacgtgaccagcgtgttgtttagcccctcttgcccgactaaattgtacgcatcgcatggcgaaaccatcagcgtgctcgacgttagatcactgaaagattccctggaccactttcatgtgaacgaagaagagattaattgcctgagcttgaaccaaacagagaatctgttggcctctgctgacgattctggcgcgattaaaattctggatttagagaacaagaaggtcatccgctctcttaaacggcactccaacatttgttcatccgtggcctttaggccgcagagacctcaatcgctcgtgagctag

SEQ ID NO: 34830 - DNA, 483 bp, Artificial Sequence
  Description of Artificial Sequence: Synthetic coding sequence
atggccgtcaagtggactggtggtcattcctccccagtgttgtgccttaacgctagcaaggagggcttattagcctcaggggcagagggcggcgaccttacagcatggggagaggacgggacccccctgggccatacaaggttccagggggcggacgatgtaacatccgtccttttttcgcctagttgtcccacaaagctgtatgcaagccacggtgaaactatcagcgttctggacgtccggtcgttgaaagactcgctggatcacttccacgtgaatgaagaagagattaattgtctctcccttaaccagactgagaacttgctcgcttctgctgacgactccggggctattaagatcctagatctggaaaacaaaaaggtgataaggtcacttaaacggcactccaatatttgctcctctgttgccttcaggccacaacgcccacagtctcttgtgtcttgtggattggatatgcagtag

SEQ ID NO: 34831 - DNA, 1005 bp, Artificial Sequence
  Description of Artificial Sequence: Synthetic coding sequence
atgttccgatgggagagatcgatcccactgagggggagtgccgcggcactctgtaataacctaagcgtcctccagctgccggcacgtaatttgacatacttcggtgtggtgcatggacctagcgctcagctactgtccgccgcacccgagggcgtccctctcgcccagagacaactccatgcgaaggaaggggcaggcgtcagtcccccgttgatcacacaggtgcattggtgtgtgctccccttccgcgtgttgctggtcctcacatcccataggggtattcaaatgtacgagagcaatggctacacaatggtttactggcacgcccttgactccggtgatgcgagtcctgtgcaggccgtgttcgctcggggaattgctgctagcgggcattttatttgtgtgggaacttggtcgggtcgagtgttggtgtttgatattccagcgaagggtccgaacatcgtgctgtcagaagagctcgctggacaccaaatgcctattactgatatcgcgacagagcctgcacaaggccaagattgtgttgccgatatggtgaccgccgacgacagtggactgttatgcgtatggagatcggggccggagtttactctactcactcgcatccccgggttcggcgtgccctgcccaagtgtacaactatggcagggtattattgctgctggatatggcaacggtcaggtccacctctacgaggcaacgacgggaaatctgcatgtgcagattaacgcgcatgcaagggcaatatgcgcgttggatctggcatcggaggtgggaaaacttctctctgcgggtgaggacacctttgtgcatatctggaaactgtctcggaatcccgagagtggctatatcgaggtggaacattgtcacggcgaatgtgtagcagacacccagttatgtggcgctagattctgtgactcgtccggaaactccttcgccgtcactggatacgacctcgcagaaatacgtagattcagcagtgtttag

SEQ ID NO: 34832 - DNA, 2925 bp, Artificial Sequence
  Description of Artificial Sequence: Synthetic coding sequence
atggcagcgaggtggagctcagagaacgtcgtagtagagttcagggacagtcaggccacagcaatgtcagtcgactgtctagggcaacacgcagtgctgtcggggcggcgattcctatatatcgtaaacttggacgctccttttgaaggccataggaaaatatcccgccagtccaagtgggacatcggtgccgtgcagtggaatccccatgacagtttcgcccattacttcgctgccagctccaaccagagagtggacctttacaagtggaaggacggatccggggaggttggaaccactttgcagggacacacgagagtgatcagcgatctagattgggctgtctttgagccagacttgcttgtgacttcatcagttgatacctacatctatatctgggatataaaggatacacgtaagcccacggtggcactctcagcagtagcaggggcaagtcaggtgaaatggaacaagaagaatgcaaactgcctcgcgacgagccatgacggcgacgtgcgaatctgggataagcgcaaacctagtacggccgtggaatatctggcagctcatctttctaagattcatgggttggattggcaccctgactctgaacacattctcgcgacaagttcccaagacaactctgttaagttctgggactatcgtcagcccagaaagtatttaaacatcctgccctgccaggtcccggtgtggaaggctcgatacaccccgttctccaacggactcgtcacagtgatggttcctcagctgcgccgcgagaatagtcttctcctatggaacgtctttgatttgaacacaccagttcacaccttcgtggggcacgatgacgttgtactcgaatttcagtggagaaaacagaaagaaggcagcaaggactatcagctcgtcacctggtctagagaccagaccctgcgcatgtggcgggtggactcacagatgcagcggctctgcgccaacgacatcctggacggggtagacgagttcattgagagcatctccttgttgcccgaacctgagaaaaccctccacacagaagacacagaccaccaacacacagcttctcatggcgaggaggaggctcttaaggaggaccctcctcgcaatctattggaagagcggaagagcgatcaattaggccttcctcaaacactgcagcaggagttcagcctgatcaacgtccagattcggaacgttaacgtggaaatggacgccgccgacaggagctgcacagttagcgtgcactgcagcaaccatcgagtgaaaatgttagtgaaatttccagctcagtatcctaacaacgcagccccttccttccagttcattaacccgaccactataaccagcacaatgaaggccaagcttctcaaaatactcaaggacaccgccctgcagaaggttaaaaggggacaaagttgcttggaaccttgtctgaggcagcttgtctcctgcctagaatcgttcgtcaaccaggaggactccgcaagctccaacccgttcgctttgccaaattccgtgacccctccactgccaaccttcgccagagtgaccactgcctatgggtcctatcaggacgcaaacatcccattcccccggacttccggtgcgcggttttgcggtgccggctacttagtatactttacccggcccatgaccatgcaccgagcagtaagtcctaccgaacccacacctaggagcttgagcgccctgagcgcgtaccacaccgggctcatagcgcccatgaaaattcgaacagaagcccccggcaatcttaggctttattctgggtcgcctactagatccgagaaggagcaagtgagtatcagttctttttattacaaggagcgtaaatcacgaaggtggaagtcaaaacgagagggatctgacagcggaaatcgccagatcaaggcagccggtaaggtgatcattcaagatatcgcctgtcttttgcccgtccacaaaagcctcggtgaactctacatactcaatgttaacgacatccaagaaacctgtcagaagaatgccgcctctgccctcttggtaggccgtaaagatttggtgcaggtatggagcttggcaaccgtcgccaccgacctgtgcctcgggccgaagtcagaccctgatctggaaaccccctgggcgagacacccattcggcaggcagttactggaaagcttactcgctcactactgtcgattgagggatgtacaaaccctggccatgctgtgcagtgtgttcgaggcccagagccggcctcagggcttaccaaacccttttggcccatttcccaatcggagcagcaacttggtggtctcccactccagatacccgtcattcacttcatctggcagttgtagctctatgagtgacccaggcttgaatactggtggatggaacatcgccggacgggaggccgaacatctgtcctcgccttggggcgagtcatcaccagaggagctaagatttggctcgctcacatacagtgacccacgggagcgggagagggatcagcacgataagaataaacgcctcctggatccggcaaacacacagcagtttgacgatttcaagaagtgttatggtgagatcctatatagatggggcttacgagagaaacgtgcagaggtgcttaagttcgtgtcctgccctcctgacccacataaagggatcgagtttggagtgtactgctcacattgccgcagcgaagtccgaggcacacagtgtgcaatttgtaagggattcacatttcagtgtgctatatgtcatgtcgctgtccgcggtagctcaaacttctgtttgacttgcgggcacgggggccacaccagccatatgatggagtggtttcgcacccaggaggtgtgcccaaccgggtgtggctgtcattgcctgctggagtccactttctag

SEQ ID NO: 34833 - DNA, 1377 bp, Artificial Sequence
  Description of Artificial Sequence: Synthetic coding sequence
atgagtgtcgattgcctgggccagcatgccgtgctgagcggacgccgtttcctgtatattgtaaacttagatgcacccttcgaaggccatagaaaaatttcgcgccagagcaagtgggacatcggtgctgttcagtggaacccccatgactcctttgcccactattttgcagcctcatctaaccaacgcgtggatctctacaagtggaaagacggttcaggggaggtgggtacaactctgcagggccacacgagagtaataagtgatttagattgggccgtcttcgagccagatctgctcgtcacctcctccgtggacacttacatctatatctgggatattaaggatacccggaaacctacagttgcactatcagcagtcgcgggagcaagtcaggtgaaatggaataaaaagaacgccaattgtctggccacatcccatgacggagatgttagaatctgggacaaaaggaaacccagcacagctgtggagtatctagcagcgcacctatctaagattcacggcctagactggcatcctgattctgaacacatcctcgcgacgtctagccaggataattcagtcaaattttgggactaccgccagcctcgcaaatacctcaatattctgccctgccaggtacccgtgtggaaagcgcgctacacaccttttagcaacggtttggtgactgtcatggtgccccagttacggcgggaaaattccttgctgctctggaacgtgttcgacctgaatacgccagttcataccttcgtcggtcacgatgatgtagtcttggagttccagtggcggaagcagaaggagggatctaaggactatcaactggtgacttggagtcgggaccagacactgaggatgtggcgggtcgattcccagatgcaaagactgtgcgcaaacgatattctcgatggggtcgacgaatttattgaatcaatttctcttctacccgaacctgaaaaaacccttcatactgaggatacagaccatcaacacacagcttcccacggcgaggaagaggccctgaaggaagaccccccacgaaatctgctggaggagcggaagagcgaccagcttggactcccccagacgctgcaacaagaattctcgcttatcaatgtgcagatacgaaatgtaaatgtggaaatggatgccgccgatcgctcttgcaccgtgtctgtgcactgcagtaaccatcgggtcaagatgctggtaaaatttccagcccagtatcccaataatgccgctccctcctttcagttcataaatccgacaacaataacaagtacaatgaaagcaaaacttctcaaggtgggcgtatgggtgcccaagttcagcctgcttttttgtattatcgtgtag

SEQ ID NO: 34834 - DNA, 993 bp, Artificial Sequence
  Description of Artificial Sequence: Synthetic coding sequence
atggccaccaaagaatccagagatgcgaaggcacagctagcactgagctctagtgctaaccagtcaaaggaggtgcctgaaaacccaaactatgcacttaagtgcaccctggtcgggcacaccgaagccgtttctagcgttaagttttcaccaaacggagagtggctagcaagctcgtcggcagatagactgataattatctggggggcttatgacggcaagtacgagaagaccctttatgggcacaatcttgagataagtgacgtcgcctggagttctgatagttctaggctggtcagcgctagcgatgacaagaccctgaagttatgggacgtgcgctctggcaaatgtttgaagaccctgaaggggcactctaattacgtattctgctgcaacttcaatccgccatccaatttgatcatctccggatccttcgacgagacagtcaaaatatgggaggtgaaaactgggaagtgtcttaaaacgctgtcggcgcattccgacccagtctcagccgttcattttaactgctccggctcgcttatcgtctcaggaagctacgacggattatgtcgtatttgggacgccgccagtggacagtgcctgaagacgctcgtggacgacgataacccacccgttagtttcgtgaagttctctcccaatggtaagtacattctcactgcgacactcgacaacacactcaagctctgggattacagtagaggacggtgccttaagacctacaccggtcataagaatgagaaatactgcatcttcgccaatttttcagtcacaggcggtaagtggatcgtgtcagggtcagaggataatcttgtttacatctggaacctacaaaccaaggagattgtgcagaagttgcagggacataccgatgttgtgatcagcgcggcatgccaccccactgaaaacttgatagccagtgccgctctggagaatgacaagactataaagttatggatgagcaaccattag

SEQ ID NO: 34835 - DNA, 3201 bp, Artificial Sequence
  Description of Artificial Sequence: Synthetic coding sequence
atggaacctggtaagcgcagaaccaaggacgacacgtggaaggcagatgacctccggaagcacctgtgggccattcagagcggcggctctaaggaagagagaaagcaccgagaaaagaagctgaggaaggagtccgaaatggatctgcctgagcataaggaaccgcgctgcagggatcctgaccaagatgcaagatcaagggatagagtcgccgaggtccacactgctaaggagagcccacggggcgagagggacagagaccgccaacgcgaacggcgcagggacgcaaaggacagggagaaagaaaagctcaaagagaagcaccgggaggccgaaaagtcgcacagtcgtggcaaagatagagaaaaggagaaagaccgaagagccaggaaggaagaattacgccaaaccgtcgctcaccataacttgctgggccaggaaactcgagatagacagcttcttgagagggccgagaggaaggggagatctgtgagtaaggttcggagcgaggagaaagatgaagattccgaacggggcgacgaggaccgagagcggcgatatcgcgagcggaaacttcagtacggcgattctaaggacaacccactcaagtactggttatacaaggaggagggcgaaaggagacataggaagcctcgggagccagaccgagataacaaacatagggagaagtccagtacccgggaaaagcgggagaagtattctaaagaaaaaagcaattctttcagcgacaaaggcgaggagcgccacaaggagaaacgccacaaagaagggttccacttcgatgacgagcggcaccaaagcaatgttgacagaaaagagaaaagtgcgaaagacgaaccccgaaagagagagtctcaaaacggagagcacagaaatcgaggggcttcctctaagcgggacgggaccagttctcagcacgcggagaacctggtccgcaatcatgggaaagataaagactcaaggagaaaacacggccatgaagaaggttcttcagtgtggtggaagctcgaccagaggccaggcggtgaagaaaccgtggagatcgagaaagaggaaactgatctggagaatgcccgagctgatgcttacaccgcatcctgtgaggatgatttcgaggattacgaagacgactttgaagtatgcgatggagatgacgatgaatcttcgaacgagccagagtcacgagaaaaactggaggagttgcccctcgcacaaaagaaggagattcaggaaattcagagagcgattaatgctgagaacgaaaggatcggagaactatcgctgaagctgttccaaaaacgtggccggacagagtttgagaaggagcctaggacagatacaaactcttcacccagccgggccagtgtgtgtggcatctttgtggactttgcatcagcgtctcaccggcagaagtcccgcactcaggcgctgaaacagaagatgagaagtactaagcttttgcgcctaatcgatctggatttttcctttacctttagtctgttggatttgcctccggtcaatgaatatgacatgtacatacggaatttcggcaagaagaacaccaaacaagcgtatgttcagtgtaacgaggacaacgtcgagcgggatatccaaaccgaggaaatcgagacgagggaagtctggacccagcatcccggcgaatccacggttgtctcaggcggctctgagcagagggacaccagcgacgccgttgtgatgccaaagatcgatacaccccggttgtgcagttttttgcgggccgcttgccaggtaatggcagttctgctcgaggaggatcgacttgctgcagagcccagctggaaccttcgagcccaggacagagctttatactttagcgatagctctagtcagctgaataccagcttgcccttcctgcagaatcggaaagtgtcctctctccatacatcgagagtgcagagacagatggtggtgagcgtgcatgatctccctgaaaaatcctttgtgccgttgctcgattctaagtacgtgctgtgtgtctgggacatttggcagccgtcagggccgcagaaagtgctgatctgtgagtcacaggtgacatgctgctgcctcagccccctgaaggcttttctgctgttcgctggaaccgctcacggcagcgtcgtggtctgggatctgcgcgaagattctaggctgcattatagcgtcactctttcggacggcttttggacattcaggacagccactttctccaccgacggcatcctgacatcagttaaccatcggagccctttgcaggcagtggagcccattagtactagcgtacacaagaaacaatctttcgttttatcaccgttctctacacaggaggagatgtctgggctttccttccatattgcctccctggatgaaagcggagtattgaatgtctgggtggtagtggaactgcccaaagcagatatcgcgggctctatctcggatctgggcttaatgcctgggggaagggtaaagttggttcacagcgctctgatccagttgggggatagtctcagccacaaaggcaatgaattctggggcacaacacagacactgaacgtgaagtttctccccagtgacccaaatcattttatcattggaacagatatgggactgattagtcatggaacccggcaagacctccgcgtggcacccaagctcttcaagccacagcaacatggaattcggcctgtgaaagtgaatgtgatagactttagtcccttcggcgaaccgattttccttgccggctgttcagatggttccatcaggctccatcagttgagctctgctttccccctgttacagtgggattccagtactgacagtcatgcagtcacaggcctacagtggagccctaccaggccagctgtgttcctggtgcaggatgataccagcaatatttatatctgggatctgcttcagtccgacctcggccctgtggcgaagcagcaggttagcccaaacaggctcgtggccatggctgctgtcggcgaacccgaaaaagctggtggatcgttcctggctttggtgctggcaagggcctcgggcagcattgacattcagcatctcaagcgccgttgggcagctcccgaagtggacgagtgtaaccgccttcgacttctactgcaggaagctttatggccggaagggaagctgcataagtag

SEQ ID NO: 34836 - DNA, 918 bp, Artificial Sequence
  Description of Artificial Sequence: Synthetic coding sequence
atgacgaaccagtatggaatcttatttaaacaggaacaggcccacgacgatgccatctggtccgtggcctggggcaccaacaagaaggagaattctgaaaccgttgtgaccggcagcctcgacgacctggtgaaggtgtggaaatggcgggatgaaaggcttgatctacagtggagcttagaggggcatcagctgggagtggtgtcagtggatatcagtcacaccctgccaatcgctgcctcctctagcctggatgcccatatccgactatgggatctggaaaacggcaagcagattaaatccatcgacgcaggacccgtggacgcgtggaccttagccttcagtcctgattcccagtacttggctaccggcacacatgtgggcaaggtgaacatctttggagtggaatccggcaagaaagaatacagcctggatacacgtgggaagttcatcctatcaatcgcttactcaccagacggcaagtatctggcttcgggagccatcgacgggattatcaatatttttgatatcgcgaccggaaaactcctgcatactctcgaaggtcatgctatgcctatacgctctctgaccttttctccggacagtcagttgctggtgacggctagcgacgacggttacattaagatctatgacgttcagcatgccaacctggccgggaccctgagtggacatgccagttgggtcttaaacgtggcattctgccctgacgacactcattttgtgtcttcctcctccgacaaatctgtcaaggtctgggatgtgggcacgcggacttgcgtgcatacgttttttgatcatcaagatcaggtttggggcgtcaagtacaacgggaacggatcaaaaatcgtttctgtaggcgatgaccaggaaatacacatctacgactgcccaatctag

SEQ ID NO: 34837 - DNA, 918 bp, Artificial Sequence
  Description of Artificial Sequence: Synthetic coding sequence
atgaccaatcagtacggcatccttttcaagcaggagcaggctcatgatgatgccatctggagcgtagcctggggaaccaacaagaaggaaaatagtgaaacagtagtgacaggctcactcgatgaccttgtgaaagtgtggaaatggcgggatgagcgattggacttacagtggtctctggaaggccatcagctgggggtcgtctctgtggacatatctcatacgctcccaatagcagcatccagcagcctggatgctcacatccgactctgggacctcgaaaatgggaagcaaataaaatctatcgacgctggaccagtcgacgcctggacattagccttcagtccagactcccaataccttgcaacaggaacacacgtgggcaaggttaacatctttggcgtagaatccgggaaaaaggagtacagcctcgatactcggggcaagtttattctctcaatcgcctactcaccagatggaaagtacttggcgagcggagctatcgatggtatcatcaatatttttgacattgcgaccggcaagctgctccatacccttgaaggtcacgctatgcctattcggtctttgactttctcacctgactctcagttacttgtgactgcgtctgacgatggatatattaagatttatgatgtccagcacgcgaacctggccggcaccctgagcggccatgcaagctgggtactgaacgtagcattctgccctgatgacacccattttgtgtccagtagctctgataaatccgtcaaggtgtgggatgtgggcacacgaacgtgcgtgcatacgtttttcgatcaccaggatcaggtgtggggcgttaaatacaatggcaacgggtccaagattgtgagcgtcggggatgatcaggaaatccacatatatgattgccccatctag

SEQ ID NO: 34838 - DNA, 885 bp, Artificial Sequence
  Description of Artificial Sequence: Synthetic coding sequence
atgactaaccagtacggaatcctctttaaacaggagcaggcacacgatgatgccatctggtctgtcgcgtgggggactaacaagaaagagaactctgagacagtagttactggctcactcgatgatctggttaaggtgtggaaatggcgagacgagcgcctggacttacagtggagtctggagggacatcaactgggtgtcgtgagcgttgatatttcccacacgcttccaattgccgctagttctagcttagacgcccatatcaggctctgggacctcgagaatggcaagcagatcaagagtatagatgccggacctgtggacgcttggactctagccttttctcctgatagccagtaccttgcgaccggcacccacgtgggcaaggtgaacatattcggcgtggagagcgggaaaaaggagtactcgctggacacaagggggaaattcatcctatcaatcgcctacagtccggacgggaagtatcttgcttccggcgccattgacgggatcatcaacatctttgatattgcaaccgggaagctgctgcacacgctcgagggccacgccatgccaatacggagtctcaccttttccccagatagccagctgcttgtaaccgccagtgacgatggctacattaaaatctacgatgtgcagcatgcaaacttggccgggactctctctggccatgctagctgggtgctgaatgtcgccttttgtcctgacgacacacacttcgtgtcaagctcctctgataaaagtgtgaaagtttgggacgtgggcacgcgcacctgtgtgcacaccttctttgaccatcaagaccaagtctggggtgtcaagtacaatggcaacggatccaagattgtttcagtgggggactag

SEQ ID NO: 34839 - DNA, 2676 bp, Artificial Sequence
  Description of Artificial Sequence: Synthetic coding sequence
atggccccaaagcagaaaaaaaagacaagccgggggaagaaaaggctgaagcctgttcttgcggccagcgaagatatggaacccgtcaacatggaatcaatgggccatccggaaatctaccccttggtgctgacaacgaagacacaggagatcttcaactgtaggattgacgaagacgtgacagatgagcagccctataagctgataaataaggaagatatctttgaagatctgcgtaatcgcgctgcggtgtcagactttcacccagtcaaaaagatcgtacaggaatatcccggtaatgaattactcctggtgtatgataaggacttcaagtatggcctgaacttttatttgatcgccaccgaagagggcaaagaaaactatctaaaccctcctgaggtaccagaagagcaggaagagtacaaggaacatatccccgaggacgtttatatttacaaacctcccgtgagcaaaccatgggtgtctcttggatctgagaaggaaatcgaagaagagagcgtaaccgagtcgacaaaacaaattacatacatgatcagccggaagaggagcgagtttggcgccccaatcaagttcagcgaccagaatgcctcatctgtcaaagacgcttatatcgagtgcacagcctatcccgacaaaaacttcacccttaaacagctggaaaaagacgtgggaatgcaagtgatcccccagattaaggacatatccacacaaactaaatggacctatccaaaaaacgctactacccaatattaccctagggagttctccgaagaagagaaggaaaccttgaagcagtcaaagcccctcgtggatttcctgaacaacgcctcaatctccgtcgagatagccctccagcaaaatgaaatcatgaacacattcattgatgattggaagtaccttgcagaagaggaaggcacctttggagataagactgacacccatctgaaggagtaccagtcttttacagacttgcacagcccgaccgagaagatgatcacgtgcgtgagttggcaccccacaatctacggactcatagccgtttcagtggccgtcagactgagcttcgaggatagagtgcatttctctgggaaactcttgctgcagcccagcctgatcttgttttggtcgttctccgatcctatacatccccagctcatgcttgagtctcccgatgatatcttttgttttaaattttgcccaagcgacccaaatattattgctggcggctgcatcaatggccagatcgtgatgtgggatataacggctcatgccgaccgaattgagaatatcaaggctggggggtccaggagcaagcgcgccacactaaagcctatgttcctgttagagccggagagtaataaagaagccatgtacatccgtcactgtgctgtctccagcattgagaacggccataaaaaggtgattactgacattcactggctcagtgatacgttcgaaatcaatcggatggggtccgtgttcgagaatcgctctggaatctgttgccagctcgtcacttgttctgcagactgtacgatttgcttctgggacattcgccctcaaaagccactgacgccgcaaaccactgagaagaagaaggaggaatccatcgagattccctttgacgtaccgagcaccttccttcacctagatctttcatggaaacctctgacaaaagttcggctctctaaaggagagacctcattggaccattgtcccactaaaatttcactcaatgaagaccacctgctttgtaaaacgcaagataagatgctcgcccagagcaagaccgagaaggcagaggaaatgaacccatatcataatctggagagcggaatggctaacctgctcaagcctatcgacgacttttgcaccaaattcttcgtcggcactgaagaaggagaggtaatttatactgactggaagatggaaaaggatcccgagaccggccgcttgatgtctaaaaagcccgtgtctcatcacacaatccatgacggtaccgtacacactatacaacgttcacctttttataatgacattattcttacggtaggagggtggaatgtggctatctggaaggagggggttatgaccggccctctgttgcagtcatgctgtgccccaaagcggtacaccagcggccactggtcgctgactcggcctggtgttttttacatcgggagagaggacggctatattgatatctgggacctactggagaagacccacgagccagcgcagtcccagaatatctgtatcacaatgattacttacatcaaaccctggatcttctccagcaagcaacaatttatcgccaccgcagattactacggcaccctccacatattggaaatcccttggactctgtccagaccctccactaatgaaatggccagcgtcaatcactacttcgaacgtgaggtcaagcatttggagtacgttgagcagagaaaaaaaatccgcgagcaggagaagaaggagatggagctggagatggctaaaaagaaagtgaagacttatcagaaatcaaaagagcagatgcaggctgagctcaagatggattacgagagctatctggagctggaaaagacggtgctgatcaacctcggcctgatcaaagtcaccgagaagggaagctacatggaggtgatgtag

SEQ ID NO: 34840 - DNA, 2559 bp, Artificial Sequence
  Description of Artificial Sequence: Synthetic coding sequence
atggctccaaaacagaaaaagaagaccagtcggggcaaaaagcggctgaaacccgtgctcgcagcaagcgaggatatggagcctgtgaacatggaatctatgggccacccagagatctaccccctggtcttgacgacgaaaacccaggaaatattcaattgccggattgatgaagatgtgacagacgaacagccttacaaactcatcaataaggaggacattttcgaagatcttaggaatcgggctgccgtaagtgactttcaccccgtcaagaaaatcgtccaggaatatcctggcaatgaactccttctggtgtatgataaggatttcaagtacggccttaacttctatctcatagccactgaagagggaaaagaaaactatcttaaccctccagaggtccccgaggaacaggaagaatataaggaacacatccccgaagacgtgtacatttacaagccccctgtgtctaaaccctgggtaagcctgggaagtgagaaggagatcgaagaggaatcagttactgagtctactaaacaaattacttatatgatttccagaaagaggtctgagttcggcgcgccgatcaaatttagtgatcaaaatgcctcctctgtcaaagatgcatatatcgagtgtacagcataccctgataagaactttactctgaaacaactggagaaagatgtcggtatgcaggtcattcctcagataaaggatatttccacccagaccaagtgtgtggagatcgccctgcagcagaacgagatcatgaatacattcatcgacgattggaagtacttggcggaggaagaaggtacatttggtgacaagacggacactcacctcaaggagtatcagtccttcactgatctacacagtccaactgagaagatgatcacctgtgtgagctggcatcccactatttatgggttaatcgcagtgtctgtggcagtaaggttatcattcgaagacagagtgcacttttcgggcaaactcttactccagccttcgctcattctgttctggtcctttagtgacccgattcatccacagctgatgcttgagtccccggatgacatattctgcttcaagttttgtccatccgacccgaacataatcgcaggaggctgcatcaacggacagattgtgatgtgggacattaccgcacacgcagaccgaatagagaatattaaggccggggggtctaggtctaagcgcgccaccctcaaacctatgtttctgcttgaacctgagtcgaacaaagaggccatgtatattagacattgcgccgtcagttccatcgaaaacgggcataagaaggttataaccgacatccactggctttcggacacttttgaaataaacaggatgggctccgtcttcgagaatagatcaggaatatgttgccagctggtgacctgtagcgcagattgtaccatctgtttctgggatatcaggcctcaaaaaccacttacaccacaaactacagaaaaaaaaaaagaagagtcaatcgagatcccatttgacgttcccagtacgtttctgcacctggacctttcctggaagccgctgaccaaagtacgcctgtctaaaggtgaaactagcctggatcactgtcccactaaaatcagtctaaatgaggatcacctcttgtgcaaaacacaggacaagatgctggcacagtctaagactgagaaggctgaggaaatgaatccctaccacaatctggagtccggtatggccaacctgcttaaacccatcgacgacttttgtactaagttttttgtgggaaccgaagaaggggaagtcatatataccgactggaagatggagaaggaccccgaaaccggcagattaatgtccaagaaaccggtgagtcatcacaccattcacgatgggaccgtccatacaattcagaggagcccattctataacgacattatactgaccgtgggcggctggaatgtcgctatatggaaagagggcgtgatgacaggcccactgctgcagagctgttgtgctcccaagcggtacacctctgggcattggtctctaacgcgccctggcgtattctatataggacgggaggatggttacatcgacatctgggacctgctggagaagactcatgaacctgcacagagccagaatatatgcatcactatgattacttatatcaaaccctggattttttcttctaagcagcagtttatagccacagccgactactacggcactctgcatatcttggagatcccttggaccctctcaagaccatccactaacgaaatggcctctgtgaaccattacttcgagcgagaagtcaagcacctggagtatgtcgaacagaggaaaaaaattcgcgaacaggaaaagaaggagatggaacttgagatggccaagaaaaaagttaaaacatatcagaagtctaaagagcagatgcaggcagagcttaagatggattacgagtcctatctagagttggagaaaaccgtactgattaatctgggcctaattaaggtgaccgagaagggaagctatatggaggtgatgtag

SEQ ID NO: 34841 - DNA, 2559 bp, Artificial Sequence
  Description of Artificial Sequence: Synthetic coding sequence
atggccccaaagcagaaaaaaaagacaagccgtggtaaaaagcgattgaagcctgtactcgcggcctctgaagatatggaacccgtgaacatggaaagcatgggtcatcccgaaatttatccccttgtgctgacgactaagactcaagaaattttcaactgccgtattgatgaagacgtgacggacgaacagccctacaagctgattaataaagaggacattttcgaggatttacggaaccgcgcagccgtgtcagacttccatcccgtgaaaaagatagtgcaagaataccctgggaatgaactgctcctggtgtacgataaggacttcaaatatggtttgaatttctatctgattgccactgaggaaggaaaggagaattacttgaatccaccagaggtcccagaggaacaggaggaatataaagagcatatacctgaggacgtctatatttacaagccgccggtgagcaaaccatgggtctcactgggaagcgagaaagaaatagaggaagaaagcgtgactgagtcgactaagcaaattacttacatgattagccgtaaacggtccgagttcggagcaccaattaaatttagcgaccagaatgcctctagcgtgaaagatgcctacattgaatgtacagcttacccggataagaacttcaccctcaaacaactggagaaggatgtcggaatgcaagtgataccacagattaaggacatttccactcaaacgaagtgcgtcgagattgccctgcagcagaatgaaatcatgaatacctttatagacgattggaaatacctggcggaagaagaaggaacatttggagacaaaactgatactcacttgaaagagtaccaatcttttacagacttgcattcccccacagagaaaatgatcacttgcgtgtcctggcatcctaccatctatggtctgattgccgtctctgtggctgtcagactctcgtttgaggaccgggtgcacttctctggcaagctcctgttacagccctcgttaattctgttttggagcttttcagaccccattcatcctcagctgatgctggagtctcccgatgacatcttctgtttcaaattctgccctagtgatcccaatatcatcgccggcggttgtatcaatggacagattgtgatgtgggacattacagcacatgccgacaggatcgagaacattaaggcaggcggctctcgatccaagagagctacactgaaaccaatgttcctgctcgagcccgagtccaacaaagaggccatgtatataaggcattgcgcagtgtctagcatcgagaatggccataagaaggtcattacagacattcattggttatccgatacttttgagatcaaccgaatgggcagcgtttttgagaatagatccggcatttgttgccagctagtgacttgcagcgctgattgcacaatttgcttttgggatatcaggccccagaagcctcttaccccccagaccacggagaagaagaaggaggagagcatcgaaatcccgtttgatgtacctagcacctttcttcacctggacctgtcgtggaagccactgactaaggtgagattgagcaagggggagacatccctcgatcattgccctaccaagatatcactgaatgaagatcacttactctgcaagacgcaggataaaatgctggcccagtccaaaaccgagaaggcggaagagatgaatccgtaccataacctggaatccggaatggccaacctactcaagcccatcgacgacttctgcactaaatttttcgttggaactgaagagggcgaggttatctatacggattggaagatggagaaagacccagaaactggcaggctgatgtcaaagaaacccgtctctcaccacaccatccatgacggtactgtgcataccattcagcgatccccattctacaatgacattatcctcactgtggggggctggaatgtggcaatctggaaggaaggcgttatgacgggtcctctcctgcagagctgttgcgctcctaagaggtatactagtgggcattggtcactgactcgccctggggtcttctacatcggtagagaggacggctatatcgatatctgggacttattagagaaaacccacgagcccgcccagtcacagaacatttgcatcacgatgattacgtacatcaaaccctggattttctcctctaagcagcaatttatcgcaaccgcagattactacggaacactccatattcttgaaataccatggaccttgagccgaccctccaccaacgagatggcatctgttaatcattattttgaacgagaggtcaaacacctggaatacgtcgaacaaagaaagaaaattcgggagcaagaaaaaaaggagatggagcttgagatggcaaaaaaaaaagtaaaaacctatcaaaagagcaaagaacagatgcaagccgagcttaaaatggactatgaatcctacctcgagctggaaaaaaccgtactgataaatctgggactgatcaaggtaaccgagaagggcagctatatggaagtgatgtag

SEQ ID NO: 34842 - DNA, 3246 bp, Artificial Sequence
  Description of Artificial Sequence: Synthetic coding sequence
atggatattcggaaagaaaaacgcctgaacatggctcttcagatgagcaactttaagaaggctttaaacagattcgagaagctcgtggaacagacagccgctcagaaacgcgatgagcgggctggactgtttatccacaaggaggatgccattggttatgacaagttttacgcaagtgttcagaaattgttcggacccgatgtgaagaaccaggatgtcaagcggttctatcgcaagttgtgcaacaacacagatgctagcgccgactggtgtgaaatcttcgggtacttctcctcggaagaggatcccatcgcctctcagcttgacgaagaaaacctagtgtttttcgtgtcacgaaagcgacggatcctgatctcaggctcacgacgaagggatgtgatcaagagcatcgtcaagatcccccatctggatctactaatcactgctacgcaaaagggcctaattactgttttcaacaaccaggacacgtcttggattactggatgcgactatttgttacagctgaagcgcatagtggctactacagagaggaccatcattgtgtgggactacaaagcgcaaggctcttcccaggaaaactattttgtcattaagccgatggaccattgtctcctgtgcgtgtgcgtagtgccactgccagatcacctttgccgggacgacattttgcttggggatgacggtgggttcgtaaataggtttacagtgaattcagatgatttcggcattaagcaggcgaagagcaaaaggaagttgcagaaccaggtcttggactcaaagaattttaagtcagtgaaacgaaagcttcacaacgactgggtcatgaagatacgctatatctctgcattgaattgcttcggctcctgctccctggattctaatcacagtctggttctggaatccttaaaaagacttgaggacaatttaccggtcagagaattctcaatgcccaggggagctaacactttttgttattgtgtgaaggcgaatgttatagtgaccgggggcgacgacaaggtcatcaggctgtggcatcctaatatctcgactaagccagtgggcaagctggtgggtcatatgttcagtatagcggaaatcgtgactaatgagaaagatcaacacgtagtttcactatctagcgcaaaggtattccgggtctgggatattcagacactaagtctgttgcaggtgtttcacgattctcagggcggccccggggatatgcagatctactccatgatctatgatgccaaccatggcatgctcattactggctctagtgtgatggatatgtaccctctgacaaggatgatacaggatacgaagcaggtacctcacacccatgagagggaaatcaacgtcatgctttacaacaaatacttccatcaagtgctgacaatatgctctgaaagtattattcgcgtatgggagctcgaaactggacttcaggtataccagatcctggaaccgcacgggttcaacaccgaggttacgtctgctgccgtcgatgagtctggctttctgttcgccacaggggcctataatggaacggttaggatctgggatttcggctctggacaagaaatgaaagtcctacctgaggggaaggactggaaagaggacgagcactgtctgagacggctgatcttcttaaaagcccaggaaaaacatcagcagttggtgctggccctggagcgaaacgggacaatcaagatgattcaaggcaaggaggatgatatatatcttatggtaatatgggaactccccgatgtcgtgccgtttctgcaagacgggaaacacgccgtgcaccttcggatgagcactcgcgataggaacatggcaatccccttccctgacgtggaactgattgtggagaggaactttagtcaacccaccgacaaccctaccatggatctccttcgggtcaattgcattgacctgctgcaggtagagggatataatctgattgccgctgggacgttgaatggagtgattatcctgtggaacttcgtaacaagtacagtgaagaaagtgtaccgccctgaggactgcttcacagtgaacccagatctgcaccccaagcactttaagattaacgatatcctctttctctttcgaacaccagaatgcgcacgccgcagttcccaagactccatctgctcgtcctcacagtgtgaatcttccaagggccctcaatcctcaaagggcagcaagcaaagcatccacgactcagaggttaagggagaacaaacagacgtgatggtgggtaaacagcagcctatggataaaaagcaccccggaatagcaaacctgccagaggcccagcctcccattctagtgaccgcccatgaggatggacatctgagattgtggactctcgaaggacgtctgctcaaggacatgctgccctttactaaacactccgctatctcattgacttcactctataccgactcttgtacccgaatccttctggctgggaacgtcgagggacatgtgatcctttgtaatatatcttcatttctggaccctcctcacgacgagaaaaagtttaagcaactcctatcctggagagctcactccctcgaaatcatccaggtgatctacgtcgaagagaagcaggtcgtgctgactgcctcgattgacggctcagtgcgactgtggcatgctctcaatgggcattactgtggctactttggtcagagacggttgtttgagctctctcagaccagggacttcatattaccttgcgacgtcacagagtaccctattgagatcaaggaagagtccaagtttaccgaaaagcagaagtacgaatacccactgatcttcgacagggagaagtggagaaaaatgtcctcagtgagccttttatttaagaggacaccccctaaggcattcgaagttgagcaagatttcaaattctttaaaagcttgtcatccccaaaaattaggaggtacccattggaaggcttcgtgaccgagaaccgggaggctggtattgtcttcggcagcctccccatatattcaattagcagcccaacgtccctccgtttcctacccttaataggcgttgaggcgcagaaggactcgtccgacggcatcactggcaaaaagaagggaggccacgtacagagagaaaaggcaccccggcgccgatctttaaagaaaaacctagtcccacaaattaatctcgcctcatcttttttcccggccatccctaagtag

SEQ ID NO: 34843 - DNA, 2745 bp, Artificial Sequence
  Description of Artificial Sequence: Synthetic coding sequence
atggatatcaggaaggagaaaagactgaacatggcgctgcagatgtctaattttaaaaaagcactcaaccggtttgagaagttagtcgaacagacagccgcccagaagagggatgaaagggcggggctgtttattcataaggaggacgccatcgggtacgataaattctatgcttccgttcagaaactattcggtcccgacgtcaaaaatcaagatgttaagcggttctataggaaactgtgtaataataccgatgcttctgcggactggtgcgagatttttggctacttctctagcgaagaggacccgattgcttcccagttagacgaagagaatctagtcttctttgtcagtcggaaacgccgcatccttatcagtgggtccaggaggcgggacgtaatcaagtctattgtgaaaattcctcatctcgacttgctgataactgcaacacaaaagggtctgataactgtgtttaacaatcaggatacatcgtggatcactggatgcgactaccttctgcagctgaagcggatcgttgcaacaaccgagcgaaccatcatcgtgtgggattacaaggcccaggggagctcccaggagaattacttcgttataaaacccatggatcattgtctgttgtgtgtttgtgtcgttcctttacctgatcatctctgcagagacgatatactgttgggagatgacggaggcttcgtgaaccgctttacggttaattccgatgactttggaatcaagcaggctaagtccaagagaaaactgcagaatcaggtcctagacagtaagaatttcaaatccgttaaaagaaagcttcacaacgactgggtaatgaaaatacggtacatcagcgcacttaactgcttcgggtcatgcagtttagactcgaatcacagtctggttctagaaagcttgaaaagactagaggacaacctccctgttcgggagttttcaatgcctcgcggtgccaataccttctgttattgtgtgaaagccaatgtcatcgtgacgggcggggatgataaagtgatccggctttggcacccaaatatatcaaccaagccagtggggaagttggtggggcatatgttttctatcgcggagattgttaccaatgagaaggatcagcacgttgtgtctttaagctcggccaaggttttccgagtttgggatatacaaactctgagcctcttacaagtgttccacgatagtcaaggggggccaggggacatgcaaatttatagcatgatttatgatgctaaccatggcatgctgatcaccggctccagtgttatggacatgtatcccttgactcgcatgattcaggacacaaaacaggtaccccatactcatgagagagaaataaatgtgatgctgtacaataaatatttccaccaagtcctcacaatttgttcagagtccatcatcagggtgtgggaactggagacaggcttgcaggtttaccaaatcctcgaaccgcacggatttaacaccgaagtgacttcagcggccgtggacgaaagtggattcctgtttgccacgggggcctacaacggtaccgtaagaatctgggactttggatccggtcaggaaatgaaagtgctgcccgagggtaaggactggaaagaggatgagcattgcctgcggcgcctaattttcctgaaagctcaagagaagcaccagcaactggtgctggctttggagcggaatggcactatcaagatgattcagggcaaggaagatgacatttacttgatggttatttgggaactaccggatgttgtcccattcctccaggacgggaagcacgcagttcacctaagaatgagcacccgtgatagaaatatggcaatacccttccccgatgtggaacttatcgtggaaagaaatttctcccagccaaccgacaaccccaccatggatctactgcgagtgaattgcatcgacctgttgcaggtggaaggatataatctgatcgcagccgggacactcaacgaaggacatgttatattgtgtaacatatcttctttcctggaccctcctcacgatgaaaagaaattcaaacagttgctaagctggagggcacattcgctggagatcatccaggtgatctatgtggaagaaaagcaggtagtgcttactgcctcaatcgacggtagtgtgagactgtggcatgctctcaatgggcactattgtgggtacttcgggcagcgtcgtctgtttgaattatcgcaaacccgagactttattcttccttgtgacgtgactgaatatcctatagagattaaagaggaatctaagtttaccgagaaacaaaaatacgagtacccactgatcttcgatagagagaagtggcgaaagatgtcttcagtttccctactttttaagcgaacccccccgaaagccttcgaggttgagcaagacttcaagtttttcaaaagtctatcatctccaaagattaggcgttacccgctggagggatttgttactgagaaccgtgaagcaggaattgtatttgggtctctgcctatctacagcatctcctcccccacctctctgcgcttcctgccattaattggagtagaagcccagaaggattcttctgacggaatcactgggaaaaaaaagggcggccatgtgcaaagagagaaggcgccccggagaaggtccctgaagaaaaatctagtaccccaaattaacctggcctccagtttcttccctgcaattcctaaatag

SEQ ID NO: 34844 - DNA, 3450 bp, Artificial Sequence
  Description of Artificial Sequence: Synthetic coding sequence
atgtcggatgcagcagaggctcctcgagaggcaaccggcgaaaacggtgaaaccgagatgaaggaggaagaggagccaaacccaaattacaaagaggttgaggatcctcagcaggagagcaaggatgacaccattgcctggagggagagccaggaagaagagcggaagactggggaagaagagggagaggaagagggcaaggaggataagaagatagtgatggaggagaccgaagagaaggccggagaggtacaggagaaggaggcttcaggcatccaggaggagaccaccgtggaacctcaggaggtcaccgcgagtatgataagattagaaactcagattacggactcccagtctatcacatcgggcatttttccaaaaactcagcggggatcgaaatcaaagttgtccctccagttagaggacgccgaaaccgatgaattgctgagggacctgtcaacacaaatcgagttcctcgaccttgaccagattagtcccgaagagcagcaaatcagctcccccgagagacagccgtcgggagagctggaagaaaagactgaccgtatgcctcaggacgagctgggccaggaaagacgtgacctagaacccgagaacagggaagagggccaggagcggagggtgtcagacatccagagcaaagccggaatttccagggagagtctggtgagcagtaccaccgaagatatcctgttccagaaggacaagagcacaccggtctatccacttacaatgacttggagcttcgggtggaattctagcctcccagtatattatattcgggaagaacgacaacgcgtattactgtatgtctgtgcacacacagccattatttacaacgtctttcgcaataaccagtatcacctccagggacatgccaacatcatcagttgcctctgcgtgtccgaagaccgacgttggattgcgaccgccgataagggcccagactgtcttgtgataatctgggacagctttaccggcattcccgtgcatactattttcgactcgtgcccggaagggaatggcatcatggcaatggctatgacccatgatgcaaaatatctcgccacaatatccgacgctgaagtccagaaagtgtgcatttggaaatggacccttgcagtggagactcccgcttgtactctcgaactgccaacggagtatggggtccagaactacgtgaccttcaaccccactaacaataaagaactggtgtccaactctaaaacccgggccatttactacgcatggtacgaagagagagacaccctggctcattctgcccccttgctgaccgaaaaaaccttcaacaagctggtggggaagttctcccagtcaattttccacctcaacttgacgcagattctatccgcaactatggaggggaagttggtggtgtgggatattcataggccaccatcgtctgcatccaccttcctcgggtttccctacatcaagccgtgtaaactggtccacctgcagaaggagggtattaccgtgctgactaccatcgattcctacatagtgaccggtgatattaaagggaacataaaattctatgaccacactctgtccatcgtcaattggtattcacacttaaaattgggcgcaatcagaacactgtctttctctaagacccctgccacacctcccacagaaaaatcgaactatccacccgactgtactctcaaaggggacctttttgtcctgcggaactttataataggtacatcagatgctgcggtctatcatctaacgactgatggcaccaagctcgagaaactgttcgtagagccaaaagatgcaatttgcgctatcagctgccacccgtaccagcctttgatcgcaatcggctctatctgcggaatgataaaggtctggaactatgagaataaacaatatctcttctctcgcgtgttcgagaaaggcctgggagtccagtctctgacctacaaccctgagggggctctgctgggtgcagggttcaccgagggtacagtttatatcctggatgccatgtcactagagaacgagagtcctgaacctttcaaatacagccgaacatccgtgacccatatcagtttctcccacgactcgcaatatatggcaacagctgaccgcagctttacggtcgctgtctatatgctagtggtcagaaacggacagcgggtctgggagtatttagcccgactgaggtcccatagaaagagtatccgttcattgctcttcggcgtgtatctggatagtaacgagcccaggttgctgagcctcggaacagatagactgctgatcgaatatgacctacttagatcttacaaggaccaccttgaggtcctagatattcatcacactgatcagggctgctacccaacatgtatggtgtggtacccccctctgacacgagagctattcttgctgatctgtaactccgggtataaagtaaaactctttaatgcaactactaagatgtgccgaaagactctgctggggccagcttatgggagtcccatcgagcagacacaagtgctgcctgtccggagcatggctgagcttcaaaaacgttacctggttttcattaaccgagacaaggtgggtttgcaaatactgcccgtagacggcaatccccataaaacatccgcgattgtttgtcatcccaacggggtggcgggcatggcggtctcatacgatggttgctacgcattcacggccggaggtcacgaccgtagtgtggtacaatggaaaatcacactgtccgtgctggaagccgctgtgtcgctgggcggggaggacctgacaccattttatggcttgttgtctggcggcagggaaggcaaattctaccgggaactcgaagactatttctactattctcagttaagatcccaggggattgataccatggagactcgcaaggtctcagagcacatctgtctgtccgaacttcccttcgtgatgcgggccattggattttatccttccgaggaaaagatcgacgatatttttaatgagatcaagttcggtgagtatgttgataccggaaaactgattgacaagataaacctaccagatttcctgaaagtttatttgaatcataaacccccttttggtaatacaatgtcgggaatccacaagtcttttgaagtcctcggctacacaaacagcaaaggcaaaaaggcaatccgaagggaggatttcctgaggctgcttgtaaccaagggggagcatatgacagaagaggagatgctggactgtttcgccagtctgttcggactgaacccggagggctggaaatccgaaccagccacctgttccgtcaagggctcagaaatttgtctcgaggaagaactccccgacgagattaccgcggaaatatttgcaacagaaattctgggactaaccatctccgaggactcggggcaggatggacagtag

SEQ ID NO: 34845 - DNA, 2826 bp, Artificial Sequence
  Description of Artificial Sequence: Synthetic coding sequence
atgtccgacgctgccgaagctcccagagaggcaactggtgagaacggcgagacggaaatgaaggaagaagaggagcccaaccccaactataaagaggtggaggatcctcagcaggaatccaaggatgataccattgcctggcgagaaagtcaggaggaggagagaaagactggtgaggaggaaggggaggaggaaggaaaggaggacaaaaaaattgtgatggaagaaaccgaagaaaaagccggtgaagtccaggagaaggaggccagcggtatacaggaggaaacgaccgtggagccccaggaggtgactgccagtatgatacggctcgagacccagatcacagactctcagtccattacttctgggattttccccaaaacccagagaggctccaagtctaagctttctctccagctggaagatgccgagactgacgagctgttacgtgacctctccacccaaatcgagtttctggacctggatcagatctctcccgaggagcagcagattagttcccctgaaagacaaccctccggagagctggaggagaaaactgataggatgccccaggacgaactgggccaggaacggcgtgatctggagcctgaaaaccgtgaggaggggcaggaacggcgggtgtccgacattcagtcgaaggctggaatcagccgagaaagtctggtgagctccactacagaagacatcttgttccagaaggacaaatccaccccggtgtacccactcactatgacgtggagcttcggatggaattccagcctgccagtgtactatataagggaggaaagacaacgcgtgctactatatgtgtgcgcccacaccgcaattatttataacgttttcaggaataaccagtaccacctgcaaggccatgcaaacattatatcctgcctttgcgttagcgaggacaggaggtggatcgctaccgccgacaaggggcccgactgcctggtgataatttgggacagcttcactggaattcctgtgcacacaatcttcgactcttgccctgaagggaatggcatcatggctatggctatgacacacgacgctaagtatctggccaccatttccgatgctgaagtacaaaaagtatgtatttggaaatggaccctggctgtcgagacgccagcctgcaccttagagctgcctactgaatatggtgtgcagaattatgtgacatttaatcccactaacaataaagagctcgtttcaaacagtaaaactagggcaatctactacgcctggtacgaagaacgtgatacactggcgcactcagcccctctgctaacagagaagacattcaataaactggtaggtaagttttcacagtctattttccacttaaatctgacccaaatcctcagtgctaccatggaaggcaaactggtggtttgggacatccaccgacctccatcaagcgccagtactttcctgggttttccgtatattaagccatgtaagctagtacacctgcagaaagaggggatcactgtcctgacaacgattgatagctacattgtgacaggggatatcaaaggaaatatcaagttctacgatcacactctgagcatcgtgaactggtatagccatctgaagcttggagctatccggactctctctttttctaagaccccggccaccccccccacagagaagtcaaattacccaccggactgcaccctgaaaggcgatcttttcgtgctacggaattttattatcggcacttccgatgccgccgtttatcacctgacaactgatgggaccaagctggaaaagctgtttgttgagcccaaggatgccatttgcgctatcagctgccatccatatcagcccttaatcgcgatcgggtctatctgcgggatgattaaagtgtggaattatgaaaacaaacaatacctgttctccagggtgttcgaaaaggggctcggagtccagtccctaacgtacaaccccgaaggggcattgctgggagccgggtttaccgaaggcaccgtttacattcttgacgctatgtccctggagaatgagtctccagaaccgttcaagtacagccgaacatcagtgacccatatatccttcagccacgacagccagtacatggcaactgcagacagatctttcacggttgccgtgtatatgctggttgtccggaacggacagcgcgtgtgggaatacttggctagactgcgctcacacaggaagagcatccggtcattgctgtttggcgtctatctggatagcaacgaaccaagactcttgtccttgggcacagataggctattgatagagtatgatctgctgcgcagctacaaggatcatctggaggtgttagatatccatcacaccgatcagggctgctatcctacgtgcatggtgtggtatccgcctctgacgcgggagttgttcctcctgatatgtaactcaggctacaaggtgaagctatttaatgccaccactaaaatgtgtagaaagacgctgctgggtcctgcatacggctccccgattgaacagacacaagtgctccccgtcaggtccatggccgaactacaaaagagatacctggtttttattaaccgcgataaggtcgggctgcagatactgccagtcgatggcaatccccataaaacctctgctattgtttgccacccgaatggtgtggctgggatggcagtgagctatgatgggtgttatgcttttaccgccggcggccacgacaggagtgtggtgcagtggaagatcaccctgtcccaccccggctctcaggcgcctattctcagtccctctgacacctccaggtcatag

SEQ ID NO: 34846 - DNA, 1248 bp, Artificial Sequence
  Description of Artificial Sequence: Synthetic coding sequence
atgaaacttaaaagtctcctactcagatattatcccccaggaataatgcttgaatacgagaagcatggagaactgaagaccaagtccatagatctgctggacctagggccaagcacagatgtgagcgcgctcgtggaagaaattcaaaaggcagaaccgctcttgaccgcgtcccggacggagcaggtcaaactgttaattcaaaggctgcaagagaaactgggacagaatagcaatcatacgttctacctgtttaaagtactgaaggcccacatcctcccactgacgaacgtggccttaaataaatcaggctcatgctttattacagggtcttatgaccggacatgcaagttatgggacactgcatctggtgaggagttgaacacgctcgaaggtcaccggaacgttgtgtatgcgatcgccttcaataacccttacggcgataagatcgccactggctcctttgataaaacctgcaagctttggtctgttgaaactggaaagtgctaccatacatttaggggccacacagcagaaattgtgtgtctgtcctttaatcctcagtctaccttggtggccactgggagcatggacacaaccgcaaagctgtgggatattcagaacggcgaggaggtatatacgctcaggggtcattccgcggagattatatccctgtcgttcaacaccagcggcgaccgcattattacggggagctttgaccacaccgtcgtagtatgggatgctgacaccggtcgaaaggtcaacatcctcatcggtcattgtgctgaaatttcctcagcctctttcaactgggattgcagcctgattctaacaggaagcatggacaagacctgcaaactatgggatgctacaaatggcaaatgcgtcgccacgcttaccggccacgatgacgagatcttggatagctgcttcgattacaccggaaaactgatagcaacagccagtgcagacgggactgctcggatcttttcggccgcaacacgtaagtgcattgcaaagctcgagggccatgagggcgagatcagcaagatcagctttaatcctcagggcaaccacctcctgactggttcaagcgacaaaactgcccgcatctgggacgcacaaacgggacaatgtctccaggtgctggaaggacacacagatgaaatcttcagttgtgcctttaattacaaggggaacatcgtgatcacgggctcaaaagataacacctgccgcatttggcggtag

SEQ ID NO: 34847 - DNA, 1203 bp, Artificial Sequence
  Description of Artificial Sequence: Synthetic coding sequence
atgctggagtacgaaaagcatggagaactcaaaacaaaatctattgacctgctggacctaggcccctctactgatgtcagcgcgttggtcgaggaaatccagaaggcggagcctcttttgacagcttcccggacggagcaggtgaaactcctgatacaaagactccaggagaaactgggccaaaatagcaatcatacattttatctgttcaaagttctcaaggcacacattttgcccctgacaaacgttgccctgaacaagagcggatcttgcttcatcactggatcctacgatcggacctgcaaactttgggatactgcaagcggagaggaactcaacacactggaagggcaccggaatgtcgtgtacgccattgcatttaacaatccatatggcgacaagatcgccaccgggagtttcgacaaaacttgcaagctttggagcgtggagactggaaagtgctatcacacatttcgggggcatacagccgagattgtctgtctttccttcaacccccagtccacattggtcgccacaggctccatggacaccacagccaaactctgggacatccagaacggtgaggaggtctatactctccgcggccacagcgccgagatcatcagcctctctttcaacacatccggagatcgcatcatcaccggcagcttcgaccataccgtggtggtttgggacgctgataccggtcggaaagttaacatcctaatcggtcattgtgcagaaattagctccgcttcttttaattgggattgtagcctgatcctgaccggctctatggacaagacctgtaaactttgggatgccactaacggcaagtgtgtggccaccctgaccggacatgacgacgagatcttagattcgtgcttcgactacaccgggaaactgatcgctaccgcctcggccgacggtaccgccagaatcttttccgctgccacacgcaagtgcattgccaagctggaaggacatgagggagaaatatccaagatttccttcaatccccagggcaaccatctgctgactggatcatctgataagacggcgcggatttgggatgctcagacgggacagtgtttgcaggtgctggaagggcacaccgatgaaatattctcctgtgctttcaactataaaggaaacatcgtaatcacaggaagcaaagataacacctgccgcatctggcggtag

SEQ ID NO: 34848 - DNA, 1965 bp, Artificial Sequence
  Description of Artificial Sequence: Synthetic coding sequence
atggagaggagcggcccatccgaggtaaccggtagcgacgcatcggggcctgacccccagctagccgttacaatgggctttacgggctttggtaagaaggcccgcaccttcgatctcgaggcgatgttcgagcaaaccaggcgaacagctgttgagaggagcaggaaaacattggaggcaagggagaaggaagaggagatgaaccgtgagaaggagctccgccggcagaacgaggacattgagcccacatcctcacgctcgaatgtcgtccgcgactgcagcaaaagtagttctagagatacctcgtcctctgagtccgagcagtcaagcgacagttccgacgacgaactgattgggccaccacttccacctaaaatggtcggaaagcccgttaactttatggaagaggatattctgggcccgctccctccgccactgaatgaggaagaggaagaggcggaggaggaggaggaagaagaggaggaagaggagaatcctgttcataaaatccccgattcccatgagattacgcttaagcacggaaccaagacagtgtccgctctcggacttgacccttctggcgcccgtctggtgactggaggctatgactacgatgtaaagttctgggatttcgctggaatggacgcctcattcaaagcattcagaagcctgcagccctgcgaatgtcaccaaatcaagtccctgcagtacagtaatacaggagacatgatcctcgtggtctctggatcgtcacaggcaaaggtaatagaccgtgacggattcgaggtgatggagtgcatcaaaggggaccagtacatcgtggatatggctaataccaaaggccatacagctatgctccacaccggctcctggcatcccaagattaagggagagtttatgacttgtagcaacgacgctacagtccggacttgggaggtggagaaccctaagaaacagaaatccgtcttcaagcctcggactatgcaggggaaaaaggtgataccaactacctgcacctattctagggacggcaacctcatagccgctgcgtgtcagaacggttcaattcagatctgggaccgaaacctgactgtacacccaaagtttcactataagcaagcacacgactctggaactgacacttcttgcgtgactttctcctatgatggcaacgttctggcttcccgtgggggagacgactccctgaagctgtgggacattcgccagtttaacaaaccactcttctccgcttcaggcctgccgacaatgtttccaatgactgattgctgtttcagccccgacgacaaattaattgtcacgggcacctcaattcagagagggtgtggaagtgggaaattagtgttcttcgagagaaggacatttcaacgggtgtacgagatcgatattactgacgcttccgtggttcgttgcctttggcaccccaagttaaaccagattatggtgggtacaggaaatggccttgccaaggtctattacgatcctaataagtcacagcgaggagcgaagttgtgcgtggtaaagacacaaagaaaggcaaagcaggccgagacactgacccaagattacattataaccccccacgccttaccgatgttcagagagcctcgccagcgttcaacaaggaaacagctggagaaggaccgcctagatcctctgaagtctcacaagccagagcctccagtggccggccccggaaggggaggacgcgtgggtacacacggcgggactctttcctcctacatcgtgaaaaatattgcattagataaaacagacgacagtaatccaagagaggctatcctccgccatgccaaggccgcagaggattcaccatactgggtgagcccagcttacagtaagacacagcccaagaccatgtttgcccaggtcgagagcgatgatgaggaagctaaaaatgagcccgaatggaaaaaaaggaaaatctag

SEQ ID NO: 34849 - DNA, 1137 bp, Artificial Sequence
  Description of Artificial Sequence: Synthetic coding sequence
atggacccaggagacgattggttggtcgagtccctgcgactctaccaggatttctatgcctttgatttaagcggggctactcgcgtgctggaatggatagacgacaagggtgtctttgtggccggctatgagagtctcaaaaaaaatgagattctacatttgaaactgcccctgaggctttcagtgaaggagaataagggcctatttcctgagcgcgattttaaggtgcggcacggcgggttcagtgacaggtccatttttgatctcaaacacgtcccacacacccgactattggtaactagtggtctgcctggatgttacctccaagtgtggcaggtggccgaggacagcgatgtaatcaaagcggtctccactattgcggtgcatgaaaaggaggagtctctgtggccgcgagtcgctgtcttttccaccttggcccccggtgtgctacacggagctaggctacgcagccttcaggtggtggacctggagtcacgaaagactacgtacactagcgacgtgagcgattcagaagagctgtcttcccttcaggtactggacgctgatacatttgcgttctgctgtgccagtggccggctggggttggtggacacaagacagaagtgggctccacttgagaacagatcaccagggcctgggagtggcggtgagaggtggtgcgccgaagtgggaagctgggggcaggggcccggcccgagcattgccagtcttgggagtgacggccggctctgcttgttggacccgcgagacttgtgtcaccctgtgagtagtgttcagtgtccagtgagcgtgcctagtcccgacccggagctcctcagagtcacctgggctcctggcttaaagaactgtctcgccatctctgggttcgatggaaccgtgcaggtgtacgacgccacatcctgggatggaacacggagccaggatggcacacggtcgcaggttgaacctttattcacccacagagggcatattttcctggacggaaatggcatggatcccgcaccgctggtaacaacccacacatggcatccctgcaggcctcgtaccctcctctctgcaaccaacgacgcgtcgttgcacgtgtgggactgggtcgacctgtgtgctcctagatag

SEQ ID NO: 34850 - DNA, 1881 bp, Artificial Sequence
  Description of Artificial Sequence: Synthetic coding sequence
atgagtcgctctggagctgctgcagagaaggccgactcccgccagaggccccagatgaaggttaatgagtataaagagaatcaaaatattgcttatgttagcttacgcccggcgcagaccaccgtgttaataaagaccgcaaaagtgtatctcgctcccttttcactttctaattatcaactagatcaactgatgtgccctaagtccctctcggagaagaactctaataatgaagtggcatgcaagaaaactaagattaagaagacctgcaggaggatcatccctcctaagatgaaaaatacctcgagcaaggcggagagcactctacagaattccagctccgcagtgcacacagagagcaacaaactgcagccgaaaaggacggcagacgcgatgaacctctcggtggatgtggaatctagccaggatggcgactctgacgaagacaccactcccagccttgacttttccgggctgtctccatacgaaaggaagcgcctaaaaaacattagtgaaaacgcagacttctttgctagcctacagcttagcgaatctgctgccagactgagagaaatgattgagaagcgccagcctcccaaaagcaaaaggaagaagccaaaacgtgagaatggtattggctgtcggagatctatgaggttactaaaggtcgatccatcaggcgtcagccttccagcggctccaacacctcctactctcgtggctgacgagactccacttttacccccagggcctctagagatgacttctgagaatcaggaagacaataatgagcgctttaaaggcttcctgcacacgtgggccggaatgtccaagccgtcttctaaaaacacggagaagggcttaagctctatcaagtcctacaaagccaatctgaatgggatggtcatctccgaagacactgtgtacaaagttactaccgggcctatctttagcatggcgttgcaccccagtgagactcggacattagttgctgtaggcgccaagtttggacaggtgggactctgcgatttaacccagcaacctaaagaagacggtgtctatgtttttcacccccatagccaacccgtgagttgcctgtacttctcccccgctaatcccgctcacatactgtctctgtcctacgacggcacgctgcggtgtggagacttctcacgagccattttcgaagaggtttacagaaacgagcgtagcagcttctcttcattcgatttccttgcagaggacgcttctaccctaatcgtgggccactgggacggcaacatgagcctggttgacaggaggactcccggtacatcttatgagaagcttacctcatctagtatggggaagatacggacggtgcatgtccaccccgtacaccggcaatatttcattacggctggtctgagagacacccatatttatgatgcaagacggctcaactctaggagatctcagcccttaatctctcttaccgaacatactaagtccatagcgtctgcgtatttcagcccgctaaccggtaatcgggtagtcacgacctgtgcagattgtaacctacgcatctttgactcatcttgcatcagttccaagataccacttttaaccaccatccgccacaatactttcacaggaaggtggctcacccggttccaggcaatgtgggaccccaagcaggaggattgcgttatagttggatccatggcccatccccgcagagtagaaatatttcacgaaacgggcaagcgggtgcactcctttgggggtgagtacctcgtctccgtgtgttcaattaacgctatgcatcccacacgctatattctggcagggggaaatagtagcggtaagatccatgtcttcatgaacgagaagtcctgctag

SEQ ID NO: 34851 - DNA, 1689 bp, Artificial Sequence
  Description of Artificial Sequence: Synthetic coding sequence
atgtgcccaaaatcattgagcgaaaaaaacagcaataatgaagtggcctgcaaaaaaaccaaaatcaagaaaacttgccgccgtattataccccccaagatgaagaatacttcttctaaggctgaatccaccttgcaaaacagcagctccgccgtgcacactgagtctaacaaactgcaacccaagcgcacggcagacgcaatgaatctgagtgttgacgttgagtcctcgcaggacggcgattcagatgaagatacaacccctagtctggactttagtggtctctcgccttatgagcgcaaaagactcaaaaatatatccgagaacgccgacttctttgcaagcctccagctatctgagtctgcagccaggctcagggagatgattgagaaaaggcagcctccaaagtcaaaacggaaaaagcccaaacgcgaaaatggcatcggctgtagacgctccatgcggctgctgaaagtcgatccctcaggagtctccttgcctgctgcccccaccccccccaccctcgttgctgacgagacccccctgctgcccccgggtcctctggagatgacctccgagaaccaggaggataacaatgaaagattcaagggtttcctccacacttgggctggaatgtcaaaaccttcttccaaaaataccgagaagggtctctcaagtataaaaagttacaaagccaaccttaatggaatggtaattagcgaggacaccgtgtataaggtcacaacgggaccaatattctcgatggctctgcacccgtcagaaacacgaaccctggtagccgttggcgcaaaatttgggcaggtcgggctttgcgacctgacacagcagccaaaggaggatggagtgtatgtgtttcatccacactcccagcccgtgtcttgcttatacttttcccctgctaatccagcccatatactgtcgctgtcatatgacggtacgctgcggtgcggagacttttctagagctatctttgaagaagtttacagaaatgaacgctcttccttctcatccttcgactttttggccgaggatgccagcactctcattgtggggcactgggacggaaacatgtctctggttgaccggcggaccccggggacttcttatgaaaaactgacttccagctccatggggaaaatcagaaccgtgcacgtgcacccggttcataggcaatacttcataaccgccggacttagagatacccacatatacgacgctcgccgcttgaacagtcgcagatcccagcctctgatctctttgactgaacatactaaatctatcgcttcagcgtacttcagccctttaacaggtaacagggttgtgactacttgcgctgactgtaatctgcgcattttcgatagtagctgtatcagttcgaaaattccactccttacaacaattaggcacaacacttttacgggccgttggctcactcggttccaggccatgtgggaccctaagcaggaagactgcgtaattgtggggagcatggcacatcctcggcgggtggaaatcttccacgagacaggcaaacgcgtgcactcctttggtggcgagtatctggtgtcagtgtgcagtatcaacgccatgcacccaacacgatatatactggcggggggcaattcctcgggtaagatacacgttttcatgaacgaaaaaagttgttag

SEQ ID NO: 34852 - DNA, 1638 bp, Artificial Sequence
  Description of Artificial Sequence: Synthetic coding sequence
atgactcccggcaagcattccggggcgagtgctagggctgccaatggcggagcctggggctacagagatttccgaggaggtcagaagaagggatggtgcactactccccaactggttgcgactatgccagtttcccccgccgggtcccataagcagcaaaattttggcttgaacaacgccacccagcctaaaaaatcaatttcttttttcgccacaatgaaggctacctccgttaaggggtataccggcgccaaccagagccgtatggcagtttccaaaacagtcttaattcccccggaacttaaaacagttgaaaagcccaatccaaatatcaaaaccacgcaagtgttcgatataaatggcacagatgtcacccctcgccccctgtatcaccctgatccattgacaggcactgcaaaaccaagtaagctgctcaccagccaagagggctccttgggctctgagttcatatcctcctattctctatatcagaacacaattaatccgagcacactgggccagttcacacgaagcgtcttgggcagctccacggtgagcaaatcatctgtttctgcctctgaaagcattgcagaggacctggaagagccatcatacaaacgggagcgcctgacctcctttacagacttacaggtcatcagggctgctccagagaagattgtgacgaaggaagacttggagaagaatatagagattattctgactgagaccgaaacactgcgttttttcgatttgcccactgtgatggtttccgtggagtccgaggaggcggagaaagtgactcagcgaaataagaactacgaagtgctgtgcaggaaccggctgggaaacgacctttatgtagaaagaatgatgcaaacatttaacggggcaccaaagaacaaagacgttcagtgcgacaagattataatggaagacaaaggtatcatgtcaactgcctgggatctgtacgactcatacaatgccatggagcttgtatctctgtctgtcaagcagtcagttgtggagtcatcgtcaaaagccaacgtgcttccaaaggaccaggaccaaaggctgcccgggagtacgacagagaaaaattcagaaaccagttctctcatggacattgagaacgtgatcttggcaaaaatccatgaggacgaggaggaccatagcgatgccatactcaaatctgataagttccatcaggacctctttttcatggagcgcgttcttatggaaaatatcttccagcccaaactcgctgcatataggcagcttccggttttaaaggaacctgaacctgaggagcctgaagacgttctcgaatctgccaagcacgaggaagtggaagaagaaagcaaaaaggaagaagaagaggagatccatgccgaggaaagtacaattccggccaatttggagagactgtggtcattcagctgtgatctgactaaaggcttgaacgttagctccctggcgtggaacaaaaccaacccggacctcctggcagtcgggtacgggcatttcggattcaaggaacagaagagaggcctggcctgttgttggtctatcaagaaccccatggtcacgcaaactagaattcggtcaatttttatctggcttttgaccaagtttagctag

SEQ ID NO: 34853 - DNA, 2547 bp, Artificial Sequence
  Description of Artificial Sequence: Synthetic coding sequence
atgactccgggtaagcacagcggggcttccgcccgcgctgccaatggaggggcgtggggctatcgagattttaggggagggcagaagaaaggctggtgcacaaccccccagcttgtggctaccatgcccgtcagtccagctggctcacataaacagcagaatttcggtctgaataatgctactcagcctaaaaaatccatttctttttttgccaccatgaaagcaacatccgtaaaaggatacaccggcgctaaccagtctcgcatggcagtgagcaagaccgttctcatccctccagagttaaagacagttgagaagcctaaccccaatatcaagaccacgcaggtttttgatattaatggaactgacgtgacaccaagacctctgtaccatccagaccccctgaccggaacagcaaagcccagcaagctattaacttctcaggagggaagcttgggcagcgagttcatcagcagctattcgctgtatcagaataccatcaacccatccaccctggggcagttcacccggtctgtgctgggatcatctaccgtctcaaagagttctgtttctgcatcggaatctatcgctgaagacctagaggaaccttcatataaaagggagcggctgacttccttcacggacctccaagtcatcagggccgctccagagaagatcgtgactaaggaggatctggagaagaacattgaaatcatactgactgaaactgagacactccgttttttcgatctccctaccgtgatggttagtgttgaaagcgaggaggccgaaaaagtcacccaacgcaacaagaattacgaagtgttatgccggaaccgcttgggcaatgatttgtatgttgagcggatgatgcagacttttaacggcgcccccaagaacaaggatgttcagtgcgacaagattatcatggaagacaagggaattatgtcaacagcctgggacctgtatgactcttacaacgccatggaactggtttcactgagcgtcaaacagtccgtcgtcgaaagttctagtaaagcaaacgttctccccaaggaccaggaccagaggctgccagggtccaccactgaaaagaacagcgagacctcctccctgatggatatcgaaaacgtgatcctggctaaaatacacgaggatgaggaagatcactctgatgccatccttaagagtgataaatttcaccaggatctgttcttcatggaacgagtactgatggaaaacattttccagcctaaactcgcagcatatcggcagttgccagtacttaaggagcctgaacccgaggagcctgaagacgttctggaatctgcaaagcatgaagaagtcgaagaagagagcaagaaggaggaagaggaggagatccatgccgaggagtccaccattccagcaaacttagagcgactgtggtcctttagttgtgacctcacaaaaggactgaacgtaagctccttggcttggaataaaaccaaccctgatcttttagcagtgggttacggccactttgggttcaaagagcaaaaaagagggctggcatgctgctggagtatcaagaaccctatgtggcctgagcgcatttaccagtcaccttatggcgtcactgccgtggactttagtattggcgctccaaacctgctagccgtcggttatcataacggaacaattgctatttacaacgtccgctctaactccaacgtacccgtactggactcatctgagagcccccagaaacatctcggccccgtttggcagctccaatggatcgaacaggatcgtggaacaactggggacgggaaaagggaaatcttagtatcaatctcagccgacggtagaataagcaagtgggtgattcgtaagggtttggattgttacgatttgatgaggctgaagcggacaactgctgcaagtaacaaaaaaggcggcgaaaaggagaagaaggacgaagcgctgatatcacgccaagctcctggcatgtgttttgctttccatcccaaagataccaatatttatctggcgggtacagaagagggacacatccacaaatgcagttgttcctataatgagcagtatcttgacacatatcgggggcataagggacctgtctacaaagtgacctggaacccattctgccacgacgtattcctgtcgtgctccgccgactggggcgtcataatatggcagcaggaaaatgtaaaaccttcactgtcattttatccagctactagcgtagtctacgacgttgcgtggtcccctaaaagctcctatatctttgcagccgccaacgagaaccgggtggagatctgggatcttcatatctcgaccctggaccctctgatcgtaaacacagcgaatcctggaattaagttcaccactattctctttgcaaagcagacagattgcctgttggtgggagattcggacggtcaggtgtccgtgtatgaactccggaatatgccaaccgtgttggaaactggtcggggcgacatcatggacactttactggggagcaagtccaatcaaagcgcatag

SEQ ID NO: 34854 - DNA, 1686 bp, Artificial Sequence
  Description of Artificial Sequence: Synthetic coding sequence
atggttagtgtggagtccgaagaagcggagaaggtgacacagagaaataagaattacgaagtgttgtgcaggaacaggttgggaaatgacctctacgtggagaggatgatgcagaccttcaatggcgcgcctaagaacaaagatgtgcagtgcgacaagattattatggaggacaagggaatcatgtccacagcctgggatctatatgatagctataatgcaatggagctggtgtccctctctgttaagcaatcagtggtcgagagctccagtaaagctaacgtacttcccaaggatcaggatcagcgtctcccggggtctacaacagagaagaactccgaaaccagcagcctgatggacattgaaaacgtgattctggctaagatccacgaagatgaagaagatcacagtgacgctatcttgaagagcgataaattccaccaagatctcttttttatggagcgcgtcctgatggagaatatctttcagcctaagctcgccgcttacagacaattacctgtgctgaaagagcccgaacctgaagaacccgaagatgtgctcgagtccgcaaagcatgaagaagtcgaagaagaatcaaagaaagaggaggaggaagaaatccatgccgaggagagcactattccagcaaacctcgaacgactgtggagctttagttgcgacctgactaagggactcaacgtgtcaagcttagcctggaataagaccaatccagacttgctggcagtgggatacggtcattttggcttcaaggaacaaaagaggggactggcctgctgttggtcaatcaagaatccaatgtggccagaaaggatataccagtcgccttacggcgtgaccgctgtggactttagtatcggcgcccccaatcttttggctgtgggataccataacggcaccatcgctatctacaatgtgcgatctaatagtaacgtgcctgttctcgactcatcagaaagcccccagaagcacctgggccccgtgtggcagcttcaatggattgaacaggatcgaggcacaaccggtgacggaaagcgcgagatcttggtttcaatcagtgccgatgggagaatctcaaagtgggtgataaggaaaggcttggattgttacgatctgatgagactgaaacgcactaccgccgcgagcaacaagaaggggggagagaaagaaaaaaaagacgaggcgttgataagcagacaagcacccggtatgtgctttgcattccatccaaagggccccgtctataaggtcacttggaacccattttgtcatgacgtatttctgtcttgttctgctgactggggcgtcataatttggcagcaggagaatgtcaaaccgtccctctctttttacccagctactagtgtcgtctatgatgtggcctggtcgcctaaatcatcatacatctttgccgccgctaacgaaaaccgcgtcgaaatttgggacctgcacattagcacactggatccactgattgtgaatacagccaatcctggaataaagtttacaacaattttgtttgcaaaacagacagactgccttctggtgggggactccgacggacaggttagcgtgtacgaactgaggaatatgcctaccgtactcgagaccggaagaggagacatcatggacacgcttctgggaagcaagtctaatcaatctgcctag

SEQ ID NO: 34855 - DNA, 2673 bp, Artificial Sequence
  Description of Artificial Sequence: Synthetic coding sequence
atggatggcgaacctccagcctcttccggcctggggttgcctgattatacttccggcgtgtccttccacgatcaggcagacctgccagaaacggaggatttccaggcaggactctatgtgacagaatcaccccagccccaggaggcagaggcagtctctctgggcagactgagtgataaatcttcaaccagcgaaacatccttgggggaagagcgggcccctgatgaggggggcgcgcctgtggataaatcttctctccgatctggggatagctcacaggacctgaagcaatccgaaggcagcgaagaagaggaagaggaagaagactcctgcgtcgtcctggaagaagaagaaggcgagcaagaagaggtgacgggagcgtccgaactgactctgagcgatacagtcctgtcaatggaaactgtggtcgctggtggatccggaggtgatggtgaggaagaagaagaagccctccccgagcagagcgagggcaaggagcagaagattttgcttgataccgcctgtaagatggtgaggtggctgagcgctaaacttggtcccactgtggcgagtcgacatgtcgctcgcaatctgttgaggctactgactagttgttacgtaggccccacccgccagcagtttacagtctcatctggagagtcacctcccctgagcgcaggtaatatctaccaaaaacgcccagtcttgggcgacatcgtttccggacccgtcctgtcttgcctcttgcacatagcccggttgtacggcgagcccgtgttgacataccaatacttgccttatatatcctatctggtcgctccgggatcagcctcaggaccaagccggctgaactctaggaaagaagctggcctgctggcagcggtgaccctgacgcaaaaaattatcgtctacctgagcgataccacattaatggacattttgccacgcattagtcatgaagtgcttttgccagtgctttcttttctgacaagcttagtgacagggtttccaagtggtgcacaggcccgaaccattctttgcgtgaaaactattagcctgatcgctctgatctgtctccgaattggccaggaaatggtccagcagcatctgagcgagccggtggcaaccttctttcaggttttttcacagctccatgaattacggcagcaggaccttaagcttgatccggcaggacgcggggagggtcagttgccacaggtagttttcagcgacggccagcaaaggcccgtggaccctgccctgctggacgagctgcagaaagtatttacactagagatggcttataccatctatgtgccatttagctgtctgctcggtgacatcataaggaagatcatacctaaccacgaacttgtgggcgagctggccgcgctttatctcgagtcaatcagtcctagttctcggaatcctgcatccgttgagcctaccatgccaggcactgggcccgaatgggaccctcacggtggggggtgcccgcaggatgacggccactccggcaccttcggatcagtactggtgggtaaccgaatacaaattcccaacgactccaggcctgaaaatcccgggcccctaggacccatcagcggagtggggggcggggggctcggcagcggcagcgacgacaatgccctgaaacaggaactgcccaggagtgttcacggactgtctggaaattggctcgcttattggcagtacgagatcggcgtgagccaacaagatgcacattttcactttcatcagatccgattacagtcctttccgggccattccggcgcggtcaagtgcgtggcccccctgagctcagaggacttctttctgtccggcagtaaagatagaactgtcaggctatggcccctgtataattatggcgacggcacaagcgagactgctccgaggctggtgtacacccaacaccggaagtccgtattctttgtcgggcagcttgaagcgcctcagcacgtggtgtcctgtgatggggctgttcacgtatgggaccccttcaccgggaaaacactgcggacagtggaacctctggactcccgcgtccctctgacagcggtggctgtcatgccagccccacatacaagtataaccatggcatcctctgattccacgctccgcttcgtcgattgccgcaaaccagggctacaacacgaattccgactgggcggcggccttaatccaggactcgtccgcgccctcgcaatctctccttccggacggagcgtggtggctggattctccagcggattcatggtcctgttggacacaagaaccggccttgtgttgcgcggctggccggctcacgagggtgacatactccagatcaaggctgtcgagggctccgtcctggtctcctcttcatcagatcactcgcttactgtgtggaaggagctagagcagaaacctactcatcattacaagtctgccagtgatccaatccacaccttcgacctctacggttcagaggtcgtcaccggaactgtttctaataaaatcggtgtttgctcactcttggagcccccaagtcaggcaacaacaaagttatctagtgagaactttcggggaactctcaccagtctcgctctcctgcccaccaagagacatctgctgctaggttcagacaatggtgtgatccggctcctggcctag

SEQ ID NO: 34856 - DNA, 2079 bp, Artificial Sequence
  Description of Artificial Sequence: Synthetic coding sequence
atggacggggagcctcccgcatcaagtggcctgggattacctgactacacgtctggggtctctttccatgaccaggccgaccttccggagacagaggatttccaggcaggcctgtatgtcaccgaatctcctcagccccaagaagctgaggccgtcagcctgggccggctaagcgataagtcatcaacctaccagtatcttccttatattagctatttggtagctccgggctccgcttctgggccatccagacttaattcacgtaaagaagctgggctcctcgccgccgtcacgttgacgcaaaagatcatcgtctatctgtccgacaccactctgatggatatcttgcccaggatctctcatgaagtgctcctgccagtgctgtcctttcttacttccctggtcaccggctttccctcgggcgcccaggcccggacaattctgtgcgtcaaaacaatttctctgatagctctcatctgcctgcgcatcggccaggaaatggtccagcaacatctgtcggagccagtggccacgttctttcaagtgttctctcaattgcatgagctgcgccagcaggatctgaaactcgatcctgcaggtcggggtgagggccagctgccccaagtggtctttagtgatggtcagcagagacccgtggatcccgctctgttagacgagttacagaaggtgtttaccctagagatggcctacaccatatatgtcccgttttcctgcctattaggcgatatcatcagaaaaatcattcctaaccacgaactggtaggggagttggccgccctctatctggagagcattagtccaagtagccgtaacccagcctccgtggaacccaccatgccaggcacagggcctgaatgggacccccacggggggggctgtccacaagacgacgggcactccgggacattcggatccgtgttagtggggaaccggatccagatcccaaatgattcccgccccgagaatccgggacctctcggtcctatcagtggagttggcggaggggggctgggctctggctctgatgacaatgcccttaaacaggaactgcctcgatccgttcatgggctctctggaaattggttggcatactggcaatacgaaatcggggtgagtcagcaggacgctcatttccatttccaccagatccgcctccagtctttccctggccactcgggtgcagttaaatgtgtggcccccctgagtagtgaggactttttcttgtccggaagcaaagacagaactgtaaggctgtggccgctctacaactacggagacggaaccagcgagacggccccaagactcgtttatacccagcatcgcaagtcagtgttctttgttggtcaacttgaagctccacagcacgtggtttcttgcgatggagcggtgcacgtgtgggaccccttcacaggcaagactctacgtaccgtggaaccccttgattccagagtccctctcacggccgtcgccgtgatgcccgcccctcatacgtccatcacgatggcctcctccgacagtacgctgagatttgtggattgccgtaagccaggactgcagcacgaatttcgactggggggcggactaaatccgggtctggtgcgggcactcgctatcagcccaagcggcaggagcgtggtcgccggattctccagtggcttcatggtgttactagatactaggactggtctcgtcctgcgaggctggccagcccacgagggggatatattgcagataaaggccgtcgagggtagtgtgctggtatcatcatctagcgatcattctctgaccgtgtggaaagaactggagcaaaaacctacccaccactacaaaagcgccagcgatccaattcatacttttgatctatatgggagcgaggtggtcactggtaccgtatcaaacaagatcggcgtgtgctctcttcttgaacctccgagtcaggctactaccaaactttcttcagaaaactttcgcggaactcttacttctctggctctactacccactaagcggcacctgctacttggaagtgacaacggggttattagattgctggcctag

SEQ ID NO: 34857 - DNA, 2217 bp, Artificial Sequence
  Description of Artificial Sequence: Synthetic coding sequence
atgctggtccgagtagtgttgtctctcactccatcgtttccagagccttctgcgctgtacactgcctgcaagatggtgagatggctgtcagctaaactagggccaaccgtagcatctagacacgtcgcccgtaacctactccgcctgttaacttcctgctatgtcggacccacgagacagcagttcacagtgtcctctggagagtctccgccgctgagtgccggcaacatataccagaaaagacctgtgcttggcgatattgtttcaggccctgtattatcttgcttgttgcatatcgctcgcctttacggagagcccgtgctcacataccagtatctgccttacatctcttatttggttgctccaggaagcgcgtctgggccaagtaggttgaattccaggaaggaagcaggcctcctcgcggccgtaaccctgacgcaaaagattatcgtttacctgagcgataccacactgatggatatcctgcctcgcatctcccacgaggtactgttgcctgtgttgtcttttttgaccagccttgttactgggttcccttcgggcgcccaggctcgaacgatcctgtgtgtcaaaaccatctctctgattgccctaatctgcctacggattggccaggaaatggtgcagcagcatttgagcgagccagtcgccaccttttttcaggtgtttagccaactgcatgagctcagacaacaagatctgaaattggacccagccggacgcggagaaggacagctgccacaagttgtgtttagtgatgggcaacaaagacccgtggatcccgccttattagacgagctccagaaggtattcacactcgaaatggcttacacgatttacgtgcccttcagctgcttactgggagacattattagaaagatcatccctaatcacgaactggtcggtgaattggcagcgctctacttggagtcaatctctccgtcatcaagaaaccccgcctcggtcgaacccacaatgcccggcaccggccctgaatgggatccccacggcggtggttgtccacaggacgacggccacagcgggactttcggcagtgtgctggtcggaaatagaatccaaatccccaacgattcaaggcccgaaaatccagggcccctaggccccatctccggggtgggtggcggcggtttgggatcagggtccgacgataacgccctcaaacaggagcttccccggagcgtgcatggcctatctggaaattggctggcttactggcagtatgagattggtgtgtctcagcaagatgctcactttcatttccatcagatacggctgcaatccttccccggtcattccggggcagtaaaatgcgtcgctccactgagtagcgaagacttctttttatctggaagtaaggatcgcaccgttcggttatggcctctatacaactatggcgatgggacgtctgagaccgcccccagattggtctacacacagcatcgcaaatcagtgttcttcgttgggcaactggaagccccccagcacgtggtcagctgtgatggagccgtccacgtgtgggatcctttcaccggcaagactctgcgcacagtggaaccactggattcacgagtgcccctgaccgccgtcgccgttatgccagcaccacacacctcgattaccatggctagctccgatagtaccctgagatttgtcgactgtcgcaagcccggcctgcagcacgagtttaggttgggcggggggttaaatcctgggctcgtgcgggctctcgcaattagccctagcgggcggagtgtggttgccgggttctcttcaggcttcatggtgctgctggacacgaggaccgggctggtgctgcgtgggtggcccgcgcatgaaggggacatactccagattaaggctgtggaaggtagtgtgctggtgagttcaagctccgaccattctctcaccgtttggaaggaactggagcagaagcccacacaccactataagtccgccagcgaccctatacatacctttgacctgtacggtagcgaggtggtcacgggaaccgtttccaacaaaatcggggtctgcagcctgcttgaaccgcccagccaggctaccaccaaattaagttctgagaactttagggggactttaacttcactcgcattactgcctaccaaaaggcatctgttgctggggagtgacaatggggtgatccggctactggcttag

SEQ ID NO: 34858 - DNA, 1719 bp, Artificial Sequence
  Description of Artificial Sequence: Synthetic coding sequence
atgggcagcctcagttcccccacgtcaacatgccccactagcgccacttggttcccctccggggcgcaggctagaactattctgtgcgtgaaaactatatccttgatcgcactaatttgcctgcgaatcggtcaggagatggtccagcagcatctgtccgaacctgtggccacgttcttccaggtgttctcgcagctgcacgagcttcgccagcaggacctcaaactagaccctgctggccggggcgaaggccagttaccccaggttgtattcagcgatggccagcaacgccccgtggacccggcactcttagatgaactgcagaaggtgttcacattagaaatggcctatacgatttacgtgcctttctcatgcctcctcggggacataattcgtaagatcatcccaaatcatgagctcgtgggggaattggccgccctctacttagagagcatcagcccatcctctaggaatcccgcttcagtggagcctacaatgccgggcacgggacctgaatgggatcctcatggcggagggtgcccccaagacgatggtcatagcggtacattcgggtcagtccttgttggaaacaggatccagattcctaacgatagccggccagagaaccctggacccttgggaccgatatcaggcgtgggggggggaggactggggtcgggctcagacgataatgcccttaaacaagaattgcccagaagcgtgcacggcctgtcaggcaattggctagcgtattggcaatatgaaatcggcgtgagccagcaggatgcacatttccattttcatcagattcggctgcagtcctttccggggcacagtggcgcggtgaagtgcgtggcccccttatctagcgaggacttcttcctgtcaggatccaaggatagaaccgtgagactttggcccctctataattacggagatggtaccagtgagactgcgccccggctggtgtacacgcaacaccggaaatccgtgttcttcgtggggcagctggaagctccgcagcatgttgtgtcttgtgatggtgctgttcacgtatgggatccgtttaccggaaagacactcaggactgtggaaccattggactctagagtccctctgaccgccgtggcggtgatgcccgctccacacacgagtataacaatggcttccagcgacagcacccttcgcttcgtggactgtcgtaaacccggcttacagcacgaattccggctcggtggcggcctgaatcccggccttgtgcgagccctggcaatctcaccttcaggcaggtctgttgtggctgggttttctagcggattcatggtcttgctggacactcgcaccggcctggtcctacgcggctggcccgcgcatgagggggacattctgcagattaaggccgtggagggcagtgtgttagtatcgtctagctctgaccacagccttaccgtatggaaggagctggagcagaagcctacacaccactacaagtccgcttccgaccctatacacaccttcgacctgtatggatccgaagtagttaccggaactgtctccaataagattggtgtatgtagcttactcgagcccccaagtcaagccacaactaaactgtcttccgagaacttccggggtaccttaacctccttagcactgctgccaaccaagcgacacttgctgctagggtcggacaacggcgttattcgcttgcttgcgtag

SEQ ID NO: 34859 - DNA, 5826 bp, Artificial Sequence
  Description of Artificial Sequence: Synthetic coding sequence
atggcacaggggagtggcgggcgggagggcgctttaagaacgccggcgggcgggtggcattccccaccgagccccgatatgcaagagcttctgcggagcgtggagagggacctgagcatagaccccagacagctggcccctgcccctggaggaacgcacgtggtagcattggtaccggctcgctggctcgcctctctgcgcgacagaaggctaccattgggcccttgcccacgcgccgaggggctcggcgaagcagaggtgcggaccctgctacagcggtcagtgcaacgacttccagcaggatggaccagggtggaggtgcacgggctgcgcaagcgacgcctgtcctatccactggggggaggccttccttttgaggacggctcatgcggaccagagaccctgactagattcatgcaagaggtagctgcccaaaattatcgcaacctctggaggcacgcctatcacacctacgggcagccatattctcactctccagcaccatccgcggtccccgctttggactccgtgcgccaggccttgcagagggtgtatggctgctctttcctgcccgtgggagaaacgacccagtgtcccagctatgccagagagggaccatgcccccccaggggcagccccgcttgccccagcctgttacgagcagaggctctgctggaatcacccgaaatgctttacgtcgtccacccctacgtccaattctcgctgcatgatgtcgtgacgttttcccctgcaaagctcacaaattcccaggccaaagtactctttatcctgttccgagtcttgagagccatggatgcctgtcatcgccagggcctggcctgcggtgccctatccctttaccatatcgcggtggacgaaaagctgtgctccgaactgagactggacttgtcagcttacgaacggcccgaggaagatgaaaatgaggaggcccctgtcgccagggacgaagcaggaattgtttcccaggaagaacagggaggacagcccgggcaacccaccggccaggaagaactgagaagtctagtgctggactgggtgcacggacgtatcagtaacttccattatctgatgcagcttaacagactcgcaggcagacggcagggtgatcctaactatcatccagtgctgccctgggtagtcgactttactaccccccatggtcgctttagagacctcagaaagtcaaaattccgtctgaacaaaggagataagcagcttgactttacctacgaaatgacacgccaggcctttgtcgcaggcggcgctggcggaggcgagccgccccacgtcccccatcacatctcggatgtgctctctgatatcacctattatgtctacaaagccagacgcaccccacgaagcgtactttgcggacatgtgagggcacagtgggaaccccatgaatacccagcttccatggaaaggatgcaaaactggacacccgatgaatgcatcccagagttttatactgatcctagcatcttccgaagtatacacccagacatgcctgacttggacgtcccagcatggtgtagttcttcccaggagttcgtagcagctcacagggcactactggagagcagggaagtgtctagggacctgcaccattggatcgatttaacctttggctataagcttcagggaaaggaagctgtaaaggagaaaaatgtctgcctgcatttggtggatgcccatactcacctcgccagctatggcgtcgttcagctctttgatcagcctcacccccaacggttggccggtgcccccgcactggctcctgaaccccctctaatccccaagttgctcgtccagaccattcaggagaccacagggcgtgaggactttactgagaatcccggacagctgccaaatggagtagggcgacccgttctggaagctacaccttgtgaagcttcttggaccagagaccgccccgttgcgggagaagatgaccttgaacaggcaaccgaagctctcgactcaatcagcttggcgggcaaagccggggatcagctggggagcagctcccaggcttctcctgggctcctgtcttttagtgtggctagcgcctcgcgccctggacggcggaacaaagcggctggggctgatccaggagaaggcgaggagggccggatcctgctgcccgaagggtttaaccctatgcaagctctggaggaattagagaagaccggtaactttcttgctaagggtcttggtggtctgttggaagtcccggaacagccgagggtgcagccagcagtccctttgcagtgcctcctgcaccgcgacatgcaggcactgggcgtacttctggccgagatggtctttgctacacgagtgcgtacacttcaacctgacgctcccctgtgggtgagatttcaggcagttcgggggctctgtacacgtcatcctaaggaagttcctgtgtctctccagcccgttctcgatacgctcctccagatgtccggccctgaggtgcccatgggtgcagagaggggcaagctggaccaactgttcgaatacagacctgtttcacagggtctgccgcccccttgccctagtcagcttttgtctcctttctcttccgttgtgccctttcctccgtactttccagccctacataggttcattctcctgtatcaggcgcgacgcgtggaagacgaagctcagggaagggagctggtctttgcactctggcagcagttgggcgctgtactgaaggatattaccccagaaggccttgagattctgctgcctttcgtcctgagcctcatgtctgaggaacataccgccgtctataccgcgtggtacctgttcgagccagtcgcgaaggcgctgggccctaaaaacgctaataagtatctgctgaagccgttgataggtgcctacgagagtccctgtcagcttcacggccgtttttacctgtataccgactgcttcgtggcccagttgatggtccgtttgggcttacaagccttcctgactcacctattaccccatgtactgcaagtgcttgccggcgcggaggcatctcaggaggagtcaaaagatctggcaggcgcggccgaggaggaggagtccggactgcctggcgccggcccgggtagctgcgcattcggagaggagattccaatggacggggagccccccgcttcctcaggattgggattacctgattacacatcaggagtatcctttcatgaccaggcagatctgcccgagaccgaggattttcaggccggactctatgtgactgagtccccccaaccccaggaagccgaggccgtgagcctgggccgtttgtccgacaagagttccacgagtgaaacaagtcttggcgaagagagggccccggatgagggcggcgctccggtggacaagagcagtctgcgtagtggcgattcgtctcaggacttgaagcagtctgaggggagcgaggaggaggaggaggaggaggattcctgtgtggttttggaagaggaggagggcgaacaggaggaggtaacaggtgcgtccgagttgacactctcagatacagtcctgagcatggaaacagttgtcgccggcggctcagggggggatggggaagaagaagaggaggcccttcctgaacagtctgagggcaaggaacagaagatccttctggatactgcctgcaagatggtgaggtggttatcagcaaagcttggtcctaccgttgcctcccgccacgtagcacgtaaccttttgcggctgctgacgagctgctacgttggtcccacacgccagcaattcacagtctctagcggcgagtctccccctctcagcgcgggcaatatttatcagaaaagacctgtgctgggcgacatagtgagcggccctgtgctgagctgtctgctgcacattgccaggctgtatggagagcctgtgttgacctaccaatacttgccttatatctcgtacctggtcgcccctgggtctgctagtggcccttcacggttgaattccagaaaggaggctggactcctggccgccgttacactgacccagaagatcatagtgtatttgtcggatacaaccctcatggatatcctccctcgaatcagtcatgaggtactcctgccagtgttgtcattcttgactagtctcgttacaggcttcccgtccggagcgcaggccaggacaatcctctgtgtgaagaccatctccctgatcgcccttatttgcctacgcataggtcaggagatggtccagcaacatctgtcagagccggtcgcaacattcttccaggtcttttcacagctccacgagctgcgccagcaagatctgaagctggaccccgcgggccggggagagggccagctgccccaggtcgtgttctctgatgggcagcagagacctgtcgacccagcactcctggatgagctgcagaaggtgtttaccttagagatggcttacactatttacgtaccctttagctgccttttgggcgacatcattaggaaaatcatccctaatcacgagctggtcggagaactggctgctctatatcttgagtccatttccccgagcagtcggaatcctgcctcagttgaaccaacgatgcccggtaccggacctgagtgggatccgcacgggggggggtgcccgcaggatgacggtcactccggaacttttggctcagtcctggttggcaatcgcatacaaattcccaacgattctcggcccgaaaacccaggcccattgggccctatatctggggtcggaggtggcggcctcgggagtggatccgacgacaatgcactcaaacaggaattgccgaggagcgtacacggcctgtctggcaattggttagcttactggcagtatgaaattggcgtgtctcagcaggacgctcacttccatttccatcagatcagacttcaatcatttccgggccacagcggagccgtgaagtgtgtggcccctttaagcagcgaagacttcttcctgagcggatccaaagaccgcacagtgaggctgtggccgctctataactatggtgacggaacctccgagacagcacctcgactcgtgtacacccaacatagaaaatctgttttcttcgtgggacagctggaggcccctcagcatgtggtgtcgtgcgatggagctgtccatgtatgggatccattcaccgggaagacattaagaacagtggagccattagactcccgggtccccttgactgcagtggcagtaatgcctgcacctcatactagcatcaccatggcgagctccgactccacactgcgctttgttgattgccgcaaaccgggtttacagcatgaattccgcctagggggaggactgaaccctggtttggttagagccctggccatcagccctagcggtagatccgtggtagctggtttcagctcgggatttatggttttgctcgacacccgtactgggctggtgttaagaggctggcctgcccacgaaggggacattctccaaataaaagcagttgaaggatccgtcctggtctcttcaagctctgatcactctttgacagtgtggaaggagctggaacagaaacctacacaccactacaagtccgccagtgatcccatccatactttcgacctgtatggttctgaggtggtgactggcaccgtgtcaaacaagattggggtgtgttccttgctcgagcctccatctcaggcgaccaccaagttatcttctgagaactttagaggcacgctcacaagccttgctctcttgcctaccaaaaggcatcttctgctgggcagcgataacggggtgatccgcttgctggcgtag

SEQ ID NO: 34860 - DNA, 2145 bp, Artificial Sequence
  Description of Artificial Sequence: Synthetic coding sequence
atggtccggtggttgtcagccaagctgggtccgacggtagcaagtagacacgtcgctcggaatctactgcgcttactgacatcctgctacgtaggacccaccaggcaacaattcacagtctcatccggcgagtctcctcccctctctgcaggtaatatctaccagaaaaggcctgtgctcggcgatatagtgtcagggcctgtcctgtcttgcctcttgcatatcgcaagactttatggcgaaccagtgctgacctaccagtatctgccctacatctcctacctcgttgctcctggatccgcaagcggcccaagccgcttaaacagcagaaaggaggctggactcctggcagccgtgacccttacccagaagattatagtatacctctccgatacaacgctgatggacatcctccccagaatttctcatgaagttctgctgccggtgctctcttttcttacgagcctggttaccggattccctagtggggcccaggcgcggactatactctgtgtgaaaacgatctcactcatagcactgatatgcctccgcataggacaggagatggtgcaacaacatttgagcgagcccgttgccacctttttccaggtatttagtcagctgcatgaactcaggcagcaggaccttaagctagaccccgccgggaggggggaggggcagttgccacaggtcgtcttttcggacggccagcaacggcccgttgatccggcactgcttgatgagttgcagaaggtgttcacactcgagatggcgtatacaatttatgtcccgtttagctgtctcctgggcgacatcatcaggaagatcatccctaaccacgagcttgtcggcgagctggctgcactgtacctggagagcatttcaccctcttctcggaaccctgctagcgtggaaccaactatgcccggcacaggtccagagtgggatccgcacggcggcgggtgcccacaggatgacggtcacagcggcacgttcgggagcgtactggtcgggaaccgcattcagatccctaacgactctagacctgaaaaccccggacctctgggtccaatatcaggggttggcggagggggcctgggctcaggaagtgatgacaacgctctgaaacaggaactcccgagatctgtccatggcctctccggaaactggctagcctattggcagtacgagataggggtgagccagcaggatgcccactttcactttcatcaaattcgtttgcaaagcttccccggtcactccggcgctgttaagtgcgtcgcccctctgtcttctgaggacttctttttgtccggcagcaaggatcgcacagtccgtctgtggccactgtataactacggggacggtacatcggagacggccccccgcctcgtgtacacccaacacagaaagagtgtgttttttgtcggacagctggaggcaccccagcatgttgtcagctgtgatggcgcagtgcatgtctgggatccttttacagggaagacacttagaacggtggaacctcttgattcaagggttcctctgactgccgtcgctgtgatgcccgcccctcacacgtcaatcaccatggcctccagcgactcgaccttaaggtttgtagactgtcgcaagccgggcctccaacacgaattccgtctgggtggaggactgaatcctggattggtacgcgcccttgctattagcccaagcggccgaagcgtggttgcaggcttttcctctggctttatggtcttgctggatactcgtacaggcttggttctccgcggatggccagcccacgaaggcgacattctccagatcaaggctgtggagggtagtgttctggttagctcttcttcggatcatagcttaaccgtgtggaaagagttggaacagaaacctacccaccactacaaaagcgcttccgaccctatccatacgtttgacctctatggctccgaggtggtgaccggtaccgtaagcaacaagatcggggtatgcagcctccttgagccccccagtcaagcaactactaagctcagtagcgagaactttagaggcaccctcacatccctagccttgctgccaacgaaacgccacctgcttttaggcagtgataacggggtgatcaggttgctggcttag

SEQ ID NO: 34861 - DNA, 834 bp, Artificial Sequence
  Description of Artificial Sequence: Synthetic coding sequence
atgagccgggagttcagaggccaccggaactgcgtgctaacactggcctacagcgccccatgggacctgccatctactccttgcgctgaagaggcagccgcaggcggtctgttagtgactggatccaccgacgggacagccaaagtctggcaagtggccagtggctgctgtcaccaaactctcaggggccataccggcgctgtgctgtgtctggtgcttgacacgccagggcatactgcattcactggatccacggatgcgacaataagagcctgggatatcctctctggggaacagctccgtgtttttagagaacataggggaagtgtgatttgtctggagtgttctcgagccgctggtactctggccccagggccaagcactagatctctggaatcttgcgggggttgttctggcgcaacacactcgagctcaacagcctcacgatgtactgcccgttgcagcactcctccgaggacgacagctccttgtgcgagtggcacgtgtgcgggaagtgaggtccccaggggccccctgagaccttgcgctgcctcacgtggctctagtgccacacgctgggctgctccgcctcgaccttgtagtcggcctgaccctgccggcccacttcagacgcctgctcagacgccctctgggtctcagagcgccccaccttgctacccccgctggtggaggccaatggcaggcgagggcagaggagctcgcaagcctggaagagaggaaagcccaagtcaggcatcaggcttttcgctcgtcgcacgaaggcggtgggaacgagaatgtagcccatggggaccacccccgttcccattttag

SEQ ID NO: 34862 - DNA, 1131 bp, Artificial Sequence
  Description of Artificial Sequence: Synthetic coding sequence
atggggggcggaggttccgcgctccgggtctgcgctgaccacaggggtggtatcaactggcttagtttgtcacccgacgggcaaagactgctcaccggcagcgaggatggcaccgcccggctttggtcaacggctgatggtcagtgttgtgctctcctacaggggcacgaatcgtacgtgacattttgtcagctggaggatgaagcagctttcacatgctctgcagactgcacaatccgtcgttgggatgttttgactggccagtgccttcaggtatacagagggcacaccagtatcgtgaaccggattctcgttgcaaataaccaattgttttcttctagctacgaccgcactgcccgtgtctggtccgttgacaaaggccagatgtctcgcgaatttcgaggacacagaaactgcgttctgacacttgcctacagcgccccttgggacctaccctccactccctgtgctgaagaggcagcagctggcggcttgttggtaactggctctaccgacggtacagctaaggtgtggcaagtcgccagcggctgctgtcaccagacgctcagggggcacactggtgccgtgctctgcctggtgctggacaccccgggtcacacggcctttaccggtagtacagacgcaacaataagggcctgggatatcctttctggcgagcaactgcgggtgtttcgggagcataggggaagcgtgatttgtctcgagctagtcaataggctggtctattccgggagcgctgacaggacggtgaagtgttggctggccgataccggcgagtgtgtccgcacatttacggcacaccggaggaatgtcagtgcgctaaaatatcacgcagggaccctctttaccggatccggagatgcctgtgctagggcttttgacgctcaatctggagaactgagaagggtgtttcgcggacatacttttatcataaactgcatccaggtgcatggacaggtgctttataccgcatcccacgacggggcactgagactctgggacgtgcgcggactgcgaggcgctccaaggcctccaccaccaatgcgctccctgagtcgcctgtttagcaacaaagtgggttgcgcagccgcacctcttcagccagcttag

SEQ ID NO: 34863 - DNA, 8622 bp, Artificial Sequence
  Description of Artificial Sequence: Synthetic coding sequence
atgagcagcccacggctgatcccactgtggaaggacctgaagcttctgttgaacgatactataaacaaatctaagcagccgtccgaagaccccaagaattgtcttatcgtattgtctgatcgctcccaagctgtggcttggatgaagtctaagaccgaggatatggttgagaaacgtacattttccatgaccgagcggctccctccaatccaatctatggtacacgccggatccttccatattctcgtggtgtattgcggggatctgatactgaggctctttggtgaccactttcgtgcgttcaagcctctgggcaaggtgccttgtcggttcaacatctcctgcctttgctatgatccagagatgaagatgctgctgagtggcatcctgggcgctgtagtgacatgggtcatcgagctgggcggcaccggcctgcagatcgctcatatggtttctatgcccggagatgaacttgtgcaggacatcgtgctcaacggaccctcaggctccctcttagcactgtgcgagaccgttgttagagttttgatgcaccagggcaagggccaactgggcgaagtgaagcgctttacatccacttcatctggcagctcaatcacgtgttgttttacctgtttcgaccagggctttctatacgcgggaaatcaggcgggagaaatacaggtctggagtttgcaacaaggacatcccctgcactcattccaagctcatcagagcggggttatctgcatcagaagtaggcctgaagcccatacactgctcacagctggtagtgattcgttgatcaaggaatggaatctgactagtggatcactattgagaagactcgagctaggagaggaattataccggctgcagttcattgacagtatcacgtttttttgccagactgcccacagcttctcactgcaccggctgccatgcttctatagtctctttaacgtgtgcggtagcgctcctcagcagctccgacgggtgtgttgcggaaacaactggtttagaattctgtgtactactgaagacggcctgcttcgattcgtcagtccagtgacaggtgacctcctggtaatcacttggccattctccatcctggatcaggccgtcgattgggcttatgaccccgggaaggaggaattgttcgtggctaccggatccagcgaggttttggtgtttgatacaacccgctgcccgtgtccggccaagtatctactgggcaccagtccgaacagtcaggacttcgttcagtgcctcgcctatggacatttcaatctggggcgcggcctggaggggctgattttctcagggcaccagtccggcgtcattcgtgttctcagtcagcatagctgcgccaggcttgagaagtttatgcacttcggggcggtgctggccttgtccactctttctggcggcattttcggcgggcagggcaattctctgctgtgttcctatggcatggatgactacgttcacctgtctgaagctgtgctagatggcgtgaaagtgcagttaaggcccctcgctagtatcttgagcagttgtcacttgacgcacctgatcctcctgcccaaatccgttggggctatcacggaaaccaattgcttgagactgtggaagtttcatgactttctgagttccggttcccaaaacggcctgaagtttattgagaccctgcccctgcacctgtgtgctataacctcattcgatgtttgcctcagcctatctctgttcgtaaccgggtccgccgacggaagcgtgagaatctgggatttccacggcaggctcattggcattctggacagttcattacatttcggccctgtctgctttgccaatgatagaggcgacctcctggtgaccttcaatcagtcattgtaccttgtgagttgcctgaagctgctgccacctgccttgttaacccgcctgagcttcatgtcaatttcagacgaagtgctggaagtgcccaagccatttatacccagcttctttttcagctttgagacaatgttcgtcccaaaatatatttaccctggacaggcccaacaaaagctggtcggcctggaaaagctggtaaataatagagccatcgctttcgaccactctgtgccgcatgtgatcgaagaagatgaggaaggatctccagtgttgttgagaagctccatgcattattctctccaagatatggaggattggatgcaggtttccaagcgttatcagtgccattatgtactgcccccacagctgcagttgacttcttgggacggtctcaatccatatcaaatcctgaggtattactttgggcacggtcgggagtggctgtttgccccggactgctatatacctaattccgtcatccgcgcccgactatggcccgagggaactcccatttatttgcagtgtaacctgcacgctccgcagcgggaactggagtgggatcgcagccaggaattctttttttggcactcacgcgttagggcaatctctaatacagagtatcccaaaaacaaggaggaggacgaacacttcctagagatgcggttgtccaaggacgtcacctattcggtgctgacggacggcgccaatagatcctggttgggtagaaagatgtccgaaatcactatcaacagcatgatagaaacgatgctgaacattatggtacatgcctccctgttgaagtaccagtgttgcgtgggagccctcggccagatttttgcgagctatcaggtgtcccctgccttgcgctccgaaaccgcccggagacttctcaacgatactacaaactcaaatccccttatacgcgagctggcctgggagggactcaaacggctgggaatgataacccacctgtttgcaatgcctctggcccaaggacttatggacaaggatgaaagagtgcgaatcaaaactctgtctctcatggccgaaatagggattcattctaggacctcattgctccagctgacccagaagcaggaaacttttagagaaatgcagcagcaaatgattggagaggaaccactggaccatctgctcggcatgcgggcgaccgatctgcagattttatctacacaggttgaacagcggctgaacgagaatcttacactgagtcatagggacgagaaacccgccttttctcttgacgtctcaatgcccagtgaactgaaaagcagcctcaaaccccccactgtaagtgaggagtccgaggtagctattaaacctagtaaaggtcagcggagggggcaggccggagtaaaaaaacatagccagaagtggcttcgaggcttaaagaagactaaggaaagagattccaagcaaatgtctactgagccaggactgttagaggacgaatccggaaccgaagcggcccctatagagatggaggaagcatctgtgtattcgcagtggagctctagtacaagcgtgatcaaactgagcaaggacgtggattcccaggaaaaggacatttctaaggatcacattgcactcacccttaagcggctacagaaaatcagggataagcgggacaaaaaagctacagcccagaaacttaagaaaaagcataaaaaaaagggaaaagaggcgaaggtgattaatgaggagacaaccccgcccgtgatggagcagcctgtgacaaagaaggtcaagatccaaggcagaggcgcctcggggattagtggacggagatctactgcgggcgacgggtcttcgtggcgcgacgatctgtgtagattgatggccttgcggatttcaggcagccaaactaagatgtcagagaatctgaacgcagagctggtcacgtttgcccaggagatgctggtagaccgacatccctcgtgggagcttttccaagagatatgccccttgctgaaaaaggagtctaaagtgttgctggaagacctcgactgggatgtggttcctcctgaaaaaaaacctattttcatacaagaaggcgctatccgggaagatatgattcagggcgttacgcaggaagtaatcaggcacaaggaagttatgccaagagaagaggaacaggcccagaagaaggctcgggatatgcttggtctggaggagacccaggttattctcaagaaaggcaaaaaggtgatcttcctggagcctggcaacgttaccatggggaaggagatctcaaagaaggaagaaaagaagacatttcagaagagtcccaaacaggggcgcaaagctgtgcagaaggagcgaaaagtcggcaaaattaagagagaaatgactaaagaagaacgagacatgtccgaagaggtggaggagatggcaacgctagaagaaaaagtggtgaaacaagagggaaagctcgtgatgattgagcgtaccccctcttggcaagattggaaaaaagcatgggatgaatggaagcaggtgcatggtgagacacggaagtcctggaaggcctggaaggaagagtgggaaaagcgcctattacaggaagaagagaaactgcaccaagccggggagaaattgagtccggaagaggaaatgttgcaggaggataagaagcttaaatgggaggagtggaagcaggtgtgggagaacatgctctcatccaaatctaaggagcagcagtacaaagatgaagaagaagtaacacttgaggaggaggtgtctcgggaaggagaagagaaggaacagcaggtcaccgaggagcagcgccatatccaggaagaacacaaatgggcgagaatacaccggaaaagggcacgtgcggaaaaaaaacgcgcccaggaggaaagaaagctcgcccaggaggaagagaagttagcacaggaagaaaggcagcttgctcaagaagagagaaagctggcccaggcctatgtgaagatcacccaggatgacagggaaatggcccaagccgaagggaaattcgctcaaaaagaagagactttagcgcagcggggcgagaaactgtcgcaagaagccgagaaactagcccagaagagaaaaaagttagccaagaaatgggagaaggtggcccgcgaagaggagaagctggcgaagaaaggcggcaagcttgctgaggtgaagaacatacttgcgcaaaaagtggaggagctgccccagagagagcagaacctagattggcaggaaaaggaactggcccaagagctcgaggaactcgagtgggatatggaggaactcagttggaaagaagaggagctgaatcaggaggagggaaaactcgtcgaggagaagaaaaaattggcagaagaggaggaggcacttgcctggcagcgggagaagctgtcagaagaggagacgaagttggctcaggaggaagagctgttgatccaggagaaggagaagcttgcccagcacaaagagaagatgccagaagaagaagaaaggcttggccggaagcgcgagcagctgatcgagaagaagatgaaacttgcccagaaaagagaacgctggattaattctatggaagagctgacaaaaaacaagatgatcttatatcagaagaagaatctggcccaagaaaaaaaaaacctcgcccaggagaaggaaaagctagcccagcggaaagagaatctgctctataataaggagcggctgacacattctaagaagcagttggttcaagtgaagaataaactcggtatgttcaacaagattctggcacaggtcgaagaaaaacttactcaggagaaagaaaccgtgatcaagaagaaggagaagcttgccgagactgaaaaaaagctcgtccaagttgaagacagtctggcaaagaaacaggagaagcttgctcaagaaaaaatgaagctagctctggagaaggctatggttcaagggaaaaagaggctgcgcggcgagctggatatagctaaggaggaaaaggctttgaatctcgaaatgaaaaggctggccgaggaaaagatgagactagtagaggggaaagaaaccctgtctaaaggggagactcccgagacttctcgacagagaaagatgacacaggtggagcaggaactgtttgaaagaaaactcagtctcgaagaaaagatcctgctccatgaagaccggattctggctatggaggaaagcgaaattgcaaagggcaagctggaattcacacgggggcaacggatttttgtgcaagggcagcggaagctggcaaaagccagccggaaactaattaagaagcgagagtcactgtcaaaagaacctgccaagctaaataagattctaaaagctctgcaaaaactgactagggatgagcggaagctgacgcaggaagagattaagatgacaaagatgaaacgcgcactgttcgtgaaggagcgccggttgagtattgagcaatcaaagctggacattaaggaatgggatttctctgagaagcgcagcgagctcactaaggatgagaaaaaattggcaagaaagcaaaggaagctggccaataagatgcggagaatgataaacaaggaagaaaagatgaccgaggaagagtctaaactggcccggaaacattcagaagtgatcctggatgatgaggaggagggtgggattgaggaggaggaagtgatcccgtttctgaagcggaggtggcgcaaacgtaaggaagcaaaaaggggcgataagcctaaggagaagtttagtagccaggtcgacgaagtggaatctgaggaacacttttccgaagagatggaaagtctccttgacgagctggaaaaacaggaaagtttatcttcagaagaagaggaggagagagaggaagaagaagaaagggaggaggaggaagtgagggaggaagaagaagaaaggaaggaagaagaagaaggtgaagaaaaacaggttgaaaaagaagaggaggaaaaaaagaaaaagaaaaaggaaaagaaaaaggaggaggtgcaggaaaaagaagaggtttttgaggagaaggaggaaattatgtccgaggaggagaccgagtctctgagcgatgaagaggaggaagaagaaagttgctcactggaagaagaagtggaccgcgagaaagagattctcaaaaaagagaagcagttcaagctgcaagagcagagacgaaaaagcctgcgagggcgtgagagggttctatccattctgcgcggagtgcctcacggaaagggtcgcgccattcgcctcggtgtgttaaaatcccctctcaagaaactcatgtctactgctctggaaatgaaggaaaaaacccccgtcccagtaccagagaagcagatttcatgggaagataagaaggctaccgtagtggagattccccgaaagtttctgggaactatggacaaggagcgggaggtgatgggaaagtatgagcccatcccccctcatgtcctaggaactgtacttgagtcccaggctcaggacctcaagaccccattcatgagtcacattctcagaaggaccgtcgaggccgaggagctacagcataaacctcttggtgcatggtggaagtggttcctccagcatcccccgctgatgggccaaacggaagtgcagctgccactcagtcaaattccagccaaggaacaacatgccgatgtgtccctcagcgatgtggagtggattcgccatgtcttggagcggatggaggcaggggagcagctctccagagatggttttcatcgcctgtgtcaactactaaaagacctggccagcaaaggtaacctggagtggttacatctcgccaagcacgaggccatagtgtaccgtcaccgccaagccctggagtcccaggacaccagaatctcttctcgccagtccatgagtccgaaatatcttaaagttattccgcccatcaaggcgaaggagaaagagtcctggccaaaaccacttgcagtgcccacccaaaaatctcccttggcaaccaaacgcatcccggaccctcgggccaaaaactggcatctgctgggtgaaccctatcgctccgagcgtgcgcaacaaatcagcatcgcccacaaagagatggagatgcaatacttctatcccgcgacccgggatatcttccccagtgctcacgcaagcgtggaaaagcagacccttgcattgatgtttcagaaggacttctgggatttcaaggacaagaggaggttccccaagttacctaaactcgaaaagaagacacagcccatatccaagaaaaaggaggagcttcctctgtgggagaccttcgttgccttgtaccacgtgctgcggatgctgcaacagcgctatccgaaggacagcaccgcctggatggaacagttctaccagctgatggacttatatcaattgaaatcgcctagaatccagaaactcctgcaagagctgctgatgagagaagagccccagccccaggaaatcatttacgaagaagctctgaaggctacagagctagtccccggggagcgcctgttttgttgcttgttctgcggctcatcacacacaccacgctcaccacaggagttccagggcgccgtccccctaccgtggcagaactgtgtgcgaacgatcctgcctgtggggatcgcccggtacggcatcctggaattggcttggaaatctctaccagaagccgatctgcatcttacaaaagccttgactcataccgtcgcccccacactttag

SEQ ID NO: 34864 - DNA, 8739 bp, Artificial Sequence
  Description of Artificial Sequence: Synthetic coding sequence
atgtcatctcccagactcatccccctctggaaggacctgaaactgctgctgaatgacacaatcaataaaagcaaacaaccttccgaggatccaaaaaattgtctgattgttctgagcgatcggtcacaagtcctcttcaaggagtcgagatatccgcagaatatgccctgtgtgtgttattacttttctgacgcccacttttttgcaagcctctcttgggtcacctcgaacaccaaggagatccaggctgtggcttggatgaagagtaaaaccgaagacatggtggagaagagaacattctctatgaccgaacgtctgccgcctattcagtccatggttcacgccggatcttttcatattctggtggtgtattgtggagatctgatattacgtctgtttggagaccattttagagccttcaaaccactggggaaagtgccctgtcgatttaatatttcttgtctttgctatgaccccgagatgaaaatgctgctcagtgggatattgggcgctgtcgtaacttgggtgatcgagttgggagggacagggctacagatcgctcacatggtgtccatgcctggagatgagttagtgcaggatattgtcttaaacggtccctccgggtcactgctggctttgtgcgagactgtggtaagggttctgatgcaccaggggaaaggtcagcttggcgaggttaagcggtttacatccaccagcagcggtagtagcattacttgttgtttcacttgtttcgatcagggatttctgtatgcagggaaccaggcaggtgagatccaagtgtggtccctgcaacagggtcaccctcttcactctttccaggcccatcagagcggcgtcatctgcatcagaagcagacccgaagcccacacacttctgaccgctgggtccgactctcttatcaaagagtggaatctcacgagcggcagcctactgaggagattggaactcggggaagagctttaccggctccagttcatagactctatcacattcttttgtcagacagctcactccttctccctgcaccgtttgccctgcttttacagtctcttcaatgtgtgcgggagcgcaccacagcaattgagacgcgtttgttgtggcaacaactggttccggattctgtgtacaacagaggatgggctccttcgcttcgtctctcctgtaacaggagatctcctcgtgatcacatggcccttctcaatactggatcaggctgttgactgggcttacgatcccggcaaggaggagctattcgttgcaaccggaagctccgaagttctcgtctttgacactacaaggtgcccctgcccagcaaagtaccttctcggcacctcccctaactcacaggattttgttcagtgtctggcctacggccatttcaatctgggtaggggcctggaggggctgatcttctccggccaccagtctggagtgatccgcgttttatctcagcactcatgtgccaggctggagaagtttatgcatttcggggctgttctggccctgtccaccctcagtgggggcatttttggaggccagggcaatagcctcctttgcagttatggtatggacgattatgtgcacctctctgaagcagtgctggatggtgtcaaagtccagctgcggcccctggcctctattctgtccagttgccatctgacccacctaattttactccccaagtccgtcggggccataaccgagaccaattgcctacgcctttggaagttccatgactttttgagttcaggctcacagaacggactaaagtttatcgagactctgccccttcacctgtgtgctatcacttcttttgacgtctgcttgtccttgtctttgttcgtgacgggaagcgccgatggctccgtgcgtatttgggattttcacggacggctgatcggcattctggattcgagcttgcacttcggacctgtctgttttgcgaacgataggggggacctgcttgttacctttaaccagtcactgtatctggtgagctgcctcaagttactgcctccggctctactcactaggctttccttcatgagcatcagtgatgaagtactggaggtcccaaagccgttcataccttcattttttttcagttttgagaccatgtttgtgcctaagtatatctaccctgggcaagcccagcagaaattagtaggccttgaaaagttggtgaacaatcgtgcaatcgcctttgatcactcagtgccgcacgtcattgaggaggacgaagaaggctctcccgtgctgctccgctcgagcatgcattattcactgcaggacatggaggactggatgcaggtcagcaagaggtaccagtgtcattacgttctgccaccccagcttcagctgacaagttgggacggcctgaacccctaccaaatcctgagatactacttcggacacgggcgggagtggctctttgcacccgactgctatattccgaattcagtgattagagcccggctgtggccggaggggacaccaatttatctgcagtgtaatctgcacgctcctcagagagaactggagtgggatcgcagccaagaattttttttttggcattctcgggtgagggccatctcgaatacagagtacccgaagaacaaagaagaggatgaacacttcctagaaatgagactttccaaggatgtgacatatagtgttttgaccgacggtgccaacaggagttggcttgggcgcaaaatgtctgaaataaccataaactccatgatcgagactatgctcaacatcatggtgcacgcaagtttgctcaagtatcagtgttgcgtaggcgctttgggccaaatattcgcatcctatcaggtgagccccgccctccgcagtgaaaccgctcgcaggctcctcaacgacaccacgaacagtaaccctctgattagagagctggcctgggaaggattgaaacgtctcggaatgattacccacctgttcgcaatgccccttgctcagggcctaatggacaaggacgagcgggttcggatcaagacactctcccttatggccgaaatcggaattcactccagaacttccctgttgcagctgacccaaaagcaggaaactttccgggagatgcagcagcagatgattggggaggagccactggatcacctcctgggtatgagggctaccgacctccaaattttatctacccaggtcgagcaacgcttgaatgaaaaccttacgctgtcacatagagacgagaagcctgccttttcgcttgatgtctcaatgccgagtgaactgaagtcctccctgaaacccccgactgtcagcgaggagtctgaggtggcaatcaaaccaagtaagggccaaaggcggggccaggccggggtaaaaaagcactcacagaaatggttgcgaggtctgaaaaagactaaggaaagagacagcaaacagatgtccacagaaccgggcctgctggaggacgaaagcgggacagaggctgccccaatcgagatggaggaggcctctgtgtatagtcaatggagctcgagcaccagcgtaatcaagctgtctaaagatgtggactctcaggagaaagatattagtaaggatcacatcgcccttaccttaaagcgactgcagaagatcagagataagagggacaaaaaagccaccgctcagaagctgaagaagaagcacaaaaagaagggaaaggaggccaaagtgatcaacgaagagactacaccgcccgtaatggagcagccggtgaccaagaaagttaagatccaagggagaggagcctcaggaatctccggccgaagaagcacagctggtgatggctcttcctggagagacgacctgtgtcgcctgatggccctccgtatttctggaagccagacaaagatgtccgaaaatcttaacgctgagctggtgacctttgctcaagaaatgcttgtggaccgccatccttcgtgggagttgttccaggagatttgcccacttttaaagaaggagtccaaggtactactcgaagatctggattgggacgtggtgccacccgagaagaagcctatctttatccaggaaggagccatcagagaggacatgattcagggtgtcacacaagaagtcatccggcataaggaggtgatgccacgcgaagaagagcaagcgcaaaagaaagcccgcgacatgctaggactggaagagacacaggtgatcctaaaaaaaggcaagaaggttatctttctggaaccaggaaacgttactatgggcaaagagatcagcaaaaaagaagagaagaagacattccaaaagtccccaaagcagggtcgcaaggccgtccaaaaggagcgtaaagtcggcaaaataaaacgcgagatgacgaaagaggaacgggacatgtcggaggaagtggaagagatggctacactggaagagaaggtggtcaagcaagaaggcaagctcgtgatgatagaacgaacaccctcttggcaggactggaaaaaagcctgggatgaatggaaacaggtgcatggagaaaccagaaaaagttggaaggcctggaaggaggaatgggagaaaaggttgttgcaagaagaagaaaaactccaccaggccggcgaaaaactctctccagaagaggagatgctgcaagaagataagaaactgaaatgggaggagtggaagcaggtttgggagaacatgctcagctcgaaatcaaaggagcagcagtacaaagatgaggaggaggtgacccttgaggaggaagtttcccgcgagggggaagaaaaagagcagcaggtcaccgaggagcagcgtcatatccaggaggaacacaagtgggcccgcattcaccggaaaagagcgcgagccgaaaagaagagagcccaggaagagcggaagcttgctcaggaggaggaaaagttggctcaagaagaaagacagttagcacaagaagaaagaaaactggcacaggcatatgtcaagatcacacaagatgaccgggaaatggcccaagctgaaggcaagtttgcccaaaaggaggaaacattagcacaacgtggcgagaagttgagtcaggaggctgaaaagctggcccaaaagaggaagaaactcgctaagaaatgggaaaaagtagcccgtgaggaagagaaactggccaaaaaaggggggaagctagccgaagtgaagaatatcctcgcgcaaaaagttgaagagcttccccagagggaacagaacttggattggcaggagaaagaattggctcaggaattagaggagctcgagtgggatatggaagaactctcttggaaggaggaagagctgaatcaagaggagggaaaactggtggaggagaaaaagaaactggccgaagaagaggaggcgctcgcctggcaacgcgaaaaactgagtgaagaggagacaaagttggctcaggaggaggaactgctaattcaagagaaagaaaaattggcccagcacaaagaaaaaatgcccgaagaggaagagagactgggtcgtaagcgtgagcagctgatcgaaaagaagatgaaactcgcacagaaacgagaaagatggataaactccatggaggaattgaccaaaaataagatgattttgtatcagaagaagaacctggctcaggaaaagaagaatctagcccaggaaaaggagaaactcgcccagagaaaggagaacttgctctacaacaaagaacgcctgacccattctaagaaacagcttgttcaggttaagaacaagctgggtatgttcaataagattctggctcaagttgaggaaaagctcacacaggaaaaagagacggtgatcaaaaagaaggagaagttagctgagaccgagaagaagctggtacaggtggaggacagtttggcaaagaagcaagaaaagctggctcaagagaagatgaaactcgcacttgaaaaagctatggtccaggggaagaagagactgcgcggcgagctggacatcgctaaggaagagaaggcacttaacttggagatgaagaggctggccgaggagaaaatgcggctggttgaagggaaggaaaccttgagcaagggagaaacccctgagacaagccggcaacgaaagatgacacaggtggaacaagagttgttcgagagaaagctctcactcgaagagaagatcctgttgcacgaagatcgaattctggcaatggaagaatcagaaatcgcaaaagggaaactagagttcacaaggggccagaggatctttgtccaggggcaaagaaaactggcaaaagcaagccgtaagctgattaaaaagagggagtccctgagcaaagagcccgcgaaacttaacaagatacttaaagccctccaaaagctcacccgggatgaacgaaaactcacacaagaggaaatcaaaatgaccaagatgaagagagcacttttcgtcaaggagcgacggctgagcattgagcagagtaaactcgacatcaaagaatgggacttcagcgagaaacgaagcgaactcacaaaagacgagaagaagctagcccgtaaacaaaggaaattggctaacaagatgagacggatgataaacaaggaagagaaaatgactgaagaagagtctaaacttgcccgcaaacactctgaggtgatactcgatgacgaggaagagggaggcattgaagaggaagaggtcataccctttctcaagaggcgctggcgcaagagaaaggaggcgaaaagaggagataagcccaaggagaagttcagcagccaggtggatgaggtggaaagtgaggaacacttttctgaggagatggagagcctcctcgatgaacttgagaagcaggagtctctctcctccgaggaagaggaagagagagaagaggaggaggaacgggaagaggaagaggtccgcgaagaggaggaagagagaaaggaggaggaggagggcgaggaaaagcaagttgaaaaagaagaagaagagaaaaaaaaaaagaagaaggagaaaaagaaggaggaggtacaggagaaggaagaagtctttgaagagaaggaagagattatgagcgaggaggagacagagtcccttagcgacgaggaggaagaggaggagtcctgctcactcgaggaggaggtcgaccgagagaaagaaatcctgaagaaggagaagcaattcaaactgcaagagcagagaaggaagtcactgagagggcgggagcgggtgcttagtatattgcggggcgtccctcacggaaaaggtagagccatcaggctgggcgttctgaagtcccctctgaagaaactgatgtcaaccgccctggagatgaaagagaagaccccagttcctgtgccggagaagcagatttcatgggaggacaaaaaagccactgtggtcgagattccacgaaagtttctggggactatggacaaggaacgggaggtaatgggaaagtacgaacccatccctccgcacgtcctagggacagtgctcgagagccaggcccaggatttaaaaaccccttttatgtcccatatactgcggagaacagtggaggctgaagagctgcagcacaagccactcggagcctggtggaaatggttcctacagcacccccccttgatgggccagacggaagtacagctgcccctgagtcagattccagcgaaagagcagcacgccgatgtgtctctgtccgatgtggagtggatcaggcacgtcctggagagaatggaagcaggcgagcagctgagtcgcgacggattccatcgactttgtcaactgttgaaagaccttgcaagcaaagggaacctggaatggttacacttggctaagcacgaggccattgtgtacagacatcgccaggcactggagagtcaggatacacgcatcagttcacgccagtccatgtccccgaagtatctgaaggtgataccaccgataaaagccaaagagaaggaatcatggcctaagccgctggctgtcccaacacagaagagtccattggccaccaagcgtatccccgacccaagggccaaaaactggcacttgctcggagagccctatcggtccgaaagagctcagcaaattagcatcgctcacaaagagatggagatgcagtatttttatccagcgactcgcgacatttttccctccgcccatgctagcgtggaaaaacagacattagctttgatgtttcagaaggacttttgggattttaaggacaagagacgttttcccaagctcccaaaactcgaaaagaagactcagcctatttcaaagaagaaggaggagctgcctctctgggaaacattcgtggccctttaccacgtgctgcggatgctgcagcagaggtatcccaaagattctacagcctggatggaacagttttatcagttgatggacctgtatcagttgaagtctcctagaattcaaaagctactgcaggaactgctgatgcgggaagagccacagcctcaagaaattatctatgaggaggccctcaaggccacggagctggtcccaggcgagcggctcttttgttgcctattttgcgggagctcacacaccccacgttctccacaggagttccagggcgcagtgccactgccatggcagaactgtgtgcggacaatacttccagtcggtattgcaagatatggcattctggagctggcctggaaaagcctcccagaagccgatcttcacctgaccaaggcattaacccacactgtagcaccaacactctag

SEQ ID NO: 34865 - DNA, 1419 bp, Artificial Sequence
  Description of Artificial Sequence: Synthetic coding sequence
atggctagccccccgcgatgcagtcctactgcccacgacagggagtgcaaactgccccccccaagcgcacctgcgtccgaatactgtccaggaaagctatcttgggggacaatggcaagagctcttggccggttcaaactctccattccccacacacatctgcttgctaccctggatccattagctctggaccgagagcccccacctcacctgctgccagagaaacaccaggtgcctgagaagttgatttggggggatcaagacccattgtctaagatcccatttaaaatcctctccggccatgaacatgcagtatccacctgtcacttctgcgttgacgataccaaactactgagtggaagctacgattgtaccgtcaagttgtgggaccctgtcgatggcagcgtggttcgagatttcgagcatcgtccaaaggcccccgttgtagagtgctctatcacgggcgacagcagcagggtaatagctgcatcctatgacaaaacagtcagggcatgggacctggaaacaggaaaacttctttggaaagtccgctacgatactttcatcgtttcatgtaagttctctcctgacgggaaatatgtcgtatccgggttcgatgtggaccacggtatctgtatcatggacgccgagaatatcactactgtgtccgttatcaaggaccaccataccagatcaatcacttcctgctgctttgaccctgactcccagcgggtggcaagcgtgtccctggacagatgcatcaagatatgggacgttaccagccaggcgacactcctgaccatcactaaggctcactcgaatgcgatcagtaattgttgctttactttctctggccattttctgtgtacgtcctcctgggacaagaatctgaagatctggaacgtccatactggtgaattcagaaactgtggcgcttgcgtgacattgatgcagggccacgaaggtagcgtttcctcttgtcactttgctcgcgacagctctttcctgatttccggtggttttgaccggacagtggctatctgggatgtagcagaaggatatagaaagctgagcctcaagggacataacgactgggtaatggacgtggctataagcaataataagaagtggattttgtccgcgtccaaagatagaaccatgcgtctgtggaatattgaagagatcgatgagatcccactggttatcaaatataaaaaggcggtggggttgaaactgaaacagtgcgagcggtgtgatcggccattctccattttcaaaagcgataccagtagcgagatgttcactcagtgtgtattctgccggatagataccagggggctcccagcagatacaagttcttcttccagcagttcagaacgcgagaacagtcccccgcctcgaggatctaaggacgattag

SEQ ID NO: 34866 - DNA, 1281 bp, Artificial Sequence
  Description of Artificial Sequence: Synthetic coding sequence
atggctagcccgcccaggtgcagtcccactgcgcatgatagggagtgtaagctcccccctccctcagcccctgccagtgaatactgtccaggaaagctgagctggggcaccatggcgcgggcattggggaggttcaagctgtcaattccccacactcacctgttggccacgctggatccactcgctttagatagggaaccgccaccacatctactgcccgaaaaacatcaggtgcctgagaaattgatctggggggaccaggaccctctgtctaaaattccttttaaaattctctccgggcacgaacacgccgtatcaacgtgtcatttttgtgtcgatgacaccaagctcctcagcgggtcctatgattgcaccgtaaagctttgggaccctgtggatggatctgtggttcgcgatttcgagcaccggcccaaagctccagtggtagaatgctcaattacaggtgatagttccagagtcatcgccgccagctatgataagacggtgcgtgcatgggacttggagaccggcaagctcttgtggaaggtgcgctatgacacattcatcgtctcctgcaaattttccccagatgggaagtacgttgtcagtgggtttgacgtagatcacgggatatgcatcatggacgcggagaacatcactaccgtgtcggtaatcaaggatcatcacacacggtccattacttcttgttgtttcgatcctgactctcaaagagtcgcatccgtgagcctagaccggtgtatcaaaatctgggacgtaacttcacaagctaccctcctgaccatcacgaaagcacacagcaatgctatttctaactgctgctttaccttctccggccactttctctgcacttcaagttgggacaaaaatctgaagatctggaatgtccatacaggtgaattccggaattgtggtgcgtgtgtcacgctcatgcagggacatgagggctccgttagcagctgtcacttcgcacgcgacagctccttcctgatatcaggcggtttcgataggaccgtggccatctgggatgtggctgaagggtacagaaagttaagcttgaagggacacaacgattgggtcatggacgttgccattagcaacaacaagaaatggattttgagcgcgtctaaggacagaacaatgaggctgtggaacattgaggagattgatgaaatcccactggtgatcaaatacaaaaaagccgtcggacttaagctgaagcaggagaaaaaagaagcctacttgaagttgaagcagggctag

SEQ ID NO: 34867 - DNA, 1164 bp, Artificial Sequence
  Description of Artificial Sequence: Synthetic coding sequence
atggagaaaatcgaggagcagttcgccaatctgcatatcgtgaaatgctcactcggcactaaggaacctacctacctccttggaattgatacaagtaagaccgtgcaggcggggaaggaaaatttggtggccgttctctgttccaacggatccatcaggatctacgataaagaaaggttgaatgttctgcgcgagttctctgggtacccaggactgctgaatggtgttcggttcgctaactcctgcgattctgtgtatagcgcctgcaccgacggcaccgtgaaatgttgggacgccagagtggcccgcgaaaaaccggtccagcttttcaaaggatatccatctaacatttttatctcattcgacatcaactgcaatgatcatattatatgcgctggcacagagaaggttgacgatgatgccctcctggtgttttgggatgctcgtatgaatagtcagaacctgagcactacaaaagattccctgggggcctactctgaaacacattcagatgacgtgacccaggtacgctttcatccatcaaaccctaatatggtggtttccggatccagcgatggtctcgtgaacgtctttgatatcaatatcgacaatgaagaggacgctctggttaccacatgtaatagcatctcatctgtcagctgcataggctggtctgggaaaggatataagcagatatattgtatgacacacgacgagggcttttactggtgggacctgaaccacctggatacagatgaacccgtgacacgccttaacatccaagatgtaagggaagtcgtgaacatgaaagaagacgcactggactatcttatcggcgggctgtaccacgagaagactgacaccttacacgtgataggggggactaacaaagggcgcatccacttaatgaactgtagtatgagtggactgacccacgtgacatccttacagggtgggcatgcagcgactgtacggagtttttgttggaacgtgcaagatgattcactgctcactgggggcgaggacgcccagctcctgctgtggaaacccggggccatcgagaagacgtttacaaaaaaggaatccatgaaaatcgcatcgtccgtccatcagcgagtgagggtgcacagcaatgattcctataaacggagaaaaaaacagtag

SEQ ID NO: 34868 - DNA, 1164 bp, Artificial Sequence
  Description of Artificial Sequence: Synthetic coding sequence
atggaaaaaattgaggaacagtttgctaatctacatatcgtgaagtgctcgttgggaacaaaggaaccgacttaccttcttggaatcgatacctcaaagaccgtgcaggccggaaaggaaaacctcgtcgcagtgctgtgctcaaacggctcaattagaatatacgacaaagagcgcttgaacgttctacgcgagttttccggataccctggtttgctcaatggcgttagattcgctaatagttgcgactctgtctactcagcctgcaccgatgggactgtgaaatgttgggatgcacgagtcgctagggagaagcctgtgcagttgtttaagggctaccccagcaacattttcatttcttttgatattaactgtaacgatcacataatttgcgcggggacagaaaaggtggatgatgatgcacttctggtgttctgggatgctcggatgaattcccagaacctgagcaccactaaagatagcctcggcgcatactctgagacgcacagcgatgatgtgacccaagtcaggttccaccctagcaaccctaacatggtcgttagtgggtcgtccgatgggcttgtgaacgtctttgatatcaatatcgacaatgaggaagacgccttagtgaccacatgtaattctatcagttccgtgagctgtattggatggagcggaaaaggctacaagcagatctattgtatgacccacgatgaaggattctactggtgggacctgaatcacctggatacagatgagcctgtgacacggctgaacattcaggacgttcgcgaagtggtcaatatgaaagaggatgccctagattatctcattggcgggctttaccacgagaaaaccgatactttacatgtgatcggcggtactaataaaggcagaatacacttgatgaactgctccatgtccgggctgacccacgtcacttcactgcaaggcggacacgctgcaaccgttagatctttttgctggaatgtacaagatgattctctcctgactggtggggaagatgcccaacttctgttgtggaagcccggtgctatagagaaaacgttcactaagaaagagtctatgaagatcgcatcttcagtccatcaacgggttcgagtgcatagcaatgactcttataagcgtaggaagaagcaatag

SEQ ID NO: 34869 - DNA, 900 bp, Artificial Sequence
  Description of Artificial Sequence: Synthetic coding sequence
atgctctggttcggccagcccgggccagggggatggaaccggaagtgtctccggcctttcacactgcctagaggacagcatccacagccaagctatggcttccctcaagtgaatgaagtcgtgttttccccaggcgaatcccattgtgccacgtgtagcgaagacggttccgtgcgggtctgggcgctggcgtcaatggaactggtgatccagttccaggtgctgaaccaatcatgtctgtgtctggcttggagcccaccatgttgcgggaggccggagcagcagcggctagccgctgggtatggggacggttcactgaggatatttagcgtcagtcgtaccgcaatggagctcaaaatgcatccccatcctgtcgcgctgaccacggtagcgttttctactgacggccaaaccgtcctgtccggcgataaggacggcttggttgcagtatcacatccctgcaccggcactactttccgcgtcttaagtgatcaccagggggccccaatctccacgatttgcgttacatgcaaagagacccaggggcatctgcctcccagccttgccgcattctgcccatgggatggagccctccttatgtatgtcggccctggagtttacaaagaagttattatttacaatctttgtcagaagcaggtcgtcgagaaaatcccattacccttctttgcgatgagtctatctctctctcctggtacacacctgctagcggtgggtttcgccgagtgcatgctgaggctagttgattgtgcaatggggactgcacaggactttgctggccacgacaacgctgttcatttatgtcgcttcacaccttccgcccgattactgttcaccgccgcacggaacgagatcctggtttgggaggtgccagggctgtag

SEQ ID NO: 34870 - DNA, 5247 bp, Artificial Sequence
  Description of Artificial Sequence: Synthetic coding sequence
atggctcgcgcgtggcagcatcccttcttgaacgtgttcagacactttcgggttgacgaatggaaacgtagcgcgaaacagggagatgtggccgtggtgacagataaaacacttaagggagcagtctatcgcattcggggcagcgtttctgccgccaactacatccagctgccaaagagcagcacccagtccctggggttaacgggaagatatctctacgtattatttaggcccttgccgtccaagcacttcgtcatccacttggacgtgtcttccaaggacaatcaagtgattcgggtctcctttagcaatttgtttaaggaattcaaatcgaccgccacctggctccagttccctttggtcttagaagccagaacgccccagcgggatctggtcggcctcgctccttcaggggcacgctggacctgtctgcagctagatcttcaggatgttctgcttgtctaccttaatagatgctacgggcatcttaaatctatccggttgtgcgcttctctgcttgtgcggaacctttatacctccgacctctgtttcgagcccgctatatctggagcccaatgggccaagctgccagttacccctatgccacgggagatggctttcccagttcctaagggggagtcttggcacgatcggtacatccatgtaagatttcctagcgagtcccttaaggtcccctctaagcccatagaaaaatcctgttccccaccagaagccgtactcttgggccctggccctcagccacttccctgtcctgtcgctagctcaaaacccgtccggtttagtgtgagcccagtggtgcagacaccctcgccaactgcaagcggtagagcggccctggctccaagaccttttccagaggtgtccctctcgcaagaaaggtccgatgcctctaacgccgatgggcccggctttcatagcctagagccatgggcccaattggaagcgagcgatatacacacggcagctgccggcacgcacgtccttacccacgagtccgctgaagtgcccgtggccaggaccggcagttgcgaaggattcttacctgaccccgttttacgactgaagggggttattggctttggaggtcatggcactcggcaggccttgtggactcccgacggcgctgcagtcgtctacccctgtcacgctgtgatcgtcgtcttgctcgtggacactggggaacaacggttttttctaggccatactgacaaagtgagtgccctggccttggatgggtctagctctctactggccagcgcgcaggcacgcgcacctagcgttatgaggctgtgggatttccagactggacggtgtctctgtttgttcaggagccccatgcacgttgtgtgtagtttatccttctctgattctggcgccctcttgtgtggagtgggaaaagatcaccatgggaggacgatggttgtcgcatgggggaccgggcaggtaggtcttggcggggaggtcgtggttctcgcgaaggctcatacagattttgatgtacaggcatttcgggtgacgttctttgatgagactagaatggcttcctgtgggcaaggctcggtgcggctttggcgcctcaggggaggggtcctacgcagttgccccgtagacctaggagaacaccacgctctccagttcaccgatctggcattcaagcaggcccgggacgggtgccccgaaccatcagctgccatgttgtttgtgtgttccaggagtggccacatcctcgaaatcgattgtcagcgcatggtcgtaaggcacgcccggcgacttctgccaacgcgcacaccaggcggtccacacccgcaaaaacaaaccttcagttcaggtccggggatcgcgatctcttcgctcagcgttagcccggcaatgtgcgccgtaggatctgaggatgggtttctcaggctgtggccactggacttctcttctgtcctgctggaagccgagcacgagggcccagtgtcaagcgtgtgcgtgtcgcctgatggacttagggtcctgagtgcgacatcatccggacacctgggtttcctggacactctctctcgggtatatcacatgctggcccgctcccacaccgcacccgttttggctttggccatggaacaacgcaggggccagttggctaccgtctctcaagacaggactgtgagaatctgggacttggctaccctgcaacaactgtacgattttacatcctccgaagatgcaccctgtgccgtgacattccaccccactcggcccacattcttttgcggattttcgagtggagccgtacgctccttctcgctggaggccgcggaagttctggtcgaacacacttgccaccgaggagccgtgacaggtctaaccgcaactcccgacggtcggcttctattctcttcctgttcgcaaggctctctggctcagtacagctgtgcggatccccagtggcacgtgttacgggtggcagccgacatggtgtgcccagatgcacccgcttccccgagcgcgctcgcagtatctcgcgacggcaggctgctggcgttcgtgggcccttcccggtgcaccgtgacggttatggggtctgccagtcttgatgaactgttaagggtggacattggcacactggatttagccagcagccggcttgattccgccatggccgtgtgtttcgggccagccgctcttggacacctgttagtatccacctcctccaatagggtcgtcgtgctggatgctgtaagcggcagaatcattcgtgagctgcctggagtgcatccagagccctgcccgagtctcaccctgtctgaggatgccaggttcttattgatagcagcaggccggaccattaaagtgtgggactacgccacacaggcctcacccggcccacaggtctatatcgggcatagtgagccagttcaagccgtagccttttctccagatcagcagcaggtcctgagcgccggtgatgccgtctttttgtgggacgttctcgccccgactgaaagcgatcaatcattccccggcgcccctccagcatgcaagactgggcctggcgcgggacccttagaggatgctgcatcaagggcgtcagaacttcctcggcagcaggtgcccaaaccatgccaggcgtctccgccaagactcggtgtctgcgcacgacctcccgaggggggcgatggtgcccgagatacccgaaattctggtgcgcctcggacgacatacctggcaagctgcaaggcttttacaccggcccgcgttagctgttcaccccactcagcgaagggcacgtgtcccccgcccgcttcgggggggtggctgcggctcaaagctgtcgtcggctactctgggaatgggagggccaatatggtttggcggcccgacacaggtttctttgcctatacctgcggacggcttgtggttgtggaggacctgcacagcggcgcgcagcagcattggtcaggacactccgccgaaatcagtaccctcgctctgtcccactccgcgcaggtcttggcgtctgcttctggccggtcctcaaccactgcacactgtcagataagggtatgggacgtgtctggcggattatgccagcaccttattttcccccacagtaccactgttttggcattagccttcagccctgatgataggctcctggttaccctgggggatcatgatggtaggaccctggccctgtgggggactgcaacttacgacttggtttcatctacaaggttgcctgaacctgtgcatggagtggcatttaatccctgggacgcaggagagctgacctgtgtgggtcaaggtacggtgacgttctggctgctgcagcagagaggggcagacatctccttgcaggttagacgagagcctgtacccgaagcagtgggagctggcgaactgacatccctgtgttacggagctccccctctcctctactgcggcacttccagcggacaggtctgcgtatgggatactagggcgggccgctgcttcctgtcttgggaagctgacgacggaggaattggcctgctgctcttttccggtagtcggttggtctctggtagtagcaccggaagacttcggctttgggctgtgggagcggtgagcgaacttagatgcaaaggatcaggcgcttccagtgttttcatggaacacgagctggtacttgacggcgcagttgtctccgcctctttcgatgatagcgttgatatgggcgtcgtcgggactacagccggaaccttgtggttcgtgagctgggccgagggtacgtcaactaggctgatcagtggccaccggtccaaagttaacgaagtggtgttcagccctggtgaatcacattgcgccacatgctccgaggatggaagtgttcgcgtatgggccttagcctcgatggaactggttatacagttccaagtcctgaatcaaagttgcctgtgtctggcttggtctccaccctgctgcggacgtcctgagcagcagagactggccgccggctacggcgacggctccctgcgcattttttccgttagccgtacagcaatggaactcaagatgcacccccacccagtagcactgactacagtggcattttctacagatggccagacggttctgagtggggacaaagatggtctagttgccgtcagtcatccgtgcactggcaccacctttagggttttatccgaccatcagggtgcacctatctcgactatctgcgttacctgcaaggagtgtgaggatctgggagtcgagggaaccgatctgtggctggccgccagtggcgaccaaagggtgtccgtttgggcatcagactggctcagaaaccactgtgagctggtggattggctctccttccccatgcctgctactacagagacgcagggccacctcccgccatcgctggccgccttttgtccatgggacggtgcactcttaatgtacgtcggccctggcgtctacaaagaggtcattatctacaatctgtgtcaaaaacaagttgtggagaagatccctttgcccttctttgctatgagcctgagtctgtccccaggcacacatttgctcgccgtcggctttgccgaatgcatgctcaggttagtggattgtgcaatgggtaccgctcaggatttcgcaggtcacgataacgctgtccacctgtgccgttttacaccctcagcaagactgctgttcaccgcggccaggaatgaaatcctcgtgtgggaagttcctgggctgtag

SEQ ID NO: 34871 - DNA, 1911 bp, Artificial Sequence
  Description of Artificial Sequence: Synthetic coding sequence
atggctgaggcggtagagcgaaccgacgaacttgtaagagagtacttgctttttagaggctttacacataccctgcgacagctcgatgcagagatcaaagctgacaaggaaaagggatttagggtggacaaaattgtggaccagctacagcaattgatgcaggtatacgacctggctgccttgagggattattggtcttatctggagagaagattattttcccgcttggaagacatctaccgacccacaatccacaagctcaagacttccctctttcggttctatcttgtgtatacaatacagaccaaccgaaacgacaaggctcaggagtttttcgcaaaacaggcaactgagttacagaatcaggccgaatggaaagactggtttgtactcccattcctgccttcccctgacacaaatcccacctttgctacttatttcagccggcagtgggccgatacatttatcgtaagtttgcataacttcctcagcgtcctgtttcagtgcatgccggtgcccgtcatcttgaacttcgacgccgaatgccagcgtactaaccaggtgcaggaagagaacgaagttctgcgacagaagttgttcgcactgcaggccgagattcaccgcctcaaaaaggaagaacaacaacctgaagaggaagaagcattggtgcaacataagctgccaccatatgtatctaacatggacagacttggtgactctgagttggctatggtctgctcccaacgcaacgcttctctgagccaaagcccaagagtgggcttcctgagctccctgttacctcagtccaaaaagagtccctccaggttgtcccctgctcaagggcctcctcagccacagtccagcgctaagaaggaatccttcggtggacagggtactaagggtaaggatcccacttcaggcgcaaaggacgggaagtccctcttatcaggcctcgccaccggggaatctgggtggtcccagcaccggcagcggcggctccaagatcacgggaaagaaagaaaggagctgtttagcactaccactagtcaatgtgctgagaagaagccagaagcatcagggccggaagcagaaccctgccctgaactacacacagaacccgtggagccgttaacgcgggcttcaagcgctggacccgaaggaggaggcgtgagaccagagcagccttttattgtgctaggacaggaggaatatggcgaacatcactcttccattatgcactgccgggtggactgtagcgggaggcgggtggctagcctggacgtcgatggcgtcatcaaggtgtggtcattcaatcctattatgcagaccaaggccagcagcatcagcaaaagcccattgcttagtctagagtgggcaactaagcgagaccgtcttctgctgctcggctcaggcgtgggtacggttcggctgtatgacaccgaggccaagaaaaacctatgcgaaatcaacataaacgataacatgcctcggatcctcagtctggcctgtagccccaacggtgcgagtttcgtgtgctctgccgccgccccatcactgaccagccaggtggacttctcggcgccggacatagggtctaaaggcatgaatcaggtaccaggcaggctgcttctgtgggatactaagaccatgaagcagcagttacagttcagcctcgaccctgaaccgattgccatcaattgtacagcgttcaatcataacggtaatctgctggtcactggggccgctgacggggttatccggctgtttgttcatccagtggagcacccgcaagagtggccacagggaatacgagtccagccgcctcttcgctgccacggtcctctgtgcgctgtttggattcagcgcttgcaggctggctcatcacctcaggggccaaccctgagattttag

SEQ ID NO: 34872 - DNA, 2244 bp, Artificial Sequence
  Description of Artificial Sequence: Synthetic coding sequence
atggcagaagccgtggagcgcacagacgaacttgtccgtgaatacctgcttttccgaggtttcacgcatacacttcgtcagctcgacgctgagatcaaggccgacaaagagaaaggattccgggttgacaaaatcgtggaccagttgcagcagttgatgcaggtatacgatttagcagctctacgggactattggtcatatctggaacgcagactgtttagtcgcctcgaggacatttatcgtccaaccatccacaaattaaagactagtctgttccgcttctatttggtgtacactatacagactaatcggaatgataaagcccaggaattcttcgctaaacaggccaccgagttgcaaaaccaggccgagtggaaagactggttcgtgctgcccttccttccatcccccgacaccaatcctacatttgccacttacttctctcgccagtgggcagacaccttcatcgtgagcctgcacaatttcctgagcgtcctttttcagtgtatgcctgttccagtcattctgaatttcgacgccgagtgtcagagaacaaatcaagtgcaggaggaaaatgaggtgctgaggcaaaagctcttcgcgctgcaagctgaaattcaccggctcaagaaagaggagcagcaaccagaggaggaagaggccctagtccagcacaaactacctccctatgtatccaatatggacaggctgggcgactctgagctggcgatggtttgttcacaaaggaatgctagtctgtcgcagtccccgcgggtcggctttctgagttcactcctgccgcagtctaagaaatctccctcgcggctgtcccccgctcagggacccccgcaaccacaatcctcagccaaaaaggaatccttcgggggtcaaggaactaaaggcaaggaccccacgtccggagccaaagacggcaagagccttctttccggtttggccactggcgaatctggatggtcccaacaccggcagcgtcggttacaggaccatgggaaggagagaaaggagctattttccacaaccacttcacaatgtgccgaaaagaaacctgaagcgagcgggcccgaggctgagccttgtccagaactccatacggagccagtcgagccgcttactcgagcatcatccgctgggcccgaggggggtggcgtgcgtccggagcaacccttcatcgtcctggggcaagaagaatacggcgaacatcattcctccatcatgcactgtagggtcgactgctccggaaggcgagtggcctccctggatgtcgatggtgtgatcaaagtctggtccttcaaccctattatgcagacaaaagcgtccagcatctctaaatctccccttctctccctagaatgggccaccaagagagatagactcttgcttctgggctccggtgtaggcacggtgcggctttatgacacggaagctaaaaaaaatctttgcgagatcaacattaatgacaatatgccaagaattctgtcccttgcgtgttcgccgaacggtgcgagttttgtgtgctctgcggccgctccatctcttacaagtcaggtcgacttttctgcacccgacataggctcaaagggaatgaatcaagtcccagggaggctactgttatgggatacgaaaacgatgaagcagcagctgcagttcagtctagacccagaacccattgccattaattgcacggcttttaaccacaacgggaacctcttggtgacaggcgctgcggatggcgtgattcgtctgttcgacatgcaacaacacgaatgtgccatgtcatggcgtgcacattatggtgaggtgtattctgtggaattctcctatgatgagaacacagtttattctatcggcgaagacggcaagtttatccaatggaacattcataagtccgggctaaaagtgtctgagtattcccttcctagcgacgcgaccggtccatttgtgttatccgggtactccggctataagcaggttcaggtgccccggggccggttattcgcctttgacagcgagggcaactatatgttgacgtgctcagctaccggaggggtcatctacaaactaggaggagacgagaaggtgttagagtcttgtctgagcctaggcggccatagggcccctgtagttacggtggactggtctaccgcaatggattgcggcacctgtctgacagcatccatggatgggaaaattaagctgactacattgctggctcataaggcttag

SEQ ID NO: 34873 - DNA, 2613 bp, Artificial Sequence
  Description of Artificial Sequence: Synthetic coding sequence
atggctactaatataccatgtgaggtcgtggcctttagcgacagaaaactaaagcctctgatctacgtgtactcgtttcctgggctgacccgacggaccaaactaaagggtaacatcctactggactacacactcctgtctttctcttactgtggcacttacctggcctcctacagtagtctgcccgaatttgagctggcactctggaattgggagtcgtctatcatactgtgtaagaagtcccaacctggaatggatgtaaatcagatgagcttcaatccaatgaattggcgccagctttgtttaagttctccttctaccgtgagtgtttggactatcgagcggagcaaccaagagcattgcttcagggcgcgtagcgtgaaactccctctggaagatgggtcctttttcaatgagactgacgtcgttttcccacagtctctccctaaggatctgatttatggacccgtgctgcctctatctgccattgccggcctggtcggaaaagaggctgagacctttagaccgaaggacgacttgtacccactcttgcaccccacaatgcattgttggactcccacatctgatctatatatcggttgcgaagagggacacctactgatgattaacggagataccctgcaggtaactgtgctcaacaagattgaggaagagtctcccttagaggataggcgaaattttatatctcccgtgacgctggtctatcaaaaggaaggcgtcctcgccagcgggattgatggttttgtgtacagtttcattatcaaagacaggtcttatatgatcgaggacttccttgagatcgagcgccccgtcgaacacatgacattttccccaaactatacagtactcctaatccaaactgacaaggggtccgtgtatatctacaccttcggtaaggaacctaccctgaataaagtcctcgatgcatgtgatggaaaattccaggctatagactttatcacccccggaacacagtatttcatgacactcacctattcaggcgagatttgcgtttggtggctggaggactgcgcatgtgtctctaaaatatacttgaacactctagctacggtcctcgcctgttgcccaagctccctgagtgcggcagtggggaccgaggacggatctgtgtattttatttcagtttatgacaaagaatctccccaagtggttcataaggccttccttagcgaatccagtgtgcaacacgtcgtatatgaccaacaaggaattttcctcctggtgggcacagccgaaggaaaggtgttcattatcaatgctaatagtagttctagcttccagatcattgggttcacagaggtggctaaagacatcctgcagatctctactgtgagcctcctggaaacagacatcgtcgaggtgatggtgctcagctctctaccggaagcaggacggagtcgcttagagatgttcacgttgcctacgctcctaccacaggtgtccacaacttttgcggacgaacgaggacgccttaaagacgagataattcataagtatctgtacgagctggagcatgccctgtcctctgcagtcctcggattccagagtaaccagatttatggattttgcagtcaggttccttacatatgctcctatctgctcccggaggaggaacataccggaatttacatactgaaaccgtataagaaagtgcagtcccgccagtatggcccgggcctcctctatctgagctcccacgggttgtggttaataaccatagcgaagtgtgggattctttgcatcagagatgtgtataccctcgagacatttgcatggtgccgcagccactcccatcagggccacggcatccagtccatgaggatcagtatggacggacagaatattctggtgaatggacgggatgatggaaccctggtgtacttgaaatggaaacgcttcggtggccacttggccagcgaaattctagattactaccaaaaattgctgatctctctgagctctgctatggacaaagagaatcattatctgagtactacacccaaagtgtctgtagatctcggctcagattctgagcatactaaacagaaggctagcacagatctgagtcaagatgagctggttttgacggacgtgaaaaaggaaattccatggatacaacaaaagagccaagaggccattaagaaagaggtcaatcttttttccaaaaagaggaaagagatcaaacagggaatcaaatctctgtctaagactatactgaatatgatggaggagaacgataagctggagaatatcgccaagctcgatcagcaagaatttggcctcgatctcgaagagctggagagattgcatgatgaatcccaagaggaagttgcgaagatgatcaaggacgtagagatgcataacctcgccaagagttacctcgccgagctcattaaagaagagtgttggaatagcatggccgtcaaggggcgagccctgaaatgctttcacattccatgcgtggtcgaaaacttcccaatgaaagcccggacagttgaagagctgaaggagctcgagagggtgctgcagcaaaaaaagatcgaagccgagtgccttaaggtacttttctag

SEQ ID NO: 34874 - DNA, 4998 bp, Artificial Sequence
  Description of Artificial Sequence: Synthetic coding sequence
atggcgcaaggaagggagcgcgacgagggcccacactctgctgggggcgctagtctgtctgtccggtgggtccaggggtttccgaagcagaatgtacacttcgtaaatgacaatacgatctgttacccttgcggaaattatgtgatctttataaacattgaaaccaagaagaaaactgtcctgcagtgctctaatgggatcgtgggggtaatggcgacaaatatcccttgtgaggtcgtggcgttcagcgaccggaagctcaaacccttgatatacgtctatagctttcctggactgacgcgcaggactaaactcaagggcaacattctgctggactataccttgctgagcttctcttactgtgggacctatttggcatcttactcatctctgcccgaattcgaacttgccctgtggaattgggagtcgagcatcatcctttgcaagaagtctcaacctgggatggatgtgaatcaaatgtctttcaaccccatgaactggcgccagctctgcctatctagcccttcaacagtgtcagtatggaccattgaacgcagcaaccaggaacactgctttagggcaaggtccgtcaagttgccactggaagatggctctttctttaacgaaactgatgttgttttcccccagtctctacccaaagacttgatttacggcccagtgctgccgttatcggctattgccgggctcgtaggcaaagaagctgaaacgttccgccccaaggatgatctgtacccactgctgcatccaacaatgcactgctggacccccaccagcgacttgtatatcggctgcgaagaaggtcaccttctcatgattaacggtgacacactgcaggtgactgtcctgaataagatcgaagaagaatctccactggatagacgcaactttatcagtccagtgaccctcgtttatcaaaaagaaggtgtgctcgctagcggaattgatgggtttgtctactcattcatcatcaaggatcgtagctacatgatcgaagatttcctcgaaatcgagaggcctgtagaacacatgacgtttagtcccaactacacagtcctcctaattcagacagataagggcagcgtgtatatatacacatttgggaaggaacctaccctcaataaggtcttagacgcttgcgacggaaagtttcaggccatcgactttataacaccaggcacacagtacttcatgactctgacctatagcggtgaaatatgcgtttggtggctggaggactgcgcctgcgtctctaaaatttatctgaatacgttggctacagttctggcctgttgcccttcaagcctaagcgccgctgttggaactgaggatggatcggtgtacttcatcagcgtgtatgacaaagagtctccacaggtggtgcacaaagcgttcctgagcgaatcatcagtgcagcacgttgtctatgaccagcaagggatttttctgctggtgggaacggcggagggcaaggttttcatcatcaacgctaatagcagttcctctttccagatcatcggtttcaccgaagttgctaaggacattctccaaatttccacagttagccttctggaaacagacattgtggaggtgatggtacttagcagcctccctgaggccggacgcagccgcctcgagatgtttactctaccaaccctgctgccacaggttagtacgacctttgccgatgagcggggtagacttaaagatgaaatcattcacaagtatttgtacgagctggaacatgcactcagctcggccgtactcggcttccaatcgaaccagatctacgggttctgttctcaggtgccttacatctgcagttatctcttgcccgaagaggagcacacaggaatctacatattaaagccctacaaaaaagtccagagcaggcaatacggcccaggattgctgtacctcagctcacatggactctggctcataaccatagccaagtgtggcatattgtgcattagggacgtgtataccctggagacctttgcctggtgtagaagtcattcacaccagggccatggcattcagagcatgagaatctctatggatggccagaacatcctcgtgaacggcagggacgacggcacgctggtctatctgaagtggaagagatttggcggacatctagccagtgagatcttagattactaccaaaagctgcttatcagcctgtcttcagcgatggataaagagaaccactacctgtcaaccactcccaaggtttcagtggacttgggttcagactctgagcacactaaacagaaggcaagtaccgatttaagtcaggatgaacttgtgctcacggatgtaaaaaaagaaatcccttggatccaacagaaatcccaagaagccatcaaaaaggaagtaaacctgttttccaaaaagcggaaggagattaagcagggtattaagagccttagcaaaactattctcaatatgatggaagagaacgataagctggagaatatcgctaaactggaccagcaagagtttgggcttgacctggaggagttagagcggcttcatgatgagagtcaagaggaggtggccaagatgataaaggacgtcgagatgcacaatcttgctaaatcctatctggccgagcttatcaaggaggagtgttggaattcaatggctgtgaaaggcagagccctgaagtgctttcatattccctgcgtagttgagaatttccctatgaaggctaggaccgtagaggagcttaaagagctcgaaagggtgttacagcagaaaaagattgaagccgagtgcttgaagctgagaaaagagatcgtcgaggcccagtctggcgttaagttgataaaacagagacatgaggaggacgatgaggaggaggaagaagaggataaaacagtgaaatatagcaacctccctaattacctgctcggttccctgagcacagatttcggcgtcgatacgtctctcttgagtagtcagttagagctgcacagtcgagaagagaagattaaccagatcattctcttaaaggatatcatttataaggtgaaaactgtgttcaataacgagtttgacgccgcatacaagcagaaggagtttgagattgcgagagtcaaggagcgtaacgtgcggatccgagagattattctggacctggagctggaagaggccgtctggcaacccgagtttgaagattgcgagaagccagaaaggaccctagtggtgcaagatgaggagatcacagcccataagcacatcaaaccttggcacaaagccaaggagctgatcgttaaccatgagaaggagcattggttgctgatacaggatgccagcacacgtctgcgggccttaatggacatgatgggtggggtcttagaggtaaagaaggaagatatccttagaatggtgataccccagcctgctttcatggccaagcctgacgcggtctggacagaggaagaacgaaaacagtttaaggattacgaaaaaaaagtcaaagaacttaatgaagaaagagacaaatatcgcaaatcgctcgaagccgagttaaagaaacttcagaactccattcaagagtcaacacaggcattcgacgagcacctgaaacgcctctttgagagacgagtgaaggctgaaatggtaaccaaccaggaggaactgaaaatcagcaacctagccttcagcctcttgctggatgaagaattatcttcgcgggaaaagttccttaacaactaccttacccgcaaacagcacgaaaagtcccagacttcagaggctgtgagaaagtcccgagaagatctggatgtgtgcaaagaacactacgacaacctgctcgctgaagacaaggtgatggacagaagcttcaaaaaggaattctctgagatcccgggtcaccaggtcgatatcctttacaagctgttcaaacgccggccccgcatctccaagcagaaaacccacagcgaaactacatcggtcgtcccattcggcgagttgccaggctctgggaagttaaacaaggacgcatttgcgcagctgatgaaagccatggatgaacttgataatatatccaatatgccagaaggtctggatcccctggtatggaatcatttttgcatgacgcgtcgcgccaaggttgagaacgagcagaaagtgaagcaaaaggctgcagaccttctggagatggccactttcttacagaaacgggtagaagaggaagagaaagtccagcaggaaattgagcgagtgtttcacgagctgatcctgctgcaggaggaaaaagtccggtttcagcttaatctgactattcaaattcttctgaaacagggccaagtcgagttggaaaatttccagctggtcctggagtactcagacgcaatcttgattaacaagaacataatcgaggacctgaactccgtgatccggacgcaaggtcagaagaaggtagcttcaatgatggagtcaaaggatgttcacaagcgcatactccagatagagtgggaacacaagaagatggaaatggagcgtgaagacctgaatcaaaaagcatgggatattcagatgctgttctttagcagagatagacaaaaatacttgaacgagccgaattacgaggctttaatatctatacagattggtattatggagcaaacgatagccgtgctggacaagatgcacaaaaagaacgttgagaactgcaagaagttgcttaagaaacttggtaaattcagtaaccagaaagatattgcaaattacgcactttcttgtaacctgcgtgaggagctcgtagccgtcagcgaaagaaaagatatctgtaacgccatgggctcgaagcttacgtgcgaaaaaatcgtgaaggaacggtacgaaaatatgatgcagcaacagaaactgaccaacatttccaaacagcaagctgagcagatcagcattctgcagactgaggtggaacggctcagaatgaaaactttccctgccttagtccagatgtag

SEQ ID NO: 34875 - DNA, 912 bp, Artificial Sequence
  Description of Artificial Sequence: Synthetic coding sequence
atggcaaccaacatcccctgcgaggtggtggcctttagcgatagaaagctcaagcctctgatatatgtgtatagcttccctggcctcacccgccgcactaagctgaagggcaacattctccttgattacaccctcctgtcctttagttactgtggaacttacctggcgtcctactcaagtctgccggaatttgaacttgcactgtggaattgggagtcatcaatcatcctgtgcaaaaaaagccagccgggaatggacgtgaatcagatgagttttaatcctatgaactggcgtcagctgtgcctctcctcaccatctaccgtatcggtctggacaattgagcggagcaaccaagaacactgttttcgcgcacgctccgttaagcttcctctggaggacggctccttctttaacgaaacagacgtcgtcttcccacagtctctgcctaaagacctgatttatggccctgtgttacctctctccgctattgccgggctggtcggaaaggaagctgagaccttccggcccaaggatgacctatatccactgttacacccgaccatgcactgctggactcccaccagtgatctgtacataggatgtgaagaggggcaccttcttatgattaatggcgatactttgcaggtaacggtgttaaataagatagaggaagagtctcccctggaggaccgaaggaattttatctcacccgtcacactagtgtaccagaaggagggagttctggcctctggcattgatggcttcgtttatagctttatcatcaaagaccgttcatacatgattgaggactttttagagattgagcgccctgtcgagcacatgacgtttagccctaactatacagttctattaatacagactgataaagtgtgttggatggtgatttcttag

SEQ ID NO: 34876 - DNA, 1239 bp, Artificial Sequence
  Description of Artificial Sequence: Synthetic coding sequence
atggccactaatatcccttgcgaggtcgtagcgttctccgatagaaagctgaagcctctcatctatgtgtactccttccctgggcttacccgacggaccaaactgaaagggaatatccttttggactacaccctgctctccttttcttactgcggcacatacctggccagttacagttcccttcccgagttcgagctggcactgtggaattgggaatcatctatcatactttgcaaaaaaagccagcctggtatggacgtgaaccagatgtcattcaatcctatgaactggcgacagctgtgccttagtagccctagtaccgtgtcagtctggacaattgagagaagcaaccaggaacactgctttagggctcgatccgtgaaacttccactggaagatggcagctttttcaacgagacagatgtggttttccctcaaagtctcccaaaggacctgatctacggccccgtcctgccactttccgcaatagccggcttagtggggaaggaggctgagacttttagacccaaagatgatctgtatccactgctccaccctaccatgcactgctggacaccaacttctgacctttacattggctgtgaggaaggccatctcctgatgatcaatggcgacacgcttcaagtcaccgttctgaataaaattgaagaagagtccccccttgaagacaggagaaattttatttcacccgttaccctggtgtaccagaaggagggagtgctcgcaagtgggatcgatggcttcgtctacagcttcatcatcaaagatcgctcatacatgatcgaggacttcctggagatcgaacggcccgtagaacatatgacctttagtcccaactacactgtgctgttgattcaaacagataaggggagcgtgtatatctatactttcgggaaggaacctactttgaataaggtcctggacgcctgcgacggtaagttccaggccattgacttcataacccccggcacacagtattttatgactctgacgtactctggagagatttgcgtttggtggttggaggactgtgcttgcgtaagcaaaatatatctcaacacactagccacagtgctcgcctgctgcccatcttctttgagcgccgccgtggggaccgaggatggctctgtatactttatcagtgtatacgacaaggaatccccacaggtggtgcacaaggctttcctctccgaatcatcagtgcagcacgtcgtgtag

SEQ ID NO: 34877 - DNA, 4914 bp, Artificial Sequence
  Description of Artificial Sequence: Synthetic coding sequence
atggcccaagggcgcgagagggatgagggaccacatagtgccggcggggcctccctctctgtgcgatgggtgcaggggttcccaaagcaaaatgtgcactttgttaacgacaatacaatttgctatccgtgtggcaactatgtgattttcattaacatcgagacaaagaagaaaaccgtcctgcagtgtagtaatggaattgttggggtaatggctactaatatcccctgcgaagtagtagcctttagtgatcggaagctcaaaccactgatctacgtgtattcctttccaggtttaacacgacgcacaaagctgaaaggaaacattctgctggattatacgctgctgtctttctcctattgcgggacatacctagcctcgtattctagtctacctgagttcgagcttgctttgtggaactgggaatcgagcatcatcctttgtaagaagagccaacctggcatggacgtgaaccagatgtcgtttaacccaatgaattggcgccaattgtgtctgagctctccgtctaccgtaagtgtttggacaattgaacggagcaaccaggagcactgttttagggccaggtccgtcaaactgccacttgaggacggaagctttttcaacgaaacggacgtcgtgtttccccagagtctgcccaaagatttaatctacgggccggtccttccactgagcgctatcgcagggctggtgggaaaggaggccgaaaccttccgacccaaggacgatctgtatccacttttgcaccccacgatgcactgttggacccctacctccgacctctatataggctgcgaggaggggcatctgcttatgatcaatggagataccttacaagttaccgtcttgaataagatagaggaggagagtccgttggaggatcggcggaacttcataagcccagtgaccctggtgtaccagaaagaaggcgtgctcgcatctggaatcgacggttttgtctattcattcatcattaaggataggagctacatgatagaggatttcctggagattgagagaccggtggagcatatgactttttcccccaattatactgtcctgttaattcagactgacaagggctctgtgtatatttacacatttgggaaagagcccactttaaacaaggtgttggacgcttgtgatggcaaattccaggcaattgattttattacacccggtacacagtacttcatgacactcacctactccggcgagatctgcgtgtggtggttagaggactgtgcttgcgtgagcaaaatctacttgaacactctcgcgaccgtgctcgcctgttgccccagttcactgagcgctgcagtgggaacagaggatggtagcgtgtacttcatcagcgtgtacgataaagaaagcccccaggtggttcataaggcttttctgtccgaaagcagcgtgcaacatgtagtgtatgaccagcaggggatcttcctgctcgttggaaccgccgaaggaaaggtcttcatcatcaatgctaattcttcttccagttttcaaatcatagggttcacggaagtcgccaaagatatcttacagatctcaacagtgtctctcctggaaaccgacatcgtggaggtgatggtgttaagtagcctacccgaagcaggccgctcaagacttgagatgtttaccctcccaacactgctcccgcaggtgtctactacctttgccgacgaacgcggacgccttaaggatgaaattattcacaaatatctttacgagcttgagcacgccctctctagcgctgtgctgggatttcaatccaaccaaatttacggcttttgtagccaagtaccttacatctgtagctatcttcttcctgaagaggagcataccggtatctatattctaaagccttacaagaaggtgcaaagcagacaatacgggccagggctcctgtacctttcaagccatggcctgtggctcataacaatcgccaaatgcggcattctttgcataagggacgtgtataccctggaaaccttcgcttggtgtaggtcacatagccaccagggccatgggatccaatccatgagaatttctatggacggtcaaaatattttggtgaatggtcgcgacgatggaacactcgtctacctcaaatggaagcgttttggggggcatctggcctccgaaatcctggattactatcaaaagctactcatctcattgtcgagcgccatggataaagaaaatcactatctctccaccactccgaaagttagcgtagacctgggcagtgactcagagcatacaaagcagaaggccagcaccgatctttctcaagatgagctggtgttgactgacgtgaaaaaggaaattccctggatacaacagaagagccaggaagccatcaaaaaagaggttaatctattctcaaaaaagaggaaggagatcaaacaggggatcaaaagtctgagcaagaccattctgaatatgatggaagaaaacgataagctggaaaacatcgccaaattggaccaacaagaatttggcctcgatctagaggaactggagcgcctccatgatgaaagtcaagaggaggtcgctaagatgatcaaagacgtcgagatgcataatctggcgaaaagctacctggccgaactcataaaagaagaatgctggaattccatggcggtcaaaggacgcgccctcaagtgtttccatatcccttgcgtagtggagaactttcctatgaaggcccgcaccgtcgaagagctcaaagaacttgaacgagttctacagcaaaaaaagattgaagctgagtgcctgaagttgaggaaggagattgtggaagcacagagcggtgttaaactaattaagcaacgtcacgaggaggatgacgaagaggaggaggaagaagacaagacggtgaaatatagtaacctgcctaactatctcctgggttcgctgtccaccgacttcggggtcgacaccagtctgttatcgtcccagttggagctgcacagcagggaagaaaagatcaatcagatcatcttgctgaaggacataatctacaaggtaaaaacggtattcaacaacgagtttgatgccgcttacaaacagaaagagttcgaaattgcccgcgtaaaggagaggaacgtgagaatccgcgaaattattctcgaccttgagctcgaggaagctgtgtggcagcccgaattcgaggactgtgagaaacccgaaagaactctcgttgtgcaggacgaagagatcactgcccataaacacattaagccctggcataaagctaaggaattaatcgtcaaccatgagaaagagcattggctccttatccaagatgctagcacacggttgcgtgcactgatggacatgatgggcggtgtgctggaggtgaagaaagaagacattctgaggatggtgattccgcagcccgcatttatggctaagcctgatgcagtatggaccgaagaggagcgcaagcagttcaaagactacgaaaaaaaggtgaaagagcttaatgaggagcgggacaagtaccggaagtctcttgaggcagagcttaaaaaactacagaactcaattcaggaatccacacaagcattcgacgagcatctgaagcgcctcttcgagagaagagtaaaggcagaaatggtgaccaatcaggaggagttgaagatcagcaatttggctttctctctgctgctggatgaggaactgtcttcacgggagaagtttctgaacaactacctgacgaggaaacagcacgaaaaagtcatggaccgctcctttaaaaaggagttcagcgagatcccgggccaccaggttgacattttgtataaactgtttaagagaaggccaagaatctcaaaacagaagacccactcggaaacaactagtgtggtccccttcggcgagttgccgggtagcgggaagttgaacaaagacgcgttcgcacagcttatgaaggcgatggatgagctcgacaacattagcaacatgcccgaaggccttgatccccttgtctggaaccatttctgcatgacacggcgcgccaaagttgaaaacgagcaaaaagtgaaacagaaggctgccgacctcctcgagatggcaaccttcctgcagaaaagggtggaggaagaggagaaggtccagcaggagattgaaagggtatttcacgagctaattctgctgcaggaagagaaggtgcgatttcagctcaacttgaccatccagatactcctgaagcagggacaggtggaacttgagaattttcagctggtgttggagtactcagatgcgattcttatcaacaaaaacatcattgaagatctgaactcagtgattcggactcagggacagaagaaagtggcgagcatgatggagtccaaggacgtgcataagcggattctgcagatcgaatgggaacacaagaaaatggaaatggaacgcgaagatctgaatcaaaaggcttgggacatccagatgctttttttcagccgagaccggcagaaatacctgaatgagcccaactacgaggccctgatctccatccaaataggcatcatggagcagacaatagcagttctggacaaaatgcacaagaagaacgtcgagaattgtaagaaactgctaaagaagctgggaaagttttcaaaccagaaggatatagctaactacgcactctcttgcaatctacgggaagagctggttgccgtcagcgaacgtaaagatatctgtaacgctatgggaagtaaattaacatgtgagaagatagtcaaggagagatatgaaaacatgatgcaacagcagaaactgacgaatattagcaaacagcaagccgagcagatttcaattctccagacggaagtggaaagactgaggatgaagaccttccctgctctcgtgcaaatgtag

SEQ ID NO: 34878 - DNA, 2994 bp, Artificial Sequence
  Description of Artificial Sequence: Synthetic coding sequence
tgacctggcctactttacctgtcttcccacggcttgtggctgatcactatagcaaagtgcggcattctttgtatcagagacgtctacactctggaaacttttgcatggtgtcgcagtcattcacatcagggtcacggaatccaatccatgcggatttctatggatgggcagaacattttagttaatggaagggacgacggcacactggtgtatctgaaatggaagcgtttcgggggccaccttgccagtgagatcctcgactactatcagaagttgcttatttcgctctcttccgcaatggacaaagagaatcattaccttagcaccacacctaaggtatccgttgacctgggctccgattctgaacataccaagcagaaagcctcgacagatctttcacaggatgagctggtgctgacggatgtgaagaaggagatcccgtggatacagcagaagagccaggaggcaataaagaaagaggttaacctgttttccaaaaaacggaaggaaatcaagcaaggcataaagtctttgagtaagaccatactgaatatgatggaagagaacgacaagctcgaaaacatagccaagctggatcagcaagaattcgggctcgatctcgaagagctcgaaaggctgcacgacgagtctcaggaggaggtggcaaaaatgattaaagacgtggagatgcataacctcgccaaatcttacctggccgagcttatcaaggaagagtgttggaactcaatggctgtgaagggccgggctctgaagtgctttcacatcccttgcgtggtggagaacttccctatgaaagctaggaccgtggaggaactgaaggaactcgaacgcgtgctccagcagaaaaagattgaggcggagtgcctgaagcttcgcaaagagatagtggaagcgcagagtggcgtaaagctaataaagcaaaggcatgaagaagatgatgaagaagaggaggaggaggacaaaacggtgaagtacagcaacctgccaaattatttactcggatcgctgagcacggatttcggggtcgacaccagcctcctatctagtcagcttgaactgcactctagggaggaaaagataaaccagatcattctccttaaggatattatctacaaagtgaagacggtcttcaacaatgagtttgatgctgcttataagcagaaggagttcgagatagctcgggtgaaggaaagaaacgtaaggattagggaaattattctcgaccttgagctggaggaagccgtttggcagccagaatttgaagactgtgaaaagcccgagaggacattggttgtccaggacgaggaaattacggctcataaacatattaaaccctggcacaaagcaaaggaactgatagtgaatcacgaaaaagaacattggctccttatccaggacgcttcaacgaggctgcgcgctctcatggacatgatgggcggagtgctggaagtaaagaaggaagatattctccggatggtcattcctcagccagccttcatggccaagcccgacgcagtttggacagaagaagaacgcaaacagttcaaggactatgagaagaaagtgaaggagctgaatgaggagagggataagtatagaaagtcgctggaagctgagcttaagaagctgcagaacagtatccaggagtccacacaggcattcgacgaacacctcaagcgtttgttcgaacggcgggtaaaggccgaaatggtaactaaccaagaggagttaaaaatttccaacctggccttctcactgctgttagacgaagaactcagctctcgggagaaatttctgaataactacctcaccaggaaacaacatgagaaagtgatggatcggagctttaaaaaggagttctctgaaatcccagggcatcaggtcgatattctgtataagctgttcaaaaggcggcctcgcatttccaaacagaagactcattcggagacaactagcgttgtgcctttcggggagctccctggatcaggcaagctgaacaaggatgcattcgctcaactcatgaaggctatggacgagctggacaatatctcaaatatgccagaggggctggaccctttagtctggaaccatttctgtatgaccagaagagcaaaggtggaaaatgaacaaaaagtcaagcagaaagctgccgatttgctggaaatggccactttcctacagaagcgcgtggaggaagaggagaaggtgcagcaagagatcgaaagggttttccatgagctgatcctcctgcaggaagagaaagttcgctttcagttaaatttgactattcagatcctgctaaagcaggggcaggtggaattggaaaatttccagctggtactggaatactcggacgccatattgatcaacaaaaacatcattgaagatcttaactctgtcattagaacccagggtcagaaaaaagtggctagcatgatggaaagtaaagacgttcacaagagaatcttgcaaattgaatgggaacataagaagatggagatggagagggaggatctcaaccagaaggcctgggacatccagatgctgttttttagccgtgatcgccagaaatatctgaacgaacctaattacgaagcactgatctccatccagatcgggatcatggagcagactatcgcagtccttgacaaaatgcataaaaaaaatgtggaaaattgtaaaaaactgctaaagaaactggggaaattttccaaccaaaaggacatagctaactatgctctgtcttgcaacctgcgggaagagctcgtggccgtgtctgagaggaaggacatctgtaatgcaatgggttcaaaactgacatgtgaaaagatcgtgaaagaacgctacgaaaacatgatgcagcagcaaaaattgactaacatctccaagcaacaggccgaacagatttcgatccttcagacagaagttgagagactgagaatgaaaacattccctgcactggttcagatgtag

SEQ ID NO: 34879 - DNA, 1545 bp, Artificial Sequence
  Description of Artificial Sequence: Synthetic coding sequence
taatggacagaggaagaacggaagcagtttaaagattacgaaaagaaggtgaaagagcttaacgaggagcgcgacaaatacagaaagtcactggaggccgaactgaagaagctccagaattctattcaggagagcacccaagcttttgatgagcacctgaagcggcttttcgagcgaagagtgaaagcagagatggtcacgaatcaagaggagcttaaaatttctaaccttgcctttagcctgcttctggatgaggaattgtctagtagggaaaagtttctcaataactacctcacccgcaagcagcacgaaaaaagtcagacgagtgaagcggttcggaagagccgggaggatctcgacgtatgcaaggaacactacgacaacttgctcgccgaggataaagtcatggatcgcagctttaaaaaggagttttcagaaatcccaggtcatcaggtcgacatcttatataagttgtttaagcgacgcccgcgtatcagcaagcaaaagacacacagtgagacaacgagtgtggttcctttcggcgaactgcctgggagcggcaaactgaacaaagacgcgttcgcccagttaatgaaagctatggatgagctggacaacatctcaaatatgccagaaggattggacccactggtatggaaccacttctgtatgacgagacgcgccaaggttgaaaacgaacaaaaagtgaaacagaaagcggccgacctcttagagatggcaacctttctccagaagagggtggaggaggaggagaaagtgcagcaggagatcgagagagtgttccatgagctgatcctgcttcaggaggagaaggttaggttccagctcaatcttacaatccagattcttctgaagcaaggtcaggtggagctcgagaacttccaactggtactcgaatactctgacgcaattctgataaataagaacataatcgaagacctgaattcagtcattcgcacacagggccagaaaaaagtcgcgagtatgatggagagcaaagacgtgcataaacggatcctgcagatcgagtgggagcacaagaaaatggagatggaaagagaagaccttaaccaaaaggcatgggatattcagatgctatttttctcccgggatcgccagaagtacttaaatgaaccgaattatgaagccctcataagcattcagattggcatcatggagcaaacaatcgcggtcttggacaagatgcataagaagaacgtggaaaattgcaaaaagctgcttaagaaactcggaaaattctctaatcagaaagacatcgccaactatgcccttagctgtaacctgagagaggaattggttgccgtatcagagcgtaaggacatatgtaatgccatgggcagtaaattgacatgtgagaaaatcgtcaaggagagatacgagaatatgatgcagcaacagaaactcacgaatatcagcaaacagcaagcagaacaaatctctattttgcaaaccgaggttgagaggttgcgaatgaagactttccccgctctcgttcaaatgtag

SEQ ID NO: 34880 - DNA, 1965 bp, Artificial Sequence
  Description of Artificial Sequence: Synthetic coding sequence
atggccccactcgtgccagggccgcccctagaggcctctcctaccactctggacgctgcagtgcggtggggactccagcggccggttcgtgggcatatggcgccaggacaggccggaggtcggggggacgccagtgccttgggtgcccagtatagttgggcccgggacggacggagtgccgtcggatctaaactaagttgggtgggtcccgctgctcccgagtccaaagctgcacaggggagggagatgggccgggatgtgggaaaggccgtggattgtctagacctgtccggccctgatggcgctagttgcctgcagctcagtctgcggaaatccgaattattcccggccgcacgccggccggggaggcctgcggaccccggattatcacccaggtgtttgcggcgcccaccccttaggccgggtccggcctcaacaccactgcgaggcccaggcgccgcccgaccaccccctctgcccccgcattccagaggcagaagcgccgtgtccttcctcgcgttcctacccccacagaggtccccatctgctcctcgcgaagccgcagggtctcgggggggactgcgggctagcggtggtcgatgcggaggccctgctggagccgccgccgggtccggcggcggcggagacgcacccggcccggccggccgggcaatgcagcgttcccgggctggggcggacgaagctgcactcctcctcgccggattggccctgcgcgagctcgaacctggatgcggatccccgggcaggggacggcgagggccacgtccaggtccgggcgacgaggcagcccctgccctagggcgtaggggcaaaggctcaggcgggcccgaggctggggcggacggtctctcccgcggagagagggggccacggagggctgcggtccccgagctgagtgcccagcccgctggaagcccccgagcttccctggctgggagcgacggcggcggcgggggaggttcggccagatcgtctgggatcagtctgggatacgaccaaagacatggttcaccaaggagcgggaggtctgatcccaggcctggccctggcccgccatccgtcggctccgcgcgaagctcagtaagctcactgggctcccggggctcagctggggcttatgcagattttctaccaccgggcgcttgtccagctccagcccgaagcccagaaccggcaggtcctgcaccattccctcttcccgctctgccactgccaccaggcagggagggagggccctcagccgccgaacgccgcctcgaggcattaacccgcgagttggagcgggcactggaggctaggaccgcccgggattatttcggcatatgcataaagtgcggattgggtatctatggtgctcaacaggcttgccaggcaatgggatcactgtatcataccgactgcttcacgtgcgattcctgtggacggaggctacgcgggaaagccttctacaacgtgggcgagaaggtttattgccaggaagatttcctctatagcggctttcaacagactgctgataagtgtagcgtgtgtggacatctcataatggaaatgattctgcaggcactcggaaagagctatcaccccggctgcttcagatgtagtgtttgcaacgaatgcctcgatggtgtgccctttaccgtggatgtggaaaataatatatattgtgtacgcgactatcataccgtgttcgcaccaaagtgcgcaagctgtgcaagaccgatcctcccagcccagggctgcgagaccactatacgggttgtttccatggaccgtgattaccatgtggcatgctaccactgcgaggactgcggtctgcagctttcaggagaggagggacggcggtgctacccactggccgggcatttgctctgtcgtcgctgccacttgcgacgtctgcagcccggccccctgcccagccccaccgtgcacgtgacagagctgtag

SEQ ID NO: 34881 - DNA, 5403 bp, Artificial Sequence
  Description of Artificial Sequence: Synthetic coding sequence
atggcaacagactccggtgaccccgcctcaaccgaagattcggagaagccggatggcatctcctttgaaaaccgcgttccacaggtcgctgccacgctgacagtggaagctcggttgaaagaaaaaaattcaactttttctgcgtccggcgaaaccgtcgagcgaaaacggttcttccgaaagagcgtagagatgaccgaagatgataaggtggcggagtcatccccaaaggacgagcgcatcaaggctgcaatgaacatccctcgtgtggacaaactacctagcaacgttcttaggggggggcaggaggtgaaatatgaacagtgctcaaagagcactagcgaaatatccaaggattgttttaaagaaaagaacgagaaggaaatggaggaggaggccgagatgaaggctgtagcaacctccccttctggtcgattcctgaagttcgatattgagctaggtaggggagcctttaaaactgtctataagggcctcgacaccgagacttgggttgaggtggcgtggtgtgagctgcaggacagaaagctaacaaaggccgaacaacagaggttcaaagaggaggcggaaatgctgaagggactgcagcatcctaacattgtgcggttttacgattcatgggagtccattctcaaagggaaaaaatgcatagtcctggtgacagagctcatgacctctgggacacttaagacctacttaaagcgctttaaagtgatgaagcccaaggtgttgagaagctggtgtcgacagattctgaagggactgcagttcctacacacgaggactccaccaattattcacagagatctcaaatgcgataacatctttatcaccggcccaacagggagtgttaagataggggacctgggtctcgctacgctgatgagaacatcattcgccaaatcagtcattggcactcctgaatttatggctcccgagatgtatgaagagcattacgacgaatccgtcgacgtatatgcttttggaatgtgtatgttggagatggcgacaagcgagtacccatattccgagtgtcaaaacgctgcccagatctaccgcaaggtaacttctggtatcaaacccgcatctttcaataaggtgaccgaccccgaagttaaggaaattattgagggctgtatccggcaaaataagtccgaaagactgtccatcagggatctcctcaatcacgctttttttgccgaagatactggtttgcgggtggagttggcagaggaagacgattgttctaattcctcgctcgctctccgcctgtgggtcgaggaccccaaaaagctgaagggaaaacacaaagataacgaagcaatcgaattcagcttcaatctggaaaccgacacgcccgaagaagtggcttacgagatggtcaagagcggcttctttcatgaatctgattcaaaggccgtggcgaagtcaatccgcgatcgggtgacacccattaagaaaacacgtgagaagaaacccgccggatgtctcgaggagaggagagactcacagtgtaagtcaatgggaaatgtgttccctcagcctcagaataccacactgcctcttgcacctgcacagcagacaggagccgaatgtgaggaaaccgaggtcgaccaacacgtgcgtcaacagctactgcagcggaaaccccagcaacattgctcaagtgtaaccggcgacaatctctcagaggcaggagctgcttccgtcattcatagtgacacctcttcacagccctccgtggcttacagttccaaccagacaatgggctcccagatggtgagtaatattccacaggctgaggttaatgtgccaggccagatctatagttctcagcagctggttggtcactaccaacaggtctctggcctacagaaacacagcaaacttacgcagccccaaattctgcccctcgttcagggccagagtacagtgctgcccgtgcacgttctgggacccacagttgtatcgcagcctcaggtcagccccctcactgtgcagaaagtgccccagattaaaccagtttcacagccggtgggcgctgagcagcaggccgccctgttgaagccagatctggtgagatcacttaaccaggatgtggcgacaaccaaggaaaatgtctctagcccagataacccttccggcaacggaaagcaagacaggataaagcaaagacgggcctcctgccccaggcctgaaaagggcacaaaattccagctaaccgtgttacaggtgagtacttcaggcgataacatggtcgagtgccagctagagacacacaacaataaaatggttacgttcaagttcgatgtggacggcgatgctccagaagacatcgctgattacatggttgaggataacttcgtgctcgagagtgaaaaagagaaatttgtggaagagctaagggctatcgtcggccaagctcaggaaattctccacgtacactttgcgacagaaagggcgactggagttgactccatcaccgtcgattccaacagttcccagaccgggtcttcagaacaggtgcaaattaatagcaccagtacacagacctcaaatgaatctgcccctcagtcatcacccgtgggcaggtggaggttttgtattaatcagaccattagaaaccgcgagacccagtctcctccttcattgcagcatagcatgagcgcagtcccaggtcgccatccacttccgtcgcctaagaacacttctaacaaggagatctctagggataccctgctgaccatagagaataacccatgtcacagggctctttttaccagcaagtccgagcacaaagacgtggtggatggtaaaatttctgaatgcgcctccgtcgaaaccaaacagcctgcaattctgtatcaggtcgaggacaatcgacagattatggccccagtcacgaattctagttcttactcaaccactagcgtgcgagctgttcctgctgagtgtgagggactgaccaaacaggcttccatttttatccccgtctatccctgtcaccagacagcctctcaagcagacgcactgatgtcacatcctggggaatcaacacagacctcaggaaactcactcaccactctggcatttgatcagaaacctcagacactttctgtgcaacaacccgctatggacgccgaattcatttcacaagaaggggagaccacagtcaacacggaggcatcaagccccaaaaccgtaatccctactcaaaccccgggccttgagcctacgactcttcagcctaccactgtgcttgagagcgatggggaaaggcctcccaaactggagttcgcagacaataggataaagactctggacgaaaagctgaggaatttgctctaccaggagcacagtatttcatcgatataccccgaaagccaaaaagatacacagagtatcgatagccctttcagcagctctgctgaagacacgctttcatgtccagtcacggaagtgattgcgatctcacactgtgggattaaggattcccccgtgcaatcgcccaatttccaacagaccggctccaagctgctaagtaatgtggcggcaagccagccagctaatattagcgtgttcaagcgcgatttaaatgtaattacaagtgtgccaagtgagctgtgccttcatgaaatgtcatccgacgcgtccctcccaggtgatcctgaggcctatccagccgccgtgtcttccggaggtgctatacatctccagacggggggaggatatttcggcctgtcctttacatgtccaagcctgaagaaccccatctccaagaagagctggacacgcaaactgaagtcctgggcataccgcctcagacaatcgacgagttttttcaagcgatctaaagtacggcaggttgaaacggaagaaatgcgctctgccatcgcccccgaccctattcccctcactagagaatctacagcagataccagagcacttaacaggtgcaaggccatgtccgggagcttccagcgcgggaggttccaggtaattaccatcccacagcagcagtctgccaagatgactagcttcggcattgaacacatcagtgtgttctcagagaccaaccactcaagcgaagaagcattcatcaaaactgcaaagtcccagctggttgaaattgagccagctacacagaaccccaagacatctttttcatacgaaaagttacaggccctgcaggaaacttgcaaagagaacaaaggcgtcccgaaacaaggcgataactttctgtcattttctgctgcttgcgagactgacgtgagctcggtcaccccagagaaggaattcgaggagacttccgcaacagggagttcaatgcagagtggtagcgaactcctgctgaaggagagggagatcctgaccgccgggaaacagccctcttctgattctgagtttagcgcatctctcgctgggtcagggaagtccgtggcaaagacaggtcctgaatccaatcagtgcctgccccatcatgaggagcaggcttatgcccaaacccagtccagtctgttttactcccccagctcccccatgagtagcgatgatgaaagtgaaatcgaggatgaggatttgaaggtcgaactccagcggctccgcgagaagcacatccaggaggtcgtcaacctccagacccagcagaacaaagagctgcaagagctctatgagagacttagatccataaaagattccaagacccaatctaccgagatacccctcccacccgccagccccaggcgacccaggtcctttaagagcaaactcagatcccggccccagagcttaacgcacgtcgataacggaatcgtggcaactgggaagagctgcctgatcaacgagcttgagaatccattgtgcgtagaatctaatgccgcctcatgccaacagtccccggcatcgaagaagggtatgttcacagacgatctgcacaagttggttgacgactggactaaggaggccgttgggaactccctcatcaaaccatccctcaatcagcttaagcaatctcagcacaaactggagaccgaaaattggaacaaggtctccgagaacacccctagcaccatggggtacacttcaacgtggatttcaagcctcagtcagattcggggagccgtcccaaccagcctccctcaggggctttcactacctagctttccagggccccttagctcctacgggatgccacatgtctgccaatataacgcggtagccggcgcaggataccctgtacagtgggttggtatcagtgggactactcagcagagtgtagtgatcccagcccagtctggggggccgtttcaacccggcatgaacatgcaggcctttccgacctcttcagtgcaaaatcccgctacgatcccacccggccctaagtag

SEQ ID NO: 34882 - DNA, 1065 bp, Artificial Sequence
  Description of Artificial Sequence: Synthetic coding sequence
atgcagggacttctgttctctaccttattgcttgccggacttgcccagttctgctgccgagtccaggggactggcccgctggatactactcccgaaggacggccaggggaagtttccgatgctccacagcgtaaacaattctgccattggccatgcaaatgccctcaacaaaaacccagatgtccaccgggcgtgtcattagtgcgggacggctgcggttgttgtaagatctgcgctaagcagcccggggagatctgtaatgaggccgacctatgcgatccacataagggcctgtactgtgactacagtgtggaccgaccgcgctacgaaaccggagtttgtgcttacctggtggcggttgggtgcgaatttaaccaagtgcactaccataacgggcaggtatttcagcccaatccactcttcagctgcctgtgcgtatctggggctattggttgtactcccttatttatccccaagctagctgggtctcactgtagcggggccaagggaggcaagaagagcgaccaatcgaactgcagccttgaacctttgttgcagcagctgtccacatcatacaagacgatgcccgcttaccgaaacctgccattaatttggaaaaagaagtgtctcgtccaggccacgaaatggacaccttgttcaaggacctgcgggatggggatttccaatcgcgtgacaaatgagaactctaattgtgaaatgagaaaagagaaaagactgtgctacattcagccctgcgattcaaatatactcaagaccattaagattcctaagggcaaaacgtgccagcccaccttccagctgtctaaggctgagaagtttgtcttcagcgggtgctccagtacacagagctataagcctaccttctgcggaatttgcctagataagagatgttgtatccctaataagtcaaagatgatcactatccaatttgattgtcctaacgagggatcattcaagtggaagatgctgtggatcacgagctgcgtgtgccagcgcaactgtcgggagccaggcgacatcttttctgaattgaaaatcctctag

SEQ ID NO: 34883 - DNA, 2139 bp, Artificial Sequence
  Description of Artificial Sequence: Synthetic coding sequence
atgttgaaagactacttgagcgtcgcccaggacgcactgcgaacccagaaggagttgtatcacgtcaaggaacagagacttgcgttggcacttgacgagtacgtcaggctgaatgatgcttataaagagaagagcagctcccacacatctctgttttccgggagttcatctagtaccaaatacgacccagatatcctgaaagcggagattagcacaacgcggctgagagtaaagaagttaaagcgggagttgtcacaaatgaaacaagagttactgtataaggagcaaggcttcgaaaccctccagcaaatagacaagaagatgagtggaggacagtccggttacgaattatccgaagccaaggctatcttgacggagctgaagagcatccgcaaggctatttcctcaggtgaaaaggaaaagcaagacctcatgcagagcctggcaaagttgcaggaacggttccacctagaccaaaacatcggaaggtccgagccagacctgaggtgctcacctgtcaacagccacctatgcttatctaggcagactctcgacgcggggagccagactagcatcagtggagatattggggtgcgctctaggtcgaacctagcagaaaaagtgcgtctgagtctccagtatgaggaagccaagaggagcatggctaacctcaagattgaactatccaaactcgactcagaggcttggcccggagccttggacattgaaaaagagaagctcatgctcatcaatgagaaagaagagctgctcaaggagttgcagttcgtcacaccccaaaagcgcactcaagacgagctggaaagactcgaggctgagcgacagaggctggaagaggagcttctctctgtgcgcggcactccctctagggcactggctgagcggttgaggctggaagagcggcgcaaggagctgctgcagaagctcgaggaaacaacgaaacttacaacctacctccactcacagttaaaaagtctcagcgcatccaccctatccatgagcagtggatcctccctggggtcactagcatcctctagagggtcactgaatactagctctaggggctccctgaacagcctgtcgtcaactgaattgtattacagttcacaaagcgatcagatcgatgtggactaccagtacaagttggattttctgctacaggaaaagagcgggtacattccctccggccccatcactaccatccacgagaatgaggtggtcaagtcaccttcacagcccggacagtctggcttatgcggagtggctgccgcggccacaggtcatacacctcctctggcagaggcgccaaaatctgtggcctccctgtcttcacgtagttctttaagctctttatcacctccaggatctcccctggttctcgaaggtaccttccccatgtcctcctctcacgatgcaagtctgcatcaatttacagccgattttgaggactgtgaactgtcaagccatttcgccgatatcagtctgattgagaatcagatactgctggacagcgattctggcggagcgagtcagtcactgagtgaagataaggatttaaacgagtgcgccagagagcccctgtatgagggaacggcagatgtggagaagagtctgccaaaacgacgagttatccacctgctcggagagaaaacaacttgtgtgtcagccgcggtttcagatgagtcggtggccggtgacagtggagtttatgaggcctttgtgaagcagccctccgaaatggaagacgtcacttactcggaggaggatgtagctatcgttgagacggctcaggtccagatcggcttgaggtacaacgccaaatcctcatccttcatggtgatcattgctcagttgcgcaatttgcatgcattcctcattccccacacttcgaaagtctacttccgggttgcagtgctaccttcctctaccgacgtgagttgtctctttagaaccaaggttcatccccctactgagagtatcctgtttaacgatgtcttcagagtggcgatcagccaaaccgcattacagcagaaaactctgcggaaaaatttcacatttgttaccgcaatcacacacggcgtctgcctacctctgccggtccctatgccaagctttgcatag

SEQ ID NO: 34884 - DNA, 3579 bp, Artificial Sequence
  Description of Artificial Sequence: Synthetic coding sequence
atgccacggcgagcagggagcggtcagctgccactcccccgcggctgggaggaggctagggattacgatggcaaggtcttctacattgaccacaacacccggagaacgagctggatcgatcctagggaccgattgaccaagcccctgtccttcgctgattgtgtgggagacgaacttccctggggctgggaggctggatttgacccgcaaatcggtgtttactacatagatcatattaataaaaccacacagattgaagatccccgcaaacagtggagaggagagcaggagaaaatgctgaaagattacctcagcgtggcgcaagatgctttgcgcacccagaaggagctctaccacgtcaaggagcagcgcctcgccttggctcttgatgaatacgtgaggctaaacgacgcctacaaagagaagagttcctcacatacaagtctgtttagcggctcctcatcatccaccaagtacgatcccgatatcctcaaagctgaaatttccacaactaggctcagggttaaaaagttgaagagggaactcagccagatgaagcaggagctgctgtataaagaacagggctttgaaacactgcaacagatcgataagaagatgagcggagggcagtcagggtacgagttgagcgaagcgaaggccatcctgactgaactgaaatccattaggaaggcaatctcctctggagagaaagagaaacaggacctgatgcagagcttggccaaattgcaggaacggttccacctcgatcagaacatcggtcgctctgagcctgatctccggtgctctcccgtaaactctcatctgtgtcttagcaggcagaccttggatgccgggagccaaacatctatcagtggtgacattggcgtgcgcagccgcagcaacctcgctgagaaagtgagactgtctctgcagtatgaagaagcaaaacgtagtatggctaacctgaagattgagctgtctaagctggattccgaggcttggccgggagcactagatatcgagaaagaaaaacttatgctgattaatgaaaaagaggaattgttaaaggagctgcaatttgtcacaccacagaaaagaacacaggatgagcttgagcgcttggaggcggagcgacagcgcctggaggaagaacttttatccgtgcgcgggacacccagtcgagctctggccgaacggctgcgcctggaggaacggcggaaggaactactacagaagctcgaggagacgacaaagctcaccacctacctccacagtcagttgaagagtctatctgcaagcactctctccatgagctccggatcaagtctcgggtccctggctagttctagaggctccttgaacacgtccagcaggggaagtctgaacagcctgtcatcgactgaactgtactattctagccaatctgatcaaatcgacgtcgactaccagtataaattggactttctccttcaggaaaagtcagggtacatcccatccgggcccattactaccatccacgaaaacgaggttgtgaagtcgcctagccagcccggacagtctgggctgtgtggggtggccgccgcagcgaccgggcacactccaccactggccgaagcccccaagtcagtggcctccctgtcctcaagatcctcacttagctcccttagtcctcctggatcgccgctcgtattggaaggcacatttccgatgtcatcatcccacgacgctagccttcaccaatttaccgcagactttgaggactgtgaactgagttcacatttcgccgacataagcctcatcgaaaaccagatcttgctagactctgatagcggtggagcttcacagtccctctctgaggacaaggatctgaacgagtgcgcccgtgaaccactgtatgagggcactgcagatgtcgaaaaatctctgcccaagcgccgggtaattcatctgctgggggaaaaaactacatgcgtgtcagccgcagtttcagacgaatctgtggccggggacagcggggtctacgaagctttcgtgaaacaaccttcagagatggaggacgtgacgtattctgaagaagatgtggctatcgtcgaaactgcacaggtccaaatcgggctgaggtacaacgcgaaatcgtcgtctttcatggtcattatcgctcagctgaggaacctgcatgcattcttgataccccacacatctaaggtatattttagagtcgccgtactgccttccagtaccgatgtgtcctgtctctttcgaaccaaggtgcacccacccaccgaaagtatcctgttcaatgatgtgtttcgcgttgcgatctcacagactgcactgcagcagaagacgctgagagtggacctgtgctccgtgtcaaagcatcgccgggaggagtgccttgcaggtacccagatatcgctggccgacctgcctttcagctctgaggtcttcacgctgtggtataatctcctgccatcaaaacagatgccttgcaagaagaacgaggaaaacgaggactcagtgttccagcccaaccagccactggttgatagcattgacctcgacgctgtgagcgccctgttggccagaaccagtgccgagcttttggctgtcgagcaggaactggctcaggaggaagaagaagagtcgggacaagaagagccacggggcccagacggcgactggctgaccatgctccgtgaggctagtgatgaaattgtcgcagaaaaagaagccgaagtcaaactgcctgaagattcgtcgtgcacagaggacctgagttcttgtacctccgtgccagagatgaacgaagacggtaaccgcaaagaaagcaattgcgctaaggatctgcggtctcaaccacccacccgaatccctaccctggtcgacaaagaaacaaacacagacgaggctgccaacgacaacatggctgtaagaccaaaggagcggtcttcccttagctctcggcagcatccttttgtgcgatctagcgttattgtacggagccaaaccttttcaccgggagagcgcaaccagtatatctgccgcctgaatagatcagactccgacagcagcaccctcgcgaaaaaatctctatttgttaggaatagcacagagcgtagatccttgcgcgtaaaacggactgtgtgtcagtctgtattgcgacgtaccacccaagagtgtccagtgagaactagcttggacctcgaactggatctccaggcaagcctcacccggcagtcgagactgaatgacgagctgcaagcactgcgggatctgcgccaaaaactcgaagagctgaaggcacagggggagaccgacctgccacccggtgtactggaagatgagaggttccaacgactgctaaaacaggccgagaaacaagctgagcagtctaaggaagaacagaaacaagggctaaatgcagagaagcttatgagacaggtgtccaaagacgtttgtagactgcgtgaacagagccagaaggtcccaaggcaggtgcagtcctttagggagaagatagcctactttactagggccaagatctccataccttccttgccagctgacgacgtgtag

SEQ ID NO: 34885 - DNA, 3651 bp, Artificial Sequence
  Description of Artificial Sequence: Synthetic coding sequence
atgcctagacgtgctggatccggtcagttgccactcccaaggggctgggaggaggcacgcgattacgacggaaaggtattctacatcgatcacaatactcggcgcacgagctggatcgacccaagagatcgactaactaaaccactctcattcgccgactgcgtgggagacgaactgccttggggttgggaggcgggattcgatccccagatcggcgtctattacattgatcacattaacaagactactcagattgaggatcctcgtaaacaatggaggggagagcaggaaaagatgcttaaggattacttgagcgttgctcaagatgcgctgcgaacccagaaggagttataccacgtcaaggaacagaggttggccttagcactggatgaatacgtgcggcttaacgatgcttataaagaaaagagtagctcccataccagcctattttccgggtcgtcttcatcaactaagtatgatcctgatattctcaaagctgagattagtacaactagactgagggttaaaaaattgaaaagggagctttcacagatgaaacaagagctgctgtataaggaacagggttttgaaactctccaacagattgataagaagatgagcggaggacagtctgggtacgagttatctgaagccaaggctattctgaccgagcttaaatctatcaggaaggcaattagcagtggagaaaaggagaagcaggatcttatgcagagcctggccaagctccaggaacgattccaccttgaccagaatattggtagatctgaacccgacctcaggtgttcacccgtcaactctcacttgtgcttatccaggcagacactcgacgcgggctctcagacttccataagtggggacatcggagttaggagccggagcaacctggcggaaaaggttaggctgtctctgcagtatgaggaggccaagcgctctatggccaacctgaaaattgaattgagcaaactggacagcgaggcctggccaggagctctggacatcgagaaggaaaagctaatgctgattaatgagaaagaggagctgctgaaagaactgcagttcgttactccccagaagaggactcaggacgaactggaacgtctggaggctgagaggcagagactggaagaggagctcctatccgttagagggaccccgtcgcgcgcacttgctgagaggctgagactggaggagcgcagaaaagaactgttacagaagctggaggaaactacgaagctgaccacttacctccatagccagctgaaatccctctccgctagtaccctcagcatgtccagcggctcaagtctggggagcctggcatcctcaagaggcagtttaaacacctctagtcgtggcagcttgaacagcctttcctcaactgaattatactattccagtcaaagcgatcaaatagacgtcgattatcagtacaagcttgatttcctcctccaggaaaaatccggttacatacctagcggaccaatcactactatccatgagaatgaggtcgtaaaaagcccttctcagccgggccaaagcggcctgtgtggcgtggcggcagcagccaccgggcatacccctcctctggcggaagcgcccaaaagtgttgcttcattgtcatccagatccagcctctccagcctttccccgcccggcagcccactagttctggaagggacattccccatgagtagttcacatgatgctagtctgcaccagttcacagccgattttgaggattgcgagctgagcagtcacttcgctgacattagcctaatcgaaaatcagattttgcttgattcagattcaggaggcgccagccagagcctcagtgaagacaaagacttgaatgagtgtgcgagagagcccctttacgagggtacggcagacgtcgaaaaatccctacccaagcggagggtcattcatctgctcggagaaaaaactacgtgcgtttcagctgcagtcagcgatgagtccgtcgccggcgactctggcgtttatgaggcatttgtcaaacaaccgtccgagatggaggacgttacctacagcgaagaagatgttgcgatcgtggagaccgctcaggttcagatcgggctgcgttacaacgccaaatcttcaagtttcatggtgattatcgcccaactcagaaacctccatgccttcctgattcctcatactagcaaggtctacttccgcgttgccgtcctccctagctcaacggatgtgtcttgcttattccgaactaaggttcacccccccaccgagagtatactctttaacgatgttttcagagtggcaatcagccagactgcactccagcaaaaaaccttacgggttgatttgtgctctgttagcaagcatagacgagaagagtgcctcgccggcacccaaatttcacttgctgatctaccgttctcatctgaggtgtttacgctgtggtataatctgcttcccagtaagcagatgccgtgtaagaaaaatgaggaaaacgaggactctgtctttcaacctaatcagcctctggtcgatagcatcgacctcgacgcggtgtcagcgctgcttgcccggacgtctgcagagttgttagccgtggagcaagaattggcccaagaggaagaggaagagtcaggacaggaagagccaagagggcccgacggggattggctgaatacctatttcctgtgttgctgggaactgaaagacgatgtgtttaccagactgacagtcaagcctctgctgactatgctccgggaggcaagcgacgagattgtcgctgagaaagaagccgaagtcaaactacctgaggattcctcatgtaccgaagatttgtcttcctgcacatcggttcctgaaatgaatgaggacgggaaccggaaagaatccaattgcgctaaagatctcaggtcccagcctcccaccaggattccaacacttgttgacaaggagactaacactgatgaggcagctaatgataacatggcagtgagacccaaagaaagaagctctctaagctctcgacaacacccattcgtgagatcgagtgtcatcgtgagaagccaaaccttctcgcctggcgagcggaaccagtacatttgtcgtcttaacagaagcgacagcgattcaagcacactggccaaaaaatcacttttcgtgcgaaattccacagagaggcgctccctgcgagtgaagaggacagtctgccagtctgtgcttaggcgaactacacaggaatgtccggttcgcacgagccttgacttagaactcgacctgcaagcttctctcacgcgacagtcacgtctgaacgacgaattgcaagcactgcgtgatctgaggcaaaagctcgaggagctgaaggcgcagggggagaccgacttgcctcccggcgtgttagaagatgagcgctttcagcgactgctgaagcaggcagaaaaacaggcagaacagagcaaagaagaacaaaaacagggcttgaacgccgagaaactgatgcgccaggtgtcaaaggacgtgtgccggctgcgagaacagtcccagaaggtcccccggcaggtacagagttttcgtgaaaaaatcgcctatttcactagagctaaaatttccatccccagcctccccgctgacgatgtgtag

SEQ ID NO: 34886 - DNA, 963 bp, Artificial Sequence
  Description of Artificial Sequence: Synthetic coding sequence
atgccccgccttagagtccacggagcctgtctccccactaagtcagtgctgttcctgttctaccacagactgacaatgctccgcgaagctagcgatgaaattgtcgcggagaaagaagccgaagtaaagctcccagaggattcctcctgtacagaagatctatcgtcctgcacttcagtccccgaaatgaacgaggacggaaatagaaaagaaagcaattgtgctaaggaccttcgctctcagcctcctaccagaatccccaccctcgtggataaggagaccaacactgatgaagcggccaatgacaacatggcggtgcgaccaaaggagagaagcagtctgtcctcccggcagcatccattcgttcgttcctccgtgatcgtccgctcgcaaacatttagccccggagagcgcaatcaatacatttgccgccttaacagaagcgactccgattcttccactttagcaaagaagtccttgtttgttagaaactctacagaaaggcgctcactgagggtgaagcggacagtctgtcagtccgtcctgcgtagaaccacccaggaatgtcctgtgagaacctctctggacctcgagctggatttgcaggcttcactcacgaggcagagcaggttgaatgatgagctgcaggctctgcgggacctgcgccagaaactcgaggagctcaaggcacagggcgagactgatttaccccctggcgtccttgaggacgaaaggttccagcgcctcctcaagcaggccgaaaagcaagctgagcagagcaaggaggaacagaagcagggattaaatgcagaaaagttgatgcgacaggtgtcaaaggacgtatgccggctgcgagagcagagccaaaaggttccacgtcaggtgcaatcctttagggagaagattgcgtatttcacccgcgcaaagattagcatccctagcctccctgcagacgacgtttag

SEQ ID NO: 34887 - DNA, 3432 bp, Artificial Sequence
  Description of Artificial Sequence: Synthetic coding sequence
atgcctaggagagcgggctctggccagctgcccctgcctcgaggctgggaggaggcacgggactatgatgggaaagtgttttatatcgaccacaacacaaggagaactagctggatcgatcctcgtgacagattgaccaaaccactgagtttcgctgactgcgtaggtgacgaactcccatggggttgggaagctggttttgatccccagattggagtatattatattgatcacattaataaaacaactcagattgaggaccctagaaaacaatggcggggcgagcaggaaaagatgttaaaggattatttgagtgtagcacaggacgccctgcgcacccagaaggagctctatcacgttaaggaacaacggctggcccttgcattagacgagtacgtacggcttaacgacgcctacaaggagaaatcttcatcccatacctccttattctcagggagctcatcctctacaaagtacgaccccgatattctgaaagcagaaatctctaccaccagactgagggtcaagaaattaaagcgggaacttagtcagatgaaacaggagctgctgtacaaagagcaggggtttgaaacacttcaacagatcgataagaaaatgtctgggggacaaagcggatatgagcttagtgaggctaaagccatactaactgaattgaaatccataaggaaagctattagttctggagagaaggagaagcaggacctgatgcagagtctcgccaagctacaggaacgctttcaccttgaccagaacattggcaggtcggagcccgacttacgctgttctccagtaaacagccacctgtgcctgagcaggcaaacactggatgctggttctcagacgtccatatcgggagatattggagttcgctctcggagcaacctggcggagaaggtccgcctgtccttgcagtatgaagaggccaagcgctcaatggcaaacttaaagatcgagttaagcaagcttgattcagaggcatggcccggcgccctggacatcgaaaaggaaaagttaatgctgatcaatgagaaggaagagctcctcaaggaattgcagttcgtgactccacagaaaagaacgcaagacgagctggagagactagaggccgaaaggcagcgactggaggaggagctgctgtccgtccgtggaacgccctcaagagctctggccgaacgcctgaggttagaagagcggaggaaggaactgttgcagaaactggaagagacgactaagctcactacttatctgcattctcagttgaaatcacttagtgccagtactctctctatgtcgtcaggctcttccctcggctcactcgccagcagcagagggagtttaaacacgagcagccgagggtctttgaactcactcagctctaccgagctgtattatagcagccagagcgaccagatcgacgtggattaccaatataagctggactttctgctacaagagaagtccggatatatcccttcagggccgattaccaccattcacgagaatgaagtggtcaagtctccttctcagcctgggcagagtggtttatgcggagtggctgctgcagccacaggccacaccccacctttggcggaggctccaaagagcgtcgcctcactctccagccggagctcattgagctctttaagtccaccaggctctcccttagttctggaaggtacatttccaatgtcttcctcccatgacgcctcacttcaccaatttacagccgacttcgaggattatgttgaaaaatctctgccaaaacggagagtcatacacctactcggtgagaagacaacatgcgtgagcgccgccgtatctgatgaatctgtggccggcgattcaggagtgtacgaagcatttgtgaagcagccgtccgagatggaggacgtcacctactctgaggaagacgtcgctattgtggagacagctcaggtacaaattggcctaaggtacaacgcaaaatcttccagctttatggtgattatagctcaactgagaaacctacacgccttcctcattccccataccagtaaagtttattttagggtggctgtgttacctagctccacagatgtctcctgcctgttccggacgaaggtccacccccccaccgagtcaatcctgttcaacgatgtcttccgggtcgcaatcagccagacagcccttcagcagaagacactgcgcgtagacctgtgctcagtgagtaagcatcgtcgggaagaatgcctagccggcacccagatctcactcgctgacctgcctttctccagcgaggtgtttactctatggtataatcttctccctagcaagcaaatgccctgcaagaagaatgaggagaatgaggattcagtgttccagccgaatcagccactagtggactccatagatctagatgccgtaagtgctcttctggcacggacgtccgcagagctcttagccgtggagcaagagcttgcccaggaagaagaagaagaatctggccaggaggagccaagggggcccgacggcgactggctgactatgctccgcgaagcttccgatgagattgttgcagaaaaggaagcggaggtaaaactccctgaagattcctcttgtaccgaagatttgagttcgtgtacctcagtcccggaaatgaacgaggacggcaacaggaaggagtccaactgtgccaaagacctccgatctcagccaccgacacgaatacccacccttgtcgacaaggaaactaacacagacgaggccgcaaatgacaacatggcagtgcgcccaaaagagcgatctagcttgtcctcccgccaacatccctttgtacgatctagcgtaattgtgcgttctcagaccttctcacccggtgaacgaaaccagtatatctgtcgcttaaatcgaagcgattcagactcatctaccctggccaagaagagcctgtttgtacgtaatagcacggaacgtcgaagcctgcgcgtaaagaggaccgtgtgtcaaagcgtgctacggcgcaccacgcaggagtgcccagtgcgcacctcccttgatctcgaactcgacctgcaagcatccttgactcgacagtcgaggctgaacgatgaattacaagctctgagggatcttcgccaaaagttggaggaactcaaggcccagggagagactgacttgccgcccggtgtgttggaggacgaacgttttcagcggctgctcaaacaagctgagaagcaggcagaacaatccaaagaagaacagaaacagggtctaaacgcagaaaagctgatgcggcaggtgagtaaagatgtgtgcagactgcgcgaacaaagccagaaagttccgcgccaggtgcaaagcttcagagagaagattgcttactttacacgtgctaaaatttcaatcccgagcttacctgccgatgatgtttag

SEQ ID NO: 34888 - DNA, 315 bp, Artificial Sequence
  Description of Artificial Sequence: Synthetic coding sequence
atgaaatcctgccagaagatggaaggcaaacccgaaaatgagtccgagcctaagcatgaagaggaaccaaagcccgaggaaaaaccagaggaggaagagaaattggaagaggaggcgaaagcgaaggggactttccgggaacggcttatccagagcctccaggagttcaaggaggatatacataatcgccacctgtccaacgaggacatgttccgcgaggtggatgagatagatgagatcaggagagttcgtaacaagctgatcgtcatgaggtggaaggtcaatcgcaatcatccatatccttacttgatgtag

SEQ ID NO: 34889 - DNA, 315 bp, Artificial Sequence
  Description of Artificial Sequence: Synthetic coding sequence
atgaaatcctgccagaaaatggaagggaaaccggaaaacgagagtgagcctaaacacgaggaggaacctaagccagaagagaagccagaggaggaggaaaagctcgaggaagaggcgaaagccaagggtacgttccgcgagcgcctgatccagagcttgcaggagtttaaggaggacattcacaatcggcatctgagtaacgaggacatgttccgggaagtggatgaaattgatgaaatacgacgcgtgcgtaataagctaatcgtgatgcgttggaaggttaatcgcaaccatccctacccatacctaatgtag

SEQ ID NO: 34890 - DNA, 3279 bp, Artificial Sequence
  Description of Artificial Sequence: Synthetic coding sequence
atggaccacatcaacaagttgacccagattgaggatccgagggaacagtggcgacgagagcaggagcgcatgctgaaggagtacctgattgtggcacaggaggccctgaatgctaaaaaggaaatatatcagatcaagcagcaacggtttgagctggcacaagaagaatatcaacagctacacaagatgtgcgaggatgattcgagatcatacgcttccagcttctctggctactcgacaaatacaaagtacgatccgcatcagattaaggccgagatcgcctcacgcagagaccgcctgagccggttaaaaagggaacttacccaaatgaagcaagagttgcaatataaagagaagggggtcgagacactgcaggaaattgatcgaaaaatgagtagcactcatacctcttataaactcgacgaagcccaggctatcatgagcgagcttcggactatcaaaaaggccatctgtacaggggagaaggagcgaagggacctaatgcactccttggccaaattaactgatagtttcaaaaacagctgctccgtgaccgacagtttggttgactttccacatcatgtgggtgttccaggtgatgcaggcgtgccccagcaattttgcgacgccggttctcaaacagatatcatcggcgagtttgtgttcgacgacaagaccaggctggtggatcgggttcgtctaaattggcagtatgaagaggcaagaaagagagtcgccaacattcagcagcagctcgctcggttagacaatgagagttggccgtctaccgctgaggccgaccgggatcgcctccaactgattaaagaaaaagaggcactgttgcaggagctccagctgatcatcgcacaaagacgcagcgcgggcgatgtagcaaggctcgaagaggaaagagaaaggctggaggaagagcttaggcgggcacgcgcaacatccgcccaaggggcaacggaaagaattcttcttcaggaaaagcggaattgtctactgatgcagctggaagaggcaacaagactcactagctatctacagagtcagttaaagagcctttgcgctagcactctaaccgtttcgagcggctcatcccgcgggtctttagcgagtagtcgaggctcgctcgcctcctcccgaggaagcttgagctccgtctccttcacagatatctacggcctgcctcagtatgagaaaccagatgcggagggctctcagctcctgcggtttgatctcattcctttcgactcacttggcagagatgccccattcagtgaaccaccaggaccctcaggattccacaagcagcggagatctctcgacaccccacagagtctagcctcccttagcagccgctcatctctcagttcccttagcccgcctagtagccccctcgataccccatttctgccagcatcccgggattccccgttagcccagttggctgactcgtgtgaagggcccggtttgggagctttggaccggctgcgggcccacgcctcagctatgggagacgaagacttgcctggcatggctgcgctccaaccacatggcgtgccaggggatggcgaaggacctcatgagaggggcccaccccccgcgagtgcccctgtgggtggaacagtgacgctacgcgaggacagcgccaagcggctcgaaaggagggcaagaaggattagcgcctgtttatctgactacagcctcgctagtgatagcggagtgttcgaacccctgactaaacgcaatgaggacgccgaagaacccgcctatggcgacacggctagcaacggcgacccccagatacacgtggggctgctgagggattccggaagtgagtgcctactggtgcacgtccttcaattaaagaatcctgcggggctggcagtgaaggaggattgtaaagtccatattagggtgtatttgccccctctagattccggcacccccaatacctattgcagtaaagccctcgaattccaggtaccgctcgtgtttaatgaggtgtttagaatccctgtccactcctctgcccttactctgaagtccttacagttgtatgtatgtagcgtgacaccccagctgcaggaggagctgctcggcattgctcaaattaacctggctgactatgacagtctctcggagatgcagctgaggtggcactctgttcaggtatttaccagttcggagccatcaaggactcgggaggcggggtgtgccggggagtcatcagcccgagatccggctcacaccatttcaatctccggtaagacggacgccgtcactgtgcttctggcaagaacaactgcccaattacaggccgttgaaagggagttagccgaggaacgtgctaagctggaatacaccgaagaagaggtgttagagatggagaggaaggaagagcaggctgaagctatatctgaacgaagctggcaagctgactcagtcgacagcggatgcagtaactgtactcagacctcacctccttatcccgaaccctgttgcatgggaatagattccatactggggcaccccttcgctgcacaggcagggccatactcccccgaaaagttccaaccaagtccgctgaaggtcgataaagaaacaaacaccgaagatctgttcctcgaagaagccgcgagcttagtgaaggagagaccatcgcgaagagcaagggggtctccgtttgttcgctctggcacgatagtccggtcccagacattttcacctggcgctcgtagtcagtacgtctgcaggttatacaggagcgactctgattcaagcacgctaccacggaagagcccatttgttcgaaacactttagaacgcaggacactgaggtataaacaaagctgtcggtcatctctggcggaattgatggcgaggaccagtttggacctcgagctcgatctgcaggctagccgaaccagacagaggcagttaaacgaagagctgtgcgctctgagggagctgagacagagattagaggatgcccaactgagggggcaaacagatcttccaccttgggtcctgcgtgacgaacgcttgagggggctgttaagagaagcagaacggcagacgcgccaaacaaaactagattacaggcatgaacaggccgctgagaaaatgctgaagaaggccagcaaggagatctatcagctgagaggacagtctcataaagagcccatacaggttcagacgttcagagagaaaatcgcattctttactagacccaggatcaatattccaccactgccagcagacgacgtgtag

SEQ ID NO: 34891 - DNA, 1749 bp, Artificial Sequence
  Description of Artificial Sequence: Synthetic coding sequence
ctgtcccatatttctgaactgacccagattgaagatccccgtgaacaatggagaagagaacaggagaggatgcttaaggagtatctgattgttgcacaggaggctcttaacgccaaaaaggaaatttatcagattaagcagcagcgatttgagctcgcccaggaggagtaccagcagctgcacaagatgtgtgaagacgacagccgcagctacgcatcctctttctccggatattctacaaacaccaagtatgacccacatcagattaaggcagaaatcgcatcgcggagggatcggttgtcccggttaaagcgcgagctcactcagatgaaacaggaactgcagtataaagaaaaaggagtcgagacactgcaagagatcgaccgtaagatgagctcaactcacacttcgtataaacttgacgaggcccaagcaattatgtccgagctgcgcaccataaaaaaggctatttgcaccggcgagaaggagcgaagggacctcatgcatagcctagcaaagctgaccgactcgtttaaaaacagctgttccgtgacggatagcttggtggatttcccacaccacgtgggagttcccggcgatgcaggtgtgccacaacagttctgcgacgcagggtcccagacggacatcatcggggaattcgtgttcgacgataagacacgcctggtggacagggtcagattgaattggcagtacgaggaagccaggaagagagtggcaaatatccagcagcagttggccaggcttgacaacgagtcatggccaagcaccgcagaggccgatcgcgaccgactccagctaatcaaagagaaggaggcccttctgcaggaattgcaacttattatagcccaacggaggagtgctggcgacgtcgcgaggctcgaggaagagcgcgagcgactggaggaagagctccgccgcgcccgagctacgtcggcccagggggccacagaacgcatcctattacaggagaaaagaaactgtttgctcatgcagcttgaagaagccacgcggttgacctcctatctccagtcacagctcaagagcctctgcgcatctacactgacggtctcttctgggtccagccgggggtcactagcttcttcaagggggagcttggcttcttcgaggggttccctgagtagtgttagctttaccgatatctatggccttccacagtacgaaaaacctgacgccgagggtagccaactgctcaggttcgatctgataccctttgacagtctcggtagggacgcaccatttagcgaaccacctgggccaagcggctttcacaaacaaagaaggagcctggatactccccagagtcttgccagtttaagcagccggagcagcctgtcaagcttaagccctcctagctcacctttagatacgccgttcttgccggcttctcgggacagcccactggcccagctcgctgactcttgtgaggggccaggtttgggcgctttagatcgactgcgagctcacgcaagcgctatgggggatgaggacctgcccggtatggcggcattgcagccacacggggtgcctggggatggcgagggccctcacgaacggggaccaccccctgccagcgctccagtaggcggtagcaaatgtggctgctccgattccagtaggcgacagtgccaagaggtaggggaagagggtacgccgcatcttaggatgtcagttggcctgttcgcttctcagaggcagtggggcgtctag

SEQ ID NO: 34892 - DNA, 3279 bp, Artificial Sequence
  Description of Artificial Sequence: Synthetic coding sequence
atggaccacatcaataagctgactcagatcgaagatccccgagaacagtggagaagagaacaggagcgaatgctgaaggagtacctgatcgtcgcccaggaggctcttaatgccaaaaaggagatataccaaattaaacagcaacgcttcgagttggcccaggaggaataccagcagctccacaaaatgtgcgaggacgattctcgctcgtacgcatcctcattctctggctatagcactaacaccaagtatgacccgcaccagataaaggctgaaatcgcttcgcgtcgcgaccggctgagcaggttgaaacgagaattgactcagatgaagcaagagttgcagtacaaggagaaaggtgttgaaaccttgcaggaaattgaccggaagatgtccagcacacatacttcttataagctggatgaggctcaggccataatgagcgaactacgaacaattaagaaggcgatctgcacaggggagaaggagcgcagggacttgatgcactctctagcaaaactaaccgattcattcaagaattcttgctccgtcacagatagtttggtggactttccacaccacgtgggcgttccaggcgatgctggcgttccacagcagttctgcgatgccggaagtcaaaccgatatcataggtgagtttgtctttgatgataagacccgactagtggacagggtaaggctgaactggcagtatgaggaagcacgaaagcgagtggccaacatccaacagcagctggctcgactcgacaatgagtcctggccatctactgcggaggccgatcgcgatagactgcagctgattaaggagaaagaggcactgcttcaggagctacagctcattatagcgcagaggaggtccgctggagacgtggctcgtctggaagaggagcgggagcgccttgaagaggagctgaggcgcgcgagggccacctccgctcagggagcaactgagagaatccttctacaggaaaagcggaactgcttgctcatgcagctcgaggaggccactagattaacctcttatttgcaaagccagctgaagagtctgtgcgcatccacactgaccgtgagctcggggtcatctagaggaagcctggcttcctcccgaggcagcttagccagttctaggggtagcctttcttccgttagcttcaccgacatctacggtcttcctcagtacgaaaagcccgacgctgagggcagccagcttctgcgttttgatcttattccatttgattctctgggacgcgacgcccccttcagcgagccacccggtccctccggtttccataaacagcggaggtccctggacacccctcaatccctcgctagcctttcctcgagatctagcctcagttcactgtcccctcctagtagtccactggataccccttttctcccagcctcgagagatagccctctagcccaactcgctgacagctgcgagggtcccgggctcggcgcgctggaccggctgcgcgcccacgcctccgccatgggggacgaggatcttcccgggatggcagcgctgcagccgcatggagtgccgggggacggggaggggccgcacgagcgaggacctccacctgcaagcgcaccagtcggtgggacagtgaccctgcgggaagattcggctaaacggctggagcgacgagcaaggcggattagcgcctgcctatctgattactctttagctagcgacagtggcgtatttgaaccactgaccaaacgtaatgaggacgcggaagaaccggcctacggagacacggcaagtaacggggatcctcagatccatgtagggcttctccgggactcaggcagcgaatgtcttctagtccatgttctccaactaaagaatccagcagggcttgccgtaaaggaggattgtaaggttcacatccgggtgtacttacctccattagattctgggaccccaaatacgtactgctcgaaggctcttgaatttcaggtcccgctcgttttcaatgaggtctttcgtatccctgtccatagttcagcgttgacactgaagagccttcagctttacgtatgctctgttaccccacagttacaggaagagttattgggcatcgcgcaaatcaacttggccgactacgactcattgtcagagatgcagttgagatggcactccgtccaggtttttacctccagtgaaccttccaggactcgggaagcaggatgcgcaggcgagagttctgctcgcgatcccgcccatactatcagcatctccggcaagaccgatgccgtgaccgtgttgcttgccagaactactgcgcagttgcaagcagtggagagagagctggctgaggagcgtgcaaaacttgaatatacggaggaggaggttctggaaatggagagaaaagaggaacaagccgaggcaatttcagaaagatcttggcaggccgacagcgtcgactccggttgctccaactgtacccaaactagccctccctacccagaaccatgttgtatgggcattgactcaattctgggtcacccctttgctgcacaggccggtccctacagcccggaaaagttccagcctagccccttaaaagtggacaaagagaccaatacagaggatttgtttctggaggaggctgcctctcttgtgaaggaacggccatcccgtcgggctagagggagtccattcgtgcgatccggcacaattgttagaagtcaaacattcagcccgggagccaggagccagtatgtttgccggctgtatagaagtgacagcgattccagtacactgccccgcaaatccccttttgtaagaaacaccctggagcgccggacactcagatacaaacagtcttgtcgatcatcactggcagaacttatggcaaggaccagcctcgacctggagctcgatctgcaggcatccagaacgcgccagaggcagttaaacgaagagttgtgcgcgcttcgggagcttcggcagaggttagaggatgcacagcttcgtggacagacagacctgcctccctgggtgttgcgcgatgaacggctgcgggggctgctgcgggaggccgagaggcaaacacggcagactaagcttgactataggcatgaacaggccgcggaaaaaatgcttaaaaaggctagcaaggagatataccagttgcgagggcagtctcacaaagagccgatccaggtgcagacatttagagaaaagatagccttctttacgcgcccacgtatcaacattcctccccttccagcggatgacgtgtag

SEQ ID NO: 34893 - DNA, 639 bp, Artificial Sequence
  Description of Artificial Sequence: Synthetic coding sequence
atgcaactcgaggaagctaccaggctaacatcctatctgcagagccaactgaaatccctgtgcgccagtactttaaccgtgagtagcggctcgtcaaggggcagtctggcatcttcaaggggtagcctagcctctagccgagggtccctctctagtgtttctttcacagacatatacggcctcccccagtatgagaagcccgacgctgaaggctcgcagctgttacgctttgacctcattccttttgatagtctcgggcgcgatgcccccttctccgaacctccgggaccatccggcttccataagcagcgacggagcctagacacacctcagagcctcgcttccctcagtagtcgcagtagtttgagttctctgtctccgccctcaagccccctggacaccccttttctgcccgcaagccgggatagccctttggcccagctggccgactcttgtgaagggcccggtctcggcgcactggaccgcctcagagcgcacgcaagtgccatgggagacgaagatttgcccggcatggcagccctacaaccacacggggtaccgggcgatggagagggaccccatgaacggggaccccctcccgcaagcgcccccgtcggggggaagatactgacctcttag

SEQ ID NO: 34894 - DNA, 1764 bp, Artificial Sequence
  Description of Artificial Sequence: Synthetic coding sequence
atgggtgacgaagatttgcctggaatggctgcactgcaaccacacggcgtgcctggcgacggagaagggcctcacgaacggggaccacccccagcttcggctccagtcggcgggactgtcacactgagggaggacagtgcaaagaggctggagaggcgcgcgcggcgcatttccgcttgcctgtctgactactcactcgcaagcgattccggcgtgtttgagcctctcacgaaacgcaatgaggatgcggaagagccagcttatggggacacggccagtaacggagatccacagattcacgtcggcctgctgcgggattctgggtctgaatgtctcctggtgcacgtgctgcagctcaaaaaccctgctggcctggctgttaaagaggattgcaaggtgcacattcgagtgtatctgcctcctctggacagcggaacccctaatacgtactgcagcaaggccctggaattccaggtgccgctcgtctttaatgaggtatttcggatacccgtccattccagcgcccttaccctgaaatccctgcaactgtatgtgtgtagtgtgactcctcagctccaggaagagttactgggcattgcgcagatcaatcttgccgactacgatagtttgtctgaaatgcagctacgatggcattctgttcaggtctttacgtccagtgagccatcacgcacaagggaagctggctgtgctggggaaagtagcgctcgcgaccctgctcacaccatttctatttctggtaagaccgacgccgttaccgttttactggctcgcacaaccgctcagcttcaggccgttgaacgggaactggccgaggaaagggcaaagctcgaatacactgaagaagaggtgctggaaatggaacggaaagaagaacaagcagaagctattagcgagagaagctggcaggccgactcagttgatagcggatgctcaaactgcactcagacctccccaccctaccctgagccttgttgcatgggaatagattccattctaggccaccctttcgctgcccaagctggcccttacagcccagaaaaatttcagcccagtccactaaaagtggacaaagaaactaataccgaggatctgtttttggaagaagccgcaagcctggttaaagaaagaccctctcggcgggcgagagggagccccttcgtgagatctggaacgattgtgaggtctcagacattttcccctggagctaggtctcagtatgtctgcagactctatcggtccgacagcgactcgtctaccttacctaggaagagtcccttcgtgagaaacactctcgaaaggagaacattacgctacaagcagtcttgccggagttccctcgctgaactgatggctagaacttccttggacctggagctggatctgcaggcttctcggactcgacaaagacagttgaacgaggagctgtgtgcgctgcgggagcttcgccagcggctcgaggatgctcagttgagagggcagacagacctgccaccctgggtcttgcgcgacgagcggctgagagggctgctgagagaggcagagcgccagacacgacaaactaaactcgattacagacacgagcaagcggccgagaagatgctaaaaaaggcatccaaggaaatataccagctgagaggacagtctcataaggaaccgatccaggtgcagacctttagggagaaaattgcgttctttactcgacctcggattaatataccacccttacctgccgatgatgtgtag

SEQ ID NO: 34895 - DNA, 210 bp, Artificial Sequence
  Description of Artificial Sequence: Synthetic coding sequence
atggaaagccctaagaaaaaaaaccagcagctcaaggttggaattctgcaccttggaagtagacagaaaaagattcgtatccagctgaggtcacaggtgctcggacgtgagatgagagatatggagggtgatctacaggagcttcatcaatcaaataccggggacaagagcggatttggctttaggaggcagggagaagacaatacctag

SEQ ID NO: 34896 - DNA, 441 bp, Artificial Sequence
  Description of Artificial Sequence: Synthetic coding sequence
atgctgctgtggtgtccacctcagtgcgcctgtagtttgggcgtattccctagcgcaccctcgccggtttggggaaccagacggtcttgcgagccggcgactcgcgtccccgaagtgtggattttgtccccactactgcggcacggcggccatacgcagacccagaatcatactgcttctccccgcagccctgtgatggagtccccaaagaagaagaaccagcagttaaaagtggggatactgcatctggggtctaggcagaagaagatccgcatacaacttagatcccagtgtgccacatggaaggtgatttgcaagagttgcatcagtcaaaccccaggaatcaacctcgatttggggtctggcgtgaaagtaaaaattattccaaaagaagagcattgtaagatgcccgaagctggagaggaacagccgcaggtgtag

SEQ ID NO: 34897 - DNA, 441 bp, Artificial Sequence
  Description of Artificial Sequence: Synthetic coding sequence
atgctgctgtggtgcccaccacaatgcgcttgcagcctcggggtgttcccttctgcccctagccccgtgtggggtactcgccgctcctgcgagcccgcaacccgcgtgcccgaggtgtggattctgagtcctctccttagacacggcggtcacacgcagactcagaaccacacagcgtcccctcggagcccggtgatggaaagcccaaaaaagaaaaatcagcaactgaaagtggggatcctgcatctgggaagtcggcagaaaaaaatccggatccaactgcgctcacagtgtgcaacttggaaggtgatctgcaaatcctgtatcagtcagacccccggaatcaatctggacctgggctcaggggtcaaggtgaagatcatacccaaagaggagcattgcaagatgccagaggccggggaggagcagcctcaggtgtag

SEQ ID NO: 34898 - DNA, 210 bp, Artificial Sequence
  Description of Artificial Sequence: Synthetic coding sequence
atggaaagccccaaaaagaaaaatcagcagctgaaggtcggcattctgcacttgggaagtagacagaaaaaaattcggatacaattgcgcagccaggtgctaggacgcgaaatgagagatatggaaggggatctgcaggagctgcatcagtccaacaccggcgacaagagtggctttgggtttcggcgccagggagaagacaacacctag

SEQ ID NO: 34899 - DNA, 336 bp, Artificial Sequence
  Description of Artificial Sequence: Synthetic coding sequence
atgatctggagaggccgatctacatatcggcccagaccgcgccgctctgtcccaccgcccgaattgatcggacctatgctcgagcccggcgacgaggaaccacagcaggaggagccacctacagaatcacgcgatcctgcccccggccaggagagggaggaagaccagggggcggccgaaacacaggttcccgatttggaggctgatctgcaagaattaagtcagagcaaaaccggaggagaatgtggcaacggtccagacgaccagggcaaaatactgcctaagagcgaacagttcaaaatgcctgagggcggcgatcgccaaccgcaggtgtag

SEQ ID NO: 34900 - DNA, 336 bp, Artificial Sequence
  Description of Artificial Sequence: Synthetic coding sequence
atgatatggcgcggcagaagtacatatcgccctcggccacgacggagtgtgccaccgccggagctcataggccctatgctggaaccaggcgacgaagagcctcaacaggaggaaccccccaccgagtctcgcgacccggcaccgggacaagaaagagaggaagaccaaggcgccgcggaaactcaggttcccgatttggaggctgacctccaagaactgtctcagtcgaaaaccggaggggagtgtggtaacggcccagatgaccagggcaagattctccctaaatctgaacaatttaagatgccagaaggaggggatagacagcctcaagtctag

SEQ ID NO: 34901 - DNA, 327 bp, Artificial Sequence
  Description of Artificial Sequence: Synthetic coding sequence
atgtcatggcgaggcagaaggtaccgccctagaaggtgtctgcggctggcccagctggtgggaccgatgctagagcccagcgtacctgaaccccagcaagaggagccgccaaccgagtctcaggatcacactcccggccaaaaacgtgaggatgaccagggtgctgcagagattcaagtgccaaacctggaggcagatctccaggaactctcccagtccaaaaccggcgatgagtgcggagactcacccgatgtgcaaggcaagatattgcccaagtcagaacaattcaaaatgccagagggcggggaaggcaagccacagctgtag

SEQ ID NO: 34902 - DNA, 246 bp, Artificial Sequence
  Description of Artificial Sequence: Synthetic coding sequence
atggaatccccaaagaaaaaaaaccagcaattgaaggtgggaatattgcacctgggcagtcggcagaaaaagataaggatccagctgcgttctcaatgcgctacgtggaaagtcatctgcaagtcctgcatcagccaaaccccagggatcaatctggacttaggctcaggcgttaaagtgaagatcatccctaaagaggaacattgcaaaatgcctgaggctggagaagaacaacctcaggtgtag

SEQ ID NO: 34903 - DNA, 441 bp, Artificial Sequence
  Description of Artificial Sequence: Synthetic coding sequence
atgctcttgtggtgcccaccacagtgtgcttgctctttgggagtattccccagcgcaccatcgcccgtgtgggggacaagacggtcctgtgagccagcgaccagagttcctgaggtctggattcttagcccgctactacgccatggagggcatacccagacacagaatcatacggcctcccctcggagccctgtgatggagtctcccaagaagaagaatcagcaacttaaggtgggcatcctacacctggggtctcgccagaaaaagatccgcatccagctgagaagtcagtgtgcgacctggaaggttatttgtaaatcatgtatctcccaaacaccagggattaaccttgacctcggcagtggtgtgaaggtcaagatcatccccaaggaggagcactgtaagatgcccgaagctggggaagagcagccccaggtttag

SEQ ID NO: 34904 - DNA, 210 bp, Artificial Sequence
  Description of Artificial Sequence: Synthetic coding sequence
atggaatctcccaagaaaaagaaccaacagctgaaggtaggtatcctgcacctgggctcaagacagaaaaagatacgcattcagctgagatcacaggtgttgggcagagagatgcgtgacatggagggcgacctccaggagttacaccagagcaacaccggtgacaaaagcgggtttggctttaggcggcaaggggaagacaatacttag

SEQ ID NO: 34905 - DNA, 336 bp, Artificial Sequence
  Description of Artificial Sequence: Synthetic coding sequence
atgtcttggaggggacggtcaacttataggccacgccccagaagatcacttcagccgcccgaactaatcggcgctatgttggaacccactgatgaggaaccaaaagaggaaaagccacccactaaaagcaggaacccaacccccgatcagaaacgggaggacgaccagggcgctgcagagatccaggtgcctgacctagaagcagacttacaggaattatgtcaaaccaagacgggtgacgggtgtgagggtggaacggatgtaaagggaaagatccttccaaaggccgagcacttcaaaatgcctgaagccggggaaggcaaatcacaggtgtag

SEQ ID NO: 34906 - DNA, 336 bp, Artificial Sequence
  Description of Artificial Sequence: Synthetic coding sequence
atgtcatggcgaggccgatcgacgtacaggccacgaccgcgtagaagtcttcagccacctgagctgataggggctatgttggaaccaaccgacgaagagccgaaagaggagaagccccccaccaagagccgcaatccgacccccgaccagaaacgggaggatgaccagggagccgctgaaatacaggtaccagacctggaggcagacctgcaggagctgtgtcagaccaaaactggagatgggtgtgaaggcggcacagacgttaaaggaaaaattctacccaaggcagaacattttaaaatgcccgaggccggggagggaaaatctcaggtgtag

SEQ ID NO: 34907 - DNA, 327 bp, Artificial Sequence
  Description of Artificial Sequence: Synthetic coding sequence
atgtcatggagagggagaaggtaccggccaaggcgttgtctaagactcgcccagttagtgggcccgatgctagagccaagtgtacctgaacctcagcaggaggagcctcctactgagtctcaggaccacacccctgggcagaaaagggaagacgatcagggggctgctgaaatacaagttccaaacctggaagcagacttgcaggagttgagtcaatccaagactggggacgaatgtggcgattcccccgatgtccagggcaaaatcctgccgaagtctgaacagttcaaaatgccagaaggcggcgaaggtaagcctcagttatag

SEQ ID NO: 34908 - DNA, 327 bp, Artificial Sequence
  Description of Artificial Sequence: Synthetic coding sequence
atgtcttggcggggccggcgctacaggccaaggcgctgtctgaggctagcgcagctggtagggcctatgctggaaccctccgttcctgagccgcaacaggaggaacctcccactgagtcacaggaccacaccccaggacagaagcgggaagatgaccaaggtgcagccgaaatccaggtccccaatttggaagcggacttacaagaactctctcagtccaaaacgggcgatgagtgcggcgattcacccgacgtccagggcaagatcctacccaagagtgaacaatttaaaatgccagaagggggtgaaggaaagcctcagctgtag

SEQ ID NO: 34909 - DNA, 228 bp, Artificial Sequence
  Description of Artificial Sequence: Synthetic coding sequence
atgtcatggcgcggccgtcgatataggccccggagatgcctgcggctggcgcaattggtaggaccaatgctggagcccagcgtaccagagccccaacaagaggagccgccgacagagtctcaggatcatacaccggggcagaaacgcgaggatgaccagggagccgccgaaatccaaggcacatccattctcgctcaggacaagacccagttttccgagactggatag

SEQ ID NO: 34910 - DNA, 327 bp, Artificial Sequence
  Description of Artificial Sequence: Synthetic coding sequence
atgtcgtggcggggtaggcggtatcgcccacggaggtgcttacggctggctcagctggtgggtccaatgttagaaccaagcgtccctgagcctcaacaggaggaaccccccacggaaagtcaggaccatacacctggacagaagcgggaggatgatcagggcgcagctgaaatccaggtccctaacctggaagcagatctgcaagagcttagtcagagtaaaactggcgacgagtgtggagatagtcctgacgttcagggcaaaattctcccgaagagcgagcagttcaaaatgccagaaggaggggaagggaaaccacagctgtag

SEQ ID NO: 34911 - DNA, 270 bp, Artificial Sequence
  Description of Artificial Sequence: Synthetic coding sequence
atgaagtacactaaacagaattttatgatgtccgtgttgggcattattatctacgtcactgacctgatcgtggatatctgggtgagtgtgcgcttttttcatgagggacagtatgtgttttctgctcttgcattatcttttatgctatttggaacacttgttgctcagtgcttctcctacagttggtttaaagctgatctgaaaaaggccggccaggagtcccagcattgtttcctgctgctacactgtctccaaggcggcgttttttag

SEQ ID NO: 34912 - DNA, 492 bp, Artificial Sequence
  Description of Artificial Sequence: Synthetic coding sequence
atgaggcgccttcttattcccctggccttatggctgggggcagtgggcgtgggggtggccgaactgaccgaggcacagcggaggggcctgcaggtggccctggaagaattccacaaacacccccccgtccagtgggcattccaagagacgagcgtagagagtgctgtggacaccccctttcccgccggcatctttgtacgattagagtttaagcttcagcaaacatcttgcaggaagagagactggaagaagcctgagtgtaaggtgcggccaaacggacgcaagagaaaatgtttagcttgcattaagttgggcagcgaagataaagtgctggggcgcctcgtccactgtccaatagaaacacaggtactccgtgaggcagaagaacatcaggagacacagtgtttgcgcgtgcaacgtgccggcgaggatccccactcattttattttccaggtcaatttgccttcagtaaagctctgcccaggagttag

SEQ ID NO: 34913 - DNA, 621 bp, Artificial Sequence
  Description of Artificial Sequence: Synthetic coding sequence
atgagctgggtgcaggccgcgagcctgatccaggggcccggggataaaggggacgttttcgacgaggaggcagacgagagcctcctagcccagcgcgagtggcagtccaacatgcagcgccgggttaaggaggggtaccgggatggtatcgacgccggaaaagccgtgaccctgcagcaggggtttaaccaggggtataagaaaggggcagaggtgatccttaattacggaagacttcgtgggacactgcggaattccacggactggagtctcctcggactcagagcccctctcaggtcccctgaggtcgggacccagttattacccagaccactgccagtccctgggcacatggcaagcggagctaccccgaaacagccaaccgagctggaggctacactgctttcccttgtgccccagtcaggtcgagcaaccccaagattccccgcacggctgcgtgcaccagggccaggtaccccttcccataggcgcagattccgacgcaaaccacacagggaccccgcagcggcttgcccggcatggccaccagaggcacccagcaatagcgagacgcatttctccacgtacaaccggattattatccgtggaggccacatctag

SEQ ID NO: 34914 - DNA, 972 bp, Artificial Sequence
  Description of Artificial Sequence: Synthetic coding sequence
atgtcacgccctcggatgaggctggtcgtcaccgccgatgacttcggctactgccctcgtcgggatgaaggtattgtggaagccttcctcgctggcgctgtgacgtccgtgagcttgctggtgaatggcgcggccactgaaagcgctgccgagctggcaagacgacacagtatcccgacaggtttgcacgcgaacctttccgaaggccgcccagttgggccagctcgccgcggagccagttccctgttaggaccagaaggtttctttttagggaagatgggcttcagggaggccgtagcagcaggggatgtcgatttacctcaggtccgggaagaactcgaagcacagttatcctgtttcagagagcttttgggcagagcccctacacacgccgatggccaccagcacgtccatgtgctaccaggcgtatgccaggtcttcgctgaggcactgcaggcatatggtgtgaggttcacgcggctgccactggagaggggtgtcggcggttgcacctggctggaagcacctgcgagggccttcgcctgcgcagtagagagggacgcccgggcagctgtaggacctttcagcagacacggattgcggtggacagatgcctttgtggggctgagtacgtgtggacgacatatgtcggcccatagggtgagcggggcactggctcgagtattagagggtaccctggccggtcacactcttaccgccgagctcatggctcaccccgggtatcctagcgtaccaccgaccggcgggtgcggcgagggtccggatgctttcagctgtagctgggaaaggctgcacgagctgagagtactgactgctcccacgctccgagctcagttggcccaggatggagtacagctttgtgcattagacgaccttgattctaagcgccctggcgaggaggtgccttgcgagccaaccctggagccttttctggagcccagcctgctgtag

SEQ ID NO: 34915 - DNA, 450 bp, Artificial Sequence
  Description of Artificial Sequence: Synthetic coding sequence
atgtcaagaccaaggatgcgtttggtggtcactgctgacgacttcggttactgccccaggagggatgaagggatcgtggaggcctttctggcaggagctgtgacttccgtctctctgctcgtgaacggagcggccacagagtctgccgccgagctggcccgccgacatagtatccctaccggtctgcacgccaatttgagtgaggggagaccggtggggccagcccgtcgaggtgcctcctccctgctgggtcccgagggcttctttctcggcaagatgggcttccgcgaggccgtcgcggcaggggacgttgatctgccgcaggttcgagaggagctggaggcgcagctgtcctgctttcgggagcttctcgggcgggcgcctacacacgcagatggacatcagcacgtacatgtgctgccgggcgggcagactccttcatgggcgtag

SEQ ID NO: 34916 - DNA, 900 bp, Artificial Sequence
  Description of Artificial Sequence: Synthetic coding sequence
atgtcttccgctgcaggacccgacccatcagaagctccggaagagagacatttcctgagagccctggagctccagccccctctcgctgacatggggcgggccgagctttcttccaacgcaactacttctttagttcagaggcgcaagcaagcttggggcagacagtcatggttggaacagatttggaacgctggacccgtgtgccagagcacggccgaagccgccgccttggaaagagagctgctggaggattaccgcttcggacgtcagcaattagttgagctgtgcggccacgcctctgccgtcgcggtcacaaaggcgttcccactgcccgccctgagccgcaagcaaagaacagttctcgtggtctgtgggcctgaacagaatggagctgtcggcctcgtgtgtgcccgacaccttagagtgttcgagtacgagcccaccattttttacccaaccaggtcactcgacctgttgcatagagacctgacgactcaatgtgagaagatggacatacccttcctgtcgtacttgcctaccgaggtccagctcattaatgaagcctatggtctggtggtcgatgcagtcttaggtccaggggtagagccaggcgaagtgggtgggccgtgcacacgcgccctggcaacactcaaactgctaagcattcccctggtatctctggacatcccctccggctgggatgcagagactggtagtgactccgaggacggcctgcgccctgatgtcctagtttctctcgccgcccccaaaaggtgcgcaggtcgattcagcggtcggcaccatttcgtggctgggcgtttcgtgcctgatgacgttcgccgcaaattcgccttgagacttcccggctacaccggcaccgactgtgtggccgcactctag

SEQ ID NO: 34917 - DNA, 750 bp, Artificial Sequence
  Description of Artificial Sequence: Synthetic coding sequence
atgtcctcagcagctggtcccgatcctagtgaggcacctgaggagcgtcactttttgtctaccgccgaggctgctgctctcgaaagggaactgctggaagactaccgttttgggcggcaacaactcgtcgaattatgtgggcacgcgtcagccgttgcagtgaccaaagcattccccctccccgccctgtctcggaaacagagaaccgtgctggtcgtgtgtggacctgagcagaatggggctgtcggactggtgtgcgctcgccacctgcgggtgtttgaatatgagcccaccatcttctaccccaccaggagcctcgatcttttgcatcgggacctgacaacccaatgcgagaagatggacattccctttctgtcctaccttcctacagaggtgcagctaattaacgaagcatacggcctcgttgttgatgccgtgctgggccctggcgttgagccgggtgaggtgggtggcccatgtacaagggccctggctaccctcaaactcttgtcgatccctctcgtgtccctggatatacccagcggatgggacgccgaaaccggaagtgacagcgaagacgggctgcgaccagacgtgctcgtgtctcttgcagctccaaagcgctgcgctggccgctttagcggacgtcatcacttcgtggccggccggttcgttcccgacgacgtacgacgcaagttcgcacttcggttacctggttatacaggaaccgactgtgtagcagccctctag

SEQ ID NO: 34918 - DNA, 750 bp, Artificial Sequence
  Description of Artificial Sequence: Synthetic coding sequence
atgagctctgccgcaggcccagacccatcagaagcacctgaagagaggcactttttgtccactgccgaagccgcggcgctggaaagggagctgttggaagactacagatttggcaggcagcagctggtggagctatgtggacacgctagcgcagtggctgtcaccaaagctttccccctccccgcattatcccgaaaacagaggacagtccttgtggtgtgtggcccagagcagaatggtgcagtgggactggtgtgtgctcgtcatcttcgagtctttgagtacgagccaacgattttttaccccacacgaagcctggatcttttacatagagacctgacgacgcagtgtgagaaaatggatattccttttctatcatacttaccgaccgaggtgcagttaatcaatgaagcatacggcctggtggttgacgctgtgcttgggccaggagtagagcctggcgaggttggtggaccctgtaccagggccctcgccactttgaagctgctctccatcccattggtttcactagacatcccatctgggtgggatgcagagactgggtctgactccgaagacgggctccgccccgacgttctcgtcagcctagctgcacccaaaaggtgcgcaggcaggttctctgggaggcatcatttcgtggccggaaggtttgtccccgatgacgtgcggcggaagttcgccctgcgtctccctgggtataccggtacagactgcgtcgcagcactttag

SEQ ID NO: 34919 - DNA, 900 bp, Artificial Sequence
  Description of Artificial Sequence: Synthetic coding sequence
atgtcctccgcggctgggcccgatccaagtgaggcccccgaggagaggcacttcctccgcgccctggaattgcagccaccactagccgacatggggagagctgagctgagttcaaacgcgactacttcactcgtgcagaggaggaagcaggcttggggaagacagtcctggctggagcagatctggaacgccgggccagtctgtcagtctacagcggaggctgccgcgttagaaagagagctgctggaagactacaggttcggaaggcagcagttggtcgagctgtgcgggcacgccagtgcagtcgctgtgacaaaggccttccccttgcccgccctctctagaaaacagcgaacggtgcttgttgtttgtggacccgagcagaatggtgccgtgggcctcgtgtgcgcaaggcacctgcgggtcttcgagtacgagcccaccatcttctatcctactcgttccctggacctgctacatcgggatttaacaacccagtgcgagaaaatggatatccctttcctgtcataccttccaactgaagtacagcttatcaacgaagcatacggattagttgtagacgctgtactgggacctggcgttgaacctggcgaggttggcggaccctgtacccgcgcgctcgcgaccctgaaattgctgtccattccactggttagcctggacatccctagtggctgggacgcggaaacgggatctgatagcgaagatggcctgagacccgatgtgttagtttctcttgcagcaccaaaacgatgcgcgggccgattcagtggacgccatcatttcgtagccggccgatttgtgcccgacgatgtgcgccggaaattcgcactccgcctccccggttatacaggcacggattgcgtagccgccctgtag

SEQ ID NO: 34920 - DNA, 822 bp, Artificial Sequence
  Description of Artificial Sequence: Synthetic coding sequence
atggccgccagtaaggttaagcaggatatgcccccaccaggcgggtatggacctattgactacaagcggaacctcccaagaaggggcttatcaggctactcaatgcttgcaatcgggatcggtaccctgatctatggtcattggtctattatgaaatggaatagggagcgcaggagattgcagatcgaagacttcgaagctaggatagcattgttgcccctgctgcaggccgaaacagaccgccgcacccttcagatgcttagagagaacctcgaggaagaggcgatcatcatgaaggatgtgcccgactggaaggcatttccactcccagccttgtcccgcaagcagcggacagtgctagtcgtgtgcggccctgagcagaatggagccgtaggcttggtgtgtgcaagacatcttcgggtgtttgagtatgagccgacaattttttaccccacgagaagcctggatctattacacagagacctcactacacagtgtgagaagatggatattcccttcctctcctatctgcccactgaggtgcagctgataaacgaagcatacggccttgtcgtggatgcggtattgggtcccggggtcgaaccaggcgaggtggggggcccctgtacccgagctcttgccacattgaaattgctgagcatcccactggtcagtcttgatataccttctgggatgcctggaagggggggccacataggagcctggggtgcctgggttgaggcccctgttccccagttattggtcgcccccgcctgtctcaatctgaacctgccctcactggacggccccacactcggatag

SEQ ID NO: 34921 - DNA, 507 bp, Artificial Sequence
  Description of Artificial Sequence: Synthetic coding sequence
atggaattcgtgccaggaggtagtatctcatcaatcataaatcgcttcgggccgctccccgaaatggtgttttgcaagtatactaagcagatcctgcaaggggtggcttacctgcacgagaactgtgtggtccaccgagacatcaaaggaaacaatgtgatgctcatgcccacagggattatcaaactgattgattttggctgcgcaaggaggttggcttgggcggggctgaacggaacacattcagatatgttgaagtccatgcatgggactccatactggatggccccagaggtcatcaacgaatccgggtacggccgaaagtccgatatctggagcatcggttgcactgtctttgagatggctacaggaaagcctccgcttgcatcaatggaccggatggctgccatgttctacatcggagctcatcgggggctgatgccccccctgccagaccattttagtgagaatgccgccgatttcgtgcggatgtgtctcactcggtag

SEQ ID NO: 34922 - DNA, 3648 bp, Artificial Sequence
  Description of Artificial Sequence: Synthetic coding sequence
atgagttccatgcctaagcctgaacgacatgccgaatcactgctagacatatgtcacgacaccaattctagtcctaccgaccttatgacagtaacaaagaaccagaacattatcctgcagtctatcagtagatcggaagagttcgatcaggatggcgattgcagccacagcaccctggtaaacgaagaggaggatccttccggtggcaggcaggactggcagcctagaactgaagaattttcaactagccatatgaagtattcaggtaggtccattaagtttcttttacctcccctgtctctactgccaacaaggagcggtgtactcaccattccccaaaatcacaagttcccaaaggagaaggagcgaaatatcccatccttgacttcctttgtacccaaattgtccgtgagcgtgcgacagagtgacgagttatcaccatcgaacgaaccaccaggagccttggtcaaaagcttgatggacccaaccctgcggagtagcgacgggtttatttggtcccgcaacatgtgttctttccctaagacaaaccaccaccggcaatgcctggagaaagaagaaaactggaaatccaaggaaatcgaggagtgcaataagattgaaattacgcacttcgagaaagggcagtctctcgtgtcctttgaaaatctgaaagaaggcaatatccccgcagtgcgggaagaggacattgactgtcacggcagcaaaacaagaaaacccgaggaggaaaacagtcagtacttgtccagcagaaaaaatgagtctagcgtcgctaaaaattacgagcaggaccctgagatagtctgcactataccctctaagttccaggagacgcaacacagcgaaataacccctagtcaggatgaggagatgcgcaataacaaagcggcctcgaaacgagttagcctgcataagaatgaggcaatggaacctaataatattctggaggagtgtactgtgttgaaaagtctttccagcgtcgtgttcgatgacccgatcgacaagctcccggagggttgctcctccatggagaccaatataaagatatccattgccgagcgcgccaagcctgagatgtcacggatggtcccactcatccacatcaccttccctgtggatggatcccctaaagagccagtcatcgctaagccatccctacagacacgtaaaggtacaattcataacaaccactccgtgaacatacctgtgcatcaggaaaatgacaagcacaagatgaattcacacagatcaaaactggattctaagacgaagacatccaagaagactcctcaaaacttcgtgatttctaccgagggccctatcaagccaacaatgcataagaccagtatcaagacacagatattccctgctctcgggctggtggatccccgaccctggcagctgccccggtttcagaaaaagatgccgcagatagcgaaaaagcagtccacccatcggactcagaaacccaaaaaacaatccttcccgtgcatctgtaaaaatcccgggacacagaaaagttgcgtgcctttgagtgtgcagcctacagagccccgattaaactatctggacttgaaatacagcgatatgttcaaagagatcaacagtacagcgaatggtcccggcatctacgaaatgtttgggacacccgtttactgccatgtgcgggagacagagcgtgacgaaaatacctattacagggaaatctgcagcgcaccttccggtagaagaatcacgaacaagtgccgctccagtcactccgaacgcaaatcaaacatccggacaagattgtcacagaagaagacacacatgaagtgccccaagacatcctttggcattaagcaggagcataaggtgctgatcagcaaagaaaaaagcagcaaggctgtgcactccaatctacacgacattgaaaatggagacggaataagcgaacctgactggcagattaagtcttcaggcaacgagttcctaagtagtaaagatgaaatccaccctatgaatctggcccaaacacctgaacagagtatgaaacaaaatgaatttccccctgtatcggacctctccatagtcgaagaggtttctatggaggagtcaactggggacagagacatttccaataaccaaatcctcaccaccagcctccgcgatctccaagagctggaggagctgcaccaccagatcccttttatcccgagcgaggattcttgggctgtgccttctgagaagaattctaacaaatatgtccaacaggagaaacaaaatactgcctccttaagtaaggttaatgcctctcgaatcctgacaaatgacttggagttcgactcagtgagcgatcactccaagactctgaccaacttcagttttcaggcaaagcaggagtccgctagcagccagacatatcagtactgggtccactacttggaccacgacagtcttgccaacaagtccattacttaccagatgtttggtaagactctcagtggcaccaatagcataagtcaggagattatggattccgtgaacaacgaggagcttactgatgagctgttgggatgcctggctgcagagctactcgcccttgacgaaaaggacaacaattcgtgccagaaaatggccaacgaaacggaccctgaaaacctcaatctggttctgagatggagaggatccacgcccaaagagatgggccgagaaacgacaaaggtgaaaatccaaaggcattcctctggtctgcggatctacgacagagaagagaaattcctgatttccaatgagaagaagatattttctgagaattctctcaagagcgaggagcctatcttgtggactaagggggagatcctcggaaagggggcttatggcaccgtctactgtggactcacaagtcaagggcagctgatcgctgtcaaacaggtcgccttggatacttccaacaagctggccgcggaaaaagagtacagaaaactgcaggaagaggtcgatctgcttaaggctctcaaacatgttaatatcgttgcatacctaggcacttgcttgcaggagaacacggtgagcattttcatggaattcgtgccgggcggttcaatttcctccatcattaatcgcttcggcccactgcccgaaatggtcttttgtaagtatacgaagcagatcctgcagggggttgcctatctccacgagaactgcgtagtgcatcgggatattaagggcaacaatgtaatgcttatgcctacagggatcataaaactcatcgacttcggatgcgctcggcgcctagcttgggccgggctgaacgggacgcactccgacatgctgaagtcaatgcatggcacaccctactggatggcacccgaggtgatcaatgagagcggatacggtaggaaatccgatatatggtccataggctgtactgtgtttgagatggccactggaaaaccaccactggcttcaatggatcgtatggcggctatgttctacatcggggcccatcggggattaatgcctcccttgcctgatcacttctcggagaacgctgccgactttgtgaggatgtgtctaacacgtgaccaacacgagaggccatccgctcttcagttgctcaaacattctttcctggagagaagtcactag

SEQ ID NO: 34923 - DNA, 1533 bp, Artificial Sequence
  Description of Artificial Sequence: Synthetic coding sequence
atgtcatccatgccaaagccggagcgccatgctgagagtctgctggatatttgtcatgatactaactcgagtcccactgacttgatgactgtgaccaagaaccagaatataattttgcagagcatcagcaggtcggaagaattcgaccaagatggcgactgtagccacagtacattagtgaacgaagaagaagatcctagtggcgggcgacaggattggcaaccacggaccgagggcgttgagatcaccgtgacatttccacgagatgtttcacctccccaggaaatgagccaggaggatctcaaagagaaaaatctgatcaattccagtttacaagagtgggcccaagctcacgcagtttcacatccgaacgaaatcgaaaccgtggagctccgaaaaaaaaagctaacaatgcggccactggtccttcagaaggaggagtccagcagagagctgtgcaacgtgaacttgggcttcctgttgccccgcagttgtctggagttaaatatttcgaagtcagttacaagggaagacgccccacattttctcaaggagcaacagcgtaaatcagaggaattctccaccagccacatgaaatactctggtcgatcgattaaacgacactcatccgggctacggatatatgatagggaagagaaatttctgatctcaaacgaaaagaaaattttctcagagaattcccttaagtccgaagagcccattctgtggacaaagggagagatcttaggcaagggggcttacggtactgtctactgcggcctgacatcgcaggggcagcttattgctgtgaagcaggtggctctggatacttcaaataagctcgccgcagagaaggagtacagaaaacttcaggaagaagttgacctgttgaaagcattgaagcatgttaacatcgtggcgtatctcggaacttgcctccaggagaacacagtgtctatctttatggagttcgtcccagggggaagtatctctagcataatcaaccgtttcgggcctcttccggaaatggtgttctgcaagtacactaaacagatcctgcaaggcgtcgcctatttgcatgagaattgtgtggtgcatagagacattaaaggcaacaacgtgatgttgatgccaacgggcataataaaactgatcgatttcggatgcgctagaagactggcctgggccggtcttaacggaacacacagcgacatgctgaaatcaatgcacgggacaccctattggatggcaccggaagttatcaatgaatccggatatgggcggaaatcagatatatggagcattggctgtaccgtgttcgagatggcgacgggtaagccacccctggcttcgatggaccggatggctgccatgttctacattggtgcccatcgcggactgatgcccccactgccagaccattttagcgagaacgccgccgatttcgtgcgcatgtgcctcacacgtgaccagcacgagcgcccctctgccctgcaactgctgaaacattctttcctggagcgttctcattag

SEQ ID NO: 34924 - DNA, 3987 bp, Artificial Sequence
  Description of Artificial Sequence: Synthetic coding sequence
atgtccagtatgcccaagccggagcgacacgcggaaagtctgcttgacatatgccacgataccaattcaagccccacagatctgatgactgtgaccaagaaccaaaatataattcttcaatctattagcagaagtgaggaattcgatcaggacggggactgctcccatagcactctggtcaacgaggaagaagatccaagcgggggaagacaagattggcagcctaggacagagggcgtggaaattaccgtaaccttcccccgcgacgtctccccaccccaggagatgtcccaggaggaccttaaagaaaagaacctgattaactctagtctgcaggagtgggctcaggctcacgccgtttcacatccaaacgagatagaaaccgtggagctcaggaagaagaagttgacaatgagacctttagtgctgcaaaaagaggagtcaagtcgagagctatgtaatgttaatctgggatttctgcttccaaggtcatgtcttgaactgaacattagcaaatccgtgactagagaagatgctccacatttcctgaaggaacagcagcgcaagtcagaagaattctcaacaagccacatgaaatacagcggtcgctcaataaagttcttgctccctcctttaagcctcctgcctacccgctctggcgtgctgacgataccacaaaaccataagttccccaaagagaaagagcggaacattccctcattgacgtcctttgtgcccaaactgagcgtcagcgtgaggcagtcagacgagctctcccccagtaacgaaccaccaggggcacttgtcaaatctcttatggaccccacattgaggtcctcagatgggttcatctggagtagaaacatgtgcagcttccccaagactaaccaccaccgtcagtgtttggagaaagaggaaaactggaaatccaaggaaattgaggagtgtaacaaaatcgaaatcactcatttcgagaagggccaatcactcgtgtcgtttgaaaacttaaaggaaggaaatatccccgcagtcagggaggaggacatagattgtcatgggtcgaagacccgcaagccagaagaagagaacagccagtacctgtctagtagaaagaacgagtcaagcgtcgcaaagaattatgaacaggaccctgaaatcgtttgcacgattccgagtaagtttcaggaaacgcagcattctgaaatcacaccaagccaagatgaagagatgagaaacaacaaagcggcctccaaaagagtttccttacacaaaaatgaagcaatggaaccgaacaacatcctcgaagaatgtactgtgctcaagagcctcagcagtgtagtgttcgacgatcccatcgataaactacctgagggttgtagctccatggagactaacattaagatctctatcgcggaaagggctaagcctgaaatgtctcggatggtgcctctgatccatatcaccttcccagtagacggaagtccgaaggaaccagtgattgccaaaccctcgctgcaaactaggaaaggaactatccacaataatcactctgtcaacatacccgtgcatcaggaaaatgataagcacaaaatgaatagccatcggagtaaactcgacagcaagacaaaaacttctaagaaaacccctcaaaattttgtgatctcaaccgaaggcccaatcaagccaactatgcacaagacttccatcaaaactcagattttccctgccctgggcctcgtcgacccgcggccatggcagttgcccagatttcagaagaagatgccacaaatcgcaaagaaacagagcacccaccgcacccagaagcccaagaaacaaagctttccctgcatttgcaaaaatcctggcactcaaaagagctgtgtccctctgtccgtccagcctacagagcctagactgaattatttggacctgaaatacagcgacatgtttaaggagattaattcaactgcgaatggaccaggaatctatgaaatgtttgggactcccgtgtactgccacgtgagagaaacggagagggatgagaacacatactaccgggagatctgcagtgctcccagcggcagaaggataactaacaagtgcagatcatcgcatagcgaaagaaagtctaatatccgaacaaggctgagccagaagaagactcacatgaagtgccccaagacctcattcgggatcaagcaagaacacaaggttctcattagcaaagaaaagagcagtaaggccgtgcacagtaaccttcacgacatcgagaacggagatggtatctcagagcctgactggcagataaagtcaagtggcaatgagttcctgagctctaaggacgagatacatccaatgaatttggcacagacgcctgagcagtccatgaaacaaaacgaatttcctccagtgagcgacctttctattgtggaggaggtgagtatggaggagtcaacaggcgaccgagacatttccaacaaccaaatcctgacaaccagcttgagagatctgcaagagctagaagaactgcaccaccagattccattcattcctagtgaggacagctgggcagtgccctcggaaaagaattcaaacaagtatgtacagcaggaaaaacagaacaccgcctctctcagcaaagtgaatgcaagtcggatattgaccaatgatctggagttcgatagcgtgtctgaccactctaaaaccctgacgaacttttcgtttcaagccaagcaggaatcagcttcttcgcagacctatcagtactgggtccattacttggatcacgacagtctggcaaacaaatcaatcacctaccagatgtttggcaaaaccttatcaggcactaattccatttcccaggaaattatggactcagttaacaatgaagaactcactgacgaactgctgggctgtctggcagctgagctgctggccctggatgaaaaagataataatagttgccagaaaatggcgaatgagacggaccccgaaaatctaaatctggtcctcagatggcgcggcagcaccccgaaggaaatgggtagagaaactacaaaagtaaagatccagaggcactcgtccggtcttcgaatttatgaccgcgaagagaagtttctcatttccaacgaaaagaagattttcagcgagaactctttgaaatcagaagagcccatcctgtggactaaaggtgaaattctgggtaaaggagcatatggaaccgtgtattgtggcctgacgtcccaaggacaattgatcgcagttaagcaggtcgccctcgacacctccaacaaactcgcagcagagaaggagtataggaagttgcaggaggaagtggatctgctgaaagctctgaagcatgtgaacattgttgcctatttggggacatgtctccaggaaaacaccgtctccattttcatggagtttgtgcccggcggaagcatatcctccatcatcaataggttcggtcctttacccgaaatggttttttgcaaatatacaaagcagattctccaaggtgtcgcatacctgcatgagaattgcgtggtgcatcgcgacatcaagggtaacaacgtcatgcttatgcctacgggcattattaagttgatcgatttcggttgtgcacggaggctggcatgggctgggctgaatggcactcattccgatatgctgaagtctatgcatgggaccccttactggatggccccagaggtgattaatgaatccggctacggacgtaaaagtgacatctggtcaatcggctgtacggtctttgaaatggccactgggaagccaccactggctagcatggacaggatggctgctatgttttatatcggcgcacacaggggcctgatgcccccccttccagatcatttcagcgaaaatgctgcagactttgtgcgcatgtgtctgaccagagaccaacatgagagaccgagtgcactgcagctgttgaagcacagcttcctggagaggtctcactag

SEQ ID NO: 34925 - DNA, 1383 bp, Artificial Sequence
  Description of Artificial Sequence: Synthetic coding sequence
atgtcttctatgcctaaacccgagaggcacgccgagagcctacttgatatttgccatgacacaaattccagccccactgacctgatgactgtcaccaaaaatcagaatattattctgcagagtatctctcgcagcgaagagtttgaccaggatggcgactgttcccacagcacgttagttaacgaagaagaggatccgtcaggcggtcgccaggactggcagcccaggactgagggcgtggaaataactgttacatttccaagggacgtctctcctccccaggaaatgtcacaagaggatctgaaggaaaagaacctcatcaacagtagcctgcaggaatgggcacaggcccacgcggtgagtcatccaaatgagatagaaaccgtggagctgcgtaaaaagaaactcacgatgcggccactcgtcttgcagaaagaagaaagtagtcgcgagctttgcaacgtgaacctaggcttcctcctgccgcgatcctgcctggagctgaatatctcgaagtccgtaacccgggaggatgcgccccacttcttaaaagagcagcaacggaagagcgaggaatttagcacctctcacatgaagtattccggccgttctatcaaggtgtactgtgggctaacctcccaggggcaacttatcgccgtgaagcaggtggccctggatacgtccaacaaattggccgcagagaaagaatatcgaaagctgcaggaggaggtggatctgttgaaagccctcaagcatgtgaacatcgtggcctatctgggtacttgtctgcaggagaatactgtgtctatattcatggagttcgttcctggcggctcgatttccagcattataaatcgattcggccccctgcctgaaatggttttctgcaaatacacaaagcagattctacaaggcgtggcttacctgcacgaaaactgtgtggtgcaccgcgatataaagggtaacaatgtgatgctcatgccgacggggatcatcaaactcatcgactttggttgcgcacgcagacttgcatgggctggactcaatgggacgcactccgatatgctcaaaagtatgcacggcacaccatactggatggctccagaggttatcaacgagagtggctatggtcgtaagtccgacatctggagtattggctgtaccgtgttcgaaatggccaccggcaagccaccgttggctagcatggacaggatggcggctatgttctatattggcgcccatcggggtctgatgccgccattgcccgaccactttagcgaaaacgccgcagacttcgtaaggatgtgtctgacacgtgaccaacatgaacgccccagcgccttgcagttgctgaaacactccttcctggagcggagtcactag

SEQ ID NO: 34926 - DNA, 1389 bp, Artificial Sequence
  Description of Artificial Sequence: Synthetic coding sequence
atgtctagcatgcctaagcccgagaggcatgctgagtcgttgctagatatatgtcatgatacgaattcctcaccaacagacttgatgacagtgactaagaaccaaaacattatcctgcagagtatttcccgcagcgaagagtttgaccaagatggtgactgctcacacagcaccttggtgaacgaggaggaggaccccagcggtggtcgccaagattggcagccaagaactgagggggtggagattactgttacctttccaagggatgtgagccctcctcaggagatgtcccaggaagacctcaaagagaagaatctgatcaatagtagcctccaagagtgggcgcaggcccacgcagtgagccatccaaacgagattgagaccgtcgaattgcgtaaaaagaaactgactatgcggcccctcgtcctgcagaaggaagaatcttctcgggagctatgcaacgtgaatctgggatttctgctcccgagatcttgcttagagctaaatatctcaaagagcgtaacccgcgaagacgcccctcatttcttgaaggagcagcagcggaagtccgaagaattcagtacctcgcacatgaagtattccggtcgctccatcaagaggcatagcagtggcctgaggatttacgaccgggaggagaaatttctcatttctaacgagaaaaaaatcttttctgagaacagtcttaagtccgaagagccaatcctgtggactaaagtcgacctgttaaaggctcttaagcacgtgaatatagtagcttacctaggaacttgcctgcaggagaacaccgtgtccatcttcatggagttcgttccaggaggttcaattagcagcatcattaatcgctttggcccacttcccgaaatggtcttctgcaagtacacgaagcagattctgcagggcgtggcatatttgcacgaaaattgtgtcgtacacagggacattaagggcaacaatgttatgctgatgcccactggaattatcaaactcatcgactttggttgtgccaggcgcttggcgtgggcgggattaaatggaacacactccgatatgctgaagagcatgcacgggacgccctattggatggcccctgaggtgattaatgagagcggatacggaaggaaatccgacatctggtctatcggatgtaccgtttttgagatggctactggcaagccacccttggcaagtatggatcggatggctgccatgttttacatcggcgctcatagagggttgatgccacccttgcccgatcacttctcggagaacgcagccgacttcgtgagaatgtgccttaccagggatcaacacgagcggcccagcgcactccagctgcttaagcattcctttctcgagcgtagccattag

SEQ ID NO: 34927 - DNA, 2094 bp, Artificial Sequence
  Description of Artificial Sequence: Synthetic coding sequence
aaacagagttttccctgcatctgcaaaaacccaggaacccagaagagctgcgtcccactgagcgtccagccgaccgagcccagactgaattacctagacctgaagtactccgacatgttcaaggaaatcaatagcacagcgaatggacctgggatctatgagatgtttggcacaccggtgtactgccatgtgcgggaaaccgagcgcgatgagaacacctattatcgcgagatatgcagtgccccgagtggtagacggattactaataaatgccgtagttcccactctgaacggaaaagtaatatcaggacacggctgagtcagaagaagacacacatgaagtgcccgaaaaccagttttgggatcaaacaagagcataaagtactgattagcaaagagaaatcttctaaagccgtacatagtaacttgcacgatatcgagaatggcgatgggattagcgaaccagattggcagattaagagctccggtaatgaattcctctcatccaaagacgaaattcacccaatgaatttagctcagaccccggagcagtcaatgaaacagaatgagttcccccccgtctcagatctgtctatagttgaagaggtgtctatggaagagagtactggggaccgagacatctccaacaatcagatcctgacaacgtccctcagggacctccaggaactggaggaactccatcaccagattccctttatcccatccgaagatagctgggccgtgcctagcgaaaaaaattcaaataaatatgtgcagcaagagaaacaaaacacagcctctctttcaaaagtgaacgctagcaggatcctcaccaacgacctggaatttgacagcgtgagcgaccactctaagaccctgacgaacttcagcttccaagcaaagcaggagagcgcttcttcccaaacatatcagtattgggtccactatctggatcacgattccttagccaacaagtccattacttaccagatgttcgggaaaaccttgtctgggacgaactcaatttcccaggagatcatggattcagtcaacaacgaggagctaacagacgaacttctaggctgtctggcagcagaattattagccttggacgaaaaagacaacaacagctgtcagaaaatggccaacgagacagacccagagaatctgaatttagtactccgatggagaggcagcacacccaaggaaatgggccgtgaaactacgaaggtgaaaattcagcggcatagctctggtcttcgcatctacgatagagaggaaaagtttctcatatccaatgagaaaaagattttttctgagaattcgctgaagtccgaggagcctatcctatggacaaagggtgagatcctgggcaagggtgcgtacggcactgtctattgcggccttactagccagggccagctgatcgcggtgaaacaggtcgcccttgacacctctaacaaactggccgctgagaaggaatacaggaaactgcaggaagaggtcgatctgctgaaggcactgaagcacgttaatatcgtggcatacctcggtacgtgtctgcaagaaaatacagtcagcattttcatggagttcgtccccggtggctccatcagcagtattattaaccgttttggtcctctcccagaaatggtcttctgcaagtatacgaagcagatcctgcagggggtggcctacttgcacgagaattgtgtggttcatcgggacatcaaagggaacaatgtcatgctgatgccgactggaatcattaaactgatcgactttggctgtgccagacggcttgcgtgggctggacttaacggcacccactctgacatgctcaagagcatgcatggaacgccttattggatggctcccgaagtaataaatgaaagcgggtatgggcgcaagtcagacatctggtcaatcggatgcactgtcttcgaaatggcaacaggtaagcctcctctggcctcaatggaccggatggccgccatgttctatatcggagcgcatcgaggactaatgccccctctcccagatcactttagtgagaacgctgcggacttcgttcgcatgtgtctgacaagatag

SEQ ID NO: 34928 - DNA, 4293 bp, Artificial Sequence
  Description of Artificial Sequence: Synthetic coding sequence
atgtccagaccatctagtgtgtcgcccaggcagccagccccaggtgggggggggggcggtggtccatccccttgtggccctggcggcggcggacgtgcaaaaggcctgaaggacatcaggattgacgaggaagtgaagattgctgttaacatcgctctggaacgattccggtatggtgatcaacgggagatggagtttccttcaagtctcacttctacagagagggccttcatccaccggctaagccaatcgttgggactggtttccaagtctaaagggaaaggtgctaaccgatacctcacagtcaagaagaaagacggatctgaaactgcccatgcaatgatgacatgtaacttgacacataatacaaaacatgccgtgcgaagtctgattcagagatttccagtcacgaacaaggagcggactgaactgctccctaaaacagaacggggcaacgtgttcgccgttgaggcggagaatcgcgagatgtccaagacctcagggaggcttaataacggtataccccagatcccagtgaaaaggggggaaagcgagttcgactcatttcggcagtcccttcccgtctttgaaaagcaagaggaaattgttaagatcattaaggagaataaggtggtgcttattgtcggggagaccggcagcggaaaaacaactcaaattccacagtttttgctcgacgactgtttcaagaatggtataccatgtcggattttctgcactcagcctcgcagactcgcagccattgccgtcgccgaaagggtggccgccgagcggcgagaacgtattggacaaacaattggctaccaaatacggttagaatccagagtcagccctaagaccctccttacgttctgtaccaatggggttctcttacgaaccctgatggctggtgattcaactctgtcaacggtgacacacgtcattgtggacgaagtccacgagcgggataggttctctgacttcctcttgaccaagctcagggaccttctacagaaacatcccacactgaagttgatcctctcctccgccgccctggacgtgaatctgtttatccgatactttggatcttgtccagtgatttacattcagggccgaccttttgaagtgaaggagatgtttttggaggatattctgagaacaacaggctacacaaataaagagatgctgaagtataagaaagagaagcaacaggaagagaagcaacagactacacttaccgaatggtactcagctcaggaaaactccttcaagccagaatcacagcggcaaaggactgtcctgaacgtcactgacgaatacgatctgttggacgacggtggagacgctgtcttttcccaactgacagaaaaggacgtgaattgcctggaaccttggctgatcaaagagatggacgcgtgtctgtcagatatttggttgcataaagacattgacgcgttcgctcaggtgttccatctaatcctgaccgagaatgtgtcagtagattatagacactccgagacaagcgcaacagccttgatggtcgctgccggaagaggctttgcgtcccaagtggaacagttgatttcaatgggtgctaacgtgcattccaaggcttctaatggatggatggccctggattgggccaaacacttcggacaaaccgaaatcgtagacctgctggagtcctacagcgctaccctggaatttggaaatctcgatgagagttcccttgtccagaccaacggatccgacctgagtgccgaagatcgcgaactgctgaaagcttaccaccatagcttcgacgacgagaaggtggacttggatctcatcatgcatctgctctacaatatctgtcatagctgtgatgcgggcgctgttctcatcttcttgccaggatacgacgaaattgttggtttgagagatcgtatcctgttcgatgataagagatttgccgactccacacaccggtaccaggtttttatgttgcacagcaatatgcagacaagcgatcaaaagaaggtattgaagaacccacccgccggtgtgagaaagataattctgagcacaaatattgccgaaaccagcatcactgtgaacgacgttgtgtttgttatcgattctggcaaagtcaaggagaagtccttcgacgcactcaacttcgtaacaatgctgaagatggtgtggattagcaaggcaagtgcaatccagcgtaagggccgggctggcaggtgcagacctggaatctgttttcgactattttctcgcctgagattccagaatatgctcgaattccaaacacccgagctgttacgcatgcctttgcaggagttatgcctgcacaccaaattactggctcctgtgaattgcccgattgccgactttcttatgaaagcccccgagccacctcccgcactgattgtcaggaacgcagttcagatgcttaaaaccattgatgcaatggatacatgggaagacctaacggaacttggctaccacctggcagatctcccggtggagccacacctgggcaaaatggtactgtgtgcagtggtgctcaagtgcttggacccaatcctgactattgcttgcacacttgcctaccgtgacccattcgtcctgccgacgcaggccagtcaaaagcgtgccgcaatgctctgcaggaaacgattcaccgctggcgccttttccgatcacatggcacttttaagagcttttcaagcttggcagaaggcccgcagcgacggctgggaacgcgcgttctgcgagaaaaattttctgagccaagctactatggagattattatcggcatgagaacgcagctgttggggcagctgcgtgcatccggattcgtccgtgcgcgtggaggaggcgacatcagggatgtgaataccaacagtgaaaattgggccgtagtgaaggccgcactggtggccgggatgtaccccaatttggtccatgtcgacagggaaaacctggtgttgaccggcccaaaggagaaaaaagtacggtttcatcctgccagcgtgctttcccaaccacagtacaaaaagatccctccagcgaacggccaggccgcagcaattaaagccctgccgacggactggctaatttacgacgagatgacacgggcgcacagaattgctaacattcggtgctgctcggctgttacacctgtcacgatccttgttttctgtggacccgccagacttgcgtcgaacgcattgcaagaaccatcatcttttcgcgtggacggcatccctaacgacagttctgattccgaaatggaggataaaacgacggccaatcttgctgcgcttaagttagacgagtggctgcacttcaccttggaaccagaggctgcgtccttgctcctgcagctacgccagaagtggcactctctatttctccggaggatgcgagcgccctcaaagccatggtcccaggtcgacgaggctacgatacgcgcaattattgcagtgctgtccactgaggaacagagtgctggtctacagcagccctcagggatcggacagaggccaaggccgatgtccagcgaagaattgccactggctagctcttggcgttctaataatagtagaaagagttcggctgatacagagttttcagacgagtgtacaactgccgaaagggtcctgatgaaaagccccagtccggctctacaccctcctcagaaatataaagacaggggtattctgcaccccaaacgcggcacagaggataggtctgaccagagttctctgaaatctacagattcatcttcttatccttctccttgcgcaagtccctcgccaccttctagtggcaaaggcagcaaatcaccctctcccaggcctaatatgccagtgagatatttcatcatgaagtcatcaaaccttagaaatcttgaaatatcacagcagaaagggatttggagtacaacacctagcaatgaacgtaagctgaaccgggcgttttgggaaagctccatcgtgtatttggtgttcagtgtgcagggcagtgggcatttccaggggttctctcgcatgtcgtccgaaataggccgtgagaagtctcaggactggggctccgccggcttgggaggcgtgttcaaagtggagtggatcagaaaagagtctctccctttccaattcgctcatcacctgctgaacccgtggaatgacaacaaaaaggtgcagatatcaagagacggccaagaacttgagcccctggtcggagagcaactcttgcagctctgggagcggcttccgctgggggagaagaacaccacagactag

SEQ ID NO: 34929 - DNA, 4023 bp, Artificial Sequence
  Description of Artificial Sequence: Synthetic coding sequence
atgctccgtaagggcgctaaccggtatctgactgtcaagaaaaaggatgggagtgagactgcacacgcaatgatgacatgtaaccttacccacaacacaaaacacgcagtgcgctcgttgattcaacggtttcctgtgacaaataaggaacggactgagctgcttccaaagacagagcgagggaacgtgttcgctgtcgaagctgaaaaccgggagatgagtaagacctctggacgtctcaacaacggcatcccccagatcccagtaaagaggggagagtcagaattcgattcctttaggcagagcctgcccgtgtttgaaaaacaggaggaaatagtcaaaataataaaggagaacaaggtggtcctcatcgtcggtgagaccggaagcgggaagacaacacagatcccacagtttttgctcgacgactgctttaaaaacgggattccttgccgcattttctgcactcaacctaggagacttgctgcaatcgccgtcgccgagcgagtcgcggcggagcggcgagagcggatcggtcagaccattgggtatcaaatccgcctggagtctcgagtttcacccaagaccctgctgaccttttgcaccaacggtgtgctcctgcgtacattaatggcgggagacagcaccttatccaccgtcacccacgtcatagtggatgaggtgcacgaacgggaccgctttagcgacttcctgctgacgaagcttagggatctgctgcagaaacaccctactctgaaactaattttatcaagcgctgcgctagatgtgaacctgtttatcagatactttgggtcgtgccctgtgatttacattcagggccggccgtttgaggtcaaagaaatgtttttagaagatatccttcggactacggggtatacaaacaaagagatgctaaagtataaaaaggagaagcaacaggaggagaagcagcagacaacattaacagaatggtacagcgcccaggagaatagttttaagcctgagtcccagcgacagcggaccgtgctgaacgtcaccgatgagtatgacctactcgatgacgggggggatgctgtgttctcgcagctgaccgagaaagacgtgaattgtctggagccatggctcatcaaagaaatggacgcatgcctgagtgatatatggctgcacaaggatattgacgccttcgctcaggtgttccacctaatcctgacggaaaatgtgtctgtggattacagacactcagagaccagtgcaactgctctgatggtggcggcggggaggggcttcgcatcccaggtcgagcagctgatctcgatgggtgccaacgttcatagcaaagctagcaatggatggatggcactcgattgggccaagcactttggacagactgaaattgtggacctgctggagagttactccgccaccctggaattcggaaatctggacgagtcaagcctcgtccagacaaatggaagcgacctgagtgccgaagaccgtgagctgttgaaggcttatcaccattctttcgatgacgaaaaggtggacctagaccttatcatgcatctcctctataacatctgccactcttgtgatgccggggcagtgctgatttttctcccagggtatgacgagattgtcggactgcgtgatcgaattctgtttgacgacaaacgattcgctgactctacacatagatatcaagtcttcatgctccacagtaatatgcagacttccgatcaaaagaaagttctaaaaaacccccccgcgggtgttcgcaagataattctatccactaatattgctgagacatccatcaccgttaacgatgtcgtgttcgtcatcgacagcgggaaggtcaaggagaaaagcttcgatgccctgaacttcgtaaccatgttgaaaatggtctggatctcaaaagcaagtgctattcaaaggaaaggaagagcagggcgatgtcgaccaggcatatgcttcagactgttctcaaggctgcgattccagaacatgctggagttccaaaccccagaactcctgcgtatgcctttacaggaactgtgtcttcatacaaagctgcttgcaccagtcaactgccccatcgccgattttttaatgaaggctccggaaccacctccggcactaatcgtccgcaatgccgtgcagatgttgaaaactatcgacgctatggacacctgggaggacctgaccgaactgggataccacctggcggacttgcctgtcgagcctcatcttggcaagatggtgttgtgtgccgtcgtgctgaaatgccttgatcctatcttaacaatagcctgcaccctggcctaccgagacccattcgtactgcctacccaggcctcacagaaaagagccgccatgctctgccgtaaaaggttcaccgcaggagccttcagcgatcatatggctctcctgcgagcgttccaggcctggcagaaagctcggtccgatgggtgggaacgggccttttgtgaaaaaaacttccttagtcaggccacaatggagattataattggcatgcggacccaactgttgggccagctgcgagctagcgggtttgtgcgagccagaggggggggggatatccgcgatgtcaacaccaacagtgagaattgggctgtggtgaaggccgcgttggtagccggcatgtatccaaacttggtccacgtggaccgagagaacctggttctcactggccctaaggagaagaaggtccggtttcatcctgcctctgttctttcacagcctcagtataagaaaattcctccggccaatgggcaggccgcagcaatcaaagccctcccgactgactggcttatctatgatgagatgacaagagcacatagaattgcgaacatccgttgttgcagtgctgtcacccccgtaaccatccttgtcttctgtggcccagccagactcgcgagcaatgccctccaagagccgagcagctttagagtggacggtattccaaacgactcatcggattcagagatggaagacaagaccaccgctaatctcgcagccctgaaactggatgaatggttgcattttaccctggaaccagaagccgcctccctgctgcttcagctccgccagaaatggcactcgctcttcctccgacggatgcgggcaccctcaaaaccatggtcccaggtggatgaggccacaatccgggcaattattgctgttctgagcacggaggaacagtcagccggactccaacaaccatccggaataggtcagagacctcgccccatgagctcagaggaacttcccctcgcttcgtcctggaggtctaacaacagccgcaaaagcagcgcggatactgagttcagtgacgaatgcacaacagcggaaagggtcctgatgaaatctccatcccccgctctgcaccctccccagaaatacaaagatagagggattctgcaccccaagcggggtactgaggatcgttctgaccagagttctcttaagtccaccgactcaagtagttatcccagcccgtgtgctagcccgagccctccatctagcggaaaaggcagcaaatcccccagtccccggccgaacatgcccgtccgatatttcatcatgaaatcgagcaatctacgcaatctggagatttcccagcagaaggggatctggagcactactccttccaatgaacgtaaactgaatagggctttctgggagtccagcatcgtgtacctggtgtttagcgtgcagggaagtggccactttcaaggtttctctcgcatgagtagtgagattggtagagaaaagagtcaggactggggctcagctggtctcggcggagtgtttaaggtggagtggatccggaaagagagtctgcctttccagtttgcccaccatctgctcaatccctggaacgataacaagaaggtgcaaatctcgcgcgacggacaggagctagaacctctcgtcggcgagcaattgttgcaactctgggagcgactgcctctcggcgagaagaacaccacagattag

SEQ ID NO: 34930 - DNA, 597 bp, Artificial Sequence
  Description of Artificial Sequence: Synthetic coding sequence
atgctgtttctcggatctctgggggcctggggaacaacttcaatcagcactgggagcatttttagcctgaagactctccggtcgcagcacggggggcaagtgggacttaaagtttcacgtccccgggcacctcggatgggagcagcgacccctactcctcgggccccatgggtggcccggtggctgatgggaagccaggccttcactgcgactccttctgctcggcctccacctccgccaattaagcataacatggatattgggacctgggataacaaaggccccgtccccaaggcccccgtgcctcagcaggcccccagcccccaagctgccccccagccccagcaggtagcccagcctttgcccgcccagccccccgctctggcccaaccacagtaccaatcccctcagcaaccccctcagaccagatgggtggcaccccggaacagaaacgccgctttcgggcagtctggcggagccggatctgatagtaacagccccggcaacgtccagcccaactccgcccccagtgtagagagtcatccggtgttggagaagctcaaagccgcccactcatacaatcccaaagaattctag

SEQ ID NO: 34931 - DNA, 1530 bp, Artificial Sequence
  Description of Artificial Sequence: Synthetic coding sequence
atgagtgatccttatctttcatcctattaccctcccagtattgggtttccatatagtctgaacgaagccccttggtccaccgctggtgatcctccaattccatacctgactacatacggtcagctatccaacggagaccaccattttatgcacgatgcagttttcggccaacccggcggccttggcaataatatttatcagcaccgctttaactttttcccggaaaatcccgccttttccgcctggggcacttccggatcacagggtcagcaaacacagtcatcagcttatggctccagctacacataccctccttcgtctctagggggaacagtggtcgacggccaaccaggcttccattctgacactctcagcaaggctcctggcatgaactcactggagcagggaatggtgggcctcaaaattggcgacgtgtcctccagcgcggttaagactgtgggaagtgttgtgagcagcgtggccctgacgggggtcctgtctgggaatgggggtaccaatgtcaacatgcccgtcagcaagcctactagctgggcagccattgcatctaaacccgcaaaaccacaacccaagatgaagaccaagtcggggcctgtgatggggggaggtctgcccccaccgcccatcaaacacaacatggacatcggaacctgggacaataagggacccgtcccgaaagcacctgtgccccagcaggccccaagcccacaggcagcccctcagccccagcaggtggcacagcccctgccggcccagccacccgctctggcacagccacaataccagtccccccagcagccgccccagactcggtgggtagccccccgtaaccgaaatgcagcttttggacagagtggaggggcaggcagcgattccaattccccgggtaacgtacagcctaattctgcccccagcgtggagtctcaccccgtgctggagaagcttaaggccgctcactcttataatcctaaggaatttgagtggaacctcaaatccggtcgcgtattcatcatcaaaagctatagtgaagatgacatccatcggtctattaaatattcaatctggtgcagcaccgaacacggcaataagcggcttgattcagcgttcagatgtatgtctagcaaggggcccgtgtacttgctgttctctgttaacggatctgggcatttttgtggggttgccgagatgaagagtcctgtggattacggcaccagcgccggtgtatggtcccaagacaagtggaaggggaaattcgatgttcaatggatttttgttaaagatgtcccaaacaaccagctgcgtcatatcaggcttgagaacaatgataataaacccgtgacgaactcccgggacactcaggaagtccctctcgagaaagcaaaacaggtcctaaagatcataagttcgtataaacataccacaagcatctttgacgactttgcgcactatgagaagcggcaggaagaggaggaggtcgttaggaaagagcgtcaaagccggaacaagcagtag

SEQ ID NO: 34932 - DNA, 1680 bp, Artificial Sequence
  Description of Artificial Sequence: Synthetic coding sequence
atgtccgcgaccagtgtcgatacacagagaaccaaaggtcaggacaacaaggttcagaacggctccctccaccagaaggataccgtgcatgataacgatttcgaaccctatctcactgggcagtctaatcaaagtaacagctacccgtctatgagtgatccgtatctcagtagttattaccctcccagtattggatttccttattctctgaacgaggctccatggtctaccgcgggggatccacccatcccttatttgactacgtacggacagttgtcaaacggagaccatcatttcatgcatgacgccgttttcggacagccgggcggactgggtaacaacatttatcagcacaggtttaatttctttcccgaaaatcccgctttttcagcctggggcacttcaggttctcagggccagcaaactcaaagttcagcttacggcagctcctatacctaccccccctcgagcctcgggggcactgtggtggatgggcagcctggatttcacagtgatacactgtcaaaagctcccggcatgaactctctcgaacaggggatggtgggactgaagatcggagacgtctcttccagtgctgtcaagactgtggggagcgtcgtgtcgagcgtggcattgacgggcgtcttgagtgggaacggcggcacaaatgtgaatatgcccgtcagtaagcccaccagctgggccgctattgccagcaagccggctaaacctcaacccaagatgaaaactaaaagtggcccggttatgggaggtggcctcccacccccaccaatcaagcacaacatggacatcggaacatgggataacaaagggcccgtccccaaggccccagtgcctcagcaggccccctctccccaagccgcacctcagccgcagcaggttgctcagccgctgcccgctcagccaccagccctggctcagccccaataccagagtccccagcaaccaccccagacccgctgggtcgcaccgcggaatagaaacgcagcatttggacagtctgggggggccggttcagatagtaatagtccaggaaacgtccaacccaacagcgccccgtccgtggaaagtcatcctgtccttgaaaagttaaaagccgcacactcatataatcccaaagaattcgagtggaatctaaagtcgggcagagttttcatcattaagagttatagtgaggacgacatccatagatccataaagtacagcatttggtgcagcaccgaacacggcaataaacgactagactccgcctttcgatgtatgagtagcaaaggaccagtgtatttgctgttttccgttaacggcagcgggcatttttgcggggtggccgagatgaagtctcctgtggactacggaacatccgcgggggtttggtcccaagataagtggaagggcaagtttgacgtccaatggatctttgttaaggacgtccctaataatcagttgcggcatatcaggttggagaacaacgacaacaagcccgtaaccaattctcgggacacccaggaggtgcctctcgagaaggccaagcaggttctgaagatcatttcatcatacaaacatactaccagcatttttgacgactttgctcattatgagaagaggcaggaagaggaagaggtggttaggaaagagcggcagtcacggaataagcagtag

SEQ ID NO: 34933 - DNA, 879 bp, Artificial Sequence
  Description of Artificial Sequence: Synthetic coding sequence
atgctgcgtaagctttggcagtggttctacgaggagactgagtcatcagacgatgtggaggtgctcacccttaaaaagtttaagggcgatctggcctatagacgtcaggagtaccaaaaagcgctgcaggaatatagctctatctctgaaaagcttagctctaccaatttcgccatgaaaagagatgtccaggaaggccaagccagatgtctcgcccatctcggaagacatatggaggcactggagattgccgcaaacttggagaacaaggccacaaatacagatcacctaaccacagttctttatctacaattagccatttgcagtagccttcagaatttggagaaaactattttttgtctgcagaagttgataagcttgcacccgttcaatccctggaattggggtaagctcgccgaggcttatttgaacctcggacccgcactttctgctgccctcgcgagctcgcagaaacagcatagcttcacctcaagtgacaaaactatcaaaagtttcttcccccattccggtaaagattgcctgctgtgttttcccgaaaccctccccgagtcatctttgttctccgttgaagctaactcaagcaatagccagaagaacgaaaaagctctcaccaatattcagaattgtatggctgagaagcgggagacagtgctgatcgagacccaactgaaggcatgcgcatctttcatcaggacccgccttttgctacagtttactcagcctcagcagacctctttcgccctggagcgcaacttaagaacacagcaggaaattgaggacaaaatgaagggatttagcttcaaagaggacactctcctgctcattgcagaggtttctgttagcttggggttcatgtag

SEQ ID NO: 34934 - DNA, 684 bp, Artificial Sequence
  Description of Artificial Sequence: Synthetic coding sequence
atggctgagctggatatcggccaacactgtcaggtggaacattgccgccagcgagacttcttacctttcgtgtgtgacgactgctccggcatattctgcctggaacacaggtctagggagtcacacggctgcccggaggtcaccgtgatcaatgagcgcctcaagacagaccagcatacaagctacccctgttccttcaaagactgcgcagagcgggagctcgtcgccgttatctgtccatactgtgaaaagaacttctgcctgagacaccgtcatcaatccgatcatgaatgtgagaaattggaaattcctaaacctcggatggctgctacccagaagctggtgaaagatatcattgactcaaagacaggcgagacagcatcaaagaggtggaagggcgccaagaactctgagacagctgctaaagtcgctctgatgaaactgaagatgcatgccgatggggataagagcttgccacaaacagaaaggatctactttcaggtgtttctccctaaaggcagcaaggagaaaagcaaacctatgttcttctgtcataggtggagcattggaaaagccatcgactttgccgccagcctggccaggttgaagaatgacaataataagtttacagcaaaagtgacttcacactataacaacatctcaattcttatcaaggtcctgtag

SEQ ID NO: 34935 - DNA, 786 bp, Artificial Sequence
  Description of Artificial Sequence: Synthetic coding sequence
atggcggagctggatatcggtcaacactgtcaggttgagcattgccggcagagagatttcttgccttttgtttgcgacgattgcagtggcattttctgcctggagcaccggagtcgggagtcgcacggatgtcccgaagtcacagtgatcaacgagcgcttgaaaacagaccagcacacctcctatccctgctccttcaaggattgtgctgagcgcgagctggtcgcagtgatctgtccttattgcgaaaagaacttttgtctgcgccaccggcaccagtcagatcatgaatgcgaaaagctggagatcccaaaaccaaggatggcagccacacaaaagctagtgaaagacatcattgattcaaagacaggtgagactgccagtaaaaggtggaaaggagccaaaaatagcgaaacagcagccaaggttgctttgatgaaactgaagatgcacgccgatggcgataaatccctgccacaggtctttctgccaaaagggagtaaggagaagagcaagcctatgttcttttgtcatcgttggagcatcggtaaggccatcgacttcgcagcaagtctcgctcgcctgaaaaacgataataacaaattcacagctaaaaaactaagactgtgtcacattaccagcggcgaagctctgcccctggatcatacgcttgagacttggatcgccaaagaggattgtcctctgtacaatggaggcaatattattctggagtatctgaatgatgaggagcaattctgtaaaaatgtcgagtcctatttggagtag

SEQ ID NO: 34936 - DNA, 3696 bp, Artificial Sequence
  Description of Artificial Sequence: Synthetic coding sequence
atgtgcaagtgctgtaacctgttcagcccaaatcagtctgagttgctgagccatgtgagcgagaagcacatggaagaaggcgtcaatgtcgacgagatcattatcccactgagacccctgtctacccccgaacctccaaacagcagtaaaaccggtgacgagttcctggtgatgaagcgaaagcggggacgccccaaaggatccaccaaaaagtcctcgacagaagaagaactggcggagaacattgtcagtccaacagaggactcacctttagctccagaggagggtaacagcctgcccccttcaagtctggaatgttcgaaatgttgcaggaagttttctaacactcgtcagttgcgcaagcatatttgcatcatcgttctcaacctaggcgaggaagagggcgaggcaggtaatgagagcgatctcgaacttgaaaagaagtgcaaagaagatgatagggaaaaagcctccaaacggcctcggtctcagaaaacagagaaggtgcaaaaaatctccgggaaggaggcaaggcagctgagtggagctaagaagccgattattagcgtggtgctcaccgcccatgaagcaatcccgggcgccaccaaaatcgtccccgtcgaggccggcccacctgagacaggtgccacaaactccgagactacaagtgccgatctggtgccaagacgcggataccaggaatacgccattcagcagaccccttacgaacagccaatgaagagcagtagattaggccccactcagcttaagatttttacttgtgagtattgtaacaaggtattcaaatttaagcactcattacaggcccaccttagaatccatacaaacgaaaagccttacaagtgcccgcagtgctcctacgcaagtgccatcaaagcaaacttgaacgtacacctgaggaaacatactggggagaagttcgcctgtgactattgcagcttcacgtgcttgtccaaaggccacctgaaagtgcatatcgaacgggttcataagaaaatcaaacaacactgcaggttttgtaagaagaagtactccgatgtcaagaacttgattaaacatattcgggacgcccacgacccccaagataagaaagtgaaagaggccttagatgagctttgcctgatgacgagagagggaaaacggcagcttctgtacgactgccacatctgtgagcgcaagttcaaaaacgagttagaccgcgaccggcacatgctggttcatggagacaagtggccgtttgcgtgcgagctatgcggacacggggcaaccaaataccaggctttggagttacacgtacgtaagcacccttttgtttacgtgtgtgcagtctgccgcaagaagttcgtcagttcaattcggctaaggacacatattaaagaggtacacggcgctgcccaagaggctctggtctttacttcaagcatcaaccagagtttttgcctgttggaacctggtggggatattcaacaggaggcacttggagaccagctgcagctcgtcgaggaagaattcgctctgcagggcgtgaatgctctcaaagaggaggcctgccctggggatacccagttggaggagggacgcaaggagccagaagctcctggagaaatgccagcccccgccgttcatctagctagccctcaggcagagagtacagcacttcctccgtgcgagctcgagactacagtcgtatcgtccagtgacctgcactcccaagaagtggtgagtgacgactttctgttgaagaacgatacttctagtgcagaggcacacgccgctcctgaaaagccccccgatatgcagcatagatcctccgtgcagacccagggcgaagtcatcactttgctgcttagcaaagctcaaagtgctggttccgatcaggaaagtcatggggcacagtcacctctgggagaaggacagaacatggcagtgttaagcgccggcgatcccgatcctagcagatgccttagaagcaacccagccgaagcctcggatctgctgcccccagtagcgggagggggcgatacaattacccaccagccagattcgtgtaaggctgcccctgaacacagatcgggcatcaccgccttcatgaaagtgctaaatagcctgcaaaagaagcaaatgaatacctcattgtgtgagcgaatccgaaaggtgtacggggacttggaatgcgaatactgcggcaaactattttggtaccaggtgcatttcgacatgcatgttcgcactcacacccgggagcacctctattactgctcacagtgccattattcgagtatcactaaaaattgtcttaagagacacgttattcagaaacatagtaatattcttctgaagtgccctaccgatggctgtgactattcaacacctgataaatataagctgcaagcgcacttgaaggtgcatactgcacttgataagcgaagctactcttgtcccgtgtgcgaaaagtcattctctgaagatcggctgatcaaatcgcatatcaaaacaaaccaccccgaggtgtctatgagcactatttcagaagttctggggcgcagagttcaactaaagggcttgatcgggaaaagggccatgaagtgcccttactgcgatttctactttatgaagaacggctccgatctgcaacgacatatttgggcccatgagggcgtgaagccgtttaaatgctccctgtgtgagtatgccactagatccaagagcaacttgaaagctcacatgaaccgccactctactgagaagacccatctatgcgatatgtgcggaaagaagtttaagtcaaagggcacactgaaatctcataagctcctgcataccgcagacggaaaacagttcaaatgtactgtgtgcgactataccgctgcacagaagccacaacttctcaggcacatggagcagcatgtgagttttaagcccttcagatgcgcccactgccactactcatgtaacatttctggttccctgaagcgccactacaaccgcaaacaccccaatgaagaatacgcaaatgtagggacaggcgagctggcagcagaggttctcatccagcaaggtggccttaagtgcccagtgtgttcttttgtttatggcacaaagtgggagtttaaccgccacctgaaaaataagcacggactcaaagtggtggagatagacggggatcctaagtgggaaacagccactgaggcacctgaggagcccagcacacaatacctgcacattaccgaggcagaagaggatgtgcaaggcacccaggcagccgttgcagcgctgcaagatttgcgctatacatccgaatccggtgaccggctcgaccccaccgccgttaacatcttacaacagattattgagctgggcgcagagacacacgatgctactgccctcgccagtgtcgtggccatggcaccaggtacggtcaccgtggtgaaacaggttacagaggaagaaccttctagcaatcacaccgtgatgatccaggagaccgtgcaacaggcctctgttgagctagccgagcagcaccacttagtcgtgtcatccgacgatgtggaagggattgaaaccgtgactgtgtacactcagggcggtgaggcctctgagtttatcgtttatgtacaggaagcgatgcagcccgtagaagagcaggccgttgaacagccagcccaggagctgtag

SEQ ID NO: 34937 - DNA, 1905 bp, Artificial Sequence
  Description of Artificial Sequence: Synthetic coding sequence
atggaaccgtctcctctgagccctagcggggccgcgctcccactcccactgtcactggccccccctcccctgcctcttcctgcagccgcagtcgtccatgtgtcattcccggaggtgacgtcagccctattggagtctctgaatcaacagcgtctgcagggccagctgtgcgacgtcagtattagggtgcagggccgagaattccgggctcatagagccgtgctggcagctagttccccatattttcacgaccaagtgctgctgaaggggatgacttccatctcgctacccagcgtgatggatcctggggcctttgagactgtgctggcctccgcttacacaggaagactgagcatggccgcagcagacattgtgaacttcttaacagtggggagcgtcttgcaaatgtggcatatcgtggataagtgcacagagctgctccgcgagggtagagcgagcgctaccacgacaataactaccgcggccgccacttcagtgaccgtgcccggggcaggagtccccagcggctctggcgggaccgttgcaccagctaccatgggatctgcccgcagccacgctagtagccgtgcttcagagaatcaatcccctagttcaagcaactatttctccccccgcgagagtacagacttctcttccagctctcaggaggcctttgccgccagcgcggttggtagtggcgagcgcagaggaggcggtcccgttttccccgcccctgtagtgggatccgggggcgccaccagcgggaagctgctgctcgaagctgatgagctatgtgacgacggaggcgacggtcgcggagccgtggtcccaggcgccgggctccgacgtcctacatacacccccccgagcatcatgccgcaaaaacattgggtgtacgtgaaacggggcggtaactgtcccgcgcctgctccccttgtgccccaggatccggacttggaggaggaagaggaggaggaggacctcgtgttgacttgcgaggatgatgaagatgaagagctcggcggttcctcccgcgtgcctgtgggcggcgggccagaggccacccttagcatttccgatgtcagaacgctctccgaacccccggacaagggagaagaacaagttaatttttgtgaatctagcaatgattttgggccttacgaagggggcggacccgtcgcaggcctcgatgacagtggtggacctacaccatcgtcatacgccccctctcatccaccacgacctctcttgcccctggacatgcagggtaatcagattctggtgttcccatctagttcatcaagcagtagttcacaggccccaggacagcccccaggtaatcaggccgagcacggcgccgtaaccgtggggggcacgagcgttgggtccttgggcgtgcctggatcagtgggaggtgtccccggtggaactggcagcggagacgggaacaagatctttttgtgtcattgcggcaaggcattcagccataaatctatgagagacagacacgtcaatatgcacctgaacctgaggccatttgactgtcctgtctgcaataaaaagttcaaaatgaagcatcatttgaccgaacacatgaaaactcacacgggcctaaagccctacgagtgcggagtttgtgccaagaaatttatgtggagagatagctttatgcgccatcggggccactgcgaaagaaggcatcgtcttgggggcgtgggagctgttcctggtcctggaacgcccaccggtccatccctgcctagtaaaagagaaagtccaggcgtgggcgggggatctggggacgaagcctccgctgcaacccccccatcttcaaggagggtatggtctcctcccagagtgcacaaagttgagatggggtttggcggaggggggggcgccaattag

SEQ ID NO: 34938 - DNA, 1905 bp, Artificial Sequence
  Description of Artificial Sequence: Synthetic coding sequence
atggaaccctcccccctatctcctagcggtgccgccttgcccctacccttgagccttgctcccccccccttgcctcttccggcagcggctgtggtgcacgtcagcttccccgaggttacttccgcattgctcgaaagcctaaatcaacagaggctgcaggggcagctgtgtgatgtcagcattagggttcagggccgcgagttccgcgcacatagggccgtcctggctgctagttcgccttattttcacgatcaggtcctgctgaaggggatgacatcaatctcactccctagcgtgatggaccctggcgcatttgagaccgttttagctagtgcctatacaggaagactatcaatggccgccgcagacatagtgaacttccttactgtcggttctgtcttgcagatgtggcacatagttgataagtgcactgagctcctgagagaagggcgcgcctcagccacaaccactatcaccactgctgctgccacctctgtcaccgttccaggcgctggggtgcctagcggctcaggcggtaccgtggccccggcgacaatgggttcggcaaggagccacgccagctctagggcctccgagaaccagagccccagtagttctaattacttcagccctagagagtccactgacttttccagttccagccaggaagccttcgcagcgagtgcagtcggctcaggagaaaggcgcgggggcggccctgtctttcccgcccccgtcgtcggatctggcggtgcgacgtctggtaaacttttgttggaagccgacgagttgtgtgatgatggtggcgatggaagaggggcagttgttccaggagcaggcctgaggaggccaacctacaccccaccttccatcatgcctcagaagcattgggtgtacgttaaacggggtggaaactgccccgcacccgcgccactggtcccacaggaccctgacctggaggaggaggaggaagaagaagatctggtcctgacctgcgaggatgacgaagatgaagagctcggaggcagctctagggtgccggtcgggggcgggcccgaggccaccctgtccatcagtgacgtgcgcaccctctcagaacctcccgataagggggaggagcaggtcaatttctgcgagtcgtctaacgattttggcccctatgagggcgggggtcctgtggctggactagacgattccggcggtccaacaccatcatcctacgcaccctcccacccccctaggcctctgttgcctctggatatgcagggcaatcagatcctggtgtttcctagcagcagttctagctcctcctcccaggcacctggacaacctccaggcaatcaggcggaacacggagctgtaacggtcggcgggaccagcgtcggtagcctgggggttcccgggagcgttggcggtgttcccggcgggaccggctcaggagatggcaacaaaattttcctgtgccactgcggcaaggctttctcgcacaaaagcatgagagatcggcacgtcaatatgcatttgaatctcaggcccttcgactgtcccgtctgtaacaagaaattcaagatgaagcatcatctgactgagcacatgaagactcacaccggcttgaagccctacgagtgcggggtgtgcgccaaaaagtttatgtggcgtgactcatttatgcgccacagggggcactgcgagcgccggcatcggctcggcggtgtgggtgcagtccccggcccaggaacccctactggaccatctctgcccagtaaaagagaatcacccggtgtgggcgggggatcaggggatgaagctagcgctgcaacgcctccttcctctcgacgcgtgtggagtcctcccagagtgcacaaagtggagatgggctttgggggcggcggcggcgcgaattag

SEQ ID NO: 34939 - DNA, 1905 bp, Artificial Sequence
  Description of Artificial Sequence: Synthetic coding sequence
atggaaccgagtcctctttcaccgagtggggccgccctacccctgcccctctctctagccccccccccccttcccctcccggctgctgccgttgtacatgtgtcattccctgaggttactagcgccctcctggagagcctcaaccagcaacggctgcagggtcagctgtgtgacgtctccattcgtgtgcagggccgcgagtttagagcccatagagcagtgctagctgcctcaagcccctattttcatgaccaagtgctcttaaaaggaatgacctccatctccctgccctcagttatggatcctggcgcctttgagaccgttctggcttccgcatacactggtagactaagtatggctgctgccgacattgtaaattttttaacagtgggcagcgtcttgcagatgtggcatatcgtcgataagtgcaccgagctgttaagagaggggcgtgcgagcgccacaaccacgatcaccaccgccgcagccacctctgtgaccgtccctggcgctggagtgccaagcggtagcggtggcacagtcgctcccgcaacgatggggagcgcccggtcgcacgcttcttctcgagcatctgaaaatcagtcaccttcgagcagcaactattttagcccaagggaatcaacagacttttcgtcaagttcacaggaggcattcgcggcaagcgctgtgggctcgggggagcggcgcggtgggggccctgtgttcccggcccctgtcgtcggttcaggcggcgccacgagtggaaaactgctgttggaagccgacgaactctgtgacgacggaggtgatggccgcggcgcagtcgtccccggagccgggctgagacgtcctacatacaccccgccaagcattatgcctcaaaagcattgggtctacgtcaagaggggcgggaactgcccagctcctgctcccctggtgccacaggaccctgacctggaagaagaggaagaggaggaagatttagtgttgacctgcgaagacgacgaggacgaagagctgggcggctcgagcagggtgcctgtggggggaggccccgaagctacactcagtatctcggatgtcaggaccctctctgagccacccgataagggagaagaacaggtgaacttttgcgaatcctcaaatgacttcgggccttatgaaggcggcggcccggtggcaggacttgacgactcgggcggccccacaccaagttcgtacgcccccagccatcctccacgcccactgctccccctcgacatgcagggcaaccagatcttggtctttccctcgagttcctccagctcgagctcgcaggcacccggacaacctccaggcaatcaggccgagcacggggctgtgactgtagggggaactagcgtcggtagcctgggggttcccggctctgtaggaggcgtcccagggggaactggatccggagacggcaacaagattttcctttgccattgcgggaaggcattttcacataagtccatgagggacaggcacgtcaacatgcacttgaatctccgcccctttgactgtccagtttgtaataagaaattcaaaatgaagcatcaccttaccgagcacatgaagacacacactgggcttaagccttacgagtgtggggtgtgtgcgaagaagttcatgtggcgcgattcatttatgcgccaccgcggccactgtgaaagaagacacaggctgggaggcgtgggagcagtgccaggtcctggcacccccactggaccaagcctgcccagtaaacgcgagtcaccgggcgtgggtggtggatctggcgatgaagcctctgccgcaacacctcccagttccagacgtgtgtggtcgcctccccgggtgcataaggtggagatgggatttgggggtggaggcggcgcgaactag

SEQ ID NO: 34940 - DNA, 450 bp, Artificial Sequence
  Description of Artificial Sequence: Synthetic coding sequence
atggagccctcccccctgtcgcccagcggagcagctctgccactccctttgtcccttgcaccaccgcccctgccgctcccagcggccgcagtggtccacgttagctttcccgaggttacctccgcgttgttagagagtctcaaccagcagcgcctccagggccagctgtgcgatgtgagcattagggtacaagggcgtgagttcagagcacacagggctgtccttgccgcatcttctccgtacttccacgatcaggtcctgctgaagggaatgacctctatctctttgccatcagtcatggacccgggcgccttcgagacagtgctcgcctccgcttacaccggtagattatccatggcagccgcggatatcgtgaatttcctgacagtcggtagtgttcttcagatgtggcacatcgtggataaatgcactgaactgctcagagaatag

SEQ ID NO: 34941 - DNA, 450 bp, Artificial Sequence
  Description of Artificial Sequence: Synthetic coding sequence
atggagcctagtccgctcagcccatccggcgccgccctgcctttgccgcttagcctggcaccgccccccttgccgctgcccgccgccgcggtggtccacgtgagctttcccgaggtgacatcagctctcctcgagagtcttaatcagcaacgcctccaggggcagctctgcgatgtctcaattagagtgcaggggcgagaattcagagcccatcgggcagttctggcagctagttcgccatatttccacgaccaagttcttctgaagggcatgacctcaatctctctcccaagcgtgatggacccaggtgctttcgaaaccgtgctcgctagtgcctatacagggagactgagtatggcagccgctgatattgtgaattttttaacagtgggaagcgtactgcagatgtggcatatagttgacaagtgtactgaactacttcgcgaatag

SEQ ID NO: 34942 - DNA, 450 bp, Artificial Sequence
  Description of Artificial Sequence: Synthetic coding sequence
atggagccgagtccactgtctccaagcggggcggctttacccctacctctgtcgctcgctccaccccctctgccattacctgcagccgccgttgttcacgtgtccttccccgaggtgaccagcgcactgctcgagtctcttaaccagcagaggcttcagggacagctgtgtgatgtaagcatccgggtacagggccgcgaattcagggcccacagggctgtgcttgccgcgtcttccccgtacttccacgaccaggtattgctcaagggtatgacctctattagtctcccctccgttatggaccccggcgccttcgaaactgtcctcgccagcgcatacacaggacggttgtcaatggcagctgctgatatcgtgaacttccttaccgtcggcagcgttctgcagatgtggcacattgtggacaaatgcacagaattgctgagagagtag

SEQ ID NO: 34943 - DNA, 1905 bp, Artificial Sequence
  Description of Artificial Sequence: Synthetic coding sequence
atggagcccagtcctctctcacccagtggagccgcactcccattgccactatccttggctcctccacctctcccattgccggctgccgctgttgtgcacgtgtccttccctgaggtgacatccgccctcctggagtccctgaaccagcaaagacttcagggccagctgtgcgacgtctcaatcagagtgcagggccgcgaatttagagctcacagagcggtgctggcagcatcaagcccgtatttccacgatcaggttctgttaaagggcatgaccagtattagtctgccgtcagttatggaccccggagccttcgagaccgtgctcgccagcgcctatactggtcggctgtctatggccgcggctgacatcgtaaatttcctgactgtcggctccgttttgcagatgtggcacattgttgacaaatgcactgaattactccgcgagggacgggcaagcgctaccacaaccatcaccaccgccgctgcaacaagcgttaccgtccccggggccggggtcccatccggttctggcggcaccgttgcgccagctaccatgggcagtgctcggtcacacgcaagttcccgcgcctccgagaatcagagccctagctctagtaactattttagccctcgagagtccacagacttcagctctagtagccaagaggcgttcgcggcgtctgcggttggcagcggtgaacggagaggtggtggacccgtctttcctgctccagtcgttggctccgggggagcgacctccgggaaattactgctcgaagctgatgaattatgtgacgacggtggggacggtcggggcgctgtagttcctggagccggcctgcgccgaccaacttacactccccccagcatcatgccacagaagcactgggtttatgtgaagcgaggtggcaactgtccggctcccgcccccttggtcccccaggatcccgacctggaagaggaggaagaggaggaagatctggtgctgacctgcgaagatgacgaagacgaagaattggggggttcctccagggtaccagtcgggggcggtcccgaggcaaccctgtctatctcagatgtgcgaactttgagtgagccccctgacaagggcgaggaacaggttaatttttgcgagtccagcaatgatttcggcccatatgaagggggagggcccgtagctgggctcgatgactccggagggcccaccccgtcgagttacgccccaagccatcccccacgaccactgcttccactcgatatgcaaggaaaccagatcctggtgttcccatctagttccagcagctctagctctcaggcccccggccagccacccggcaaccaggcagagcacggtgccgtgactgttggaggcacctccgtaggaagtctcggcgtgcccggctccgtgggcggagttccaggaggcactggaagcggcgacggcaacaagatcttcttgtgccattgtgggaaagctttcagccataaaagcatgcgagacagacacgtcaacatgcatctgaatttgcggccttttgattgccctgtgtgcaacaaaaaatttaagatgaagcatcacctaacagagcacatgaaaactcacaccggattgaagccttacgaatgcggggtttgtgccaaaaagttcatgtggagagattcttttatgaggcatcggggacattgtgaacgaagacatcgcttgggcggggtgggggctgtccctggccctggtacacccacagggccaagcttaccatcaaagcgagaatcgcccggcgtgggcgggggcagcggggacgaggcctctgccgcaactcctcctagcagccggagagtgtggtcgccaccgagagttcacaaggttgaaatgggcttcggagggggtggaggtgctaactag

SEQ ID NO: 34944 - DNA, 1905 bp, Artificial Sequence
  Description of Artificial Sequence: Synthetic coding sequence
atggaaccctctcccttgagcccttctggtgccgcccttcctcttcctctctcactggctccccctcccctgcctctccccgccgctgccgtagtacacgtatcctttccggaagtcacctctgctctactggagagtctgaatcaacagaggctccaaggtcaactctgcgatgtgagcattcgtgtacaaggtcgcgagttcagagcacacagagccgtccttgcagcatcaagcccatacttccacgaccaggtgctactcaaaggcatgacatctatatctctcccctcagtcatggatcctggagcatttgagacagtactcgcctcagcctatacaggacggctgtctatggcagcggctgatatcgtgaacttcttgacagtcggctctgtactccaaatgtggcacatcgtggacaagtgtaccgagcttctgagggaggggagagcttccgccaccacaacaataacaacagctgccgcaaccagtgtcactgtgcctggtgccggggtgccttccgggtctgggggaaccgtagctccagcgacaatgggctctgcccgctctcacgcttcttccagagcgtccgagaaccagtctcccagttcaagcaattacttctcacctcgagaatccaccgatttttctagttcaagccaggaagcctttgccgccagtgctgtggggtctggggaaaggcggggtggcggtccagtgtttcccgctccagtcgtaggctcgggcggagccaccagcgggaagctgctcctggaagccgacgagctttgtgatgatggtggcgatggccgcggcgcagttgtgcccggcgccggactcagacgccccacttacacccctcccagcatcatgcctcagaaacattgggtctacgtgaagaggggcggcaattgcccagcccctgcccctctggtgccccaggacccagaccttgaagaagaggaggaagaggaagacctcgtgctcacatgtgaagatgatgaagacgaggagcttggaggctcctcccgggtccctgttgggggcggtccagaggccactctgtctatttccgacgtccgcaccctgtccgaaccacctgataagggtgaagagcaggtgaacttttgtgaaagttccaacgacttcggcccttacgaagggggcggtcccgttgccggcctggatgacagcggaggccctaccccaagctcatacgctccgagtcatccgcctcggcctctgctcccactggatatgcaggggaaccagatcttggtgttcccctcaagctctagctctagctctagccaggcacctggacagccccccggcaatcaggctgaacatggcgctgtgacggttggtgggactagcgtaggatctttgggtgtacctgggtcagtgggcggtgttcccggagggacaggcagcggggacggcaataaaatttttctctgtcactgcggcaaagcatttagccacaagagtatgagagatagacacgtgaacatgcacctcaatctgagaccctttgattgtccagtctgcaataaaaagttcaaaatgaagcaccacctgaccgaacacatgaagacacacaccggcttgaaaccgtatgagtgcggcgtgtgtgccaagaagttcatgtggagagattccttcatgagacacagaggccactgcgagagaagacaccgtctgggaggagtgggcgctgtccctggtcctggaacacctacagggccttctctccctagtaaacgcgaaagcccgggcgtgggaggaggtagcggtgatgaggcctccgctgccacacctccatccagccggagagtatggtcaccccccagagtccacaaggttgagatgggattcggaggggggggaggtgccaactag

SEQ ID NO: 34945 - DNA, 1905 bp, Artificial Sequence
  Description of Artificial Sequence: Synthetic coding sequence
atggagccttctcctttatcaccatcaggcgccgccctgccactgcctcttagcttggctccccccccactgcctttgcctgcagctgcagtcgtgcatgtgtcatttccggaagtgactagtgctctgttggaatccttgaaccagcaacgcctacagggacaactgtgcgacgtgagcatccgcgtccaggggagggagttccgtgctcatcgggccgtcctggcggctagtagcccatacttccacgaccaggtcttgcttaaaggcatgacgagcattagcctgcctagtgtcatggaccctggcgcttttgagacggtcttggcttcggcctacacagggaggctgtccatggccgccgccgacattgtgaacttcctgaccgtcggtagtgtgctgcaaatgtggcatatcgtggacaagtgtacggagcttctcagagaggggcgcgcatccgccaccaccaccattaccacagcggcagcgacctctgtgactgtccccggtgccggcgtgccatcaggatcaggcggcacagtagctccagccactatgggttctgcccggtcacacgcctccagtagagcctccgagaatcagagcccttcttcatctaactactttagtcctcgagagtcaactgacttcagctcgtctagccaggaagcgtttgcagcatccgcggtcggatctggtgagagacgcggaggcgggcccgtgtttccggcccctgtagtagggagcggaggcgcgacgagtggcaaactgttactggaggctgatgaactgtgtgacgacggcggggatggtagaggcgccgtcgttcctggtgcagggctcagacgtcctacctacactcccccctctattatgcctcagaaacattgggtttacgtgaagagggggggaaattgccctgccccagcacctctggtcccacaggaccctgacctggaggaagaagaggaagaggaggacttggtgcttacgtgcgaggatgacgaggacgaagagctgggagggtcctctagagtacctgttgggggtgggccggaagccacactatccatttctgacgtgcggactctgagtgaacctcccgataaaggggaagagcaggttaatttctgcgagagcagcaacgacttcggtccttacgaagggggtggcccagttgctgggctggacgactccggcgggccgaccccttccagttatgcaccttcacaccccccgcgccccctcctgcccctggacatgcaggggaaccagatactcgtgtttccaagcagctcaagtagttcttccagccaggcccctgggcagccaccaggaaatcaggccgagcacggagccgtgaccgtcggtggcacctcagtgggctccctgggagtgccagggagcgtgggcggagtccctggtgggaccgggtctggcgacggtaacaagattttcctctgccactgcggcaaggcatttagtcacaaatccatgagagatcggcacgtgaacatgcacctcaatctcagacccttcgactgccctgtctgtaacaaaaaattcaagatgaaacaccatctaacagagcacatgaagacccacacaggactgaaaccctatgaatgtggcgtctgtgcaaagaagtttatgtggcgtgacagtttcatgcgccatagaggccattgcgagcggcgtcaccgcttagggggggtgggcgctgttcccggcccaggtactcccaccggcccctccctgcccagcaagagggagagccccggcgtcggcggaggctctggggacgaggcatccgccgcgactccacccagctctaggagagtgtggtctcctcctcgagtacacaaggtggaaatgggatttggcgggggcggcggcgcaaattag

SEQ ID NO: 34946 - DNA, 2019 bp, Artificial Sequence
  Description of Artificial Sequence: Synthetic coding sequence
atggaaagcaggaagctgatttcagcaactgacatccaatatagcggttccctcttgaattccctcaacgagcagaggggccatggactcttctgtgacgtgaccgtgattgttgaagatagaaagttccgggcacataagaacattttaagtgcctcctccacttattttcaccagctcttcagcgttgccggccaggttgtcgaactcagttttattcgcgctgagattttcgccgaaatcctgaattacatctactccagtaagatagtgagggtccgttctgatttactggacgaactcataaagagcggccagttgctgggtgtcaagttcatcgcggagttgggggtgccgttgtctcaggtgaagtcgatcagcggcaccgcccaggatggaaacacagagccactgccacccgactccggcgacaagaacttggtaatccagaagtctaaagatgaggcccaagacaacggagctaccatcatgcctattatcacagagagcttcagcttatccgcggaggactatgaaatgaaaaagatcatagtgactgactctgacgatgatgacgacgacgtcatattttgtagcgaaatccttccgacgaaggagaccctgccttctaataacacagtagcgcaggtgcagtccaatccgggtcccgttgccatctctgacgtggcaccctccgcatccaataactcccctccactgaccaatataaccccaactcagaagctgcctaccccagtgaaccaagctaccctcagccagactcagggatctgagaaactactggtcagctcagccccgacccacttaacccccaatatcattctgctgaaccagacgcccttaagcacaccccccaacgtgagctctagtttgccaaatcacatgccctcttccattaatctgctagttcagaaccagcagactccaaactccgctatcctgaccggtaacaaagccaacgaggaagaagaagaggaaatcatcgacgacgatgacgacacaatctccagctcacccgactcggcagtttccaatacctctctggttcctcaagcggacacgtcacaaaatacgtcattcgacgggtctctgatccagaagatgcagataccgaccttactccaggagccgctgtcaaattccctcaagatcagtgacataatcacaagaaacacaaacgaccccggggtaggaagcaaacatttgatggaggggcagaagatcatcacccttgatacggctaccgagatcgaagggctgtccaccggttgtaaagtgtatgcaaatatcggagaggacacatacgacatcgttattccagtgaaggacgatcccgacgagggagaggctagacttgagaacgagatccctaagacgagcggcagcgagatggcaaacaagagaatgaaggtaaagcacgatgaccattatgagctgatcgtggatggacgagtgtattatatatgcatcgtgtgcaagcgaagctatgtgtgtcttactagcctaagaagacacttcaatatacattcttgggagaaaaagtacccatgccgctactgcgaaaaagtgttccctctggctgagtatagaacaaagcatgaaattcatcatacaggagagaggcgctatcaatgcttggcctgtggcaaaagctttattaactaccaatttatgagtagccacattaaaagcgtccatagccaggacccgtccggagacagcaagctctatcgcctccatccttgtaggagcctgcagatcagacagtacgcttacctgagcgaccgcagcagcactattccagccatgaaagatgatggtatcggatacaaggtcgacacggggaaagaaccaccagtagggaccactacgtcaacccagaacaaaccgatgacatgggaagatatctttattcagcaggagaacgactccatattcaagcagaacgtgaccgacgggtctactgaattcgaattcatcatacccgagagctactag

SEQ ID NO: 34947 - DNA, 609 bp, Artificial Sequence
  Description of Artificial Sequence: Synthetic coding sequence
atgctaactgccactctgtcaatcaatactgagaatatcattgatgtattagctgctgcctcatacatgcagatgttctctgtcgccagcacttgcagtgaattcatgaagagctccatactatggaacaccccgaattctcaaccggagaaaggactggatgccgggcaggagaataattcgaactgcaatttcacctcacgggacggctcaatatcccccgttagttccgaatgttccgtcgtagagcgaactatcccagtgtgccgagagtcacgcaggaaacggaagagctatatagtgatgagtcccgagtcacctgtgaagtgcggtacccagactagtagcccccaggttctgaattcgagtgcatcctattcagaaaacagaaatcagccagtggacagtagcctcgcatttccttggacatttcctttcgggattgatagacgcatacagcccgagaaggtgaaacaggccgagaacacacgcactctggaactgcctggcccctccgaaacaggtcggcgtatggctgactatgttacttgcgagtccacaaagaccacgcttccgctgggaactgaagaggatgtgagaagcaagtag

SEQ ID NO: 34948 - DNA, 1713 bp, Artificial Sequence
  Description of Artificial Sequence: Synthetic coding sequence
atgggagtcaagaccttcacccactccagcagttcacattctcaggagatgctagggaaactcaacatgttgcgcaacgacggccacttctgcgacataacaatccgcgtgcaggataaaatattccgagcacataaggtggttctggccgcgtgttctgacttttttagaacgaaacttgtggggcaggcagaagacgaaaataagaatgtcttagacctgcatcacgtgacggtgaccgggttcattcctctcctcgagtatgcttacacagccacactgtctataaacactgagaatataatcgacgttctggctgctgcttcttacatgcagatgttctctgttgctagcacttgttctgaatttatgaagagttcaatactttggaatacacccaactctcagccagagaagggcctggatgctggtcaggagaacaattctaactgtaattttacaagcagggacggcagcatcagccccgtgtcctcagaatgttccgttgtggaacgcacgatccctgtctgccgagaaagtaggagaaaacggaagtcctatatagtgatgtctcctgagtctcccgtgaagtgcgggacccagacttcttccccacaagtgctgaactccagtgcatcctatagcgaaaataggaatcaacctgtggattccagcctggcatttccttggacttttcctttcggaatagaccgcagaatacagcccgagaaggtcaagcaggcagagaatacccgaacactggaactcccaggaccctcggagaccggccggcgcatggctgactacgttacctgcgaatcgacaaagaccacattgcccttggggaccgaggaggatgttcgcgtgaaggtggagcggctctccgacgaagaggtccatgaagaggtctcccagcccgtgagcgccagccagtcctctctgagtgaccagcagactgtgccagggtccgaacaggtgcaggaggatttgcttattagcccccagtcctctagtatcggtagtgtagatgaaggcgtgtctgaaggcttgccgacactccaatctacctcttcgaccaatgcacccccggacgatgatgatcgcctcgaaaacgtgcagtatccttatcagctctatatcgccccaagcacttcttccactgagagacccagtccaaacggccccgaccggccattccagtgccctacatgtggagttcgctttactagaatacaaaatctaaagcaacatatgttgatccacagcgggattaagccgttccaatgtgaccgctgtggaaaaaaatttacacgggcctattctctgaagatgcatcggctcaagcatgagggcaagaggtgtttcaggtgtcagatttgttcagcaaccttcaccagcttcggagaatataagcaccacatgcgggtctccaggcacatcatccggaagcctcggatctatgagtgtaaaacttgtggggccatgttcaccaacagtgggaacttgatcgttcatttgagaagcttgaatcacgaggcttctgaactcgcaaactatttccagagcagtgatttcttagtgccagactacctcaaccaagagcaggaggaaaccctcgtacagtacgacttgggggagcatggattcgaatcaaacagcagcgtccagatgcctgtgatctcccaataccattctaagggcaaagaaccgtag

SEQ ID NO: 34949 - DNA, 1713 bp, Artificial Sequence
  Description of Artificial Sequence: Synthetic coding sequence
atgggcgtaaagacatttacccactccagcagtagccatagtcaggaaatgcttggtaagttaaatatgctgcgtaatgacggccacttctgtgacattacgattagagtccaagataagatttttagagctcacaaagtggtgctggctgcctgttctgacttcttcagaaccaaattagtcggacaagccgaggacgaaaacaagaatgtcttagatcttcatcatgtgacagtcacaggattcatccccctgctggagtatgcatacacagcaaccctttccataaacacggagaacatcattgatgtgttagcagcagcatcatacatgcaaatgttcagcgtcgctagcacctgttccgagttcatgaaatcgagcatattatggaatacccctaactcccaaccggaaaaaggtcttgacgccggccaggagaacaactccaactgcaacttcaccagtagagacggaagcattagtcccgtatcgtcagaatgcagtgtcgtggaacgaaccattcctgtatgccgagaatcaagaagaaagagaaaatcatatatcgtaatgtcccctgagagtccagtgaagtgcgggacccagactagctcccctcaggtgctgaattccagtgcctcatacagcgaaaaccgtaatcagccagtagattcgagtctggcattcccttggacatttccgtttgggattgataggaggatccagcccgagaaggtgaaacaggccgaaaacacaagaacacttgagctgccgggaccaagtgaaacagggcggagaatggctgattacgtcacatgcgaatccacaaaaacaaccctgcccctgggaactgaagaggatgttagagtcaaagtggaaaggttatcggacgaagaggttcatgaggaggtgagtcagccggttagtgcctcacagtcatccctcagtgatcagcagacagtccccgggtcagagcaagttcaggaagacttattaatatcaccccagtcttcctctatcgggagcgtggacgagggagttagtgaagggttgccaactctgcagagtactagttctaccaatgcccctcccgatgacgatgatcgcttagaaaatgtgcagtatccatatcaactgtacatcgctccctccacctcctctacagagagaccttcaccaaatgggccagatcgccctttccagtgccctacctgtggtgtgagatttactcggattcagaatctcaaacagcacatgctgatccactccggtatcaaacccttccaatgtgacagatgtgggaaaaagtttactagggcttactccctgaaaatgcataggttgaagcacgagggcaaacgttgctttaggtgtcaaatctgctccgcaacatttacttctttcggcgagtacaagcaccatatgcgcgtgtcccgacacatcattcggaaaccaagaatatatgaatgcaagacatgcggggccatgttcaccaacagcggtaatctcatcgtgcacctcagaagcttgaatcatgaagcctcagagctggcaaattattttcagtcttctgattttttagtccctgactatctcaatcaggagcaggaggagaccctggtgcaatacgacctaggggagcatggctttgaatcaaatagtagcgtccagatgccagtgatcagccagtatcactccaagggaaaagagccttag

SEQ ID NO: 34950 - DNA, 1404 bp, Artificial Sequence
  Description of Artificial Sequence: Synthetic coding sequence
atgggagttaagacatttacacactcttcttcttcacactcccaggagatgttgggaaaactgaatatgctgcgaaatgatgggcacttctgcgacataactattcgcgtacaggataagatctttagagcccacaaggtcgtgctggccgcctgctcagattttttccggaccaagctcgtggggcaggcggaggatgagaacaaaaatgtgctcgacttgcaccatgttaccgtgacagggttcattcccctcctagagtacgcctacacggccaccctgtcaatcaataccgagaatataatagatgttctggccgcagctagctacatgcagatgttctctgtggcttccacttgcagtgagtttatgaaatcttctattttgtggaatactccgaactcccaaccagagaagggacttgatgccggccaggagaataatagcaactgcaattttacttccagggacggaagcatctcccctgtgagttccgagtgttccgtggttgaaaggactatcccagtgtgcagggaatcaaggagaaagcgcaagtcttatatcgtgatgtctcctgagagccccgtaaagtgtggaactcaaacctcctcaccacaggttctcaacagttctgcgtcctactctgagaacagaaaccagcccgtcgattccagccttgctttcccctggacttttccttttgggattgaccgccgcatacagcccgagaaagttaaacaagcggagaacacccgcactctagagttgccagggcctagcgagactgggagacgcatggcagattatgttacatgtgagtcgacaaagaccaccttacctctcgggacagaagaggacgtccgagtgaaagttgaacgcttgtctgacgaagaagtacacgaggaggtgagccagcccgtcagcgcaagccagtcaagcctctccgatcagcagaccgtgccggggtctgagcaggtgcaggaggacctgctgatttctccacagtcatctagcatcggttccgtggacgagggtgttagtgaaggactcccaacactgcaaagcacaagttccacaaacgcacctcctgacgacgatgaccggctggagaacgtacagtatccctaccaattatacatcgcacctagcacgtcttcaaccgaacgccctagccctaacggccctgaccggcccttccagtgcccaacctgtggcgttcgattcactagaatccagaacctaaagcagcacatgctgatacactcaggtattaagcctttccagtgcgaccgatgcgggaagaaatttacccgcgcgtacagcctcaagatgcatcggctgaaacacgagggccatcctaggaagagcgctagccgcagtagctccgcaactaactgttgttag

SEQ ID NO: 34951 - DNA, 1362 bp, Artificial Sequence
  Description of Artificial Sequence: Synthetic coding sequence
atgggagtgaagactttcacacacagctcaagctctcacagccaggaaatgttggggaagctcaatatgctgcgaaatgacgggcatttttgtgatattactattcgtgtgcaggataaaatcttccgagcacacaaggtcgtgctggcagcctgtagtgacttttttaggaccaaactggtggggcaggccgaggatgagaacaaaaatgtgttagacctccaccacgtgaccgtgactgggttcataccgctactggagtatgcatatacagcaaccctgagtataaatacagagaatattatcgacgtgctggctgccgcttcctacatgcagatgttttccgtggcatccacctgttctgagttcatgaaaagctcaattctttggaacaccccaaattcccagcccgagaagggcctagacgccgggcaagaaaacaattcaaactgcaactttacaagccgggacggctcaatatctccagtaagtagcgagtgctcggtcgttgagcggacaatcccagtatgcagggagtcacgtaggaaacgaaagagttacatcgtcatgtcacctgagtcccctgtgaagtgcgggactcaaactagcagcccacaggtacttaacagctcagcgtcctattccgagaaccgcaaccagcccgtcgattcttcactagcctttccttggacgttcccttttgggatcgaccgccggattcaacccgagaaggtgaagcaagcagagaatacaagaactttggaacttcccggcccaagtgagacaggacgtcgcatggccgattacgtgacctgcgagtcgaccaagacaaccctgccattagggaccgaggaggacgtgcgggtgaaggtggagcgtctgtccgatgaggaagtgcacgaagaggtctcgcagcccgtttcggctagccagtctagcttgagcgaccaacagacagttcctggctcagagcaggtgcaggaggacctgttgatctcgcctcagtcaagctccatcggatccgtagatgaaggggtgtcagaggggctgccgacactgcagagcacgagtagcaccaatgcgcccccagacgacgacgatcgcctggagaacgttcagtacccatatcaactttatattgcaccatctaccagctctacagaacgcccctcaccaaatgggcccgaccggccgtttcagtgtcctacgtgcggagtgagatttacccgtatccagaacctgaagcaacacatgctgattcatagtgggatcaagccctttcagtgcgatcgctgtgggaaaaaattcacgagagcctacagcttaaagatgcacaggctaaaacatgaggtcatcagttag

SEQ ID NO: 34952 - DNA, 1425 bp, Artificial Sequence
  Description of Artificial Sequence: Synthetic coding sequence
atgggggtcaagactttcacacacagcagttcctcacatagccaggaaatgttaggcaagctcaacatgctgaggaatgatggacatttttgcgatatcacaattagagtccaggataaaatcttccgggctcacaaggtcgtcctggcagcatgttctgacttctttcgcacaaagttagttggacaagctgaggatgaaaataagaacgtgcttgacttacatcacgtcacggtgaccgggttcatccccctcctcgagtacgcctatacagccacactctcgattaacacagagaacatcatcgatgtcttggctgccgcctcctacatgcaaatgttctcagtggctagtacctgctctgaatttatgaagtcttctattctctggaatacccctaattctcagcccgaaaaaggcctcgacgcaggacaggagaataactcaaactgtaatttcacatcacgagatggcagtattagtccagtctcttccgaatgtagcgtggtcgagcgtactatacccgtgtgcagggagagtagacgcaagagaaagagctacatagtgatgtctcctgaaagtcccgtgaagtgtgggacccagacctccagtcctcaggttctcaactcatcggcctcatactcagaaaacagaaaccagccagtggatagcagtctggcattcccatggacctttcccttcggcatcgatcggcggatccagccagagaaggtgaaacaggccgaaaatacacggacgctggaactccccggaccatccgagacggggcgccgcatggctgactatgttacatgtgaatccactaagacaacgctacccctagggaccgaagaagacgtgcgggtaaaggtggagaggctgagcgatgaggaggtgcatgaggaggtgtctcaacctgtgagcgcctcccagtcctctctctcagatcaacaaaccgttcccggttccgagcaagtacaggaggaccttctgatatcaccccagtcaagtagtattggttcagttgacgagggcgtctctgagggtctacctaccctgcagtctacatcctctaccaacgccccccccgatgacgatgacaggctagaaaatgtccagtatccctatcagctgtatattgccccatccacctcatcaaccgaacgcccatcccctaacggaccggaccgtccttttcaatgtccaacatgcggggtgcgttttactcgaattcagaacctcaaacagcatatgctgattcatagcggcatcaagcccttccagtgcgacagatgcgggaaaaaatttacgcgagcgtactcactgaagatgcaccggctgaaacacgaggtgcccctgcagcgccagggaactatgatcgataatagccaggccgtggatgagatgaccaggaatggcgagtag

SEQ ID NO: 34953 - DNA, 231 bp, Artificial Sequence
  Description of Artificial Sequence: Synthetic coding sequence
atgaagggggggtctagggtgtctaacccagccgtgatggctcaggaggaagaagacgttcgggactacaatctaactgaggagcagaaagccattaaggcaaagtatccgcctgtcaatagaaagtacgaataccaccagacccacttattgcagtccccccaccggatttacagccacttgcactcctcagccatctggaatccttatctccatttgatggggacatag

SEQ ID NO: 34954 - DNA, 411 bp, Artificial Sequence
  Description of Artificial Sequence: Synthetic coding sequence
atggcccaggaggaagaagatgttagggattataacctgactgaagaacagaaggccattaaagccaagtaccctcctgtgaatagaaagtatgagtatctggaccatactgcagacgtgcagttacatgcatggggagatactctcgaagaggcttttgagcaatgtgccatggccatgttcggctacatgacagatactggtaccgtggagcctctccagactgtggaggtcgagacacagggagatgacttgcagagcttactcttccactttctcgacgaatggctctacaaatttagcgcggacgagttcttcattccccgagtgggcagacgaatctttattgtccaggccccatccggcaataggtctcaatctaataatatttttagcaatgccggcctttag

SEQ ID NO: 34955 - DNA, 444 bp, Artificial Sequence
  Description of Artificial Sequence: Synthetic coding sequence
tagggtgggtcgagggtctccaacccagccgtcatggcacaggaagaagaggatgtccgggactataatctcacagaggagcagaaagcaatcaaagctaaatatccacctgtgaaccggaagtacgaatacttggaccacactgctgatgtgcagctgcacgcgtggggcgacaccttagaagaagccttcgaacagtgtgcaatggcaatgttcggctatatgaccgataccggtacggtagagccacttcagactgtagaggtcgagacgcaaggcgacgatttacaaagtttgttgttccacttcctggacgagtggctgtataagttcagtgctgacgagttttttattcctagggttggcagacgcatctttatcgttcaagccccttctgggaaccgttcccaatctaataacatcttttcaaacgccggcctctag

SEQ ID NO: 34956 - DNA, 540 bp, Artificial Sequence
  Description of Artificial Sequence: Synthetic coding sequence
atgaaaggagggtctcgtgtgtcaaaccccgctgtaatggcccaggaggaagaagacgtgcgcgactataatctgacagaagaacagaaggccattaaggcaaagtatccccccgtgaaccgtaaatatgagtatttagaccacacagctgatgtgcagttacacgcgtggggggacacactcgaggaagcgttcgagcagtgtgccatggccatgtttggctacatgactgacaccggcactgtggagcctctgcagaccgtcgaggtggaaacccagggagacgatcttcaatctctgctgtttcacttcctggatgagtggttatataaattcagtgccgacgagttttttatacctcgcgaggtcaaggtgctatcaatcgaccagcggaatttcaagctgagatctatcggctggggtgaagaattttctttaagcaagcacccgcaggggacagaagttaaagcaatcacctatagtgctatgcaggtgtacaacgaggagaaccctgaggtgtttgtcattatagacatttag

SEQ ID NO: 34957 - DNA, 1488 bp, Artificial Sequence
  Description of Artificial Sequence: Synthetic coding sequence
atggctgcaaactggactttgtcctggggccaagggggtccctgtaatagccctgggagcgacactcccagaagcgtggcatctcctgagactcaactcgggaatcacgatcgcaaccccgagacatggcacatgaatttccgaatgttcagttgtcccgaggagagcgatcctatccaggcactgaggaaactcaccgaactgtgccacctgtggctcagacccgatctccacacaaaagagcagattcttgacatgttggttatggagcaatttatgatttcaatgccccaggagctccaggttcttgtgaaggtgaacggcgtgcagtcctgtaaggacctcgaagatttgctgcgcaataacaggcggcccaaaaagtggtctatcgtcaatctgttgggtaaggaatacctcatgctgaattcagatgtcgaaatggccgaagcccccgccagtgtccgcgacgaccccagagatgtctcttcgcagtgggcttcctctgtgaaccagatgcatcctggcacgggccaggcccgcagggagcaacagattctgccgcgtgtggctgcgttgtcccgcagacagggggaggactttctgctgcataagagcatcgacgttaccggggatcccaattccccccggcctaaacagaccctggagaaggacctgaaagagaatcgcgaggagaatcccggactcagtagccccgagccacaactgcctaagagtcctaatttagtgagggctaaagaggggaaagagccccaaaaaagagcttccgtggaaaatgtggacgcagacaccccctctgcatgtgtcgtcgagcgggaggccctgactcatagcggcaaccggggcgacgccctgaatcttagcagcccaaagcggagtaagcccgatgcaagctccatttctcaagaggagccccagggagaggccacaccagttgggaatcgcgaaagccctggtcaggctgagatcaatccagtccacagcccagggccagccggcccagtgtctcaccccgatggacaagaagcgaaggcactgccgcctttcgcgtgcgatgtgtgtaataaatcatttaaatattttagccagctctccatccatcgtcggtcacatactggggaccggccattccaatgcgacctctgccggaagaggtttctacaaccaagcgacctcagggtacaccagagagtgcataccggtgaaagaccttatatgtgcgacgtctgccagaagcgcttcgcccatgagtccacgctgcagggccataagcgcattcatacgggggagcggccctttaagtgtaagtattgctccaaggtgttctcacacaagggaaatctgaatgttcaccagcgtacccacagcggcgagaaaccctacaaatgtcctacctgccagaaagcattccggcagttgggcacctttaagaggcacttaaagacccacagggaaacgacctcccagtag

SEQ ID NO: 34958 - DNA, 1491 bp, Artificial Sequence
  Description of Artificial Sequence: Synthetic coding sequence
atggccgccaactgcacctcgagttggtcgctcggagaaagctgtaattctcctgggtccgagccaccccagagcatgccatcaccggctactcagctcgggaatcacgattccgacccagagacgtgccacgtgaactttcggatgttctcctgtccaaaagaaagcgaccctatacaagcactgcgtaagttaaccgagttgtgtcatctgtggcttcggcccgatctacataccaaagagcagattctcgatatgctggtgatggagcagttcatgatttcaatgccccaggagctgcaggtgctcgttatgatgaacggtgtccagtcctgcaaggacttggaggacctgctgcgaaataaccggcggccaaagaagtggtccgtcgttagcttcctgggcaaagagtatttaatgcaggagagtgatgtggagatggccgaggcaccggctagcgtgagagatgaccctagacacgtgagctctcagaggactagctccgtgaatcagatgtgtccagaggaagggcaagcttcgcaggagcttcagactctcccccgggttccagccctgttccggagacaggaagaagatttcttactccctgaaacaacagtcatgaagggtgatcccaaggctttacggcccaaacccacacttgagaaagacttagaagaggacagagaagaaaatcctggtttaaccagccccgagccacagttgcccaattcccccaccggggtagtcggtgccaaggaagggaaggagccccaaaagagagcctccgtcgaaaacgtggatgccgatactcctagcgcctgtgttgtggaaagggaggcaagcacccacagcgggtcgcgcggtgacgcccttaacctccgaggcctcaagcgtagcaagccagacgctaccagtatctcacaggaagaaccacaaggcgaagcgacgccagtgggaaatagagagtcccctggccaggcagagattaatccggttcacagcccgggcccggcaggccctgtgtctcatccctccggacaggaggttaaggagctccttccatttgcttgcgaagtgtgtgggaaaagatttaagtaccgaggaaaactggccgtacacacccgctcccatacaggagaacgcctattccagtgtaacctgtgcgggaagcgcttcatgcagaggatcggtctccagttccatcaaaggactcacaccggggagaggccttacacctgcgacatttgtcaaaagcagttcacgcagaagtcttacttgaagtgtcacaagcgaagtcacaccggggagaagcctttcgaatgcaaagactgtaagaaagtttttacctacaaggcaaacctcaaggagcatcagagaatccatagcggcgagaagccgcataagtgctcaaagtgtccccgcgcctttggacgcccagccacgctgcgtaggcaccagaaaacccaccgggaggcaacctcccaatag

SEQ ID NO: 34959 - DNA, 1491 bp, Artificial Sequence
  Description of Artificial Sequence: Synthetic coding sequence
atggcagcaaactgcaccagttcatggtctctcggcgaaagttgtaacagtcccggatctgagcctccacagagtatgccaagccctgctacccagttaggtaaccatgatagcgatccagagacttgtcacgtaaacttccggatgttcagttgtcctaaggagagcgacccaatccaagccctgcgaaagttgaccgaactctgtcatctatggctgcgtcctgacctccacaccaaggagcagatacttgatatgctggttatggaacagttcatgatatcaatgcctcaggaactccaagtactagtgatgatgaacggagtgcaatcatgtaaagacctcgaagacctgcttcggaataaccgtaggcccaaaaaatggagtgtcgtgtctttcctcgggaaagaatacctcatgcaggagtccgatgtagagatggctgaggccccagcatccgttagagacgacccgcgccatgtgtcttctcaacggacttctagcgttaaccagatgtgtccagaggaggggcaggcttctcaggagctgcagacactgcctcgagtacccgccctgtttagacggcaggaagaagactttctcctgcccgaaacaaccgtcatgaagggcgacccaaaggcgttacgacctaagccaaccctagaaaaggacttggaagaggaccgcgaagagaatccaggccttacctcccctgagccacagttgcccaattcgcctaccggagtggtgggagccaaagaggggaaagagccgcaaaaaagggccagcgtggagaatgtcgatgctgatactccctcagcatgcgtagtggagcgcgaagccagcacccatagcgggtctcgaggagatgcgctaaacttgcgaggattaaaacggagtaagcccgatgctactagcattagtcaggaggagcctcagggcgaggccaccccggtgggaaacagggaatcgcccggccaggcagaaatcaaccccgtccactcacccgggcctgccgggccagtgagccatccttcaggacaggaggtcaaagagctccttcctttcgcctgcgaagtgtgcggcaagcggtttaagtaccgggggaaactcgccgtgcacacgcggtctcacacaggagagaggctattccagtgtaacctctgcggcaagcgttttatgcagagaatcggcctgcagtttcatcaacgaactcatactggcgaaagaccctacacatgtgacatttgtcagaagcagttcactcagaaatcctacctcaagtgccacaaaagaagccacacaggagaaaaacctttcgaatgtaaagattgtaagaaagtcttcacatacaaggctaaccttaaggaacatcagaggattcacagtggcgaaaaaccacacaagtgttccaaatgcccacgggctttcggcagacctgctacactgcgtaggcaccaaaagacccatcgggaagcaacatctcagtag

SEQ ID NO: 34960 - DNA, 2316 bp, Artificial Sequence
  Description of Artificial Sequence: Synthetic coding sequence
atggagaaggtacagctcgaatttgagaatcaggaaatggaaaagaaactacaagagtttcggtctacccgtaataaggagaaagaagaccgagagtcaagcgaatactactggaaatccggcaaagtaggaaaactggtgaatcagtcttatatgatgtcgcagaacaaagggaatgtcgtcaagttctccgctggcaaggtgaaactgaagttgttgaaggaacagatccaggagcccgtgaagccaacggtcaattataagatggccaattcatctgaatgtgagaaaccaaaaatcaatgggaaggtgtgtggtcagtgtgaaaataaggccgcactcctcgtttgtctcgaatgtggggaagactactgcagcggctgctttgctaaggtgcatcagaagggcgcactgaaattgcatcgcactacgcttctacaggccaaatcccagattttattcaatgtcctggacgtggcccaccaatttatcaaagacgttaatcctgatgagccaaaggaagagaataatagcaccaaggagacttctaaaatccagcacaagcctaagagcgtgctgctgcaaagatccagcagtgaggtcgaaatcacaaccatgaaaagagcccagcggactaaacctagaaaaagcctgctctgcgagggctccttcgacgaggaagcttccgctcagtcctttcaggaagtcctgagccaatggcggaccgggaaccacgatgataataagaaacagaacctgcatgctgccgtgaaagattcacttgaggaatgtgaggtgcagacaaatctaaagatctggcgggagccccttaatatagaactgaaggaagatattctgtcgtacatggagaagctgtggcttaaaaagcacaggagaactccacaggagcagttattcaaaatgttgcctgatacctttccccacccccatgagactacaggcgacgcacaatgttcccagaatgaaaacgacgaagactccgacggagaggaaacaaaagttcagcacaccgccttgttactgcctgttgagacattgaacatcgaacgcccagaaccctccctaaaaattgtggagctcgacgacacctatgaggaagaattcgaggaagccgagaacatcgttccctacaaggtgaaattggcagatgctgactcccagagaagttgtgccttccatgattgccagaagaattcttttccctacgaaaacggaatccaccagcatcacgtgttcgacaaaggcaagcgagacttcctaaatctttgcctgagaaattcatctacttattataaagacaatagtaaagctgagacatccaataccgacttcgacaatatagtcgacccagacgtctactcctccgacattgaaaagatcgaggaaagcaccagtttcgagcgcaacttgaaagaaaaaaatatcggtctggagagtaatcagaaatctgacgacagctgcgtgtcgcttgagagcaaagacacactgttaggacgagatcttgagaaggcaccaatagaagaaaagttgagccaggatatcaaagaaagcctggagctgagtaacctgtacaaacgtccatctttcgaagaatccaagacaactaaatcaagtctgctcctccaggagatcgcatgtcgctctaagcccatcaccaagcaatatcaaggcctggagaggttcttcattttcgatacgaatgaacggctcaacctgttgccctctcaccgactggagtgtaacaactcgagcacaagaatcaccctggcaggccaaaagtcccagagaccaagcactgcaaatttcccgctgtcaaactccgtcaaagagtcttcctcatgtctgtcaagttcgcatcctcggtccagatccgccgcagctcagtcgagttcaagagctgcatctgagatatctgaaatcgagtatatagatataaccgaccaaaacgaactaagcttagatgacaccacggaccaacacactttagacaacttggagaaagagctccaggtgttgcggagtctggccgacacctccgaaaaattgtatagcctgacaagcgaggagttcccagacttctcatcacagtccctgaatatttcacagatttccaccgactttctgaaaacctcccacgttcgcggcccatgcggagtcgaggagctttcttgctctggtagagatacaaagatccagtctctgctctccctgagcgagagctctactgacgaggaagaggaagactttctgaataagcagcacgtcatcacactgccttggagcaagtcgacctag

SEQ ID NO: 34961 - DNA, 2082 bp, Artificial Sequence
  Description of Artificial Sequence: Synthetic coding sequence
atgattgcccctctgttatgtatattgtcttacaacttcaacacatttgccatcctgaatgtttattccaagcttaccatgttctgtacaaccaattcattaccgatggaccttcttcttaaacagggttccctaaaacaagaggtcgagtcattctgttatcaaatcgtgagcgagtctaacgatcagaaggtgggcatcttacaaagtgaggacaaacagttgcagccatccgtgtctaagaaatctgagggggaactttcacgcgtgaaattcatctcgaattccaacaagatcacttttagcaaaaaacctaagcggcgcaagtacgatgagagctatctgagtttcggcttcacctattttggcaaccgagacgccccccacgctcagtgtgttctctgcaaaaagattctgtcaaatagttccctggcgcccagtaagttgagacgacatttagagaccaaacatgctgcatacaaggacaaagacatctcgttcttcaagcagcatttggatagccctgagaataataagcctcctactcccaagatcgttaacactgataacgagtccgccaccgaggctagctataatgtctcctaccacattgccttatctggggaggcccacaccatcggtgagttgctgattaaaccgtgtgccaaagacgtcgttatgcggatgtttgatgagcagtatagtaagaaaatcgacgccgtgcagcttagcaactcaaccgtagcccgccgcataaaagaccttgccgcagatatcgaggaggagctcgtctgccgtcttaaaatttgcgacgggttttccctgcaactggacgaatcagcagatgtgtctgggctggcagtgttgttagtcttcgtacggtaccgatttaacaaaagtatcgaagaagatctgctgttatgtgagagtctgcagagcaatgccacgggagaagaaattttcaactgtatcaactcttttatgcaaaagcatgaaattgagtgggaaaagtgtgtcgatgtttgctccgatgcctctcgcgctgtggacggcaagattgcggaagctgtcacattgatcaagtacgtggccccagaatctactagctcacactgcctgctgtaccggcacgccctggcagtgaaaattatgcctacatccctaaagaacgtccttgatcaggccgtgcagatcattaattatatcaaggctcggcctcaccagagccgactgttgaagattctatgtgaggagatgggcgctcaacacacagcactgttacttaatacggaggtgcgttggttgagtagaggcaaggttctggtgcggctgttcgaactgagacgtgagttgctggtctttatggactcagctttcagactgagcgattgtctaacgaactcctcctggcttctgcggcttgcatatctggctgacatctttaccaagttgaatgaggtgaacctgtctatgcaaggtaagaacgtgacagtgtttacggtattcgataagatgagctccttactgaggaaactagagttttgggcctcctcagtcgaggaagagaacttcgactgttttccaaccctgtctgacttcctcaccgagataaacagcactgttgacaaggatatctgttccgctatcgttcaacatctgcggggcttgagagcaactctgctcaaatactttcctgtgacgaacgataataatgcctgggtacgtaaccccttcactgttaccgtgaaacccgcttcactggtggcacgcgattatgagagcctgatcgatcttacatccgactcacaggtcaagcagaactttagcgaactgtcactcaatgatttctggtcctctctgatccaggagtatccaagcattgcaagacgagccgtgagagtgctgctcccattcgccacaatgcacttatgtgagaccgggttttcatattatgctgccacaaagactaaatatcgcaagagactggacgcagcaccccacatgaggatccggttgagcaatatcacaccgaacattaagagaatttgcgacaagaaaacgcagaagcattgcagccactag

SEQ ID NO: 34962 - DNA, 2082 bp, Artificial Sequence
  Description of Artificial Sequence: Synthetic coding sequence
atgattgccccactgctgtgtatcttgagctataattttaacacgttcgctattctcaacgtctactctaagctcaccatgttctgcaccactaatagtctgcctatggatctgctccttaaacaggggtctttgaaacaggaggtcgaaagcttctgttaccagattgtgagcgagtctaacgatcaaaaggtcgggatccttcagagcgaggacaaacaactacagccgagcgtttccaaaaaaagtgaaggagagttgagtcgggtcaaatttatttcgaatagtaataagatcacgttctccaagaagccaaaacggaggaaatatgatgagtcctatctcagttttggtttcacatatttcgggaaccgagacgctcctcacgcccaatgtgttctctgcaagaaaattctgtctaattccagcctggctccatccaagctgagacgccatctggaaaccaagcacgctgcctacaaagacaaagacattagcttctttaagcaacacctcgattctcccgagaacaacaagccgcctacccccaaaatcgtgaacacggataacgagtcagcaacagaagccagctacaacgtgtcgtaccatatagctctcagcggggaggcacataccattggggaactcctgatcaaaccctgtgccaaagacgtggtgatgaggatgtttgacgagcaatacagcaagaaaatcgacgccgttcagttatctaattccacagttgcccgcaggataaaagatcttgccgccgacatcgaggaagaactggtgtgtaggctgaagatttgtgacggtttcagcctgcagctcgatgagtctgccgacgtgagtggcctcgcagtgctgctcgtttttgtccgctaccggtttaacaagagcatcgaggaggacctgctgctgtgtgagagtttgcagtccaatgccaccggagaggaaattttcaactgcatcaactcgttcatgcagaaacacgaaatcgaatgggaaaaatgcgttgatgtgtgtagcgacgcctctagagccgtcgacggaaaaatcgcagaggcagttactttgatcaagtacgtggccccagagagtacaagtagccattgcctcctgtaccgccacgcactcgcagtcaagatcatgcccaccagcttaaagaacgtcctggaccaggccgtgcagataattaattacatcaaggcccggccgcatcagagcagattgctcaagatcctttgtgaagagatgggcgcccagcacacggcattgttgctgaatactgaagtccgctggctctctcgagggaaagtgttagttcggttgttcgaactgagaagagagctcctagtcttcatggattccgcattccgcttaagcgactgcctgaccaacagtagctggctgcttcggctggcctatctcgccgatatcttcacaaaactgaatgaagtcaacttgtccatgcagggtaaaaatgttaccgtgtttaccgtgttcgacaagatgtcctccctgctccgaaaactggaattctgggccagtagtgttgaagaagagaattttgattgctttccgaccctgtccgatttcctgaccgagatcaacagcactgtcgataaggatatatgtagcgccattgtccagcacctgcgagggctccgcgctaccttgcttaagtactttccagtaaccaatgacaacaacgcatgggttcggaacccgttcactgtcacagtgaaacctgcctcactagtcgcgagggactatgagtcactgattgatctgacatccgacagccaggtgaaacagaacttctctgagctgtcccttaatgatttttggtcttcccttatccaggagtacccatcaattgcaagaagagcggtccgagtgttactccccttcgccaccatgcatctatgtgagacagggtttagttactacgcagcgacgaagaccaagtacaggaaacgccttgacgcggccccccacatgcggattcgcctatcaaatatcacccccaacatcaaacgcatctgtgacaagaaaacacagaagcactgcagccattag

SEQ ID NO: 34963 - DNA, 1305 bp, Artificial Sequence
  Description of Artificial Sequence: Synthetic coding sequence
atgcccgatcgggactcttacgccaatggcactggctcatcgggcggaggccccggaggcgggggcagcgaagaagccagtggagccggcgtgggcagcggcggcgccagctccgacgccatctgcagggattttttacgcaatgtgtgcaagagagggaagcgatgcaggtacaggcacccagacatgtcagaagttagcaatttgggagtctcaaagaacgaatttattttttgtcatgactttcagaataaggaatgcagccggcccaactgccggtttatccatggcagtaaagaggacgaagatggctataagaagacaggtgagctgccgcctcggcttaggcagaaggtggctgctggcctcggtctgtcacccgccgatctgccaaacgggaaagaggaggtgcccatttgtagggactttttaaagggcgattgtcagaggggcgcaaaatgtaagttccgtcacttacagcgcgattttgaattcgatgcccgcggcggcgggggaaccggaggcgggagcaccggttctgttctgccagggcgacgtcatgacctgtacgatatttatgacctgcctgacaggggctttgaggatcatgaaccggggccaaaacgcagacgcggcggttgctgcccaccagatgggccacatttcgaatcttatgagtacagcctggcgcctcctaggggtgtggaatgtcgcctcttggaagaagagaatgctatgttgcgaaagagggtggaagagctgaaaaagcaggtaagcaacctgctggccacaaacgaggttctactggagcaaaatgcccagttccggaaccaggcaaaggttatcaccttgagcagcacagctccagctaccgagcagacactggcccccaccgttggaactgtggcgaccttcaatcatgggatagctcagacacacactacactgtcctcgcaagccttacaaccccgccctgtctcccagcaggaactggtcgcacctgcaggagcccctgccgccccacccaccaacgcagctccccccgccgcacctcccccaccccctccacacctaacccccgaaataacacctctgtctgcggcgctagcccagaccatcgcccagggcatggcgcctccacctgtgagcatggcacccgtggcggtctctgtcgccccggtagcccctgttgctgtatcaatggcccaacccctggctgggatcaccatgtcccacactacgacacccatggtgacctaccccattgcgtcgcagtcaatgagaataaccgcaatgccccactag

SEQ ID NO: 34964 - DNA, 270 bp, Artificial Sequence
  Description of Artificial Sequence: Synthetic coding sequence
atgcccgaccgggattcttatgccaacgggaccgggagctctggagggggaccgggcggcggtgggagcgaggaggcatcaggagctggcgtgggttcgggaggagcctcttcagacgctatttgtcgcgacttcctgcgtaacgtctgtaagcgagggaagagatgtaggtaccgacacccggacatgagtgaggttagcaatctaggggtatctaagaatgagtttattttctgtcacgatttccaaaacaaggagtgcagcaggtag

SEQ ID NO: 34965 - DNA, 138 bp, Artificial Sequence
  Description of Artificial Sequence: Synthetic coding sequence
atgccagacagggacagttatgccaacggaactggttcatctgggggagggcctggaggcggcggatcagaagaggcgagcggcgccggtgtgggcagcggcggcgcctcctccgacgccatctgcagagatttctag

SEQ ID NO: 34966 - DNA, 240 bp, Artificial Sequence
  Description of Artificial Sequence: Synthetic coding sequence
atgccagatagggatagctacgccaacggtactggatccagtggtggaggaccaggcggcggcgggtctgaggaagccagcggagccggggtgggtagtggaggggcgagttcagatgctatttgcagggattttctgcgcaatgtctgtaaaagaggcaaaaggtgtcggtaccggcatcctgacatgtccgaggtgagcaatctcggcgtcagcaagaatgaattcattttttgctag

SEQ ID NO: 34967 - DNA, 5136 bp, Artificial Sequence
  Description of Artificial Sequence: Synthetic coding sequence
atgataagtaccgcacctctgtattccggagtgcacaattggactagctcagaccgaatccgcatgtgcggcattaatgaagagagaagggcacccctgagcgacgaagaatcaaccacaggggactgccagcacttcggcagccaggagttctgtgtttcgtccagctttagcaaggtggagctgacggctgtcggctctggaagcaacgcccgaggtgcagatcctgatgggtccgccaccgaaaagctgggacataagtccgaggacaaacctgatgatccccagccgaagatggactacgccggaaacgtcgccgaggccgagggatttctagttcccctgagttctcctggcgacgggctgaagctccctgccagcgacagcgctgaggcatccaatagccgcgcagattgttcctggactcccctgaacacccagatgagtaagcaagtggattgcagccccgccggcgtcaaggcattggatagtaggcagggcgttggtgagaaaaacacatttatcttagccaccctgggcactggggttccagtcgaagggactctgccactggtaactacaaatttctctcctctgcccgcacccatttgccctccggctcccggttcagctagtgtcccccatagtgtaccagacgccttccaggtcccgttgtccgtccccgcccccgttcctcactcaggtctagtgcccgtacaggttgctaccagcgttcctgctccgtcccctccattagcccccgtgccggctctggccccagccccgccctcggtgccgactcttatctcagattcaaatcccctgtccgtaagtgctagcgtcctcgtgcccgtccctgccagtgccccaccctctgggccagtgccactttcagcccccgcccccgctccattgagcgtaccggtgagtgctccccccctcgcactgatacaagccccagtacctcccagcgcgcccacactcgtcctggcacccgtacctaccccggtgctggctcccatgccagcatctacccccccagccgcgcctgctccccctagtgtaccaatgcctactcctactccgagctcgggaccgccatccacgccaaccctgattccagcttttgccccaacaccggtgccggccccaacccctgccccaatctttacacctgcccccactcctatgcctgcggccaccccagcggctatccccacctctgcgcccattcctgctagttttagtctgtcgcgggtgtgctttccggcggctcaggcaccagcaatgcaaaaggtccctctctcttttcaaccaggaacagtgctgaccccatctcaacctctggtgtatatcccccccccgagttgcggacagcctttaagtgtagcgaccttacctaccacactcggcgtctcaagcactctgacactgccggtgctgccaagctatttacaggaccggtgcctgcctggagtgctggctagtccagagctgaggagctatccatacgcctttagcgtagctcggcccctgacttccgactccaagctcgtgtcacttgaggtgaatcggctgccctgcacctcaccctccggctccaccacaacacagccggctccggacggagtgcccggtcctctggccgataccagcctggtgacagcatcagccaaggtgctccccacaccgcaacccctgctccctgcacccagcggatccagcgcgcctccccatcctgccaagatgccctccggtacagagcagcagacagaaggaacgagcgttaccttttctccgctgaaatccccacctcagctcgagagagagatggcatcgccccccgagtgtagcgaaatgccactagatctttcctcaaaatctaatcgtcagaaacttccactgccgaaccagagaaaaactcctcccatgcctgtcttgacgcctgtccatacatcgagtaaggcgctgctgtccaccgttttgagccgaagtcaacgcaccacccaagccgcagggggcaacgttacctcctgtttagggagcacttcatcaccattcgtgatctttcctgagattgtgcggaacggcgatccgtcgacatgggtgaaaaattctacagccctgatctccactatccccgggacgtacgtaggcgtagctaaccctgtaccggccagcttattgcttaataaggatcctaacttgggattgaatcgagatcctcggcatttgcccaagcaggagccaatctctatcattgaccagggtgagccaaaaggaaccggggcgacatgtgggaagaagggatctcaggccggcgcagaggggcagcctagcactgtgaaacgctacacaccagcgagaatcgctcccggcctacctgggtgccagaccaaggaactttctctgtggaagcccaccggaccagcaaatatatatccccggtgtagtgtgaatggtaaacctacctccacccaagtgttgcctgttgggtggtcaccttaccaccaggccagcctgctatccatcggcataagctcagccgggcagctgactccttctcagggggcccccattaggcccaccagcgttgtcagcgagttcagcggggtgccatcacttagctcaagcgaggccgtgcatgggcttcccgaaggacaaccgagacctggcgggtcttttgtacctgagcaggatcctgttaccaaaaacaaaacctgccgtatcgcagcgaaaccatacgaggagcaagtgaatcctgtgttgctgactttgtcgccacagactggcaccctcgcactctcagtccagcctagtggcggggatatccggatgaatcaaggtccagaagaatccgagtctcacctctgctctgattccacccccaaaatggaaggacctcagggggcttgtggcttaaaactcgctggagacacaaaacccaagaatcaggttctcgctacttacatgtcacatgagttagtgttggccactccacagaatctcccaaagatgccggaactgcccttactgccgcatgatagccacccaaaagaactgatactggacgtcgtcccaagcagccggcgaggctcttccactgaaaggccccagcttggatcccaggtagatttggggcgggtcaagatggaaaaggtggacggggacgtggtcttcaacttagccacgtgctttagggccgatggacttcctgtggccccccagagaggccaggcagaagtgcgcgccaaagccggacaagctagagttaaacaagagagtgtaggcgtgttcgcttgcaagaacaaatggcagcctgacgacgtgaccgagagcctgccccctaaaaaaatgaagtgtggaaaggagaaggattccgaagaacagcaactgcaaccgcaggcaaaagctgtggtacgctccagccacaggcccaagtgccgaaaactgccctccgacccccaggaatcaactaagaaatccccccgaggagcctcagactcgggcaaggaacataatggagtgcgcgggaagcacaaacaccggaagccgaccaaaccagaatcccaaagtcctggcaagcgtgccgatagccacgaggaaggatctctggaaaagaaggccaaatctagctttagagattttatccctgtggtcctgtctactcgcaccagatcccaatccgggtccatctgtagcagctttgcaggaatggccgattcagacatgggcagtcaggaggtatttcccactgaggaagaagaagaggtaacccccacccccgctaagagacggaaggtgcgcaagacccagcgggacacccagtacagatcccatcacgcacaggacaagagcctgcttagtcaaggccggagacacctgtggcgcgcacgtgaaatgccttggcgcacagaagccgcccggcaaatgtgggatacaaacgaggaggaagaggaggaagaggaggaaggccttctcaaacggaagaagaggcggcggcagaaaagcaggaagtaccaaacaggcgaatatctgaccgagcaggaagatgaacaacgcagaaaaggccgcgccgacctaaaggccaggaaacagaaaactagctccagccagagcttagaacaccgcttgcggaacagaaatctattgcttccaaacaaggtgcagggcattagcgatagtccaaatggatttctgcccaataacttagaggagcctgcctgcctcgaaaatagcgaaaaaccatctggaaagcggaagtgcaaaaccaaacatatggccaccgtttccgaggaggccaaggacgtggtactgtactgcctgcaaaaagacagcgaggatgtcaatcatagagacaacgcaggttatacagccctccacgaagcctgctcccgcggatggactgacattctcaatattttactggagcatggggcaaatgtgaactgtagtgcacaagacggaacccgacccgtccatgacgccgtggttaacgacaatctcgagacaatctggctcttactgtcatatggcgccgatcctacactggccacatactccggtcagacagctatgaaactggcctccagcgataccatgaagcgcttcctgtcagaccatctaagcgacctgcagggcagggctgaaggggaccccggcgtatcctgggacttctatagctcatctgtcctcgaggagaaggacggctttgcctgcgatttactacacaacccaccagggagctccgatcaggaaggtgatgaccccatggaggaggacgatttcatgtttgaactgtctgacaagccgctgctgccatgctataatcttcaggtgtccgtgagcagaggaccctgcaactggtttttgttctctgatgtcctcaagcgactgaagctgtcgtcgcgcatatttcaggcaaggtttccgcacttcgaaataaccacaatgcctaaggctgagttttatcggcaggttgccagctcccagctgttaacaccggccgaaagaccaggcggactcgacgatcgctctcctcccggctcgtccgagaccgtggagctggtccggtacgaacccgacctcctgcggttgctagggtctgaagtagaattccagtcatgtaatagctag

SEQ ID NO: 34968 - DNA, 2511 bp, Artificial Sequence
  Description of Artificial Sequence: Synthetic coding sequence
atgactgccacggctgaggtcgaaacacccaagatggagaaaagcgcctccaaggaggaaaaacagcagcccaaacaggatagtacggagcagggaaatgcagactcagaagagtggatgtccagtgaaagcgaccccgagcagatctccctgaagtcttccgacaacagcaagtcctgccaacctagagacggccagttaaagaaaaaggagatgcattccaagcctcaccgacaactctgccgatccccttgcctggatcgtccgtccttcagtcagagttctatcctgcaggacgggaagctagacctcgaaaaagaataccaggctaagatggagtttgccctgaaactgggttacgctgaagagcagattcagtcagtactgaacaagttgggacccgaatccctaattaacgacgtgctggcagagttggtcaggttggggaacaagggtgatagtgaggggcaaatcaacctgtccttgctggttcctcggggcccgtcttctcgggagatagcctctccagagctatcactcgaggatgaaatcgacaatagtgacaatctgcgccctgtggtcatcgatgggagcaatgtcgccatgtctcatggcaacaaggaagaattcagttgcagggggattcagctggccgtggattggtttctcgataaaggccacaaagatatcactgtgttcgtgcccgcgtggcgcaaggaacagagccgccccgatgcccctatcacagatcaggacatcctgagaaagcttgagaaggagaaaatcctggtctttacccccagcagaagagtgcagggtagacgggtggtatgctatgacgaccgatttatagtgaaattagccttcgatagcgatgggatcatcgtaagtaacgataattatagggatcttcaggtggaaaagccagagtggaaaaagtttattgaagaaaggcttcttatgtactccttcgtgaatgacaaattcatgccacccgatgaccctctgggacgccacgggcccagcctggaaaatttcttaaggaaacgtcccatcgttcctgagcacaagaagcagccttgcccgtacggcaaaaaatgtacctacggccataaatgtaaatattatcatcccgagagagccaatcagcctcagagatccgttgctgatgagctcaggatctccgccaaattaagcaccgtgaagacgatgagcgaggggacactcgctaagtgcggcaccggaatgagctcagcgaagggcgagattacctcagaggtcaagagggttgctcccaaaaggcagtcggacccgtcgattaggtccgttgcaatggagcctgaggaatggctgtccattgctcgaaagccggaagcctcatcagtcccttccctggtgaccgccctgtccgtaccaaccattccacctcctaagagccacgcagtgggcgctctcaacacacgatcagcctcttccccggtgcctggatcatcccacttcccacaccagaaggcttcacttgaacacatggcaagcatgcagtatccccctatacttgtgaccaactctcatggcacgcctatatcttacgctgagcagtatcccaaatttgaatctatgggagaccacggctactactccatgttaggggatttttccaagctaaatatcaactcgatgcataatcgggagtattatatggctgaagttgatcggggggtgtacgctcgcaaccccaatctgtgctccgacagtcgcgtgagccatactcgcaacgacaactatagcagctataataacgtttacctcgccgtggctgacacacaccccgaaggaaacttaaaacttcaccggtcagcaagccagaatagactgcaaccttttccacatggttaccatgaggcgcttacacgcgtccagtcctatggacccgaggatagcaagcagggcccccacaagcagtcagtgccgcatttagctttacacgcccagcaccctagcacggggacacgcagctcctgcccagcagactaccccatgcctcctaacatccatcccggcgccaccccccagccagggcgagccctcgtcatgacacgcatggactctatctccgatagtagactgtacgagagcaaccccgtccgccagcgacggccccccctgtgtagagagcagcatgcaagttgggatcctctgccttgcaccaccgacagctacggttatcacagctaccctctgtctaattcgcttatgcagccttgttacgagccagttatggttaggagtgtgcctgagaagatggagcagctttggaggaacccatgggttggcatgtgcaatgactcaagggagcatatgattccagaacaccagtatcagacatacaaaaatctttgcaacatcttccctagtaatatcgtgctggccgtgatggaaaaaaacccccacacagcggacgcacagcagctcgctgcgttaattgtggctaaactgagagccgccaggtag

SEQ ID NO: 34969 - DNA, 2478 bp, Artificial Sequence
  Description of Artificial Sequence: Synthetic coding sequence
atggagaagtcagcctctaaggaagaaaagcagcagccaaagcaagatagtaccgaacagggaaatgccgattccgaagaatggatgagttcagagagcgatccagagcagatttctctaaagagctcagacaattccaagtcatgtcagcctcgagacggtcaactgaaaaaaaaggagatgcatagcaaaccacaccgtcagttgtgcagatccccctgcctggaccgaccaagtttcagccaatctagcatcctgcaggatggcaagctggacctggagaaggaatatcaagccaaaatggagttcgcccttaagttaggatatgcggaggagcagatccagtcagtgttgaacaagctcgggcccgagagcttgataaacgacgtgctggcagagctggtcaggttggggaataagggtgattctgagggccaaattaacctgtcactgctggttccgcgaggtccctcttcaagggagatcgccagccccgagctgagtctcgaggatgagatagacaactccgacaaccttcggccagtcgtaatcgatgggagtaatgtggccatgagccatggcaacaaggaagagtttagctgtcgtgggatccaactggccgtcgattggttcttggacaaaggtcataaagacattacggtttttgtccctgcctggaggaaagaacaatctcgccctgatgctcctatcaccgatcaggatattctaagaaagctcgagaaagagaagattttagtgttcacacctagtcggcgggtgcaggggcgtagagtcgtatgctatgatgaccgttttatagtgaagcttgccttcgattccgacgggatcattgtgagcaatgataactacagagacctgcaggtggagaaacccgagtggaaaaaatttatcgaagaaaggctgctcatgtactcctttgtgaacgacaagtttatgccccctgacgaccctttaggccgacacgggccgtcactcgaaaacttcttacgaaaaagacctatcgtgcccgagcacaagaagcagccctgcccttacgggaagaagtgtacttatgggcacaaatgcaaatactatcatccagaacgcgcaaaccagccacagcgaagcgtggccgatgaattgagaatctcggcaaaattatccacagtgaagactatgtccgagggcacccttgccaagtgtggcaccggaatgtcttctgctaagggagagattacctccgaagtcaagcgagtcgctccgaagcgccaatccgatccctctatcagatcagtagctatggagccagaggaatggctcagcatcgccagaaaacctgaagcttcctccgttccttctcttgtaaccgccttatctgtccctactataccgcctccaaagtcccacgcagtaggggctttaaacaccagatcagcatcttcccctgtgcccggtagcagtcatttcccccatcagaaagccagcttggagcatatggcatcgatgcagtatccccccatcttagtcaccaactcccacgggacgcccatctcttatgctgaacagtaccccaagttcgagagcatgggcgaccacgggtactactccatgctgggcgatttttccaaacttaacatcaacagcatgcacaaccgcgaatactacatggccgaagtggacaggggggtgtatgcccggaatccaaatctgtgcagcgactcccgtgtgagccacactaggaatgataactacagttcttacaataatgtgtatctggctgttgcagatacacaccctgaaggaaacctgaaattgcatcgcagcgcctctcagaataggctccagccattcccccacggctatcatgaggccctcacgcgggtgcaaagctacggacccgaggattccaaacagggcccacacaagcagtccgtgccacacctcgctctccacgcccagcatccgagcaccggtactcgaagctcttgcccagctgactacccaatgcccccgaacatccaccccggcgccaccccgcagcctgggagagcactggtgatgacacgtatggactcaatcagcgatagccgactgtacgagagcaatccagttagacagcggcgacctcctctttgcagggaacagcatgcgtcttgggacccgctgccatgtaccactgacagttacggctatcactcatacccactatctaactctttaatgcaaccttgctacgagcctgtgatggtacgctccgtgccagaaaaaatggagcagctgtggagaaacccatgggtcggaatgtgcaatgatagtcgagaacacatgatcccagagcatcagtaccagacctacaaaaacctctgcaacatcttcccctccaatattgttctggccgtgatggaaaaaaaccctcacacagctgatgcacagcaactcgctgcacttatcgttgccaagctgagggccgccagatag

SEQ ID NO: 34970 - DNA, 2652 bp, Artificial Sequence
  Description of Artificial Sequence: Synthetic coding sequence
atgcccggcggagggagccaggaatacggggtgctgtgtatccaggaatataggaagaatagcaaagtggagtcatcaacgcgcaacaatttcatgggtctcaaagaccaccttgggcacgacctcggacacctctacgttgaatcaactgatccacagttaagccctgccgtcccatggtctaccgtagaaaacccttctatggataccgtgaacgtaggcaaggacgaaaaggaggcatctgaggagaatgcttctagcggtgacagtgaagagaacaccaattcagatcacgagagtgaacaactaggaagcatttccgtggaaccgggactgattaccaagacccacaggcagttgtgtaggagtccctgcctggaacctcacattctgaaacgcaacgaaatccttcaggacttcaagccagaggagagccagaccacttcaaaagaggccaaaaaaccacctgacgtggtgagggaataccaaactaaactggaatttgccctcaaactaggttattcagaggagcaggtgcaactggtattgaataaactaggcactgacgctctgatcaacgatatcctcggggagctggtgaaactggggaataagtctgaagccgaccagactgtgtcaaccatcaatacgatcactcgagaaacttccagtttggaatcacagcggtccgaaagccctatgcaggaaatagtgacagacgatggagagaatctacggcctattgtcatcgacgggtcgaacgtcgcgatgagccatgggaacaaagaggtgttcagctgcaggggcatcaaactcgcagtagactggttcttagagcgaggacacaaagacatcactgtatttgtgccagcatggcgcaaagaacaatcccgaccagacgctttgattactgatcaagaaattctgcgcaaactggagaaggagaaaattctggtctttacaccctccagacgggtacagggcaggagagtcgtttgttacgatgatagattcatagttaagcttgccttcgagagcgacggaatcattgtgtctaatgataattatcgagacttggctaacgagaaacccgagtggaagaagtttatcgatgagcgcctacttatgtattcatttgtaaatgataagttcatgcccccggacgatcctctgggcagacacggtccttctctcgataatttcctcaggaaaaagcccatagttccggaacacaaaaagcagccatgtccatacggaaagaagtgcacgtatgggcacaagtgtaaatattatcaccccgaaagaggttcacagccccagagatctgtggcagacgagctcagagcaatgtctagaaatactgctgccaagacagcaaacgagggaggactagtaaaaagtaattcagtcccatgctcgactaaggccgattcaaccagtgacgtgaagagaggcgcaccaaaaaggcagagtgatcctagcattaggacacaggtctaccaggatctggaggagaaactgcccacaaaaaataagctcgagactcgtagcgtcccgtcactggtgagcatccctgccacctccacggctaagccgcagtctacaacctcccttagcaatggtttgccaagcggagtacactttccacctcaggaccagcgtcctcagggccaataccctagtatgatgatggccactaagaatcacggcacaccgatgccttatgagcagtacccaaagtgtgattcccccgtcgatattggctactatagcatgctcaatgcatactctaacctgtccctgtcaggccccaggtctcccgagcgcagattcagcctggacacagattaccgaatctcctcagtagctagcgattgctctagcgagggatcaatgtcctgcggtagcagtgatagctacgtaggctataatgacaggtcctatgtgtcgtcacccgacccccagttggaggaaaatctcaagtgccagcatatgcacccacacagtcgcctgaacccccagcctttcttgcagaacttccacgaccctctaactcgcggacagtcatacagtcatgaggagccaaagttccaccacaaacctcccctccctcacctcgcgcttcacctgcctcacagtgcagtgggcgcgagatcgagttgccctggcgattaccccagccctccgagctctgcccactcgaaagcaccccacctggggagatcactggtagctacccgtattgactcaatttctgatagcagactctacgactcgtccccatcacgacagcgaaaaccctactctcgccaagaaggactcgggtcatgggagagacccgggtacgggattgatgcctatggttaccggcaaacctattctctgcccgacaacagtacacagccctgctatgaacagtttactttccagagcttgccagaacaacaggagcctgcctggcgcatcccctactgtggtatgccccaggatccacctaggtaccaggataacagagaaaaaatctacatcaacttgtgcaatatttttcccccagacctggtgcggatcgtcatgaagcggaacccacacatgactgatgcacagcagctggccgccgccattttggttgagaagagccagctcggctactag

SEQ ID NO: 34971 - DNA, 5007 bp, Artificial Sequence
  Description of Artificial Sequence: Synthetic coding sequence
atgtccaagattcggaggaaagtgaccgtggaaaacactaaaaccatttcagacagtacctcccgacggccaagcgttttcgaaaggctgggaccgagcactggcagcaccgctgagacacagtgccgcaattggcttaaaacaggcaactgcctgtatggaaatacatgcaggtttgtgcatggcccctcccctaggggtaaaggatacagctcaaactatagaaggtctccggagcggcctactggcgacctcagagagcggatgaagaataaacggcaagacgtggataccgagccacagaaaagaaacacagaagagtcatccagtccggtcagaaaagaatcctcgcggggacggcaccgagagaaagaggatatcaagatcaccaaggaaagaactccagagtccgaagaagaaaacgtggagtgggaaactaaccgggatgatagcgataacggagacataaattatgattacgtgcacgaactgtccctggaaatgaaaagacagaagatacaacgcgaacttatgaagctggaacaggaaaatatggagaagcgagaagagatcatcattaagaaagaagtgagccccgaggtggtgcgctcaaaactgtcaccgagtcctagtcttcgcaaatcgagcaagtcccccaagcgaaagagctctcccaagtcctcctctgcctcgaagaaggacagaaagacttctgcagtttcatcaccgctgctggatcagcaaagaaactctaagactaatcaaagtaagaagaaagggcccagaaccccttcccctccaccccctattcctgaagacatagcactcggaaagaaatacaaggaaaagtacaaagtgaaagatagaatcgaggagaagacccgggacggaaaggaccggggcagggactttgagaggcaacgagaaaaacgtgacaagcctaggtccactagtccagccgggcagcaccattcccccatcagttcacgccaccatagcagcagctctcagtcagggtccagcatccagcgccactccccctcaccaaggaggaagcggaccccctccccatcatatcagcggacgctgacaccacctcttaggcgaagtgcctccccttacccttcccactccctgagcagtcctcagcggaagcagagccccccaagacaccgaagtcctatgcgtgaaaaagggcgtcatgatcacgaacgcacttctcagtctcacgatcgtaggcacgagaggagagaagacacacggggtaaaagggatcgagagaaagattctagggaagagagggagtatgaacaggatcagtcctctagccgagaccacagagacgacagagagccacgcgacgggcgggaccgacgagacgcaagggatactcgtgaccgcagggagcttcgggacagcagggacatgcgcgacagccgagagatgcgcgactattcgagggacacaaaggagtcgagagatccccgagacagccgtagcacccgtgacgcccatgattatagggacagggaaggtcgagatactcatcgcaaagaagatacctatcctgaagaatctagatcttacgggcggaatcatctacgcgaggagagcagtagaacagaaattagaaatgaaagccggaatgaaagccgctctgagatccgcaacgacaggatgggtcggtctcgcgggagagtgccagagctgcctgagaagggctctcggggttctcgcggatcccagatcgacagccatagttccaatagcaactaccatgatagttgggaaacaaggagctcctatcccgagcgcgacagataccccgagcgggacaatagggatcaagctagggactcctcattcgaacgtcggcacggggaacgggaccgtagagacaaccgggagagggaccagagaccatcctcacctattcggcaccagggtcgcaatgacgagctggagagggacgaaagaagagaggaacgaagggtcgaccgcgtagatgatcggagagacgagagggcgagggagcgggacagagagcgggagcgtgacagagagcgggagcgagagagggaacgagaacgggatcgagaaagagaaaaggaaagagaactggagagagagcgggccagagagcgggagcgggagcgtgaaaaggagagggaccgagagcgggatcgcgaccgggaccacgacagagaacgcgaaagagaacgcgaacgagatagagaaaaagagcgcgagcgggagagagaggagcgcgagcgggaaagggagcgagaacgcgagcgtgagcgtgaaagggagcgggagcgggaaagagcacgcgagagggacaaggagagagaacggcagcgtgactgggaggataaggataagggcagagatgaccggcgggagaagcgggaagaaattagagaagacaggaatccccgggacgggcatgacgaacgcaaatcaaagaagagatacaggaatgaggggtccccgagtcctcgccagtccccaaagagaaggcgagagcatagtcctgattccgatgcttataacagcggggatgacaaaaacgagaaacaccggttattgtcccaagtggttagaccccaggagtctcgttctctgtcaccatcccacctgactgaggatcgccaggggaggtggaaagaagaagatcgaaagccagagcggaaggagtcttccagaagatacgaggaacaggaattgaaagagaaagtgtctagtgtggacaagcagagagagcagactgagatcctggaatcaagccgaatgagagcccaggacataattggtcaccaccagtcagaggatagagagacatccgaccgcgcacacgatgaaaacaagaagaaagccaagatacagaaaaagcccattaaaaaaaagaaggaagatgacgtggggatcgaacggggcaacattgaaacaacgagcgaggacggccaggtgttttctccaaagaagggccaaaagaaaaaaagcatcgagaagaagcggaagaaatccaagggtgactccgatatctcagatgaagaagctgcccagcagagcaaaaagaaacggggtcccagaacccctccaattactacaaaagaggaattggtcgaaatgtgtaatgggaaaaacggcatcctggaagactctcagaagaaggaggacacagccttttctgactggtctgatgaggacgtgcctgatcgcactgaagtgaccgaagctgagcacacagctacggccaccaccccaggaagtacaccttctcctctgtctagcttgctacctccacccccccctgtggccaccgccactgcaacgacagttcccgcgaccctcgcagcaactaccgctgcagcagctaccagtttctccacatctgccattactatttctacctctgccacacctaccaatacaactaacaacacgttcgcaaatgaagactcccatcgcaaatgtcaccggactcgggtggagaaggtagagacaccacacgttactatcgaggacgcccagcaccgcaaaccgatggaccagaaacgttcctcaagcctggggtccaaccggtctaatcgctcccatacctcgggaagactgagatctccatctaatgacagtgcccaccggagtggggatgatcagagcggacggaagcgcgtcttgcacagcggcagcagagaccgcgagaaaaccaagtccctggagatcaccggcgaaaggaaaagtcggatcgaccagctgaaaagaggcgagccttcccgctcaacttctagcgacaggcaagattccaggagtcatagctctcgacggtcttctccggagagcgacagacaggttcattcccggagcgggtctttcgatagccgcgaccggctgcaggaaagagatcggtacgagcacgacagggaacgcgaacgcgagcgaagggacaccagacaaagggagtgggatagggatgccgacaaagactggccccggaacagggatagggatcggctaagggaacgcgaacgggagcgcgagagggataagcgccgggatctagaccgggaaagagagcgcctgatttctgacagcgtcgaaagggatcgagatagagacagggatcgaacgttcgaaagttcacaaattgagagcgtgaagagatgcgaggccaagctggaaggggagcatgagagagacctggaatcaacatcccgagactcgctagctctcgataaggagcgcatggacaaggacctgggcagcgtgcaagggtttgaagaaactaataaaagcgaacgcacagagagtctagagggcgacgatgaatcgaaactcgacgatgcacactccctcgggagcggggccggcgaaggttacgagcccatatctgacgacgaactcgacgagatattggctggcgacgctgaaaaacgtgaggaccagcaggacgaggagaagatgcctgaccccttggacgtcatcgacgtcgattggagcggactcatgccaaagcatcccaaggaaccccgggaaccaggagctgccctgcttaagttcactcctggcgctgttatgctgagggtgggaataagcaaaaagcttgccggtagcgagctttttgcaaaagtcaaggagacatgccagcgattgctcgaaaagcccaaggatgccgacaacctgttcgagcatgaattgggcgccctaaacatggccgccctcttgcggaaggaggaacgggcaagtctgctgtccaacctcggcccatgttgtaaggccctttgtttccgcagagactcagccattcgaaaacagctggtcaagaacgagaagggaaccatcaaacaagcctacacctcagcaccgatggttgacaacgagctcctgcgcctgtccctcaggctgttcaaacggaaaacaacctgccacgcgcccgggcacgaaaagactgaagacaataagttgtcgcagagtagtatacagcaagagctgtgcgttagctag

SEQ ID NO: 34972 - DNA, 4695 bp, Artificial Sequence
  Description of Artificial Sequence: Synthetic coding sequence
atgagcaaaatacgcagaaaggtgaccgtcgaaaacacaaaaacaatttccgattctacttcacgtaggcccagtgtgtttgagcggttgggtccaagtacaggaagtacggctgagacccagtgtagaaattggctgaagactggtaattgcctctatggtaatacctgcagattcgttcacgggccttcgcctcgtggaaaaggttattcctcaaattatcggcggtcaccggaacggcccacgggagatttgcgcgagcgcatgaagaataaacgtcaggacgttgacacagagccacagaagaggaacaccgaggagtcttccagtccggtgcgcaaagaatcctcccggggtcgccatcgggagaaggaggatattaagatcactaaagagaggactcctgaaagcgaggaggaaaacgtggaatgggaaactaacagggatgatagcgacaacggcgacatcaactacgactatgtgcacgaattatctctggagatgaagcggcagaagatccagagggagctaatgaagctcgagcaggagaacatggagaaacgagaagaaattattattaagaaggaggtcagccccgaagtggtgagatccaagctctcgccatcaccctctctgcggaagtcaagtaagtctcccaaaagaaagtcttcacctaagagtagttctgccagcaagaaggacagaaagacttctgccgtgagctctcctttactggaccagcagagaaattccaagacaaatcagtccaagaaaaaagggccccgtaccccttcgccgcccccacccataccagaagacatcgcactgggaaaaaaatacaaagaaaaatacaaagtgaaagaccgaatcgaggagaaaacccgggatggcaaagatagggggcgcgactttgaacgacagcgagagaagcgcgataagcccagatctacgtctcccgctgggcagcaccatagccccatctcaagtcgccatcacagctcatcttcccagtccggctcttctatacagaggcactcaccatctcctagaagaaaaaggactccctcacctagctatcagagaactctgaccccccccctgaggcgaagtgcatcgccgtatccttcccattcactgagctctccccagcggaagcaaagtccaccacgtcatcgctcccccatgcgggaaaagggacggcacgaccatgagcgaacctcccagtctcatgaccgtcggcacgaacgaagagaggacacacggggcaagagagatcgtgaaaaagatagccgcgaggagcgggagtacgaacaggatcagagttcatctcgggaccacagagatgatcgagagccccgagatgggcgagaccggcgtgatgctcgagatacccgtgaccggcgggaactccgagactcccgggatatgcgagactcccgggagatgcgcgactactcccgcgacactaaagaatctagagatcccagggactcacgatctaccagggatgctcacgattacagggaccgagagggacgtgatacccaccgtaaggaggatacttatcctgaggagtctagatcgtacggtaggaaccatctccgagaggaatcatccaggacagagattagaaacgagtctcgaaacgagagccggtctgagattcggaacgacagaatgggaaggtccaggggacgcgtgccggaacttccagagaaggggtcacgtggctcgcgcggatcccaaattgacagccattccagtaatagtaattaccacgatagctgggaaacgcggtcttcatatccggagcgcgaccgatatcctgagcgggataaccgagatcaggccagagattcaagcttcgagcgacgacacggtgagcgggaccggagggataatcgcgaacgcgatcagcgtccatcctcgcctattaggcatcagggccggaacgatgagctagaacgcgacgagaggcgtgaagaacggagagttgatcgtgtggacgaccgacgcgatgagagggcaagagagcgcgacagagagcgtgagcgagacagggaacgcgaaagagagagggagagagagagagatcgggagcgagagaaggaaagagaactggagcgggagagggcccgcgagcgggagagggaacgagagaaggaaagagacagagagagagatagagatcgcgatcacgatagagaaagggagcgggagagggaacgagatagagaaaaagaacgcgaacgagagagggaagaaagagagcgtgagcgggaacgagagagagagagagaacgagaacgcgagagagaacgagaaagagcccgtgagcgggataaagagcgggagcgacaacgagattgggaagataaagacaaagggagagacgatcggagagagaaacgcgaggaaattagggaggatagaaatccgagggacggccacgacgaacggaaaagcaaaaaacggtaccgcaacgaaggatctcctagccccaggcagagcccgaaacgcaggagggagcactcccccgatagtgacgcgtacaacagcggagacgacaagaacgaaaagcacagattgttgagccaggtggtccgtccccaggaaagccgctcgttgagcccaagccatctgactgaagatcgtcaaggccgctggaaggaggaagaccggaagccggaaagaaaggagtcctccagaaggtatgaggaacaggaattgaaagaaaaggtgagcagtgttgacaagcagagggaacagactgagattctagaaagtagcagaatgcgcgcccaggatataatcggtcaccatcagagtgaagaccgggagacaagcgaccgtgcccacgatgaaaacaagaagaaagccaagattcagaagaagccaataaaaaaaaagaaggaggatgatgtcggaatcgagaggggcaacattgagacgactagtgaggacggccaggtattttcacccaaaaaaggccagaagaaaaaatctattgaaaagaagcggaagaagagcaagggcgatagtgacatctccgatgaagaggccgcacagcagagcaagaagaaacggggaccccgcacccctcctatcacaactaaggaggaactagtggagatgtgcaatggtaaaaatggaatcctcgaggatagccagaagaaagaagacacagccttcagcgactggagcgatgaagacgtccctgatcggaccgaagttactgaagcagaacacacagccacagccaccacaccaggatccacccctagtcccctctcctccctcctgccgccaccccctcccgttgccacagccacagcgacaacagttcctgccaccctggccgctaccaccgccgcagcagccacctcttttagtacgtccgcgataacaatctcaacgtcagccactcctaccaacactacaaataacacgtttgccaacgaggatagccatcgtaagtgccatcgcactagagtggaaaaggtcgaaaccccacatgtgactatcgaggacgcacagcacaggaagccaatggaccagaaacgcagtagttcattgggatcaaacagatccaatcggagccatacttctgggcgtctaagatctccttccaacgatagtgcccacagaagtggtgacgatcagtccggtagaaagagagttttacacagcgggtcccgggaccgggagaagacaaagagcctcgaaatcacgggggaacggaagtcccgaatcgaccaacttaaaaggggcgaaccgtcccgctcaacgagtagcgatagacaagattcccgttctcattcatcccgacgcagctcccccgagtccgatcggcaggtccacagtaggagcggcagcttcgactcccgggaccgacttcaagagcgcgacaggtatgagcatgacagagagagggagcgcgaaagacgcgacactcggcaacgggagtgggaccgggatgctgataaagattggccaagaaatagggatcgggatcgccttcgcgagcgagaaagagagcgagagcgggacaaaagaagggaccttgacagggaaagagaaagattaatcagcgactctgtagagcgggatagagatcgggatcgggatagaaccttcgagtcatcccaaatcgaaagcgtcaagagatgcgaagccaaactggagggagagcatgagagggacctggaaagcacctctagagattcgctggcccttgacaaggagaggatggataaagatctgggctcagttcagggatttgaagagaccaacaagagcgagagaacggagtcactggaagccggagacgacgaatccaagctcgatgacgcacattccttaggtagcggcgcaggtgaaggctacgaaccgatttccgatgacgaactggacgagattttagcaggagacgctgagaagagagaggaccaacaggacgaggagaagatgcctgaccctttggatgtcatcgacgtcgattggtccggcctaatgccgaaacatcccaaggagcctagagagccgggagcagctctcctaaagtttacccccggcgccgtaatgctgagggtaggcatttccaagaaactggcaggatccgagttgttcgcaaaagtgaaagagacatgccagcgactgttagaaaagccaaagggttctttcatcttactgtag

SEQ ID NO: 34973 - DNA, 1875 bp, Artificial Sequence
  Description of Artificial Sequence: Synthetic coding sequence
atgtgcaatggtaagaatggaatcctggaagatagtcagaaaaaagaagataccgctttctcagactggagtgatgaggatgtacctgataggaccgaggtcactgaggccgaacacacagctaccgccacgacgcccggatccaccccttcccccctcagttccctcttgccccctccccccccagtggctacagccaccgccaccactgtgccagccacactggccgcaactactgctgccgctgcaacttcattttccacttccgccattacaatttcaacttccgcgacccccacaaataccactaataacacctttgccaacgaggattctcatcggaagtgccatcggacaagggtagaaaaggtggaaactccacatgtgaccatagaggatgcgcagcatcggaagcccatggatcaaaagcgatcttccagccttggcagcaatagatcaaatcggagccatacgagcggaaggctgcgctctccatccaacgacagtgcccatagaagcggagacgatcagagcggacggaaaagggttctccatagtggcagccgggatcgtgaaaaaaccaaatcactggagatcactggcgagcgcaagtcacgcatcgaccagcttaagcgaggtgagccatctaggtcaacctcatcggatagacaagatagccgttcccactcctcccggaggtcatctccggagtctgatcgtcaggtgcacagtcgatccgggtcatttgactctagggaccggctccaggagcgcgaccgctacgaacatgatcgtgagagagagagagagcgccgtgatactcgacagcgcgagtgggaccgggacgctgacaaggattggccccggaaccgggatagagatcggctgagagagcgggaaagggagcgtgagagagacaaacgtcgggacctggatagagagagggagcggctcattagcgactctgttgagagagatcgagaccgcgacagagacagaacattcgaaagttcacagatagagtcagttaagcggtgcgaagcgaaactcgagggcgagcatgaacgtgatctcgagtctaccagtagggactccctggccctggataaggagcgcatggacaaggacctcggatccgttcagggatttgaagagactaacaagagcgagagaacagagtctctcgagggagacgacgaatcaaagttggatgacgcccacagtcttggctcaggggctggtgaggggtatgagcctatcagtgacgacgaactggacgagatactggccggggacgctgagaaacgagaagaccaacaagatgaagagaaaatgccagaccctctggacgttatcgatgtggactggagcggtctgatgccaaaacatccgaaagagccgcgggaaccaggcgccgctttactgaaatttaccccaggtgccgtgatgcttcgcgtcggcattagcaagaaactggcaggatcggagctgtttgctaaagtaaaggagacgtgccaacgactgctggagaagccaaaggacgcggacaatcttttcgagcatgagctaggggctctgaatatggctgccctgctgcggaaagaagagcgagcaagtttgctgtccaatcttggaccttgctgtaaggcactctgcttccggcgtgactccgccatcaggaagcagctggttaagaacgagaaggggacgatcaaacaggcctatacaagcgcaccaatggtggataacgaactgctaagactcagcctgagattgtttaaacggaaaaccacctgtcatgcgccagggcacgaaaagacagaggacaacaaattatcacaaagcagcatccagcaagagttgtgtgtgtcatag

SEQ ID NO: 34974 - DNA, 348 bp, Artificial Sequence
  Description of Artificial Sequence: Synthetic coding sequence
atgtctaaaattcgtagaaaggtgactgtcgagaacactaagaccataagcgacagcactagcagacgaccttcagtcttcgaacggctggggccatcgaccggcagtaccgctgagacccagtgccgcaattggctgaagacggggaattgtctgtacggcaacacatgtcggttcgtgcatgggccgtcccctcgaggaaaagggtactcttctaattacagacgaagtcccgaacgccctaccggggatctgagggagaggatgaagaacaagaggcaggatgtcgatactgaaccccagaaacgaaacacagaagagagttccagccccgttcgagtgggatag

SEQ ID NO: 34975 - DNA, 1455 bp, Artificial Sequence
  Description of Artificial Sequence: Synthetic coding sequence
atggagaagagggaagaaatcatcatcaaaaaggaggttagcccagaggttgtgaggagtaaactgtcgccaagcccttccctccgcaaatcttccaaaagccctaaaagaaagtcttccccaaaatcgagcagtgccagtaagaaagatcgcaaaacctcagctgtgagttcacccttgttagaccagcagcgtaattcaaaaacgaaccaatccaaaaaaaaagggcctaggaccccaagtccccccccaccaatccctgaggacattgcgctcggaaagaaatacaaggaaaagtataaggtgaaggacaggattgaagagaagacgagagatggcaaggatagggggcgggactttgagaggcagcgggagaagagagataaaccgcgaagtacatcccccgcgggccagcaccatagtccaatcagcagtagacatcattcctcctcctcccagtcaggatccagtatccaaaggcacagtccctctcctaggaggaaacggacacctagcccgagctaccagaggacccttactccaccgttacgcaggagcgcgagcccataccccagccatagcctgtcaagcccacaaaggaagcagtcacccccacgccaccggtcccctatgcgcgagaaaggacggcatgatcacgagaggacaagtcagtcacacgatcgtcggcatgaaagaagggaggacactcgtggaaaacgcgacagggaaaaagattcaagagaagaaagggaatatgagcaggatcagagcagctctcgcgaccacagagatgatcgggagccacgcgatggtagggatcggagagacgcgagagacacacgggacaggcgagagctgagggacagtcgagatatgagagactcgcgggagatgcgggactacagtagagacacaaaagagagtagggatcccagggactcccgctccacccgcgatgcccacgactatagggatcgtgagggcagagatactcatagaaaggaagatacatatcccgaagagtctcgaagttatgggcggaatcacctgcgcgaagaatccagcaggactgaaatcaggaacgagtcaaggaatgagagccggtccgagatcaggaatgatagaatggggcggagtcgcggccgtgttcccgagctgccagagaaaggtagtaggggatcccgcgggagtcagatcgacagtcattctagcaactccaactaccacgactcttgggagactagatcctcatacccggaacgggataggtatcccgagcgggacaacagagatcaggccagagattcatcttttgagcgtcggcatggggaacgcgataggcgtgataacagggagcgcgaccagcgcccctcatctcctattcgccaccaaggccgtaacgatgagttggaacgggatgaacgccgagaggagcgccggaaagagaagaagtag

SEQ ID NO: 34976 - DNA, 3912 bp, Artificial Sequence
  Description of Artificial Sequence: Synthetic coding sequence
atggaagctgcgccaggcacgcctcctcctccaccgtcagagtctccacctccgccaagccctcctcccccctccaccccttccccccctccttgttccccggatgcccgccctgccactccccaccttctacaccatagactgccactacctgatgacagagaagacggtgaactcgaagagggcgaactggaggatgatggggctgaagaaactcaagatacatctggtgggcccgagcgctcccggaaagagaagggggaaaagcaccatagcgactctgacgaagagaaaagccatcggcgccttaaaagaaaaaggaagaaggagagagaaaaggagaaaagacggagcaagaaaaggcgcaagagcaaacacaaacggcacgccagtagttccgatgatttctcagactttagcgatgattctgatttcagcccaagcgagaaaggacatagaaagtaccgcgaatattctcctccctatgcaccttcccaccaacagtacccaccatcccacgccactcccctccctaaaaaggcctatagtaagatggacagtaagtcctatggaatgtacgaggattacgaaaacgaacagtatggtgaatacgaaggcgatgaggaggaggacatgggtaaggaagattacgatgattttactaaagagctgaatcagtataggcgagctaaagaaggctcaagcaggggccgggggagcagggggcgaggtagagggtataggggtcgtggctctaggggaggctcgcgcggacgcggaatgggccggggcagtcgcggtcgaggccgagggtccatgggcggggatcaccctgaggacgaggaagacttttatgaggaagagatggattacggagagagcgaagaacccatgggcgatgatgattatgatgagtatagcaaagaactaaaccagtataggcgcagcaaagactctcggggcagggggctcagcagaggaagaggtcggggttctcggggccgcggaaagggaatgggacgagggcggggacgtggaggatcaaggggcgggatgaacaagggcggtatgaacgatgacgaagacttttacgacgaggatatgggggatggaggaggcggcagttatcggtctcgtgaccatgataagccccatcagcagtctgacaaaaaggggaaagtcatttgtaaatattttgtggaggggaggtgtacttggggagaccattgtaacttctcccatgatatcgagctgcctaagaagagggagctgtgtaagttctacatcacaggattctgtgccagagccgagaattgtccatatatgcacggcgactttccctgtaaattgtatcacacgaccgggaattgtatcaacggcgatgattgcatgttcagccacgatcctctgaccgaggaaaccagagaactgctggacaagatgctggctgacgatgctgaagccggggcggaagatgagaaggaggtggaagaacttaaaaaacagggtattaatcctctcccaaagccaccaccaggcgtgggtctgctccctaccccaccacgcccaccaggaccccaggcacctacttcccctaatggcagaccgatgcagggtgggccgcccccccccccccctcctccacctccaccacccgggccaccacagatgcccatgcctgtgcatgagcccctatctccccagcagcttcagcagcaagatatgtacaacaaaaagattcctagtctgtttgaaattgtggtccggccaacaggtcagttggccgagaaacttggtgtgcgctttccaggcccagggggtccacccggacccatgggacctggcccaaacatgggtccccccggcccaatggggggcccaatgcatccagacatgcaccctgatatgcatccggatatgcatcctgatatgcatgccgatatgcacgcggacatgcccatgggcccaggtatgaatccaggccctccaatgggcccagggggaccgcccatgatgccgtacggacctggagacagcccacacagtgggatgatgcctcccataccccctgcacagaatttttacgaaaatttctatcaacaacaggaaggcatggagatggagcccggactgctgggggacgctgaggactacggacattatgaagaattaccgggggagccaggtgagcacctatttccagaacatcccttagaacctgattcttttagcgaaggaggccctccgggacggccaaagcccggagccggcgtcccagacttcctcccaagcgcccagagggccctgtatctgcgtattcaacagaaacagcaagaagaagaagagcgagcccgacgactggctgaaagctctaaacaggaccgagaaaacgaagagggtgacacaggaaattggtactccagtgacgaagacgagggaggcagtagtgtcacgtcaatcctgaagacactgcgccagcaaaccagtagccggcctcccgcgtcagtcggagagttgtccagctccggtctcggagaccctcgtctgcagaaaggccacccgactggtagccggcttgccgatccaagactgagcagagaccccagattaactcgtcatgtagaagcctccggcggaagcggccctggcgattccggcccttcagatccccggctggccagggccttacctaccagcaaaccagagggctccctgcatagtagtcctgtcggccccagtagcagtaaggggtccggcccacctccaactgaagaagaggaaggggaaagagctctccgcgaaaaagccgtgaacatcccccttgatcctctcccaggccatcctcttagagatcctaggtcccagctccagcagtttagtcacatcaagaaagacgtcacactgtccaagcctagttttgcccgaacagtattgtggaatcccgaagatctaatacctctccccattcccaaacaggatgctgtgcctcccgtacccgcagctttgcagtctatgcccacgctggacccaaggctgcatcgcgcagctaccgcaggtccaccaaacgcccgtcagaggcctggcgccagtacggatagcagcacccaaggcgctaacctaccggactttgaactgctttccaggatcctgaagacagtaaatgccacagggagctctgccgctcctggctcctcagataaaccttctgaccctcgagtgcgcaaggctcctaccgacccccgtctccagaagcccaccgactctaccgcctcaagtcgggccgcaaagcctggacctgccgaagctccatcaccaacagcttctcctagtggagatgcctcccctccagcgaccgcgccttacgatccgcgggtgctggcagccggtgggctgggacagggcggaggcggaggacaatcatcggtcctgagcggaatcagcctgtatgaccctcgcacaccaaacgccggcggcaaggcaaccgaacccgccgcagatacaggtgctcagcccaagggcgccgaggggaacggcaaatcatccgcctctaaggccaaggaacccccctttgtgcggaagagcgcccttgaacagcctgagacaggcaaagctggcgcagatgggggaactccgacagacaggtacaactcttataaccggccaagaccaaaagccgctgctgcccccgccgcgactacagctaccccacctcccgaaggcgccccaccccaaccgggcgtgcataacctcccagtcccaacgctgtttggaaccgtgaaacagacccctaagactggatcgggctcccccttcgccggtaactctcctgcaagagagggcgaacaggacgccgcgagcctcaaagacgttttcaagggcttcgaccccacagcttcaccattctgtcagtag

SEQ ID NO: 34977 - DNA, 3570 bp, Artificial Sequence
  Description of Artificial Sequence: Synthetic coding sequence
atgactgacagcgaacacgccggccacgatagagaagatggcgaactagaagacggcgaaattgacgacgcaggcttcgaagagattcaggagaaagaggcaaaggaaaatgagaaacagaagtccgaaaaggcttacaggaagtccagaaaaaaacataagaaggagcgcgagaagaagaagtccaaacgacggaagcgcgagaagcacaagcacaattccccctcaagcgatgactccagcgactactccctggacagtgacgtggaacatacagaatcaagtcacaagaagcggactggtttctacagagattacgatatacccttcacccagcggggccacattagcggaagctatatcaccagcaagaaaggccaacacaacaaaaagtttaagagcaaggaatacgatgaatatagcacatatagcgatgacaatttcgggaactactccgatgataatttcggcaactacgggcaggaaacggaggaggatttcgctaaccagctgaagcagtaccgccaggctaaggaaacatcaaatattgctctcggtagttctttctccaaagaatctggcaagaagcagcgcatgaaaggggtgcagcaggggatcgaacagagggtcaaaagcttcaatgtgggcagaggtaggggactgccaaagaaaattaagaggaaggaaagagggggcaggaccaacaaagggcccaacgtttttagtgtctctgatgattttcaggaatataacaagccaggaaagaaatggaaagtgatgacccaggaatttattaaccaacatacagtggagcacaaaggcaaacagatttgtaagtactttctcgagggtcgttgcatcaagggcgaccaatgcaaattcgatcatgacgccgaacttgaaaaacggaaggaaatttgtaaattttatcttcaaggatattgcacgaagggcgagaactgtatctacatgcacaacgagtttccctgtaagttttaccactccggagcaaagtgctaccaaggtgataattgcaaatttagccatgacgacttgactaaggagaccaagaaactgctggacaaagtcctgaacaccgacgaggagctgattaatgaggacgaacgagagcttgaagagctcagaaaaagagggattacgcccctgcctaaaccacctccaggagtaggccttcttccgacaccacctgaacatttccccttttcagaccctgaggacgacttccagactgacttttctgatgacttcagaaagataccgtccctgtttgagatcgtggtgaaaccgacggtggatctggctcataagataggacgtaagcccccagccttctatacatccgcctctccacccggccctcagttccaaggatccagcccccatcctcaacacatctattcttcaggttctagccctggtcctggacctaatatgtctcagggacactcttcacccgtcatgcatccgggctctccagggcaccatccctgtgccgggcccccagggctccccgttccacagagtcctccactgcctcctggacctcctgaaatcgtgggcccacagaatcaggctggagtcctcgtacaacctgacacgtccctcacacccccatccatgggcggcgcctaccattctccagggttcccagggcacgtgatgaaggtcccccgcgaaaatcattgcagtccaggctcttcctatcaacagtccccaggcgagatgcagctgaataccaactatgaatccctacagaaccccgccgaattttacgataactactacgcccagcactcgattcacaacttccagccaccgaataacagcggcgatgggatgtggcacggcgaattcgcacaacagcagcccccggtagtgcaggacagccccaatcacggaagcggcagcgacggctccagcaccagaacaggacatggtcctcttccagtgcctgggttgctccccgccgtccagagagccttattcgtgcgcctcacacagcgctatcaggaggatgaagaacagacatctacgcaaccccatagagcgccctctaaggaagaggacgataccgtgaattggtatagttctagcgaggaggaggaggggtccagtgttaagagcattctgaaaaccctgcagaagcagactgagacactcagaaatcagcagcagccctcaacagaactgagcaccccgacagacccgaggctggcaaaggaaaagtctaaggggaaccaggtggtggatcctcgtctgcggaccattccccggcaggatattaggaaaccctcagagtctgcaccattggacttgcgtctggcttgggaccccaggaaacttcggggaaatgggtccggccacatcggctcttctgtggggggggctaaattcgacctccaccacgcaaacgccggcactaatgtcaaacataaacgaggggacgacgacgacgaggatacagaacgtgaactccgcgagaaggcctttcttattcctctcgacgcaagcccgggcattatgctacaggatcccaggtctcagttgagacagttttctcatataaagatggacatcacactgactaagcccaatttcgccaaacacattgtttgggcgcctgaagatctgcttcctgtccccttgccaaagcccgacccagtgagttcaatcaatctccccctccctccactcattgccgaccagcggctgaaccggctatggaacaccaagtccgaccttcatcagaacaccgtttcaatcgaccctaagttggccgcaaaggccaaaatcaacaccactaaccgggaggggtatttagaacaattcggcgactcccatgggtctggtgccaaacttggcgatcctcgcttacaaaagaactttgatcctaggctacacaggttgcctaataccgaatcgcatcaggttgtaatgaaggactctcacgcgtcaaagggtgctccccatcttccccgatctaacccaggctcgtctcaaccaagcggcgccgggacaagtaatagcggttccggcgccctgcccccatatgcgccgaagctctcgtcgtccgcgggattacctttaggcacaagcaccagcgttctgagcggcatcagcttgtatgatcccagagaccatggttccagctccacctcggagctggccactgcgagttcgggcgagaattcaaaaaaccaaaagaagtctggcggcctcaaaagttcggataaaaccgagcctagtcccggtgaagcaattctgccccagaaaccctccccgaatgtcggcgtcactctggaggggccagccgatccacaggctgatgtgcccagatcttccggcaaagtacaggtgccagctgtgcattcattgcctgtccaggctctgacaggactgataaggccccagtattcagaccctcgccaggctagacagccagggcagggaagccccacgcctgataacgatcccgggagggaaactgacgacaaatccttgaaagaggtctttaaaactttcgacccaacagccagtccattctgttag

SEQ ID NO: 34978 - DNA, 3570 bp, Artificial Sequence
  Description of Artificial Sequence: Synthetic coding sequence
atgacagacagcgaacacgcggggcacgatcgggaggacggcgagcttgaggatggggagatcgatgacgccggtttcgaagaaattcaggagaaggaagccaaagagaatgaaaaacagaagtctgaaaaggcataccgcaaatcacgaaagaaacataaaaaggagcgcgagaagaagaagtctaagcggcgcaagagggagaaacacaaacataactcaccgagttcggacgattccagtgactatagtcttgatagcgacgtcgaacacaccgagagtagccacaaaaaacggaccgggttttaccgggactacgacataccgttcacccaacgaggtcatatctcgggatcctacatcacgtcgaagaaggggcagcataacaaaaagttcaaaagtaaagagtacgacgagtattctacctatagcgacgacaattttggaaactattccgacgacaacttcggaaactacggccaggagacagaagaagacttcgcaaaccagctgaaacagtatcggcaggctaaagagacgtccaatatcgcccttggctcaagcttctcgaaggaatctggtaaaaagcagcggatgaaaggcgttcagcagggtattgagcaaagggtgaagagtttcaatgtgggccggggacgaggactgccaaagaagatcaagcgtaaggaacgaggcggccgcactaacaaaggacccaacgtgtttagcgtgtctgatgactttcaggagtacaataagcctggaaagaagtggaaagttatgacccaggaattcatcaaccagcacaccgttgaacacaaaggcaaacagatatgtaagtacttcctggaggggagatgcatcaagggggaccaatgcaagttcgaccatgacgcagagctggaaaagcggaaagagatatgcaaattttaccttcaggggtattgtaccaagggggagaattgcatctacatgcataatgaatttccctgcaagttctatcattctggggcaaaatgctatcagggtgacaactgcaagttcagccatgatgatctgaccaaggaaacgaagaagctgctcgacaaggtgctgaacaccgacgaggagttgatcaacgaggacgaaagagaactcgaggagttacgcaagagggggatcacaccactgcccaaaccaccaccaggagtggggctgctgcccactccccctgaacacttcccttttagcgacccagaagatgatttccaaactgacttcagcgacgacttccgtaagatcccttccctgttcgaaattgtcgtcaagcccaccgtggaccttgcccataagattgggagaaagccgcctgcattctacacatctgcctccccgcccgggccacagttccagggctcttcgccacatcctcagcacatttatagctctgggagcagccctgggcctggccctaatatgtcacaggggcatagtagcccggtcatgcaccctgggtccccaggccatcacccctgcgctggccctcccggactgcccgttccgcagtcccctcccctcccaccaggaccaccagagattgttgggccacagaaccaagctggtgtgcttgttcagcctgacacgagccttacccctccatccatgggcggggcttatcattcccccgggttccccggccatgtcatgaaggtcccacgggagaaccactgctccccaggtagctcttatcaacagtcccccggcgaaatgcagctaaatacgaactatgagagcctgcagaatcctgctgaattttatgataactactacgcccagcattctattcacaattttcagcctcccaacaacagcggagatgggatgtggcacggagaattcgcacagcagcagcctccggtcgttcaggattccccgaatcatggctccgggtcagacggcagttcaaccaggaccggccatggacctctgcccgtccctggcttgctccccgctgtccagagagctctctttgtacggctgacccagcgatatcaggaagatgaggaacagaccagcacgcaaccgcacagggccccatcaaaagaggaggatgatacagtgaactggtactctagcagcgaggaggaagagggctcctcggtgaagtccattctgaagacccttcaaaaacagacagaaactctccgtaatcagcagcaaccaagcacagagctcagcactccaactgacccccggcttgccaaagagaagtccaaaggcaaccaggtggtcgacccacgcctgcggaccatcccacggcaagatatccggaagccctccgagagcgctccccttgatctcaggctcgcatgggatcccagaaaattgagaggaaatgggtcaggacacatcggaagctcagtcgggggggctaagtttgacctgcatcacgccaatgccggtacaaacgttaaacacaaacggggagacgacgacgacgaagacaccgagcgggagttgcgggaaaaagccttcctgatcccgctagatgcctcacccggcatcatgctacaggacccccggagccagctgaggcaatttagccacatcaagatggacattacactcaccaagccaaatttcgcaaagcacatcgtttgggcgccggaggacctgttacccgtccctctcccgaaaccagatccggtctcgagtatcaatcttccactgccccccctgattgcagatcaacgtctgaatcgactgtggaacactaagtcggaccttcaccagaacaccgtgagtatcgatccaaaactcgcagcaaaagccaagatcaatactacaaacagagagggatacctggaacaatttggggatagccatgggtcaggggctaagctgggtgatccaaggttgcaaaagaacttcgaccctcggttacatcgcttacctaatactgaatctcatcaagttgtcatgaaggactcccatgcttctaagggcgctcctcatctccctagatcaaaccccgggagcagtcaaccctctggtgctgggacttctaacagcgggagtggcgccctgccaccgtacgcacctaaactgagttcttctgcggggctccctttaggaacatctacttccgtcttgtcaggcatatctttatatgatcctagagaccacggctcctccagcacaagcgaactcgctaccgcctcctccggtgagaattctaagaatcaaaagaagtctggaggtcttaagagtagcgataaaacagagccaagccctggggaagccatacttccgcagaagcctagtccaaacgtaggggtgacattggagggccccgctgacccacaagctgatgtgccccggtcatccggtaaggtgcaggtccctgccgtacattcccttccagtgcaggccctcaccggcctgattagaccacagtactctgaccctcggcaggcccggcagcccgggcaagggagccccacgccagacaacgacccaggacgtgagacagacgacaaaagtctgaaagaggtctttaagacttttgatcctactgcttctccgttctgctag

SEQ ID NO: 34979 - DNA, 2679 bp, Artificial Sequence
  Description of Artificial Sequence: Synthetic coding sequence
atgcaggatctcaaaaagtataaaaagaaaaagcaaaagcgtatgaagagtcgcaaggtgaggaaaccaactgagaatcaggaaaaaaatatacggaaacgcgaaagaaagaaatcaaaaaggagaaaaagggagaagcacaagcacaacagcccttctagcgatgactcctcggactattcattggatagcgacgttgagcacaccgaatcgtctcacaagaaacggacaggtttctaccgggactatgatatcccttttactcagaggggacacattagtgggtcgtacattaccagtaagaagggtcagcacaacaaaaaatttaaaagcaaggagtacgacgagtactctacttattctgatgataattttggcaactacagcgacgacaactttggtaactacggccaggagaccgaagaggattttgctaaccagcttaaacagtaccggcaggcaaaagagacttcaaacattgctctggggtctagcttttctaaagagtctggaaaaaaacagcgcatgaaaggcgttcagcaggggatcgagcaacgggtgaaatccttcaatgtgggacggggcagaggtctccctaaaaagataaaaaggaaagagcgaggtgggcgtacaaacaaggggcccaatgtgtttagcgtgtccgacgatttccaagaatataacaaacctgggaaaaagtggaaagtgatgacccaggagtttatcaatcagcatacggtcgagcacaaagggaaacaaatctgtaagtatttcctggaaggcagatgtatcaaaggagatcagtgtaagttcgaccacgatgccgagctggaaaagcgaaaggaaatctgcaagttctatttacagggttactgcaccaaaggtgagaactgcatctacatgcacaacgagtttccttgtaaattctatcattcgggcgccaaatgttatcagggcgataattgcaaattttctcacgatgatctgacaaaggaaacaaaaaagctgctggacaaggttctgaataccgacgaggaactcatcaatgaagatgagcgcgagcttgaagagttgagaaagagaggaattacccctttgccgaagccccctcctggtgtcggattgctgccaactccgccagaacactttcctttctctgaccctgaggacgactttcaaaccgatttttccgatgactttcgcaagatcccctctctcttcgagatcgtagtaaaacccactgttgaccttgcccacaagattgggaggaaaccccctgccttttacactagtgcctctccccctggaccccagttccaggggagtagcccacatccccaacatatctatagcagcggatcgtccccaggccctggccctaatatgtcccaggggcattcgagcccggttatgcaccctggctcgccaggccatcatccatgtgccggcccccccggcctgcctgtgccgcagagcccaccactgcctccaggcccaccagagatcgtcggcccacagaatcaagcaggggttctagtgcaaccggacacctctctaaccccaccctccatgggcggagcttatcacagcccaggctttcccggacacgtgatgaaggtgcctcgggaaaaccactgcagcccaggtagctcttatcagcagtcacctggcgagatgcagcttaacacgaactacgagagcctgcaaaatccagccgaattctacgacaactactatgcccaacattctatacacaacttccagcctcccaacaactccggtgatgggatgtggcatggcgaatttgcacagcaacagcctccagtcgtccaagattcccccaaccatgggagcgggagcgacggctccagcacacgtacaggtcacggcccacttcctgttccaggcctcctgcccgctgtgcagagggccctatttgtccggcttacccagaggtaccaggaggacgaggagcagacttcaacacagcctcatcgcgcacccagcaaggaagaagatgatactgtcaattggtatagcagttctgaggaagaggagggaagctcagtaaagtccattttgaaaaccctgcagaagcaaacagagacactgcgaaatcagcagcagcctagtacggagctgagtacccccacagacccaagactcgccaaggagaaatctaagggcaatcaggtggtggatcccagactgcgcactattccgcgccaggacatccggaagccaagcgagtcagctcctttagatctgagactggcatgggatccccggaagttgaggggtaatggtagtggacacataggatccagtgtggggggggctaaattcgacctgcaccacgctaatgcagggacaaacgtcaaacacaagcgcggagacgatgatgatgaggatacagagagggaattgcgggaaaaggccttcctgatccccctggacgctagccccggcatcatgcttcaagatcctcggtcgcagcttcggcaattctcacatattaaaatggacatcacactcacaaaaccaaactttgccaaacacattgtatgggcgcctgaagatctcttgccagtaccacttccaaagccagatccagtcagcagtatcaaccttcccttaccaccccttatcgccgaccagagattgaaccgcctctggtag

SEQ ID NO: 34980 - DNA, 903 bp, Artificial Sequence
  Description of Artificial Sequence: Synthetic coding sequence
atggccgaacccaccgtatgttcgtttctgactaaggtattatgtgcacatggaggccggatgttcttaaaggacctgagagggcacgtcgaactgtccgaggctcggttgagggatgtgctacagcgtgccggaccggaacggttcctcctccaggaggtggagacccaggaggggctgggagacgccgaggccgaagccgccgccggagctgttggcggaggaggaacatctgcatggcgagtcgtcgctgtgtcatctgttcgcttgtgtgctcggtatcaacggggagaatgccaagcgtgtgaccagttacacttctgtaggcgtcacatgctgggcaaatgtccgaacagggactgttggtcaacatgtacactgagccacgatatccacacacccgtgaatatgcaggtgctgaagtctcacggattattcgggttaaatgagaatcagctgagaatcctgctgttacagaatgatccgtgcctcctccccgaggtatgtctcttgtacaataagggcgaggctctgtacggatattgtaacttgaaggacaagtgcaacaagttccatgtgtgcaaatcattcgttaagggggagtgcaagctccagacgtgcaagcgcagtcaccaactgattcatgcggcttctctgaagttgcttcaagaccaggggctgaacattcccagcgtagtgaatttccagattatcagtacttacaagcacatgaagctccataaaatgcttgagaacaccgataactccagccccagtacagagcactctcagggcctggaaaaacaaggcgttcacgcagctggcgccgccgaggcaggccccctcgcctcagttccagcacagagtgccaagaagccttgccctgtgtcttgtgaaaaatag

SEQ ID NO: 34981 - DNA, 309 bp, Artificial Sequence
  Description of Artificial Sequence: Synthetic coding sequence
atggccgaaccaacagtgtgcagttttctgacaaaagtgctgtgcgcccatgggggcaggatgttcttaaaagacctgcgtggacacgtggaactgtcggaagcccggctgcgggacgtcctgcagcgagctggacctgagcgatttctgctacaggaagtcgaaactcaggagggactgggcgatgcggaagcagaggctgccgccggcgcagttggcgggggggggacctcagcatggagggtagttgccgtatctggaacaatcggggcctgtcaccacacccaattgatctttttgggattctag

SEQ ID NO: 34982 - DNA, 1575 bp, Artificial Sequence
  Description of Artificial Sequence: Synthetic coding sequence
atgatgaccaccctgcaaaacaaagaggagtgcggtaaggggcccaaacgaatttttgcccctcccgcccagaaatcttactccctgctcccttgttctccaaattccccaaaggaggagacccctggcatctccagcccagaaacagaggcacggatttcgttgccaaaagcctcattaaagaaaaaggaggagaaggcaactatgaagaatgtgccttcccgggagcaggaaaaaaagagaaaagctcagatcaataagcaggcggagaagaaggaaaaggagaagtcatctctcaccaatgctgagttcgaggagatagtccaaattgtcttgcagaagagtctccaggagtgtctgggtatggggtcagggctggacttcgctgaaactagttgcgcacagcccgtggtgagcacccagtctgataaagagccaggcatcacagcgagtgctaccgataccgataacgcgaatggtgaagaagtgccacacacacaggagatctcagtctcctgggaaggagaggcagcgcccgagattagaacatccaaactcggtcaaccggatcccgcaccatccaagaaaaaatccaacagactgaccctgtccaagcgcaagaaagaagcccaggacgagaaagtggaaaaaactcaggggggccacgaacatcggcaggaggatcgtttaaagaagaccgtccaggaccacagccagatccgtgatcaacagaaaggcgagatttccggcttcgggcaatgtctggtgtgggtgcagtgcagttttcctaactgcggtaagtggcgaaggttgtgtggtaacatcgaccccagcgtactccccgacaactggagctgtgaccagaatactgatgttcagtataacagatgcgatataccagaagaaacctggactgggctcgaatccgatgtcgcatacgccagttatatcccaggctctataatctgggctaagcaatacggctacccttggtggcccggcatgattgaatctgatcctgatctgggtgaatattttttgtttacgtctcacttggactctttgcctagcaagtatcatgttaccttcttcggggagacagtctccagggcatggattcccgtaaacatgctaaagaacttccaggaactcagcctcgaactgagcgttatgaaaaaaaggcggaacgattgcagtcagaagctgggcgtggctctgatgatggcacaggaggctgagcagattagcattcaggaacgagttaatctgtttggattttggagccggttcaacggatctaactcaaacggggagcgcaaggacctgcaacttagtggactaaacagccctggatcatgtttggagaagaaagaaaaggaggaagagttggagaaagaggaaggtgaaaagacagccctgcggaaaaacctgaagttaccacgtgctagaccatggcaacctgcctttcagcgggagaagaaactggagcagtgtcaaagaacttgggcataccagagggttcgtgggcctgcgccacacctcagaaaaaagagccccgatacgggaaacccttag

SEQ ID NO: 34983 - DNA, 330 bp, Artificial Sequence
  Description of Artificial Sequence: Synthetic coding sequence
ccaatggtgggacttctggtccacacagctgcgacattcaactacagtttccgaaaaatcagaggactcctctgccctcagcacaagcaacggggtgtccaggccaatcaaactccagtgctgttcctccatatttcatgcgtgtactatagtctttacttgttctttcttttctgctgtctctttcttattccactggagcaaaaaatgaccactagtcccctgccctatccatgtgacaatattcacgtgactgtctggcctttgggggaggtgctgatggagactagaatgtgggaatctaaaattggcctggagatgcggttatag

SEQ ID NO: 34984 - DNA, 399 bp, Artificial Sequence
  Description of Artificial Sequence: Synthetic coding sequence
atgcgtaacatgattcctcaggacaacgaaaaccctccccaacagggcgaggccaaccaaaacgatttcgccctggtggcccaggccggggtacaatggttggaccttggcccacagcttccattgttacccgggttcaagcaattcttctgcctctctctgctgtcctcctgcggctactcctggagcctcgctctgtctcctaggctcgagtgctccggtgccatttcggcctacggcaaactccggctgcccggaagctgccattcccccgcttctgcttcccgggtcgcgagaactacaggagcacggcatcacactagattaatctttgtgtttctagtggagacccgcttccaccgggtgtctcaggacgggctggatctcctcacctcttag

SEQ ID NO: 34985 - DNA, 891 bp, Artificial Sequence
  Description of Artificial Sequence: Synthetic coding sequence
atgatcgccgagaggttggcaaggctcaggcaggagaataaacccaaactggtgcctagtcaagccgagattgaggctagactggcagctctgaaggacgaaagacagggatcaataccatctacacaggagatggaggcccgactggccgccttacagggtagagtgctgccaagccagactccacagccagcgcatcacacacctgatactagaacgcaagcccagcagacacaagatcttttgacccagctggcagcggaggtggctatagatgaatcttggaagggcgggggcccagccgcaagcctacaaaacgatcttaatcagggcggtccaggatcaaccaattctaagcgccaggctaactggagcctggaggaagagaaatctcgactactggctgaagccgccttagagcttcgggaggaaaataccagacaggagaggatcctcgctttagccaagcggctggccatgttacgtggtcaggatcctgagcgggttaccctgcaagactatcgcctccccgatagtgacgacgatgaggacgaggaaactgccatccagagagtcttacagcagttgacagaggaagccagcctggatgaagcttcaggcttcaatatcccggccgaacaagcaagcagaccatggactcagcctagaggagctgaaccggaggctcaggacgtggatcctcgccccgaggccgaagaagaagaactgccttggtgctgcatttgcaacgaagacgccaccctgcgctgtgctgggtgtgatggcgacttgttttgtgccagatgtttccgggaaggtcatgatgcatttgaattaaaggaacatcagacttccgcttattcccccccccgggccggccaagaacactag

SEQ ID NO: 34986 - DNA, 1584 bp, Artificial Sequence
  Description of Artificial Sequence: Synthetic coding sequence
atgtatcaaccagaggatgataacaactcagacgttaccagcgacgatgacatgacacgcaacaggcgggagagctcacctccacacagcgttcactctttttctggtgatagagactgggaccgccgcggaagatcaagggacatggaaccacgggatagatggagtcacaccagaaacccccgatcccgtatgccaccgcgggatctaagcttaccggtggtcgcaaagacttcttttgaaatggatcgcgaagacgatcgcgacagtagagcatacgaaagtaggtcccaggatgctgagtcctaccagaatgttgtggatctcgctgaggatcgaaagccccataacaccatacaggataacatggagaactacaggaaactcctgagtctgggattcctcgcgcaagactccgtgcccgcagaaaaaaggaatactgaaatgctcgataatctcccctcggccggatcccaattcccagacttcaagcatctagggactttcctggtttttgaggagttagttacatttgaagatgttctcgtggattttagtcctgaggaactgtcgtcactctccgcagcgcagagaaacctttaccgggaggtaatgcttgagaactatcggaacctcgtgtccctaggccaccagttttcaaagcctgacatcatttccagactagaggaggaggaaagctacgccatggaaacagactcccgccacacagtgatatgtcagggagaaagtcatgacgacccattggaaccccatcaggggaaccaggagaaactactcaccccgattaccatgaacgatcccaaaacactgacccctgagcgctcctatggctcagacgagttcgagagaagttccaacctgtctaagcagtccaaagacccccttggcaaagacccacaggagggaaccgcccccggcatctgtactagcccccagagcgccagccaggaaaacaagcacaatcgctgtgaattctgcaagcgcaccttctctacacaggtggcgttgaggcgacatgagaggatccataccggcaaaaagccctacgagtgtaagcagtgtgccgaggctttctacctgatgccccacctcaataggcatcagaaaacccatagcggacggaagaccagcggttgcaatgaaggaaggaagccctctgtccagtgcgctaacctgtgcgagcgcgtgagaatccatagtcaggaagattatttcgagtgctttcagtgcgggaaggccttcctgcagaacgtgcacctgcttcagcatctgaaagcccacgaagctgcacgcgtcctgccacctgggctgtcccactccaagacttacctgatcagataccagaggaaacatgactacgtgggtgaacgagcgtgccagtgttgcgactgcggacgcgtgttcagcaggaattcctacctgatacagcactaccgcacgcatacacaagagcggccctatcagtgccagctctgcggaaagtgctttggccgtccatcttatcttacccaacattaccagctccattcccaggagaagaccgtggagtgtgaccactgctag

SEQ ID NO: 34987 - DNA, 1809 bp, Artificial Sequence
  Description of Artificial Sequence: Synthetic coding sequence
atggcacgactcaccaagaggcgtcaggcggatacaaaagcgattcagcacttgtgggccgcgattgaaattatccgcaatcagaagcagatcgctaatattgaccggataacgaaatatatgtctcgggtccatgggatgcacccaaaagaaactactcgtcagctgagcctggccgtgaaggacggcttgatcgtggaaaccctcaccgtgggctgtaaagggagcaaggccgggatcgaacaagaaggatattggctccctggagacgaaatcgactgggaaacagagaaccatgattggtactgcttcgaatgccacctccctggagaagtacttatttgcgatctctgtttccgcgtgtatcatagtaagtgcctctctgacgagttccgactgcgggactctagcagcccttggcagtgcccagtatgccgatctattaaaaagaagaataccaataaacaagagatgggcacttacctgcgctttattgtgagtaggatgaaggaaagagccattgacctgaacaaaaagggaaaagataacaagcatccaatgtaccggcgtctcgttcactctgccgtcgatgtacctactatacaggagaaggtcaacgagggaaaatatcggagctacgaagagttcaaagctgacgctcaactgttactgcacaatacggtgatattttatggggccgatagcgagcaagccgatattgccaggatgctctacaaagacacttgccatgagctggatgaactgcaattatgcaaaaactgcttctatctgtccaatgcacgcccagataactggttttgctacccctgtattcctaatcatgaattggtatgggcgaagatgaagggattcggtttttggcctgccaaggttatgcaaaaggaggacaatcaggtcgatgtccgtttcttcggacatcatcatcagagggcctggatcccttccgaaaacattcaggacatcacagttaacatccaccgcctccacgtaaagcggtcgatgggctggaagaaagcatgcgatgagttggagctccatcaaagattcttgagggaaggtaggttctggaagagcaaaaatgaagacaggggtgaggaggaggccgaatctagtatcagcagcacatccaatgaacaactgaaggtgacccaagagccacgcgcgaaaaagggtagacggaatcagtccgttgaacccaagaaagaggagcccgaacctgagactgaggcagtgtccagtagccaggaaatccccaccatgcctcagcccatcgaaaaggtatcggtgagtacccagacgaaaaaactctccgcttcttccccaaggatgctgcaccgcagcacacagaccacaaatgatggcgtatgtcagagcatgtgccatgataagtatacgaagatcttcaacgacttcaaggacaggatgaaaagcgatcacaagcgcgagactgaacgggtagtcagggaggctctggaaaaactgaggagcgagatggaggaggagaagcgtcaggctgtgaacaaagctgttgccaacatgcagggcgagatggatcgcaaatgcaagcaggtgaaggaaaaatgtaaggaggaatttgtagaggagattaaaaaattggcaacccagcacaaacaactgatctcacaaacaaagaagaagcagtggtgttacaattgtgaagaggaggctatgtaccactgctgttggaacacaagctactgctccatcaaatgccaacaagaacactggcacgccgagcacaaacggacatgtcgaagaaagcgctag

SEQ ID NO: 34988 - DNA, 1920 bp, Artificial Sequence
  Description of Artificial Sequence: Synthetic coding sequence
atgacacctgcgtccgcaagcggggaggactccggtagcttctacagttggcaaaaagcgaagcgcgaacaaggtctggtcacattcgaagatgtcgcagtcgatttcacacaggaagaatggcagtacctcaaccccccacaacggaccctgtatagggacgtaatgctcgagacatattctaatctcgtctttgtgggtcaacaagtgaccaagcccaacctgatactaaaattggaagtcgaagagtgcccagctgagggcaagatccccttctggaattttccagaggtttgccaagtcgacgagcagatcgagagacagcatcaggatgatcaggataaatgcttactcatgcaagttggcttctcagataaaaagaccattataactaagtcagcgcgcgactgccacgaatttggcaatattctgcacctctctacgaatctcgtggcctccatccagagacccgacaaacacgagtcctttggaaacaatatggttgacaatctcgatttattttccagatctagcgccgagaacaaatatgacaacggatgtgccaagctcttcttccacactgaatacgaaaaaaccaatccggggatgaagccatacgggtataaggagtgcggcaaaggattacgcagaaagaagggtctgtcattgcaccagaggataaaaaacggggaaaagccattcgaatgtactgcgtgcagaaaaactttttcaaagaagtctcaccttattgtgcactggaggactcacactggagaaaaaccatttgggtgcactgaatgcggcaaggccttctcccagaaaagtcaactgattattcatcttaggacgcacacaggagaacggccatttgagtgtcctgagtgcgggaaagcttttagagaaaaaagcactgtgattattcactaccgaacacacaccggggagaagccctacgagtgcaatgagtgtgggaaggcatttacacagaaatctaatttgatcgtgcaccaaaagacccataccggagaaaagacatacgaatgcaccaaatgtggggaatccttcatccagaaattggatcttattatacatcactctactcacaccggcaaaaaacctcacgagtgcaacgaatgtaagaagaccttcagtgataagagcactctgatcatccaccagaggactcacaccggtgagaagcctcacaaatgcaccgaatgcggcaaaagctttaacgaaaagtcaactctcattgtgcaccagcgtactcacaccggcgagaagccctacgaatgtgacgtatgtggaaaaacctttactcagaaaagcaatttgggggtccaccagaggacccatagtggggagaaaccattcgagtgcaatgaatgcgagaaagcattttcccaaaaatcttatctaatgctccaccaaaggggccataccggcgagaagccttacgagtgtaatgaatgcgaaaaggcgttctcccagaagagctacctgattatccatcaaaggactcatactgaagaaaagccttataaatgcaatgaatgcggcaaggcgttccgggaaaagagcaaacttatcatccaccagagaattcacaccggcgaaaagccatacgagtgcccggtttgctggaaagccttttcccagaaatcccagttgattatacatcagcggactcacacaggagaaaaaccctatgcctgtacggagtgcggtaaggcttttcgggagaagtccacatttacagttcaccagcgtactcacacaggagagaaaccatataaatgcacagagtgcgggaaggcctttacccagaagtccaatttaatagtgcaccagaggacccatgccggtaagaaggcccatggccgcggccatactcggaaaagcaagtttatggcccattag

SEQ ID NO: 34989 - DNA, 993 bp, Artificial Sequence
  Description of Artificial Sequence: Synthetic coding sequence
tgatccgaaatggccgcccgggacgagctcgggttgggtggcgactcactggaagctatgccagtgcccgccgctcgcggcaggcctcgaattactaacggtccggaagagcttgccgcgccatcaccggcagcgctggctgactacgaaggcaaagacgtggctactagggtaggggaggcatggcaggaaaggccgggtgccccaaggggaggtcagggagatcctgcagtaccagcccagcagcctgccgacccatccacacccgagcgccagagttcgccctccggaagcgagcaattagtccgtagggagtcctgtggatcaagcgtgttgacggatttcgagggcaaggacgtggccaccaaggtgggggaggcatggcaggacaggcctggcgcccctagaggcggacagggggacccagcagtgccgacgcaacagccagccgacccttcgaccccagaacagcagaatagtcctagtgggtccgaacagtttgttcgcagggagtcgtgtaccagcagggttcggtcccccagctcgtgtatggtcaccgtgactgtgactgccacatcagaacaaccccacatctatattccagcacccgcatccgaactggacagtagtagcacaactaaggggatactcttcgtaaaagagtatgtgaacgcttcggaagtctctagcggcaagcctgtgtcagcacgatactccaacgtatcctctatcgaagacagctttgccatggagaaaaagccaccatgcggtagcacgccctattccgagagaacaaccggcgggatatgtacatattgcaaccgggagatccgcgattgtccgaaaatcacactcgaacacttggggatttgctgtcacgaatattgttttaaatgtggcatatgtagtaagccaatgggggatcttctggatcagattttcattcaccgcgatacaatacactgcggtaagtgctatgagaaattattttag

SEQ ID NO: 34990 - DNA, 1167 bp, Artificial Sequence
  Description of Artificial Sequence: Synthetic coding sequence
atggcagctgtttctcctaccacaagatgtcaagaaagcgtgacctttgaggacgtcgccgtggtttttacggatgaggagtggtcaaggttggtgcctattcagagagacctgtacaaagaagtcatgcttgaaaactacaactctatcgtgagtctggattgggaaacaaaaccagaaattcacgacgcttccgataagaagtcggaggggagtctgcgtgagtgtctgggccgccagagtcccctctgtccaaaatttgaggttcacacccctaacgggcgaatgggtaccgagaagcaaagtccttcgggcgaaactaggaagaaatccttatctcgggataaaggcttgagaaggcggagatccgctcttagcagagagatattaacaaaagagcgacatcaagagtgttcagattgcggaaaaaccttttttgatcactcctctctcaccaggcatcagaggacccacactggcgagaaaccttacgattgcagagagtgcggaaaggccttttcacacaggagtagcctgagtcgccacttgatgtcgcatacaggagagagcccatacgagtgctctgtctgtagtaaggctttcttcgacaggtcgagcctaaccgtgcatcagaggattcacaccggagagaagccttttcagtgcaacgaatgcggcaaggccttttttgaccggtcatctctgacacggcatcagaggatccacactggggaaagcccatatgagtgtcatcagtgcggaaaggcattctcccagaagagtatactgacgcgccaccaacttattcatactggccggaaaccttacgagtgtaacgaatgtggaaaagcattttacggggtctcctcactgaatcggcatcagaaggcacacgccggcgatccacggtatcaatgcaacgagtgcggaaaggccttcttcgatcgtagttctctgacccagcaccaaaaaattcacacgggtgataaaccgtacgagtgctccgagtgcggaaaggcattcagtcagcgttgccggctcacacgtcatcagcgcgtgcacaccggggaaaagcccttcgaatgcaccgtgtgtggcaaagttttcagcagtaagtcgagtgtgatccagcatcaaagaagatacgcaaaacaggggattgactag

SEQ ID NO: 34991 - DNA, 2049 bp, Artificial Sequence
  Description of Artificial Sequence: Synthetic coding sequence
atgattccgaaacaggacatcagcgaggaacttgagtctcagcgggccaaaagcgaggaccacgttagaaacatcttcaaagaaaccgaggagatgtctaaaaccgagggaaaactggagaattgctggagaaagtacgcggtcgagggcgtcaaaaattccttttcacagaagagcaacttccgagagatcacgatgcgctatgtcaaaacgctctcccgtgagaacggacagaagtttaatgctgtgggggagaattgtattactgacagtaacccagcaaagcacctgcggggctctcgtgaagagagcttgcatccatcggtcagcagcgtcgaaaatctccagcagcatgaagacctgatcaacctgcagagctttcagctgggcgagcgcgcctatcaaaccgacgtgcttgtgaaggtgccccggcagagctctgtgctctccgaaaaccagagaatgaataaccctgagcgatggtttgagtccaccggatgtgggaagacatataatcagaatcgggcctttaaccaacatcagaggtttcactccggcgaaaagacctatgagcacaacgaatgcggaaaggcattttcgtggccctccatcctgtccaaacaccagcgcatacacacggggaagaagctatatacatgcgaagactgtggcaaaagttttagcgtgcattcttatttcatccagcactgcaaaatacatacgcgcgagaaaccttatgagtgtattaagtgtggaaaagcattttccacacatagctcgtacgtccagcaccttaagatccacacaggggagaagcaccacgagtgcaaccagtgtgggaaagcattttcgcattcctcgaatctgatccatcatcagcgaatccatagtggggaaaagccatacaaatgtaaggagtgtgggaaggccttcaataggcaatcaaacctgatccagcaccaacggatccatagcggggagaagccctacgactgcaaggagtgcggtaaggctttcagcactcaactgtttcttatccagcatcagcgcatccacacaggtgagaagccatatgaatgcaacgagtgcgcaaagtcttttagccttaatcggactctgaccgtacaccagcgaattcacaccggtgaaaagccatataggtgcaatgagtgtggcaagagctttagtcagtgcagtcaggtgatccagcataagcggatccataccggcgaaaaaccttacatctgtaacgagtgcggtaagtcatttggtgcacgcttgagtctcatccagcatcagcggatccacaccggggagaaaccatacggatgtagggaaaagccctacgaatgcagcgaatgcggcaaggcattcagccagtcattcaatctgatccaccatcaaagaacacataacggtgagaagtcgtatgagtgtaatgagtgcgacaaagccttcagtttgctttcctctctagtgcagcatcagcggattcacaatggcgacaaaccttacgagtgtcacaagtgcggcaaggccttctctcagggttcgcatctgattcaacaccagcgctcccatattggggaaaagccctatgaatgtaacgagtgcggaaagacctttggccagatttcaaccctaattaaacacgagcggactcacaatggcgagaagccctacgagtgttccgattgcgggaaggccttttcacagtctgcccatctgatacatcaccagagaattcacacaggggaaaatccatatgagtgcagtgaatgtggcaaggccttcaacgtttgcagtagcttaatccaacatcatcgcatccatactggcgagaagccctatgagtgtagtgactgcggtaaagccttttcccagcattcacagtttattcagcaccaacggatccacactggggagaagccctacatgtgcaatgagtgtgaaaaaagtttcagcgcctgtcttagtcttattcagcataaacggattcacacaggcgagaagccctatgtgtgtgcgaagtgtggcaaaagcttctag

SEQ ID NO: 34992 - DNA, 1419 bp, Artificial Sequence
  Description of Artificial Sequence: Synthetic coding sequence
atgatgggtacatatggtaacctgctgagcctggggtgcgattctaggatagagaaagaagagatgattccaaagcaggatatctccgaggaactggagtcccagcgtgctaaaagcgaagaccacgttagaaatatcttcaaggagacagaggagatgagtaaaaccgaaggtaaactggagaattgctggcgaaagtacgccgtcgaaggagtaaagaactccttcagccaaaaatcaaattttagggagattacaatgaggtatgtcaaaacactttcacgggagaacgggcagaagttcaatgctgttggtgagaattgcattactgatagtaatccagctaagcacctgcggggcagtagagaagagagccttcaccctagcgtaagctcggtggagaatctccagcagcatgaggatctgatcaacctgcaatcatttcaactaggagagcgagcgtatcagacagacgtgctagtgaaggtgcccaggcagagtagcgtcctcagtgagaaccagaggatgaacaaccccgaacgctggtttgaatccaccgggtgcggcaaaacctacaaccaaaaccgtgcgttcaatcaacaccaacgatttcacagcggcgagaaaacatacgagcataacgagtgcggcaaggctttttcctggccttctatcttgagcaaacaccagcgcatccacactggaaaaaagttatatacgtgcgaggattgcggcaagtctttctctgtccattcctattttatccagcattgcaagatccacaccagggagaagccctacgaatgcatcaaatgcggcaaagcttttagtacacattcctcttacgtccagcaccttaagatacacaccggggaaaaacaccacgaatgcaaccagtgcggcaaagctttcagccacagcagcaacctgatccatcatcagcgtatccactcaggggagaagccctacaaatgcaaagagtgcgggaaaactttcggccaaatatcgactctcattaagcacgaacggacccataatggagaaaagccatacgaatgtagcgattgcgggaaggccttcagccagagcgcacacctaattcaccaccagaggatccacactggggagaatccatatgagtgtagcgaatgtgggaaagcctttaacgtgtgctcctctcttatccagcaccaccggatacatactggagaaaaaccttacgaatgctcagattgtggcaaagccttctctcaacattcacagtttatccaacaccagcgtattcatacaggcgaaaaaccttacatgtgcaacgaatgcgagaaaagcttttccgcctgcctgagcttgatccagcacaagaggattcacaccggagaaaagccttacgtttgtgcaaagtgcggaaagtctttttag

SEQ ID NO: 34993 - DNA, 1200 bp, Artificial Sequence
  Description of Artificial Sequence: Synthetic coding sequence
atgagtcaggtaacttttagcgatgttgctattgatttctctcacgaggagtgggcttgcctggactcggcacagagagatctgtacaaagatgttatggttcagaactatgagaacctggtgtccgtgggcttaagcgttacgaaaccttatgtcatcatgctccttgaggacgggaaagagccgtggatgatggagaaaaaactgagcaaggattgggaaagccgctgggaaaacaaggagctgagcacgaaaaaagacatctacgacgaggattctccgcagccagttaccatggaaaaggtagtaaaacagtcttacgagttctcgaatagtaataagaatctggagtatacagagtgtgatacatttaggagcacattccactcaaaatcaaccctcagcgaacctcagaacaatagcgccgagggaaacagtcataaatatgatattctgaagaaaaaccttagtaagaagagtgtcatcaaaagtgagcggatcaacggggggaaaaaattgctgaacagcaacaagtctggtgctgcctttaatcagagcaagagtctgaccctaccacagacctgcaaccgagagaagatctacacctgcagtgagtgcgggaaagcatttgggaaacaaagtatcctgtcccgccactggagaatacataccggggagaagccctatgaatgcagggaatgcgggaagaccttcagccacgggagctctttgacacgccaccagatctcccattctggtgagaagccatataagtgtattgaatgcggaaaagccttctcccatggttcaagtttgacaaaccatcagtcaacccacactggcgaaaagccctacgagtgcatgaactgtggaaagtccttctcacgggttagcctgctaattcagcacctgcgaatccacacacaagagaagcgctacgaatgcaggatctgtggcaaggctttcatacattcaagctccctgatacaccatcaaaaaagccacaccggcgaaaaaccctacgagtgtagggaatgcggcaaagctttctgctgttccagccaccttacccagcatcagaggattcactcgatgaaaaaaaagtatgaatgcaacaagtgccttaaggttttcagttccttctcctttttggttcagcatcagagcatacataccgaggagaagccttttgaagtatag

SEQ ID NO: 34994 - DNA, 1332 bp, Artificial Sequence
  Description of Artificial Sequence: Synthetic coding sequence
atgtctcaacgtcagtatcctgagtgctatttagcccctaacggatgtctggtctctaattgtggcgtgaacaagatgagtaatgaggagcttgtgggtcagaaccatgggatggagggggaagcctgcactggcggtgatgtcacattcagtgacgtggctatcgatttttctcacgaagaatgggcctgcctggattcggcacagcgggacttatacaaagacgttatggtgcagaactatgaaaatttagtgagcgttggcctgtcagttacaaaaccgtatgtgatcatgctgttggaggatgggaaagagccctggatgatggagaagaagctttctaaggactgggagtcaagatgggaaaataaggagctaagcactaagaaggatatctacgatgaggattctccacaacctgtgaccatggagaaggtagttaaacagagctatgagttcagcaatagtaataaaaatctggaatacactgaatgcgatacctttagatctacgttccattcaaagtcaacactgagcgagccccagaataactctgcagaggggaattcacataaatatgacattctcaaaaaaaatcttagcaaaaaatccgtgataaagtcggaaaggattaatggcggaaaaaaactgctcaattccaacaagtccggagctgcctttaatcagtccaaaagcttaaccctgccacagacttgcaatagggaaaaaatctacacctgctcggagtgcggcaaggcctttggtaaacagtctattctctcaaggcattggagaatccacaccggcgaaaaaccctacgagtgtcgcgaatgcgggaagacctttagccatggcagtagcctgactagacatcagatctcccattccggtgaaaagccttataagtgcatcgaatgtggtaaggcgttctcccacggatccagcctcacaaatcaccagtccacgcacacaggtgagaaaccatatgagtgtatgaactgcggcaagtccttcagccgcgtgagcctgctgatccagcatttgcggatccatactcaggaaaagaggtatgagtgcaggatctgcgggaaagcctttatccatagttcctcgctgatacatcaccagaagagtcatactggggagaagccctatgagtgtagagaatgcggtaaagcattctgctgcagttctcatctgactcagcaccaaaggattcactctatgaaaaagaaatacgagtgcaataaatgtttgaaagtgttttcctccttctcctttttggtgcagcaccagtccattcatacagaagaaaagccatttgaagtttag

SEQ ID NO: 34995 - DNA, 1200 bp, Artificial Sequence
  Description of Artificial Sequence: Synthetic coding sequence
atgtctcaggtgacctttagtgatgtggccatcgattttagtcatgaggaatgggcctgtctggactcggcccagcgtgacctgtataaggacgttatggtccagaactatgagaatttggtgtctgttggcttgagcgtgaccaagccctacgtgataatgcttctcgaggacgggaaggagccttggatgatggaaaagaagctgtctaaggactgggagtcaagatgggaaaataaagagctgtcgacaaaaaaagacatttacgacgaagactcgccacagccggtgactatggagaaggtcgttaaacagagttatgagtttagtaattcaaacaaaaacttggagtataccgagtgcgacacctttcgatcaacgttccattcaaagtcaacactatcggagcctcagaataacagcgcagagggcaattcccataagtacgacattctcaagaagaacctttccaagaaatcagtgatcaagtccgagcgcatcaatggggggaaaaagctcctgaattctaataagtcaggcgccgcgtttaaccaaagcaagagtcttacgctgccccagacctgtaaccgcgagaagatatacacctgctcagagtgcgggaaagcatttgggaagcagtccattctcagccgccattggagaatccacacgggggaaaaaccctacgagtgtcgagaatgtgggaagactttctcccacggaagcagtctgacgcgacaccagatttcacattccggcgaaaaaccctacaagtgtattgaatgcggaaaagcgttctcccacggaagttcgttgacgaatcaccagagcacccacacaggagagaagccttatgaatgcatgaactgtgggaaaagcttctctcgggtgagcctcctgattcagcacctccggatacacacacaggagaaacgctacgagtgccggatatgtgggaaggcattcatccattcttcttccctgatccatcatcagaagtctcacactggcgagaaaccctacgaatgtagggagtgtgggaaagctttctgctgttcgtcacatctgacccagcaccagaggatccactcgatgaaaaaaaagtacgagtgtaataagtgcctgaaggtgttctccagcttttcctttctggtccagcaccagagtatacacacggaggagaagcccttcgaggtgtag

SEQ ID NO: 34996 - DNA, 429 bp, Artificial Sequence
  Description of Artificial Sequence: Synthetic coding sequence
atgtcgcaagtgaccttttccgacgtggctatcgacttcagtcacgaagaatgggcctgtctcgactcagcccagagagatctttacaaagacgtcatggtgcagaattatgaaaacctcgtttccgtggggctaagtgtgacaaaaccgtatgtaattatgcttcttgaagatggcaaagagccatggatgatggaaaaaaaactgtctaaagactgggaaagtcgctgggagaacaaagaactttccaccaaaaaggatatttacgatgaggacagcccacagccggtgaccatggagaaagtcgtgaaacagtcatatgaatttagcaacagcaacaaaaacctggagtatacagaatgcgacacatttagaagcacttttcattctaagtcaacactatccgagccacagaataactctgcatag

SEQ ID NO: 34997 - DNA, 1200 bp, Artificial Sequence
  Description of Artificial Sequence: Synthetic coding sequence
atgtcgcaggtgaccttttccgatgttgctatcgacttctcacacgaagagtgggcttgtctggattctgctcagagggatttgtataaggatgttatggtgcagaattatgagaaccttgtgagcgtgggtctctctgtcaccaagccatatgtgatcatgctgttagaggatgggaaggagccctggatgatggagaagaagctgtcaaaagattgggagtcccgctgggagaataaggaacttagcacaaagaaggacatttacgacgaagacagccctcagccagtgactatggaaaaggttgttaagcagagctacgagttctccaattctaacaaaaacctcgagtataccgagtgtgatacattcaggagtactttccacagcaagtcaaccctatctgagcctcagaacaattccgcagagggcaacagccacaaatacgacatccttaaaaagaatctttcaaagaaaagcgtaattaagtcagagaggattaacgggggtaagaaactcttgaactctaataagtctggcgccgctttcaaccagtcgaaaagtctgaccctgccacagacttgtaatcgggaaaaaatttacacttgttcagagtgtggcaaggcctttggaaagcagtcaatcttatctcggcactggagaattcatactggtgaaaagccctacgagtgtagggaatgcggaaaaactttcagccacggctccagtctgacgcgccaccagatctcacactccggagagaagccctataagtgtatcgagtgtggcaaagccttttcccacgggtcctctctcactaaccaccagtccacacacacaggagagaaaccgtatgagtgcatgaattgtgggaaatcattttcccgagtcagcttgctgatccagcacctaagaatccacactcaggagaaaagatatgagtgcaggatctgcggtaaggcctttattcactcttctagtctaattcaccatcagaaaagtcataccggagaaaagccttacgaatgccgcgaatgcgggaaagcattctgttgttcatcccaccttacccagcaccaaaggattcattccatgaaaaaaaaatacgagtgcaataaatgtttaaaggtgtttagctcattctcttttctggtgcagcatcaatccattcacaccgaagagaagcctttcgaggtgtag

SEQ ID NO: 34998 - DNA, 399 bp, Artificial Sequence
  Description of Artificial Sequence: Synthetic coding sequence
atgtcccaggtgaccttcagcgacgtagccattgacttttctcatgaagaatgggcttgccttgactccgcacagcgtgacctgtacaaggatgtgatggttcagaattatgaaaacctggtgagcgttgcgggcctcagtgttaccaaaccatacgtgatcatgctgctggaggatgggaaggagccctggatgatggagaagaagctatcgaaagcttaccccttccccctgtcccattcagtacccgccagcgtaaatttcggattcagtgcactgtttgagcactgtagcgaagtcacggaaatatttgagctgtctgaactatgtgtcttttgggtacttcactttctgtcaaatagccctaactcaactgtggaagccttttttaaaaagtag

SEQ ID NO: 34999 - DNA, 399 bp, Artificial Sequence
  Description of Artificial Sequence: Synthetic coding sequence
atgtctcaggtaacattctccgatgtcgcaatcgacttctctcacgaagagtgggcttgtttggattcggcacaacgcgacctctacaaagatgtcatggtacaaaactacgagaacctcgttagcgtagcaggtctctcggttacaaagccctatgtgatcatgcttctggaagatggaaaggagccctggatgatggaaaaaaaactgagcaaggcctacccatttccgctaagccactctgtcccagcctcggtaaatttcggcttttctgctctgtttgagcactgcagcgaagtgacagaaatattcgagctgtcagagctgtgcgttttctgggtgctccatttcctgtctaattcccccaactctaccgtcgaagcattttttaaaaagtag

SEQ ID NO: 35000 - DNA, 2001 bp, Artificial Sequence
  Description of Artificial Sequence: Synthetic coding sequence
atgcaggaagtcgtgctcctggacgaaagctctggtcccccctcgcagctgttgtggacgcgtcaggatacacagcttccccaggagtccgctttgctccccgccccctacccagcatttacaaaggacggttcccagggaaatctgccccaagctgatattaccctgatgagccaggcccaggaatccgtgacctttgaagacgtcgccgtaaacttcacaaaccgagaatggcagtgtctcacttacgcccagagacacttatataaggacgtcatgcttgagaattacgggaatatggtctcactgggctttccttttcccaaacccccccttatttctcacctggaacgagaggttgacccttgtgtacaagacccccaggaccgggagtcccttagttgcagttacccagtctctgcagacaagatgtggcctgagaatgagaaggcttctagccagcaggagatctttgaaaacggcgaggcgtattggatgaagtttaacagcctcctcaaggttgacagcagagatcccaaagttagagaggtatgcgtccaggacgtgaagctcgagaaccaatgggagacttctattagggagaagctgcgcgaagaaaaggaaggtagtgaggaggtgacttgtaagaagggaaaaaaccagaaggttctctctaaaaacttgaacccaaattcaaagcactctcagtgtaacaaggtgctcatcgcccaaaagcttcatgaatgtgcgcggtgcggcaagaacttctcttggcattccgatctaatcttacacgagcagattcatagcggagaaaaaccccacgtgtgcaatgaatgtgggaaggcattcaaaaccagaaaccaactgtctatgcataggattattcacaccggagaaaagccgttcaactgcacgcaatgtggcaaagccttcaatagcaggagcgccctgtgcaggcataaaaagactcactccggagaaaagccccatgagtgcagggactgcggtaaagcttttaagactcgcaaccgtctgtgcatgcaccagttaatccatactggggagaaaccatataaatgcaactgttgcggaaaggcttttcagtttaagcacagtctgactatccatggaagaattcacacaggggagaagccatatgagtgtgaagagtgcggtaaggcattctcaggcagcagtgatctgacgaaacatattcgcattcacactggggaacggccttacgaatgtagcaaatgtgggcgcgcattttctcggtctagtgatctcagtaagcataagcgaatccatacccgcgaaaagcactacgggtgtccccagtgtggtaaggatttcagcataaaagccgagctcacaaagcatcggaggatccatactgaggagaaacgatacagatgcgaagagtgtggcaaagcattcaggcacaactgcaaaaggagagcccatgagagagagcataccggggagaaaccgtatcagtgtagggattgcggcaaaactttccaagatcagcattgcctaacgatacaccagagaatccataccggagagaagccgtataagtgccttgaatgtggaaaggcattttccggcaagagtaatctcaccaaccaccgtcgaatccacaccggcgagaaaccacacaaatgcgaggtgtgcggtatggcctttcatcatagctcagtcctaaggcagcacaagcgcattcacacgggggagaagccttatacatgttccgagtgcggcacaagcttcagacaggggtctgctctcatcggccacaaaagagtccacacgggcgaaaaaccttatgaatgcgaagaatgcggcaaggcttttcgggtgtcctccaacctcaccgggcataaaaagcggaaacaccaagtgtggagcacacacgaacttgatggaagtagaaaatctttgagtccagtcactgtatctcagacatccgtggtgagcatactgacatcagcatag

SEQ ID NO: 35001 - DNA, 1725 bp, Artificial Sequence
  Description of Artificial Sequence: Synthetic coding sequence
atgctggagaactatggtaatatggtaagtttgggcttcccgttccccaagccgcccctgattagccacctcgagcgggaggtcgatccgtgcgtgcaagaccctcaggatcgcgaaagcctgagctgctcttatcctgtgagcgccgataagatgtggccggagaacgagaaagcaagcagtcagcaggagattttcgagaacggcgaggcttactggatgaagttcaattctctcctgaaagtcgacagtcgagatcccaaggttcgcgaagtgtgcgtgcaggacgtgaagctcgaaaatcaatgggagacatccatccgtgaaaaactgagggaagagaaagaaggctccgaagaggtgacctgtaagaagggcaaaaaccagaaagtactgtcgaaaaacctgaatcctaattcaaaacatagccagtgtaacaaagtgctgatcgcacaaaaattgcatgagtgtgctaggtgtgggaagaatttcagctggcactccgacttgattctccacgagcagattcatagtggagagaaacctcatgtctgtaatgagtgtgggaaggcctttaagaccagaaaccagctgtctatgcaccggattatccacacaggagaaaaaccttttaattgcacccaatgcgggaaggccttcaactctaggtccgctctttgccgccacaagaaaactcattcaggcgagaagccacacgaatgccgtgattgcggtaaggcctttaagactcgcaaccgcttatgcatgcatcagctcattcacacaggcgagaagccttataagtgtaactgttgcgggaaggcattccagttcaaacacagcctgaccattcacggacggattcatactggggagaagccttatgagtgtgaagagtgcggcaaagctttcagcggttcttcagatctcactaagcacatacggatccacaccggcgaaagaccatatgagtgctcaaaatgtgggcgagcgtttagtcgatctagcgatttgagcaaacacaagcggatccacaccagagagaagcactatggatgccctcagtgtggcaaagatttttcaatcaaagccgagctgaccaagcacaggcgaatccacacggaagaaaagaggtacaggtgcgaagaatgcggcaaggcatttcgtcataactgtaaacgccgtgcacatgagagggagcatacgggagagaagccctatcagtgccgcgactgtggtaagactttccaggaccaacactgtttgaccattcaccagcggatccatactggggagaaaccctataaatgtttagagtgtgggaaagcattttcaggtaaaagtaacctgaccaaccataggagaatccatacaggtgagaaacctcacaaatgtgaggtttgcggaatggcctttcatcattctagcgtcctgcgtcaacacaagcggatccataccggtgagaagccctatacctgtagtgaatgtggtacttcgttccgtcaggggtctgcactgattgggcataagcgtgtccacacgggtgaaaagccctatgagtgcgaggaatgtggcaaagccttccgggtgtcgagcaacctgacaggacacaagaagcgcaagcaccaagtgtggagcacccacgaactggacggcagccgcaaaagtttgtcaccagtcacagtaagtcaaacttcggtggtaagcatcttgacgtcagcatag

SEQ ID NO: 35002 - DNA, 702 bp, Artificial Sequence
  Description of Artificial Sequence: Synthetic coding sequence
atgctgagagaggaagccactaagaagtctaaggagaaagaaccgggcatggccctcccacaagggaggttaacatttcgggacgtcgctatagaattttccctcgaggagtggaaatgccttaaccctgcccagagggccctgtacagggcggtgatgctggaaaattataggaatctagaattcgtggacatctccagcaagtgtatgatgaaggagtttagtagcaccgcccagggaaacactgaagtcatccacaccgggacgcttcagcggcacgaaagccatcacatcagggacttctgcttccaggagatcgagaaagatatccacaactttgagttccagtggcaggaagaggaacgtaacgggcatgaggcacccatgacagaaatcaaagaattgacgggcagcacggaccgccacgaccagcggcatgcaggaaataagcccatcaaagaccagctcggtagcagcttccactctcatcttcctgagctgcacatcttccagcctgaatggaagatcggaaatcaggttgagaaatccattattaacgccagtcttatcctcacaagccagaggatctcttgttcgccaaaaacccgcatcagcaacaattatggcaataatagcctgcatagttctctccccatccaaaaactgggttctacccatgaaaggaagatctttcctatgtag

SEQ ID NO: 35003 - DNA, 1209 bp, Artificial Sequence
  Description of Artificial Sequence: Synthetic coding sequence
atgtacacatcagaagagaaatgcaaccagagaacacagaagcgaaaaatttacaacgtctgcccccgtaagggcaaaaaaatcttcattcacatgcacgagattatccagattgacggtcacatatatcaatgtctggagtgtaagcaaaacttttgtgagaacctagccctgataatgtgtgagcgaacacatactggggaaaaaccgtataagtgtgacatgtgcgagaaaacatttgtacagtctagcgatctaacttctcatcaaaggattcacaattacgaaaagccatacaagtgcagcaagtgcgaaaagtctttttggcaccacttggcactatctggccaccagcggacccacgctggtaagaaattctatacttgtgacatatgcgggaaaaattttggccagtcctcggatctattggtacatcagcgaagccacaccggagagaaaccatacttgtgtagcgagtgcgacaagtgcttcagccgaagcacaaacctgattagacaccggagaacccacaccggagagaagccctttaaatgtcttgagtgcgaaaaggcattttccgggaaatccgatttgatctctcatcagaggactcacacaggcgagcgcccttacaaatgtaacaaatgcgagaagtcatacaggcatcgatccgcatttatagtgcacaagcgggtgcatactggcgagaagccatataagtgcggagcttgtgagaaatgctttggtcagaaaagcgatctgatagttcatcagcgcgtccatactggcgagaagccttacaagtgtttagagtgtatgcggtccttcacaaggtccgcaaacctcatccgtcaccaagccacccacactcacacctttaagtgtctagagtacgaaaagagctttaactgttcatctgatctgatagtgcaccagagaattcacatggaggagaaaccccatcagtggtctgcatgtgaatcgggattcctcctcggtatggatttcgtggcgcaacagaagatgagaactcaaacggaggagttacactacaaatacaccgtgtgcgataagtctttccaccagtccagtgccctgctgcagcaccaaacagtgcacattggtgaaaaaccgttcgtgtgcaatgtctccgagaagggcctcgaactgtcacccccccacgcttccgaagccagccaaatgtcttag

SEQ ID NO: 35004 - DNA, 744 bp, Artificial Sequence
  Description of Artificial Sequence: Synthetic coding sequence
atggtgacccagcttagatacgaatctttctgtctgcaccagttccaagaacaggacggcgagtctatccctgagaaccaggaactggcctccaagcaggagatcctcaaggagatggaacacctgggagatagtaagctccagcgggacgtcagtttggatagtaaataccgtgagacctgtaaacgcgacagcaaagcagagaagcagcaggcacacagtaccggcgagcgacggcaccggtgtaatgagtgcggcaagtccttcacaaagtcctctgtcctgattgagcatcagcggatacataccggggaaaagccctacgagtgcgaggagtgtggtaaagccttcagcaggaggagctcactcaatgaacaccgacgttctcacactggggagaagccgtatcagtgcaaagaatgtggtaaggcattttcagctagtaacgggctcactagacacagaaggatccacacaggcgaaaagccttatgagtgtaaagtttgcggaaaggcatttctgctgagttcctgtctggtacagcaccagcgaatccacaccggcgagaaaagataccagtgccgtgaatgtggtaaggctttcatccagaacgccgggctgtttcaacaccttcgagtacataccggcgaaaagccctatcaatgctcccaatgctctaagctgttttccaagcgaaccctgttaaagaagcatcagaaaatccatacgggtgaacggccttag

SEQ ID NO: 35005 - DNA, 1653 bp, Artificial Sequence
  Description of Artificial Sequence: Synthetic coding sequence
caggtgcccctcactttttcagatgttgctatcgacttttcacaagaagagtgggaatatctgaactcagaccagcgggatctgtaccgcgacgtaatgttggagaattacacaaatctggtgtcgctcgattttaacttcacgacagagagcaacaagttgagcagtgagaagcgcaattacgaagtcaacgcataccaccaagagacatggaagagaaacaagacatttaatttgatgcgttttatctttaggaccgaccctcagtacacaattgaattcggcaggcagcagagaccaaaggtgggctgcttctcacagatgatttttaagaaacacaagagcctgccgctccataaaaggaataatactcgcgagaagtcatacgaatgcaaggaatacaagaaaggattcagaaaatacctgcatcttacagaacatttaagggaccatacgggtgtgattccgtacgaatgcaacgagtgtggtaaagcgtttgtggttttccaacacttcatccgacatcggaaaatccatactgatctcaagccgtatgaatgcaacgggtgtgaaaaggcgtttagattttacagccagttgattcagcaccagatcattcataccgggatgaagccttatgaatgtaagcaatgcgggaaggccttccgaagacatagccatctgactgaacaccagaaaatccatgtggggcttaagccttttgaatgtaaagagtgcggggaaacttttaggttgtatcggcacatgtgcctccaccagaaaatccatcacggggttaagccatataagtgtaaggagtgtggcaaagcgtttgggcaccgtagttccctctatcaacacaagaaaatccactcaggcgaaaagccatacaaatgtgagcaatgcgagaaagcctttgtgagatcgtatttgctcgtggagcatcaacgatcccacaccggggaaaaacctcacgaatgcatggagtgcggaaaagcctttggtaagggaagctctctgctgaaacataagcggattcactcttccgagaaactgtacgattgcaaggattgcggcaaggcgttttgccgcggaagtcagctgacccaacatcagcgcatccatacaggggagaaaccccatgaatgtaaagaatgcgggaagactttcaagctgcactcgtaccttatccagcatcagattattcacacagatctgaagccgtacgagtgtaagcagtgtggcaaggcgttctcccgtgtgggggatctaaagacacaccaatccatccatgctggggaaaagccctatgaatgcaaggagtgtggcaagacctttcgcctgaattcacagcttatttaccatcagaccattcataccgggctgaagccctatgtttgtaaggagtgcaaaaaggcttttagatcaataagcggcttatctcagcacaagagaatacacacaggtgaaaagccttacgagtgtaaggagtgtgataaagctttcaatcggtctgatagactgacccagcacgaaacaatccatactggtgtgaaaccacagaaatgcaaggaatgtgggaaggccttttcgcactgctaccaacttagtcaacatcagcggttccaccacggcgaaagacttctgatgtag

SEQ ID NO: 35006 - DNA, 1668 bp, Artificial Sequence
  Description of Artificial Sequence: Synthetic coding sequence
atggccttcacccagctaacattccgcgacgtggcaatcgagttttcacaggacgagtggaaatgtctgaactctacccagaggaccctataccgggatgtaatgttggagaattaccgcaacctggtgtcgctggaccttagcaggaactgtgtgatcaaggagctcgccccccagcaggagggcaaccccggagaggtgtttcatactgtcacgctggagcagcatgaaaaacacgacattgaagagttttgcttcagagagatcaaaaaaaagatccacgattttgactgtcaatggcgggacgatgaaaggaactgtaataaggtaaccacagccccaaaggaaaatttgacctgcaggagagaccagcgagacagaagggggattgggaacaaatccatcaagcatcaactcggcctgtctttcctgcctcacccccacgaattgcagcagtttcaggctgagggcaaaatttatgaatgcaatcacgtagaaaagagcgtgaaccatggatcctctgtcagcccaccgcagatcatttccagtacgataaagacacacgtgtcaaataaatacggaacagatttcatctgcagtagtctgcttactcaggagcagaagtcatgcattcgggaaaagccgtacagatacatcgaatgtgacaaggccctgaaccacggtagtcacatgacagttagacaagtctctcattctggggaaaaggggtacaagtgtgacttgtgcgggaaggttttctcccaaaagtcaaacctagccaggcattggagggtccatacgggtgaaaagccctacaaatgcaacgaatgcgaccgtagctttagcagaaattcctgcctcgccctgcaccgacgagtccatacaggagaaaagccctacaagtgttacgagtgtgataaggtgttctcaaggaactcctgcctggcactgcaccagaagacacacatcggggaaaagccgtacacctgcaaagagtgcggcaaggcatttagcgtgagatcaacactgaccaaccaccaagtcattcactccggtaagaagccttataagtgtaatgaatgtggtaaagtgttttcgcagaccagttctctggcaacgcatcagcggatccacacaggagagaagccatacaagtgcaatgaatgtggcaaggtgttttcacagacatctagcctggccagacactggaggatccatactggcgaaaaaccatacaagtgtaatgaatgcggcaaggtgttttcctataacagccatctggcctcccaccgaagagtgcatacaggcgaaaaaccctacaagtgtaacgaatgtggtaaggcattttccgtccacagtaacctgacgacacatcaggtgatccacaccggggagaaaccctataagtgtaaccagtgcgggaaaggcttctctgttcactcatccttaactactcatcaggtcattcataccggggagaagccctacaagtgtaatgagtgcggcaagtcttttagcgtgcgccccaatttgacccgtcaccagatcattcacacggggaagaagccatacaagtgctctgactgtgggaagtcattcagtgtgcggccaaacttgtttagacatcaaattatacatactaaggagaagccttacaaacgtaattag

SEQ ID NO: 35007 - DNA, 1704 bp, Artificial Sequence
  Description of Artificial Sequence: Synthetic coding sequence
atgccggaactgtatacagaagatttcatacaaggctgcgatgtgggagaactacaggaacctggcctcccaggactggagtgcaacggtgcgatttcagcccactgcaacctccgcctccctgatagcaatgattctcccgccagcgcttcacgcgtggcgggcattaccgacctgagccgcaactgtgttattaaggaactcgccccacagcaggaagggaatccgggggaagtgtttcacaccgtgacacttgaacagcatgaaaaacacgatatagaagagttctgtttccgggaaatcaagaaaaaaatccacgacttcgactgccagtggcgcgatgatgaacggaactgcaacaaagtcacaacggcacccaaggagaatctaacatgtcgcagggaccaacgtgacaggcgagggattggaaacaagtcgattaaacaccagctgggcttatcttttttgccacatcctcatgaactccaacagtttcaggccgaaggtaaaatctacgagtgcaaccatgtggaaaaaagcgtgaaccacggcagcagcgttagccccccacagataataagctcaacaatcaaaactcatgtatctaataaatacggcaccgattttatctgtagctctctgttaacccaagagcagaagagctgtatccgcgagaaaccatacaggtacatcgagtgtgataaagcgctgaatcacgggagccacatgaccgtccgtcaggtgtctcattctggtgaaaaaggttacaagtgtgacttgtgtggtaaagttttttcccagaagagtaacctggcccgccactggcgggttcacacgggggaaaagccctataaatgcaacgagtgtgacaggagctttagtaggaattcttgtttggcactgcaccgacgggtgcacaccggagaaaagccatataagtgctacgagtgcgataaggttttcagccgtaatagttgcctggcgctccaccagaagacacatataggtgaaaaaccctatacttgtaaagaatgcggtaaagccttttctgtgaggagcactctgactaatcaccaggtgatccacagtgggaagaagccctacaagtgcaatgagtgcgggaaagtgttttcccaaacatctagtctggcaacccaccagcggatccatactggggagaaaccatacaaatgtaacgagtgcggaaaagtgttttcccagaccagtagcttggccagacattggcgtatacacacaggtgagaagccctataagtgtaacgagtgcgggaaagtgttttcatataactcccacttggcatctcatcgacgggtgcatacaggagagaagccatataagtgtaacgagtgcgggaaagccttctccgtgcattccaacctgacaacccatcaggtgatccacaccggggagaaaccctataagtgtaatcaatgcggaaaaggattttccgttcattcctcgctgacaacccatcaggtcattcacacaggcgagaagccgtataagtgtaatgaatgcggcaagagctttagtgtgaggcccaatttgacacgacaccagataatccatactggcaaaaaaccttataaatgcagtgactgtgggaaatcattcagcgtgaggcctaatctctttcgtcatcagataatccacactaaggagaaaccctataagcgtaattag

SEQ ID NO: 35008 - DNA, 1629 bp, Artificial Sequence
  Description of Artificial Sequence: Synthetic coding sequence
atgtgggagcaccggaaggagccttggaccatcgagtcgcaagtgcgcgttgctcggaaaccgaagggttgggagtggatcaagggggttaagaccgatttatctcgcaattgtgtgatcaaagagctggctcctcaacaggaggggaaccctggcgaggtcttccacaccgtgacccttgagcagcatgagaaacatgatattgaagagttttgctttcgagagataaaaaagaaaatccacgactttgactgtcaatggagagatgacgaacggaattgtaacaaggttaccactgcccctaaggaaaacctgacatgcaggcgagatcagagagacaggcgcggaatagggaataaaagtattaaacatcagctcggcctctcctttctgcctcatcctcatgaactgcagcagtttcaggccgaagggaaaatttacgaatgcaatcatgtggagaaaagcgtgaatcacggatctagcgtgtctccaccacagattatctcttccaccattaaaacccacgtgtcaaataagtacggaacagattttatttgttcttcactccttacacaggaacaaaaaagttgtatccgggaaaagccatacaggtacattgagtgtgataaagcccttaatcacggtagccatatgacagtacgacaggtctcccactctggggaaaaggggtacaagtgcgatctctgcggaaaagtcttctcgcagaagtcaaacttagcccgccattggcgggttcacactggggaaaagccatacaagtgcaacgaatgcgatcgttcattctcaaggaacagctgtctcgctcttcacagacgggttcataccggtgagaagccatataaatgctacgagtgcgataaggttttttcacgtaatagctgtctcgctctacaccagaaaacacatattggggagaagccttacacttgtaaggagtgcggtaaggccttttccgtgcgctctacccttaccaatcaccaagtgatccatagtggaaagaagccatacaaatgtaacgagtgtggaaaggtgttctctcagactagctccctcgcaacacaccagagaatccataccggcgagaaaccctacaagtgtaacgaatgtggaaaggtcttctcgcagacgtcttctcttgccagacattggcgcatccacactggcgaaaagccttacaagtgcaacgagtgcggcaaggttttcagctataattcccacctcgcatcacaccggcgtgtccacacaggagaaaaaccatacaaatgcaatgaatgcgggaaggctttttcagttcacagcaacttgactacccatcaggttatacacacaggcgaaaagccatataagtgcaaccagtgcggcaaaggcttttcggttcatagtagcctcacgacgcatcaggttattcacaccggagagaaaccatacaaatgcaatgagtgcggtaaatccttcagtgttcgtccaaaccttactcgacaccaaatcattcatactggaaaaaagccatataagtgttccgattgcggaaagtccttcagcgttagacccaatctatttaggcaccagataatccatacaaaggaaaagccatataagcgcaattag

SEQ ID NO: 35009 - DNA, 1812 bp, Artificial Sequence
  Description of Artificial Sequence: Synthetic coding sequence
atgcccgagctctacaccgaagactttattcaagggtgcgacgttggagaattgcaggagcccggtcttccaggggtcctgtcatatgtgggagctcaggagagagcccttgaccaccgcaaaccatcgacgagcagcaaaaaaacaaaaagagtgggcatggaccagcgatgcgagaacagattggaatgcaatggtgctatcagtgcccattgcaaccttcggctgcctgactcgaatgactcacccgcgtcagcaagccgcgttgccgggattaccgatctctcccgtaactgtgtgattaaagagctcgccccgcagcaggaagggaatcccggcgaggtttttcacacagttacactggaacagcacgagaagcatgatatcgaagaattctgtttccgggagatcaaaaaaaaaatccacgattttgactgtcagtggcgggatgacgagcgtaactgcaataaagtgacgactgctcccaaggaaaacctgacgtgtagaagagatcagagggacagaagagggatcggcaataaatccatcaagcaccagctgggactcagttttctcccccacccacacgagctgcagcaatttcaggcagagggtaagatttacgaatgcaatcatgttgagaagtcagtgaatcatggatctagtgtgtccccaccacaaatcatcagcagcaccattaagacccacgtgagcaacaagtacgggacggacttcatttgcagttcactgctcacccaggaacagaaaagctgcattcgagagaagccttatcgatatatagagtgtgacaaggccctgaatcacggcagccatatgaccgtgagacaagttagccacagcggcgaaaaaggctacaagtgtgatctgtgcggaaaagtgttttcacagaagtctaacctggctagacactggcgggttcataccggcgaaaaaccatataaatgcaatgaatgcgaccgctcattctctagaaacagctgcctcgccctgcatagacgagtgcatactggcgagaagccctacaaatgttacgaatgcgataaggtattttcaagaaactcctgtttagcgctgcaccagaaaacccatattggagagaaaccttacacctgcaaagaatgcggcaaggccttcagcgtgcggagcaccttaaccaaccatcaagtgatccattcaggaaaaaagccgtacaaatgcaacgagtgcggcaaggtgttttcgcaaacaagtagccttgccacacaccagagaatccacacaggcgaaaaaccctacaaatgtaatgaatgtggaaaagtgttctcacagactagcagcttggctagacactggagaatccacactggagagaagccctacaagtgtaacgaatgcggcaaagttttttcgtataatagccatttggctagtcatcgaagagtccacaccggcgagaagccttataagtgtaacgaatgtggaaaagccttttcggtccactccaatcttacgacccaccaggtcattcatactggtgaaaaaccttataaatgtaatcagtgtggcaaagggttctctgtacattcgagcctcacaacccaccaggtgatccacacaggggaaaaaccttataaatgcaacgaatgcggcaagtctttctcagttaggcctaatcttactcggcaccagataatccataccgggaagaagccatacaagtgttcagactgcggcaagtccttttccgtcagaccaaacctgtttcggcaccagattatccacacaaaggaaaagccatataagcgcaactag

SEQ ID NO: 35010 - DNA, 1812 bp, Artificial Sequence
  Description of Artificial Sequence: Synthetic coding sequence
atgcccgagctctacactgaagattttatccaagggtgcgatgttggagaactgcaggagcccggactccctggggtgctctcttacgtcggagcacaggaacgggcattggatcatcggaagccctcaacttcaagcaagaagactaaacgcgtgggcatggatcagcggtgtgaaaatagacttgagtgcaacggcgccatctcagcacattgtaatttgcgtctgccggactccaatgactcccccgcctcagcgtctagagtggccggtattaccgacctctctcgtaattgcgtgataaaagagctggccccacaacaggagggtaacccaggtgaggtctttcacactgtgaccctggagcagcacgaaaagcacgacattgaggaattttgttttagggagattaaaaagaagattcacgacttcgattgccaatggcgagatgacgagcgcaactgcaacaaggtgactaccgctcccaaggagaacttgacttgtcgccgcgaccaacgtgacagacggggcatcggaaataagtctattaagcatcagctgggcctaagcttcttacctcatcctcacgaactgcagcaattccaggccgaagggaagatatatgagtgcaatcacgtggaaaagagcgttaatcacggcagttccgtaagtccaccccagataatctcatcaacaattaagacccacgtctcaaataaatatgggacagattttatttgtagcagccttctgacccaagaacaaaagtcttgtatacgggagaaaccctataggtatatagaatgtgacaaggctcttaaccacggttctcatatgacagtgagacaggtttctcactcgggggaaaaggggtataagtgtgacttatgcggcaaagtgttcagccagaaatccaacctggcacgacattggagagtgcacacgggtgagaagccttacaaatgtaacgagtgcgacagatctttctcaagaaatagctgcctcgctctgcatagacgggtgcacacgggcgaaaagccatataaatgttatgaatgtgataaggtgttttctcgcaattcatgcctggccctgcatcaaaagacccatatcggagagaagccttatacatgcaaggaatgcggcaaggcattttctgtgaggtcaacactcacaaaccatcaggtcatccactccgggaaaaaaccctataagtgcaacgagtgtggcaaggttttcagccaaacttcatcccttgctacccaccagaggattcataccggcgaaaaaccgtataagtgtaatgaatgcgggaaagtcttcagtcagacctcctccttggctaggcactggagaatccacactggggagaagccttacaagtgtaatgaatgtggcaaagtctttagctacaactcacatcttgcttcccatcgacgggtgcacactggggagaaaccttataaatgtaacgagtgtgggaaggctttctctgtgcattcaaacctgaccacccatcaagtcatccatactggagagaaaccttataagtgcaaccagtgtgggaaaggtttttcggttcatagctcactaacaacgcaccaagtgatccacacaggagaaaagccatataaatgtaatgaatgcggcaagagcttctccgtgcgcccgaacctgacccgacaccagattatccacacagggaagaagccctacaagtgcagcgactgcggaaagtcattctcagtacggccaaacctgttccggcatcagataatccacacaaaggagaagccctataaacgtaattag

SEQ ID NO: 35011 - DNA, 1668 bp, Artificial Sequence
  Description of Artificial Sequence: Synthetic coding sequence
atggacggcgacggactcacctttagagacgtggcaattgagtttagccaagatgagtggaagtgcttgaacagcactcagcgcaccttgtaccgagatgtgatgctggagaactatcggaatctcgtctcacttgatttgagcagaaattgcgttataaaggagctggcccctcagcaggaaggaaatcccggtgaggtgtttcacactgtgacacttgagcagcatgaaaaacacgacatcgaagagttttgttttagggaaataaagaaaaagattcacgactttgattgtcagtggcgtgatgatgaacgaaactgcaacaaagtgaccacagcgccgaaggagaacttgacttgtcgaagagaccaaagggatcggagaggaattgggaataaatccatcaagcaccagctgggattgtcttttctgccacacccccacgagcttcagcagtttcaggcagagggtaagatctacgagtgtaaccacgtcgagaaatccgtgaaccatggttcctcagtgagtccgcctcaaattatcagctccaccatcaaaactcacgtgtcaaataaatacggcaccgactttatttgttcaagtctcctaacccaggaacagaaatcctgcatcagagagaaaccgtatagatatatcgaatgcgacaaggcgctgaaccacggaagtcacatgacagtgcgtcaggtgagtcactccggcgagaaggggtacaagtgtgatctttgtggcaaggtctttagccaaaaatctaatctggcacgacattggcgggtgcacacgggagagaagccctacaaatgtaatgaatgcgaccggtcctttagccgtaattcatgcctggctttgcaccggagagtgcacaccggcgagaaaccatacaaatgttatgagtgcgacaaagtgttctctcgcaatagctgtctggctctccatcagaaaactcacatcggtgagaagccgtacacttgtaaagagtgtggcaaggccttttcggtccgctccacactaactaatcatcaggtgatccactccggtaagaagccatacaagtgtaatgagtgcggaaaggtgttctcccaaacttcttccctagcaacccaccagcgcatccataccggtgaaaaaccttacaagtgtaatgagtgtggcaaggtgttttctcaaacgagctcgcttgcgaggcattggaggatccatactggcgagaagccctacaaatgcaacgagtgcggcaaggttttttcatataactcacatttggccagccacagacgagttcataccggggagaagccttacaaatgcaatgagtgtggtaaggctttctcagtccactcaaacttaaccacgcaccaggttatacacactggcgaaaagccttacaagtgcaatcaatgcggaaaggggttcagtgtacattcatcactcaccacgcatcaggtcatccacacaggggagaagccatacaaatgtaatgaatgtggcaagagcttctccgtgcggcctaacctgaccagacatcaaatcattcacaccggtaagaaaccatataaatgtagtgattgcggtaagtcatttagcgtgcgtcccaatttgtttaggcaccagatcatccatacgaaggagaaaccctacaaaagaaactag

SEQ ID NO: 35012 - DNA, 567 bp, Artificial Sequence
  Description of Artificial Sequence: Synthetic coding sequence
atgacagaaactcgggagcctgcagaaaccggaggttacgcgagtctcgaggaggacgacgaggatctgtctcctggacctgagcactcatctgactctgagtataccctctccgaacctgattcagaggaagaggaggacgaagaggaagaggaggaagaaactaccgatgatccagaatacgatcccgggtataaggtcaagcaacgcctgggcggaggacgcgggggaccgtcgcgacgcgcccccagagcagcgcaacccccagcccaaccctgtcagttgtgcgggcgcagtccgctcggggaggctcctccagggacacctccttgtagactgtgctgcccagctaccgccccacaagaagccccagcacccgagggacgcgcccttggcgaggaggaggaggaaccccctcgggccggagaggggcggcccgcagggcgggaagaagaggaagaagaggaggaagaaggaacataccattgcacagagtgtgaggactctttcgacaatctgggagagttgcacggacactttatgttacacgcccgtggggaagtttag

SEQ ID NO: 35013 - DNA, 375 bp, Artificial Sequence
  Description of Artificial Sequence: Synthetic coding sequence
atgaccgagactagagaacccgccgaaaccggtggatacgcaagcctggaagaagacgacgaggacttgtcacctggtcccgaacatagcagcgattccgagtacactcttagtgagcccgattccgaagaagaggaggacgaagaagaagaagaggaagaaaccacggatgatcccgaatatgatcccggttacaaggttaaacaaagactcggaggaggacgaggcggaccttcaaggagagcacctagagccgcacagccacccgctcagccctgtcagctctgcggtcgctcccccctgggcgaagcacctccaggaacccctccatacggagagctgggacggcgcggcggcgttggcggcggcggatag

SEQ ID NO: 35014 - DNA, 2412 bp, Artificial Sequence
  Description of Artificial Sequence: Synthetic coding sequence
atggacgttgctattgagttttgcctagaagaatggcagtgtctcgacattgctcaacagaacctctatcggaacgtgatgctcgaaaattatagaaatttggtgttcttgggaatcgcagtgagcaagcctgatctcatcacttgcctcgagcaagaaaaggagccatgggagccgatgcggaggcatgaaatggtagcgaagccgcctgtgatgtgtagccatttcacacaagacttttggccagagcagcacatcaaagaccccttccagaaggccacactgagacgctataagaactgtgaacacaaaaacgtgcaccttaagaaagatcataagagcgttgacgagtgtaaggtgcatcgtggcgggtacaacggatttaaccagtgtcttcccgcgacccaaagcaagatctttctattcgataaatgtgtgaaggcctttcataagttcagtaacagcaatagacacaaaatcagccatactgagaagaagctcttcaaatgtaaggagtgcggcaagtcattctgtatgctccctcacttagcacaacacaaaatcatccacacccgagtcaacttctgtaagtgtgagaaatgtggcaaggccttcaattgtccttctatcataaccaaacacaagcgcatcaacacaggcgaaaagccctacacctgcgaggaatgcgggaaggtgttcaactggagttcccgtctcacaacgcacaaaaagaattatactagatacaaactctacaagtgcgaagagtgcggcaaggcattcaataaaagtagcatcctgacaacccataagataatcaggacgggggaaaagttttacaagtgtaaggagtgcgccaaggccttcaaccagagcagtaatctaaccgagcacaagaagatacaccccggcgagaagccatacaaatgcgaagaatgcggtaaggcttttaactggccaagtaccctgaccaaacataaaagaatccataccggggaaaaaccctatacttgcgaagaatgcggaaaagcattcaaccagttttctaatctgacaacccacaaacgtatccacactgccgaaaagttctataaatgtaccgagtgtggagaggccttctctcggtcctctaacttaaccaagcataagaagattcacacagaaaaaaaaccttacaagtgcgaggaatgcggaaaagcgtttaagtggtcctctaaattgaccgaacataagctcacacacacgggagagaaaccttataaatgcgaagaatgcggaaaggcatttaactggccctccactcttacaaagcataacaggatccataccggcgaaaagccttataaatgtgaagtttgtggtaaggctttcaatcagttcagtaatttgacgactcacaagcggatccacacagctgaaaagccttacaagtgtgaggagtgtggcaaggccttctcccggagcagcaacttgaccaaacacaagaaaatccatattgaaaaaaagccctacaagtgtgaggaatgcggcaaggcctttaaatggagcagcaaacttaccgagcacaaaatcacccataccggagaaaagccctataaatgtgaggaatgtggcaaagcattcaatcacttctcaatattgaccaaacacaagagaatccacaccggagagaagccttataaatgtgaagaatgcgggaaggctttcacacagagttctaatcttaccacccacaaaaagatccatacgggcgagaaattctacaagtgcgaggagtgcgggaaggcctttacacaatcatcgaatttgaccactcataagaagatccacacgggcgggaagccgtataagtgtgaggagtgcggaaaagcatttaatcagttttcaactctaaccaagcacaagattattcataccgaagagaagccttataagtgtgaggaatgcggcaaggctttcaaatggtcgtctacacttaccaaacacaagattatccacactggtgaaaaaccctacaagtgcgaggagtgcggtaaggctttcaaactgagttctacactatctactcataagattattcacacaggggagaagccatacaaatgtgaaaagtgcggaaaagcctttaatcggtcttccaatctaatagagcacaaaaagattcacactggcgaacagccgtacaaatgtgaagagtgcgggaaggctttcaattatagttcacacctcaatactcacaaacgcatccacacgaaagagcagccatacaagtgtaaggaatgcggcaaggctttcaatcagtactccaacctcaccacgcacaacaaaattcatacaggcgagaagctgtataaaccagaagacgtgacagttatcctgaccacccctcagaccttttccaacatcaaatag

SEQ ID NO: 35015 - DNA, 1095 bp, Artificial Sequence
  Description of Artificial Sequence: Synthetic coding sequence
atggagcggggaaagaaaaaacgaatatctaacaagctgcagcagacttttcaccattctaaagagccaaccttcctgatcaatcaggccggactgctgagcagcgactcgtactcctctctttctcctgaaaccgagagcgtcaaccccggagagaatataaaaacagacacacagaagaaacgtcccggcacagtgatcctgtccaaactgtcttcccgaaggataatatctgagtcccagctgtccccccccgtaattcccgctagacggcctgggttcagagtctgctacatctgtggtcgcgagtttggatcccagtctatcgccatacacgaaccacagtgcctgcagaagtggcatattgaaaacagcaaactgccgaagcacttaagaagaccagagccatctaaaccacagtcactcagtagttcaggttcctatagccttcaggccaccaacgaggcagctttccagagcgctcaagcgcagctgctgccttgtgaatcatgtggcagaacattcctgccggaccaccttctggtgcaccacaggagctgcaagccgaagggtgaaggcccacgtgccccccattcaaacagctcagaccacctcacgggtctgaagaaagcttgttccggcacacccgccaggccccgtacagtcatctgctacatctgcgggaaggagttcggcacattatcgctgccaatccatgaacctaaatgcttagagaaatggaagatggagaacgaccggctccctgtggagctgcaccaaccactcccacagaaaccacagcccctgccaaacgcccagagctcacaggccggccccaatcaggcccagctggttttctgtccccactgttcacgtatcttcacgtcagaccggttgctggtgcatcagagaagctgtaagactcacccgtatggccccaaatatcagaatctcaacttaggctctaagggaggcctcaaggaatataccaactctaagcagcaacggaacagggccgccccctctgtgacggacaaggtgatccacgccacacaggacgcgctgggggagccaggaggcgcactgtgtctctag

SEQ ID NO: 35016 - DNA, 192 bp, Artificial Sequence
  Description of Artificial Sequence: Synthetic coding sequence
atggagcggggaaagaagaaacggatctccaacaagctccaacagaccttccatcatagcaaggaaccaacattccttatcaatcaggccggccttctgtcttcagactcttacagcagcctaagccccgagacagagagcgtgaacccgggtgagaatataaaaacagacacccagaaaaaaaggccatag

SEQ ID NO: 35017 - DNA, 111 bp, Artificial Sequence
  Description of Artificial Sequence: Synthetic coding sequence
atggaacgcggcaagaagaaacgcatttctaacaagttgcagcaaacttttcaccattctaaggagcctacttttctgatcaaccaggccggtctcctgtccagcgactag

SEQ ID NO: 35018 - DNA, 4452 bp, Artificial Sequence
  Description of Artificial Sequence: Synthetic coding sequence
atgcccagtgaacagaagcaattgttttgtgatgagaaacagaccacactgaaaaaggattacgacgtcaaaaacgagattgtggaccgatcagctcccaaacccaaaataagcggttccatccattatgctctgaagaatgtgaagattgacctgcctaagatcaacattcccaatgaggtgttactgaagcacgaagtggacaagtataggaagctctttcagtccaagcagcagaccgcacggaagtcgatttccatcaagaccgtgagctgtgtcgaagaatgtaccctgctgcataaatcggagagggcagaagaggaaggggttaagatgtccgcaaagatcctgaatttctcttgcctaaagtgccgggataacactcgatattctccgaacgacttgcagaagcactttcagatgtggcaccatggcgagcttccatcctacccatgtgagatgtgcaacttcagtgctaacgatttccaagtgttcaagcagcaccgtcgaacgcataggagtacgctggtaaagtgcgatatttgcaataacgagagtgtttacacacttcttaacctgacaaagcactttacgagcactcactgcgtaaacgggaattttcaatgcgagaagtgcaaattcagtactcaggacgtcggcactttcgttcaacacattcataggcataatgaaatccactacaaatgtggtaagtgccaccacgtctgttttaccaagggggaacttcaaaaacacctccacattcactctggcaccttcccatttacatgtcagtactgtagctacggggctacccggcgcgagcaccttgtccgccacgtcatcacactgcataaggaacacctctacgctaaagaaaagctggaaaaagacaagtacgagaagcgcatggctaaaacgtccgcgggcctcaagctcatcctcaagcgctataaaattggagcatccaggaagaccttttggaagcgaaagaaaatcaactccgggagtgatagatctatagaaaagaacacccaggtcctaaagaagatgaacaagacccaaactaaatcagaagatcagagtcatgtcgtgcaggaacacctgagtgaggagaaggacgagagattgcactgcgagaataatgataaggcccctgagtccgagtctgaaaagccaacgccgctatcaacagggcaggggaatcgggccgaagaaggacccaacgcctcctcaggcttcatgaagaccgccgtcctcggccctaccctgaagaacgtcatgatgaaaaacaacaaactggcggtgtccccaaattataatgcaacattcatgggattcaaaatgatggatggaaagcagcacattgtgcttaagctggtccccatcaagcagaacgtctgttccccagggtctcagtctggagccgccaaggacggaaccgcaaatctgcagccccagactcttgatactaacggatttcttactggtgtaactaccgaactgaacgatactgtttatatgaaagccgccacaccattttcatgctcatcttctatcctctccggaaaggcctcgtccgagaaagagatgactcttattagtcagaggaacaatatgctccagaccatggactatgagaaatctgtgagctcattaagcgccacatccgagttagtcactgcttccgtaaatctcacaactaagtttgagacgcgcgataatgtcgatttctgggggaaccaccttacacagtctcaccctgaagtgctcgggacaacaatcaagtcaccagataaagtcaactgtgtggctaaaccaaatgcctacaactctggagatatgcacaactattgtatcaactacggaaattgcgagctgcccgtcgaatcatcaaaccaagggagcctcccatttcataattactcaaaagtgaataattccaacaagaggcgccggttttctggcacagcggtatacgaaaatcctcaacgagaatcctcttctagtaagactgtagtgcagcagccaatctcggagtcattcctgagcctcgtacgccaggaatcgtccaaaccggatagtctgctggcctccatcagcctgctcaatgacaaggatggtactctgaaagccaagagcgaaatagaggagcaatatgtcctcgaaaagggccagaatatcgacgggcagaacctatattcaaacgaaaatcagaatttggagtgtgctacagaaaaatctaagtgggaggatttttccaatgtggacagcccaatgatgccacggattactagcgtgttcagtttgcagtctcagcaggccagcgaatttctgccgccagaagtaaaccagctgctgcaggatgtgctaaagattaaaccagatgtgaaacaggattcgtccaacacccctaacaaagggctgcctcttcattgcgaccagagcttccagaagcacgaacgcgagggcaagatcgttgagtcgagtaaagatttcaaggtgcaggggattttccctgtgcctcctggttctgtggggattaacgtccccactaacgatctcaatcttaaattcggcaaagagaaacaggtcagcagcatcccacaggatgtgcgggattctgaaaaaatgccccggatcagcgggtttgggacgctgttgaagacccagtcagacgcaattataacgcagcagcttgtgaaagacaaacttcgcgctactacgcagaatttaggcagtttttatatgcagtcacctctgttgaactcagaacagaaaaaaaccattattgtacaaacctcaaagggattcttgatcccactgaacattacaaacaagcctgggctacctgttattccaggtaacgctctgcccctggtcaattcccagggaatccccgctagtctcttcgtgaacaagaaaccaggtatggtcctcaccctgaataatgggaaactggaaggcgtgagcgcggtaaaaactgaaggagctcctgctcgcggaaccgtgaccaaagagccctgcaagacacctattctaaaagtggagcccaataataactgcctgactcctgggctatgtagctccatcgggtcctgcctttctatgaagagtagctcggagaatacgctacccctgaaaggcccctacatactaaagccaaccagcagcgtcaaggctgtcctaatccctaatatgctgagcgagcagcagagtaccaagctgaatataagcgactctgtgaaacagcagaacgaaatattccccaagccaccgctgtacacttttctgcccgatggaaagcaagccgttttccttaagtgtgtcatgccaaataagaccgaactgctcaaacccaagttggtacaaaattctacttatcaaaacatccaaccaaagaaacctgagggaactccccagcgcatactgctgaagatcttcaacccagtgctaaacgtcaccgctgcgaataatctcagcgtgtcaaattcagcctcatccctgcagaaagacaatgtgccgagtaaccagatcatcgggggcgaacaaaaagagcctgagagcagagacgccctgccattcctcttagacgacctgatgcccgctaatgaaatagtcattacgagtaccgccacatgcccagagagttcggaagaaccgatatgcgtctcggactgctctgagtcacgcgtcctgcgatgtaaaactaattgtcggattgagaggaatttcaatcgcaaaaagacttcgaaaaagatcttctctaaaaccaagacccacgggagtaaagattctgaaaccgcttttgtgtcaagaaaccggaattgtaaacggaaatgcagagacagctaccaggagcccccacgacgaaaagccacattgcaccgcaagtgtaaggagaaagcaaaaccggaagatgtacgggagaccttcggattttctagaccacgtctctctaaagacagtatcagaacactcagactcttcccattttcgtccaaacagctggtgaaatgcccccggcggaaccagcccgtagtagtgctcaaccaccccgacgccgatgctccagaagttgtttcagtcatgaagaccattgccaaattcaacggacatgtgcttaaagtgtccctgtcaaaacggaccataaacgcactcctgaagcctgtatgctacaacccgcccaagaccacgtatgatgacttcagcaagagacataaaacattcaagcccgtgagctcagtcaaggagagattcgtgctgaaattgactctgaaaaagacctctaaaaataattatcagattgtgaaaaccacgtcggaaaatatcctcaaggccaagtttaattgttggttttgtggcagggtattcgacaaccaggacacctgggcgggccatggccagaggcacctgatggaggctaccagagactggaacatgctggagtag

SEQ ID NO: 35019 - DNA, 1734 bp, Artificial Sequence
  Description of Artificial Sequence: Synthetic coding sequence
atggctgtgggtctgtgcaaggcgatgagtcagggtcttgtcacattccgggatgtggccctggacttctctcaagaggagtgggagtggcttaaacccagccagaaagatctgtatcgtgacgtaatgctggaaaactataggaacctcgtgtggctggactgggagtcctggtgtgaaatcgaggagctgagccccaaatggttcattgatgaagacgaaatcagccaggaaatggtgatggaacggttagcctctcatggattggagtgttcttcgttcagggaggcctggaagtacaaaggtgagttcgagttgcaccaggggaatgcagaacgacacttcatgcaagtcacagccgttaaggaaattagcaccggaaaacgagataacgaattctcaaattctgggcgctccattccattaaagtcagtttttttaacccaacagaaagtaccaaccattcagcaggttcataagtttgatatatatgataagcttttccctcaaaatagtgtcataatcgagtataaacgcctgcatgctgagaaggaatctctgatcggtaacgagtgtgaagagtttaatcagagcacttacttgtctaaagatatcggcattccccccggtgaaaaaccttacgagtcccatgatttcagcaaattactgagttttcatagcctatttacccagcaccagactacacacttcgggaaactgccacacggatatgacgaatgcggcgatgcattctcatgctactcatttttcactcagccacagcggatacactctggtgaaaaaccctacgcttgcaacgattgcggaaaagcattttcacatgacttttttttgagcgagcatcagaggacccacatcggcgagaagccatatgaatgcaaagagtgtaacaaggcattccgtcagagtgcacatcttgcccagcaccaacgcatccacactggggagaaaccctttgcctgcaacgagtgcgggaaagccttctctagatacgcatttctcgttgaacatcaaaggattcacactggagagaaaccttatgaatgcaaagagtgcaataaggccttccgacagtctgcccacctgaaccaacaccagcgcatacataccggggaaaagccatacgagtgcaaccagtgcggtaaggccttctcacggcgcattgccctgacactccaccaaaggattcatactggcgaaaagccctttaaatgcagcgagtgcggcaaaaccttcggctaccgctctcacctcaatcaacaccagcggatccataccggcgaaaaaccatacgagtgtattaagtgcggaaagttctttaggaccgacagtcaactcaatcggcaccatcgcatacatacaggagagcgaccatttgaatgtagcaaatgcggcaaggcctttagcgacgcccttgtcctgattcatcacaaacggtctcatgctggtgagaaaccttacgaatgcaacaagtgcgggaaagccttctcctgcggctcttatctgaatcagcaccagagaattcacaccggtgaaaagccgtatgagtgcagcgaatgtggaaaggctttccatcagatccttagcctaaggctgcaccagagaatccacgcaggggaaaagccctataagtgcaacgaatgcggtaataatttcagttgcgtgtccgcacttcggcggcaccagaggatccataacagggagaccctctag

SEQ ID NO: 35020 - DNA, 1830 bp, Artificial Sequence
  Description of Artificial Sequence: Synthetic coding sequence
atggccgtagggttatgcaaagctatgtcacagggactggtcacgtttcgcgacgtcgcactggattttagccaggaggagtgggaatggctgaaaccgagccaaaaggatctctacagagatgttatgctagaaaattaccgcaatctggtttggctcggcctgtctatatctaagccaaacatgatcagcctcctagagcagggcaaggaaccttggatggtagagagaaagatgagccagggacattgcgcggactgggagtcttggtgtgaaattgaggaattgtcacccaaatggttcattgatgaagacgagataagtcaagaaatggtaatggagcggctagcttcacatggcctcgagtgctcttcatttcgcgaggcctggaagtacaagggtgagtttgaacttcaccaggggaatgccgagaggcacttcatgcaggtgaccgccgtgaaagagatatctaccggtaaacgcgacaacgagttttccaactccggccgatctattccactgaaaagcgtctttctcacccagcagaaggtacccactattcagcaagttcacaaattcgatatatacgataaactgttcccccaaaattccgttattatcgaatacaagcggctgcatgccgagaaagaaagcctcattggcaatgagtgtgaggagttcaatcagtccacctacctgagtaaagatataggaattcctccgggggagaagccctatgagtcacatgacttcagcaaattactttcttttcattcgctgttcacacagcatcagacaactcatttcggaaaactgccacacgggtatgatgagtgcggggatgcattctcatgttactctttctttactcaacctcagcgcatccacagtggcgaaaagccatatgcatgcaatgactgcggaaaagcattttcccacgacttcttccttagtgagcaccagaggacacacatcggcgagaaaccatacgagtgcaaggagtgcaacaaggcgttcagacagtccgctcacctggcacagcaccaaaggatccacaccggcgaaaaaccctttgcatgcaacgagtgcgggaaggccttttcacgctatgcatttctagttgaacaccagcggattcacaccggcgaaaaaccttatgaatgcaaagaatgtaataaggcctttagacagagtgctcacctgaaccagcatcagaggatccacacgggagaaaagccctacgagtgtaatcagtgtggcaaagctttctctaggcggatcgccctcacactccaccaacggatccatactggggagaagcccttcaaatgttctgagtgcggaaagacgtttggataccgaagtcacctgaaccaacaccagcgtattcatacaggggaaaagccatacgaatgcattaaatgtgggaaattctttcgcacagactcacagttgaacaggcatcaccgaattcatactggcgaaaggccattcgagtgtagtaagtgtggcaaggccttcagtgatgccctggtgctgattcaccataagcgctcacatgcgggcgaaaaaccatatgagtgcaacaaatgtggcaaggccttcagctgcggcagctacctgaatcaacaccagagaattcacactggtgagaagccttacgaatgcagcgagtgtggtaaagcattccatcagattttgtccttacggctacaccagcgcattcatgctggggagaaaccctataagtgcaatgaatgtggcaataacttctcttgcgtgtccgccctgcgacgccaccagagaatacacaaccgtgaaactctgtag

SEQ ID NO: 35021 - DNA, 1674 bp, Artificial Sequence
  Description of Artificial Sequence: Synthetic coding sequence
acgggtctgtcaatatcaaaaccgaatatgataagccttctggagcagggtaaggagccatggatggtggaaaggaaaatgagtcaaggccattgcgcggactgggagtcctggtgtgagatcgaggaactgtcaccaaaatggtttattgacgaagatgaaatcagccaggagatggtaatggagcgcctcgcctcacacggcctggagtgttcgagcttccgcgaggcatggaagtacaaaggagagttcgagctgcaccaaggcaacgctgaacgccacttcatgcaggtgaccgctgtgaaggagatctctacaggaaagagggataatgagttttctaacagtggtaggagtattccactgaagagcgtctttctcacgcagcaaaaagttcctacaatccagcaggtgcacaaattcgatatatacgataaactgttcccgcagaattcggtgatcatcgagtacaagcggctccacgccgaaaaagagtctcttataggaaacgagtgcgaggaattcaaccagtctacatacctgagtaaagacatcggaatcccaccaggggaaaaaccttacgagagtcacgatttcagcaagcttctatccttccatagcctgtttacacagcaccagactacacattttggcaagctaccccacgggtacgatgaatgtggcgacgcctttagttgttattcattttttacccagccacaacggatccattctggcgaaaagccttatgcatgcaatgattgcggaaaagctttttcccacgactttttcttgagcgaacaccagcgaactcacatcggggaaaagccatacgagtgtaaagaatgtaacaaagccttccgccagtcggctcatctagcccagcaccagcggatacatacaggcgaaaaacctttcgcctgtaacgaatgtggcaaggccttcagtagatacgcctttctcgtggagcatcagagaatccatacgggcgagaaaccatatgagtgcaaagagtgtaacaaggcattcaggcagagcgcccacctgaaccaacaccaacgcatacatactggagagaagccctatgagtgcaaccagtgcggcaaggccttctccaggcgaatagctttaacgcttcaccagagaattcatactggggaaaagccctttaagtgctccgagtgtggaaaaaccttcgggtataggtctcaccttaaccagcatcagcgcatacacacaggagagaaaccttacgagtgtataaagtgcgggaagtttttccgcaccgactcccagttgaaccggcaccatcgcatccacacaggggagagaccttttgaatgtagtaagtgcggtaaagcattcagtgatgcacttgtacttattcaccacaagcgatcccatgccggtgagaagccatacgagtgcaataagtgtggtaaggcttttagttgcggcagttacctgaatcagcaccagcgaatccatacaggagaaaagccttacgagtgtagcgagtgcggcaaggcgtttcaccaaatcctgtctcttcgcttgcaccagagaatacatgccggcgaaaaaccgtacaagtgtaacgagtgcggcaacaactttagctgcgtctcagcactccgaagacaccaacgcatccacaacagagaaaccctgtag

SEQ ID NO: 35022 - DNA, 1692 bp, Artificial Sequence
  Description of Artificial Sequence: Synthetic coding sequence
atggccaattcatcatttattggggaccacgtccacggcgccccccatgcagtgatgcctgaggtagagtttcccgatcaattctttacagtcctcacaatggaccacgaattggtaacgctgcgggacgtagtcatcaacttctcccaggaagagtgggaataccttgactccgcccaaagaaacctctattgggacgtcatgatggaaaattactccaacctcctgagcctggacctggagagtcgtaacgagaccaaacacttgtcggttggcaaggacatcatccaaaataccggctctcagtgggaggtcatggagagcagtaagctgtgtggattggaaggctccatctttcggaatgattggcagagcaaaagcaagatagacctgcaaggcccagaggtgggctacttcagtcagatgaaaattatttccgaaaacgtccccagttacaagactcacgaatcgctgacattacccagacggacgcacgactcagaaaagccttatgaatataaggaatacgaaaaagtcttctcttgcgatctcgaattcgatgagtaccagaagattcatactggggggaagaattatgaatgtaatcagtgctggaaaactttcggtattgacaacagtagcatgctgcagctaaatatacacaccggggtgaaaccctgcaagtacatggaatacggcaatacgtgctcattttacaaggacttcaatgtctaccagaagatacataatgagaagttctacaagtgcaaggagtaccgacggaccttcgaaagggtcgggaaagtcactccactgcaacgggtgcacgatggcgagaagcatttcgagtgttccttttgcggaaagagcttccgagtgcacgcccagcttaccagacatcagaaaattcataccgacgagaaaacctacaaatgcatggagtgcggtaaggatttcaggtttcacagccaactcacagagcatcaacgaatccacaccggcgaaaagccgtataaatgtatgcattgtgaaaaggtgtttaggatctcctcgcagctgattgaacaccagagaattcataccggtgaaaaaccatatgcttgtaaggagtgtggaaaagcattcggcgtgtgtcgagaactcgcccgacatcagcggattcacacaggaaagaagccttacgaatgtaaggcatgcgggaaagtgttcagaaattcttccagcctgactaggcaccagcgcatacacactggcgagaagccttataaatgtaaggaatgtgaaaaagcctttggagtcggctccgagttgactagacacgagagaatccatagcggacagaaaccatacgagtgcaaggagtgcggaaagtttttcagattgacaagtgctctgatccagcaccagcggatccattcgggagagaaaccttatgaatgtaaagtatgcggcaaggcctttaggcactcctctgcgttgaccgaacaccaaagaattcacaccggcgaaaagccctacgagtgtaaagcttgcgggaaggcgtttagacactcaagcagctttaccaaacaccaaaggattcataccgacgacaagccctacgagtgcaaggaatgtggcaatagcttctcggtagtagggcacctgacttgtcagcctaaaatctacacaggagagaagagcttcgactag

SEQ ID NO: 35023 - DNA, 1692 bp, Artificial Sequence
  Description of Artificial Sequence: Synthetic coding sequence
atggctaattcaagttttataggagaccacgtgcacggggcacctcacgccgtgatgcctgaggttgaattccccgatcagtttttcaccgttctcactatggatcacgagcttgtaacacttagggatgttgtcatcaattttagccaggaagaatgggagtatcttgactccgcccagcgcaacctgtactgggatgtgatgatggagaactattcaaacctgctcagtctggatttagagagtcgcaacgaaactaagcacctgtccgtgggcaaggatattatccaaaacacaggaagccaatgggaggttatggaaagcagcaaactgtgtggcctggaaggctcgatttttaggaatgattggcagtcaaagtctaagatcgatctgcaaggtcctgaggttggatacttcagccagatgaagatcatctcggaaaacgtgccttcgtacaagacacacgaatctctgaccctgccacgtagaactcatgattcggagaagccatacgagtacaaggaatatgaaaaagtgttctcctgcgatctggagtttgacgagtatcagaagattcacacaggaggaaagaattatgagtgcaatcagtgctggaaaactttcggtatcgataatagtagcatgctgcaactgaatattcataccggggtaaaaccctgtaaatatatggagtacggaaacacctgttccttctataaagactttaatgtgtaccaaaaaatccataatgaaaaattttacaagtgtaaggaatacaggcggacctttgaaagagtcggcaaggtgacgccactacagcgcgttcacgatggtgagaaacattttgaatgctccttctgtggtaaatcctttcgtgtacacgctcagctgacacgacatcagaagattcacacagatgaaaaaacttataagtgcatggagtgcgggaaggacttccgatttcacagccaactgaccgaacatcaaaggattcacacaggggagaagccctacaaatgcatgcactgcgagaaggtgttccgtattagctctcaactgatcgaacaccagaggatacacaccggcgagaagccctatgcatgtaaggaatgtggaaaggcatttggggtgtgtagggagttggcccgccatcagcgaattcacacaggaaagaaaccatacgaatgtaaagcctgtggtaaggtattcaggaatagttctagcctgaccagacatcagcggatccacacaggagaaaagccgtataagtgtaaggagtgcgagaaagcatttggggtaggcagcgagcttactaggcacgagcgtattcatagtggacagaaaccttacgagtgtaaggaatgcgggaagttttttcgcctcacttccgccctgatacagcatcagagaatccactcaggagagaagccttatgagtgcaaagtgtgcggaaaggcattccgccattcctccgcactaactgaacaccagcgcatccacacgggcgaaaagccttacgaatgtaaggcctgcgggaaggcattcagacactcctcatcattcacaaagcatcagagaatccacactgacgacaaaccgtatgagtgtaaggaatgcggcaactctttcagtgtcgtgggacacttaacatgtcagcccaaaatttatacgggggaaaagtcctttgactag

SEQ ID NO: 35024 - DNA, 1209 bp, Artificial Sequence
  Description of Artificial Sequence: Synthetic coding sequence
atggccgctgtgattctgccgtctacagcagccccctcctctctgttccctgcctcccaacagaaaggccacactcagggtggtgagctggtgaatgagttactcactagctggctgcgggggctggttacctttgaagatgtagctgttgagtttacccaagaggaatgggcgctgctggatcctgcccagcgtacattatacagggacgtcatgttagaaaactgccgtaacctagcctctctcggttgtagagtcaacaagcccagtctcatttcgcagctcgaacaggataagaaagtggttactgaagagcggggaattctgccctccacttgtccagatctggaaaccctcctcaaagcaaaatggctcacacctaagaagaatgtgttcagaaaagagcagtctaaaggcgtgaagactgagcggtcacaccggggcgttaagttaaatgagtgcaaccagtgctttaaagtcttcagcaccaagtctaatttgactcagcataagagaatccacacgggcgagaagccatacgattgcagtcagtgtgggaagagtttttcatcccgaagctatctgaccattcacaaaagaattcataacggagagaagccctacgagtgcaatcactgcgggaaagccttctccgaccctagtagtctgcggttgcacctgcgaattcacaccggcgaaaagccttacgagtgtaaccagtgctttcatgtttttcggacctcatgtaatttgaaaagccacaaacgcatacataccggagaaaaccaccatgagtgtaatcagtgtgggaaagcttttagtactaggtccagcctcacaggtcacaatagtattcacacgggtgagaagccatacgaatgccacgactgtggcaaaacctttaggaaatctagctacctgacccagcatgtgcgcacccacacaggcgagaagccttatgaatgcaatgaatgcggcaagagcttcagttcatccttctcgctcacggtgcacaagcgcatccacacaggcgagaagccatacgaatgtagtgattgcggcaaggctttcaataacctgagcgcagttaagaagcatctgagaacacatactggagagaagccttacgagtgtaaccattgtggcaagtcttttacctctaactcctacctgtctgtccataagcggatccacaaccgctggatctag

SEQ ID NO: 35025 - DNA, 1098 bp, Artificial Sequence
  Description of Artificial Sequence: Synthetic coding sequence
atgagggaaaaaagcttccagtgtaatgaaacaggcgaggctttcaactgtagctcattcgtgagaaagcatcaaatcattcacctgggagagaagcaatacaagttcgatatttgcgggaaggtgttcaatgagaagagatacctcgctcggcatagacgatgtcacacttctgagaagccttacaaatgtaacgaatgcggcaagtccttctcctacaagtcatcgctcacatgtcatcgacggtgccacactggagagaagccgtacaaatgtaacgaatgtgggaaatctttcagttacaaatcgagcctgacatgccatcatcgctgtcacactggcgaaaagccctataaatgtaatgagtgtggaaagtccttttcttacaagtcttccctccggtgtcaccgccgcttgcacaccggaatcaaaccgtacaaatgtaacgaatgcggtaagatgttcggacagaattcaactcttgttatccacaaggccattcatacaggcgagaagccctataaatgcaatgagtgcggcaaagcttttaaccagcaaagtcatctgagcagacaccaccggctgcacactggggaaaagccctacaagtgtaacgactgcggaaaggctttcatacaccagtcgagtttagcccgccatcatcggctgcacaccggcgaaaaatcatataagtgtgaggagtgtgatagggtgtttagccaaaaatctaatttggagcggcacaaaatcatacacaccggcgaaaaaccgtataaatgtaacgagtgccataaaaccttcagtcacagaagtagccttccctgtcatcgccgacttcatagcggagagaagccctacaaatgtaacgagtgtggcaaaaccttcaatgtccaaagccacctgagcaggcaccatcgccttcacacgggcgagaagccttacaaatgtaaagtgtgcgacaaagcattcatgtgtcacagctacctggccaatcacactaggattcactcgggtgagaaaccttacaagtgcaatgagtgtgggaaagcacacaaccaccttatcgactcttctatcaagccatgtatgtcctcatag

SEQ ID NO: 35026 - DNA, 1773 bp, Artificial Sequence
  Description of Artificial Sequence: Synthetic coding sequence
atgctccatgaagaagctgcacagaaacggaaaggcaaggagccaggtatggcactaccacaaggcaggctgacatttcgagatgtcgctattgagttttctcttgccgaatggaaatttctgaaccccgcccagcgagccctctatcgcgaagtcatgttagagaattaccgcaacctggaggccgtagacattagtagcaagaggatgatgaaagaggtgctttccaccggacaggggaacactgaggtgatccatacaggcatgctgcagcgtcacgaatcttaccacacaggagacttttgcttccaagagatcgagaaggatattcacgacttcgagtttcaatcccagaaggacgagcgtaacgggcacgaggcatcgatgcctaagatcaaggagctcatgggctctaccgataggcacgatcaacgccatgcgggcaacaaacctattaaggatcagttggggctgtcgtttcatcttcatttgccagagttgcacatctttcagccggaggaaaagattgcaaatcaggttgagaagtcagtgaacgatgcctcaagcatatccactagtcagcggatttcttgtagacctgaaacacacactcctaataattacggcaacaatttcttccactccagccttcttacgcaaaaacaggaagtgcacatgcgcgaaaagagttttcaatgcaatgaaactggggaggcgttcaactgtagtagtttcgtgcgcaagcaccagatcattcatctgggtgagaaacagtataagttcgatatttgcggaaaagtgttcaacgagaaacgctacttagcccggcaccggagatgccacacttccgaaaagccgtacaagtgtaacgaatgcggcaaatccttttcttacaagtcatcgctcacctgtcacaggcggtgccatacaggcgaaaaaccgtacaagtgtaacgagtgtggcaagagtttcagttacaaatcctcgcttacctgccaccaccgatgtcacacaggcgaaaaaccctacaagtgtaacgagtgtggcaagtccttcagctacaaaagttcgctgcggtgtcaccggcgcctgcatacagggattaagccttataagtgcaatgaatgcgggaaaatgttcgggcagaatagtacacttgttatccataaggcgatccataccggtgagaagccttacaagtgtaacgagtgcggtaaggctttcaatcagcaaagccatctgtcccgccatcatagactacacacaggagagaagccttataagtgtaacgactgtggaaaggcattcatccaccagagcagcctggctcggcaccacaggctgcacaccggagaaaagagttacaagtgcgaagaatgtgacagggttttctctcagaagagtaacttagaacgacacaagatcattcacactggtgagaaaccctacaaatgcaacgaatgtcacaaaacattcagccaccgcagcagtttgccttgccacagacggcttcattctggtgagaaaccttataaatgcaacgaatgtggaaagacttttaatgtgcagtcacacctttccaggcatcaccgtctgcacacaggggagaagccatataaatgcaaagtgtgcgataaagccttcatgtgtcacagttatttggctaaccacactcgtatccatagtggcgagaagccatataagtgcaatgaatgcggaaaagcacacaatcacctgattgattcaagtatcaaaccatgcatgtcatcctag

SEQ ID NO: 35027 - DNA, 1773 bp, Artificial Sequence
  Description of Artificial Sequence: Synthetic coding sequence
atgctgcatgaagaagctgcgcagaaacgcaaggggaaagaacctgggatggccttgccgcaaggccgactgacattccgtgacgtggccattgaattttcacttgctgaatggaaattcctgaaccccgcacagcgggccctgtatagggaagtgatgttggagaactaccgaaatctcgaggcagtggacatttcttcaaagcggatgatgaaggaggtcctttctaccgggcaaggtaacacagaagtcattcacaccgggatgctccagcggcacgagagttatcataccggagatttttgcttccaggaaatcgagaaggacatacacgacttcgagttccagagccagaaagacgaaaggaacgggcacgaagcctctatgccgaagataaaagagctgatgggttctacagatagacacgaccagcggcatgcgggtaacaaacctatcaaagaccaactggggttgtcattccatctccacctgcctgaactgcacattttccaacccgaggagaaaatcgctaatcaggtggagaagagtgtgaatgatgcatcttccatcagcacatcccagcgcatcagctgccggccggagacccacacacccaacaactatggcaataacttctttcattctagtctgctaacccagaagcaagaagtgcacatgcgcgagaaaagcttccaatgcaacgagactggcgaggcattcaactgcagttcattcgtccgcaagcaccagataatccatctgggggaaaaacagtataaattcgatatttgtggcaaagtgtttaatgagaagcgctatcttgcaaggcacagacggtgccatactagcgagaaaccatacaagtgcaacgagtgcggaaaatctttctcctacaaaagctcgttaacctgtcatcggcgctgccatactggggagaaaccatacaagtgtaatgagtgcgggaaatcattttcttacaaaagcagtctgacctgtcaccaccgatgccatacaggcgagaaaccctacaaatgcaatgagtgtgggaaatctttcagttacaagagtagtctgcgttgtcaccgtcgcctgcatacaggtatcaagccctataaatgtaatgaatgtggcaaaatgttcggccagaattcgactctagtgatacataaggctatccacactggtgaaaaaccttataagtgcaatgagtgtggcaaggcattcaatcagcagtcgcatttgagcaggcatcatcgcctgcataccggtgagaagccatacaagtgcaatgactgcggaaaagccttcatccaccagagctccctcgcgagacatcatcgcctccatacgggggagaaatcatacaaatgtgaggaatgtgaccgagtgttttcccagaaaagcaatttggagcgtcacaagatcatccatactggcgagaagccatataagtgcaacgagtgccacaaaacttttagccataggagcagtctaccctgtcataggagacttcatagtggcgaaaagccgtacaaatgcaacgagtgtggcaaaacgttcaatgtgcagtcccatctttcccgccaccatagacttcatactggggagaaaccctataagtgtaaggtttgtgacaaagcgttcatgtgccacagttacttagcaaatcacacccgtatccacagcggcgaaaaaccatacaagtgcaatgaatgtgggaaggcccacaatcacctcatcgactcatctatcaagccctgtatgtccagctag

SEQ ID NO: 35028 - DNA, 279 bp, Artificial Sequence
  Description of Artificial Sequence: Synthetic coding sequence
atggagctagtgactttccgagacgtggcaatcgaattttcccccgaagaatggaaatgcctggacccggcgcaacagaatctgtaccgagacgtcatgctggaaaattacagaaacctggtttctctggggttcgtcattagtaatcccgacctggtgacgtgcttggaacagattaaagagccatgtaatctgaagatccatgaaacagctgctaaacctcctggttccgacctgcaggtgtataaggaatcccaatgcccactctataggctatag

SEQ ID NO: 35029 - DNA, 2715 bp, Artificial Sequence
  Description of Artificial Sequence: Synthetic coding sequence
atggccgccgccgggggcgctgagggacggcgtgccgacatggaggccgaagctgcagccgcccctgaacgggagggtggctcgtgcgttctttgctgcggtgacctggaagctaccgccctgggtagatgtgatcaccctgtgtgttaccgctgctctacaaagatgagggtgctttgtgagcagcgttattgcgctgtctgcagggaggaacttagacaagttgtattcggaaaaaaacttcccgctttcgcgaccatcccaattcatcaactccagcatgagaaaaaatatgatatctatttcgcagacggtaaggtatacgccctctatcggcagttgttgcagcatgagtgtcctaggtgcccagagcttcctcctttttcattattcggcgacctagaacaacacatgcgtaggcagcacgaattattttgctgccggctatgcctgcagcatcttcagattttcacatacgagaggaagtggtactcgcgcaaagacctagcccgtcatcgcatgcagggagacccagacgacacatcacatcgcggtcatccactgtgtaagttttgtgacgaacggtacttggataatgacgaactgctgaaacaccttcgccgtgaccactatttctgccacttctgtgacagtgacggggctcaggactactacagtgattatgcctacctacgtgaacattttcgggagaagcatttcctgtgtgaggagggtagatgttcgactgagcaattcacccatgcttttcgtacagagatcgacctgaaggctcaccgaacagcatgccactcacggtcacgtgccgaggccaggcagaatcgccacattgatttgcaattctcttacgcgcctcgacattcccgcagaaatgaaggtgtcgtgggcggggaagactacgaagaagtagacaggtacagccgacaaggtcgagtggctagagctggtaccagaggcgcccagcagtctagacgaggttcttggcggtataaaagagaagaggaggacagagaggtcgctgccgccgtccgtgcctcagtggctgcccaacagcaagaagaggcgcgacggagtgaagatcaggaagaggggggacgccccaagaaggaggaggctgctgctcgggggcccgaagatcctcgcggtccacgaaggtccccacgtactcagggcgagggccctggcccaaaggagacgtctactaatgggcctgtttcgcaggaggcttttagcgtcaccggtcccgcagctccaggttgcgtaggagtcccgggggctctgccccctcctagcccaaagctcaaagatgaagacttccccagcctgtccgctagtacaagctcctcatgcagcaccgctgcgaccccaggacctgtgggactggccctaccatatgctatccccgcacgtggccgttcagccttccaggaagaagactttcccgcactagtgtcgtcagtgccaaagcctggcacagcccctacatccctcgtgtctgcttggaactccagctctagtagtaaaaaggtagcccagcctcccctgtccgcgcaggccaccggctctggccagcccacccgtaaggccggtaagggttcccgcggcggccgaaaggggggtccccccttcacacaggaggaagaagaggatggggggcccgccctgcaagaattgctgtctacacggcccaccggatcagttagctcaacgctgggtctagcctcaattcagccgtccaaggtggggaagaagaagaaggtcggcagcgagaagcctggaacaaccctccctcagcccccaccagcaacctgccccccgggagccctgcaagcaccagaggcacctgcatcaagggccgaagggcccgtcgctgtcgtagtgaacggacacatggagggccctgcgccagctcggtccgcccccaaagaaccaccgggtcttccacgcccgctgggctcttttccttgcccaacaccccaggaagacttccctgcgctcggggggccttgccctccccggatgccacctccccccggcttctccgcagttgtgctgttaaagggcacccctccaccccccccccccggactggtccctcccatcagtaaacccccgcctggcttctcgggccttctcccaagtcctcaccctgcttgcgtgcctagtccagccacaacgacgacaaccaaagctccacgcttgttgccagccccccgggcgtacttagtgcctgagaacttccgggagcgaaacctgcagcttatccagtcaattagagactttctccaatcagatgaagctcggttcagcgaatttaaatctcatagcggggagtttaggcaaggactgatcagcgcagcccaatactataaatcctgtagagacctgttgggtgaaaacttccagaaggtctttaacgaactcctggtgcttctgccggacactgcgaagcagcaggaactgcttagtgcccacactgacttctgtaatagggagaagcccttaagtacgaaatcaaagaagaataagaaatccgcatggcaggctacaacccagcaggcaggattggattgccgggtgtgccccacatgtcagcaggtgctcgcccacggcgacgcctcttcgcaccaagcccttcatgcagccagggatgatgattttccgagtctacaggcaatcgccaggatcattacatag

SEQ ID NO: 35030 - DNA, 2550 bp, Artificial Sequence
  Description of Artificial Sequence: Synthetic coding sequence
atgcgagtcctatgcgaacagcgctactgtgccgtgtgcagagaagaactgagacaagtcgtttttggaaagaaattgccagcctttgctactattccgattcaccagctgcagcacgaaaagaagtacgatatctactttgcagacgggaaagtgtacgccctgtatcgtcaactactacagcatgaatgtcctagatgtccagagctgccaccatttagtctctttggggatttggaacaacacatgaggagacagcacgagctcttctgttgccgcctctgtctgcagcatcttcagattttcacatatgagcgcaagtggtactcccggaaggacttagccaggcaccggatgcaaggcgaccctgatgatacaagccacagagggcatccattgtgcaagttttgtgacgaacgctatctggacaatgatgagttgctcaagcatctgaggcgggaccattatttctgccacttctgcgatagcgatggggctcaagactattatagcgattatgcataccttagagaacacttccgcgaaaagcacttcttgtgtgaggaaggaagatgtagtacagaacagttcacccatgcattcagaaccgagatcgacctcaaagcccacaggaccgcctgtcactcccgatcaagggcagaggctagacaaaataggcatattgacctgcagttctcgtacgcgccccgacactcccggagaaatgaaggcgtcgtgggaggagaggactatgaagaagtagatagatacagcaggcaaggaagagttgcaagagcagggacccgaggtgcccaacagagcagacggggctcttggcggtataagcgcgaggaagaggaccgggaggtggccgccgctgtcagagccagcgtcgctgcccagcagcaggaggaagccagacgctctgaggaccaggaagagggggggcgaccaaaaaaggaggaagcagcggcccgaggtccagaggatccccggggtccccgaagatctccgagaacccagggggagggccctgggccgaaggaaacatccaccaatggccctgtgagccaggaagccttctccgtcaccggcccagccgcccccggttgtgtcggtgttccgggcgcgttgccaccccctagccccaaattgaaagacgaagacttcccatcactgtctgcttccacaagtagtagctgctctacagcagcgacacctggtcctgtgggcctggcactgccctacgccattcccgccagaggccgctccgcattccaggaggaggacttccccgcactcgtcagtagtgtgccaaagcctgggaccgcccccacctccctggtgagtgcatggaactccagctcatcatccaagaaagtggcccagccaccattatcggcacaggctactggatcgggacagcccacccggaaggccgggaaggggagtcggggagggcgcaaaggcgggcctccatttactcaggaagaggaggaagatggcggccctgccctgcaggaattgttaagcacgaggcctactggttctgtgtcatcgactctgggcctggcaagcatccagcctagcaaggtgggaaagaaaaaaaaagtcggttctgagaaacccggaacaacactcccccagcctccgcctgccacatgtccccccggagccctgcaggccccagaggctcctgccagccgcgccgaggggcccgtagctgttgtcgtgaacggccacatggaaggcccagcacccgctcgcagtgctcccaaggagcctccagggctacctaggcctctgggatcttttccatgccccaccccacaagaagactttcctgcgctggggggaccatgccccccccggatgccgcccccgccaggtttctctgctgttgtgcttctgaaaggaactcctccaccccctccccccgggctggtgcccccaatatccaagccaccacccgggttctcaggcctgttgccatccccccatccagcatgcgtgccctcgccagccactacaactaccactaaggctccccgcttgctgcccgcaccacgtgcttatctcgtcccagaaaattttagggaacgcaatctccaactgatccaatcgattagagacttcctacagagtgatgaggctcgatttagtgagttcaaaagccatagcggggagttcaggcagggcttaataagtgcggcacagtattacaagagttgtcgcgatttgctaggcgaaaacttccagaaagtctttaacgaattgttagtgttgcttcccgacacggccaaacaacaggagctcctctccgctcatactgacttttgcaaccgcgagaaaccgttaagtaccaaatcgaagaagaataagaaaagtgcatggcaggccaccactcagcaggcagggctcgattgccgtgtttgccctacctgccaacaggtcctggcccatggcgacgctagttcacatcaagcattgcacgccgctagagatgacgatttccccagcctgcaggctattgctaggatcattacatag

SEQ ID NO: 35031 - DNA, 4539 bp, Artificial Sequence
  Description of Artificial Sequence: Synthetic coding sequence
atgtctgtcaacatcagcaccgctggaaagggagtggatcccaataccgtggatacttatgactccggggacgactgggagatcggagttggcaacctgatcatcgatctggatgctgatctggagaaagacaggcagaaattcgaaatgaacaactcaactacaacaacctcatcaagtaacagtaaggattgcggcggtccagcttcatctggggccggcgccaccgccgctctggcagacggcctcaagttcgcctccgtgcaggccagcgccccccagggaaactcccacaaggagacaagcaaatctaaagtgaaacgctctaagacttctaaggacgctaataaatctcttccgtccgctgccctatacggtatccccgaaatctcctctactggtaagcgacaggaggtccagggacgcccgggtgaggccaccggcatgaactccgctctagggcaatccgtaagttctggtggatctggcaaccccaattcaaattcaacaagtacgtcgaccagtgctgcaaccgctggcgctggctcctgcggaaagtccaaggaagagaagcccggaaagagtcagagctcccgcggtgccaaacgcgataaagacgcaggaaagtctaggaaagacaagcacgacctgcttcagggccaccagaatggtagcggcagccaagcaccctcaggaggccacctgtatggttttggtgcgaaatccaacggcggtggcgcctctccttttcactgtggcggaacaggaagcggcagtgtcgccgcagccggggaagtctccaaatctgctcccgactccgggctgatggggaactcaatgttagtaaaaaaggaggaggaggaggaagagagccataggagaatcaaaaaattgaaaacagaaaaggtggatcccctgttcactgtaccagctcctcctcctcccatcagttcttcgctgacccctcagatcctgccatcatatttttccccatcatcgagcaacattgccgcccctgtggagcaattgctggtgagaacgaggtcagtaggagtgaacacatgcgaggttggagtggtcacagagcccgaatgtctgggcccgtgcgagccagggacatcggtgaacttagaaggcatcgtgtggcacgagacagaagaaggagttcttgtcgtaaacgtcacctggaggaacaaaacctatgtcgggacactgctggattgtacaaagcacgactgggcaccacccagattctgcgagtctccgacgtctgatctagagatgcggggcggacgggggcgcgggaaacgcgccaggtctgctgccgccgcacccggtagcgaggcctcctttacagagtcacgcggtctgcagaacaaaaatcgcggaggggccaacggcaaagggaggagaggttcactgaatgcttctgggcgtagaactccaccgaattgcgcagctgaagacatcaaagcgtccccctccagcacgaacaagagaaagaataagcccccgatggagttggacttgaatagtagctccgaggacaataaacctggcaaaagagttagaacgaactccaggagcaccccaaccacccctcagggtaaaccggagacgacatttctggaccaaggctgttcatccccagtcttaatcgactgtccacaccccaattgtaataagaagtacaaacacattaatggacttagataccatcaggctcatgcccatcttgatcctgaaaataaactcgagttcgaacctgatagtgaagataaaataagcgattgcgaggaagggctctctaacgtcgctctggagtgttccgagccatctacctccgtttcagcatacgaccagctgaaggcacctgcgtcgcctggcgccgggaacccacccggaacacccaagggcaaacgcgagctcatgagtaacggcccaggatctatcatcggagctaaagccggaaagaacagtggcaagaagaagggactgaataatgagttgaacaacctgcccgtgatctccaacatgacggccgctctggattcctgcagcgctgccgatggcagcctggcagcggaaatgcccaagctggaggctgaagggctgatcgataagaagaatctgggagacaaggaaaaaggcaagaaggctacgaactgtaagaccgacaaaaatctttccaagctgaaatcagctcgacccatagcccctgcccccgctcccacacctccacagttgatagccatccccacagctacgttcaccaccaccacaactgggacgatccccggcctgccatccctgactaccacagttgtacaggcgactccgaaatccccgcctcttaagccaattcagcccaaacccacgataatgggtgagcctatcacggtgaatcccgcgctcgtgtcccttaaagataagaaaaagaaagagaagcggaaactgaaggacaaggaaggaaaggagactggctcccctaagatggatgcaaaactagggaagctggaggatagtaaaggcgcatcaaaagatctgcctgggcactttttaaaggatcatctgaacaagaatgaggggttagccaatggtctctctgaatctcaggagtcccgcatggccagcatcaaggcagaagctgataaagtctacaccttcaccgacaatgctccatcaccgtccatcggcagcgcctctcggctggagtgtagtacattagtcaacggccaagccccaatggctccgctgcacgtgctgactcagaacggcgctgagtccagtgcagccaagacctcaagcccagcttactctgatatctccgatgctgccgatgacggggggagcgattcacggtcagaaggtatgcgctccaaggcctcaagcccttccgatattatcagctccaaagatagcgttgtcaaagggcactccagtactactgcccagtcatcccaactcaaggagagccacagcccttattaccattcctacgacccttactactcgccctcctacatgcacccggggcaagtaggtgctcctgccgccgggaatagtggctctacgcagggaatgaagatcaaaaaagaatccgaggaagatgccgaaaagaaagacaaagctgagcagctagacagcaagaaagtggaccataactctgcttctttgcagcctcagcaccaaagtgtaataactcagcggcaccctgcacttgcccagtccctctattatgggcagtatgcttacggattatatatggatcagaagagtctgatggccacctcccccgcttacagacagcagtacgagaagtactatgaggatcaacgcctggcagagcagaagatggcacaaacagggagaggagactgcgagcgaaagtctgagctgcctctgaaagaactgggcaaggaagaaaccaagcaaaaaaacatgccctccgcgaccatttctaaggctccaagtacaccagaacccaataagaaccactctaagctggggcccagcgtgccaaataagactgaggaaaccggcaagagtcagctattaagcaaccaccaacagcagctgcaagcagattcttttaaggccaagcagatggagaaccatcagctgattaaagaggctgtggaaatgaagagcgttatggatagcatgaaacagacaggagtagacccaacctcccgcttcaaacaggaccccgactcacgcacatggcaccattatgtctaccagcctaaataccttgaccaacaaaaatcagaagagttggaccgggagaagaagctgaaagaggacagccctaggaagacccccaataaggaatctggagtgcctagccttccggtgagccttacttccattaaagaagaaccaaaagaggcaaagcaccccgactctcaaagcatggaggaatcaaaattgaagaacgacgatcgtaaaaccccagtcaactggaaagatagcaggggaaccagagtggctgtctctagccctatgagtcaacaccaatcatacattcagtacctgcacgcctatccctatccccagatgtacgacccttcccaccctgcctatagggcagtcagtcccgtgctgatgcacagctaccccggtgcatatctttctcccggctttcactacccagtgtatggcaagatgagtggacgggaagagacggagaaggtgaacacatctccatcggttaacaccaagactaccactgagtccaaagcgttggacctgttgcaacagcatgccaatcagtaccggtcgaaatcacccgcacccgtggagaaggctaccgcagagcgggaaagggaagccgagcgtgagagggatcgccactcccccttcggccagcggcatctccatacccaccaccacacccatgttggcatgggatatcctctcatacccggacaatacgatcctttccagggcttaacttcggcggctctggtggcttcccagcaggtcgccgcccaggcatccgcttccggcatgtttcccggccagcggcgcgaatag

SEQ ID NO: 35032 - DNA, 3258 bp, Artificial Sequence
  Description of Artificial Sequence: Synthetic coding sequence
atgaggggtgggagggggcggggcaagcgggctaggtcagctgccgcagctcccggttcagaagcaagctttaccgagtccaggggactacagaacaaaaaccgcggcggcgccaatggaaaaggtagaagaggctccctgaacgcctcgggcagacgcacaccaccaaattgtgcagcagaggacatcaaagcatcccccagctccaccaataagcgcaagaacaagccacctatggaattggatttgaatagttcttccgaggacaacaagccaggcaagcgcgttcggaccaattctcgcagcacgcctacaaccccacagggcaaacctgagactacctttctggaccagggttgttcgagccctgtgcttattgactgtccccaccccaactgcaacaagaaatacaagcacatcaacggcctgagataccaccaggcccacgcacatctggatcccgagaacaaactcgagtttgaaccagattcagaggacaaaatctcggactgcgaggagggcctgagcaacgtggcgctggagtgttcggagcctagtacatccgtatcagcgtatgatcagctgaaggcccccgccagccccggcgccgggaatccaccaggaacccctaagggcaagcgagaactgatgtcaaacggacctggttcaatcattggcgccaaggccgggaaaaacagtggcaaaaagaaaggactgaataacgaactcaataacctgcctgtgatcagtaacatgacagccgccctagattcttgcagcgcggcagacggatcactcgctgctgaaatgcccaaactggaggccgaagggctcatagataaaaaaaacctgggggataaggaaaagggaaagaaggccactaactgcaaaacggacaaaaatttaagtaagcttaagtcagcaagaccaatcgcccctgcaccagcccccactccaccacaattaatagctattcctacagccactttcacgacaaccacgacaggcacaatccctggcctcccatcactaacaacaaccgtggttcaggctacccctaagtcacctcccctgaaaccaatacagccgaaaccaactattatgggcgaaccaataaccgtgaaccctgctcttgtctccctcaaggataagaaaaagaaagagaaacgcaaacttaaagacaaggagggcaaggaaaccgggtcgccaaaaatggacgcgaaactgggaaagctcgaagactctaaaggcgcctctaaggatttacccggtcatttcctgaaagatcacctcaacaagaacgaggggcttgctaacgggctgtccgagagccaggagtctcgaatggctagcatcaaggcagaagccgataaagtgtatacatttacggataacgcccctagtcccagcatcgggagtgcaagccgtctcgagtgttccaccctagtcaacgggcaggctcctatggccccactgcacgtattaacccagaatggagccgagagttcagcggctaagacatcgtctccagcgtattccgacatctcagatgcagccgacgacggggggtcagattccagatccgaagggatgcggtccaaagccagctcgccttcagatatcatctccagcaaagattctgtggtgaaagggcatagttcaaccacagcccagtcttcacagctgaaggagtctcattccccctattatcattcctatgatccctattacagtccttcctatatgcaccccggccaagttggcgcccctgctgccggcaattccggatcaactcagggcatgaagatcaagaaagagtctgaggaggacgccgagaaaaaggataaggccgagcagcttgacagcaagaaagtcgatcacaactccgcaagcctccagccacagcatcagtcggttatcacccaaagacacccagcactcgcccagtcactgtactacggtcaatacgcttacggcctgtacatggaccagaagagcctcatggctactagcccagcatacaggcagcagtatgaaaagtattacgaagaccagaggctagcagagcaaaagatggcccagaccggccgtggcgattgcgaacggaaatccgagctaccattgaaagaactgggaaaagaagaaactaagcaaaagaatatgccttctgcaactatctccaaagctccttcaactccagaacccaacaaaaaccatagcaagctaggtccgtctgtccccaacaaaaccgaggaaaccggcaagtcacagctgttgagcaatcaccagcaacaactccaagcagacagttttaaggcaaaacagatggagaatcatcagctgattaaagaggccgtagagatgaagtctgtaatggacagtatgaagcagacgggggtggatcctacgagcagattcaaacaggacccagactcaaggacttggcatcactacgtatatcagccgaaatacttagatcagcaaaagtccgaggagcttgatagagagaaaaagctgaaggaggacagcccaagaaagacgcctaacaaagagtctggagttccgtctctgccagtgtcgctaacaagtatcaaagaagagcccaaagaggccaagcatcctgacagtcagagcatggaagaatcgaaacttaaaaacgacgatagaaagacacccgtaaattggaaagacagcagaggaacaagggtcgcagtgagcagccccatgagccagcaccagagctacattcagtacctgcacgcttacccttatccccaaatgtacgaccccagccaccccgcctaccgcgcggtctcccccgtgttgatgcattcctatccaggggcgtatctatcacccgggtttcattacccagtttacgggaaaatgagcgggagagaagagactgagaaagtcaatacttcgccctcagtgaacacgaagacaactactgagagtaaggcgctcgacctgcttcagcagcacgcgaaccagtatcgctcaaaatcccccgctccagtagagaaagcgactgcagaacgcgagagagaggcggagagggaacgcgaccgccattctccttttggacagcggcatctccatacacaccatcacacacatgtggggatgggatacccactcatccctgggcagtacgatccatttcaaggactgacaagcgccgccctggtggccagccaacaggttgccgctcaagcaagtgcctcggggatgtttcccggacagcgaagggagtag

SEQ ID NO: 35033 - DNA, 2148 bp, Artificial Sequence
  Description of Artificial Sequence: Synthetic coding sequence
atgtcagtcaacatttccaccgccgggaaaggcgtggacccgaacacagtggacacctatgactcaggagatgactgggaaattggcgtggggaacctgattatcgatctggatgctgacctggagaaggatcggcaaaagtttgagatgaacaattcaactactaccacatcctcttctaactccaaagattgcggaggacccgccagcagcggcgccggcgctaccgccgccttagcagacggccttaagtttgcatccgttcaggcctccgctccacaaggcaattcccacaaagaaacttccaaatccaaggtgaagaggagtaagacctctaaagacgcgaacaagtcactcccaagcgctgccctctacggaattccagaaatatcgagtaccgggaaacggcaagaggtacagggacgtccaggggaggcaacaggaatgaactctgctctgggacagtcggtgtcgtcagggggctcaggcaatccaaactctaattcaaccagtacatccacatccgccgccacagccggagctggatcctgtggcaaatccaaggaggagaagcccggcaagagccagagttcacgcggcgccaaacgagacaaggatgccggaaaaagtaggaaggataagcacgacctgttacagggacatcaaaacggcagcggatctcaagctccatccggaggccatctctatggattcggagcaaagtcaaacggcggcggtgcaagtccattccattgcggaggtactggatctgggagtgtggcagctgccggggaggtttcaaaatcggccccagattccgggctcatggggaactccatgctggtgaaaaaggaggaagaagaagaggagagccaccgccgtattaaaaagctcaaaacggagaaagtagaccccctttttacggttcccgcaccgcccccaccaatctctagttctctgacaccccagattctgcccagttactttagccctagctcttctaatattgcggcaccagtcgagcagctcctggttcgtacacgaagcgtcggagtgaatacgtgcgaagtgggcgttgtcaccgagcccgagtgtctgggtccttgcgaacccggcacttcagtgaatcttgagggcatcgtgtggcacgagacagaagagggggtccttgttgttaatgttacatggcgaaacaagacgtacgttggaacgctccttgactgcacaaagcacgattgggccccgccccgattttgtgagtctccaacaagcgatctagaaatgcgaggggggcgcggaaggggtaagagggcgaggtccgcagcggctgctccgggttctgaagccagcttcaccgaaagccgcggcctgcagaacaaaaatagagggggggccaatgggaaagggcgtcggggttctctaaacgccagcgggcgcagaaccccccctaactgcgctgctgaagacatcaaggcatctccttcttccaccaataagcgtaaaaacaaacctcccatggaactggatctcaactccagctccgaggataacaagcccgggaaacgagtccggacaaactctaggtcgacacccacgacacctcagggtaagcctgagaccaccttcctggatcaggggtgtagtagccccgtccttatagattgcccccaccccaactgcaataaaaagtacaagcatatcaatggccttagataccatcaagcccacgcccatcttgatccagagaataaactggaattcgaacctgattcagaggataagatatcagactgcgaagaaggcctgagcaatgtcgcattggagtgcagtgaaccaagtacaagcgtaagcgcctacgaccagctgaaagcccctgcctcgccaggtgccggaaaccctcccgggacgcctaagggcaaacgagaactaatgagcaacggcccgggctctattattggcgctaaggccggaaagaattctggcaaaaagaaaggcctcaacaacgagctcaataacttacccgtgatcagtaacatgacagcagccctcgatagctgctctgctgctgacggctccttagcagctgagatgcccaagctggaagccgaggggctcattgacaaaaagaatctgggcgacaaggagtag

SEQ ID NO: 35034 - DNA, 2124 bp, Artificial Sequence
  Description of Artificial Sequence: Synthetic coding sequence
atgtccgtgaatattagcaccgccggcaaaggggtagaccccaatacagtggacacatatgattcaggggatgattgggaaatcggagtgggtaatcttattattgacctcgatgcagatttggaaaaagaccgacagaagttcgaaatgaacaacagtactacaaccaccagctcatcaaatagcaaagactgtggtggcccagcttccagcggcgccggcgctacggcggcgctagcagacggcctgaaattcgccagtgttcaggcttcagcacctcagggcaactctcataaggagaccagcaaaagtaaagtcaaacggtcaaaaacctctaaggatgcgaataagtccctgccatctgccgccctttacggaatccctgagatttccagcacaggcaagcgccaggaagtgcaaggacgacctggagaggctacaggcatgaacagtgctcttggacagagcgtgtctagtggaggaagcggtaacccgaactcaaattccactagcacaagcacctctgcagctacggctggagctggcagttgtggcaagagcaaggaggagaagcccggtaagtcacagagctctcggggcgccaagcgggataaagatgccggcaaatctaggaaagacaagcacgacctcttgcaggggcaccagaacggctccggctcccaggctccatccggggggcatctgtatggatttggagcaaagagcaatggcggcggcgcatctcctttccattgcggggggaccggctctggttccgtggccgcagcaggggaggtgagcaagtctgcccccgactctggtctgatgggcaatagtatgttggtaaaaaaggaggaggaagaggaggaaagccatcgcagaattaagaaactgaaaacagagaaggttgacccactgttcacggttccggcccctccaccaccgatctcaagcagcctgacaccccagatactgcccagttacttctcgccatcttcaagcaacatcgcagcccccgtggagcagctgttagtgcgcacacgcagcgtaggggttaacacctgcgaagtgggcgtcgtgactgaaccggaatgtctcgggccttgtgagcctggcacctcagttaacttagaaggtatcgtatggcatgaaacagaggagggggtcctggtggtcaatgtgacctggagaaacaagacctacgtcggcaccctcctggattgcaccaaacatgactgggcacccccgcggttctgcgagtcccccacgtcggatctcgagatgaggggtggacgcggacggggtaagagggctcgctctgcggcagctgctcctggtagcgaagcaagtttcacagagtcccggggccttcagaacaaaaaccgggggggcgccaacggcaaaggacgcagagggagtctcaacgcttccggaagaagaacaccacctaattgcgccgcggaagacataaaggccagcccatctagtactaataagagaaagaataaaccccccatggaactggacttgaattcctcctccgaggataataagcccggcaaaagggtacgtaccaactccagatctactccaaccacaccacagggcaaacctgaaacgactttcttggatcaaggatgctcaagtcccgtactaatagattgtccacatccaaactgcaataaaaaatataagcacatcaacggactccggtatcatcaggcccacgcacacctggaccccgaaaacaagcttgaatttgaaccagatagcgaggacaagatttcggattgtgaggagggtctgtctaatgtggcgcttgagtgttcagagccgtctaccagcgtgtccgcttatgaccagctgaaagcccctgccagtcccggagccgggaaccctcccgggacacccaagggcaaaagggaactgatgagcaacggccctggatctatcattggggcaaaggcaggcaaaaattcagggaagaagaaagggcttaacaatgagctgaacaacctcccggtgatcagcaatatgacagccgcattagactcttgcagcgcggccgacggcagcctggctgctgagatgcctaagctcgaggccgaagggcttatcgactag

SEQ ID NO: 35035 - DNA, 1503 bp, Artificial Sequence
  Description of Artificial Sequence: Synthetic coding sequence
ttgttcttgtttttggccgtagtatgttcctactttgcgcaggatttctggcctaagcagggcatcaaaaactgtttccagaaggtcatcctgaaacgatataagaagtgcgggcacgaaaaccttcagctgggcaagtactgtaaatccatggacgagtgtaaggtgcacgaggaatgttacaacgggctgaatcaatgccttaggaccacacagtctaaaattctgcagtgcgataaatacgtcaaagtgttccataaattctcgaacagtaaccggtataagatccgacatactggaaagaagccttttaagtgcaaggaatgcgaaaaaagtttttgcatgctttctcatctggcacagcataagagaattcataccagagaaaaaccttataaatgtaaggagtgcgggaaggcttacaacgaggccagtaatctctcgacccataaacggatacacacaggtaagaaaccatacaagtgcgaacagtgtgggaaagcattcaacagattaagccacctcaccacccacaagatcattcataccggcaagaagccttacatctgcgaggactgcgggaaagccttcaatcaaagtgctaatctcacaactcacaagcggatacacacgggcgagaaaccatacaaatgtgaggagagcggaaaagccttttctcagagctctacactcacaacgcataagatcatccatgctggagagaagccatataagtatgaggagtgtggaaagtcttttaaccaatctagcacgctaaccaccagaaagatcatccataccggtgaaaaattctgtaagtgcgaggagtggggaaaggccttctctagattatctcatctgacaacacacaaaagaatccattccggcgagaaaccctacaaatgtgaagaatgcggaaaggccttcaagcagtcaagcacactgaccactcataagcgcatccatagcggcgaaaagttttacaaatgtgaggtgtgcagcaaggcctttagccggttttcccatttgaccacccacaagcgcatccatagcggagaaaagccctataagtgtgaagagtgcgggaaggccttcaatctgagcagccatctgacaactcacaagataattcataccggagaaaagccctacaagtgtgaggaatgtgggaaagccttcaacctgtctagtcacctcaccactcataaaatcattcacacgggcgaaaaaccttacaaatgtgaggaatgtggaaaggcatttaatcagtcctctaccctgtcaaaacacaaggtgatccatactggcgagaagccctataaatgcggcgaatgcggaaaagccttcaaccagtcatcccatctgactacacataagatcattcacacaggcgagaagccctacaaatgtgaggagtgtggcaaagccttcaataatagctctattcttaaccggcataaaatgatacacaccggcgaaaagttttacaaacccgaaagctag

SEQ ID NO: 35036 - DNA, 1239 bp, Artificial Sequence
  Description of Artificial Sequence: Synthetic coding sequence
atgactttcaccttccagagcgaggacctaaagcgggactgcggcaagaaaatgtcccatcagcacgtgttctcattggcaatggaggaagacgttaagactgcggacactaaaaaggcctctagaattctggaccatgaaaaagagaataccaggagcatctgtctattggaacagaaacggaaagtcgtttcttccaatatagatgtgcctcccgcccgcaagtccagtgaggagctagacatggataaggtgacagctgcgatggttctgacttcacttagcacttccccattagtcaggagccctcctgtgcggcctaatgaatcattgtcaggatcatggaaggagggcggttgtgtcccgtctagtaccagctcttctggctattggagctggagtgctcctagtgaccagtccaaccctagtacccctagccccccattgagcgcagactctttcaaaccttttagaagtcctgcccagccagacgatggtatcgacgaggcagaagcttctaacctcctgtttgacgagcccatccctagaaaacggaagaatagcatgaaagttatgttcaagtgtctgtggaagaattgcggtaaagtcttatccactgccgccggaattcagaagcacattaggactatccacctggggagagttggagattcagattacagtgatggggaagaggatttttactacaccgagattaagctcaatactgatagcgttgcggacggcctgtcgtcactggctccggtctcgccatcgcagtccctggccagcccgcctacattcccaatccctgattcttctcggaccgaaacaccgtgtgccaaaacggagaccaaattaatgactcctctaagtcggagcgctcccacaaccctgtatttagtgcatactgaccatgcttatcaagcaacgcctcccgtgactatacctgggagcgccaagttcacccctaatggatcctctttctctatcagctggcaaagccctcctgtgaccttcaccggtattcccgtcagtcctacgcatcacccggtgggcacaggcgagcagaggcagcacgcccatactgtcttgagctccccaccaagaggcacagtcagtttgagaaagcctcggggggaaggcaaaaagtgtcgtaaagtgtatgggatggagaatcgggatatgtggtgtaccgcatgcagatggaagaaagcctgtcaacgctttctggactag

SEQ ID NO: 35037 - DNA, 570 bp, Artificial Sequence
  Description of Artificial Sequence: Synthetic coding sequence
atgactttcacctttcaaagcgaggacctcaagagggactgtggcaagaaaatgtcccatcagcacgtgtttagcttagcaatggaggaggacgtgaagacagctgatactaaaaaggcgagccggattttagatcacgaaaaggaaaacacaaggagcatctgcctgctggagcagaagcgtaaagtggtatctagcaatatcgacgtgccgccggcaaggaaaagttcagaggaactggacatggacaaggtaaccgccgctatggtgctgacatcactatctaccagtcccctggtgaggagcccaccggtgcggccaaacgagtccctttcaggatcctggaaggaaggcggctgtgtgcctagctccacttcttctagcggttactggtcttggagcgcaccatcagaccaatcaaatccttctactcccagtcccccccttagtgcagatagctttaagccgtttagatccccggcgcagccggacgacggtattgatgaggcagaggccagcaaccttttgttcgacgagccaattccgcgtaagcgaaaaaactccatgtag

SEQ ID NO: 35038 - DNA, 903 bp, Artificial Sequence
  Description of Artificial Sequence: Synthetic coding sequence
atgcattctttagagaaagttacatttgaggacgtagctattgatttcactcaggaggagtgggacatgatggatacttctaaacgaaagctataccgtgatgtgatgcttgaaaatatctcacacctcgtgtctctaggttaccagatttccaagagttacatcatactccagttggagcaggggaaggagctgtggtgggaaggcagagtcttcttgcaggaccagaaccccgatcgggaaagcgcactgaagaagaagcatatgattagtatgcaccccatcatcagaaaagacacctcgacgagcatgaccatggagaactctttaatcctggaagatcctttcgagtataacgacagtggagaagattgtactcactcgagcacaatcacgcagtgcctgcttacacactctggaaaaaagccgtgtgtctcaaagcagtgcggaaaaagcctcagaaatctgctctcaccgaagccaaggaagcagattcacactaagggcaagagctatcagtgtaacctgtgtgaaaaagcctacacaaattgcttctatcttagacgccataaaatgacccatactggtgagcgcccgtacgcatgtcacctctgcggcaaggcattcactcaatgttcccatctgaggcgacacgagaagacgcacaccggggaacggccctacaagtgccaccagtgcgggaaggccttcatacagtcctttaacctcagacggcacgaaaggacccatctgggccaaaagtgctatgagtgtgataagagcggtaaggcattcagccagagttccggcttccgtgggaacaagatcatccacatcggtgagaagcctcccgcctgcctgctctgcgggaaggccttttcactgtcttctgacctgcgttag

SEQ ID NO: 35039 - DNA, 903 bp, Artificial Sequence
  Description of Artificial Sequence: Synthetic coding sequence
atgcactccctcgaaaaagttacttttgaagacgtagctattgatttcactcaagaggaatgggatatgatggacacaagcaagcggaagttgtatcgcgacgtcatgttagaaaatattagccatcttgtgtcgcttggataccagatctccaaatcttacatcatcctacaactggaacaaggcaaggaactctggtgggagggccgcgtctttctgcaggatcagaatcccgacagagaatctgctctgaaaaaaaaacatatgattagtatgcatcctatcattagaaaggacacgtcgacttctatgacaatggaaaatagcctcattctagaagacccttttgaatataatgactcaggtgaggactgtacccactcctctaccattactcagtgtttgctcacacattccggcaaaaaaccatgcgttagcaagcagtgcggcaagtccctgaggaacctgctgtctcccaagccacgaaagcagattcataccaaaggcaagtcttaccagtgtaatctttgcgagaaagcctacactaattgtttttacctgagaagacacaaaatgacgcatactggggaacgcccctatgcctgccacctgtgcgggaaagcttttacccaatgttctcatttacggaggcatgaaaaaacacacacaggagaaaggccttacaagtgccaccagtgtggaaaggcattcatccaatcattcaaccttaggaggcacgagaggacgcacctggggcaaaagtgttacgagtgtgacaagagcggaaaagcctttagtcaatcctcaggattcaggggtaacaagatcatccacatcggagagaaaccacctgcttgtctcctatgtggtaaggctttctctctttcctcggatctgcgctag

SEQ ID NO: 35040 - DNA, 903 bp, Artificial Sequence
  Description of Artificial Sequence: Synthetic coding sequence
atgcatagcctgaaaaaacttacctttgaagatgtagctatagactttacacaagaggagtgggccatgatggacacttccaagaggaagctgtaccgggacgtcatgctcgagaacatatctcaccttgtgtctttgggttaccaaatcagcaagagttacatcattctccaactcgagcagggcaaagagttgtggagagagggcagagtctttttacaagaccagaaccctaaccgcgaatccgcgcttaagaaaacgcacatgattagcatgcatccgatcacgcgcaaggacgcctctaccagcatgacaatggagaatagcctgatcctggaggacccattcgagtgtaacgactcaggcgaggactgcactcgaagctctacaataactcaatgtctgttaacccactctggtaaaaaaccctacgtttcaaagcagtgcggcaaatccctgcgcaaccttttgagtaccgaacctcacaaacaaattcacacgaaaggtaagtcctatcaatgcaatctgtgtgagaaggcttataccaactgttttcacctgcgtcgccataagatgacacacacgggagaacggccctacgcctgccacctatgccggaaggccttcacgcagtgttcccatctgcgaaggcatgaaaagacccacaccgggcaaaggccctacaagtgtcaccagtacggaaaagtcttcattcagtcctttaacctccagagacacgaaaggacacacctcggtaaaaagtgttacgaatgtgataaatcaggcaaagccttctcccagtcgtctggatttcgcggcaataaaattattcataccggagaaaagcctcatgcctgtcttctctgtggcaaagccttcagcctctctagcaatctgcggtag

SEQ ID NO: 35041 - DNA, 903 bp, Artificial Sequence
  Description of Artificial Sequence: Synthetic coding sequence
atgcatagcctgaagaaacttaccttcgaagatgttgccatcgactttactcaggaagagtgggcaatgatggacacgtcgaaaaggaaactataccgggatgttatgctcgaaaacatcagtcacctggtgtcactggggtatcagattagtaaatcgtacataatcctccagctggaacaagggaaggaactctggagagaaggacgagtgtttctgcaggatcagaaccctaatcgagaaagcgccctgaaaaaaacccacatgatctccatgcacccgataacccggaaagatgcctccacttccatgacaatggaaaacagcctcatccttgaggatccattcgaatgtaacgattcaggcgaagactgtaccaggtctagcaccataactcaatgccttttgacgcacagcggaaaaaagccttatgtgagcaaacaatgtggaaagtctttaagaaaccttttaagcactgagcctcataagcaaattcatacaaaggggaaatcctatcagtgcaatctctgtgaaaaggcctataccaattgcttccacctgcgccgccataaaatgacacacacgggagaaaggccatatgcatgtcacttgtgccgcaaagcctttacccagtgctctcacctgaggagacatgaaaaaactcacactggacagagaccgtataaatgtcatcaatacggaaaagtctttattcagtcctttaacttgcaaaggcatgaaaggacccacctcggaaaaaagtgttacgagtgcgataaaagcggcaaggctttctctcagagtagcggattcagggggaataagataattcacactggcgagaaacctcacgcctgtctcctgtgtggcaaggccttttccttgagctctaatcttagatag

SEQ ID NO: 35042 - DNA, 231 bp, Artificial Sequence
  Description of Artificial Sequence: Synthetic coding sequence
atggctcgcggccaacagaagatccagtctcagcagaaaaatgcgaagaagcaggctggccagaagaagaaacagggccatgatcagaaagccgctgccaaagcagcgctcatttatacctgcaccgtttgccgtacacagatgcctgacccaaagacctttaagcagcactttgagagtaaacaccccaagacgcccctgcctcccgagttggccgacgttcaggcctag

SEQ ID NO: 35043 - DNA, 231 bp, Artificial Sequence
  Description of Artificial Sequence: Synthetic coding sequence
atggctcgcggacagcaaaagattcaaagtcagcagaaaaatgcaaagaagcaagccggacagaagaagaaacaggggcacgaccagaaagcagccgctaaggctgctctgatctatacatgtacagtctgtcggacccaaatgcccgatccgaagaccttcaagcaacacttcgagtctaagcacccaaagacaccattgccacccgaacttgcggatgtccaggcttag

SEQ ID NO: 35044 - DNA, 231 bp, Artificial Sequence
  Description of Artificial Sequence: Synthetic coding sequence
atggccagaggtcagcagaagattcagtctcaacagaagaacgcgaagaagcaggcaggccagaaaaagaaacagggccatgaccagaaagctgcagccaaagccgccctgatctacacctgtacagtgtgtagaacgcagatgccagaccctaagacatttaagcaacatttcgaatcgaaacaccctaaaacccccctgccccctgaactcgcagacgtgcaggcatag

SEQ ID NO: 35045 - DNA, 231 bp, Artificial Sequence
  Description of Artificial Sequence: Synthetic coding sequence
atggcgcgcggacagcagaagatccagtcacagcagaagaatgcaaagaagcaggccggccagaagaagaaacagggccatgatcagaaagcagcagcaaaggctgctctaatctatacatgcacagtgtgtcggactcagatgcctgatcccaagaccttcaaacagcacttcgagtctaagcacccaaagactccattgccccccgaacttgccgatgtacaagcgtag

SEQ ID NO: 35046 - DNA, 231 bp, Artificial Sequence
  Description of Artificial Sequence: Synthetic coding sequence
atggcccgggggcaacaaaagatccagtcccagcagaagaacgccaagaaacaagcaggccaaaagaaaaagcaaggtcacgaccagaaggcggccgctaaagccgccttgatctatacctgcactgtttgccggacccagatgccagatcccaagacgtttaaacagcacttcgagagcaagcacccaaagacccctctcccccccgagctcgccgatgtccaggcctag

SEQ ID NO: 35047 - DNA, 27 bp, Artificial Sequence
  Description of Artificial Sequence: Synthetic coding sequence
atggcacgcggtcagcagaagatttag

SEQ ID NO: 35048 - DNA, 231 bp, Artificial Sequence
  Description of Artificial Sequence: Synthetic coding sequence
atggcgcgcggccaacagaaaatccagtcccagcagaagaatgcgaagaaacaggcagggcagaaaaagaaacagggtcacgaccaaaaagcagctgcaaaagccgccttaatctacacctgcactgtgtgtagaacccaaatgcctgaccccaagaccttcaagcagcacttcgaaagtaagcatccaaagacacccctgcccccagagctcgcagatgtgcaggcatag

SEQ ID NO: 35049 - DNA, 231 bp, Artificial Sequence
  Description of Artificial Sequence: Synthetic coding sequence
atggcgcggggacagcagaaaattcagtcccagcagaagaacgccaagaagcaggccgggcagaaaaagaagcagggccatgaccaaaaggccgctgcaaaagcagctcttatctatacctgtaccgtgtgcagaacccagatgcctgatcctaagacttttaaacagcacttcgagagcaagcacccaaagaccccattgccgcccgaactagctgatgtccaggcatag

SEQ ID NO: 35050 - DNA, 129 bp, Artificial Sequence
  Description of Artificial Sequence: Synthetic coding sequence
atggcccggggacagcaaaagatccagtcccaacaaaaaaatgccaagaagcaagccggccagaaaaagaaacagggtcacgatcagaaggccgctgccaaggcagcactgatttacacgtgtacctag

SEQ ID NO: 35051 - DNA, 1116 bp, Artificial Sequence
  Description of Artificial Sequence: Synthetic coding sequence
atggacatggctcaggagccagtgacattccgagacgtggcaatatatttttcacgggaggaatgggcatgccttgaaccttcacaaagagccctgtatcgcgacgttatgcttgacaacttttcgagcgtggctgccttgggcttctgctcaccacggcctgaccttgtaagccggctggagcaatgggaggagccgtgggtggaggatagggaaaggccagaatttcaagctgtccagagagggccaaggccaggggcccggaagtcagccgacccaaagaggccatgcgaccaccccgcttgggcccataagaaaacccatgtgcggcgcgaacgggctagggaaggcagctcattcagaaaagggttccgtctagacaccgatgatggacagttgccacgagctgccccagagaggacggatgcaaagcccacagcatttccgtgccaggtcctgactcagaggtgcgggcgaaggcctggtaggcgagagagacggaaacagagggctgtcgagctcagcttcatttgtggcacctgcggtaaggcactgtcctgtcattcccgcctgctggcccatcagacagtgcatactggcacaaaggcctttgagtgtccagagtgcggccagacattcaggtgggcgagcaatcttcagcgacaccagaagaatcatacacgagaaaagcccttctgttgtgaagcgtgcggccaggcttttagtttgaaagacaggctcgcccagcatagaaaagtgcacactgagcatagaccatattcgtgcggggattgtgggaaggcttttaaacagaagagtaacctactccgccaccagctggtgcatacaggtgaaaggccattttattgtgctgactgtggaaaggccttccgtactaaagaaaacttgagccaccaccagcgcgtgcatagtggcgagaagccctatacttgtgccgaatgcggtaaaagtttccggtggccaaagggattttctatccacaggcgacttcatctgacaaagcgcttttacgaatgcgggcattgcggaaaagggttcaggcatttgggcttttttactagacaccaacggactcaccggcatggggaagtttag

SEQ ID NO: 35052 - DNA, 1116 bp, Artificial Sequence
  Description of Artificial Sequence: Synthetic coding sequence
atggatatggcccaggagccagttacatttagagacgtggccatatattttagccgtgaggagtgggcgtgcctggaaccctcacagagagctctataccgggacgtaatgttagataacttttcctccgtggctgccctgggattttgcagccccaggcctgacctggttagccggctggagcagtgggaagaaccgtgggtggaggatcgggaaagacccgaattccaggccgttcaaaggggtcccaggccaggagcgagaaagtccgctgatccaaagagaccctgcgaccaccctgcatgggcacacaaaaaaacccacgtgcgtagggagagggcaagagagggatcatctttcaggaagggtttccgtctagacaccgacgatgggcagctgccaagagcagcgcccgagagaactgatgccaagccaacagcctttccttgccaagtactcactcaaaggtgcggtcgacggcccggaaggagagagcggcgtaagcagagagctgtcgaattgagttttatttgtggaacgtgtggcaaggcgctgagttgccactccaggctcctggcccaccaaacggtccacacgggcacaaaggccttcgagtgccccgagtgcgggcagacatttagatgggcaagtaacctccagagacaccagaagaaccatacgagagagaaacccttttgctgtgaagcttgtggacaagctttttcgcttaaggatcggctcgctcaacatcgcaaggtgcacactgagcatagaccctattcttgtggcgactgcggcaaggcttttaagcaaaaatccaacctgctgcggcatcaactggtgcataccggtgagagaccattctactgtgccgattgcgggaaggctttccgaactaaggaaaacttaagtcatcaccagcgcgtccacagcggagaaaagccctacacttgtgccgagtgcggcaaatcgttccgctggcccaagggtttctcaatccatcgaaggcttcaccttaccaagaggttttacgaatgcggacactgtgggaaagggtttaggcacctggggttctttacgaggcatcaacgtacgcacagacatggagaggtttag

SEQ ID NO: 35053 - DNA, 1665 bp, Artificial Sequence
  Description of Artificial Sequence: Synthetic coding sequence
atgaacgtcatgcttgagaattataagaatcttgtgttcctcgctggtatagccgtttctaagcaggatcctataaccagtctggagcaggagaaggagccctggaatatgaagatttgcgagatggtcgatgagtctccagccatgtgctcctcctttacaagggatttgtggccagagcaggacatcaaggacagttttcagcaagtgatccttaggagacatgggaagtgtgagcacgaaaatttgcagctgcggaagggctctgccaatgtcgtggagtgtaaggtttacaagaaaggttacgaactgaatcaatgtttaacaactacccagtccaagatctttccgtgtgacaaatatatcaaagtgttccataagatcttcaacagcaaccgacacaaaaccagacatactggcgaaaaaccatttaagtgcaaaaaatgcgacgagtccttttgcatgctgctccatcttcatcaacacaaacgtattcatattagggaaaatagctaccaatgcgaggagtgcgataaggtgttcaagcgcttttctaccctgacacgacacaagcgggtgcatactggggaaaaacccttcaagtgcgaagagtgtgggaaagcttttaagcatagtagcaccttgaccacgcacaagatgatacatacaggtgaaaagccgtatagatgcgaagagtgtggcaaagccttctaccactcttcacatctgaccacccataaagtaattcacacaggggaaaaaccttttaagtgtgaggaatgtggaaaagcctttaaccacccatccgccttgactactcataagttcatccacgtgaaggaaaagccgtacaaatgtgaagaatgcgacaaagctttcaataggttttcatacctaaccaaacacaagattattcacagcggcgaaaaaagctacaagtgtgaacagtgtggcaagggctttaactggagctccactctgaccaaacacaaacgaatacacacaggggagaagccttacaagtgtgaagagtgcggtaaggcctttaacgttagtagtcacctcaccactcacaaaatgatccacaccggcgaaaaaccctataagtgtgaggaatgtggcaaggctttcaaccattcatcgaagttaaccattcataagattatccatactggggagaagccctacaaatgtgaggagtgcgggaaagcattcaatcagtccagcaacttgacaaaacataaaattatccataccggcgagaagttatataaatgcgaggagtgcgggaaggctttcaataggagttctaatctaacaactcataaacggatccatacaggcgaaaagccatacaaatgtgaagagtgtgggaaagccttcaaccggagctctaatctcaccaaacacaatataattcacacaggtgaaaagagctacaagtgcgaagaatgtgggaaagcctttaatcagagctcaacgcttacgaaacatcgcaagattcagcagggtatggtggcacatgcctgtaaccctaacaccctgcgtggccttggcgaacaaattgctaggtcaggggtacaggatcaacccgggcagcatggcaagaccccgagcctcttaaaaattcaaaaattcgccgggtgcggagggcggcgactgtag

SEQ ID NO: 35054 - DNA, 1572 bp, Artificial Sequence
  Description of Artificial Sequence: Synthetic coding sequence
atgaacgtgatgctggaaaactacaagaacctcgtgttcctcgccgggatcgcagtgagcaaacaggatcccattacctccctcgagcaggaaaaagaaccttggaacatgaagatatgcgaaatggtggacgaatcacccgctatgtgctcatcctttacccgcgatctgtggccagagcaggacattaaagatagctttcagcaggttatcctacgccggcatggtaaatgcgagcacgagaacctccagttaagaaagggaagcgcgaacgttgtagagtgtaaggtgtataaaaaaggctatgaactaaatcagtgccttacgacaacacagtcaaaaatcttcccatgtgacaagtatatcaaggtattccataaaattttcaactcaaacaggcacaaaactcgacatactggagagaaaccattcaagtgcaagaagtgtgacgagtcattttgcatgctgcttcatctgcatcagcacaagcgcatccacatccgggaaaacagctatcagtgtgaagaatgtgataaggtgtttaaaaggttcagcaccctgacaagacataagcgcgtacatactggtgaaaaacccttcaagtgcgaagagtgtggcaaggccttcaagcacagctctacattgaccacccataagatgatccacactggcgaaaaaccttacaggtgtgaggagtgcggaaaggctttctaccactcatcgcacctcacgacgcataaagttattcatacaggcgagaaaccttttaaatgtgaggagtgcggtaaggcatttaaccatccttccgcgctcacaacacataagttcattcacgtgaaagaaaagccttataagtgtgaagaatgcgacaaggcctttaaccggttctcctacctgacgaaacacaagatcattcatagtggggagaagtcatataaatgtgaacagtgcggcaaagggttcaactggagtagcacactgaccaaacacaaacgtattcacaccggggaaaagccatacaagtgcgaagagtgcggaaaggccttcaacgtatcctcccatttgactactcataagatgatccatacaggtgaaaagccctataaatgtgaggagtgtggtaaggcctttaaccatagctcaaagctgacaatccacaaaatcatccacaccggcgaaaagccatataagtgtgaagagtgtggtaaggcctttaaccaaagcagtaatctaaccaaacacaagattatccacaccggagagaaactgtataagtgcgaggaatgcggaaaggcgtttaatcggagcagcaatttgactacacacaagaggatccacactggagaaaagccttacaagtgtgaagagtgtggcaaggcctttaacagatcatctaaccttaccaagcacaatatcatacacactggggagaagtcctataaatgtgaagagtgcggcaaggcctttaaccagtcgagtacccttaccaaacaccgaaagattcagcaaggtatggtagcccatgcttgtaatccaaacacactgcggggccaagggcggtggatcatgtag

SEQ ID NO: 35055 - DNA, 1665 bp, Artificial Sequence
  Description of Artificial Sequence: Synthetic coding sequence
atgaacgtgatgttggagaattacaaaaatctagtcttcctggccggtatcgcagtgtccaaacaagaccctattacgagcttagaacaagaaaaggagccctggaacatgaagatttgcgagatggtagatgagtccccggccatgtgctcgtcatttacgagggatctatggccagaacaggatatcaaagactcatttcagcaggtgattcttcgacgacacgggaaatgtgagcatgaaaatctgcagctgaggaaaggtagcgctaacgttgtagagtgtaaggtgtataaaaagggatacgaactcaatcaatgcctaacaacaacccagtccaagatattcccttgtgataagtatattaaggtgtttcataaaatcttcaactctaacagacataaaacccgccatactggtgagaagccatttaagtgtaagaaatgtgacgaatccttttgcatgttattgcacctccaccaacacaaacgtatccatattagggagaacagctaccaatgtgaagagtgcgacaaggtttttaaacggttctcgactctcacacggcataagagggtccacactggtgagaagccattcaagtgcgaagaatgcggcaaggccttcaaacactcttccacactgactacccacaagatgattcacacaggggagaagccgtaccggtgtgaggagtgtggaaaggccttttatcactcaagccacctgacgacccacaaggtcattcacactggtgaaaagcccttcaaatgtgaggaatgtggcaaagccttcaaccacccatcagcacttactacacacaagttcattcacgtgaaagaaaaaccatacaaatgtgaggaatgtgataaggcctttaaccgcttttcctacctgactaagcataaaattatccactctggagagaagtcttacaaatgtgagcagtgtgggaaggggtttaactggtcctcaacactgacaaaacacaaaagaatacatactggtgagaaaccatataagtgtgaggaatgcggaaaggctttcaacgtcagctctcatcttaccacccacaagatgattcataccggggaaaaaccgtacaagtgtgaggagtgtggcaaggccttcaatcacagctcaaagctgaccatacataagataatccatacaggagagaaaccttataagtgtgaggaatgtggaaaggcctttaatcaaagcagcaatttgaccaagcataagatcatccacacgggggaaaagctatacaaatgcgaggagtgcggaaaagcctttaacagatcatctaacctgacgacgcacaagaggatccacaccggagagaaaccctacaaatgcgaggaatgtggaaaggctttcaacagatcctctaaccttaccaagcataacattatccacacaggagaaaaaagctacaagtgtgaggaatgcgggaaggctttcaatcagtcgagtacactgacaaaacacagaaaaatccaacagggcatggtggcccacgcctgtaatcccaacactctgaggggcttgggcgagcaaattgccagaagtggggtgcaggaccagccgggtcaacacggcaaaacaccatctctccttaagatccagaagtttgccggctgcggcggacggaggttgtag

SEQ ID NO: 35056 - DNA, 1452 bp, Artificial Sequence
  Description of Artificial Sequence: Synthetic coding sequence
atgggactcttgaccttccgagacatcgccatcgagttcagtcttgcggagtggcagtgcctcgatcatgctcagcaaaacttatatagggatgttatgcttgaaaactaccgcaacctcgtgtccctgggcatcgctgtctcaaagccggaccttatcacctgtctggaacaaaacaaggagcctcagaacatcaaacggaatgagatggtggccaaacacccagtgacgtgcagccactttacacaggacctgcaatcagagcagggaatcaaagatagtttacagaaggtgattctgaggcgctatggcaagtgtggtcaggaggatctgcaagtaaaaaagtgttgcaagagcgtcggcgagtgcgaggtgcataaaggaggatacaactacgtaaaccagtgtctctcagcaacccagaataagacctttcagacccataaatgtgtcaaagtgttcggaaagttctccaattctaacagacacaaaaccaggcatactggtaagaaacatttcaagtgcaagaacgacggaaaaagcttctgcatgctgagtcggctgaatcagcaccagattatacatacccgagaaaaaagctataaatgcgaggaatgcggaaaatcttttaactgtagctccacactgacgagacacaaacgaatccataccggagaaaagccatacaggtgtgaagagtgtggcaaagccttttcttggtcagcgagcctgactaagcacaagcgaattcataccggtgagaagccctatacatgtgaggagcgggggaaagtgttctcccgcagtacactgaccaactataagaggatacacactggcgagaaaccttacacttgtgaggaatgcggcaaggccttctcccgctcctctacgctgacaaaccacaaacgaattcacacaggcgaacgcccatataagtgcgaagagtgcggaaaggcctttagcctttcaagcacgctcaaaaaacataagatagtgcatactggtgagaaactttacacctgtgaagagtgcgggaaagcattcactttttcctccactctaaacacgcacaagcggattcacaccggtgaaaaaccatacacgtgtgaggagtgcggcaaagccttctctctcccctcaactttcacctaccataagaggacgcatactggcgagaagccctataaatgtgaggagtgtggaaaggcttttaattgctcatctactcttaaaaagcacaaaattatccacaccggcgagaagttatataagtgtaaggaatgtggcaaggctttcaccttttcatcgaccctgaacacgcataagaggattcacactggagagaaaccttacaagtgcgaagagtgtgatcagacctttaaatggcactccagtcttgcaaatcataaaaacatgcacacgggcgagaaaccatacaaatatgaatag

SEQ ID NO: 35057 - DNA, 1488 bp, Artificial Sequence
  Description of Artificial Sequence: Synthetic coding sequence
atggctaaacgcccagggccacctggctctcgggaaatggggttactgacttttagggatattgccattgagttctccctagccgaatggcagtgcctcgatcatgcgcagcagaacttgtaccgtgatgtgatgttagagaactatcggaatctggtatctctggggatcgctgtgagtaagcctgacctgatcacatgtttggagcagaacaaggaaccccagaacatcaagcggaacgagatggttgccaaacatccggtcacttgttcccatttcacacaagatctgcagtctgaacaggggatcaaggactctttacagaaagtgatcctgagacgctacgggaagtgtggccaggaggacctgcaggtgaaaaagtgttgtaagagcgtaggcgaatgtgaggtgcacaagggtggatataattatgtgaaccagtgcctgagcgcaactcagaacaaaacatttcagacccacaaatgtgtaaaggtgttcgggaaattcagtaattccaacaggcacaaaaccagacacactggaaagaagcactttaagtgcaagaatgacggcaaaagcttctgcatgctctcacgcctgaatcagcatcagatcatccacacccgggaaaagagctataagtgcgaggaatgcgggaagagttttaattgtagctccaccctgactcgccataagagaattcataccggtgagaaaccctataggtgtgaggagtgcggcaaggccttttcatggtcagcgagccttacaaaacacaaaagaatccatactggagagaagccatatacatgtgaagagcgaggcaaggtgttttcccgctccactcttaccaattataaaagaatccacacaggcgagaaaccttacacctgcgaggaatgtggcaaggcctttagcagaagctccactcttacaaaccataaacggattcatacaggtgagcggccatacaagtgtgaagagtgtgggaaagctttctcactatctagtacgctcaaaaagcacaaaatcgttcacacaggggagaagctgtatacgtgtgaggaatgtggaaaagcctttactttcagttctaccctaaatactcacaagaggatacatacaggggagaagccgtacacttgtgaggagtgcggtaaagcatttagcctgccttctactttcacttaccacaagcgcactcatacgggagagaagccgtataagtgcgaggaatgtgggaaggccttcaattgctccagcacactgaagaagcataagatcattcacacaggggagaagctctataagtgcaaagagtgtggtaaggcttttacgttctcttcaactctcaacacccacaagaggatacacaccggagagaagccttataaatgcgaagaatgtgatcaaacattcaagtggcacagttccctcgccaaccacaagaatatgcacaccggcgagaaaccatacaagtacgagtag

SEQ ID NO: 35058 - DNA, 2724 bp, Artificial Sequence
  Description of Artificial Sequence: Synthetic coding sequence
atgctggaaacttataattctctggtgagtttacaggaactggttagcttcgaagaagtggctgtgcattttacctgggaagagtggcaggatttggacgacgctcagcgaactctgtatcgggatgtgatgttggaaacctacagctccctggtatcccttggccattatatcacaaaacctgagatgatctttaaactcgagcaaggtgcagaaccttggatcgtggaggagaccccaaatctgcgattgtcagcagtgcaaatcatcgacgacttaattgagaggtcccacgagagccacgacaggtttttttggcagatcgtcatcacaaatagtaacaccagcacccaagaacgtgtagagctagggaagacgtttaacctaaactctaatcatgtactgaacctgatcatcaataacgggaacagtagcggtatgaaacccgggcagtttaacgattgccaaaatatgttgttccctattaagcccggcgagacgcagagtggcgaaaaaccccatgtctgtgacattactcgtagatcacacagacaccacgaacaccttacccaacatcacaagattcagaccctgttacaaactttccagtgcaacgagcagggtaaaacttttaataccgaggcaatgtttttcattcacaaacgtgtccatattgtccaaacattcggaaagtacaacgagtacgaaaaggcttgcaacaactccgcagtaatcgtgcaggtgattacacaggtgggccagcccacatgttgccggaagtctgacttcacaaagcatcagcagacccacactggcgagaaaccctatgagtgcgtggagtgcgaaaagccgtctatttctaagagtgacctaatgttgcagtgtaaaatgccaaccgaggagaagccttacgcctgcaactggtgcgaaaagctgttttcttataaaagttctctgattatccaccagcgtatccacacaggtgagaagccgtatgggtgtaacgaatgcggcaagaccttccgcaggaagtcattcctcaccctgcatgaacgcacccacacaggggacaaaccttacaaatgcatcgaatgcgggaagaccttccactgcaagagcctcctgacactgcaccacaggacacattctggggaaaagccctaccaatgctcagaatgtggcaaaactttctcgcagaagagctacctgacaatacaccaccgcacccacacgggtgagaagccctacgcatgtgaccactgcgaggaggctttttcccataagagccgactgaccgtgcatcagcgcactcacactggcgagaagccttacgaatgtaatgaatgtggaaagccattcatcaacaagagcaatctgagactccaccaacggacccataccggcgaaaaaccatacgaatgtaacgagtgcgggaaaacttttcatcgcaagagctttctgaccattcaccaatggacacacacgggcgagaaaccatacgagtgcaatgagtgcggtaagacgttccggtgtaaatcctttctcacggtgcaccagcgaacacatgccggggagaagccatacgcatgtaatgaatgtggcaaaacttattcccacaaatcttacctgaccgtgcatcatcggactcatactggcgagaagccttacgagtgcaacgagtgtggtaagtcctttcattgcaagtcttttctgactatccaccaacgtacacacgccgggaaaaaaccttacgaatgcaacgagtgtgaaaaaaccttcataaataagttgaacttggggatccataaaaggacccatactggtgagcggccttacgagtgcaacgaatgcgggaagacctttcgccagaagagcaatcttagtacgcaccagggaactcacacgggagagaagccgtatgtctgcaatgagtgtggaaagacattccataggaagagcttcctgacaatccaccagcggactcacaccggtaagaacaggatggatgtcatgaacgtcgaaaaactgttcgtccgtaaccacacgttgctctacatcagggagttgactccggggaagtctccaatgaacgtcatgaacgtagaaaacccctttattcggagacagattttccgaagcatcaaggtctttactaggggacgaaacccaatgaacgtcgccaacgtcgaaaaaccgtgtcaaaagtcagtcctcaccgtgcaccacagaactcataccggggagaagccctacgaatgcaatgagtgtggcaaaacattttgtcacaaaagcaacttgtctacacaccaaggtactcactcaggcgaaaagccatacgagtgtgacgaatgccggaagacattctacgacaagaccgtgctaaccatacatcaacgcacgcataccggcgagaaaccattcgagtgtaaggagtgtcgaaaaacgttctctcaaaagagcaaactgttcgtgcaccacagaactcacaccggcgaaaagccgtttcgttgcaatgagtgccgcaagacatttagccagaagtccgggctgtctattcaccagcggacacataccggggaaaaaccttatgagtgtaaggagtgtggcaagactttttgtcagaagtctcacctcagccggcatcaacagacccacattggcgaaaagtcagacgtagccgaagcaggctacgtgttcccccagaatcactcgttttttccctag

SEQ ID NO: 35059 - DNA, 2745 bp, Artificial Sequence
  Description of Artificial Sequence: Synthetic coding sequence
atgtttcccgtattctctggctgctttcaggaacttcaggagaaaaacaaaagtctggagctagtgtcctttgaagaagttgccgtccacttcacatgggaggaatggcaggatcttgacgatgctcagcgcaccttatatagagacgtcatgttagaaacttatagctctttggtgtctctagggcattacattaccaaacccgaaatgatttttaagttggaacagggagctgagccatggattgtggaggagaccccaaacctgcgtctgagcgcagtgcagataattgacgaccttatcgagaggagccacgaatctcacgaccgttttttttggcaaattgtaattaccaattcaaacacatcaacacaagagagggtcgagcttggaaagaccttcaacctgaacagcaatcacgtgttgaatctgattatcaacaacggtaacagcagtggaatgaaaccgggccagttcaatgactgccagaacatgctttttcctatcaaacccggcgagacccagagtggggagaaacctcacgtgtgtgatatcacccggagatctcatagacaccacgagcaccttacacaacaccacaagattcagacactgctgcaaacttttcagtgcaacgagcagggcaaaacgttcaacacagaggcaatgttttttattcataagcgggttcacatagtccaaacttttggtaagtataacgagtatgaaaaagcatgcaacaatagcgcagttatcgttcaggtgatcacacaggttggacagcctacatgttgtcggaagtcggactttacaaagcatcagcaaacgcataccggcgagaagccctatgagtgcgtggagtgtgaaaaaccttccatctcgaagtccgatcttatgcttcagtgtaagatgccgactgaagaaaagccttatgcttgcaattggtgcgagaaactgtttagctacaagtccagccttatcattcatcagcggattcacacgggcgagaagccatatggctgtaatgagtgtggcaaaaccttcaggagaaaaagctttttgacacttcacgagaggacccacactggagataagccctataaatgtatagagtgcggtaagaccttccactgcaaatcgcttctcaccctacaccatagaactcattcgggagaaaagccgtaccaatgctccgagtgtggcaagacattctctcaaaagtcttatctgaccattcaccatcggactcataccggggagaagccctacgcttgtgaccattgtgaagaagctttcagtcataagtcaaggctgactgtacaccaacgcactcacacaggcgaaaagccctatgagtgcaatgagtgtggcaagccctttattaacaagtccaacctgcgcctccatcagagaactcatacaggggagaaaccctatgagtgtaacgaatgtggcaagaccttccacagaaaatccttcctgaccatccatcagtggacacacaccggggagaagccttacgaatgcaacgagtgcggtaaaacattccgctgtaaatcgttcctgacagtgcaccagcgaacacacgctggagagaagccctatgcctgtaacgaatgcggcaaaacctatagtcacaaaagctacctcactgtacaccatagaacacacaccggagagaagccatatgaatgcaacgaatgtggcaaatctttccactgcaagtccttcctcaccatccatcagcgcactcacgctggcaagaagccctatgagtgcaatgagtgtgagaagacattcattaacaagcttaatttgggaattcacaagcggacccatacgggcgagcgtccgtatgagtgcaacgaatgtggcaagacgtttcgacagaagtccaatctcagtactcatcaaggcacccatacaggggagaaaccctatgtctgcaatgagtgtgggaaaacctttcacaggaaaagctttctcacaatccatcagaggactcatactgggaaaaacaggatggacgtgatgaacgttgaaaagctgtttgtgcgcaatcacactctcctctacattcgtgagctgacacccggaaagtcccctatgaatgtgatgaatgtggaaaacccttttattcgtagacagatatttaggtccatcaaagtgtttacccgcgggcgcaacccaatgaacgtcgccaacgtggagaagccatgccagaaatctgtgttgacagtccaccaccggacccataccggggagaaaccttatgagtgtaacgagtgtggcaagaccttctgccataaatcaaacctctctacacatcagggcacccattctggggaaaagccctatgaatgtgacgagtgcaggaagaccttttatgacaagactgtgctgactattcaccaaagaacacacacgggcgaaaagccttttgaatgcaaagagtgccgcaaaacattcagccagaagagtaaattgtttgtccaccaccggacccacactggcgagaagccgtttcgctgcaacgagtgccgaaagaccttctctcagaagtctggtctgtccatccaccaacgaacacataccggcgagaagccttatgagtgcaaggagtgtggtaagacattctgtcagaagagtcacctttctcgccaccagcagactcatataggggagaagtctgatgtggcggaggcgggatacgtgttcccccagaaccactcgttttttccttag

SEQ ID NO: 35060 - DNA, 381 bp, Artificial Sequence
  Description of Artificial Sequence: Synthetic coding sequence
atgggcctactcacctttcgtgacgtggctatcgaattctctcgcgaagagtgggagcatcttgattcagatcagaaattactctacggagacgtgatgttagaaaattatggtaacctcgtgagccttggacttgctgtgtctaagcccgacctgattacatttctcgaacagcggaaggagccatggaatgtcaagtccgctgaaacagtggcaattcaacccgatatcttctctcatgacacccaggggcttctgcggaaaaaacttattgaggcttccttccagaaagtcatcttggatggctatggatcgtgtggacctcagaatcttaatctgcggaaggagtgggaatccgagggcaagatcattctgtggtag

SEQ ID NO: 35061 - DNA, 537 bp, Artificial Sequence
  Description of Artificial Sequence: Synthetic coding sequence
atggtgaatgtgcccgacatcttctctcatgacacacagggcctgctgaggaaaaagcttatcgaagctagtttccagaaagtaatcttggacggctatggatcctgcggaccccagaatctgaacctccggaaagagtgggagtcagaaggtaagtgcgagggtcataatggttattatgacggtcacactaagtgtaagactactacatataataaaaacttaacagttacagggggtcaaaaacatgaaaagacacaatttatgtccgtggccttcagtaagccgtgcgtatcagtgtctaaatgtcagcatcagttcctgaaactgaccttcagcttcaaaggaaatctggacaacccgaatagcgatttggtgcatgtctcaaataatcacctgaaccagctcaaatatcgaaccggtgttaatgtgcagtctaacatttctgaaaaggaacggtttaagaacgaggaggtgataagcaagtacgatcagttcgacggttcacttctgaaggtatgtttcacaaacaaatag

SEQ ID NO: 35062 - DNA, 1428 bp, Artificial Sequence
  Description of Artificial Sequence: Synthetic coding sequence
atgagcctggctacagtcgacaccctctatatctttagtcacgacacacagggactgctgaggaagaagctcatcgaggcatcgtttcagaaggtgatcctggatgggtatggatcatgtggcccacagaatctcaacctccgcaaggagtgggagtccgaagagaaaaaccaatacaacaaaagcgacaccaccctgtctcaggggatttctccacgcaggcaccagaagactcacttcctgcacaaccactgcaaacgcaaaaaatgcgagaaagcctttcatgagtgtaccaaccacgtccaccagagcatatttatccaggaaaagtcagcaaagtgcaacaaatgcatcgagacctttattcagtcttcaaaacatacgcaacctcagagaattcacataggcgagaagtcccatcgctgtaataatggcgagaagatcttatctaagctcagcagtttgcgcaaacataaaataatccacaatgaagagaagccatataagtgcaaagaatgtgataaagctttcaatcatcgcagtcacctcactcagcatcagatcatccacacgggggagaaaccctataagtgtaaagagtgtggaaaggctttcaactcgtccagctatttcacaaggcaccagcgtatccacactggggaaaaactgtacaagtgtaaagcctgctccaaatgcttcacacactcctcaaacttgcttgtacaccagagaatccataccggcgaaaaaccctacaagtgtaaggaatgcggcaagagtttcaaggtgagttcagctctgactcaacatgaaaggatccacaccggggagaaaccttacaagtgcaaggaatgtagtaaggcattcaactgccgcagctacctgacaaaacaccagcgcatccatactggggaaaaactgtacaagtgcaaatcatgttcgaagagtttctcgcgctccagcagtttaatagtgcaccagcgaattcacacaggtgagaaaccctataagtgtaaagagtgcggaaaggcctttaactgcagttcccgcctgactcagcatcagcggatccacactggtgagaaaccatatatctgtaaggaatgtgggaaagccttcaattgctcctctagcttgactaagcaccagcggatacataccggagtcaaactctacaagtgtaaggcatgctcaaagagttttagtcactctagctgtctgtctgtgcatcaaattacccacaccgggatgaaaccttacatctgtaaagattgtggcatctctttcaataggtcctcaaacctgcggcgtcaccagatgattcacacaggcgagaaaccttacaaatgcaaggagtgtggcaagctatttaacaggtgctccactcttacacggcacaaatctattcacactcgggaatttctttag

SEQ ID NO: 35063 - DNA, 1860 bp, Artificial Sequence
  Description of Artificial Sequence: Synthetic coding sequence
atgggccctctgaccttcatggacgtagcaattgagtttagcgtcgaagagtggcagtgcctggatacagcgcaacagaacctctatagaaacgtcatgctggagaattatagaaaccttgtctttctaggcatcgccgtgagtaagcccgatttaatcacatgcctcgaacagggtaaggaaccctggaacatggagcggcacgaaatggtcgctaaacccccggggatgtgttgttacttcgcccaagacctcaggccagagcagtctatcaaggccagtcttcaaaggataatcctcaggaaatacgaaaagtgcggccaccacaacctccagttgaagaaggggtataagagcgtcgatgaatataaggttcacaagggatcttacaatggattcaaccagtgtctaaccacaacccagtctaagatattccagtgtgacaagtatgtaaaggatttccacaaattcagtaattctaatcgacacaagaccgagaaaaacccctttaaatgtaaggagtgcggaaaaagcttttgtgtgttatctcatttaactcagcataagcggatccacaccacagtgaactcgtataagctcgaagaatgtggtaaagcttttaatgtcagctcaacgctcagtcagcacaagcgcattcatacgggacagaagcattataagtgcgaagagtgtgggatcgcgtttaataagagtagtcatctcaatactcataagattattcatacaggtgaaaaatcctacaaaagagaggagtgcggtaaggcctttaacattagcagtcatctgaccacccataagataatacacaccggagagaacgcttacaaatgcaaagaatgtgggaaggcctttaaccagagctctaccttgacacgtcacaagatcatccatgccggcgagaagccatacatctgcgagcactgtggacgggccttcaatcaatccagcaacctgaccaagcataagcggattcacacaggtgacaagccgtacaagtgtgaagagtgtgggaaggccttcaatgtgtcaagtacgctgactcagcataaaaggattcataccggggagaaaccatacaagtgtgaagagtgcggcaaagcctttaatgtgagctctacgctcacacagcacaaacggatccacactggggaaaagccatacaaatgcgaggagtgtggcaaggctttcaacacaagcagccatcttacaacacataagcgaattcatacaggcgagaagccgtataaatgtgaggaatgtgggaaagcattcaatcagttttctcagctgaccacccataagataatccacactggggagaaaccatacaagtgtaaagagtgcgggaaggcattcaagcgcagctcgaatctcactgagcatagaatcatccacaccggcgaaaaaccttataagtgtgaagaatgcggcaaagcttttaacttgagctcccacctaacgacgcataaaaaaatacacaccggcgaaaaaccctataagtgcaaggagtgtggaaaggcgttcaaccagagctcaaccctggcacgacataaaatcattcacgctggcgaaaagccttacaaatgtgaggaatgcgggaaggccttttatcaatattccaacctgacgcagcacaagattattcacacaggagaaaagccctacaagtgtgaagaatgtggtaaagcctttaactggtcgtccacactgactaagcataaggtgattcacacaggagaaaaaccgtacaaatgcaaggagtgtggtaaggcatttaatcagtgttctaatctcacgacacacaagaaaatccacgctgtcgagaaatccgataagtag

SEQ ID NO: 35064 - DNA, 1500 bp, Artificial Sequence
  Description of Artificial Sequence: Synthetic coding sequence
atgagggtcctcactttccgcgatgtcgcagtggagttcagcccagaagagtgggagtgcttggacagcgcccagcagaggctgtatagagacgttatgctcgagaactatgggaacctctttagtttgggactggccattttcaaaccggacttaataacatacctcgaacagcgaaaggaaccttggaatgcccgtagacagaagactgtggccaagcacccggccggctcactccatttcaccgctgagattcttctggagcacgacatcaacgacagttttcagaaggtgatcctgcgcaaatcaggctcatgcgatttgaataccttgcgtctcaagaaggattaccaacgtgtaggcaactgtaagggacagaaaagcagctacaacggcattcaccagtgtctgtcagccaccaggtcgaagacgtgccagtacaacaaatgcggcaaggcgtttggattatgtagtattttcactgaacataaaaagatcttctcacgcgagaagtgctacaagtgcgaagagtgtggcaaagattgtcgcctgagcgattttacgattcagaagagaatccatacggcagacagatcctataagtgtgaggagtgcggaaaggcctgcaagaaattcagcaatctgactgaacataacagagtgcacaccgggaaaaaaccttataaatgtgaggagtgcgggaagaccttcacttgctcttctgcacttacgaagcacaaacggaaccacaccggcgaccgtccctacaaatgcgaggagtgccataaagcgttcagatgttgcagcgacttgaccaagcataagcgcattcacaccggagagaagccttataagtgcaaagaatgtcataaggcattcagatgttgctcagatctgaccaagcacaagcgtatccacacaggcgaaaagccttataaatgtaacgagtgtggaaaagcttttatgtggattagtgccctgagccagcataatagaattcacacaggggaaaaaccttacatttgtgaggaatgcgggaaggcctttacatacagctccactttaataagccacaagcgtatccacatggaactgcggccatataagtgcgaggagtgtgggaagacctttaagtggttttcagatttgaccaaccataaaagaatccatacaggcgagaagccctacaagtgtgaggaatgtggaaaaagctttacgtgctcatcgaatctgatcaagcacaaacgcatccatatggaagtacgcccatacaaatgtgaggagtgcggcaaaacatttaaatggttccctgatttaacgaaccataagcgcatccacactggggagaagccgtataaatgtgaagaatgtggcaagacatttacgtgcagctctagcttaattaagcacaagaggtcacataccggtgatagacctacaagcgctaagaacgtggcgaaaccccttggtggctctcaaaccctcctgaatattagatag

SEQ ID NO: 35065 - DNA, 1869 bp, Artificial Sequence
  Description of Artificial Sequence: Synthetic coding sequence
atgggatccttgacttttagggatgttgcaatccagttttctctagaggaatggcaatgtttagacacagcgcaacaaaacctttataggaatgtcatgctggaaaattaccggaatttggtgtttctcggaatagcagcaccaaagcctgaccttattattttcttggaacaaggaaaagagccctggaatatgaaacggcacgagctggttaaggagcctcccgtcatctgtagccacttcgctcaggatctttggccagagcaaggtcgcgaggactcctttcagaaggtgatactgagacgatacgagaagtgtggccatgagaacctgcagttgaaaatcggatgcacaaatgtggatgaatgcaaggtccacaagaagggctacaataaacttaatcaaagcctcaccaccactcaatctaaggtgttccagtgcggcaagtacgccaatatctttcacaagtgctccaactctaagaggcataaaattagacacacgggaaagaagctcctaaagtgtaaggaatacgtacgttcattttgtatgttgtctcacctctctcaacataagagaatctatacccgcgagaactcctacaagagcgaagagcacggtaaggctttcaattggtcttcagcactaacctataagcgaatccacactggtgaaaagccctgtaaatgcgaggaatgtgggaaagctttctcaaaattttccatcttgacaaagcataaggttatccacacaggagaaaaacactacaaatgcgaggaatgcgggaaggcgttcacaaggagttcctccttaatagagcacaaacgtagccatgcaggtgaaaaaccctataagtgtgaggagtgcgggaaggccttttccaaagcttctacgctcacagcccacaaaacaatccacgctggcgaaaagccttataagtgcgaggaatgtggtaaggcttttaaccggtcatctaatttaatggaacacaaaagaattcacaccggagaaaaaccttgcaagtgcgaggaatgcggaaaagctttcgggaatttctctacgctcaccaagcataaggtcatacacaccggggaaaaaccatacaaatgcgaggaatgtgggaaagcgttctcttggccgtcctctctgacagagcacaagagaatccatgctggcgataaaccttataagtgcgaagaatgcggcaagacctttaaatggtcgtcaactctgacgaagcacaagattatccatacaggggaaaaaccatacaaatgcgaggagtgcggaaaagctttcaccacctttagtagtctcacaaaacacaaagtcatccacacaggcgagaagcattacaagtgcgaagaatgcggtaaggtgttctcctggagcagctctttgaccacccacaaggccatccatgctggggagaagttatacaagtgcgaagaatgtggtaaggccttcaaatggtcatccaacctcatggagcataagcgaatacatacaggtgaaaagccatacaagtgcgaggagtgcggtaaagccttctccaaggtggctaacctcaccaagcacaaggtcattcacactggagagaagcagtacaagtgtgaggaatgtggcaaggctttcatctggagctctcggttgtcagaacataagcgtatccataccggggagaaaccatacaagtgcgaggagtgtgggaaggcattctcctgggtgagtgtgctcaacaaacataagaagatccatgcagggaaaaagttttataagtgcgaagagtgtgggaaggactttaaccagagctcacacttaacaacacacaagaggatacacaccggtggcaaaactcttcaaatgtag

SEQ ID NO: 35066 - DNA, 3522 bp, Artificial Sequence
  Description of Artificial Sequence: Synthetic coding sequence
atgcctggagcccccggctccctggagatggggcctctgactttcagggacgtcactattgagttctcgttggaggaatggcagtgtctcgacacggtccaacagaatctctatagagacgtcatgcttgagaattatcgcaacctcgtgttcctggggatggccgtttttaagcccgacctcattacgtgcttgaaacagggcaaggagccctggaatatgaaaagacacgagatggtgactaaacctccagttatgcgatcacacttcactcaggatctgtggccagaccaatctaccaaagattccttccaggaagtgattttgcgcacatatgctcggtgcggacataaaaacctgagactgcgcaaagactgcaagtcagccaacgagggcaagatgcacaaggagggatacaataagctgaaccagtgtagaacagcgacccagagaaagatattccagtgcaacaaacatatgaaagtattccacaaatattcaaatcgcaataaggttagacacaccaagaagaagacgtttaagtgcattaaatgtagcaaatccttcttcatgctgtcttgcctgattagacataagcgcattcacatcaggcagaacatatataaatgcgaagagcggggtaaggcattcaaaagtttcagcaccctaacgaagcacaagattattcacacagaggacaagccttataaatataaaaagtgcggaaacgctttcaaattcagtagtactttcaccaagcacaagcggatccatacaggagagacccccttccgctgtgaagaatgtgggaaagcgtttaatcagagctctaatcttacagaccacaagaggatacatactggagagaagacttataagtgcgaggagtgtggtaaagcttttaaagggagctccaacttcaacgctcacaaggtgattcataccgctgagaaaccatataaatgtgaggattgtggcaaaacatttaaccacttttctgccctccgtaagcataaaatcattcacactggtaagaaaccctacaagcgggaagagtgtgggaaggccttcagccaaagctcaacccttcgaaagcacgagattattcacaccggggagaagccgtacaaatgcgaagagtgtgggaaggcctttaagtggtcctcaaagctgaccgtgcacaaggtggtacatacaggcgagaaaccttacaagtgcgaagagtgtggtaaagccttctcgcaattcagcacgttaaagaaacataagattatacatacaggaaagaagccctacaagtgcgaggagtgcgggaaggccttcaactcctccagcactctgatgaagcataaaattatacacactggagagaaaccctacaagtgcgaagagtgcggaaaagctttccggcagagttcacatctcaccagacacaaggctatacacacaggcgaaaagccatacaaatgtgaggagtgtggtaaggcattcaatcacttctcggatttgcggcggcacaaaatcatccataccgggaaaaaaccctacaagtgcgaggagtgtggtaaagcgttttctcagagttctactctgcgcaatcatcaaatcatacatactggggagaagccatataaatgtgaagaatgcggcaaggcattcaaatggagctcgaagcttaccgtgcataaggtgattcacacaggcgagaagccctgcaagtgtgaagagtgtggtaaggctttcaagcattttagcgccctgcgcaaacacaaagtgatccacactcgcgaaaagctgtacaagtgcgaagagtgcggtaaggccttcaataattcaagcattctggccaaacacaagatcattcataccggtaagaagccgtataagtgcgaagagtgcggaaaggcattccggcagagctcccacttaacaagacacaaagccatccataccggcgaaaagccctacaaatgcgaggagtgtggaaaggctttctctcatttttctgccttgagaagacacaagattatccacacaggaaaaaagccttacaaatgcgaggaatgcgggaaggcattttcccactttagcgcgctaagaagacataagataatccacactggcgagaagccctataagtgtgaggaatgtgggaaagcattcaagtggtcttctaaactcaccgttcacaaagtgattcacaccgcggagaaaccttgtaagtgcgaagagtgcggaaagtccttcaaacacttctcagccctgcgaaagcacaaagtgatacacacgcgagagaaattatataagtgtgaagagtgcgtgaaggcattcaactcattttccgcgttaatgaagcataaggtcattcacacgggcgagaaaccttataagtgcgaagaatgtgggaaagcttttaagtggagctccaaactgacagttcacaaggtgattcacacaggggaaaaaccatgcaagtgcgaggagtgcgggaaggcgttcaaacacttcagtgccctacgcaagcacaaagtgatccacacagggaagaaaccttataaatgcgaggagtgtggcaaggctttctcccagtcctccagtctgaggaagcatgagatcatacactctggtgagaagccatacaagtgtgaggagtgcgggaaagcattcaagtggctgtctaaacttaccgtgcacaaaattatccacactggaaagaagccttacaagtgtgaggagtgtggcaaagcgttcaatgacagtagtacactaatgaagcataagatcatccacacaggtaaaaaaccgtataagtgcgccgaatgtgggaaagccttcaaacagtctagccatttgactcgacataaggctattcacactggtgagaaaccctacaagtgtgaagagtgtggcaaggacttcaataattccagtacactcaagaagcacaaactcattcatacccgggaaaaactgtataagtgcgaggaatgtgtgaaagctttcaacaatttctctgcactgatgaagcataaaatcatccacacaggcgaaaagccttataagtgtgaagagtgcggtaaggcttttaaatggagctccaagcttaccgagcataaagtgattcatactggagaaaaaccgtgcaaatgtgaggagtgcgacaaggcatttaaacatttctccgctctcaggaaacacaaagtgatccataccggaaaaaagccgtaccagtgcgatgagtgtggcaaggcctttaataacagcagcaccctcaccaaacacaaaatcattcacacaggtgagaagccgtacaaatgtgaagagtgtgggaaggctttttcacagtctagcatcctgaccaagcacaagataatacattctgtagagaagccatataagtgcgaagaatgtggcaaggctttcaaccagtccagccatcttacgcggcataagactattcacacaggagaaaagccttacaaatacaagaccatccataccggcgagaagccatataaatag

SEQ ID NO: 35067 - DNA, 3759 bp, Artificial Sequence
  Description of Artificial Sequence: Synthetic coding sequence
atgcccggcgctccgggcagtttggagatgggcccactaacgttccgcgatgtgacgatcgagttcagcctggaagagtggcagtgcctggacacagtgcagcaaaatctgtaccgcgacgttatgcttgagaactatcggaatctggtattcctggggatggccgtgtttaagcccgacttgatcacctgtctgaaacagggcaaggagccctggaacatgaaacggcatgagatggtgacgaagcctccagtcatgaggtctcactttacccaagacctgtggcccgaccagtcgacaaaagatagctttcaggaagtcatcctgagaacatatgcccgatgcgggcataagaacctgcggctgaggaaagattgcaaatcagcaaacgagggcaaaatgcacaaagaagggtataataagctgaaccagtgcagaaccgccactcagcgaaaaatcttccagtgtaacaagcatatgaaggtttttcacaagtactcaaatcggaataaagttaggcatacaaagaagaagacattcaagtgcatcaagtgcagcaaaagttttttcatgttatcttgcctgatccgtcataaacggatccacattcggcagaacatctataagtgcgaggaacgcgggaaggcgtttaaaagtttttctacgctcactaagcacaagatcatccacaccgaggataagccctataagtacaagaagtgcggaaatgccttcaagttttctagtacgttcacaaagcataaaaggattcatactggtgagactcctttcagatgcgaggagtgcggaaaggctttcaaccagtcctctaacctgactgatcataagagaatccatactggggaaaagacgtacaagtgcgaagagtgcgggaaggctttcaaggggtcttctaattttaatgcacacaaggtcatccacacggcagagaaaccatataaatgcgaggactgcggcaagaccttcaaccactttagcgcgctgcggaagcacaagattatacataccggaaaaaaaccatacaagcgtgaagagtgcggcaaggctttcagccagtcaagcaccctccgcaagcacgaaatcattcacactggtgagaaaccgtataaatgtgaagagtgtggaaaagcctttaagtggtccagcaagctgactgtgcacaaggtggtacatacaggcgagaagccgtataaatgtgaagagtgtggaaaagccttttcccagttcagcactctgaagaaacacaaaatcatccataccggaaagaagccttacaaatgtgaagagtgtggtaaggcattcaattccagcagcacgttgatgaaacataagatcattcacaccggagagaagccgtataaatgcgaagaatgcggcaaagcctttcgccaaagcagccatctgactcgccataaggccatccacactggggaaaaaccctataaatgcgaagagtgcggtaaagcattcaaccacttctcggacctgaggcgtcacaagatcatccacaccggcaagaagccctacaaatgcgaagaatgcggaaaggccttcagccagtcttccacactccgtaaccaccaaatcatccacactggcgaaaagccctataaatgcgaagagtgcgggaaagcattcaagtggtcatccaaactgaccgttcataaagtaatacatacaggggagaagccctgtaagtgcgaagagtgcggcaaagcctttaagcatttcagtgccctgcggaagcataaagttattcatacacgtgagaagctctacaaatgtgaagagtgtggtaaggcttttaacaactcaagcattttggccaaacacaaaatcatacataccggaaagaagccctataagtgtgaagagtgtggcaaggctttcaggcagagctcacacctgacaagacacaaggccattcacacaggggagaagccttacaagtgtgaggagtgtgggaaggctttcagtcattttagcgcactgaggcggcacaagatcatccacacaggtaaaaagccatacaagtgtgaagaatgcgggaaagccttcagtcatttctctgccctaaggaggcacaaaatcatacacaccggagagaagccctacaagtgtgaggaatgtgggaaggcgtttaagtggagcagcaaactcacagtgcataaagtgattcacacagcagagaagccctgtaagtgtgaagaatgcgggaaaagtttcaagcacttttccgccctgcggaagcacaaagtcattcacactagagagaaactatacaagtgtgaagagtgtgttaaggcctttaatagtttttccgcattaatgaaacacaaagtgatccacaccggcgagaaaccttataagtgcgaagaatgcgggaaagcctttaagtggtcctccaaactgactgtccataaagttattcacaccggtgagaaaccttgcaagtgcgaggaatgtgggaaggcctttaaacattttagcgctctccgcaagcacaaagtgatccacactggcaaaaagccttataagtgcgaagagtgcggcaaagccttctcccagtcttcatcactccgcaagcacgaaataatccactctggcgaaaagccttataaatgtgaggagtgcggcaaagcctttaaatggctgtcaaagctaactgtccataaggtgatccatacggccgagaaaccctgcaagtgtgaggagtgtggcaaagccttcaaacacttcagcgcactgagaaagcataagatcatccatacaggaaagaaaccgtacaagtgtgaggagtgtggaaaggcctttaacgactcatcaactctgatgaaacacaagatcattcataccggtaagaaaccctacaaatgtgccgaatgtggcaaagcattcaagcagtcatcgcatctgaccagacataaagcgatacacaccggtgagaaaccttataaatgcgaggagtgcgggaaggactttaataattcatctaccctaaaaaagcataagctgattcacaccagggaaaagctgtacaagtgtgaagaatgtgtgaaagcctttaacaacttcagtgcactgatgaagcataaaatcatccacacaggggaaaaaccttataaatgtgaggagtgcggtaaggccttcaagtggtccagcaagctcactgagcacaaagtcatccatacaggtgagaagccctgcaaatgcgaagagtgtgataaggccttcaaacatttttctgcgctccggaaacataaggtcatccacaccggtaagaagccctatcagtgcgacgagtgtgggaaagcctttaataatagtagtacactcactaagcataaaataatccatacaggcgagaagccctacaaatgtgaggagtgcgggaaggctttcagccagtcttccatcctgacgaaacacaaaatcatccacagtgtggaaaagccatacaagtgtgaggagtgtggcaaagcctttaaccagtcgagtcatttgactagacataaaactatccacaccggtgagaaaccctataagtgtgaagaatgcggcaaggcattcatccagtgcagctacctgatcaggcataagacaatacacacccgggagaagcccacgaacgtcaaaaaagtgccgaagctgctcagcaacccacatacacttctcgataagactatccacacaggagagaaaccttataagtgcgaagaatgcgcgaaggccttttag

SEQ ID NO: 35068 - DNA, 576 bp, Artificial Sequence
  Description of Artificial Sequence: Synthetic coding sequence
atgaccgacccttcccttggtcttacggtgcccatggccccaccactagcccctctgcctccacgcgatccaaatggagccggcagtgaatggcggaaacctggggcggtctcgtttgcagatgtggcagtgtacttttcacgagaagaatggggttgtctgagacctgcccagagggccctgtacagggatgtgatgagagaaacctacggacaccttggggctctgggtgagagtcccacatgtttgccaggcccttgtgctagcacaggccctgctgcacccctcggagcagcatgtggggtggggggacccggggcaggtcaggccgcgtcttcgcaaaggggcgtgtgtgtcctcctcccacaagagtctgaagctgcatctcgtcgatcttccccgggctggagaagaagaccaaattgcggcatcagactgccgcgcatccgccgctggaggtctgtaaggcagaaaagaacccagcagattcccgaaacacgaaagcggaaggacaagggcaaggggcgcgaaccttggcgttcaccaaccctgtggcctcccggcctccttgggtag

SEQ ID NO: 35069 - DNA, 573 bp, Artificial Sequence
  Description of Artificial Sequence: Synthetic coding sequence
atgaccgatccctctctgggactcactgtccctatggctccaccattagcccccctgccaccacgggacccgaatggcgccgggtccgaatggcggaagcctggggcagttagttttgcggatgttgccgtgtatttcagccgggaggagtggggctgtctgcgcccagcccagcgagcattgtatcgagatgtgatgcgcgagacctatggacatttgggtgcactgggagaaagtcccacttgtctaccaggaccctgcgcctctacgggcccggctgccccactcggcgccgcatgtggagtggggggacctggagcaggccaagccgcctcctcccagcggggggtgtgtgtactgctgccacaggaatcggaggccgcctctaggcggtccagcccgggttggcggcgtaggcccaactgcggaattaggctgcctcggatccgccgctggaggagtgtaagacagaaacggacccagattcccgagacccgcaagagaaaggataagggcaagggtagggaaccttggcggtcaccaactttgtggcctccgggcctactgggatag

SEQ ID NO: 35070 - DNA, 993 bp, Artificial Sequence
  Description of Artificial Sequence: Synthetic coding sequence
atgacagacccttcactgggccttactgttcctatggctccgcctctcgctccactgccacccagagatccaaatggtgccgggtccgagtggcggaagcccggagctgttagtttcgctgatgtcgcagtgtatttctcaagagaggagtggggatgtttaagacctgcccagcgagctctgtatcgcgacgttatgagggaaacgtatggtcacctgggagccctcggagtggggggtagtaagcccgctctcatctcttgggtggaggagaaagcagaactctgggaccctgccgctcaagatcctgaagttgctaaatgtcccacagaggccgaccctgatagccggaataaggaagaggagaggcagagggagggtactggagccctggaaaagccagatcctgtcgccgctggctcacctggccttaaggccccccaggctcccttcgcaggtctcgaacagttgagcaaggcccgccggcggagcagacctaggtttttcgctcacccaccagtcccccgagccgatcaacgccacggatgttacgtctgcggtaagagttttgcttggagaagcacattggtcgagcacatatattcccaccgcggcgagaaacccttccactgcgctgactgtggcaagggatttggccacgcgtcttcgctatctaagcaccgtgctattcaccgaggagaaaggcctcacagatgccccgaatgcggccgcgcctttatgcggagaactgccctgacaagccacttgcgggttcataccggcgagaagccctatagatgcccccagtgcgggcgctgctttggtctgaagactggcatggcaaaacatcagtgggtgcacaggcctggcggagagggcaggagggggaggcgaccaggcgggttgtctgtgacccttacaccagtgcggggcgatctcgatccccccgtggggttccagctctatccagagatattccaggagtgcggctag

SEQ ID NO: 35071 - DNA, 2496 bp, Artificial Sequence
  Description of Artificial Sequence: Synthetic coding sequence
atggagaaccaaagatcgtccccgcttagtttcccctccgtgccccaggaggagactttgcggcaggctcctgcgggtttacccagagagaccctgttccaaagccgcgtcctgccaccaaaggaaatcccatctctatcacccaccattccccgacaaggatccttgccccagacgagctctgcccctaaacaagaaactagcggaaggatgccacatgtgctccagaaaggcccctcattgctgtgttcagctgcctcagagcaggaaactagccttcaggggcccctggctagccaagaaggaactcagtatccccctcctgctgcggctgaacaagaagtgagcctgctatcgcattctcctcatcatcaggaagcgcctgttcattcgcccgaagcccctgagaaggacccactcaccctgtcgccgaccgtgcccgaaaccgacatggaccccctactgcaaagcccagtatctcagaaggacactccgtttcagattagttcagcagtgcaaaaagagcagcccctccctacagctgaaattacaagattggcagtctgggcagctgtgcaagccgtcgagcggaagctggaggcccaggctatgcgactgttgaccttggaggggcgcaccgggacaaatgagaagaagattgccgattgtgagaaaaccgccgttgagttcgctaatcacctggaatcaaagtgggtggttcttggcactctgctccaggaatacggtttactgcagaggaggcttgagaatatggagaatctccttaagaaccgcaacttttggatcctgagacttccgcccgggtctaacggagaggtgcccaaggttccggtgactttcgatgatgtggcagtccacttcagcgagcaggaatggggcaatttgagcgagtggcagaaagagctttacaaaaatgtaatgcgtggcaattacgaatcactggtgtcgatggattatgccatatccaagcccgatctgatgtcacagatggagcgcggcgaacggcctaccatgcaggaacaggaggacagcgaagagggggagacacctactgacccctctgccgcacacgatggcatcgtgattaagattgaggtacagaccaacgatgagggaagtgagtcgctcgaaacccctgaacccctgatggggcaggtggaggagcacgggttccaggactctgaactaggtgatccgtgcggagagcaaccagatctagacatgcaagagcctgagaatactttggaggaatcgaccgaggggtccagcgagtttagcgaactgaaacagatgctggttcagcagcggaattgtactgaaggcatagtgattaaaacagaggagcaggacgaagaggaggaggaggaagaagaagacgagttgccccagcacctgcaatccttagggcagctgtctggtagatacgaagccagcatgtatcagactccactgcccggcgagatgagtcctgagggcgaagaatcccccccacccctgcagctggggaaccccgcagtgaaaaggctagccccttctgtgcacggagagcgacacctttccgagaatagaggtgcctcaagccagcaacagagaaatcgccggggagagcggccttttacatgcatggaatgcgggaagtcattccggttaaagatcaatctcattatccatcagagaaaccatattaaggagggaccttatgagtgtgcggagtgcgagatatcattcaggcacaaacagcaattgacactccatcagagaattcacagagtgaggggaggctgcgtgtcaccggagcggggacctactttcaatcctaaacacgcgctcaaacctcggccgaaaagcccctcctcggggagcgggggcgggggccccaagccctataagtgcccagagtgcgatagtagctttagccataagtcctctcttaccaaacatcaaattacgcataccggcgagcgcccctatacctgtcccgagtgtaaaaagtcttttcggctccatatttccctcgtcatccaccagcgtgtgcatgcgggaaagcatgaagtctctttcatttgttccctgtgtggcaagtccttttcacgtcctagccatctcttgagacaccagaggactcacactggcgaaagacctttcaaatgtcctgaatgcgaaaagtctttttctgagaaatcaaagctgacgaaccattgtagagttcattcgcgggagcgaccacacgcctgtccggagtgtggaaagagctttataagaaagcaccacttgctcgaacaccggagaatccacactggcgagcgaccgtatcactgcgcggagtgcggcaaaaggttcacccagaaacaccacctgctggaacaccagagggctcatactggcgagcgcccctatccatgtacacactgcgctaagtgcttcagatataaacagtctcttaagtaccatctgcgcacacataccggggaatag

SEQ ID NO: 35072 - DNA, 1575 bp, Artificial Sequence
  Description of Artificial Sequence: Synthetic coding sequence
atggagaatctgctgaagaatcggaatttctggatcctacgcctgccgccgggatccaatggggaagtgcccaaagtgccagtgacatttgatgatgtcgctgtgcacttttcagagcaggaatggggaaacctctcagagtggcagaaggaactctataagaacgtgatgcgggggaactacgaatcacttgtcagtatggattacgccatcagtaaacccgatctaatgtctcagatggagcgcggagaacggccgactatgcaagagcaggaggattccgaagaaggcgagactcctactgatccatcagcggctcacgatggaatagttattaaaattgaagttcaaactaatgacgaaggcagtgaatctctggagaccccagagcctctaatgggccaagtggaagagcacggcttccaggatagtgaactgggggatccctgcggcgagcagccggatctcgatatgcaagagccagagaacactttggaggagtctaccgagggtagttctgagttctccgagctcaagcagatgctcgtgcaacagaggaattgtactgaggggatcgtaattaagacagaggaacaagatgaggaagaggaggaggaggaggaagacgagctcccacaacatctgcaatccctagggcagttgtcgggtcggtacgaagccagcatgtaccagactcctctccctggcgaaatgtcccccgagggggaggagtctccacctccacttcagcttggaaaccccgctgtcaaaaggctggcgccatcggtgcatggggagcggcacctaagcgagaacagaggggcttcctcacagcagcagagaaacagacggggggagcgtcctttcacatgtatggagtgcgggaaaagctttagactgaaaattaatctgatcatccatcagaggaaccacataaaagaggggccctacgaatgcgccgagtgcgagatttctttcagacataaacaacagctgaccctgcaccagcgtattcacagagtccggggaggctgcgtttctcctgagcggggacccactttcaaccccaaacacgccttgaagccgcgaccgaagagtccgagctccgggtctggcggtgggggaccaaagccttacaagtgccctgagtgtgattcatcgttttcccacaagagcagtttgacaaagcatcagattacacacaccggcgagagaccgtatacatgccccgatgctgctgccaggccaggcgctcgggcagtccctcctctgggtcaccggcaagcacgggctcagcgcgctggtcgcggagcccctcagcccttgtgtagggaacttccactgtcctccaggcccagcagccagggccacggcgggagtgagactagatctttggctgcagcattcccaaggggccctcaaggcggtggccgagggcccggcgaaccctttcgtgcagtaaatttcctcgacaataaaatggacgagactaaccagcacggggggagggatcttgcggctggccattccgaggggcgctgccgggcccatctggtgggcgaccgtaccttgtag

SEQ ID NO: 35073 - DNA, 984 bp, Artificial Sequence
  Description of Artificial Sequence: Synthetic coding sequence
atgcaacggaacgccatgtatctcaagaacgtggccgaaaccgcatgcaattttcagctcacccaataccaaattagccatgccaatcaaaagccatacgaatgccagatttgcggcaaacctttcagaaaacgggcacatttaacccagcacaacaggatacataccgggggtaagccctacgagtgtaaggaatgcggcaaggtctttatatgctgctctactctgatccagcataaaagaactcacaccagcgaaaagccctacgagtgtctggaatgcaggaagacctttaggcgtagcgcccacctgattaggcaccagcgtatccacactggtgaaaagccatacaaatgtaaacagtgttggaaagccttcgcgtccgtgtcagatctgatcgacatcggcaaattcaccctcatgcgtgactttacaaacgtgcaaaatgtgggccggcatctgaccattgctcagctgctcttctctatccgggaattcacactggtgcgctcgcccctgaatgtccgcaacgtggcaaaacacagtatcatcgcacagcaccttcttaatactagagagttgatcctgatgagaaatttaatgaatgtgaggaatgtgaagaggctgcttgggaaagtccatatactgctcaatattaaagagtttattttggtgagaaatcacatgtccgtatccaatgtcggcaggctgtcactggttttcttaatactgatcgacattagggagttcacgttggttaagaacccaatgaacgtaaagaatgtcgtggaattacttactattgtacagctgctgttcaacactcgggaatttaccctggtgcgccgcctcatgaacatatcatcagtcgggagatttttgagccccgtgcagcacctctttaacattcgtgagcatatacttatgaagaacctcatgaacgtctccaatgcccgaaggccgagctcaatcatgcacatctag

SEQ ID NO: 35074 - DNA, 1062 bp, Artificial Sequence
  Description of Artificial Sequence: Synthetic coding sequence
atgcagaggaatgctatgtatctgaaaaacgttgccgagaccgcctgcaatttccaattgacccagtatcaaatcagccatgctaatcaaaagccttacgaatgtcagatctgcggcaaaccctttaggaaaagagcacatctgacacaacacaatcgaattcacactggaggtaagccgtacgagtgtaaggagtgtggaaaggttttcatctgctgttcaactctcattcagcacaaacggacacacacctccgagaagccttatgagtgtttggaatgtaggaagacattccggaggtcagctcaccttattagacaccaacggatacacactggtgagaagccctacaagtgcaaacaatgctggaaggcgttcgcctccgtgtctgacttgattgatattggcaaattcactttgatgcgcgacttcaccaatgtgcagaatgtggggcgccacctgacaattgcacagctgctgttctctatacgggaattcacactagttaggtcacctttgaacgtccggaacgtggcaaagcactccattatcgcacaacacctgctcaacacaagggaacttatccttatgaggaacttaatgaacgttaggaatgtgaaacggctgttaggcaaggtccatatccttcttaacataaaggagttcatcctggtgaggaatcatatgagtgtcagtaacgtgggaagactatcacttgtgttcctcatcctgatagacatccgggagtttactttggtgaaaaacccaatgaatgtcaaaaacgtggtggagctactgacaattgttcaacttttgtttaatacgcgggaattcactctcgtccgcaggctaatgaatattagctctgttggtagattcctttctcctgtgcaacatctgttcaatataagagagcacattcttatgaaaaaccttatgaatgtgtccaatgcccggaggccatcctccattatgcatatcgacattcgtgaattcacggtgggaaggaacccaatgaatgttatgaatgtgggcatgccatccttcgtgtttctgatctag

SEQ ID NO: 35075 - DNA, 1122 bp, Artificial Sequence
  Description of Artificial Sequence: Synthetic coding sequence
ctcgagtaccagatcccagtgagttttaaagatgtggtcgtaggctttacccaggaggagtggcataggttatcccccgcccagcgagcactttatcgtgacgtcatgctcgagacttactccaatctggtgagtgtgggatatgaaggaactaaacctgacgtgatcctgagactcgaacaagaggaagcaccttggattggcgaggctgcttgccccggctgtcactgctgggaggacatctggcgcgtgaatattcagaggaaacggcggcaagatatgttgttgcgaccaggggcagccatcagcaagaagacattacccaaggagaaatcctgcgagtacaacaagttcggcaagatctcgctcctgtctacggatctcttctccagcatccagtctcccagtaactggaacccttgtggaaaaaacctcaaccacaacctcgacctgattggattcaagaggaactgtgctaagaaacaggatgagtgttacgcttatggtaagttacttcagagaatcaaccatggaaggaggccaaatggagaaaaaccaagaggctgctcccactgtgagaaggctttcacccagaacccagccctgatgtataagccggccgtgagcgacagcctgctttataagcgtaaacgtgtgcctcccacggagaaaccacacgtctgtagtgagtgtgggaaagcattttgctataaatctgaattcattagacaccagaggagccatacaggcgaaaaaccgtacggctgtaccgattgcggtaaggcttttagccacaaatcgacactgatcaaacaccaacgaatccacactggcgtgaggcccttcgagtgtttcttttgcggcaaggctttcacacagaagagccaccgaaccgagcatcagcgcacacatacaggcgagagacccttcgtctgcagcgaatgcggtaaaagcttcggagagaaatcgtatctaaacgttcatcggaaaatgcacaccggtgaacgtccgtaccggtgtcgagaatgcggtaaatccttttcacagaagtcgtgtttgaacaaacactggagaacccacttcggcgagtcaagcctgcgctcaaagtcttccaacacctag

SEQ ID NO: 35076 - DNA, 1125 bp, Artificial Sequence
  Description of Artificial Sequence: Synthetic coding sequence
atgattgagtaccaaatccccgtgagtttcaaggatgttgtagtgggatttacacaggaagagtggcatcgccttagtcctgctcaacgcgcgctgtaccgggacgtcatgttggagacctactcaaatctcgtgagcgtcggttacgaggggactaaacccgatgtgatcctccgcctcgagcaggaggaggctccatggatcggcgaggccgcctgtcccggttgtcattgttgggaagacatttggcgggtcaatattcagcgcaagcggaggcaggatatgctgcttaggccaggagctgctatcagcaaaaagactttgcctaaagaaaagtcttgcgagtataacaagttcgggaagatctcgctgctgtctacggatttgttctctagtatccagtcaccatctaattggaatccttgtgggaagaacctcaatcataatcttgacttaatcggttttaaaagaaactgcgccaaaaaacaggacgaatgttatgcgtatggaaaacttctgcagagaataaaccacggcagaaggcctaatggcgagaaacctcgcggatgcagtcactgtgaaaaggctttcacacagaatcccgcactcatgtataaacccgctgtatccgattctcttctgtacaagcgaaagagggtccctccaacagagaaaccccacgtctgcagcgaatgtggaaaagccttttgttacaagtctgagttcattagacatcagcgctctcataccggggaaaagccatacggatgcacagactgcgggaaagcattttcgcacaaatcgaccctgattaaacaccagaggatacatacaggagtacggcccttcgagtgctttttctgtggaaaggccttcactcagaagagtcaccgcaccgaacaccagcgtacccatactggtgagaggccattcgtctgtagcgaatgtggcaaaagttttggtgagaagagctatctgaacgttcacagaaaaatgcacaccggcgagcggccctatagatgtagagagtgcggaaaaagcttcagtcagaagagctgtctgaataaacactggaggacgcatacaggcgagagccttgaaccgaggcgccagaggttgcaatag

SEQ ID NO: 35077 - DNA, 1221 bp, Artificial Sequence
  Description of Artificial Sequence: Synthetic coding sequence
atgatcgagtatcagattcccgtcagctttaaggatgttgtggtgggatttacccaggaagagtggcacaggctttctccagcccaacgcgcactctacagggacgtgatgctcgaaacttacagtaacctggtgagcgtgggctacgaaggtactaagccggacgtgatcctgcgcctggagcaggaggaggccccgtggatcggcgaagctgcctgcccaggatgccattgctgggaggacatctggagggtgaacattcaaagaaaaaggagacaggacatgctgttgcggccaggcgccgccatctcaaaaaagaccctacccaaggagaagtcatgtgagtataacaaatttgggaaaatctctctcctaagcacagacctgttctcatcaattcagagcccaagtaattggaacccatgcgggaagaatctgaaccacaacctggatttgatcggctttaagaggaattgcgctaaaaagcaggacgaatgctatgcatacggcaagttgctgcagagaattaaccacggtcgccgcccaaacggagaaaagcctcgagggtgcagtcattgtgagaaagccttcacacagaatcctgcactgatgtacaagccggctgtctccgattccctgctctacaaaaggaaacgggtgccacccactgaaaaaccccacgtatgctcagaatgcgggaaagccttctgctataagtccgaatttatccggcaccagaggagtcacactggggagaaaccttacggatgcacagactgtgggaaggcctttagtcataagagcacactcatcaaacaccagcggatccacaccggagtgcggccattcgaatgtttcttctgtggaaaggcattcacacagaaatcccaccgcacggagcatcagcgaactcatacaggcgaacgcccatttgtgtgttcagaatgtggcaaaagcttcggtgagaagtcttacttgaatgtccaccgaaagatgcacacaggtgaacggccttatcggtgccgagagtgcggaaagagcttctcccaaaagtcttgcctcaataaacattggagaactcacaccggggaaaagccatatggatgtaatgagtgtggtaaagcgttctatcagaagcctaatcttagtcgccatcagaaaatacacgcccgcaaaaatgcgtaccgaaatgagaacctcattattgtgggcaacacctag

SEQ ID NO: 35078 - DNA, 1221 bp, Artificial Sequence
  Description of Artificial Sequence: Synthetic coding sequence
atgatcgagtaccagataccggtctcctttaaggacgtggtggtgggctttactcaagaggagtggcatcgcctcagtccagcacagagggccctttaccgcgatgtgatgttggagacctacagcaacctagtttcagtgggctacgaagggactaaacccgacgtgattctgagactggaacaggaagaagccccctggattggcgaagcggcctgcccaggctgccattgttgggaggacatttggagagttaacattcagcgaaaacgcaggcaggacatgcttctgcggccaggcgctgctatctcaaaaaaaaccctacctaaagaaaaatcctgcgaatacaataaatttggcaagatctcgctgctatccactgatctattctcatcgatccagtctccaagcaactggaatccatgcggcaaaaacctcaaccacaatctggacctcatcggatttaagaggaactgcgcgaaaaagcaggatgagtgctacgcctacggcaaactgttgcagcggattaaccatggcagacggcctaacggcgaaaaacctcgcggctgctcacactgcgagaaggcctttacacagaaccccgcccttatgtacaagcctgctgtatcagacagcctactctacaaacgaaagagagtgccccctactgaaaagccacacgtgtgtagtgaatgcggaaaagctttctgctataagtcagagtttatacgccaccaaaggtcacataccggtgaaaagccatatggatgcacagactgtggcaaagcattttcccataagtcaacattgataaagcaccaacggatccatacgggagtgagaccttttgagtgttttttctgcggcaaagccttcactcaaaagagccataggaccgagcaccagagaactcataccggcgaacgtccttttgtgtgctcggagtgcggcaaatcttttggcgagaaatcttacctaaacgtgcaccgcaagatgcacactggggagcgcccttaccggtgccgggagtgcggtaagtccttcagtcagaagagttgcttaaataagcattggaggacgcacaccggcgaaaaaccctacggttgcaacgaatgcggaaaagccttttatcagaagcccaatttgtctaggcaccagaagatccatgcaaggaagaatgcgtacagaaatgaaaatctgattatcgtgggtaacacctag

SEQ ID NO: 35079 - DNA, 4050 bp, Artificial Sequence
  Description of Artificial Sequence: Synthetic coding sequence
atggcatgttatctggtgatcagctcacgacatctgagtaatggccattacagaggaatcaagggagtgttccgagggccactgtgtaagaacggaagtccttccccggacttcgccgagaagaaaagtaccgctaaggcgttagaagacgtgaaagcaaacttctattgcgaactctgcgacaaacagtaccataagcaccaggaattcgataaccacattaatagctacgatcacgcgcacaagcaacgcttgaaagaattgaagcaacgtgaatttgctcgcaatgtggcatcaaagagttggaaggacgagaagaagcaggagaaagccctgaagcggcttcaccaactggcggagctgcgtcaacagtcagagtgtgtgtctggcaatggtccagcttataaggccccccgggtcgcaatcgaaaagcagctgcagcagggtatcttccctattaagaacggcaggaaagtctcctgcatgaaatccgccctgctcctcaaggggaagaatctcccacggatcattagcgataagcagcgatcaacaatgccaaatcgacaccagctccagtctgatcgccgctgcctcttcggaaatcaagtactccagacgagtagcgacttgtcaaacgctaatcatagaactggcgtcagcttcacattctctaagaaggtgcacctcaaactggagtccagcgcttccgtttttagcgagaacacagaagagactcacgactgcaacaaatcccctatatacaagacaaagcagaccgccgataagtgcaagtgttgtaggttcgctaacaaggacactcaccttaccaaagagaaggaggtgaatatctcacctagtcatctggaaagcgtgctgcacaatacaatcagtatcaattccaagatccttcaggacaagcacgatagtattgacgaaacactggaggatagtatcggaatacatgcatccttctctaagagcaatatccacctcagcgacgtggatttcacacctacctctcgtgagaaggaaacgaggaacaccttgaaaaatactctggagaactgcgttaaccacccttgtcaagccaacgcgagtttttcaccaccaaatatctataaccattctgacgctagaatatccgaatgtctcgacgagttctcatctctcgaaccttccgagcagaagagcacagtgcatctaaaccctaacagcaggatagaaaacagggaaaagtctctggacaaaactgaaagagtctccaaaaatgtgcagaggctagtaaaagaggcatgtacacacaatgtagcttccaaacctcttccatttcttcatgtccaatccaaagacggccacactaccctgcagtggcccactgagctgctcttgtttacaaagaccgagccatgcatatcatacggatgcaatccgttatactttgacttcaagcttagcaggaatactaaagaggatcacaatcttgaggatctgaagaccgagctgggaaaaaagccgcttgaactgaaaaccaaacgggaaagccaggtgagcggtctgactgaggaccagcaaaaactgatccaggaggactaccagtatccaaagcccaagaccatgattgctaatcccgattgggagaaatttcagcgcaagtacaacctagactactcagattccgaaccaaacaagagcgaatacaccttctccgcgaacgacttggagatgaagaacccaaaagtgcccctgtatcttaacacgagcctgaaggattgtgccgggaaaaataacagctccgagaacaagcttaaggaggcctctcgggcgcactggcagggatgcagaaaagccgtgttgaatgatatcgacgaagatctgtcgtttccatcatatatttctagattcaagaagcataaactcatcccgtgctcccctcacctggagtttgaagatgagcggcaatttaactgcaaatcctcaccatgcactgtgggcggtcactcagatcacggcaaggacttctccgtgatcctcaagagcaatcatatcagcatgacctccaaggtatccggatgcggtaaccagaggtataagcgctatagcccccagtcgtgtctgtcacgctactcttcctctctcgatactagcccttccagtatgtcttctctgagaagcacctgttcatctcaccgcttcaacggcaattctagaggtaacctgctgtgctttcataagcgcgaacaccacagtgttgaacggcataaacgaaaatgtctaaagcacaactgcttctatttgtccgacgatatcactaagagttcccaaatgcagtccgagcctcaaaaagagcggaattgtaagctgtgggagagtttcaagaacgagaagtactctaagcgacggtactgtcactgtcgtgagagacagaaactcggcaaaaaccaacaacagttttccggattgaagtccaccagaattatctactgtgactcaaattctcagattagctgcacgggatcctctaagaaaccaccaaactgccagggcacccagcatgatcgactggattcatatagcattgagaagatgtattatttaaataaatcaaaacggaaccaagaaagcctggggtcaccccacatctgtgacctcggaaaagtgcggccaatgaaatgtaattccggaaatatcagttgcctgctcaaaaattgctccagcggaccatctgagactacagaatcgaataccgctgaaggagagagaacaccactcaccgccaagatactgctcgagcgtgtgcaagctaaaaaatgccaagagcagagcagcaacgtcgaaatttcttctaattcctgcaaatccgagcttgaggcgccgtcccaggtgccatgcacaatccaactggcaccctctgggtgcaatcgccaggctctgcccctgtcagaaaagatccagtacgccagcgaatcccgcaacgaccaggattctgccattcctcggactactgagaaggacaaaagcaaaagctcgcataccaataactttacaatattagctgataccgactgcgacaatcatctgtctaagggaattatccatctggttaccgagagccagagcctgaatatcaaaagagatgccacaacgaaggaacaatctaaaccactaatatccgaaatacagccctttatccagtcctgtgatcctgttcctaatgaatttccgggagccttcccttcaaacaagtatactggggtgactgattcgacggagacgcaggaggaccagatcaacctcgacctgcaggatgtaagtatgcacatcaaccacgttgagggtaatattaactcatattatgaccggaccatgcagaaacctgataaggtcgaagacggcttagaaatgtgccacaagagcatctctcctcccctgatccaacagcccataacgttctcccctgatgagattgataagtacaaaatactgcagctccaggcgcaacagcatatgcagaagcagctgctgagtaagcacctgagggtgcttcctgccgccgggcctacggctttctcgccggcgagtacagtgcagactgtaccggttcatcagcataccagtatcacgaccattcatcacactttcctgcaacatttcgcagtctctgcctcgcttagctcacactcatcccacttgcctatagcacacctgcatcccctgagccaggctcattttagccccatcagtttctctaccctaacgccaacgatcatccccgcccatcctacgttcctcgcaggtcatcccctgcacctagtggccgcgacgccattccaccctagtcacatcaccctgcagccacttcctccgactgcgttcattcccactctcttcggtccacatctcaaccccgctacaacttctattattcacctgaaccccctcatccagcctgtgttccaagggcaggatttctgccatcacagctgttcctctcaaatgcagcagcttaatgaagtgaaagaggctctaaacgtgtcaacacatctaaactag

SEQ ID NO: 35080 - DNA, 1986 bp, Artificial Sequence
  Description of Artificial Sequence: Synthetic coding sequence
atgccagcaaacgaggatgctccacagccgggagaacatggctccgcctgtgaagtctctgtaagtttcgaggatgtcacagtggatttttctcgagaggaatggcagcaattggattctacccagcggagactgtatcaggacgtgatgctggagaactattctcaccttctatccgtcggctttgaagtcccaaagcctgaggtgattttcaagttggagcagggcgaaggtccgtggacactggaaggcgaggccccacatcagagctgtagtgacgggaagttcgggataaaacccagccagcggcgcataagcgggaagagtacattccacagtgagatggaaggtgaggatactcgtgatgactccctatactccatcctcgaggaattgtggcaggacgctgagcagatcaaacgatgtcaggagaaacacaataaactcctgagccggacgacttttctgaacaaaaagattctgaacactgaatgggactatgaatacaaggactttggtaagtttgtgcacccctcaccaaatctgatactatcccagaaacggccacataagcgagactctttcgggaaaagctttaagcacaatctggatcttcatatccacaacaagagcaacgcagccaaaaatctagataagactatcggtcacggccaggtgtttactcagaattctagctactcacatcacgagaacacacatactggggtgaagttctgcgaaagaaaccagtgtggtaaggttctctcgctcaagcactctctctcacaaaacgtcaagttccctatcggagaaaaggcaaatacatgcaccgaatttgggaaaatcttcacccaaagaagccacttcttcgcaccccagaaaatccacaccgtggaaaaacctcacgagctttccaagtgtgtgaacgtgttcacccagaagccactcttgtcgatctacctccgcgtccatcgcgacgagaaattatacatatgcaccaagtgcggcaaggccttcatccagaatagtgagcttattatgcatgagaaaacacacactcgagaaaagccttataagtgcaacgaatgcggtaagagtttcttccaagtgtcctccctgcttcgccaccagacaacacacacaggggaaaaactcttcgaatgctcagagtgcggaaaggggttctctctgaactctgcactcaacatacaccaaaagattcacaccggagaacgtcatcacaaatgcagcgaatgtggaaaagctttcacccagaaaagcacattgcgcatgcaccagcggatccatacaggtgaaaggagttacatctgcactcagtgtggtcaggcctttatccagaaggcgcatctcatagcccaccaacgaattcacacgggagaaaagccttatgagtgttctgattgtggtaaatcattcccctcaaagagtcagttgcagatgcacaagcgaatacataccggggagaaaccctacatctgtactgagtgcgggaaggctttcaccaacagatcaaacctcaatacccaccagaaatcacatacaggagaaaagagctatatatgtgccgaatgcggcaaagctttcacagatcgtagcaattttaataagcaccagactattcacacaggtgaaaagccatatgtctgtgcagactgcggaagagcattcattcagaaatcagaactgatcacccaccagcgcattcacaccacagaaaagccttacaaatgcccagactgtgagaagagcttctccaagaaaccacacttaaaggtacatcagcgcattcatactggagaaaaaccatatatttgcgcagaatgtgggaaggcatttaccgaccgcagtaacttcaataagcaccaaacgattcatacaggcgacaagccatacaagtgcagtgattgtggcaaggggtttacacagaagtccgtcctgtccatgcaccggaacatacacacctag

SEQ ID NO: 35081 - DNA, 1365 bp, Artificial Sequence
  Description of Artificial Sequence: Synthetic coding sequence
atggcagtcacagacctgtcccacggtttcttcccaagggaacccatatgcccctttgaagagaaaacaaagatcggtactatggtggaagattaccttgctaactcataccaggatagcgttacattcgatgatgtagctgtcgaatttacccctgaagagtgggcattactggacacaacagaaaagtgtctctatagggatgtgatgttagagaattacgttaacctcgctagcgttgaggccactgtcgatgggaactcggaaaactgcggcgaggtattctccgaatggttctgcttgaagacgcatatgagagcccagaacggtggcaacatatttgaaggtaattgctacggcaaagacatcctgagcgtacacaaagaggcttcaatagggcaagaactatccaagttcaacccatgcggaaaggttttcaccctcaccccagacctggctgcccacctcggaatactgaacgcccgtcaaccttacaagtgtaaagaatgccgaaaaggttttaagtacttcgccagcctggataatcacatgggcatccacattggggagaaattttgtgagtttcaagaatgccggcgtgccataacgcatagttctcatttgaaacagtgtgtgaccgtccatacagggaagaaatcgaagaagacaaagaaacacggaaagagtttcactaacttctcccagctcagtgcgcatgtaaagatccacaagggagaaaaaagctttgaatgtaaggagtgcggaaggtcctttaggaattcctcttccttcaatgtgcatatccagatccataccggaataaagccccacaagtataccgagtgcggaaaggccttcactcggtctacgcacttaactcagcacgttagaactcacacgggcataaagccttatgagtgtaaagaatgcggacaggcattcacccagtacactggcctggctatccacatcaggaatcatactggcgagaaacattaccagtgcaaagagtgtggcaaagcctttaacggctcctccaccttgacccaacacaagataattcacaccggagaaaaaccatacggttgcgtcgagtgcggcaagaccttcatcacgagttcgtaccggtccaagcaccttaaaacccatcacgaagagagaccttttgtgtgtaaaatttgcgggaaggccttcctgtattcctcccctcttaatgtccacctgcagacgcacacgcgggaaaaagccctcatctgcaaggaatgtgggaaagcattcgcagtgtcttcccatctgagtaggcacgagagaatccacacgggtgaagaaccatatgagtataagggaatgaacgttacgatatag

SEQ ID NO: 35082 - DNA, 1734 bp, Artificial Sequence
  Description of Artificial Sequence: Synthetic coding sequence
atggctgccgctgccaccctgcgccttagtgcccagggcactgtgaccttcgaggatgtggccgtgaattttacttgggaggagtggaatctcttaagtgaagctcaaaggtgcctctaccgcgatgtcactcttgaaaatcttgcccttataagctcacttggctgttggtgcggcgttgaagacgaagccgcaccgtctaagcagtcaatctatattcaacgggagactcaggtcaggacaccgatggccggcgtgtcccccaaaaaggcccacccatgtgagatgtgcggcccgatcttaggcgatatcctgcacgtggccgatcatcagggaacccaccacaagcaaaagctccatagatgtgaagcctggggtaacaaactttatgactccggaaactttcatcagcaccagaacgaacatattggagagaagccttaccgcggttctgtcgaggaggcactatttgccaaaagatgcaagctccacgtgagcggtgaatcttcagtgttcagcgaatcaggaaaggactttttaccacggtcaggactgctgcagcaggaagccagccacacgggggaaaagagcaactccaaaacggaatgcgtttcaccaatacagtgtggaggcgcacactacagttgcggcgaaagcatgaagcatttctcaacaaaacacatcttgagtcaacaccaacgtctgctaacaagagaagaatgctacgtgtgctgcgagtgcgggaagtctttttctaagtatgccagttttagcaatcaccagcgagtgcataccgacaagaagcattatgagtgcggagaatgcggtaagtcgttttctcagaaaagcagtctgatccagcatcaaaggtttcatacgggagaaaagccttatggctgcgaagaatgtgggaagtcgttctctcacaagcgcagcctggtacaccaccagcgcgttcactccggtgaacgtccctaccaatgcggagaatgcggcaagtcgttctctcagaagggcaatctcgttctccaccagagggtgcacacaggagcaagaccgtacgaatgcggtgagtgcggaaagtcttttagccataagcgttcactcgtgcaccatcaacggatgcatactggtgaacgcccatacaaatgcggagattgtggcaaaagcttcaacgaaaagggccacctcagaaaccaccagagggtccacactacagaaagaccctttaagtgcggcgagtgtggcaaatgcttcagtcataagggcaacctaatactgcaccaacatggacacaccggggagcgcccatatgtttgccgtgaatgtggtaagctgttcaaaaagaaatcccacctgttggtgcaccagcggattcataacggcgaaaagccttatgcctgcgaagcgtgccaaaagttctttcgcaataattctacattttgcgtgcacaaaagaatacacacaggcgagaagccctatgagtgttcagagtgcgggaagagctttgctgaatcgagctcctttaccaaacataagagggtccacaccggcgagaagccctatgaatgttccgagtgcggaaagagtttcgccgagtcatcaagtctgacaaagcataagcgggtacatacgggtgaaaagccatacaagtgcgaaaagtgcggcaaattgttcaacaagaagagtcacctcctcgtgcatcagtcttcacattggcgaaaggccatctag

SEQ ID NO: 35083 - DNA, 2568 bp, Artificial Sequence
  Description of Artificial Sequence: Synthetic coding sequence
atggccgccgccgcaacactgaggctcagcgcccaaggaaccgtgacattcgaggatgtggctgtgaacttcacttgggaagaatggaacctgctttcagaagctcaacggtgtctctaccgtgatgtgaccttagaaaatctggctcttatctcctccctcggttgctggtgcggcgtagaggacgaagccgctccaagcaaacagagtatatatattcagcgcgagacgcaggtccgtactcctatggcaggtgtgagtccgaaaaaggcgcatccatgcgaaatgtgcggacccatcctaggagacattctgcatgtcgcagatcatcagggaacccaccataagcagaaactccaccgttgcgaggcctgggggaacaagttgtacgattcaggcaatttccatcagcatcagaacgaacatatcggcgagaagccttataggggaagtgtcgaagaagctctgtttgccaaaagatgtaaactgcacgtgtcaggagagtcttcggtcttctcagagagcggaaaggattttctgccccgaagtggtctacttcagcaggaggcatcacacactggagaaaagtctaatagcaaaacagagtgcgtctccccaattcaatgcggcggcgctcattattcttgcggcgagagcatgaagcacttctcaaccaagcacatcctgagccagcaccagcgtctgttgactagggaagagtgctacgtatgctgcgaatgtggaaaaagtttctccaagtacgccagcctcagtaatcaccagagggtgcacactgaaaaaaagcacgagtgcggggaatgcggtaaatctttctccaaatacgtttctttctctaaccatcaacgtgtccacacagaaaagaaacacgagtgtggagaatgcggtaagagctttagtaagtacgtaagcttcagtaaccaccagagagtgcacactggcaaacgcccttacgaatgcggagaatgcgggaagtcgttcagcaaatacgcctcatttagcaaccaccagcgggttcataccgaaaaaaaacactacgagtgcggcgagtgtggaaagagcttcagcaagtatgtcagcttcagcaatcatcaacgtgtacatacaggaaagcggccttatgaatgtggtgagtgtggtaaaagcttctctaagtatgcatctttctctaatcaccagcgcgtccacactgataaaaagcattacgagtgtggggagtgtggcaaatcgttcagtcaaaagtcttccctgattcagcaccagcggtttcatacaggtgaaaaaccatacgggtgcgaggagtgcgggaagtcattctcgtctgagggtcacctcaggtctcaccagagagtccatgccggtgagcggccctttaaatgtggtgagtgcgttaaatcctttagtcataaaagatcattggtgcaccaccagcgagtgcactccggcgagagaccttatcaatgtggagagtgcggcaaatccttctcccagaagggcaatcttgtgctacatcagagggtgcacactggagctcgcccgtacgagtgcggtgagtgtggcaagagcttttcttctaaaggacacctccggaatcaccagcagatacacaccggcgacagactctacgagtgcggcgagtgcggcaaatcctttagtcacaaaggaaccctcattctgcaccagcgcgttcaccctcgggaaagatcctacggatgtggagaatgtggtaaaagcttttccagtatcggtcatctgcggtcccatcaacgcgtccacactggtgaacgtccttatgagtgcggtgagtgtggtaagagtttctctcacaagcggtcgctggtacatcaccagcgcatgcataccggggagcgtccatacaagtgcggagattgtgggaagtcctttaacgagaaaggacacttgaggaatcaccagcgcgtgcacacaactgaacggccattcaagtgcggggaatgcggtaaatgcttttcacataagggaaacctaatcttgcaccagcatggacatacaggagagcggccttacgtttgcagagagtgcggcaaattattcaagaaaaagtcacacctgctcgtccaccaacgaatacacaacggggaaaaaccatatgcttgcgaggcttgccagaaattcttccgcaacaaataccagttaattgctcaccaacgggtacatactggggagaggccctatgaatgcaatgattgtggcaagtctttcacccattcctctacattctgcgtgcataagaggatccatactggtgagaaaccttatgagtgttctgagtgcggcaaaagcttcgcggagagcagttcatttacaaagcacaagcgagtgcacacaggtgagaaaccctatgagtgcagtgaatgtggcaagagctttgctgagagttcctcattgaccaagcataaaagggtccatacgggcgaaaagccatacaaatgtgagaagtgcggcaaactttttaacaagaaatcccatctgctcgtgcaccagagttcccattggcgcaaagccatctag

SEQ ID NO: 35084 - DNA, 1113 bp, Artificial Sequence
  Description of Artificial Sequence: Synthetic coding sequence
atgtcccgacggaaacaaaccaacccgaataaagtgcactgtgattcagaaggcgacgaggaggaaaccacccaggatgaggtgagcagccatacctccgaggaagacgggggcgtggttaaagttgagaaagaactagagaacacggagcagccggtggggggtaatgaggtggtcgaacatgaggttacgggcaatctcaattccgaccccctgctggaattgtgtcagtgccctctgtgtcagctggactgtggaagccgcgagcaattgattgcccacgtgtaccagcataccgctgccgtggtgtccgcgaagagttatatgtgcccggtttgcggcagagcactgagttcccccggcagtcttggcagacatttgctgatccatagcgaggaccagcgtagcaactgcgccgtctgcggtgccaggttcacaagtcacgccaccttcaatagcgagaagcttcccgaggtcctcaatatggagagccttcctacagtgcacaatgagggaccaagcagtgctgagggcaaagatattgccttctctccacccgtataccctgccgggattctcctggtgtgcaataactgtgcagcctaccgaaaactcttggaagcccagaccccctctgtgcggaagtgggccttacgcagacagaacgaacccctagaggttcggctgcaaaggctggagcgggagagaacagcaaaaaaatccaggagggacaacgagactcctgaggagcgcgaagtcagacgcatgagggatagggaggccaagaggctccagcgcatgcaggagacggatgagcagagggcccgacggcttcaacgcgatagggaggccatgaggctgaaacgagccaacgaaacccctgagaagcggcaagcacggcttattagggaaagagaggcaaagcgtctgaaacgccgcctcgagaagatggacatgatgctgcgggctcaattcggtcaggaccctagtgcaatggcggccctcgctgccgagatgaactttttccagctccccgtctctggcgtggaactggattctcagctactgggcaaaatggcatttgaggagcagaatagtagttctctgcactag

SEQ ID NO: 35085 - DNA, 1239 bp, Artificial Sequence
  Description of Artificial Sequence: Synthetic coding sequence
atgtcccgacgtaaacagacgaatccaaacaaagtgcattgggaccaagtgttcgccggacttgaagagcaagctcgtcaggcgatgatgaaaacagactttccgggcgaccttgggtctcagagacaggcaatccaacaactaagagaccaggattccagctcttccgactctgagggggatgaagaagagaccacccaagacgaggtaagttctcatactagcgaggaggacggcggagtggtgaaagtagagaaagagctagagaatactgaacagccagtggggggtaacgaggtcgttgagcacgaagtgactggtaacctcaacagcgatccacttctagagttgtgccagtgccccctctgtcagttggattgcggctccagagaacaactaatagcacacgtgtaccagcacactgccgctgtggtctccgccaaaagttacatgtgcccagtgtgtggaagggcgctctcatccccagggtcgctcggaaggcatctgctgatccattccgaggaccagagaagtaactgtgccgtgtgcggtgctcgatttactagccatgcaactttcaacagcgagaagctccccgaagttttgaatatggagtccctgcctacggtgcacaacgaaggcccttcttccgctgaggggaaggacattgcttttagccctccggtgtacccagccggaattctactggtgtgcaacaactgcgccgcatatcggaagctccttgaagcacagacaccgtccgttaggaagtgggcactgaggcggcaaaatgaacctcttgaggtaaggttgcagcgtctcgagcgggagagaactgccaaaaaatccagacgagataatgaaacccctgaagagagggaagtccgccggatgagagatagagaagccaagcgtctgcagaggatgcaagaaacggatgagcagcgggctaggaggctgcaaagagacagagaggctatgcgcttgaagagggcaaatgagacccccgaaaaaagacaagctcgtctgattcgggagagggaggccaaaagacttaagagaagactcgagaagatggatatgatgctccgcgcccaatttggtcaggacccatccgcaatggcagcattagccgccgagatgaatttctttcaactcccagtgtctggggtggagcttgatagccaactcctgggaaagatggccttcgaggaacaaaactcgtcatcattacactag

SEQ ID NO: 35086 - DNA, 1113 bp, Artificial Sequence
  Description of Artificial Sequence: Synthetic coding sequence
atgtcgaggaggaaacaaaccaaccctaataaggtccactgcgattctgagggtgacgaggaagagacgacacaggatgaagtctcgagtcatactagcgaggaagacggaggagtggtgaaggttgagaaagagctggagaacacagaacagccggttggaggaaatgaggtagtcgaacatgaagtgacaggcaacttgaactcagatccccttctagagctgtgccagtgtccactttgtcagctggattgcggctccagagagcagctaatcgcacacgtctatcagcatacagctgctgtggttagtgctaaatcctacatgtgccctgtttgcggaagggctttaagctcccccgggtctctcggtcggcacttactgattcattccgaggatcagcgcagcaactgtgcagtctgtggtgctcgctttacatctcatgccacttttaatagcgagaaacttcctgaggttctcaacatggaatccctcccaacagtccataacgagggcccttcctcagcggaaggcaaagacattgctttttcacctcctgtatatccagctggaatcctgctggtatgtaataattgcgctgcgtatcggaagctacttgaagcacagactccgtctgttaggaagtgggctctcagaaggcaaaatgaaccattagaggtgcggttgcaaagactggagcgcgagaggacagccaagaagtcccgtcgggacaacgagactccggaagaacgtgaagtgcgccgcatgagggacagagaggctaagcgcctacaacggatgcaggagacagacgagcagcgagctagacgtttacagcgggaccgggaggcgatgaggttgaagcgggccaatgaaactcccgaaaaaagacaggctaggctcatcagggagagggaggcaaagcggctcaaaagacggctggaaaaaatggatatgatgctacgggctcaatttgggcaagatcccagcgcaatggccgctctggccgccgaaatgaactttttccaactgcctgtgagtggggtcgaactggattctcaactacttggcaaaatggcgtttgaggaacagaatagctcttctctgcactag

SEQ ID NO: 35087 - DNA, 417 bp, Artificial Sequence
  Description of Artificial Sequence: Synthetic coding sequence
atgtctagacgcaaacagacaaatcccaataaggttcactgggatcaggtgttcgccggcctcgaggagcaagctagacaggcaatgatgaagaccgactttcctggagatttgggatcacaacggcaagcaatccagcaattgagagaccaggattcgtcctcttctgattctgagggagatgaagaagaaaccacccaagacgaagtgtcgtcgcacacctcagaggaggatggcggcgtcgtgaaggtcgaaaaggagctggaaaatacggagcagcctgtcggcggcaatgaggtggtggagcatgaagctagaaatctgaacagtgacccgctcctcgaactgtgtcagtgccctctttgtcaactggactgcggttcaagagagcagctgattgcacatgtctatcagtag

SEQ ID NO: 35088 - DNA, 1239 bp, Artificial Sequence
  Description of Artificial Sequence: Synthetic coding sequence
atgtcacgcagaaaacagaccaatccaaataaggtgcattgggatcaggtctttgctggcttagaagaacaggccaggcaagccatgatgaagaccgatttccctggcgatttaggcagtcaaaggcaggcaattcagcagctgcgtgatcaggactccagctccagcgactcagagggggatgaggaagagaccactcaagacgaagtgtcctctcacacttccgaggaggacggtggcgtggtgaaagttgaaaaggaattggagaatacagagcagcccgttggtggtaacgaggtggtagaacatgaggtgaccggtaacctgaattcagaccccctcctggagctgtgtcagtgccccctgtgtcaactggactgcggatctcgggagcaattaatcgcacacgtgtaccaacataccgccgcggtggtgtccgctaagtcatatatgtgcccggtgtgtgggagggcactttcctcacccggtagtctgggccgtcacctgctaatacactcagaggatcagaggtcaaattgtgctgtgtgtggggccagatttacatcccacgctacgtttaattcagaaaagctccccgaggtgcttaatatggagtccttacccacagtccacaacgaagggccaagtagtgccgaagggaaggatattgccttctctccacccgtgtatcccgctggcatcctcctagtgtgcaacaattgtgcagcataccgtaagcttctggaggcacagacaccaagtgtgaggaaatgggctctgcgccgacagaacgaaccactggaagttaggctgcagaggctcgagagagaaagaacagcaaaaaagagcaggcgagacaacgagacacccgaagaacgagaagtgaggcggatgcgggaccgggaggccaagcgcttgcagcgtatgcaggagactgacgaacagcgtgcccggcgcctccagcgcgacagggaagccatgcggttgaagagggccaatgaaacacccgaaaagcgccaggcaaggcttattcgggagagagaggccaagagactcaagcggcggctggagaaaatggatatgatgctgcgggctcagtttggtcaagaccctagtgccatggccgctctggctgccgagatgaattttttccagctgccagtctccggagttgagctggatagtcaactgttgggaaaaatggccttcgaggagcagaacagctcttctcttcattag

SEQ ID NO: 35089 - DNA, 1680 bp, Artificial Sequence
  Description of Artificial Sequence: Synthetic coding sequence
gtgccagggagtcaatgtgaccctgaaaagcgctgcgagattaagaccgcagcacagggctcacgaatggaaggcctgcttagtgtggctctccagggggccgaactcgaggggaactggaagcacgaaggtcaggtcgaagacctgcaagagaaccaagaatcatgcccagaaccagaagccgtagcttgtaagggtgacccagctggcgacagcatgcaagagcgggatgaattcagtcgtatcccccggactatcagtagccccgccgccacccaggcatcagttcctgacgattcaagctcccgtcgctgttctgcccccggcgagtcccccaaagaacgccatccggacagccgccagcgcgaaagggggggcggccctaaaaagccttggaaatgtggagattgtggaaaggcctttagttattgctccgcattcatattgcaccaacgcatccacacaggcgagaaaccattcgcttgtcctgagtgcggtaaggcttttagccagagcgtgcacctgactctccaccagcggacccacacaggagagaaaccctacgcatgccacgaatgtggcaaagctttcagccagggaagttatctggcatcacactggcggacacacacaggtgagaaaccacaccgctgtgccgattgcgggaaagcattcacccgtgtgactcatcttacacagcaccggcgcgtgcacactggtgaaaggccatacgcatgtgcgcaatgcgccaaggcgtttcggaatcgttcttccctgatcgaacaccagcgcatccatactggggagaaaccgtacgagtgttcggcttgcgctaaggcatttaggttcagcagcgcattaatccggcaccagagaatccacacggaggagaagccgtacagatgcggacagtgcgcaaaagcattcgcccagatagcacatctgacacaacatcgccgggtgcacactggggagaagccttatacctgccaggattgcggtgccttgttttcccagtccgcctcgctggcggagcataggcgcatccatacaggcgagaagccctatgcctgtggccaatgcgccaaggcatttacacaggtaagccatttgacccagcaccagcgaacccatactggtgaaaggccctatccatgtcacgactgtgggaagcgattctctaataggtcccatctgcttcagcacagactggttcatactggcgagagaccctacagatgcttacagtgcggcgcggccttctcccacgttagctcactgattgaacatcaaaagattcatacaggagagagaccatataaatgcggagaatgcggaaaagcgttctcccagggatccagcctagcgctgcatcagcgcacgcatacaggtgagagaccatacacatgtccagaatgtgggaaggcatttagtaaccgctcctatctgatacaacaccatattgtgcataccggggagaagccgtacgagtgttccggttgcggcaaggctttttccttctcttcagcattgattagacatcaaagaactcatgccgatagttccggccggctgtgtccagctccgacaccggactccacaccgggattatcccaggggggagaaacctgtcagcagggatgtcctggtaggaaccctcggggccccgccgaggattag

SEQ ID NO: 35090 - DNA, 1614 bp, Artificial Sequence
  Description of Artificial Sequence: Synthetic coding sequence
atggaaggccttttgtctgtggctttgcagggtgccgaactggagggcaactggaaacacgaaggacaagtggaggatttgcaggaaaaccaagaatcatgtccagagcctgaagctgttgcctgcaagggcgatcctgctggtgactctatgcaagagagggacgagttttcccggatcccaagaactatctcctccccagccgccacccaggctagcgtgcctgacgacagttcaagcagaagatgttctgcccctggggaatcccccaaagagcggcacccagattcacgccagcgggagcggggggggggtcccaaaaaaccttggaagtgcggcgactgcgggaaggctttcagctattgttcagcatttattttacaccaacggattcacaccggagaaaagccttttgcctgtccagaatgtggaaaagcattttcacagtccgtgcatctaaccctgcaccagcgaactcatacaggcgagaagccctacgcatgtcacgaatgtggcaaagccttctcacaggggtcttatttagcctcccattggagaacacacactggcgaaaaaccccacagatgtgctgattgcgggaaggcatttacacgagtgacccatttgacccaacaccgtagagtgcatacgggcgagcgaccctatgcttgtgcacagtgtgcgaaggccttccggaacaggtcttccctgatcgagcatcagcgtattcataccggtgagaagccctacgaatgttctgcttgtgctaaggccttcaggttcagtagtgcgctcataaggcaccagaggattcacacagaagagaagccttacagatgtggacagtgcgccaaagcttttgcccagatagcgcatttaacccaacatagacgggtacacaccggggaaaagccctatacttgccaggactgcggggctctgttcagtcagagcgcaagtctggctgaacataggcgcattcacactggcgagaagccgtacgcctgcggacagtgcgctaaagcttttactcaggtcagtcacctaacacaacatcaaagaacacatacgggagagcgcccttatccttgccacgattgcgggaaacggtttagcaaccggtctcacttgctccagcatcgtcttgtgcacaccggggaacgtccctaccgatgcctccaatgcggtgccgctttttcccacgtgagcagcctaattgagcatcagaaaatccatactggcgagcggccttataagtgcggtgaatgcggaaaggcctttagccaggggagctccctggccctgcatcaacgaacccacactggcgagagaccctacacatgtcccgagtgcggcaaagcgttcagtaacaggtcgtacctgatccagcatcacattgtccacacaggcgagaagccctacgagtgcagtggttgcggtaaggcctttagcttctccagcgcactgatacggcaccagaggacccatgcagactcttcgggacgcctgtgtcccgctccaactcctgacagcactcctggtctatcccaggggggggaaacatgccagcagggctgcccaggtaggaaccccagaggtcccgctgaagactag

SEQ ID NO: 35091 - DNA, 2442 bp, Artificial Sequence
  Description of Artificial Sequence: Synthetic coding sequence
atgctcttgcccacaacgatccagcctcagacggctaggaaatcacagctccctagaggaaactcgtgtctggttggcctgcacattgcttccccccagcttttgcgtgtgcagccacttgtgcggacagaaccacagtcttgtttcctaagcgatctgtgccagcccccagcccagggttttgtccagcggccgctgcctgcgctgcaggtcgttcctgctaaaagagtacccgcgccgaaggcacccgatgaacagggatcaatgctgaccccactgtctgcatccgaccccctggctgtcacctccttgagcagctcctcagctcacccgtttatttctaacttacacactcgtcacaccgagaaactaaaaaagtccctgaaagtgaagacgaggagcgggagggtctcaagaccaccaaaatacaaggcaaaagactacaagttcattaaaaccgaggacctcgctgacggacacctttcagactccgacgactactctgagctgtgcgtggaggaagacgaggatcagcgtgagcggcacgcactattcgacttgtcgagctgctctctccgtcctaagtcctttaaatgtcagacgtgcgagaaaagctatattggaaagggtggcctggccagacactttaaactgaaccccgggcacgggcagctagaccccgaaatggtgttgtctgaaaaggcctctggcagcaccttgcgtggttgcaccgaggaacgcaccctgagcctgaccagcctagggcttagtatgcccgccgatccatgtgaaggcggagcacggtcctgtttagtgacagagagcgcccgggggggcttacagaatggccagagcgtcgatgtcgaagagaccctgcctagcgagcccgaaaatggagctctcctaagatccgaaagatatcagggccccaggagacgtgcatgctctgagactctcgcagaaagtcgaactgccgtgctccaacagagaagagctgcccagttgcccggagggcctgccgccgctggtgagcaacgagccagtccgtccaaggcccggctgaaggaattcctgcagcagtgtgaccgggaggatctcgtggagctcgcactgccacagctggctcaggttgtcacggtctacgagttcttgctcatgaaggtggaaaaggatcatttggccaaacctttcttccctgccatctacaaagaattcgaagagctgcataagatggtcaaaaaaatgtgccaggactatttatctagttctggcctgtgctcgcaggagaccctggaaattaataatgacaaggtggctgagagccttggaattactgagttcctccgcaaaaaagagattcacccggacaatctgggtcctaagcacctgtctcgagatatggatggcgaacagttggaaggggcgtcctctgaaaaaagggagcgagaggcagccgaggaggggctggctagtgtaaagcgtccgagacgcgaggcactgagcaacgatacgaccgaatccctggctgcaaactcccggggccgagagaagccaagacctctgcatgccctggccgcaggggagggcttttcaccgcctgtcaacgtaacggtcagccccaggagcgaggagtctcatacaacaactgttagcggcggcaacggaagtgtgttccaggccggccctcaattacaggccttggctaacctcgaagcccggcgcggctctataggggctgcactttcctcccgtgatgtgagcggtctcccagtgtacgcacaaagcggcgagccccggcggcttactcaggcccaagttgcagcctttccgggtgagaacgctctagaacacagttctgaccaggacacgtgggattccctgcgctctccgggattctgcagcccattgagcagcgggggaggcgcggagagcctgcctccaggaggtcctggccatgcggaagcgggacatctggggaaagtgtgtgattttcatttgaaccaccagcaaccttccccaacatccgtacttccaacagaggtcgccgcacctcctctggagaaaattctgagcgtggattcggttgccgtcgattgcgcttatagaaccgtgcctaaacccggcccccagccgggtcctcatggatctctgctcacggaggggtgcctgagatcgctgagtggcgacctcaaccgattcccttgtgggatggaggtgcattctggacagcgggagctggagagcgtcgtcgccgtgggtgaggctatggcatttgaaatctccaacgggagtcatgagctgctgtcccagggacagaaacagatttttattcagaccagcgacggcttgatcctgtccccccccgggacaatcgtttcccaggaggaagacattgttacagtgactgacgcggaggggcgagcttgcggatgggcaaggtag

SEQ ID NO: 35092 - DNA, 1368 bp, Artificial Sequence
  Description of Artificial Sequence: Synthetic coding sequence
atgcctgccgacccctgcgagggcggcgcgcggagctgcctcgtgacagaatcggccagaggcgggttgcagttccttcagcagtgcgacagggaggacctcgtggaactggccctgccacaactggcacaggtggtaacagtctatgaattccttctcatgaaggttgaaaaagaccaccttgccaaacccttcttccccgccatttacaaggagtttgaagaactgcacaagatggtcaagaagatgtgccaggattacctgtcgtcatccggtttgtgcagtcaagaaaccctggagattaataacgataaggtggccgagtcattgggcatcacagaattcctgaggaagaaggaaatccaccctgacaatttgggtcccaaacacctgagtagggatatggacggggagcaattagaaggtgccagctctgagaaacgggagcgggaagctgcagaggaggggctcgcgtccgtgaaacgtccccgacgcgaggccctgagcaacgacactactgagtctctagctgcaaattcgagagggagggagaaaccgaggccactgcacgcacttgcagctgggttttcccctcccgtgaatgtcaccgtctcaccccggtctgaagaaagccatacgacaactgtttcaggaggcaatggctctgtctttcaagccggcccccagttacaggcattggctaacctcgaggcacgccgaggatctatcggcgcagctctatcttctagagatgtgagcggcctgcccgtgtacgcccagagtggcgagcccagacgactcacccaggcccaggtggctgccttcccaggcgagaatgccctggaacacagctccgatcaggatacttgggattccctgcggagtcccggattctgctccccgctttcatccggtggaggcgccgagtctctgccccctggtggccccggccacgcggaagccgggcacctcgggaaagtatgcgactttcatctgaaccatcaacagccaagccccaccagtgtcctcccgaccgaggtagccgcgcccccactggagaaaatcctatctgtcgactcagtggcagtggactgtgcttaccggactgtccccaaacctggccctcagcccggccctcatggtagcctgcttaccgaaggatgtctgcgatccctgagtggtgatctgaaccgattcccttgcggcatggaggttcactccgggcagcgggaactggagagtgtcgtggcagtgggcgaagcgatgttgaagttccccatgggagctatgagctattgcctgagggacaggtcaaggtttctgtttcgcctacccatgggcctgtcgtgccccctgcaagtccagtag

SEQ ID NO: 35093 - DNA, 2784 bp, Artificial Sequence
  Description of Artificial Sequence: Synthetic coding sequence
atggccgatgccgagcctgaggccggtggcggaagcgaagacggcggcggggggggtggacccgcgcctccgggtcaatcagggtccgttgcaagggttgctccgctgggtccggagcagctgagacaggttctggaacaggtgactaaagctcaacctcctccccctccacctccattcgtactgagagacgcggcccgccgcttgcgagatgcggcacagcaagcagccctccagcggggcagaggaacggaaccaccccgcctgcccaggctgttgccaccgcagcaactcgaggccatctgtgtgaaagtcacttcaggggaaaccaaggggcaggagcggccaatgctcctgcccaccacaattcagccccaaacagctaggaaatctcagctgcccaggggcaatagttgcctagtcggattgcacatagcaagtcctcagcttctacgggtacagcccctggtcaggaccgaaccccagtcgtgtttcctctcagacctctgccagccccccgcacaaggcttcgtgcagagacccttgcccgccctgcaagtcgtgccggccaaaagggtgccggcccctaaggcccccgatgagcagggatctatgctcacacccctaagcgcctcagaccctctggcagttacgtctctatcctctagtagtgcccatccgttcatctccaatctccatacccgccataccgaaaaactgaaaaagagcctaaaggtgaagacgcgtagcggcagggtttctcgcccacccaagtacaaagcaaaggattacaagttcattaagactgaggacctggcagacggccacctctctgactcggatgactattctgagctgtgcgtcgaggaggatgaagatcaaagagaacgacacgcactttttgacctctcctcctgttctctgaggccaaaatcatttaagtgccagacttgtgagaagtcatatattggaaaaggtggcctggcaagacatttcaaacttaaccccgggcacgggcagctcgatcctgagatggtgctcagtgaaaaggcctccggatccacacttcgggggtgcactgaagagcgtactctgagtctgacaagcctgggactttccatgcctgccgatccctgtgaggggggtgcaagatcttgtctggttactgaatcagcacgcgggggacttcagaacggacagtcagttgatgtggaggaaacgctgccctcagaacccgaaaacggagcgcttcttcgctcagagagataccaggggccgcggcgaagggcatgttcagagacactcgcggaaagcagaaccgctgtcctgcagcagcgcagggctgcacaactgccaggcggcccagctgcagccggcgagcaacgggccagcccctccaaggctcggctgaaagagttcttgcagcaatgtgatcgggaagacctggtggaactggccttaccacagttggctcaggtggtgactgtgtacgagttccttttgatgaaggtggagaaggaccatttagcgaagccattcttccccgcgatttataaagaattcgaagaactccacaaaatggttaagaaaatgtgtcaggattatttgtccagctctggtctttgcagtcaggagaccttagaaatcaacaacgataaagtggcggagtctttgggaatcaccgagtttctccggaagaaagagatccacccggacaacctggggccgaagcacctttctcgagatatggatggcgagcagcttgagggtgcctcttccgagaaaagagaaagagaggctgctgaggagggtctggccagcgtgaagcgaccgcggcgcgaggcactgagcaatgatacaactgagtctctggccgccaatagccgggggcgcgagaaacccagacccctccacgctctggccgccggtttttcaccacccgtgaacgtgacagtttcgccacgatccgaggagtcccacacaaccacagtgtcgggcggcaacggtagtgtgtttcaggccggcccccagctccaagcgctcgctaatttggaggccaggcgaggaagtattggcgctgccctgagttcccgcgatgtgtcaggcctgcccgtgtacgcccagagtggtgaaccccgtaggttgacccaggcccaagtagccgcgtttcccggagaaaacgcactggaacattccagcgaccaggacacctgggactctttgaggtcacctgggttctgttcaccactgtcctcaggaggcggagccgagtcactgccacctggcgggccagggcacgccgaagccgggcatctgggaaaggtatgcgactttcatcttaatcaccaacagccctctcctactagcgtgctccctactgaggttgccgcccccccgctggagaaaattttgagcgttgatagcgtcgcagtggactgcgcctacaggactgtgccaaagcccggcccgcaaccagggcctcatggcagtctactgactgaaggctgtcttcggtcgctgagtggagatttaaatcgcttcccgtgtggtatggaagttcactccggtcagcgggaactagagtcagtggttgccgtgggtgaggcgatggcctttgagatctctaatggcagccatgagctgctaagccaaggccaaaagcagatcttcattcagacaagtgatggccttatcttgagtccacctggcacgatcgtcagtcaggaagaggatatcgtcactgtaactgacgctgaagggcgagcatgtggatgggcccggtag

SEQ ID NO: 35094 - DNA, 2436 bp, Artificial Sequence
  Description of Artificial Sequence: Synthetic coding sequence
atgctactgccaaccaccatacagccacagaccgcacgcaaatctcagttgccccgaggaaactcctgcctcgttggacttcatattgcgagccctcagctgctccgggtccagcccctggtacgtaccgagcctcagtcatgctttctcagcgatctttgtcagcctcctgcccagggttttgtccagcggcccctccccgcgttgcaggttgttccagccaagcgcgttcccgcaccaaaagctcctgacgaacaggggtccatgctgacccccctgagtgccagtgaccccctggccgtgacgtctctatcgagcagctccgcacacccattcattagtaatcttcatactaggcatacagagaagctcaaaaagtcgttgaaggtgaagacgagaagcggtagggtatctcgccccccaaagtacaaggctaaagactacaaattcataaaaactgaagacctggccgacggccacctgtccgactctgacgactactccgaactgtgcgtggaggaagacgaggatcagcgggagcgccatgctttatttgacttaagttcttgctcacttaggcccaaatcctttaagtgtcagacttgcgaaaaaagctacatcgggaagggcggcctggctagacatttcaagcttaacccaggccatggccagcttgatcctgagatggtcctctctgaaaaagcatcggggtcaacattacgagggtgtaccgaagaacgcactctgtccctcacttctttgggcctctctatgccagccgacccatgcgaaggcggagctcgaagttgtttagtgactgaaagcgctcgaggcggacttcaaaacggtcagagtgtggatgtcgaggaaactttgcctagcgagccagaaaacggagcacttctgcggtctgaacggtatcagggaccacggcggagagcttgctcagaaacgctcgccgaatctagaacggccgttcttcagcagcgacgggcagcccagctgccgggaggacccgccgccgcaggcgagcagagagccagcccttctaaagccaggctgaaagagtttttgcagcagtgcgaccgcgaagatctcgtggaactcgcgctgccacagctggcacaggtggtgacagtttacgagtttctgttgatgaaagtggagaaagaccacctggcaaaacccttcttcccggcgatttataaggagttcgaagagctgcacaaaatggtgaagaaaatgtgccaagattatttgagttcctccgggctctgttctcaggagactcttgagatcaacaatgacaaagtggctgagagtctgggaatcactgagttcctgcgcaagaaagaaatccaccccgataatctcggcccaaaacatctttcaagggatatggatggtgagcagcttgaaggcgcctcctcagagaagcgtgagcgggaggcggctgaggagggcctggcatctgtgaaacgccctagacgcgaagccttaagcaatgataccaccgagtccctagctgctaactctaggggaagagaaaaacccagacccctgcatgctcttgcagctggatttagcccaccggtgaacgtaacagtttccccccgttccgaggagtctcacaccaccaccgtttccggcgggaatgggtcggtgttccaggcaggtccacagctgcaagcactggccaacctagaagcgagaaggggtagtattggggccgcactatccagcagagacgtaagtgggctgcccgtttatgctcagagtggcgaaccgcggaggctaacgcaagcccaggtcgctgcgtttcccggagaaaacgctctcgaacattctagtgatcaggacacatgggactctctcagatcccccggcttctgcagtccattgtcatctggaggcggggccgagtccctgccacccggcggaccgggtcatgcagaggccggccatctgggcaaagtttgcgactttcatttgaatcaccagcagccatcccccacctccgtgttgccgactgaggtagctgctccgcctttggaaaaaatactttctgtggattcagtcgccgtggattgtgcttacaggaccgttcctaagcccggacctcagcctgggccacacggatcacttttgacagaagggtgtctgagaagcttatcaggcgacctgaaccgcttcccttgtgggatggaggtgcactcaggacagcgagagctcgagtctgtggtggcagtgggagaggctatggcatttgagattagcaacggatcacatgaattgctgagccagggacagaaacaaatctttattcagactagcgatggcctgatcctgtcccctccgggcactatcgtaagtcaagaagaagatatagtgacagtgacagacgctgaagggagagcatgtggatgggcacgctag

SEQ ID NO: 35095 - DNA, 2436 bp, Artificial Sequence
  Description of Artificial Sequence: Synthetic coding sequence
atgctgcttccaaccactatccagcctcagactgcccggaagtcccaactgccccgtggcaatagctgcttagttggactccatatcgcctccccccaattgttaagagtacaacccctggttaggacagaaccacagtcttgtttcctctcagatctgtgtcagccacctgctcagggatttgtgcaaagacctctgcctgctttgcaagtcgtaccagcaaaacgggtgcctgcccctaaagccccagacgagcagggctccatgctgacccccctgtccgcaagcgatccactggctgtcacatcactttcctcttcgagtgcacacccttttatcagtaacctgcacactcggcacactgagaaattgaaaaagtcgctaaaagtgaagacacgaagcggtcgcgtttcccggccacctaagtacaaggcgaaggactacaagttcattaagaccgaggacctcgccgatggacatctgtctgacagtgatgactactcggagctgtgtgtggaagaggatgaggaccagcgtgagcgacatgcactattcgatctgtcaagctgcagtctcaggccgaaatccttcaagtgccaaacgtgcgagaaatcttacatcgggaagggggggctagcgcggcattttaagttgaatcccggccacggacaacttgacccggaaatggttctgagtgagaaggcctccggcagtaccctgcgtgggtgcacagaagagcggactctgtcacttacatctttgggcctgtcgatgccagctgacccatgcgaaggaggagcgcggtcttgcctggtgaccgagagcgcccgcggagggctgcagaatggacagagcgtggatgtggaggaaaccttgcctagcgaacccgagaatggagcccttcttagatcagagcggtaccagggacctcgtcgacgggcatgtagcgagactctggcggaatctcgcaccgctgtgctgcagcagcggcgagccgctcagctccctgggggaccagcagcagccggcgagcaacgagcaagcccatccaaggctaggcttaaagagttcctccaacagtgtgatcgcgaagaccttgtggagttggccctcccccagctcgcacaggtagtgacagtgtacgagttcctgctgatgaaggtcgaaaaagaccacttggctaagcctttcttccccgccatttataaggaattcgaggagcttcacaagatggtgaagaagatgtgccaggactatctttcgtcctctggcttatgttcccaggagaccttggaaatcaacaatgacaaggttgctgagtctctcgggattaccgaatttctccgtaagaaagaaatccatccagacaatctgggccctaaacatctgtcccgggatatggacggggaacagctcgaaggggcatctagtgagaaaagggagcgggaggccgctgaagaaggattagccagcgttaaaagacctagaagagaggcgcttagcaatgataccactgagagcctggccgcaaacagtcggggtcgggaaaagcctaggccactgcacgcactggccgctgggttcagcccacccgtaaacgttaccgtatccccacggtcagaggaatcacacaccactactgtcagcggggggaacggcagtgtgttccaggcaggaccgcagctgcaagccctggctaacctggaggcccggcgaggatccatcggggctgcattgagtagcagagacgtcagtggactgccagtatatgcccagtccggcgaacctcgacgactaacgcaagcccaggttgctgcatttccaggagaaaacgctctcgagcactctagcgatcaggacacctgggactcgctgcggtctcctgggttttgtagtccgttgtccagcgggggcggcgctgagtccctgccccccggcgggcccgggcacgccgaggctggccatcttggtaaagtatgcgacttccatctaaaccatcaacaaccttctcccacctctgtactgcctacagaggtcgctgcgccgcccttggaaaagatcctgtcggttgattctgtggcggtggattgtgcgtatagaaccgtgcctaagccgggcccacagccaggtccacacggaagcctactgactgagggatgcttacgatcgctcagcggcgatcttaacaggttcccatgtgggatggaggtgcattccggccagcgggaactggaaagcgtggtcgcagtgggtgaggctatggcctttgagatctccaacggctcccatgaactgttatcacaggggcagaaacagatctttatccaaacttctgacggtctcattctgtctccccctggaacaattgtttcacaggaagaggatatcgtcacagtgacggatgctgagggccgggcatgcggctgggcaagatag

SEQ ID NO: 35096 - DNA, 1047 bp, Artificial Sequence
  Description of Artificial Sequence: Synthetic coding sequence
atgcgctcgctaccttttgcccttaccgttgaaagcgtctctgccagggcgccaacatgctgtagcaccggcagattcacccaagggcgacagccttgtaagtgcaaagcctgtggccgcggctttacacaatccgcatctcttctgcagcattggagagtccattccgactggcgcgagaccctgtccctctcccctgtgaggcaggatctcctctggcccctccagccccaccaagcccctgcaagccctcttggacgctcccattcttcggctggggtgcggcagggattttccggacagctgtgttgctggcttaccaaggaacataccctggccgaggccctgcgtctgtcccccgtacctgccggcttttggggcccagtggaagcagatcggcccccagcgaacagccaccgtcgcgtttgcccgttctgctgttgctcatgtggcgactcagtcaacgagaaaacgagcctgtcccaacgtgttcttccgcacccgggtgagaaaacatgccgggggggttcggtcgagagtgtctctttggccccctccagcgtcgcccctgattcgacctctggcctaagaccttgcggcagtccggggtcttttctgcaacacctccccccatccacactgctgccacgtcccccattcctgtatcccgggccacctctctcactgcagcctttggtcccatctggtctcccggccgtgcctgcggtaccgttaggaggtctcgaagtcgctcaggtacccccggcaactcagcctgccgcgcagcaggaaggcgctatggggcctcgctcgtgcgccagtgccggccgagattcccgggaggcggtccaagctcctgggtaccctgaaccggctcgcaaggcatctcagcatagagccgccggtcctcttggtgaggccagggctaggcttcagagacagtgtagggcaccaccaccaccctccaatccccattggagaggagcacttcctgtattcccggtatggaaagcttctagccgtagaagtaatctcgctcggcactag

SEQ ID NO: 35097 - DNA, 1788 bp, Artificial Sequence
  Description of Artificial Sequence: Synthetic coding sequence
atgggacccctgacatttagggatgtggcgatcgagttcagcttgaaagagtggcagtgcctggatactgctcagagaaatctttatcgcaacgtcatgctggaaaattatcggaatttggttttcctcgggattaccgtgagtaaacccgacctcatcacatgcctggaacagggtaaagaggcatggtctatgaagcgccatgaaatcatggtggcgaaacccaccgtgatgtgctcacacttcgcccaggacttgtggcctgagcagaacatcaaagattcctttcagaaagtaaccctcaaaagatatggaaagtgtaggcatgagaacttgcctctgcgcaagggttgtgaatccatggacgaatgcaagatgcataagggtggctgcaatggcctaaatcaatgccttactgccacccaatctaagatctttcaatgtgacaagtatgttaaagtggcacataaattttccaacagcaacagacacgagattaggcacacgaagaaaaagccgtttaagtgcacaaagtgtggcaaatcctttgggatgatatcttgcctgaccgagcatagcaggattcataccagagttaatttctataaatgcgaggaatgtggaaaagccttcaactggagttctacccttaccaagcataagcggattcacaccggggagaagccttacaagtgtgaggagtgcggcaaggcattcaatcagtccagtaacttaatcaagcataagaagatccataccggtgagaagccatataagtgcgaagagtgtggaaaaacattcaacaggtttagcactctaactacacacaagattattcacaccggcgagaagccctacaaatgcaaagaatgtgggaaagccttcaatcgctccagcactctgacgactcatcggaagattcacacaggagaaaaaccatacaaatgtgaagaatgtggtaaggccttcaagcagagcagcaatcttaccacacacaaaatcattcatacaggagaaaaaccatacaaatgcaagaagtgcgggaaggcatttaaccagtccgcgcatctgaccacacacgaggtgatacacactggagagaaaccttataagtgcgaaaagtgcggaaaagctttcaaccatttctcccacctaaccacacataagatcatccacaccggtgaaaagccgtacaaatgtaaggagtgcggaaaagcattcaagcactcttcaacgctgacaaagcataaaatcatccacaccggcgaaaagccttataaatgtaaggagtgtgagaaggcttttaaccagagttccaagttaaccgaacataagaagatacacacaggagagaaaccttatgaatgtgaaaagtgtgggaaggccttcaaccagtcaagcaacctgacccgacataaaaagtctcataccgaggaaaagccctacaaatgcgaggagtgtgggaagggctttaagtggcccagtactctgacaatccacaagataattcacacgggtgaaaaaccctacaagtgtgaggagtgtggaaaggcatttaaccagtcctccaaactgacgaagcataagaagattcacaccggggaaaagccttatacttgcgaggagtgtgggaaagcctttaaccagtccagtaaccttaccaaacacaaacgcattcacactggcgagaagccttacaagtgcgaggagtgcgacaaggcattcaaatggagtagcgtgctcaccaagcacaaaataatacatacaggcgaaaagctgcaaatctag

SEQ ID NO: 35098 - DNA, 3273 bp, Artificial Sequence
  Description of Artificial Sequence: Synthetic coding sequence
atgaacatggaggggttggtgatgtttcaagatctttctattgacttcagtcaggaggaatgggagtgtcttgatgcagcccaaaaggacctgtacagagacgtgatgatggaaaactactcctctttggtgagcctcggcctctccatcccaaaacccgatgtaatatcgctcctggagcaggggaaggaaccatggatggtatctcgcgatgtgctgggcggctggtgtcgcgattccgaatttaggtgcaagacaaaagattcctgcttacccaaggagatctatgaagtaacaagtagtcagtgggtgcgcatggagaagtgccattcacttgtcggcagcagtgtcagggacgattgggagtgtaaaggtcagtttcaacatcaggacatcaatcaggagaggtatttggaaaaggctatcatgacatatgagacaactcctaccttttgcctccagacgagtctcacccttcaccaccggatacaccctggagagaagctctataagagcacagaatgtatggcgttcaaatatgggagcgagttgactcaacaacaagagactcacaccggagagaagttatataagtgtaaggaatgcggaaaggcatttcaccacttcagctatcttgtaaaacatcagcgtatacacactggcgagaagccgtgcgcttgtaaagaatatgggaaggcattcattagcggttcacaccttatccagcatcagaaaatgtatactgacgaacgcccacacgagtgccaggagtcggtaaaggcttttcgcccttccgctcatctcatccagcactggagaatccacacaggagataaaccttatgaatgtaaagaatgcgggaaatcctttacttcaggaagcacgctgaaccagcaccagcaaattcataccggtgagaaaccttatcactgcaagcaatgtggcaagagtttcacagtggggtccaccctcattcgccaccagcagatccatacgggcgagaaaccctatgactgtaaagagtgtggcaagagcttcgcttcgggttctgcactgatccggcaccagaggatccacaccggagagaagccatacgactgcaaggagtgcggcaagagttttacattccacagcgcgctgatcaggcaccaaaggatccacacaggggagaagccctatgactgtaaagaatgcgggaaaagcttcactttcaggtctggactgatcggacatcaggctatccacacaggcgaaaaaccttacgattgtaaggaatgcgggaagtctttcaccgccggatctaccctcattcagcatcaacgtattcacaccggcgagaagccttacgactgcaaggaatgcggcaaatctttcgccagtggatctgccttgctgcaacatcagcgaattcacacgggagagaaaccatactgttgcaaggaatgtggcaagtcctttaccttcagatccacgcgcaaccgtcaccagaggatccatacaggcgaaaagccatataactgcaaggaatgcggcaaatcttttgcttctggcagcgccttactccagcatcagcgcatccacaccggggaaaaaccctaccattgcaaagaatgcggaaaatccttcacgtttcgaagtgggttgatcggccaccaggcagttcataccggcgagaagccatacgactgcaaagaatgtggaaaaagtttcacaagccgcagtgctctgatccagcaccagagaatccacacaggcgagaagccttaccattgcaaagaatgtgggaagagctttactgtaggctccaccctcttacagcaccagcagattcacacaggtgagaagccttacgattgcaaagaatgtgggaaggcctttcgcctccggcttcgcttgacacagcaccagcagatacatacaggggagaaaccatatcaatgccaagagtgcgggaaggcattcgttagtgtgtccggactgacacaacaccacaggatacacacaggtgagaagccatacgagtgcccggactgcgggaaagcatttcggcaaagaacctatctgaatcagcatagacgcatacacacaggagaaaaaccctacgaatgcaaagagtgtgggaaatccttcacattttgctcaggccttatccagcaccaacagaaccacacagatgagaagccttacgacgggaaggaatgcggcaaatcatttacctcccattcaactctaatccagcaccaacagattcatactggcgaaaaaccatatgactgcaaagaatgtggtaagagctttaccagtcacagtactcttatccagcaccagcagatccataccggggagaagttgtacgactgcaaggaatgtggcaagtcatttacttctcactctacactaatccagcaccagcccctgcatacaggcgagaaaccctaccactgcaaggaatgtgggaagtcttttaccctgagatccgctctcatccagcaccgccccgtacatacaggagagaaaagatacagttgcaaggaatgtggcaagtcctttaccagccggagcactctcattgaacatcagcgcatccatacaggagagaagccataccattgtaaggaatgcggaaagtctttcgcctttaggagtgccattattcagcaccgtcgtatccataccggcgagaaaccatacgattgtaaggagtgcggtaaggcatttcgaaggagatcaaaactgacccagcatcagagaatccacaccggcgagaaaccatacaggtgtcatgagtgtggtaaggcctttgtacggtttagcggattgacaaaacaccactccatacacactggcgagaaaccctatgagtgcaaaacgtgcggcaagtccttcaggcagagaacacacttgacattacaccagaggattcatactggagacaggccctacgaatgcaaagagtgtggcaaaagcttcacatgtggcagtgaactcatcaggcatcagaggacccacaccggagagaagccttatgattgcaaagaatgtggtaaagctttcaggtgtccatcccaactgtcccagcacaagcgaatccatactggggaaaaaacctatcaatgccccgagtgtggcaaggctttcttctacgccagcggcttatcccgccaccaatctgttcacaccggagaaaagccgtatgagtgcaagacctgtggcaaagctttcaagcagctgactcagctgacacgccaccagcggatacatgacctcacatag

SEQ ID NO: 35099 - DNA, 1593 bp, Artificial Sequence
  Description of Artificial Sequence: Synthetic coding sequence
atggtgcgtccacaggataccgtcgcatacgaggacctctcagaagactacacacaaaagaagtggaagggcctggctctaagtcaaagggctctacattggaatatgatgctggagaacgaccgctcaatggcttctctcggcaggaatatgatggagtcttcggagctcacgcctaagcaggagattttcaaaggcagtgagtcgagcaattccacgtcaggaggcttatttggggtggtgcctggggggaccgaaacgggggatgtctgcgaggataccttcaaggagctggaaggacaacccagtaacgaagaaggctcccgactagagagtgacttcctggagatcatcgacgaagacaaaaaaaaaagcactaaggacagatacgaagaatataaggaggtcgaggagcatccaccgctttcatcatctcccgttgaacatgaaggggtgttaaagggacagaagtcttaccgatgcgatgagtgcgggaaagccttctattggtccagccatctgataggtcaccgaagaatccacacaggcgagaaaccttacgagtgcaacgagtgtggtaaaacgttccgacaaacaagccaactcatcgtccatctccgtacccacaccggagaaaagccatatgagtgttcggagtgtggtaaggcataccgacattcatcccacctcatccagcatcagaggctgcacaatggtgagaagccctataaatgcaatgaatgcgccaaagccttcaatcaaagttccaagctattcgatcaccagcgcacacacaccggggagaagccctacgagtgtaaagagtgcggcgctgcttttagccggtccaagaaccttgtgcggcaccagttcctgcatactggaaaaaaaccttacaaatgtaacgagtgtggccgagccttctgctccaatcgcaatctaatagatcatcagaggactcatacaggagagaagccttacaagtgcaacgagtgcgggaaagcctttagccgatcaaaatgtctgattcggcatcaatctctgcacaccggggaaaagccctataagtgctcagagtgcggaaaggcattcaaccagatttcacagctggtggaacacgaaagaatccatacaggggaaaagcctttcaaatgcagtgagtgtggcaaggcttttggacttagtaaatgtctgattcggcaccaacgtcttcacacatctgaaaaaccttataagtgtaacgaatgcggtaagtcattcaaccagaactcctacctgatcatccatcagcgaatacacaccggtgaaaagccctacgaatgcaatgaatgcggaaaggttttctcgtacaatagctctctgatggtgcaccagagaactcacaccggcgagaaaccgtataaatgtaacagctgtggaaaagctttctctgatagctcgcagctgactgtccaccaacgtgtacacacaggagagaaaccctacgaatgtatcgaatgcggaaaagctttcagccagcgtagcactttcaatcaccaccaaaggacacacgctggcgagaaaccatcgggcctcgctcgttccagtagttag

SEQ ID NO: 35100 - DNA, 1632 bp, Artificial Sequence
  Description of Artificial Sequence: Synthetic coding sequence
atggtgcgccctcaggacactgtagcatatgaggacctttctgaggattacactcagaaaaagtggaaaggtctggccctgagtcaacgggcattgcactggaatatgatgctcgagaatgaccgctccatggcctcattgggcagaaatatgatggaatcttccgaattaaccccaaaacaggaaatctttaagggctcggaaagctctaattctacctctggcggtctttttggcgtagtccccgggggcacagaaactggtgacgtgtgcgaggacacgttcaaggagctggaaggacaaccttcgaatgaggaaggttcacggctggagtccgatttcctcgagattatcgacgaagataaaaaaaagagcaccaaggaccgctacgaagagtacaaggaggtggaagagcatccgcctctgtcctcaagccctgtggagcatgagggggtactgaaaggacagaagagctaccggtgtgatgagtgcggcaaggctttctattggagttctcacctaatcgggcaccgacggattcatacaggggagaagccctacgaatgtaacgagtgcggaaagacctttaggcagactagccagctgatcgtgcaccttagaactcacaccggcgagaagccatacgaatgttcggagtgcggcaaggcgtatcgtcattcgagccacctcatacaacatcaacgcttgcacaacggcgaaaagccctataaatgtaacgaatgcgcaaaggcctttaatcaatccagcaaactcttcgatcatcagcggacacacaccggagaaaagccgtacgagtgtaaggagtgcggggccgccttttctcgaagcaaaaacctagtaagacatcagtttctgcacactggcaaaaagccgtacaaatgcaacgaatgtggccgtgccttttgctccaacaggaacttgattgatcaccaacggacgcatactggcgaaaaaccttacaaatgcaacgaatgcggaaaggcatttagccggtccaagtgcctgatccgacaccaatccctgcatactggggaaaaaccctacaagtgcagcgaatgtgggaaagcctttaatcagatctcccagctggtggagcacgaaagaattcacaccggagaaaagccgttcaaatgcagcgaatgcgggaaagccttcggcctgtctaagtgcctcattcgccatcagagactccatacttctgagaaaccctacaagtgcaacgaatgtggcaagtcattcaatcagaatagctacctgatcatacatcagagaatacacacaggtgaaaaaccctacgagtgtaatgagtgcggcaaagtcttttcctacaactcctccctgatggtgcaccaaagaacacacacaggtgaaaagccctacaagtgtaattcctgtggcaaagccttctccgactcctcgcagctgaccgtacaccaaagagtacatactggggagaagaaccttatgaatgtgttatctgtagggaaacccctggtgtccgtgccgctgttgatcacgacttcagagctgatgctggagaggtctccacaagtatggctcggccatctgctgaaggcctggtttagcgaaactgattcgaaggatctgtag

SEQ ID NO: 35101 - DNA, 1980 bp, Artificial Sequence
  Description of Artificial Sequence: Synthetic coding sequence
atgctgcaccagccaactccaggaaataggggactaactgcccgcatggaggtgggtccagcaacggagacattcgtgctcgagcttcagtgtctggaggatgggggccccgggcctgacaccctgagcggaggctctggcgggagcgagtctcaggaagaggaagagccacaggagcgcaacagctcacctcagaggccggcagtcagcgcacctgtcggtgcttctgagattgccgaggagactaggccgggccagcgggaattacagctgcagcaacttgagcagcagcccgagccacaacagcagccacagcatgagcaactgcaacagcctcagcctcacctggagcttcagcagcagccacaacaagacggacagcaacaactgagccagctgcaacaagagaagcatcaaagtgttcaccaccaggagctcaaacctgagcttcagctgatgcaccagcagcagcagctccagccgcagcaagtgcaggagcagcagcgactccagcagcaacaggaacagctccaaacccagcaggctcaagaacagcaggtattgcagcagcaggagcagttgcagcagcaggtgcaggagcagcaactgctgcagcagcagcaggagcagcttcaacaacaacagctcctgcagcagcaggagcagctgcagcagcagcaattccagcaacagcaggaacagcttcagcagcagcagcagctccttctgttgcagcaacagggacagctgcaacagcagctgttgcagcagcagcaggcccagctgcaacagcagctgttggaacagcagcaagcccagctgcaacaacaacttctgcttcagcagcaggagcagctgcagcaacagcagcagcagcaactgctgcagcagcagcaagagcagcttcagcagcagcagctccagcccccccctctcgaaccggaagaagaggaggaggtcgaactggagctcatgcccgtggacctggggtctgagcaggagctggaacagcaaaggcaggaactggagcgtcagcaggagctggagcgacaacaggagcagagacagcttcagctcaaactgcaggaagagcttcaacagctggagcaacagttagagcaacagcagcaacaactcgaacagcaggaggtgcaactggaattgacacctgtggaactgggagctcagcaacaagaggtccagcttgaactgaccccagtgcagcccgaactgcagctggaactggtgccagccgctggaggcggcggagccgccgttcccggagcccccgcagcagtagttgtcgccccgcctggttatgtggtcgttcaggagctgatggtgctgcccgctgtcgcagcaccagcagtcgtcgccattcctgggcctgccggtagtgctgctttgacccccgctaggcagcgccggaggaggagagctcgcgaccgccctacgatatgcggtgagtgcggtaagggattcagcaggagcacggacctggtgcggcatcaagcaacacacaccggcgagaggccccacaggtgcggagagtgcggcaagggcttttcacagcactctaacttagtaacacatcagaggatacatactggcgagaaaccgtatgcttgtagctattgtgctaagcgtttctccgagagttccgcactagtgcagcatcagcggacacacacgggcgagcggccctatgcttgtggggactgcgggaaaaggttcagcgtatccagcaatcttcttcggcaccgcaggacgcacagtggtgaaagaccatacgtgtgcgaggattgtggggaacggttcagacataaggtccagattaggaggcacgaaagacaactacatggggccgggaggtcacggggccttgggctcctccgggcttccagaccagctgccttgggcggtccagctagagctgagcaggctgccaccgcaacagcccccgcagataaggcactatag

SEQ ID NO: 35102 - DNA, 3180 bp, Artificial Sequence
  Description of Artificial Sequence: Synthetic coding sequence
atggaggccaaccctgctggctccggcgctggagggggtgggtccagcggtatcggcggtgaggacggagtacactttcagtcctatccttttgattttctggaattcctcaaccatcagaggttcgagccgatggaattgtacggggaacacgccaaagccgtggcagccctgccatgcgctccaggccctcctccccagccaccaccccaaccccctcccccgcagtacgattaccccccacagagcacttttaaacccaaggctgaggtgccgtctagttcaagcagctcttccagttccagctcctcttcgtcttcctcaagctcaagcagttcttcatcctcatcccaggcaaaaaaaccggacccccctctgccgcccgcatttggggcaccccccccccccctcttcgacgcagctttcccaacgccccaatggggcatcgtggatttgtctggtcatcagcacctgttcggcaatttaaaacgcggagggccggcatcagggcctggtgttacccctggactcggtgctccagcaggggcccccggacctttgcccgcccccagccagactcccccaggaccccctgcagctgcagcctgtgatcccaccaaagatgacaaggggtactttagacggctcaaatatttaatggaacgacgatttccttgcggtgtgtgtcagaagagttttaagcagagtagccacttggtccagcatatgctggtgcactctggtgaacgtccctatgaatgtggggtttgcgggaggacttacaatcacgtttcttcactgatccgccaccgacgttgtcacaaagacgtgccacctgctgcaggtggtccacctcagcccggcccacatttgccaccactcggactgccagcccctgctgctagtgctgcaactgcggcagccccgagtactgtttcatctggtcccccggctacgccagtcgcccctgccccaagcgctgacggctctgcagcacccgcgggcgtgggtgtgccgcccccggccactggcggaggagatggcccttttgcctgccccctgtgttggaaggtgtttaagaagccctcccacctccaccaacaccagatcatacacaccggagaaaagccattcagttgcagtgtctgctccaaatcctttaataggagggaatctctcaagaggcatgtgaaaactcattctgcggacctgctccggctgccctgcggaatttgtgggaaagcctttcgagatgcatcataccttctaaaacaccaagctgcccacgcaggtgcaggcgcgggcgggccacggccggtatatccttgtgatctctgtgggaaatcttacagtgctcctcagagccttctgcgccacaaggctgcacacgctccacccgctgcagccgccgaggctcccaaggacggagccgctagcgccccccagccccctccaaccttccctccgggcccttatcttctgcccccagacccacccaccactgacagtgagaaagccgccgctgcagccgctgcggtggtgtatggggctgtacccgtaccccttctaggagctcatcctctcctcttgggaggggcaggcacctctggcgccggcgggtcgggagctagtgtacctgggaaaaccttctgttgcggaatttgcggccggggcttcggccggagagagactttaaagaggcatgaacgcatccacacgggcgagaagcctcatcagtgtcccgtgtgtgggaagcggttcagagagtcctttcatctctcgaagcatcatgttgtgcacacaagggagcgtccctataaatgtgagctgtgtggcaaggtgtttggctatccccagagcttgaccagacacagacaggtgcatcgcctccagctgccgtgcgcgctagcaggagccgccggtctgcccagtacccaggggacccctggcgcttgtggccccggcgctagcggcacttctgcaggcccaactgacggtcttagctacgcgtgttctgattgtggagaacatttccctgatctgtttcatgtgatgtctcataaagaggttcacatggccgaaaaaccgtacgggtgtgatgcctgcggcaagacatttggcttcatagaaaatcttatgtggcataaattggtgcaccaggccgctccagaacgtctgctgccccctgccccgggagggctgcagcctccagacggatcctccggaaccgatgccgcaagtgtgttagacaatgggctcgccggggaagtgggggctgcggtggcggctctcgcaggagtgagtgggggcgaagatgccggcggcgccgccgtagccggtgcgggcgggggcgcctcttccggccccgagagattttcttgcgcaacttgtggtcaaagctttaaacactttctcgggctcgtgacccataaatatgtgcacttggtgagacgtacactgggctgcggcctgtgcggccagtccttcgcaggagcttacgacctgttgctccaccggcggtctcaccggcagaagcgcggtttcaggtgtccagtgtgtggaaagcggttttgggaagcagcgctgctcatgcgtcaccaaagatgccataccgaacagaggccctataggtgcggcgtttgcgggaggggatttttgaggtcttggtatttacgtcagcaccgggtggtacacactggcgaaagagctttcaagtgtggcgtttgcgctaaacgttttgcccagagctcctcattagccgaacatcggcgactgcatgctgttgcacgcccccagcggtgctcggcctgtggcaaaaccttcagatataggagcaatcttctggaacatcagaggctccacttgggggaacgcgcttacaggtgtgaacactgtggcaaaggcttcttctatttatcttcagtgctccgccatcaaagggctcacgagccaccacggcccgagctgaggtgtcctgcatgcctgaaggcctttaaggacccgggttacttcaggaagcatctcgctgcccaccaaggcgggaggcccttcagatgttcttcttgtggggagggctttgctaatacatatgggctcaaaaaacacaggctggcccataaagcggagaatctcggtggccccggcgccggggctgggactctggcaggtaaggacgcctag

SEQ ID NO: 35103 - DNA, 1596 bp, Artificial Sequence
  Description of Artificial Sequence: Synthetic coding sequence
atggactcagtcgcctttgaagacgtggccgtaaacttcacacaggaagagtgggccctacttgatccctcgcaaaagaacctttatagagaggttatgcaggagacacttaggaatctgacctcgatcggtaaaaaatggaacaaccaatacatcgaagacgaacaccagaatccacgccgcaacctcagaagactcatcggagagaggctctcggaatcaaaggaatcccatcagcacggggaggtgctgactcaggtccccgacgatacactgaaaaagaagacccccggggtccagagttatgaatcgagtgtttgtggagaaatcggcattgggctcagctcacttaatcgccatttgcgggcctttagctatagctccagcctcgccattcacgggcgaacgcacactggtgaaaagccttacgaatgtaaagagtgtgggaaggcttttcgcttcccttcctccgtgcggcggcacgagcgtatccattctgcgaaaaagccttacgagtgtaagcagtgtggaaaagccttcagcttcccgtcgtccgtaagacgtcatgagaggatacacagcgctaagaaaccatatgagtgtaagcaatgcggaaaggctcttagctacctggtcagtttccagacacatatgcgcatgcatactggagagaggccacataaatgcaatatctgcggcaaggctttcttctccccctcgtcactaaaaagacatgagaagtcacatacaggagaaaagcgttacaaatgtaaacagtgtgacaaagcttttaactgcccaagcagctttcagtaccacgaacgcactcactcaggcgaaaagccctatgaatgtacacagtgcagaaaagctttcaggtcggtgaaatacctcagagttcacgagaggaaacatacaggtgagaagccatacgagtgcaagctgtgcggcaaaggctttataagctccacgtcattccgatatcacgaaaagacccacactggggagaaaccttatgaatgcaagaagtgtgtgaaggccttttcatttgtgaaagacttaaggattcatgagcgcacccacaccggagagaaacccttcgagtgtaaacagtgcggcaagactttcacctcctccaacagctttcactaccacgaacggactcatacaggagagaaaccctacgaatgtaaacagtgtggcaaggcttttaggtccgcttccgtgttgcaaaagcatattcgcacccatacgggggagaagccatacggatgcaagcagtgcggcaaagtgttccgcgtggcttctcagctgaaaatgcacgagcgaacacataccggcgagaaaccatatgaatgtaagcaatgcggaaaagcattcatttcttcaaattcaatccggtaccacaaaaggactcacaccggagaaaaaccatacaaatgtaagcaatgcgggaaggcttttatttccagtaacagttttctgtaccatgagaggatacatacaggcgagaagccttacgagtgcaagcagtgcggaaaagcatttagatcggcatcaatcctgcagaagcacgttcgcacacatgccgggtag

SEQ ID NO: 35104 - DNA, 297 bp, Artificial Sequence
  Description of Artificial Sequence: Synthetic coding sequence
atgctccggcggggccacttggcattcagggacgtcgccatcgaattcccacaggaggaatggaagtgtcttgatcctgcccagcgtactctataccgggaagttatggttgaaaactacagaaatctggtctttctaggcatttgtctgccggatctcagcgttataagtatgttggagcagcggcgtgacccgcggaatttgcagagtgaggtgaaaatcgcaaacaaccccgggagctgctccgtcacccaggcagtcgtggaatggcagagtagtgtcgcaatcgtagcgtag

SEQ ID NO: 35105 - DNA, 1734 bp, Artificial Sequence
  Description of Artificial Sequence: Synthetic coding sequence
atgctcaggcgaggccatctggcattcagggacgtcgccatcgagttcccgcaggaagagtggaagtgtctcgaccccgcccagcggacactttacagggaagtaatggtggagaattatcgcaatctggttttcctggggatctgtctgccagatctcagtgttatcagcatgctggaacaaagacgcgaccctcgaaatctccagagcgaggtgaaaatcgcaaataacccaggcggcagggagtgcataaagggagtcaacgcggaatcctcatccaaactgggatctaacgccggcaataaatccctgaaaaaccagttaggtctgacattccagctacacctctctgagttacaactgtttcaggctgagaggaacatcagtggttgcaagcacgtggagaaaccaataaataattctttagtgagtcctctccagaaaatttattcctccgtaaagtcgcatattttgaataagtaccggaatgattttgatgatagcccatttctgccacaagaacaaaaggcccagattcgggagaagccgtgcgaatgcaatgaacacggcaaagcatttagggtgagtagtagactcgccaacaatcaggtaatacataccgccgacaatccatacaaatgtaacgagtgcgacaaggtgttcagcaacagtagcaacctggtacaacaccagagaatccataccggtgagaaaccctataaatgccatgaatgtggaaaacttttcaatcggatatccctgctcgcccggcatcaacggatccataccggggagaaaccttataaatgccacgagtgtggcaaggtctttacccaaaattcgcatcttgcaaaccaccacagaatccatacaggtgagaagccctacaaatgcaacgaatgcggaaaagtcttcaatcgaaacgctcacctggctcgccaccaaaagattcactctggagaaaagccatacaaatgcaaagaatgcgggaaagctttctctggagggagcgggctgacagcccacttagttattcacactggcgagaaactctacaaatgcaataagtgtgggaaggtgtttaaccggaacgctcatctgacgagacatcagcgtatacataccggcgaaaagccctatgagtgtaaagaatgcgggaaggtgttcagacacaaattttgcctgacgaatcatcatagaatgcataccggggaacagccgtacaagtgtaatgagtgcgggaaggcctttagggactgtagcgggctgaccgctcacctgctaatccacaccggcgagaaaccatacaagtgtaaggagtgtgctaaagtgttcaggcatagactgagcctaagcaaccaccaacggttccacacaggggagaagccataccggtgcgatgagtgcggaaaagatttcacgaggaattcaaacttggccaaccatcacagaatccacaccggtgagaaaccgtataaatgttcagagtgccataaggtgttctcgcacaattctcacttagcgaggcatcggcagattcatactggagagaagagttacaagtgcaatgaatgcggtaaagtcttcagccataaactgtacctgaaaaaacacgaaaggattcataccggagaaaagccatacagatgtcatgagtgtggtaaagacttcacacgcaatagcaacttggccaatcatcacagaattcatacaggagagaagccttaccgttag

SEQ ID NO: 35106 - DNA, 1635 bp, Artificial Sequence
  Description of Artificial Sequence: Synthetic coding sequence
atggctgtgatggatctctcgtccccttgggccctgactaaacaagactctgcatgcttccatcttcgcaacgccgaggaggagagaatgatagccgtgtttctaaccacttggttacaggagccaatgacctttaaagatgtcgccgtcgagttcactcaggaagagtggatgatgctagactccgcacagaggtccctctacagggatgtgatgttggaaaactaccgaaacctgacctcagtcgagtaccagttgtatagactaactgttattagcccgttagaccaggaggaaatccggaatatgaagaaacgtatcccacaggccatctgtcctgatcagaagattcagccgaagaccaaggaaagcacggtccagaaaatcctgtgggaagaaccatccaacgccgtgaagatgattaagcttacaatgcacaattggtcatctactctgagagaggactgggagtgtcacaaaatcaggaagcagcacaaaattcccgggggtcattggcgacagatgatctacgctcctaaaaagaccgtacctcaggaactcttccgcgattatcacgagttagaggagaattctaaactggggagtaaattgatcttcagccagagcattttcactagtaaacactgtcagaagtgctattctgagattgggtgcctcaagcataactctatcataaataactacgttaaaaattccatcagcgagaagttatacgagagccatgagtgcgatactactctgtggcactttcagcgcaaccagactgttcagaaggaatatacgtatagcaagcacggaatgcacttcactcataatatgttccccgttccaaacaacctgcatatggcccaaaacgcctgtgagtgcaacaaggatgagaccttatgccaccagagcagcttgaaaaagcagggacagacgcataccgaaaaaaagcatgaatgtaaccagtgtggaaaggccttcaagagaattagcaatctcacgctctataaaaagtctcacatgggagaaaagcagtacgagtgtaaagagtgcgggaaagtatttaacgactcgtctacgctgcgcagacacgttcgcacacacactggtgagaagccatatgaatgcaaccagtgcggcaaagcttttagccagaaaacatcactcaaggctcacatgcgaacacatacaggcgagaagccctatgagtgcaaccagtgcggaaagagcttcggcacatcctcctacttaattgttcacaaaaggatccatacaggagagaaactctacgagtgctccgaatgtggcaaagccttcaatacatcctcacacctgaaggtgcataaaaaaatacacaccggcgaaaacgtgtacgaatgtagtgactgtgggaaagtcttttcaggggtgtcttctctgcggatgcatatccggacacatactggggagaagccttacgaatgtaaggagtgccgtaaagctttttcagtgagcagcagcctacgccgtcacgtccgcatccatactggagaaaagccttacgagtgcattcagtgcggcaaagcattttcacagagctcatctctgattattcataaacggatccatactgagcgcgagacgctgtag

SEQ ID NO: 35107 - DNA, 2820 bp, Artificial Sequence
  Description of Artificial Sequence: Synthetic coding sequence
atggccacctcgcagtacttcgatttcgctcaggggggaggtccccagtactctgcacagccccctacgctgccactgccaaccgtaggcgctagttatactgcgcagccaacccctgggatggaccccgcggtcaacccagcattcccccccgcagcaccagcgggctacgggggctaccaaccacactccggccaggattttgcttacggatccaggccacaggagcccgtgcccacagcgacaaccatggccacttatcaggatagttattcatacggacaaagcgccgccgcacggagctacgaagatcggccttacttccagtctgccgccttacaaagcggtaggatgactgctgccgactctggacagccaggaacacaggaggcttgcggccagccctctccccacggttctcatagccacgcgcagccacctcagcaggcgccaatcgtcgagtcggggcagccagcttcgacattaagtagtggatatacataccctacagctacaggtgtccagcctgagtccagcgcttcaattgtaacgtcctatcctcctcccagttacaacccaacttgcactgcatataccgccccctcttatccaaactatgatgccagcgtgtactcggctgccagtcccttctacccccctgcacagccgcctcccccgccaggtccgccccagcaattgcccccgcccccagcccccgccggcagtggctcaagtccccgcgccgattcaaagcctcccctccctagcaaactgccaagacccaaggcgggccccagacagctgcaactgcactattgtgacatttgtaagatctcgtgcgctgggccgcagacctatcgggagcacttgggtgggcagaagcaccggaaaaaagaggccgcccagaaaaccggtgtgcaacctaatgggagccccaggggcgtgcaggcacaactccattgcgatttgtgcgccgtgtcctgcaccggcgccgacgcatatgccgcccacataaggggaagcaaacaccagaaagtattcaagttgcatgccaaattaggaaaacctatccccacacttgaaccagccctggctaccgaaagtccgccaggcgccgaggccaagcccaccagccctacagggccgtccgtgtgcgcatcatctagaccggcgctcgccaagcgccccgtggcgagcaaggccctgtgcgaaggcccgccagagccacaggccgcaggttgccggccccagtggggcaaaccggcccagcctaagcttgaaggcccaggcgccccaactcaggggggcagtaaggaggctcccgccgggtgttctgacgcccagccagtcggcccggagtatgtcgaggaggtattcagcgacgagggcagggtgttaaggttccactgtaaactgtgtgaatgtagcttcaatgacctgaacgctaaagatctgcatgtgaggggcaggagacatcgactccagtaccggaaaaaggttaatcctgaccttcccatcgccacagagccctcctccagggctaggaaggtcctggaggaaaggatgcggaaacaaaggcatctagccgaggagcggttagagcaactgcgacggtggcacgccgaacgtcgtcggttggaagaggagcccccacaggatgtcccgccccatgccccccctgactgggcacaaccactgctcatgggaaggccagagtctccggcgtcagcccctctacagcccggcaggagacccgcatcttccgacgataggcacgtgatgtgtaagcatgcaactatttatcccaccgagcaggagctcttggccgttcagagagccgtatctcacgccgaacgagcgttaaaactagtgagtgacacactggctgaggaagataggggaagacgggaggaggaaggggacaaacggagctccgtcgctccacaaacgcgcgtcctcaagggcgttatgcgggttggaatcttggcaaaaggcctcctcctgaggggcgaccgcaatgttagactggccttgctgtgctccgagaaacccacacacagtctgctgcgcaggatcgcacagcagttaccaaggcaattacagatggtgacagaggatgagtatgaagtgagctctgaccccgaggcaaacatcgtgatttcctcttgtgaggagccacgcatgcaggtaactatcagcgtgacctctcccttgatgcgcgaagatccttctaccgaccctggggtcgaggaaccacaggcagacgccggcgatgtcctgtctcccaagaagtgcctcgagagtcttgccgcgctgcggcatgcaagatggttccaggcccgcgcttcggggctgcagccgtgtgtgatcgtgattcgcgtgctgagagatctttgccggcgggtacccacctggggagccctacccgcatgggctatggaacttctcgtcgagaaagccgtcagctcagctgccgggcctctcggaccaggagacgctgtcagacgagtgttggagtgtgtcgctaccggaacacttcttacagacggtcccgggctgcaagacccatgtgaaagagatcagaccgatgccctggaaccgatgacactgcaagaaagggaagatgtcaccgccagtgctcagcatgccttgcggatgcttgctttccgccaaacacacaaggtcctcggcatggacttgctaccacctaggcacaggctgggagctcgcttccgaaagagacagcggggcccgggcgagggtgaagagggtgccggcgaaaagaagcgcgggagaagaggcggagagggactagtgtag

SEQ ID NO: 35108 - DNA, 1101 bp, Artificial Sequence
  Description of Artificial Sequence: Synthetic coding sequence
atggccacatcacagtattttgattttgctcagggcggcggcccccagtatagcgcccagccccctactctgcccctcccaactgtgggcgcatcctacacagctcaacctactccagggatggaccccgcagtgaatccagcattcccccccgcagctccagctgggtacggaggctatcagccccatagtgggcaagattttgcctacgggtcacgccctcaggaacctgtcccaacagccacaacgatggccacttatcaggacagttatagctatgggcaatctgccgccgccagatcctacgaggaccggccctactttcagtcagcagcactccagagtggaagaatgactgctgctgacagcgggcaacccgggacacaagaggcatgtggccagccctccccccatggatcacatagccacgcacagccaccccagcaggccccaattgttgaaagtggccagcccgcaagcaccctctcaagtgggtatacatatcccaccgctactggcgtacagccggagtctagcgccagtatcgttacttcctacccccccccttcctataatccgacatgtacagcttacaccgctccctcctatccaaactacgacgcatccgtttactcagcggcctctccattttaccctcccgcacagcccccacccccccccggacccccacagcagctcccaccacctccagcccccgctggctcaggtagcagcccaagggccgatagcaagccgcctctgccgtctaaactgccgagacccaaagcggggccgaggcagctgcagcttcactattgtgacatctgcaagattagttgcgcaggaccacagacatatagagagcacttaggtgggcagaaacatagaaagaaagaggccgcccaaaagactggcgtgcagccaaatggcagccctcgtggagtgcaggcgcaactgcattgcgatctgtgtgcggtgagctgtaccggagccgatgcctatgctgcacacatccgcgggagtaaacatcagaagggactactctcccacagacagcaggccgctgacccgtccggtggaaaccagcctaacttgaattag

SEQ ID NO: 35109 - DNA, 213 bp, Artificial Sequence
  Description of Artificial Sequence: Synthetic coding sequence
atggccacctcccagtacttcgactttgctcagggaggcggaccacagtattcgccagaggtagagacaacgccccctgccttggccagcgggctcccatgtgctctaccatggacagtcggctgctcaggttctgatgctgtaacagctctgtgcccatcattaagaggcctcgcctgtatttgttcaatcttgtgggatcccgcgtggtag

SEQ ID NO: 35110 - DNA, 843 bp, Artificial Sequence
  Description of Artificial Sequence: Synthetic coding sequence
atgctctcttgtaatatctgtggggaaacagtgacctctgagccagatatgaaagctcacctgatcgtccatatggagagcgagatcatctgtcccttctgcaaactgtccggcgtgaattacgatgagatgtgtttccacattgaaactgcccattttgagcagaatactctggagcggaatttcgaaagaatcaatactgtccagtacggtacgagcgataacaaaaaagacaacaccctgcaatgtggcatggaggtgaattctagcattctgtctgggtgcgcgagcaaccaccctaaaaatagcgcacagaacctcactaaggatagtacgctgaagcatgagggattttactctgagaacctgacggagagtcgcaaattcttgaaaagtcgcgagaaacaatctagcctgacagaaatcaagggctccgtctatgaaaccacttacagtccacctgagtgtccattttgtggaaagatcgaggaacactccgaagacatggagacgcacgtgaagacgaaacatgctaacctcctggacattcccttagaagattgtgaccagcccctatacgattgccctatgtgcggccttatttgtacgaactaccacattctgcaagaacacgtggaccttcatcttgaggagaactctttccagcaggggatggacagggtccagtgcagcggggatttgcaactcgctcaccagctgcagcaggaagaggatagaaagcggagatcagaggagagccggcaggaaatcgaagagttccagaagttacaggaactgttgaaacatttcataggaattatccggatgcttccacagatgtag

SEQ ID NO: 35111 - DNA, 1737 bp, Artificial Sequence
  Description of Artificial Sequence: Synthetic coding sequence
atgctttcctgcaacatttgcggcgagacagtcacttcagagccagatatgaaagcccacctaatagtgcacatggagtccgaaatcatttgcccgttttgtaagctaagtggcgtcaactacgacgaaatgtgcttccatatcgagacagcgcatttcgagcaaaatactctggaacggaactttgagagaatcaatacagtacagtatggaacaagcgataataagaaggataatactctgcagtgtggtatggaagtaaattcctcaattctgagcggatgtgctagcaatcatcccaagaattccgcccagaatctcacgaaagattccaccctgaagcatgaaggcttctatagcgagaatctcactgagtcaagaaaatttttgaaatcacgcgagaagcagtcttcactgactgagattaagggcagcgtgtatgagaccacttatagtcctccagaatgtcctttttgcggaaaaatcgaagaacactctgaggacatggaaactcatgtgaagacaaaacatgccaacctgctcgatatccccctggaggattgtgaccaaccattatatgactgtcccatgtgcggtctcatctgcactaactaccatatcctgcaagagcacgtggacttgcacctagaagaaaacagctttcaacaaggtatggaccgcgtgcagtgttccggagacctgcagctagcccatcagctgcaacaagaagaagacagaaagcggcgcagtgaagagagccggcaggagatcgaagaatttcagaagttgcaacgtcaatatggacttgacaactccggcggatacaaacagcagcagcttcgcaacatggagatcgaggtcaataggggcaggatgccgccttctgaatttcatcggcgtaaagcggatatgatggagtcattggcgttaggattcgacgatggaaaaactaaaacttctggtatcattgaggcactgcaccggtattatcaaaatgccgctaccgatgtcagacgggtctggctgtcttccgtggttgatcatttccactcaagtctcggggacaagggctggggctgcgggtacaggaacttccagatgcttctgtccagccttttgcaaaatgacgcctataacgattgcctgaaaggaatgctcatcccatgtatccctaagatccaaagcatgatcgaggacgcttggaaagaaggattcgacccccagggggcttcgcagctcaataacaggctccaaggcaccaaggcttggatcggagcctgcgaggtatacattctgctgacctctctgcgcgtgaaatgccacatagtagatttccacaaaagcacggggcccctgggaacacaccctaggctctttgaatggatcctaaactattactctagtgagggcgaggggtccccaaaagtggtctgtacctcaaagcctcctatttacctgcagcatcagggccattctcgaaccgtgatcggaatagaggaaaagaagaaccgtactctctgcttactgatcctggaccccggatgcccaagtcgcgaaatgcagaaactgctgaaacaggatatagaggcttccagcctgaagcagcttcggaagtccatgggcaacctgaagcataaacagtatcagattctcgccgttgaaggtgcattgtctctggaagaaaaacttgcgaggcgacaggcctcccaggtgtttacagccgaaaaaatcccttag

SEQ ID NO: 35112 - DNA, 1260 bp, Artificial Sequence
  Description of Artificial Sequence: Synthetic coding sequence
atgcctgggcgaggccggtgtcccgactgcggatccacagagctggtggaagattctcactactcacagagccagctggtgtgcagtgattgtggttgtgttgtgacagaaggggtcctgacaactacctttagcgatgaggggaatttacgggaggtcacttactccagatccaccggcgaaaatgagcaggtcagccgtagtcagcagaggggactgagacgggtcagggacctgtgtcgggtgctgcagctgcctccgacgtttgaagacacagctgttgcatactaccagcaagcgtatcggcattctggcattagagctgcccgccttcagaaaaaagaagtgctggtgggttgctgtgtgctaatcacctgtagacagcacaattggcctctgacaatgggtgccatctgtacgctgttatatgcagacttagacgtctttagttctacctacatgcagatcgttaagcttctaggtctcgatgtaccctctctgtgtctggctgagcttgttaagacatattgtagcagtttcaagctgttccaggcttcaccgtccgtgccagctaaatatgtggaggacaaagagaagatgcttagcagaactatgcagcttgtcgagctcgccaatgagacctggctggtgacaggccggcacccacttccagtgatcaccgcggcgaccttcctcgcctggcagtccttgcagcccgccgatagactgtcttgtagtctggctagattctgcaaactagctaacgtagacctgccgtaccccgccagtagtcgtttgcaggagcttctggccgttctgctgagaatggccgagcaattggcctggcttagagtactgagactggataaaaggtccgtggtcaagcacataggcgacctactgcagcataggcagagcttggtccggtctgcattccgggatggcaccgcagaggtagagacccgtgagaaggagccacctgggtgggggcaggggcaaggagagggggaagtggggaataatagcttaggcctaccccaggggaagagacccgcctcacctgcactgcttctccctccctgtatgctgaagtctcccaagaggatctgccctgtgccccccgtgtctaccgtgactggcgacgagaacatttccgacagcgaaattgaacaatatctgagaactccacaagaagttagagacttccaacgtgctcaggccgcaagacaagctgctacttccgtcccaaatcctccgtag

SEQ ID NO: 35113 - DNA, 162 bp, Artificial Sequence
  Description of Artificial Sequence: Synthetic coding sequence
atggctgctacacagaaattagttaaggacattatcgatagtaaaactggcgaaactgcatcgaagagatggaaaggcgctaaaaactccgagaccgctgccaaggttgccttgatgaagctgaagatgcacgctgacggcgataaaagccttccacaatag

SEQ ID NO: 35114 - DNA, 132 bp, Artificial Sequence
  Description of Artificial Sequence: Synthetic coding sequence
atggcagctactcagaagctcgtgaaagatataattgactctaaaacaggcgaaaccgcaagtaagagatggaaaggagctaagaacagcgaaactgcagcaaaagttgcgctaatgaaacttaaaatgtag

SEQ ID NO: 35115 - DNA, 129 bp, Artificial Sequence
  Description of Artificial Sequence: Synthetic coding sequence
atggccgcaacgcagaaattggttaaagacatcatcgacagcaagactggcgaaactgcatccaaacgttggaaaggggccaagaatagcgagacggctgcgaaagtcgcgctgatgaagcttaaatag

SEQ ID NO: 35116 - DNA, 294 bp, Artificial Sequence
  Description of Artificial Sequence: Synthetic coding sequence
atggctgcaacacagaagctggtgaaagatattatagacagcaagacgggggagacagcctctaaacggtggaagggggccaagaattctgaaacggctgctaaggtcgccttgatgaaactgaagatgcacgcagacggcgacaaatccctccctcagacagagcgcatctacttccaggtctttttgccaaaaggctccaaggagaagagcaaacccatgttcttttgccacagatggagcatagggaaggcaatcgactttgctgccagtctcgcccgcctcaagaattag

SEQ ID NO: 35117 - DNA, 360 bp, Artificial Sequence
  Description of Artificial Sequence: Synthetic coding sequence
atggcagcgacccagaaactcgttaaagatatcatcgattccaaaacaggggagaccgccagcaagcgctggaagggcgccaagaatagcgagaccgcagcaaaggttgccttgatgaagttaaagatgcatgccgacggggataagagccttccacaaactgagcggatatattttcaggttttccttccaaaaggtagcaaggagaaatctaagccaatgtttttttgtcataggtggagtataggcaaagcaattgactttgctgcatcactcgcgcggctcaaaaacgataataataagtttacggctaagaaattacgcctctgtcatattacttctggggaggcgctaccatag

SEQ ID NO: 35118 - DNA, 486 bp, Artificial Sequence
  Description of Artificial Sequence: Synthetic coding sequence
atggcagctactcagaaattggtcaaagatatcatcgacagcaagaccggagagaccgcaagcaaacgctggaagggggctaaaaatagtgaaacggcggcgaaagttgccttaatgaagctcaagatgcacgccgacggcgacaagtcactcccccaaactgagagaatatacttccaagtatttctgcctaaaggatctaaggaaaaaagtaaaccaatgttcttctgtcaccgatggagcatcgggaaagcaatcgactttgccgccagtctggctcgcctcaagaatgacaacaacaagttcacggccaagaagctcagactctgccatatcaccagcggagaagccttaccgctggatcatactctggagacctggatagcaaaggaggattgtcctctgtataacggcgggaacattatcctcgaataccttaacgacgaagaacagttctgcaagaatgtagagtcctacctcgagtag

SEQ ID NO: 35119 - DNA, 162 bp, Artificial Sequence
  Description of Artificial Sequence: Synthetic coding sequence
atggctgcaactcagaagttggtaaaggatattatagacagcaaaacgggggaaactgcttctaaaagatggaaaggcgcgaaaaatagcgagaccgctgcaaaagtagcccttatgaagctgaaaatgcatgcagacggagataaaagtttaccccagtag

SEQ ID NO: 35120 - DNA, 486 bp, Artificial Sequence
  Description of Artificial Sequence: Synthetic coding sequence
atggccgccacccagaaattagtcaaagatatcatcgactcgaaaacaggcgaaacagcctccaaaaggtggaaaggcgccaaaaatagtgagacagcggcaaaagtcgcactgatgaagctgaagatgcacgccgatggcgataaatctctaccgcagactgaaagaatctacttccaagtttttctgcccaagggtagcaaggagaagtcaaaaccaatgttcttttgtcacaggtggtcgatcggtaaggctatcgactttgccgcgtctctggcccggttgaaaaatgacaacaacaagtttactgccaaaaaattgcggctctgccatattacgtctggggaagcgctgcctctcgatcatacccttgaaacatggatagctaaggaagactgtcctctctataatggggggaatattatacttgagtatttaaatgacgaggagcagttttgtaaaaacgtggagagttatttagaatag

SEQ ID NO: 35121 - DNA, 186 bp, Artificial Sequence
  Description of Artificial Sequence: Synthetic coding sequence
atggccgccacacagaagctcgtcaaggacattatcgacagcaaaaccggggaaaccgcatccaagcgatggaagggggctaagaactctgagactgcagctaaggttgctcttatgaagcttaaaatgcacgccgatggcgataagtcgttaccacagacagaacgaatctactttcaggtttag

SEQ ID NO: 35122 - DNA, 348 bp, Artificial Sequence
  Description of Artificial Sequence: Synthetic coding sequence
atggacaacagaaaagagccaccatttttcaacgatgacaacatgggacctttctactaccgcttgcatttttgcgacaccatggaacttttcatcgaaacgctgacgggcacatgcttcgagttgagggtgtcaccctttgaaaccgttatatccgtgaaggctaagataaggaggctggagggaattcccatctgcaggcagcacttgatttggaacaacatggaactggagaacgattactgtttgaacgattataatatctcagagggctgtacccttaaactcgtcctggccatgcgcggagggcccatcaacacccgacgcgatctccagatcccccggtag

SEQ ID NO: 35123 - DNA, 2184 bp, Artificial Sequence
  Description of Artificial Sequence: Synthetic coding sequence
atggataatcgcaaggaacctcccttcttcaatgacgacaatatgggacccttctattaccgcttacatttttgcgataccatggagctgttcatcgaaaccctgacaggaacatgcttcgagttgcgcgtgtcaccatttgaaactgtaattagcgtgaaagccaagattcgaaggttagaaggtatccccatatgtagacagcacttgatatggaataacatggagctcgagaatgactactgtctgaacgattacaacatctcggagggttgtaccctgaagctcgtgctagctatgcgtggaggtcccataaataccagaagggtcccaaccgatgacccactgcgtaagatggcagaatacctcgacagctctagagtggaagtgtgggaaaaaacctcttgctccaagcaggtgacctttctggtatatcaggaaggcgaccaattgaacttcttcccggctgtggacaggggggacggaactctcactccccttagcgatagtagtaagaaaatcgatttccatctgcatgtcctgagacgtaagggtgagcaccgcatgtccggcggttcgatgtataatagtgataccgacgaagacgaagaaacagagcccagctcctctggtcaacagattattgaaaactcaatcactatgaacaagatgaagctgctaaaggccaaaatgaaaaacatgaacctgtcgaagaagcccaaaaaagccgtgaaaatcaaacctcatccaccagtagccccaaggccatctagcggctcgaccgctccaagcaggcatagattgctgcgtgttttgcctaatattggccaatcctgcagtccagcgttcggaaacgcctacccccctgaaatttctcggaatgggatctctagtttggccacccagctgtctgccgagcgctacatcagttctataactggagaattcctgaaggaggataattcttgggagaataataccctttcccacttcagctcaaacgtgaagttaccaccccaaattcctcacctggaacttggtaatgatcaggagctggctgattctgtgctgcacttgggtagcagcctccccagacagactaagcatttccttggcaatctcccttctagtaacggaaacattgtcctgccttccgaggaatgtgtcaccgaacagtcactgctgcccaaagtgggctcgttggcctctttcgcggagggcaatgcagacgagcagagctccggcttggagggagcctgtaaagtgaacctggaactgcttctgaccaatgctgataaagggctgaaggcaccagagcagcacctcaaacatgtggctggggtgctgaacggggagagtgtagaaacctctgtgctcaactatagagagctctcaccacataagaatagactcttatcacctttgcgttgcagtgctcccatgtctctgcacaattcactcgtgaagcccgaaaggcagtctaaatgcttcgaatttggcaagcttcagccctcatcctcacaatcactcgatgtacagaatatcaccgacagttcattcagcaggactacgtgctttcaaggggtaaaagtggatagcctgggaaagcgctccgacgtgatttctaaagtggaggcaagagacatcaccgaaatgacaaacaaagcctctaaggaacccgtgggctgcgtgaataatatctccttcctcgccagcctcgccggctctacgtctcggaacagacttcagtccacccgaggcgctggccggctccagaacagtggcaccggtttgtccaccaatctccaacacttccaggaggaaaactttcgaaagtcctccccacagctcgaacataccggggtgttcttgtctacacatggggtgggcatgaacggtaacaacgcagcggccggcaagtcagttggagaatgtacaactcaccacctccctccagtgaaggcgccgctgcaaacaaaaaagaaaactaccaatcattgttttctgtgtgggaaaaagaccggtcttgcatcatcttatgaatgcagatgcgggaacaacttctgtgcttctcaccggtacgccgaaacccatggttgcacttatgattataaaagtgccggacgacgctacctgcatgaggcgaatccagtcgttaacgcaccaaagttaccaaaaatctag

SEQ ID NO: 35124 - DNA, 1962 bp, Artificial Sequence
  Description of Artificial Sequence: Synthetic coding sequence
atggaactggagaacgattactgcctgaacgactacaatataagtgagggctgcaccctgaagttggttctggccatgcgtggcggcccaatcaacacacggagggtgcctacagacgatccactgcgcaagatggcagaatacctcgactctagtagagtggaagtttgggagaaaaccagctgctctaagcaggtcactttcctggtctaccaggaaggagatcagctgaacttttttcccgctgtcgaccggggagacggcacactcactcccctgtctgattcttccaaaaaaatagattttcaccttcacgtgcttcgacggaaaggggagcaccgtatgtcaggaggatcaatgtataactctgatactgatgaggatgaagaaaccgaacccagtagttctgggcagcagattattgaaaatagtatcacgatgaacaagatgaaacttctcaaagcaaagatgaaaaacatgaatctcagtaagaagcctaagaaggcggtcaagatcaagcctcaccctccagtcgcccctaggccctctagcgggtctaccgccccctcacgccaccggctcctgcgagtgctgcctaatattggccaaagctgctctcccgcatttgggaacgcatatccgcccgaaatctcacggaacggaatctcaagcctggcgacacagctatccgccgaacgttatataagcagtatcactggcgaattcttgaaggaggacaattcctgggagaataacacgctctctcactttagtagtaacgtgaaactgccgccgcagataccacacctggagcttgggaacgaccaggagctggcagattccgtactccatctgggctcctcactgcctaggcaaacgaaacactttctcggtaatctgccctcatctaacgggaatatagttctgccatcggaggaatgcgtcacagagcaaagtcttctgccaaaagtgggcagcctggcctcttttgctgagggaaacgctgacgagcagagcagcggtctggagggtgcctgtaaggtcaatctggaactgctactcactaacgctgataaagggttaaaagcgccagagcaacacctgaaacacgtggccggcgtgcttaacggagagtctgtggaaacatcagtgcttaactaccgggaattgtctccacataaaaacaggcttctttctcctctaaggtgcagtgctcctatgtccctgcacaatagtctggtgaaaccagagcgccagtctaagtgttttgaattcggtaaactgcagcctagttctagccagagcctcgatgtgcagaacattaccgacagttctttcagcagaactacctgtttccagggtgtcaaggttgacagccttggcaaacggtccgatgtgatttctaaggtggaggcaagggacattacagagatgactaataaggcttccaaggaaccggtggggtgcgtaaataatattagctttctggcttccctggcaggttccacctcacgtaatagattacagtcaaccagaggtgctggacggctgcagaatagcggtacaggactttccacaaacctgcagcactttcaagaggagaactttaggaagtcctccccacaattggaacacacaggagtctttctatcaactcatggagtgggtatgaatggaaacaatgcagctgctggtaagagcgtcggagagtgtaccacacaccacctgccccccgtgaaggcgcccctccagactaagaaaaagactacaaatcattgttttctgtgtggcaaaaaaaccgggctggccagtagctacgaatgcagatgcgggaataatttttgtgcttctcataggtatgcagaaacccacgggtgtacatacgattacaaatctgctgggagacggtatctgcatgaagcaaaccctgtggtgaatgccccaaaactgcccaaaatctag

SEQ ID NO: 35125 - DNA, 1830 bp, Artificial Sequence
  Description of Artificial Sequence: Synthetic coding sequence
atggccgagtatttggattcatcacgtgtcgaagtgtgggagaaaacaagctgttctaaacaggtgacattcctggtctaccaggaaggtgatcagctgaactttttcccggccgtggacaggggcgatggcactcttacacctctcagcgattcctctaaaaagatcgatttccatctgcacgtgctgagaaggaagggggaacatcgcatgagcggagggagcatgtacaattctgatacggacgaagatgaggaaactgaaccaagctcatccggccagcaaatcatcgagaacagtattaccatgaacaaaatgaaactgctgaaggccaaaatgaaaaatatgaatctgtccaaaaaacctaagaaagctgtaaagatcaaaccccacccacccgtcgcccctcggcctagtagtggtagtacagccccatctcgacacaggttgctccgtgtgctgcctaatattggacagagctgctcccctgcgttcggcaatgcctaccccccggagataagcaggaatgggatttcttccctggctactcagctgtctgccgaaagatatatctcctctatcacaggcgagtttctaaaggaggataactcgtgggagaataataccctcagccattttagcagcaacgttaagcttcctcctcagatccctcatcttgagctcggcaacgaccaagagctggccgatagtgttctccaccttggaagctccctgcctcgccaaactaagcacttcttgggtaatctgccctcctctaatgggaacattgtgttaccatccgaggagtgcgttaccgagcaaagtcttctgcctaaggtgggtagcctggccagcttcgcagaggggaatgcagatgaacagagttccggactggagggggcctgcaaggtgaatcttgaactactcctgacgaatgccgataaaggcctgaaagcccccgagcagcaccttaagcacgtcgccggggtactaaacggcgaaagtgtggagacatctgtgctgaactaccgtgagctcagcccacacaaaaaccgattgctgtccccgttgcggtgttctgctccaatgtccctccacaacagcctcgtcaaaccagagcgccagagcaaatgctttgaattcggtaaactgcagccatcttcttcacaatctttggatgtgcagaacatcaccgattctagcttctcacggactacatgcttccaaggggttaaggtggattccctggggaagagaagtgacgtgattagcaaggtggaagctcgggacataacagaaatgactaataaggccagcaaggagcccgttgggtgcgttaataacataagtttcctcgccagcctggccggaagcacttccaggaaccgtctgcagagcaccaggggagccggacggttgcagaattcagggacgggactgtccaccaacttacaacactttcaggaggagaactttcggaagagcagcccccagctggagcataccggggtgtttttgagcacccatggggtgggcatgaacggtaacaacgccgctgccggtaaaagcgtcggagaatgtaccacccaccatttgcctcccgtaaaggcccctctgcagactaaaaaaaaaacaacaaaccattgctttctctgcggcaagaagaccggactcgcgtcttcttacgaatgtcggtgtggcaataatttctgcgcaagccacagatatgccgagacgcatggatgcacctatgactacaaaagcgccggacgtcgctatttgcatgaggctaatccggtggtcaatgcacccaagctgcctaagatatag

SEQ ID NO: 35126 - DNA, 675 bp, Artificial Sequence
  Description of Artificial Sequence: Synthetic coding sequence
atggacaatcgtaaagagccaccattctttaatgatgataatatgggtcccttctactatcgtcttcatttctgcgacactatggaactgtttattgagaccctgacaggaacctgttttgaactgcgggtcagccctttcgagacagtgattagtgttaaagccaaaatccgacgactggaaggtatccccatctgccggcagcacctaatctggaacaatatggagttggaaaacgattattgcttgaatgattataacattagtgaaggctgtacactaaagctggtgctcgcaatgcgtggcggtcctatcaatacgcgtagggtgcccaccgacgaccccttgcgaaagatggccgaatacctggattccagcagagtcgaggtctgggagaaaaccagttgcagtaagcaggtgacctttctcgtctatcaggagggcgaccagctgaacttcttcccggccgtggaccggggagacggcacactcacccccttgtcagactcaagcaaaaagatcgactttcatctgcacgtcctgagacgcaaaggcgagcatcgcatgcggcgaatgtattactcatcacctcccacatgcgagtccccttcttcagacaaggaagaaaacaacaaatctctcttttctctttggaaggaaaatcgcactggctag

SEQ ID NO: 35127 - DNA, 675 bp, Artificial Sequence
  Description of Artificial Sequence: Synthetic coding sequence
atggacaaccgtaaggaaccccctttttttaatgacgataatatgggacccttttactataggttacatttctgcgacactatggagttatttatagaaacactgacgggaacatgttttgagctcagagtgtccccttttgaaactgtgatcagcgttaaagctaagatccgacgattggaaggaattcccatctgtcgtcagcacttgatctggaacaacatggagctggaaaatgactactgcctcaacgactataatatctctgaggggtgtaccctgaaacttgtcctggccatgcgggggggtccgataaataccaggagagtacccacagacgatccactgcggaaaatggcagagtacctggacagttctcgcgtcgaggtgtgggaaaaaacgtcctgttccaagcaggttaccttcctcgtataccaggagggagaccagctgaacttcttcccagctgttgacagaggtgatgggactctcacccctctgagcgattcgtctaaaaagattgactttcatctacacgtgctccggaggaaaggcgagcacagaatgcgcaggatgtactattcctcccctccaacatgtgaatctcccagcagcgataaggaagagaacaacaaatcactcttttcactgtggaaagagaaccgtaccgggtag

SEQ ID NO: 35128 - DNA, 627 bp, Artificial Sequence
  Description of Artificial Sequence: Synthetic coding sequence
atggctcaggagaccaaccacagtcaggtccctatgctgtgttctaccgggtgtgggttctacggtaatccccggactaacggtatgtgcagcgtttgctataaggagcacttacagcggcagaatagttccaacggccgtatcagcccgcccgccacttccgtcagttcccttagtgagagcctacccgttcagtgtactgacggaagcgtgccagaagctcaaagtgccctggatagcaccagctcgagcatgcaacctagccccgtttccaatcagagcctgctttcagagagtgtagcttcttcccagctggacagtacgtcagtagataaagccgttcctgagaccgaggatgtgcaggcaagcgtttccgataccgcccagcaacccagcgaagaacagtcaaagagtcttgaaaagcctaaacagaaaaaaaacaggtgctttatgtgcaggaagaaagtcggcctgactggttttgagtgtcggtgcggcaatgtctactgcggagtgcacagatattctgacgtacataactgcagttataactataaagcagacgcggcagagaaaataagaaaggaaaatcctgtggtggtcggggagaagatccaaaagatctag

SEQ ID NO: 35129 - DNA, 2520 bp, Artificial Sequence
  Description of Artificial Sequence: Synthetic coding sequence
atgaataggaaggacttcgtcgtgctgccctggggaaaacccggcaattcagttaagctgaaataccgaaatgctcaggagctgagaatggaaaaggtacagctagagttcgagaaccaggagatggagaagaaacttcaggaattccgttccacccgaaacaaggagaaggaggatcgagaatccagcgaatattattggaagagcgggaaggttggaaagctcgtgaaccagtcatacatgatgtcccagaacaagggcaacgtggtgaagttctccgccggaaaagtcaagctcaaactcctgaaagagcagatccaggaacccgtgaaaccgaccgtcaactacaaaatggccaacagctcggagtgtgagaaaccgaagattaacggaaaagtgtgtggccagtgtgaaaataaggccgcactcctggtttgcctggaatgcggagaggattactgcagcgggtgttttgctaaagttcaccagaagggagcactaaagctgcatcgcactacgttgctccaggcaaagagccagatactgtttaatgtcctggatgtcgctcaccagtttatcaaggatgtaaatccagacgaacccaaagaggaaaataattctactaaagaaacctctaagatccagcacaaacctaaatctgtcctcctgcaaagaagtagcagtgaggtcgaaatcaccacgatgaaacgcgcacagcggacgaagcccagaaaatctctgctgtgtgaagggtcatttgacgaggaggcttcagcccagagttttcaggaagtgctttcccagtggcggacaggcaaccatgacgataacaaaaaacagaatctgcacgcagcggtcaaggactcactagaggaatgtgaggtacaaacaaacctcaagatatggcgggaacccctcaatatcgagctcaaggaagatattctgtcctatatggaaaaactatggctcaagaagcaccggcggaccccacaggaacaactctttaagatgctcccagatacttttcctcatcctcacgaaacaaccggggatgcccagtgtagtcagaatgagaatgacgaggattccgacggggaggaaaccaaagtgcagcatactgcactgctgctccccgtggagacccttaatattgagcggccggagccctccctgaaaatagtcgagttggatgacacctatgaggaggagttcgaagaagctgaaaacatagtgccctacaaagtgaaattggctgatgcagatagccaacgaagctgtgcctttcatgattgccagaagaactcctttccatatgaaaatggcattcatcagcatcacgtcttcgataagggcaagagagactttcttaatctctgcctgcggaacagctctacatattacaaggacaactctaaggccgagacaagcaacactgattttgacaacattgtggaccccgacgtgtatagctccgacatcgagaagattgaggaaagcaccagctttgaaagaaatctgaaggagaaaaatattggccttgagagcaaccagaagtctgatgactcttgcgtgtcgctggagagtaaggatacacttctcggcagggatcttgagaaggcgcctattgaagaaaaactcagccaagatattaaggagagtctggaactcagcaatctctataaacgtccatcttttgaggagagcaaaacaacgaaatctagcctactgctacaggagattgcctgtcgcagtaagccaatcaccaagcagtaccagggtttggaaagattcttcatctttgataccaacgagagactcaacctccttccttcccaccgactggaatgtaataacagcagtactcgcattaccctggccgaggatcgtgagtggatcccagatcattccctgtctgagtatgctgataatgccattgttctcggtgtgcttcagggcgcgcaaagtcctagctccagccggaagcagcagaagatgggacaaaaaagtcaacggccaagtacggccaattttccactgtcaaattccgtgaaagagagctccagctgcctttcatctagtcaccccagatccagaagcgccgctgcgcagagcagctccagagcagcatcagagataagcgagattgagtacattgacataactgatcaaaatgagttgagtttggatgacacaactgatcaacacacgctggataacctggagaaggaacttcaggtcctgagaagcctcgccgatacctccgagaagctctacagtctaacaagcgaagaatttcccgatttctcttcacaaagcctaaacatctcccagatcagtaccgacttcctgaaaacaagccacgtccggggtccctgcggcgtggaagaactgtcttgcagcggcagggacactaagatccaatcattgctgtcactatctgagtcaagtactgacgaggaagaagaagattttctgaataagcagcacgtaatcacactcccctggtctaagtccacatag

SEQ ID NO: 35130 - DNA, 2403 bp, Artificial Sequence
  Description of Artificial Sequence: Synthetic coding sequence
atgaaccggaaggatttcgttgttctaccatggggcaaaccggggaattccgtcaagctgaagtaccgaaacgcacaagagcttcgtatggagaaagtgcagctagagttcgaaaatcaggaaatggaaaagaagttacaggagttccgatctactcggaacaaagaaaaggaggatcgcgagtcaagcgagtactattggaaaagcggcaaagtgggcaaacttgtcaaccagagctacatgatgagtcagaataaaggcaatgtagtgaagttcagtgctggtaaagtcaagttgaagctgctcaaggagcagattcaggagcccgtaaagcccaccgtgaactacaagatggccaactcttccgaatgcgagaagcccaagatcaatgggaaggtctgtggacagtgcgagaataaagcagcactccttgtgtgcctggaatgcggcgaggattattgctccggctgttttgctaaggttcaccaaaagggcgccctgaaactgcatcggaccacattactccaggccaagagccaaattctttttaatgttctggatgtggctcatcagtttattaaagacgtgaatccagatgaacccaaggaggaaaataactcaaccaaggagacctccaaaattcagcataagcccaagtctgtgctactccagaggtctagctcagaagtagagataaccactatgaagcgcgcgcagaggacgaagcctcggaagtccctactgtgtgaggggagcttcgacgaagaagcttctgcacagagcttccaggaggtgctgtctcagtggaggaccgggaaccacgatgacaacaaaaaacagaatctccacgcggcggtcaaggactcactcgaagagtgtgaggtgcagacaaatttgaaaatctggagagagcccctcaatatagagctcaaggaagacatcctgagctacatggaaaaactgtggctgaagaaacacagaagaacccctcaggagcaattgtttaaaatgctgccagataccttcccgcatccccacgaaaccaccggggatgcccaatgctcccagaacgaaaacgatgaagacagtgatggagaggagacgaaagtccaacacaccgccctcctgctccctgtcgaaacgttaaatatcgagcgccctgagccttcattaaagattgtagagcttgacgatacatacgaggaggaatttgaggaagccgagaatatcgtaccctacaaagtgaagttggccgacgccgattcccaacgtagctgcgcttttcacgattgccagaagaactcgttcccatatgagaatggaattcaccagcatcacgtgtttgataaggggaaacgcgatttccttaacttgtgcttaagaaacagttccacttattataaggacaattccaaggctgaaacatcgaatacagacttcgataatatcgtcgatccggatgtctactccagtgatattgaaaagatcgaagagtccacttcttttgagcgcaacttgaaggagaaaaatatcgggcttgagtctaatcagaagagcgacgacagctgtgtttccctggagtcaaaggatactttactcggtcgcgatctggagaaggctcctattgaggagaaactgagccaagatattaaagagtcactggagctgtcaaatctgtacaaaaggccttcctttgaagagtccaagaccacaaagtctagcctgctgcttcaggagattgcatgcaggtcaaagcccatcactaaacagtaccaaggattggaacgattctttatatttgacacaaacgaacggctcaacctgctgcctagtcaccggctagaatgtaataattcttcaacaagaattaccctcgctgggcaaaagagccagcgaccctccaccgcgaactttccattatctaatagcgtcaaagaatcgtcatcctgcctgtcttccagccatccaaggtcccgctcagccgccgcccagagttcttcgcgcgccgcctctgaaatatccgagattgagtatatcgacataactgaccagaacgagctgtccctcgatgacaccacagatcagcataccctggacaacctggaaaaggagttacaagtgctgcggagcttggccgacacgtcagaaaagctgtatagcttgacgtctgaggagttccctgactttagctcccagtccctcaacatctctcagatctccactgacttcctgaaaacttcccatgttcgaggaccgtgcggtgtggaagaactgtcctgttctggacgagataccaaaattcaatccctcctgagtctgtcagaatcttctactgatgaggaagaggaggactttctgaacaaacagcatgtgattactctgccatggagtaagagcacatag

SEQ ID NO: 35131 - DNA, 2403 bp, Artificial Sequence
  Description of Artificial Sequence: Synthetic coding sequence
atgaacaggaaagatttcgttgtcctcccttgggggaagcctggcaactcggttaaactgaagtatcgcaatgcacaggagcttaggatggaaaaggtgcagcttgagtttgaaaatcaggaaatggagaaaaagctccaagaatttagaagcactcggaataaggagaaagaagaccgggaatccagtgaatactactggaaatcaggcaaagtaggaaagttggtaaaccagagctatatgatgtctcaaaataagggaaatgttgttaagttctccgctggaaaggtaaagctgaagcttttaaaagaacaaattcaggaacctgtgaaaccaactgtgaactataaaatggccaattcctcagagtgcgagaagcctaaaatcaatggtaaggtgtgtggtcaatgcgaaaacaaagccgcactcctcgtatgcttagagtgtggggaggattactgtagcggatgcttcgccaaggtacatcagaagggggcactgaaactgcatcgaactaccctcctccaagcaaaaagccagatactctttaatgtgctggacgtagctcatcaatttattaaagatgtgaacccagacgaacccaaggaagagaacaatagcaccaaggagaccagtaagatccagcacaagccaaaatctgttctgctgcagagatcatcatcagaggttgagattaccacaatgaaaagggctcagcgcactaaacctcgtaaaagccttctgtgtgaaggaagcttcgacgaagaggcttcagcacagagttttcaggaagtactcagccaatggaggactggcaaccacgatgataacaaaaaacagaacttgcatgctgccgtcaaagattcgctggaggagtgtgaagtgcaaactaacctcaagatatggcgcgagcctctcaacattgagcttaaagaagatatcctctcctatatggaaaaactatggctgaaaaagcacagacggaccccacaggagcagctgtttaaaatgcttccggacactttcccccaccctcatgagaccactggggatgcccagtgttctcaaaacgagaacgacgaggactcagatggagaggagaccaaggttcagcacacagctcttctgctgccggtcgagacactcaatatagagcgtcccgaaccatctttgaaaatagtagagttagacgatacatacgaggaggagttcgaagaggctgagaacatcgttccgtacaaagttaaattggcggacgcagactcccagcggtcatgcgccttccacgattgtcaaaagaacagcttcccttacgaaaacggcattcatcagcaccatgtcttcgacaaagggaagagggatttcctgaacctctgcctgcgcaatagctccacttactacaaggataactctaaggccgaaaccagtaataccgacttcgacaatatcgtggacccagacgtgtactcctcagacatcgaaaaaatcgaggagtcaacttctttcgagcgaaacctgaaggagaaaaacattgggctcgagtcgaatcagaaatcagatgactcttgcgtatctctagagagtaaggatacgctcttgggaagggatctagagaaggcgcctatagaagagaagctgagccaggatattaaagaaagtctcgagttaagcaacctatataagcgacctagtttcgaagaaagcaagaccaccaaaagttctctgcttctacaggaaatagcatgccgctctaaacctattaccaaacaatatcaggggctggagcggtttttcatctttgatactaacgagagactgaatctcctgccttcacaccggctcgagtgcaataattcatctacgagaataactcttgccggccagaagtcacagaggccttccaccgccaatttcccactgtccaattccgtgaaagagtcatcatcttgcctatcctcctctcaccctcgctcacgctccgccgccgcccagtcctcgtcccgagctgcgtcggagattagcgagatcgaatacattgatatcaccgaccagaatgaacttagcctggatgacaccacggaccagcatacgctggacaacttggagaaggagctacaggtactccgatctctagcagatacctccgagaagctctattcactaacttccgaggagtttcccgacttcagcagccagtcactgaacatcagtcagatttctactgattttctaaagacatcgcatgtgcgcggcccttgtggagttgaagagctgtcttgctccgggagggacaccaagatacagtccctgctctctctcagcgagagcagtaccgacgaggaagaggaagattttctgaacaaacagcatgtcatcacacttccttggtccaagagcacgtag

SEQ ID NO: 35132 - DNA, 2520 bp, Artificial Sequence
  Description of Artificial Sequence: Synthetic coding sequence
atgaatagaaaagatttcgtagtgctcccctgggggaagcctgggaatagcgtcaagctgaaatatagaaacgcccaagagcttaggatggagaaagttcagttggaatttgagaaccaggagatggaaaagaaattacaagaatttaggagcacccgtaacaaggaaaaggaggatagagagagcagtgagtactactggaagtccggaaaagtgggaaaactggtgaatcagtcctacatgatgtcccaaaataagggcaacgttgtgaaattcagcgccggcaaagtcaagttgaagttgctgaaagaacaaatccaggaacccgtgaagcccacggtgaattataagatggccaactcatcagagtgcgaaaagcctaaaattaacgggaaggtttgtggccagtgcgagaacaaggcagcgctgttggtttgtttagaatgtggtgaggactattgcagtggttgtttcgctaaagtgcaccaaaagggtgccttgaaactgcatagaaccacactgctgcaggctaagtcccagatcctgtttaacgtgttggatgtcgcacatcaattcatcaaggacgtaaacccagacgagcctaaggaggaaaataattccaccaaggagacctcaaaaatccagcacaagcccaaaagcgtgctgcttcaacggtcttcctcagaggtggagatcaccacaatgaaacgtgcccagcggacgaaaccaaggaagtcactgctttgtgagggaagcttcgacgaggaagctagcgcacagtcctttcaagaagtgctttctcaatggcgaacaggcaatcacgatgataacaagaaacagaacctgcatgccgcagtcaaggactcccttgaagaatgcgaggtccagaccaatctgaaaatctggcgggaacctttaaatatagaactcaaggaggatattctcagttacatggagaaactgtggctgaagaaacatagacggaccccacaagaacaactgttcaagatgctcccagatacttttccgcacccacacgaaacaaccggggatgcacagtgcagccagaacgaaaatgatgaagattccgatggcgaggagacgaaggtacaacatactgccttgctgctgccagtggagactctgaatattgaaagacccgagccttccctgaagattgtggaacttgatgatacgtacgaagaagagttcgaggaagcggagaatatcgtaccatataaggtgaagttggcggacgccgattcccaacgatcttgcgcattccatgactgtcagaaaaacagcttcccatacgagaatggcattcaccaacaccacgttttcgacaagggtaaaagggatttcctgaatctttgcctgaggaatagctccacgtactacaaagacaattccaaggcggaaacctcgaataccgactttgacaacatcgtggaccccgatgtgtattcttctgatatagaaaaaattgaggagagtactagctttgagcgcaatctgaaggaaaaaaacattggtttagagagtaatcaaaagtctgatgattcctgtgtgagtctcgaaagcaaggacacccttctcggtcgcgaccttgagaaggctcccatcgaagagaaacttagtcaggacatcaaagagagcttggagctttccaacctctacaaaagaccatcttttgaagagagcaagaccacaaaatctagtctgctcctgcaggagattgcttgcaggagtaaaccgatcacgaaacagtatcagggactggaaaggtttttcattttcgatactaacgaacgcttgaacctgctgccttcccataggctcgagtgcaacaactcctcgacaagaatcacgcttgcggaagatagagagtggattcccgaccactctctctctgagtacgccgacaatgccatcgtgctaggcgtgctgcagggggctcagtcaccatcatcctcccggaagcagcagaagatgggccaaaagagtcagaggccttcaacagccaactttcctctgagcaattccgtgaaggagtccagtagttgcttgtcaagttcccatcccagatcacgctccgcagccgcacagtctagctcaagggcggcgtccgagattagcgaaattgagtatatcgatatcaccgaccagaatgaattgtctttggatgatacaaccgaccagcacacgcttgataacctggagaaggaactccaggtcttgaggtccctcgccgatacatctgagaaactctattccctaacgtccgaggagtttccggacttctcatcccagagcctcaatatcagccagatctctactgattttcttaagaccagtcacgttcgggggccatgcggcgtggaagagctgtcatgttccgggagagatacaaaaattcagtcattattgtcactgtcagagtccagcaccgacgaggaggaggaagacttcctaaacaaacaacacgtgattaccctaccctggtcaaagtcaacctag

SEQ ID NO: 35133 - DNA, 492 bp, Artificial Sequence
  Description of Artificial Sequence: Synthetic coding sequence
atgaaccggaaggatttcgtcgtgcttccctggggtaaaccaggaaattctgtgaagctgaaatacaggaacgcacaggagcttcgcatggaaaaggtgcagttggaatttgagaatcaggagatggagaagaagttgcaagagtttcggagcacccgcaacaaagaaaaagaggacagggagagcagcgaatattattggaaatcaggaaaagtcggcaagctcgtcaaccagagctacatgatgtcgcagaacaagggcaatgtggtgaagttcagtgcaggcaaagtcaagctgaagctgcttaaagagcagatacaggagcccgttaaacctactgtgaactataagatggctaactcctcggagtgcgaaaagccaaagattaatggcaaggtgtgcggccagtgcgaaaataaggcagccctgctcgtgtgcctggagtgtggcgaagattactgctctgggtgttttgcaaaagtgcatcaatag

SEQ ID NO: 35134 - DNA, 657 bp, Artificial Sequence
  Description of Artificial Sequence: Synthetic coding sequence
atgatgagaagagaggacgaggaggaggaggggaccatgatgaaggcaaaaggggatctggaaatgaaggaggaggaggaaatcagcgagactggcgagttagtcggcccctttgtttcagccatgcccactccaatgcctcacaacaagggaacgcgtttctccgaagcatgggaatattttcacctcgctccggcccgcgctggccatcacccaaatcaatatgctacctgccggctttgcggacgccaggtgagtcgggggcctggcgttaatgtggggactacagcattgtggaaacatttgaagtctatgcatagagaagagttggagaagagcgggcatggacaggcggggcagaggcaggacccacgcccacacgggcctcagctaccaacgggaatcgagggcaattggggccggttgcttgaacaggttggaactatggcgctatgggcaagccagcgagagaaggaggttctccgaagggaaagggccgtagagtggcgcgaacgggcagttgaaaaacgagagagggcgttggaagaagtggaaagggcaatccttgagatgaagtggaaggtcagggccgagaaggaggcatgccagcgggaaaaagagcttcccgcggcggtgcaccctttccactttgtatag

SEQ ID NO: 35135 - DNA, 705 bp, Artificial Sequence
  Description of Artificial Sequence: Synthetic coding sequence
atgcgatctggggagcccgcctgcaccatggatcaggctcggggccttgatgacgctgctgctagaggcgggcagtgtcccgggctcggtccagcgccaacaccaacgccaccggggaggctgggagccccttatagtgaagcatggggatactttcacctcgcccctggaagacctggacaccctagtggccactgggcaacgtgccggctatgtggagaacaagtagggaggggccctggattccatgctgggacctccgccctatggcgccacttaagatccgctcatcgacgtgagttggaatcttcgggcgctggctctagtcccccggctgctccctgtcccccacctcctggaccagctgcggcgcccgagggcgactgggcgagacttctggaacagatgggggcgttggccgtgcgcggctcccgacgagagcgggagctggaacgtagggagctggcggtggagcagggcgaacgagcactcgagcgacgccgccgagcgctgcaggaggaagagagggccgccgcccaggcaaggcgtgagttacaagctgaaagagaagccctgcaggcgcgtctgagggacgtgtcgaggcgggagggcgctctcgggtgggccccagccgcgcctccccccttaaaggacgaccctgagggagacagggacggctgtgtaatcacaaaagttctactatag

SEQ ID NO: 35136 - DNA, 453 bp, Artificial Sequence
  Description of Artificial Sequence: Synthetic coding sequence
atgaggagcggcgaacctgcctgcacaatggaccaagccagaggcctagacgatgccgccgctcgtggtgggcagtgtccgggcttgggccccgctccaacccctaccccacccggacgcttaggcgccccttatagtgaggcttgggggtattttcatttggcccccgggaggccaggccacccctccgggcattgggcaacatgtagactgtgcggcgaacaggtgggaaggggacccggcttccacgccggtactagcgcgctttggagacacctccgatcagcgcataggagagagctggagtcctctggcgccggctccagccccccagctgctccctgcccccctccaccagggccagccgctgcgcctgaaggtgactgggcccgactcctggagcagatgggagcattagcagtgcgtgggagtcgccgagagagagagctgtag

SEQ ID NO: 35137 - DNA, 5970 bp, Artificial Sequence
  Description of Artificial Sequence: Synthetic coding sequence
atggcaacagccgatacccccgcgccagcatcttctggtctgagccccaaagaggagggcgagctcgaggacggggaaatttccgacgacgacaacaattcgcaaataagatcccgcagttccagttcatcctccggcggagggttgctgccctaccctagacgacgacccccacactcagctcgtggcggaggatcaggtggcggcggcggttcaagctcttcgagctcctcctctcaacaacagctgagaaacttttctagatcacgtcatgcttctgagcgcgggcacttgcgcggaccctccagctaccgccctaaggagcctttccgtagtcaccccccctcagtgcgcatgccttcgtcatcactaagtgaatccagtcccagaccctcgttttgggagcgctcacatcttgccctcgaccggttccgatttagagggcgtccctaccgggggggatcccgctggagtagaggccgaggtgttggcgagcgggggggaaagccaggatgtcgcccgcctctgggaggtggcgctggatccgggttcagtagttcacaatcatggcgagaaccatctcccccacgaaaatccagtaagtctttcgggaggagtccttcacgaaagcaaaactatagttccaaaaatgaaaattgtgtcgaggagacattcgaggatttgctgctgaagtacaagcagattcaactggagcttgagtgcatcaataaggacgaaaaattagccctttcctccaaagaggagaacgtccaggaggatccaaaaacactgaattttgaagaccaaaccagtaccgacaacgtgtcaattactaaggacagctctaaagaagtggcaccagaagagaagacacaggtcaaaactttccaggcatttgagttaaagccacttcgacagaaactgaccttgccaggcgataaaaatagattgaagaaggtcaaggacggcgctaaacccctgagcctgaaatctgatacaacagacagctcccaaggccttcaggacaaagaacagaatctaacccgccgcatctctacttccgacatattaagcgagaagaagctgggcgaagatgaggaagagctatccgaacttcagctgaggctcctggccctgcagtccgcgtctaagaaatggcagcagaaagaacagcaagtgatgaaggaatcaaaagagaaactaaccaaaacgaagacagtgcaacaaaaggttaagacaagtactaagacgcattctgcaaagaaggtcagcactacggccaagcaggctttgcgaaagcagcagaccaaagcctggaagaaattacagcagcagaaggaacaggagaggcagaaggaagaggatcagcgcaagcaggccgaagaggaagagaggcggaaacgagaagaggaaattcgaaaaatcagagatctgagtaaccaggaagaacaatataaccgcttcatgaaactggtcgggggcaaaaggagaagccggtctaaatccagtgatcccgatctgcgcaggtccctggataaacagccaacagattccggcggtggcatataccaatatgataactacgaagaggtagcgatggacacagactccgaaacttcatcgccagcgccgtcgccagtccagcccccgtttttttccgagtgctctctgggctatttcagcccagccccgtccctgtccctgcctccaccccctcaagtttcctctctgccccccttaagccagccatacgtcgagggactgtgtgtctcccttgagccactgcctccattgcccccactccctccgttgcccccggaggatccggagcaacccccaaagccccccttcgcggatgaggaagaagaagaagagatgcttctccgtgaggaactcctcaaatccctggcgaataaaagggcgtttaagcccgaggagacgtcctctaactctgacccccccagcccccctgtcctaaacaactcacaccccgtgccgcggagcaacctgagcatcgtgtccatcaacacagtaagtcaacccagaattcagaatccaaagtttcatcggggccctagactgcccagaaccgttatcagtctgcctaaacataaaagtgtggtcgtgacgctcaatgatagcgacgattccgagtcagatggcgaggcaagcaaatccactaatagcgtgtttgggggcttagagtcaatgatcaaggaggccagacggaccgcagagcaggctagcaagcccaaagtgccgcccaaatcagagaaagaaaatgacccactcagaaccccggaggccctgccagaagaaaaaaaaattgaatacagactgctgaaagaggagatagcaaatcgcgaaaaacaacgtctgatcaagtcggaccagcttaaaacatcctcttcatctccagctaatagtgacgtcgaaatcgatggaatcggcaggattgccatggtgacaaagcaggtgacggatgccgagtctaagctgaagaaacaccgaatcttgctaatgaaagacgaaagtgtgctgaagaacctggtgcagcaggaggccaaaaaaaaagagagtgtgaggaatgcagaggctaagatcactaaactgacagaacagctgcaggccaccgagaagatcctcaacgtcaatcggatgtttctgaagaagctgcaggagcagatacatcgggttcagcagcgagtgacgataaagaaagcattgacactgaagtatggagaagaactggctagggctaaagccgtggccagcaaagagattggcaagaggaaactggagcaggatcggttcggcccaaacaaaatgatgcgccttgactcctctcccgtgagttcaccacggaagcattccgccgagctgatagcgatggaaaagcgacgacttcagaaactggagtatgaatacgctctgaaaatacagaagctcaaagaagcccgcgccctcaaggctaaagaacagcagaatatttctcctgtcgtggaggaggaacccgaattctccctgccccagccaagcttacatgacctgacacaagacaagttgacccttgatacagaggagaatgacgttgatgacgaaattttgtctgggagcagtcgcgagaggaggcgtagttttctggagtctaattattttacaaagccaaacctaaaacataccgacaccgcaaataaggagtgtataaacaagctgaataagaatacagtcgagaaaccggaactgtttttaggcctcaaaatcggagaactgcagaaattgtactccaaggcagattcgctgaaacagcttatcctgaagacaaccaccggcattaccgaaaaggtcttgcatggccaagagatatccgtggatgttgacttcgtcacagcccagagtaaaaccatggaggttaagccctgtccatttcgcccttaccactcgccgcttctggtttttaaatcctacaggttcagcccatactaccggacgaaggagaagctgccactaagttccgtttcctattcaaatatgatcgagcccgatcagtgtttttgcagatttgaccttactggtacctgtaacgatgacgattgccaatggcagcacatccaagactatactctgtcacggaagcaactctttcaagatatcctttcctacaatctgtcccttatcgggtgcgctgaaacctcaacaaacgaagagatcacagccagcgccgaaaaatatgttgagaagttatttggcgtcaataaagacagaatgtctatggatcaaatggccgtcctactagtttccaatattaacgaaagcaagggtcatacaccaccctttacaacatataaggataaaaggaagtggaagcccaagttttggaggaagcccatttctgacaattctttttcttctgacgaagaacagagtactggcccaattaagtatgccttccagcccgaaaatcagatcaatgtgccagcccttgacacggtggtgactccagatgatgtcaggtactttaccaatgaaaccgacgacattgctaacctagaggcttccgtcctggaaaatcctagtcacgtccaactttggcttaagttagcctacaagtacctcaaccagaatgagggtgaatgtagtgagtctctcgacagcgctttgaatgtgctagcaagggctctcgagaataacaaagataatcctgagatttggtgccattacttacgactgttttcaaaacgggggacaaaggacgaggtgcaggaaatgtgcgaaaccgcagttgagtacgcacccgattaccagagtttctggacgtttctccaccttgagagcactttcgaagagaaggattacgtctgcgagcgaatgctggagtttcttatgggtgctgcaaaacaggagacttccaatattctgtccttccagcttctggaagctcttttgttccgggtgcaactacatatctttactggccgatgccagtctgcactggccatactgcagaacgctttaaaatctgcaaacgatggaatagtggccgagtacctaaagacctccgacaggtgtctcgcgtggctagcttatatccacctcattgaattcaatatcttgcccagtaaattctacgacccgtccaacgataacccctcacggatcgttaataccgaatcattcgtgatgccttggcaggctgtgcaggatgttaaaactaatccggatatgctgctcgcagtatttgaagatgcagtcaaggcttgcacagacgaaagtctggccgtcgaggagagaatcgaagcatgccttccattgtatacaaacatgatcgcgctccatcagctgttagaacggtacgaagccgcaatggaactttgtaagagtcttctggagtcatgccccatcaattgtcagctgctggaggccctcgtcgcattgtacctgcagactaaccagcacgataaagcccgggccgtgtggttaaccgcttttgagaagaacccacagaatgctgaagtattctatcacatgtgtaagttctttatactgcagaatcgaggggataacctgctgccgttcctgaggaagtttatcgcgtcattttttaagcctggtttcgagaagtataataatttggacctgttcaggtaccttttgaatatccctggtcccatcgatatcccttcccgtttgtgtaaagggaattttgatgacgatatgttcaaccatcaggtcccctacttatggctaatctactgtctctgccatcccctccagtcttccattaaggaaaccgtggaggcttacgaggctgcgctcggcgttgccatgagatgcgatatagtccaaaaaatctggatggactatctggtcttcgccaacaaccgggctgcagggagccggaacaaggtgcaagagtttaagttctttacagatctcgttaatcgctgcctagtgacggtgcccgctagatatcccattcccttcagcagtgcagattactggtcgaattatgagtttcataaccgcgtcatttttttctacttatcctgcgtgcctaagacacaacactctaagactctggagcgtttttgcagtgtcatgcccgcgaacagtggattggccttgcgcctcctgcagcatgagtgggaggagagcaatgtccagatactgaagctccaggccaagatgttcacctacaatattccaacctgcttggcaacatggaaaattgctatcgctgctgagattgtgctcaaaggacagcgggaagtacacaggctttaccaaagggcgctccagaagcttccactctgtgcttccctgtggaaagatcaactgctgtttgaagcatcagagggtggcaaaaccgacaatctgcgtaagctggtgtctaagtgtcaagagatcggtgtaagtctcaacgagctgctgaacctcaacagcaacaagaccgagtccaagaaccattag

SEQ ID NO: 35138 - DNA, 1041 bp, Artificial Sequence
  Description of Artificial Sequence: Synthetic coding sequence
atggctactgccgacacacctgctcctgcaagcagcggcctgtcacctaaagaggagggagagttagaggatggtgaaatcagtgatgacgacaataacagtcagattaggtcacgtagcagttcgtcttctagcggtggcggcctgctcccgtaccctaggagacgccccccacattcagcccggggaggagggtctgggggcggaggtggctcaagttcatccagcagctcctcacaacagcagcttcgcaatttctctcggagtcgccatgcgtccgagaggggtcatctgcgcggaccaagtagttatcgcccaaaggagccatttaggagccacccgccgtcagttcgcatgccttctagcagtctgagtgagagttctccacgaccttctttttgggagagaagccatttggccctggatcggttcaggtttcggggacgcccctatagaggaggctcaagatggagccgcgggcgaggggtgggagagcgcggtggtaagcccggatgtagaccgccgttgggtgggggggcaggctcggggttctcctcctctcagagctggagggagccctctccaccgaggaaaagtagtaagagcttcgggcgttctccatctagaaagcaaaactacagctctaagaacgaaaattgtgtagaggaaaccttcgaggatctcctgctgaaatacaagcagattcagcttgaactcgagtgtattaacaaagatgagaagttagccttgagctccaaagaggagaacgtccaggaagaccctaagaccctgaattttgaagaccagacctccaccgacaacgtgtcaataactaaagactcatccaaggaagtagctcctgaagaaaagacgcaggtgaaaacctttcaggcgttcgaactgaaacctttaagacaaaagctaacgttacccggagataaaaacagactcaagaaggtgaaggatggcgccaaacccctcagcctgaagtccgataccacagatagttcacagggcaacggaattaaatatttttcgtag

SEQ ID NO: 35139 - DNA, 606 bp, Artificial Sequence
  Description of Artificial Sequence: Synthetic coding sequence
atggaaaagattaaagctagactcaaagctgaatttgaggccctggagtccgaagaacgccacctcaaggaatacaaacaggaaatggatcttctccttcaagagaagatggcacacgttgaggagctacgcctgatccacgccgatatcaacgtgatggagaatacaatcaagcaatctgagaatgacctcaacaagcttctagagtctacaaggcgactgcacgatgagtacaagcctttgaaggaacatgtggatgccctgcgcatgacgctcggcctccagagactgcctgacctgtgcgaagaggaagagaagctgtccttggattattttgaaaaacagaaggcagaatggcagaccgaaccacaggagccccctatccccgagagtctggccgcagccgccgccgcggctcagcagttacaagttgcccggaagcaagatacgaggcagacggcaacattcaggcagcagcccccacccatgaaagcctgccttagctgtcatcagcagattcacagaaatgccccaatctgtccgttatgtaaggcaaagagtcgctccaggaacccgaaaaagcctaagcggaaacaggacgagtag

SEQ ID NO: 35140 - DNA, 675 bp, Artificial Sequence
  Description of Artificial Sequence: Synthetic coding sequence
atggccgacgagcaagaaattatgtgtaagttggaaagcatcaaggagattcgcaacaagacgctgcagatggagaagattaaagcccgtcttaaagctgagttcgaagctctcgagtctgaggagaggcaccttaaggaatacaagcaagaaatggatcttctccttcaagaaaagatggcgcatgtcgaagagcttcggctgatccacgcagatatcaacgtgatggagaatacaatcaagcagtccgagaacgatctgaataaactgctagaaagcacacgacgacttcacgacgaatacaagcccttaaaggaacatgtggacgctctgagaatgacacttggacttcagcgcttgcctgacctttgtgaggaggaagaaaagctgtcactcgattatttcgaaaaacagaaggcagaatggcagacagaacctcaggagccccccatcccagagtctctcgccgccgctgccgctgcagcccagcagttgcaggtggcccggaaacaagataccagacagaccgccacattccgccagcaacctcccccgatgaaggcctgcctgagctgccaccagcaaattcaccgaaacgctcccatctgcccgttatgcaaagccaagagccggtctcgaaatccgaagaaacctaagagaaagcaagacgaatag

SEQ ID NO: 35141 - DNA, 531 bp, Artificial Sequence
  Description of Artificial Sequence: Synthetic coding sequence
atggcagacgagcaggagattatgtgcaagctggaatccataaaggagatccggaacaaaaccctgcaaatggagaagatcaaagcccggctaaaagccgagttcgaagcgttagagagcgaagaaagacaccttaaggagtacaagcaggagatggatttgctcctgcaggagaaaatggcccacgtggaggaactgagactgattcacgctgatatcaacgtcatggagaacacaatcaagcagtctgaaaacgatctgaataagctgctagaatctacgaggagactgcacgatgaatacaagcccctgaaggagcacgtggacgcccttcggatgacgctgggactgcaacgtcttccagatctttgtgaggaagaggagaaactgtctctcgagcccgcctgccacgtcacatccaagttcaccggcatgcatctctatgccctgtttgcaaggccacgggtgggccctggaacccccaagtccaggaatgggagcaggatgaataaagagcgggaaagcacctag

SEQ ID NO: 35142 - DNA, 660 bp, Artificial Sequence
  Description of Artificial Sequence: Synthetic coding sequence
atgattcatttccacttgatttttctgtacgtggctcgaaataagacgcttcaaatggaaaagataaaggcccggctgaaagccgagttcgaagctttggaaagtgaggaaaggcacctgaaagaatataaacaggagatggacctactgctccaggagaagatggcccatgtcgaagagctgcgactgatccacgcagacattaacgtcatggaaaataccatcaaacagtcggagaatgaccttaacaaacttctcgaatctacaagacggctccatgatgagtataaacccctgaaagagcatgtggatgcgctgcggatgacactgggattgcagagactgcctgacttatgtgaggaggaggaaaaattaagtctcgattactttgagaaacaaaaggccgaatggcagacagaaccacaagagccccccatacctgagagtctagcagccgccgctgctgctgctcagcaacttcaagttgcccgtaaacaagacacacggcagaccgctactttccggcaacaacccccgcccatgaaggcttgcctgagttgccatcaacagatccatagaaacgcccccatctgccccctctgtaaagctaagagccggagtcgaaacccaaaaaaaccaaaacgaaagcaagacgaatag

SEQ ID NO: 35143 - DNA, 513 bp, Artificial Sequence
  Description of Artificial Sequence: Synthetic coding sequence
atggcaacccctatgcaccgtctcattgctaggaggcaggccgaagcaaataagcagcatgttcggtgtcagaaatgtttggagttcggacactggacctacgagtgcaccggaaaacggaagtacctgcacaggccctcgcgaactgcagaacttaagaaggccttaaaagagaaggaaaacaggctgctcctccaacagagcattggggagaccaacgtggagagaaaggccaagaagaagcgatccaaaagcgttaccagctcatcaagctctagcagcgacagtagtgcgtccgatagcagtagcgagtctgaggaaacaagcacgagttcttccagcgaggattctgacacagatgaaagtagcagttctagcagttcatccgccagctcaactaccagctccagctcgtcagactccgattctgattcaagcagcagctcatcttcttcaacatctactgattcgtcttccgacgacgaacctcctaaaaaaaagaagaaaaaatag

SEQ ID NO: 35144 - DNA, 501 bp, Artificial Sequence
  Description of Artificial Sequence: Synthetic coding sequence
atgtcatcaaaggattttttcgcctgtggccattcaggtcattgggcaagagggtgccctcgcggtggagctggtggacgcaggggcggcgggcatggtcgcggcagtcagtgcggatccaccaccctcagttacacttgctactgctgcggagagtctggacgtaatgcaaaaaattgcgtgctgctgggcaacatctgttataattgcggccgcagcgggcatatagcaaaagattgtaaggatccgaagcgagagcggcggcaacactgctacacttgtggccgattaggacacctggctagagactgtgatagacagaaggaacagaagtgttattcctgcgggaagttggggcacatacagaaagattgtgcccaggtaaaatgttaccgctgtggggaaatcggccatgtcgccattaactgttccaaggccagaccgggccagctactgccacttaggcagattcccaccagttctcaggggatgtcccagtag

SEQ ID NO: 35145 - DNA, 2850 bp, Artificial Sequence
  Description of Artificial Sequence: Synthetic coding sequence
atggccagtaaccacccagcgttctctttccaccagaaacaggtgctgaggcaggagttgacacagattcagtcatccctgaacggaggcggtggtcacggaggcaagggcgcccccgggccaggtggagctcttccaacatgcccggcctgtcataaaatcaccccccgaacggaggcccctgtgtctagcgtgagtaactccctcgaaaatgcactgcacaccagtgctcattctactgaggagagtctgcctaagcgtccactaggaaaacattcaaaagtgtcagtggaaaaaatcgacttaaaagggctgagccatacgaaaaacgaccgcaatgttgaatgcagctttgaggttctgtggtctgacagctctatcactagtgtgacaaagtcttcctccgaagtcacagagtttatcagcaagctgtgtcagctctatccagaggagaatctcgaaaagttaattccatgccttgcaggacccgatgctttctacgttgaaaggaaccatgttgacctggatagcggcctacggtacctcgcctccctcccctcccatgtgctaaaaaatgaccacgttagaaggttcctgagcacttcgtctcctccacaacagctgcagtcaccctcccccggcaacccaagcttgtcaaaggtgggaaccgtaatgggcgtgtctggaagaccagtgtgcggggtggcaggcattccttcaagccagagcggagcgcagcaccacggccaacacccggccggtagtgctgccccactgcctcactgcagtcacgccggttctgccgggtctgccctggcctatcgtactcagatggataccagtccagctatccttatgccaagttctctgcagacaccccagacacaggaacaaaacgggatactggattggctgaggaagcttagactgcacaagtactaccccgttttcaaacagctgtcaatggagaaattcttaagcctcacggaagaggatttgaacaagttcgagtccctgacgatgggagcaaagaagaaacttaagacgcagctggagctcgagaaggagaagagcgagaggcgctgcttgaatccctcagcgcctcccctcgttacctcatctggggttgcaagagtaccccctacctcccatgtggggccggttcagagcggcagagggagtcacgctgctgaattgagggtggaagttgaacagcctcatcaccagctgccaagggaaggctcttcttctgagtatagctcctcctcaagcagccccatgggggtacaggctcgggaggaaagcagcgactccgctgaagagaatgatagacgcgtggagatacacttggagtcgtcggataaggaaaaacctgtgatgctgctgaaccacttcacatcatcaagcgcccggccgactgcgcaggtgttaccggtccagaacgaggcctccagcaatccaagtggccatcatccacttcctccgcaaatgcttagcgctgcaagccatattacaccgatcagaatgttgaactccgtacacaaacctgaacgaggctcagcagacatgaagttactgtcttcatcagtgcattccctgctgagcctcgaagagaggaacaaaggctccgggccgaggtcgtccatgaaagtcgataagtccttcggatccgccatgatggatgtgctaccagcaagcgctccccaccagcccgtccaagtcctctctgggttgtccgaaagctcttcaatgtctccgacagtgtcattcggccccagaacgaaggtggtacacgcctcgacgttagatcgagttctgaagacggcacagcagcctgccctggtagtggagacatccaccgcagctactggtacgccctcaacggtcctgcatgcagctcggcctccaatcaaactgttactttcctcttccgtcccagctgattctgctatctctggccagacttcttgccccaataacgtacagattagcgtgccacccgccattatcaaccccagaaccgctctgtacaccgctaacacgaaggtcgcttttagcgccatgtcgagtatgcccgtgggacctctgcagggtggattctgcgccaacagcaataccgccagtcctagtagccatccttctacaagcttcgcgaatatggccactctgccttcatgcccggccccgtcttcttctcctgctcttagcagtgtccccgaatcttcattttattcatcatctggcggaggtggcagtaccggaaatattcctgccagtaaccctaaccatcaccatcatcatcaccatcaacaacccccagcacccccccaacccgccccaccgccaccagggtgcattgtttgtacaagctgtgggtgcagcgggtcttgcggtagctctggactgacagtttcatatgccaattattttcagcacccgttctccgggccgtccgtattcaccttcccctttctccctttctcacctatgtgcagtagcggatacgttagtgctcagcagtatggtggtgggtcgaccttccctgtggtgcacgccccatactcttcctctggtacccccgatccagttctgtccggtcagagcacctttgccgtccctccgatgcagaatttcatggccggcactgccggggtgtatcagacccagggcctggtaggctcgtctaatggatcttcccacaaaaagagcgggaatctgtcgtgttataattgcggtgccactggccatagagcccaggattgtaagcagccctcaatggacttcaacagaccaggaacttttcgtctcaaatacgcgcctcccgccgagtctttggactctactgattag

SEQ ID NO: 35146 - DNA, 933 bp, Artificial Sequence
  Description of Artificial Sequence: Synthetic coding sequence
atggaaaaatgcacaaaatcaagctcgaccatgcaagtcgagcctagcttccttcaggcggagaacctcatactcaggctgcagatgcaacatccgacaactgagaacactgctaagcgcggtcaagtgatgcctgccctggctaccaccgtgatgccagttccctatagccttgaacatctcacccagtttcacggggaccctgccaactgctctgaattcttgacacaggtcacaacgtatctaactgcacttcagatctctaacccagcaaacgacgcgcaaatcaagctgttcttcgattatctgtcccagcagctggaatcttgcggcatcatctccggcccagataagagcacactattgaaacaatatgagaaccttattctcgaattccaacagtctttcggcaaacctaccaaacaggagatcaacccattgatgaacgcaaagttcgataaaggcgataattcatcgcagcaggaccccgccactttccatttactggcccagaacctgatctgcaacgaaacaaatcagagtggccagttcgaaaaggctttagccgacccgaaccaagacgaggagtccgtaaccgacatgatggacaacttgccagacttgatcactcagtgtatccagctcgacaagaaacacagtgacagacctgaactgctccaaagcgagacccaactcccgctgcttgcatcgctcatccagcaccaggcgttattctcgcctacagacccccctcctaaaaaaggtccaatacaactgcgtgaagggcagcttccattaactccggcaaagcgtgctagacagcaggagacgcagctctgcctttattgtagccagagcggccatttcacacgggattgcctggccaaacggagtcgcgcccccgccactacaaataacactgctcaccagtag

SEQ ID NO: 35147 - DNA, 687 bp, Artificial Sequence
  Description of Artificial Sequence: Synthetic coding sequence
atgcaggaggtgtgttctggcgaagatactcacggaggccacttcccctcacgcccgggccacaccggcgctgaacagcagtgcgtacagggaaggctcaccctgtggctgccacagcagcatcgacgctggccgcagctcccccatagggccctgctcagacctgatccacatcttcggggcagccaggctcagcaggccgccccgacacagctaccggtcccccccgtgctgcaacagaggactcttcaccagggcttgccacccggcaccccacagcgtaggggccccgattccatacccggacagaaagcactgctgagaagagtccaggtgagccaggtccaggaaaaaatggacgagcgggaacttctgggtcagcacggagcaggagtgcaccaggtgcctcaccagcgagttagtactcaggcggagactcccggtgaggcgcgccgccctgggcgcgtgagaccagagcagggggctcctgccgccccgctaagggaagtgcagggtcccggcctgttgctgccatctcgcgcggtgacggggtgtcctcccgcgcctcgcgccaccccaagacagcctgaagagactctgttaccatgcgctaccccacgtggatgcgtcagcccctgcgcctggggtgctctggccggtctgcggggctgggctggcggaagctag

SEQ ID NO: 35148 - DNA, 726 bp, Artificial Sequence
  Description of Artificial Sequence: Synthetic coding sequence
atgtccctattatctgccatcgacacttccgctgccagtgtgtaccagcctgcacaattattgaactgggtgtatctgtcactgcaggacacacaccaggctagtgctttcgatgcattcagacctgaacctactgccggggccgcccccccagagctggccttcggcaagggccgtccagaacagctaggttcccccctccatagctcctacctgaattctttcttccagctgcaacggggagaggccctgtccaactctgtgtataaaggagcctcgccttatgggtcattaaacaatatcgccgacggactttcaagccttaccgaacactttagcgatctgacactgacgagcgaggctcgcaaacctagcaagcggcccccaccaaactatctgtgtcatttgtgcttcaacaaaggtcactatattaaggattgcccccaagcgcggcccaagggcgagggccttactccctaccaggggaagaagcgctgctttggggagtacaaatgtccgaaatgcaagcgcaagtggatgtccgggaactcatgggccaacatgggccaggagtgtattaagtgtcacatcaacgtctatccgcacaagcagcgccccctggagaagccagacgggctggacgtgtctgaccagtcaaaggagcatcctcagcacctgtgcgagaaatgtaaggtcctgggttactactgcaggagagttcagtag

SEQ ID NO: 35149 - DNA, 1215 bp, Artificial Sequence
  Description of Artificial Sequence: Synthetic coding sequence
atggcaacgggcggaggtgccgaggaggagcggaaaagggggcggccgcagcttctccccccagccaggcctgccgcccggggggaagaagccgacggaggtagagaaaaaatggggtgggctcaggtggtcaaaaacctggcagagaaaaagggggaattccgtgagccgcgcccacccaggcgcgaggaggagtctggcggggggggggggtccgccggactcggtggacctgcgggtctggctgcccccgatctgggtgattttccgcccgcagggcgcggagaccctaaaggtaggagacgcgaccccgccggggaagcagtagatccaaggaagaaaaagggcgccgccgaagccggaaggcggaaaaaggccgaggcggccgcagcggccatggccacccctgcaaggccaggcgaagccgaggacgccgccgagcggccacttcaggatgagcccgccgctgccgccgcggggccaggcaagggccggtttttggttcggatatgttttcaaggggatgaaggagcctgccctactcgggacttcgtagttggggcacttatactgcgaagtatcgggatggacccctcagatatttatgcagtaattcagataccagggtccagagaatttgacgtttctttccgctctgctgagaagcttgctcttttcttgcgggtatacgaagagaagagagagcaggaggattgttgggagaactttgtggtattagggcgatctaaatctagcctgaagactctttttatcctcttcagaaacgagacggtggatgtcgaagacatagtcacctggctgaagaggcattgcgacgtgctggcagtccccgtgaaggtaaccgacaggtttgggatctggaccggtgagtacaaatgcgaaatcgagttgcggcagggggaaggcggggtccgccaccttcctggcgcttttttcttgggcgccgagaggggatactcatggtacaagggacagcccaagacgtgttttaaatgcggctcacgaacccacatgtctggctcttgcacccaggatcgctgcttccgatgcggggaggagggccatttgtctccgtactgtcgaaaggggattgtgtgtaacctgtgtggaaagcgaggccacgcttttgcccaatgcccaaaggccgtgcacaactcagttgcggcccagctcaccggcgttgctgggcattag

SEQ ID NO: 35150 - DNA, 1428 bp, Artificial Sequence
  Description of Artificial Sequence: Synthetic coding sequence
atggtagaagacttggctgcctcctacatcgtgcttaaactcgagaatgagattcgacaggctcaggtgcagtggctgatggaggagaatgccgctctccaagctcagattccagagcttcagaagagccaagcagccaaggaatatgacctactcagaaagtcttccgaagccaaggaaccccagaagctgcctgagcacatgaaccccccagctgcatgggaggcccagaagacaccggaattcaaagaaccacaaaagcccccggagccacaagatctgctgccctgggaacccccggccgcatgggagttacaggaggcgcccgctgcccctgagagcttggctccacccgccacaagggaatctcagaaacctcctatggctcacgaaatacccacagtcctcgagggtcaagggccagccaacacgcaagatgcaaccatcgcccaagagccaaagaattcggagccccaagacccacccaacattgagaaaccacaggaagcacccgaataccaggaaacagccgcccagctcgaattcctggaactgcctccaccccaggaacccctggagccaagtaatgcacaggagttcctggaattgagcgccgcccaggaatctctggaaggccttatagtggtcgaaacttccgccgcaagtgagtttccacaggcgcctataggccttgaagcaacggacttcccccttcagtataccttgacttttagtggcgattcacagaaactgcctgaatttctggtgcaactttactcttatatgcgcgtgcggggccatttgtaccccaccgaagcggccttggtctccttcgttggcaactgtttcagcgggcgagcaggttggtggtttcaactgctgctggacattcaatccccattgctggaacaatgcgagtccttcatcccggtcctgcaagacacattcgataatcccgaaaacatgaaggacgccaatcaatgcattcaccagctgtgtcaaggcgaggggcacgtcgccactcacttccacttaatcgctcaggaactaaattgggacgagtccactttgtggattcaatttcaagaggggttggccagctccatccaggatgaattatcacacacaagcccagcaaccaatctgagtgatttaataactcagtgcatctccctagaagaaaaaccagatcccaacccacttggtaagagcagctccgccgagggagatggccccgagtcacctcctgcggaaaaccagcccatgcaggctgcaattaattgcccacatatctcagaggctgaatgggtccgctggcacaaagggaggctgtgtttgtactgtggctaccccggtcacttcgcccgtgactgcccagtcaaaccacaccaggctctgcaggcaggcaatatacaggcttgccagtag

SEQ ID NO: 35151 - DNA, 2355 bp, Artificial Sequence
  Description of Artificial Sequence: Synthetic coding sequence
atggggaatgagcacatatccgtccaccctgagaacagtgattgtattcaggccgatgtgaatagcgacgattataagggggataaagtctaccaccccgaaacgggaaggaaaaacgagaaagaaaaggttgggagaaagggcaagcaccttcttaccgtggatcagaagagaggagagcacgtcgtgtgtggttctacaagaaataatgaaagcgagagcaccctcgacctggaaggtttccagaatccaacagcgaaggaatgcgaggggctcgccacattagacaacaaggccgatcttgatggcgagagtacagagggcaccgaggagcttgaggattcactaaaccactttacccattccgtgcaagggcagactagcgagatgataccatcagatgaggaggaagaggatgatgaggaggaggaagaagaagaagagcccagactcaccatcaatcaacgagaggacgaagacggaatggcgaatgaggatgaacttgataacacctataccgggagtggcgacgaggacgctctgtctgaagaagatgacgagctgggtgaggccgctaagtacgaggatgtcaaagaatgtggaaagcatgtcgaaagggcgcttctggtggagttgaacaaaatcagtcttaaggaggaaaacgtgtgtgaggaaaaaaacagtcctgtggatcaaagtgactttttttacgaattctcgaaactgatcttcacgaagggaaagagcccgacggtggtctgcagtctatgcaaaagggagggccatctgaaaaaggattgtccggaagattttaagcgaatccaactggaaccgctccctcccctgacacccaagttcctgaacattctggaccaggtgtgcatccagtgctataaggacttttccccgacgatcatcgaggaccaggccagagagcatatacgccagaatctggaatctttcatcagacaggacttccctggaacgaagctgtccctgttcgggagttcaaaaaatggctttggttttaaacaaagtgacctcgacgtgtgcatgactattaacgggctggagacagcggaggggcttgattgcgtgaggacaatcgaggaactggcccgcgtgctccggaagcattcaggactccgaaacatcctacctattactaccgcaaaggttcctatcgtgaaattcttccaccttaggagcggtctggaggttgacatctctctgtataacaccttggcactgcacaatacacggctcttatccgcttacagtgctatagacccccgcgtgaagtacctctgttacacaatgaaggtttttaccaaaatgtgcgacattggtgacgcttcacgcggttcactgtcatcttacgcttacacgctcatggtactctattttctgcagcaacgtaaccctccagtcattcctgtactgcaggagatctataaaggtgaaaagaagcccgagatcttcgtggacgggtggaacatttacttcttcgatcagatcgatgaactaccaacgtattggtcagagtgcggcaagaataccgagtctgtggggcagctgtggctcggactgctcagattctacaccgaagagttcgattttaaggagcatgttatctccatcagaagaaaaagcctgcttaccactttcaaaaaacagtggaccagcaagtatatcgttatcgaggatccgtttgatctcaatcacaatctgggcgcaggattgagccggaaaatgacaaatttcattatgaaggcattcattaacgggcgcagggtgttcggcatcccggtgaagggttttcccaaggattatccatccaagatggagtactttttcgatcctgacgtgctcacggagggagagcttgcccccaatgatagatgttgcagaatctgtgggaagatcggtcactttatgaaagattgccccatgcgccgcaaggtacgccggagacgggaccaggaagacgcgctcaatcaacgctatcctgagaacaaagaaaagagatcaaaagaggataaggagatccacaacaaatacaccgaaagggaggtgtctacgaaagaagacaaaccaatacagtgtacgccacaaaaagccaaacccatgagagctgctgccgacttgggccgcgagaaaatactgaggcctcccgtcgaaaaatggaagcgccaggatgacaaggatctgcgagagaagagatgttttatttgtggccgggagggccacatcaaaaaagagtgtccacagttcaaaggctcctctggaagtctgtcatccaagtacatgacacagggaaaggcaagcgccaaacgaacccaacaggagtcatag

SEQ ID NO: 35152 - DNA, 507 bp, Artificial Sequence
  Description of Artificial Sequence: Synthetic coding sequence
atggaagctggaagtcctgaaaacaaaaagcagagatcaaggcccaggaagcccaggaaaactcggaacgaggagaatgagcaggacggagaccttgagggcccggttatagacgaatccgtactgtcaactaaagaattactcgggcttcagcaagcagaggaacgtctgaaaagggactgcatcgaccgcttaaaacgtcgcccacgcaattatccaacagctaagtacacatgccggctttgtgacgtgctcatcgagtctattgccttcgcccacaaacacatcaaagagaagcgccacaagaagaacatcaaagagaaacaagaggaagagctgttgactacattacctcctcccacccctagccaaattaacgccgtaggaatcgctatagacaaagtggtgcaggagttcggccttcataatgagaatctggagcagcgactagaaattaaacgcattatggagaatgttttccaacacaagctacctggaatcttttag

SEQ ID NO: 35153 - DNA, 375 bp, Artificial Sequence
  Description of Artificial Sequence: Synthetic coding sequence
atgagccagcctgacgtcctcctgctggtgcaggaatgtctcaaaaacagtgacagctttattgatgttgacgcggacttccacgccagggttcctgtcgtggtctgccgagagaaacaaagcggattgctgtgtaaggtgtcagcaggaaatgagaatgcttgtctgaccacgaaacatcttacagctttggggaagctggaacctaaactggtccctctggtgatagcatttagatattgggcaaaactgtgcagcattgacagaccggaggagggtggtctgcctccgtatgtgtttgccctgatggccatcttctttttacagcagaggaaagagccactgctgccagtctacctcggctcttgggtgtag

SEQ ID NO: 35154 - DNA, 1188 bp, Artificial Sequence
  Description of Artificial Sequence: Synthetic coding sequence
atgactattaatggactcgagaccgccgaggggctggactgtgttcgaaccattgaggagctagcccgggtgctgcgcaagcactctgggctacgaaatattctaccgatcaccaccgccaaagttcccatcgttaaatttttccatctccgttccggcctggaagtggacattagtctatataatacattggccctgcataatacccgcctgctttcagcgtacagtgcaattgatccaagggtgaaatatctgtgctatacgatgaaagtgtttaccaagatatacaaaggggagaagaaacctgaaatcttcgtcgatggatggaatatctacttcttcgaccagatcgatgaactgcccacctattggtctgaatgtggaaagaacactgagtcagtcggacagctgtggctgggattgctgcgattctacaccgaggagttcgatttcaaggaacatgtaatcagcattaggaggaagagccttctgaccactttcaagaaacaatggacttccaagtacattgtcatcgaggatcccttcgatttgaaccacaacttaggcgcggggctctcacggaagatgacaaactttatcatgaaggcgttcataaatggccggcgggtttttggtatccctgtgaaaggatttcctaaagattatccctccaagatggaatatttctttgaccccgacgtgttgacagagggagaactggctcctaacgatagatgttgccggatatgcggaaagattggtcacttcatgaaagactgcccaatgcggcgtaaagtgcgtcgccgccgcgaccaggaggatgctcttaatcagagataccctgaaaacaaggaaaagaggagcaaagaggataaggagatacacaataagtacacagaaagggaagtgtcaacaaaagaagataagcccatacagtgcacccctcagaaagccaagccgatgagggccgccgctgacctgggtcgggaaaaaatcttaaggcctcccgttgagaaatggaagcgacaagacgataaggacctgcgcgaaaaacggtgctttatttgtggaagagagggccatatcaagaaagaatgcccgcagttcaaaggctcctctggcagtctttcctctaagtacatgacgcaaggaaaagcatccgccaagagaacacaacaagaatcctag

SEQ ID NO: 35155 - DNA, 3780 bp, Artificial Sequence
  Description of Artificial Sequence: Synthetic coding sequence
atgggagacactgccaaaccctatttcgtgaagcggactaaagacaggggaacgatggatgatgatgattttaggagaggacaccctcagcaggactatctgattattgatgatcatgcaaaaggacacggcagtaaaatggaaaagggcctgcagaagaagaagatcacccccggcaactatggaaataccccacgtaaaggcccatgcgctgtgtcatctaatccatacgcattcaagaaccccatctacagccagcccgcctggatgaatgacagccacaaggaccagagtaagagatggctgtcagacgaacatacaggtaactctgacaattggcgtgagtttaagcctggaccgagaattccagtgatcaatagacagcggaaggactccttccaggaaaacgaggatgggtatcgatggcaagataccaggggttgtagaacggtgaggcggcttttccataaagatctgactagcttagagacaaccagcgaaatggaggctgggtccccggagaacaaaaagcagcgttcaaggcctcgcaagccacgaaagacccgaaacgaagagaatgaacaagatggagatctggagggccctgtgatagacgagtcagtccttagtactaaggagctgctgggccttcagcaagcagaagagcgccttaagcgcgactgcatcgaccggttgaagaggcgccccaggaattacccaacggccaagtacacctgccgcctatgtgacgtgctgatcgaatccattgcctttgcacataaacatattaaggaaaagcgacataaaaagaatataaaggaaaagcaggaggaggaactactgaccacactgccccctcctaccccctctcagataaacgccgttggaatcgccatcgataaggtagtgcaggagttcggactgcataacgagaatttagagcagcggctggaaataaagcggataatggaaaacgtattccaacacaaactccccgattgtagcctccggttgtatggctcctcctgcagtcgcctgggcttcaagaattcggacgtcaatattgatatccagtttcccgctatcattgagggcttttcgctctccaaactgggaaactttaacttacaggacatagaaaaagacgtagtgatctgggagcatactgatagtgcagccggcgacactgggataaccaaggaagaggcaccccgggagacgcccattaagcggggacaggtgtcccttatcttagatgtgaaacaccaaccttcagtgccagtagggcaactctgggtggagttgctccgtttttacgcattagagttcaatttagccgacttagtgatctccattcgggtaaaagagttagtgtcccgtgaactgaaggattggcccaagaagcgcatcgccattgaggacccttacagtgttaaaagaaacgtggccagaaccctaaactcgcaaccagtgtttgagtacatactccactgcttgagaactacttataagtatttcgcactgccgcacaagataactaaaagctcactgctgaaaccattgaatgccatcacctgcatatccgagcattctaaggaagtgattaaccatcatcccgatgtgcagactaaggatgacaagctgaagaacagcgtcctcgctcaagggcctggcgcaacctccagtgccgccaatacctgtaaggtccaaccacttactctgaaagaaacagcagagtcctttggatcccccccgaaggaagagatgggcaatgagcatatctctgtgcaccctgagaatagcgactgcatacaggctgatgtcaacagtgacgattacaaaggcgacaaagtttaccatcctgaaactggacgtaaaaacgagaaagaaaaggtcggtaggaaaggtaagcacttgctcacagtagatcagaaaaggggcgagcacgtggtttgcggatccacacgcaataacgagtctgaaagcacactcgaccttgaggggtttcaaaatcctacagcaaaggagtgcgagggcctggcgactctggacaataaagcagacctcgacggagagtcaaccgaaggaaccgaggagctggaggattctctgaaccacttcactcactccgtgcagggccagacatccgagatgatcccttctgatgaggaggaggaagacgacgaggaggaggaagaggaggaggagccacgacttaccatcaatcaacgcgaagatgaggacggaatggccaacgaagacgagcttgataacacttacaccgggtcaggggacgaagatgccctgtccgaagaagacgacgaactgggggaggccgctaagtacgaggacgtgaaggaatgtggaaaacacgtggagcgcgcactgctcgtagagctcaataagatctcgctaaaggaagagaatgtttgcgaggagaagaatagcccggtggaccaatctgacttcttctacgagttcagcaaactgatctttactaaggggaaaggactggactgcgtaaggacaatcgaagagttggccagggtactgagaaaacacagcgggttgcggaacatattgccgatcactaccgcaaaggtacctattgtgaaattttttcatctgcgcagtggactggaggtggatatttccctctacaataccctggccctccataacacacgcctgctgtctgcatactcagccattgaccctcgagttaaatatctatgctataccatgaaggttttcaccaaaatgtgtgacatcggggacgcatctcggggatcactatcttcttacgcctataccttgatggttttgtattttctccagcagagaaaccctccggtcattccggtgttgcaggagatctacaaaggagaaaaaaagccagagatttttgtggacgggtggaatatctactttttcgaccagatagacgaactccctacttattggagcgagtgcggcaaaaacaccgagtccgtggggcagctctggctaggcttgctgcgtttctatacagaagaattcgacttcaaggaacacgtaatctctatcagaagaaagagcctactgacgacattcaaaaagcagtggacttcaaaatacatagtaatagaggacccatttgacttgaaccacaacttaggggctgggctgtccagaaaaatgaccaactttatcatgaaagcctttattaacggccggcgtgtttttggaattcccgttaagggctttcctaaagattaccccagcaaaatggagtacttctttgatccagatgtcctgacagagggcgagctcgcgccaaatgacagatgttgtaggatttgtggaaagataggccatttcatgaaggactgtccaatgcgaagaaaggtgagaagaagacgggatcaagaagatgcactgaatcagcgataccccgagaacaaggagaagagatctaaagaagataaagaaattcataataagtacactgaaagagaggtttcaacaaaagaggacaagcctatccagtgcacgcctcagaaggcgaagcctatgcgtgcggctgctgatctgggccgggaaaaaatcttgcggcctcccgtggaaaagtggaagcggcaggatgacaaagacctacgggaaaaaagatgcttcatctgcggacgcgaagggcacattaagaaagagtgcccccagttcaaagggagttcaggttctttgtccagcaagtacatgacccagggcaaggcaagcgcgaagagaacgcagcaggagtcctag

SEQ ID NO: 35156 - DNA, 4374 bp, Artificial Sequence
  Description of Artificial Sequence: Synthetic coding sequence
atgggagacaccgcgaagccctatttcgtgaagcgaaccaaggatcgcggaaccatggatgatgatgactttcgcagggggcacccccagcaagactacctgattatcgatgaccacgctaagggccacggctccaaaatggagaaaggcttgcagaagaagaaaatcactccagggaattacggaaacactcctaggaaagggccttgcgcggttagctctaatccctacgcattcaagaatcctatatattcccaaccagcgtggatgaacgactcccacaaagaccagtccaaaaggtggttgagtgacgagcacacaggaaacagcgataactggagggagttcaagccaggacccagaattcccgtaatcaacaggcagagaaaagatagctttcaggaaaatgaggacgggtatcgatggcaggacacccgggggtgtcgcacagtcaggcggctattccataaagatttgacctcactagagacgaccagcgaaatggaagcagggtccccggaaaataaaaaacaaagatcgagacctaggaaacccaggaaaactcgtaatgaagagaacgagcaggacggtgacttggagggccccgtaatcgatgagtctgtgctgtctaccaaggaattgctcgggttgcaacaagccgaggaacgactaaagcgagactgcatcgaccgtttgaaaagacggccccggaactacccgaccgcgaagtacacatgccgcctatgcgatgtcctcattgagtctatagcgtttgcgcataaacatatcaaggagaagcggcacaagaaaaacattaaagagaaacaggaagaggagttattgacaacccttcctccacccacccctagccagattaatgcggtcggcattgcaattgataaggtggtgcaagagttcgggctccacaatgaaaatttggagcagagattggagataaaaaggatcatggaaaacgttttccaacacaagctcccggattgtagcttgaggctttacggctcgtcttgctcccgcctaggattcaagaactccgacgtgaatatcgatattcaatttcctgccatcatgagccagccagacgtgctgctgttagtgcaggaatgtcttaaaaatagcgacagctttatcgacgtggatgcagactttcacgccagagtacccgtggtcgtttgccgtgagaagcagagtggactcctgtgcaaagtgagcgcggggaacgagaatgcctgtctgacaacgaaacacctgactgccctgggtaaactggagcccaagctcgtcccgctggttatcgcattcaggtattgggcaaagttgtgttcaatagatcggccagaagaaggagggctcccaccctatgtgtttgctcttatggcgatattttttcttcagcagcggaaggagcctctgttgcccgtataccttggatcatggattgagggcttctctttgtcaaaattgggcaacttcaatctccaggacatcgagaaagatgtagtgatatgggagcacacagatagtgctgctggagacaccggcatcactaaggaggaagcaccacgggagacacctataaagcgaggtcaggtttctttgattcttgatgtcaagcatcaaccaagcgtgcctgtaggccagttatgggttgagctgctgcgcttttacgccctggaatttaatctggccgacttggtgatcagcatcagggttaaggaacttgtgagcagggaattaaaagactggcccaaaaagcggattgcaatcgaagatccgtactcggtgaagcgcaatgtggcgaggacactgaacagccagcccgtgttcgaatacattctgcactgtttgcgaaccacttacaaatatttcgcgctcccccacaagataactaagtcaagcctgctgaaaccgcttaatgctatcacatgtatcagcgagcacagtaaggaagttatcaatcatcaccccgatgttcagaccaaagacgataagctgaagaattcggtcttggctcagggccccggagccacatcttccgccgctaacacatgcaaggtgcagccgctaactctaaaagagaccgccgaatcattcggtagcccaccgaaggaagagatgggcaacgaacacattagcgtccatcctgagaattcagactgtattcaggctgacgtaaacagcgacgactacaagggtgataaagtgtaccatccggagacaggccgcaaaaatgagaaagagaaggtggggagaaaggggaagcacctccttaccgttgatcaaaaacgaggcgagcacgtcgtctgcgggtcgacgcgtaacaacgaatccgagagtacattggacctcgaaggattccagaatcccaccgcgaaagaatgtgagggtctggcgaccttggataacaaagccgatctggacggagagtccaccgaaggaaccgaggagctagaagatagtcttaatcatttcacacacagcgtgcagggacagacctctgagatgattcctagtgacgaggaggaggaagacgatgaagaagaggaggaggaggaggagccccgtctcactatcaatcaaagggaagatgaggacggtatggccaacgaggacgaacttgacaacacctacacaggttcaggcgacgaagacgccttgtccgaagaagacgacgagttgggcgaagctgctaagtatgaagacgtgaaggaatgtggtaaacacgtggaacgcgccctgttggtcgagctgaacaagatcagcttgaaggaggaaaacgtctgtgaagagaagaatagccccgtggatcagagtgacttcttttatgagtttagtaagctgatctttactaaggggaagtcccctacagtcgtttgttctctgtgcaagcgcgagggacatctgaaaaaggactgccctgaggatttcaaacgaattcaacttgaaccactgccaccgctaacccccaaatttctcaatatactggatcaggtttgtattcagtgctacaaggattttagccccactataattgaagaccaggcacgagaacacattcgccagaatttagaaagctttatcagacaggatttccctggaaccaaactgagcctatttggtagcagtaaaaacggcttcggattcaagcaaagcgatctcgacgtgtgtatgactatcaacgggctcgaaaccgccgagggtttagattgcgtgcgcaccatcgaggagctggctcgtgttctccggaagcattcaggcctgcgaaacattcttccaatcacaaccgctaaagtgcctatcgtgaagttctttcatcttcgctctgggcttgaagtggacatcagcctgtacaatacactcgccctgcacaatactaggctgctgtcggcgtattctgccattgatcctcgggtgaagtatctctgctacaccatgaaagtattcacaaagatttacaagggtgagaagaagccagaaatcttcgtggacgggtggaacatctattttttcgaccagatcgatgaactgcctacctattggagcgagtgcgggaagaataccgaaagcgtgggtcagctgtggctgggactcctgagattctatacagaagagttcgattttaaggaacatgtaattagtatccgacgcaagtcactcctgacaacttttaagaaacaatggacatcgaaatatatcgtgatagaggacccgttcgatcttaatcacaacctgggcgccgggctgagcagaaagatgactaactttatcatgaaggcattcatcaatgggcggagggtcttcggtattccggtcaaaggcttcccgaaagactacccctcaaagatggagtatttttttgatcctgacgtcctcaccgagggcgaactcgcccctaacgatcggtgttgcaggatctgtggcaagattggccatttcatgaaggactgtcccatgcgccggaaagtgaggcgccgaagggatcaggaggatgctcttaatcagcggtatccagagaacaaggaaaaacggagcaaggaggataaagaaattcacaacaagtataccgagagagaagtgagcacgaaggaggataaacccatccagtgcaccccacagaaggcaaagccaatgagagcagccgccgatctgggcagggaaaagattctgagacctcccgttgagaaatggaagaggcaagacgacaaagacttgagagagaagcggtgctttatttgcggcagggaggggcacatcaagaaggaatgccctcagtttaaggggagttccgggagcttgtcctccaaatatatgacccaaggcaaggcctctgctaagcgcacacagcaggagagttag

SEQ ID NO: 35157 - DNA, 4488 bp, Artificial Sequence
  Description of Artificial Sequence: Synthetic coding sequence
atgggtgatacggcaaagccttactttgtgaaacgaactaaggatagaggcaccatggatgatgatgattttagacgcggacacccgcaacaggattatttaataatcgatgaccatgccaaagggcacggctcaaaaatggagaaggggctgcagaagaagaaaataactccaggcaactacggtaatactccaagaaaaggtccctgcgcggtcagtagcaatccatacgccttcaagaatccgatctactctcagccagcctggatgaatgactcacacaaggaccagtcaaaacgctggcttagcgatgaacataccggaaactccgacaattggcgtgagttcaagccggggccgagaattcctgtaatcaatcgccagaggaaggattcatttcaagaaaacgaagacggttacaggtggcaggatactcgcggatgcaggacagtgcgcaggctttttcataaagatctgacatctctcgagaccacttctgagatggaagcaggcagcccagaaaacaaaaaacaaagaagcaggccaaggaagcctcggaagacacgcaacgaggagaatgaacaagacggcgatttagaaggaccggtcattgacgagtcggtgttgagcaccaaggaacttctggggctgcaacaggcagaggaacgcctcaagagagattgcatcgacagactgaaacgacgcccgcgcaactatccaaccgccaagtatacctgtcggttgtgcgacgtactgatcgagtctatcgcttttgcccataagcacatcaaggaaaaaagacacaagaagaacattaaggagaaacaggaagaggaactcctcacgacccttccaccaccaactccctcacagatcaacgccgtcggaattgctatagacaaagttgtgcaggaatttggcttgcacaatgagaaccttgagcagcggttggagatcaagagaatcatggaaaatgtgtttcaacataaactgcccgactgttccctgaggctgtacggatcttcctgctcgaggcttggattcaaaaatagtgatgtgaatattgacattcagtttccagccattatgtctcaaccagatgttctcctgttggtccaggagtgcctcaagaactccgactccttcatcgacgtggacgccgattttcacgctcgcgtgcccgttgtggtgtgtcgagagaaacagtccggacttctgtgcaaagtgtcagccgggaatgagaacgcctgcctgactactaaacaccttaccgcccttgggaaactcgaaccgaagcttgtgccactggtgattgcattcagatattgggctaaactgtgctccatcgatagacccgaagagggcgggttgccaccatatgtgtttgctctaatggccatatttttcttgcagcaacggaaggagcctttactacccgtgtacctaggcagctggattgagggattctcactctcaaaattgggaaattttaaccttcaggatatcgaaaaagatgtggtgatctgggaacacactgacagcgccgcaggggatactggcattaccaaagaagaagcaccccgtgagactcccatcaagcgcggccaggtgagcctgatactggatgtgaagcaccagccctcagtaccagtgggacagctgtgggtggaattactcaggttctacgccctcgagtttaatcttgctgatttggtgatttctatccgggtgaaagaactggtttctagagagctaaaagactggcccaagaagcggatcgcaattgaggatccctattctgtgaaaagaaatgtggccagaactctcaattctcagcccgtgttcgaatacatcttacactgcctacggactacctataaatacttcgcactgcctcacaagattacgaaaagctccttgctcaagcctctcaatgcaattacttgtatctccgaacactctaaagaagtcattaaccaccacccggatgtccagacaaaagatgacaaactgaaaaatagcgtgttagcccagggcccaggggctacctctagcgcggcaaacacctgcaaggtgcagccgctcaccttaaaggaaaccgcagagtccttcgggtccccccccaaggaggagatggggaatgagcacatctccgtccatcctgagaattcagactgtattcaggctgacgtgaattctgacgactacaaaggagacaaagtgtaccatccggagaccggtcggaaaaatgagaaggagaaggttggaagaaaaggaaaacacctgctgaccgtcgaccaaaagcgaggcgaacacgttgtgtgcggctccacaagaaataatgaatctgaatccaccttggaccttgaaggctttcagaatccaaccgctaaggagtgtgagggattggcaacccttgacaataaagcagacctcgacggggagagtaccgaaggaacagaggagctcgaggactccttaaaccattttacacactccgtgcaaggccaaacatcggaaatgattccttcagacgaggaggaggaggacgatgaggaggaagaggaggaggaggaaccgcggctgaccatcaaccaacgtgaggatgaggacggcatggctaacgaggacgaattagacaatacttatacgggcagcggcgatgaggacgcactgtctgaggaggacgacgaactgggggaggctgcaaaatacgaagatgtcaaagagtgcgggaaacacgtagaaagagcccttctcgttgaactgaacaagatttcgttaaaagaggaaaacgtgtgtgaagagaaaaattctccagtcgatcagagcgactttttttacgagttctccaagttgatctttacaaagggaaagagccccacagtggtttgcagtctttgtaagcgcgaaggccacttgaaaaaggactgtccagaggactttaagaggattcagttagagcccttgcctcccctgacaccaaagtttctgaatatcctagaccaggtatgtatccagtgctacaaggacttctcgcctaccattattgaggaccaagcaagggagcatattagacagaatctggagtcgttcattagacaggattttccaggtacaaagttatcacttttcgggtcttctaagaatggctttggatttaagcagtccgacttggacgtgtgcatgactatcaacgggttggagacggcagagggccttgactgtgtgagaaccattgaagagcttgcccgggtgctccgtaaacactccggattgcgcaatatattgcccattacaacagctaaggtgcctattgtgaagtttttccaccttagaagcgggttggaagtggacatcagtctctacaatacactcgcactccacaatactaggctgctgagcgcctacagcgctatagacccgagagtcaaatatctgtgctatacgatgaaagttttcactaagatgtgtgacatcggcgacgcatcccgaggatctctatcctcatatgcgtatactctgatggtgctgtactttctgcagcagcgcaaccccccagtgatccccgttttgcaggaaatttacaagggcgaaaaaaaaccggagatctttgtcgacgggtggaacatttacttctttgaccaaatcgacgagctgcccacctactggagtgagtgcggaaaaaacacagaaagcgtgggacagctgtggcttggactgctacgattctacacagaggaattcgatttcaaggagcatgttatatctattaggagaaagagcttgcttacaacatttaagaaacagtggacttcgaaatatattgtgattgaagatccattcgacctaaatcacaacctgggggctggactgtctcggaagatgaccaatttcataatgaaggccttcataaacgggcgacgggtgttcggtatccctgtgaagggctttcccaaagattaccccagtaaaatggagtacttcttcgaccctgacgttcttaccgaaggtgagctggcccccaacgaccgctgctgccgtatctgcgggaaaatcggacacttcatgaaggactgtccaatgcgccgaaaagtacgacgccgcagagatcaggaagatgctctgaaccagcggtaccccgaaaacaaagaaaagcggtctaaggaggacaaagagattcacaataagtacaccgaaagagaagtgtctacgaaggaggataagcctatccagtgtaccccacagaaggctaagccaatgcgagccgctgccgaccttggcagagagaagatactcaggccaccggtcgaaaaatggaaaagacaagacgataaagacctccgtgaaaaacgctgtttcatctgcggtagagaggggcatatcaagaaagaatgtcctcagttcaaagggtccagcggatccctgagctccaagtatatgacccaggggaaggcttctgccaaaaggacacagcaggagagctag

SEQ ID NO: 35158 - DNA, 498 bp, Artificial Sequence
  Description of Artificial Sequence: Synthetic coding sequence
atggaagccggcagccccgagaacaaaaaacagcgaagcaggcctagaaagccacgtaagacccggaacgaggaaaacgagcaggacggtgacctggagggaccagtcattgatgagagcgttttgagcacaaaagaactcctcgggcttcagcaggcggaggaaagacttaagagagattgtatcgataggctgaaacgcaggccccgcaactaccctacggccaaatatacttgcaggctgtgtgacgtgctgattgaaagtatagccttcgcgcacaagcatataaaggaaaaacgacataaaaagaacatcaaggagaaacaagaggaggaattgttgacaaccctgccacctccaacaccatcacagatcaacgccgtggggatcgccatcgataaagtggttcaggagttcgggctgcacaacgaaaacctcgaacagcggctcgagatcaaacgaatcatggaaaatgtgtttcagcataagctcccctag

SEQ ID NO: 35159 - DNA, 618 bp, Artificial Sequence
  Description of Artificial Sequence: Synthetic coding sequence
atgtttggagggtacgagaccattgaggcatatgaggacgacctttatagagacgagtcatccagcgagctctccgtcgatagtgaggtggagtttcaactgtacagccagatccactacgcacaagacttggatgacgtcatccgggaagaagagcatgaagaaaagaactctgggaactcagaatcctcttccagcaaacctaaccagaagaaattaatagttctctcggacagcgaggtcattcagttatcagacggtagcgaggtgattacactctctgatgaagattcgatctatcggtgtaagggaaaaaacgtgagagtccaagctcaggaaaacgcacatggcctgtctagtagcctgcagtctaatgaattggtcgataagaagtgcaagtctgacatcgagaagcctaaatcagaggagcggtcgggcgtcattagagaggtgatgattattgaggtttcctcatctgaagaggaagaatctacaataagcgaaggggacaatgttgaaagctggatgctgctagggtgcgaggtcgatgacaaagacgatgacatcctgctcaacctagtgggatgtgagaattcagtgacggaaggacaggaatag

SEQ ID NO: 35160 - DNA, 1632 bp, Artificial Sequence
  Description of Artificial Sequence: Synthetic coding sequence
atgatgtttggtggatacgaaacaatcgaagcctatgaggatgacctctaccgggatgaatcctcatccgaactgtccgtggacagtgaggtggaatttcagctttattcccagatccattacgcccaggacttggacgatgtcattcgagaagaagagcacgaagagaagaacagcggcaacagcgaatccagttcctcaaaaccgaaccagaaaaagcttattgtgctttcagattctgaggttatccagctgagcgacggaagtgaagtgatcacgctttctgacgaagactcaatctaccggtgtaagggaaaaaacgttagggtccaggctcaagagaacgcccacggactgtctagttctctgcaatcaaatgaactggtggacaaaaagtgcaaatccgatattgagaagcctaagtcagaagagcggtcgggcgtcatccgcgaagtaatgattatcgaggtctcgagctccgaggaagaagaaagcacaatcagcgagggcgataatgtggagagttggatgctactagggtgtgaggtggatgataaagacgatgacattttacttaatctcgtcggctgcgagaattcagtgactgagggtgaggatgggatcaactggagtattagcgacaaggatatcgaggcccaaatcgcaaataacaggactcccggccgctggacccaaaggtactattctgctaataagaacatcatttgtagaaactgtgataaaaggggtcacctgtcaaaaaattgcccgctgcctcgcaaagttcggcgctgctttttgtgtagtcgccgaggacatctcctttacagttgcccggccccgttgtgcgagtactgccccgtgccaaaaatgctggatcactcctgtctgtttcgacattcttgggataagcagtgcgataggtgccatatgctggggcactacaccgatgcctgcacggagatctggcgccaatatcacctcacaaccaaacccggaccacccaaaaagcctaaaacgccgtcgaggcccagcgccctcgcatattgctaccattgtgctcagaaggggcactacggacacgaatgcccagaacgagaggtctacgatccctcacccgttagcccctttatctgctactacgacgacaaatatgagattcaggaaagggagaaacgcttgaagcagaagataaaagtgctcaaaaagaatggtgtcatccccgaaccgtcgaaattgccctatattaaagccgcaaacgaaaaccctcatcacgatatccggaagggcagggcttcctggaagtcaaatcgatggcctcaggaaaacaaagagacccagaaggagatgaagaacaagaaccggaattgggagaagcaccgaaaggccgatcgccaccgtgaggtggatgaagatttcccgcgcgggccaaagacctattcatctcctgggagctttaaaacacaaaagccctcaaaacccttccatagaagttcacactatcatacatcccgcgaagacaaaagccccaaagagggcaaacgcggcaaacaaaagaaaaaggagcgatgctgggaggacgatgacaacgataatctttttctgattaaacagaggaaaaagaagagttag

SEQ ID NO: 35161 - DNA, 762 bp, Artificial Sequence
  Description of Artificial Sequence: Synthetic coding sequence
atgttggatcactcgtgcctgtttaggcacagctgggacaaacagtgtgacaggtgtcacatgctgggccactacacagacgcctgcaccgagatttggagacagtaccatctcaccactaaaccgggtcctcctaagaaaccaaaaacccccagccgcccctcggccttggcatattgttatcattgcgcccagaaaggacactacgggcacgaatgccctgaacgggaggtatacgatccttcccctgtgagcccattcatctgttactacgacgataagtatgagattcaggaacgggagaagaggttaaaacagaaaatcaaggttctgaagaagaatggtgtaataccggaaccgtctaagttaccctacattaaagcagctaacgaaaatcctcatcacgacattaggaaaggtagggcctcatggaagagcaaccgctggccccaagagaacaaggaaactcagaaagaaatgaagaataagaatcgcaactgggagaaacaccgtaaagccgataggcatcgcgaagtagatgaagatttcccaagaggcccgaaaacgtactcgtcgccaggctctttcaagacacagaagcccagcaagccatttcataggtcctcacactaccatacttccagggaggataagtctccaaaggagggaaaaagggggaaacagaagaagaaggaacgttgttgggaagatgacgacaatgacaacttattcttaatcaaacagaggaaaaaaaaatcatag

SEQ ID NO: 35162 - DNA, 2124 bp, Artificial Sequence
  Description of Artificial Sequence: Synthetic coding sequence
atggctgccgaggtatactttggtgacttagagctgttcgaacccttcgaccatcccgaggaatctatccccaaacccgtgcatacaagattcaaagacgacgacggcgatgaagaagacgaaaatggcgtaggagacgcagagctgcgcgagagattgcgccagtgcgaagaaactatcgagcaactccgggcagagaaccaagagctaaagcgaaagctgaatatcctgactcggccttctggcattttggtcaatgatacgaagctcgacgggcctattctccaaatcttgttcatgaataatgcaattagcaagcagtaccaccaggagatcgaggaattcgtcagcaatcttgtgaaaagatttgaagaacagcagaagaatgacgtcgagaaaacatcatttaacctcctccctcagccaagctctatagtacttgaagaggaccataaggttgaagagtcttgcgcaatcaaaaataacaaggaggcctttagcgtggtgggatctgtactctacttcactaacttttgtctggataaactaggtcagcctttactgaatgaaaaccctcagctgagcgaaggttgggaaatcccaaagtaccatcaggtgttttcacacatcgtgtccctagaaggtcaagaaatccaggtcaaggccaagcgccccaagccacattgcttcaactgcggatccgaggagcatcagatgaaagactgtcctatgcctcggaacgccgcccgaatttcagagaaaagaaaagaatacatggacgcatgcggagaggctaataaccagaacttccagcagagataccatgcggaagaagttgaagagcggtttgggaggttcaaacccggcgtcatctccgaggagctgcaagacgccctgggtgtgactgacaagtcccttcctccctttatttaccggatgcgtcagcttgggtatccgcccgggtggctgaaagaagctgagctggagaactcaggcctggcactgtacgatggcaaagatggcaccgatggcgagactgaagtgggggagatccaacaaaacaaaagcgtgacctacgacctgtcaaagctcgttaactatcccggattcaacatctccaccccacgcggcatcccagacgagtggcggatctttggaagcatccctatgcaggcatgccaacagaaagatgtgtttgcaaactatttgacatccaacttccaagcaccgggcgtgaaatccggtaacaaaagatcatcctctcactcctcccctggaagtccaaaaaagcagaagaatgagagcaatagcgcaggttcccccgccgatatggagctggacagtgatatggaggtcccgcacggaagccagagctctgagtcctttcagtttcagcccccactgccgccagacactccccctctgccccggggcactcctccccctgtctttacccctccattgccaaaggggacacccccactgaccccttcagatagcccccaaactagaactgcctccggggcagtagacgaggatgctttgacactcgaggagttggaggagcagcagcggcgaatttgggcagccctggagcaagctgagtctgtgaacagtgattctgacgttcccgttgatacaccactgaccggtaactctgtggcatcgtctccctgccccaacgagcttgatctgcccgtccctgaaggaaaaacatccgagaaacagactttggatgagccagaagtgcctgagatcttcaccaaaaaaagcgaggccggacacgccagcagccccgactcggaggtgacttctctgtgtcagaaagagaaggccgaactggcgcctgtgaatacagaaggagctctgctagacaacggatccgtggtgccaaattgtgacatatcaaacggggggagtcagaagttgttcccagctgatacttcacccagtactgccaccaaaattcatagcccaatccccgatatgtctaagtttgctacaggcatcaccccctttgagttcgagaatatggcagagagtactggcatgtacctgcggatcaggtcactcctgaagaactcaccaaggaaccaacagaaaaacaagaaggcaagtgagtag

SEQ ID NO: 35163 - DNA, 1410 bp, Artificial Sequence
  Description of Artificial Sequence: Synthetic coding sequence
atgaaggactgcccaatgccaaggaacgccgcacgcattagcgagaagcggaaggaatacatggatgcctgtggagaggcaaataatcagaacttccagcaacggtaccatgcggaggaagtggaagagaggtttgggcgttttaagcccggtgtgattagcgaggaactgcaggacgccctgggcgtgaccgacaaatcacttcccccattcatctacaggatgcggcagctgggctatccgcccggatggctcaaggaggctgaattggaaaatagcggtctggccctctacgatgggaaagacggcaccgatggcgaaaccgaggtgggcgagattcaacagaataagagcgtaacatacgatctgtccaagttggtgaattacccaggctttaatatctcaaccccgagaggcatccccgatgagtggcgtatctttggctcaatcccaatgcaagcctgccagcagaaggacgtttttgctaattacctgaccagcaatttccaagcacctggtgtaaagtctgggaacaagagaagctcctcccattcttccccaggttcacccaaaaagcagaaaaatgagagcaacagtgccggcagcccagccgacatggagctggactccgacatggaggtgccccatggcagtcaatcctccgaaagcttccagttccagcctcccctgccaccggatacaccaccccttccaaggggtacacccccgcctgttttcacccctcccttgcccaaaggtaccccaccactcactccgagcgacagccctcagacccgcaccgcctccggagccgtggacgaagatgcactgactctggaagagctcgaggaacaacagagacggatctgggcagccctcgaacaggccgaaagtgtgaattccgacagcgatgtcccagttgacactcccctgacggggaatagcgtcgcttcctccccatgtcccaacgagctggatctgccagtgccagagggaaagacatccgaaaaacagactcttgatgaacctgaagtgcccgaaattttcactaagaaatccgaagccggccacgcctcatctccagattcagaagtgacatctctgtgccagaaggagaaggccgaactcgctcctgtgaacactgaaggagcattactggacaacggctcagtggtccctaattgtgacatttctaacggggggtctcagaaattgttcccagccgataccagcccctcgaccgctaccaagattcacagccctattcccgacatgagcaagttcgcgaccgggatcacacccttcgaattcgaaaacatggcagagtcaacgggtatgtatctgcggatccggtccctcctcaagaacagtccaagaaatcagcagaaaaacaaaaaggcctcagagtag

SEQ ID NO: 35164 - DNA, 117 bp, Artificial Sequence
  Description of Artificial Sequence: Synthetic coding sequence
atgaaagactgccccatgccaagaaacgccgccaggatctcagaaaagcggaaagagtacatggacgcttgcggcgaggcaaataaccaaaactttcaacagagataccatgcatag

SEQ ID NO: 35165 - DNA, 1410 bp, Artificial Sequence
  Description of Artificial Sequence: Synthetic coding sequence
atgaaggattgccctatgcctcgcaacgctgcaaggatatctgagaagcggaaagagtacatggacgcttgcggggaggccaacaatcagaacttccaacagcgttatcacgccgaggaggtcgaggaacgctttggaaggtttaagccaggagtaatctctgaagaactacaggacgccttgggtgtcactgacaagtccttgccaccatttatctataggatgcggcagcttggctaccccccaggatggctgaaggaagccgaactggagaactcggggttagcgctgtatgatggaaaagacggaacagacggcgagactgaagtcggtgagatccagcagaataagagtgtgacgtacgacctttccaaactcgtgaattatccaggatttaatatctccactccgaggggtattcctgatgaatggaggatttttggcagcatcccaatgcaggcctgtcagcagaaagatgtgttcgctaattatttaaccagcaatttccaggccccgggcgttaagtccggaaataaaagatcctctagccattcctcacctggctctcctaaaaaacaaaagaatgaatccaattctgctggcagtcccgcagatatggaattggactccgatatggaggtgccgcacggttcccagtcttccgaatcatttcaatttcagccgcctctgcctcctgacacgcctccgctcccaagaggcactcctccccctgtgtttacgccaccattgccaaaaggcactcctcctctgacccccagcgacagcccccagacacggaccgcctctggggccgtcgatgaagacgcccttaccttggaagaactagaagaacagcagcgtcgtatctgggcggcactggagcaggcagagtctgttaactctgatagtgatgtgcccgtggacactccactcactggcaatagcgtggcttcctctccttgcccaaatgagctagatcttcccgtccccgagggaaagacaagtgaaaaacaaacgctggatgaacccgaggttcccgaaatctttactaagaagtccgaggcaggacacgcgtcttctccagactccgaggttacctcgttgtgccagaaagagaaagccgagcttgcaccggttaataccgagggggcactcctcgacaacgggtcggtggtgcccaattgcgatatctccaacggtggctcccagaagctgttcccggccgataccagtccgtccacagcgactaagattcactcgccaatccctgacatgagcaaattcgccaccggtattacaccgtttgagttcgagaatatggctgaatctacgggcatgtaccttcggatacgctctctcctaaagaacagtccacgcaatcagcagaagaataaaaaggcatccgagtag

SEQ ID NO: 35166 - DNA, 816 bp, Artificial Sequence
  Description of Artificial Sequence: Synthetic coding sequence
atgacccgatgggcaagggtcagtaccacttataacaaacgcccactgcctgccacttcttgggaagatatgaagaagggcagctttgagggcacaagccagaatcttcccaaaagaaaacagttggaagcaaatcgtttgtccctaaaaaacgatgccccacaggcaaaacataaaaagaacaaaaagaaaaaagagtatctgaacgaggacgtgaacggctttatggagtacctgcgacagaacagtcagatggttcataacgggcagataattgcaacggactctgaggaggttcgtgaggaaatagctgttgcgctaaaaaaagacagtaggcgggaaggaagacggctcaagcggcaagccgctaaaaagaatgcaatggtgtgcttccattgccggaaacccggacatggcattgcggactgtcctgcagccctggagaaccaagatatgggcaccggaatttgttatagatgtgggagtaccgagcacgagatcactaagtgtaaagctaaggtagacccagcactcggagagttccccttcgcaaaatgttttgtttgcggcgagatgggacacctctcacgtagttgtccggataatcctaaagggctctatgcagatggaggaggctgtaaactgtgcggcagcgtggagcacctcaagaaagattgccctgaaagccagaactcagaacgtatggtgaccgtgggccgatgggccaagggtatgtctgccgattatgaggagatacttgatgtccccaagccacaaaaaccgaaaaccaaaatccctaaggtggtgaatttttag

SEQ ID NO: 35167 - DNA, 816 bp, Artificial Sequence
  Description of Artificial Sequence: Synthetic coding sequence
atgacccgctgggccagagtgtccaccacatacaacaaacgtcctctccctgctaccagctgggaagatatgaaaaaggggtcctttgagggaacttcccagaacctgccaaaacgtaagcagctcgaagcaaacaggctctcactgaagaatgacgcaccacaagccaaacataagaaaaacaagaagaagaaggaatatctgaatgaggatgtcaatggcttcatggagtatcttcggcagaatagtcaaatggtgcacaacggccagatcatcgccaccgatagcgaggaagtgagggaagagattgccgtggccctgaaaaaggactcacggagagaagggaggcgattgaagcggcaggcagcgaaaaaaaatgcgatggtatgctttcactgtcggaagccaggacatggtatcgccgattgcccagctgcgttggaaaatcaggatatgggcacggggatctgctaccgttgtgggagcaccgaacacgaaataactaaatgcaaggcgaaggtcgatcccgccttgggtgagtttccatttgcaaagtgctttgtgtgcggggagatgggacatctgtctaggtcctgccctgacaatcccaaagggctgtacgccgacgggggaggttgtaagctttgcgggtccgtggaacaccttaagaaggactgccccgaatctcagaatagtgaacgcatggtcaccgtgggcaggtgggcaaagggtatgtccgccgattacgaagagattctggatgtgccaaaaccgcagaaacccaaaacgaagattccaaaggtcgtcaacttttag

SEQ ID NO: 35168 - DNA, 816 bp, Artificial Sequence
  Description of Artificial Sequence: Synthetic coding sequence
atgaccagatgggcgcgtgtcagcacaacctacaataagaggccgctccccgccacaagctgggaggatatgaaaaagggatccttcgagggaaccagtcaaaatctgcccaaacgcaaacaacttgaggccaatcgcttgtcactcaagaacgacgctccacaggccaaacacaaaaagaataaaaagaagaaggaatatttaaatgaagatgtgaatggctttatggagtatttgcggcaaaacagccagatggtgcacaatggtcaaattatcgctaccgacagtgaggaagtgcgcgaggaaattgctgtggcattgaagaaagactcaaggcgcgaaggcaggaggctgaagcggcaggcggcaaagaagaacgcaatggtgtgtttccactgtaggaagccgggccacggtatagccgactgtcccgccgcgcttgaaaatcaggatatgggcactggaatctgctaccgatgcggttccactgagcatgaaatcaccaaatgcaaggcaaaggtcgaccccgctctcggagaattcccctttgctaaatgctttgtctgcggcgagatgggacacctttctcgcagttgtccggacaacccaaagggcctatacgccgatggagggggatgcaaactgtgtggaagcgtagaacacctcaagaaagattgccctgaaagtcagaactcggagaggatggtgacggtgggcaggtgggctaaagggatgtccgcagactacgaggaaatactcgacgtcccgaaaccacagaagccgaagacaaagatccctaaagtagtgaatttttag

SEQ ID NO: 35169 - DNA, 816 bp, Artificial Sequence
  Description of Artificial Sequence: Synthetic coding sequence
atgacacgttgggcgcgggtgagcactacatataataaaagaccccttcccgccacttcttgggaggatatgaaaaaaggtagttttgagggtacaagccagaatctccccaaacggaagcagttggaggccaaccggttgagcctcaagaacgacgcccctcaggcaaaacacaagaaaaacaagaaaaaaaaagagtacctcaatgaggatgtaaacggctttatggagtatctgcgtcagaattctcaaatggtgcacaacggacaaattatcgctacagactccgaagaggtacgcgaagagattgcagtggcactaaagaaggacagccgacgcgaaggccggaggctgaaacgccaggctgcaaagaaaaatgccatggtgtgtttccattgccggaagccagggcatggaatcgctgactgtcctgccgccctggagaaccaggacatgggcacagggatttgctacaggtgcggctccacagaacatgagattacgaaatgcaaagccaaggtagacccagccctcggtgagttcccattcgccaagtgctttgtgtgcggggagatgggccatctatcacggagctgtccagacaatcctaagggcttgtacgccgatggaggtgggtgtaagctgtgcggaagtgttgagcacctgaagaaggattgcccagagtcacagaattctgagcgcatggttacagtcgggagatgggccaaaggaatgtccgctgactacgaagagattctggacgtgccaaagccacagaagcctaaaaccaaaataccaaaggtggtcaacttttag

SEQ ID NO: 35170 - DNA, 1434 bp, Artificial Sequence
  Description of Artificial Sequence: Synthetic coding sequence
atgggttctggactcgactttgctgaaacaagctgcgcccagccagtcgtctctactcaatccgacaaggaacctggcattacagcctctgccacagacactgacaatgcaaacggggaagaagtgccacatactcaggagatcagtgtctcttgggagggagaggctgcaccagaaatcaggacttcgaagctgggtcaacccgatccagctcccagcaagaagaaaagcaataggctgacactgtcaaaaaggaaaaaagaagcgcaggacgaaaaggtggagaaaacgcagggcgggcatgagcatcgccaggaagacaggctgaagaaaacagtccaggaccactcccagatccgagatcagcaaaaaggtgagatatcggggttcgggcagtgcctggtgtgggtgcaatgctcatttcccaactgtggtaagtggcgccgcctgtgtggcaatattgatcccagcgtgttgcccgacaactggtcttgcgaccagaatacagatgtgcagtataatcgctgtgatattcccgaggaaacatggaccgggctcgagtcagacgtggcatacgcttcctacattcctgggagcattatatgggctaaacaatacggctatccttggtggccagggatgattgagagcgatcctgacctgggggagtactttttgtttactagtcacttggactccctcccgtccaagtaccacgttaccttcttcggggaaactgtgagccgagcttggatacctgtgaatatgctcaaaaattttcaagagctatccctagagctgtcagtgatgaaaaagagaaggaatgactgcagccagaagcttggcgtggctctgatgatggcccaggaagctgagcagattagcatccaagagcgggtgaacctttttggattttggagccggttcaatggatcaaattccaacggtgagcggaaggatctccagctgtccggtttgaactccccaggatcatgtctggagaagaaagaaaaggaagaggagctcgagaaagaggaaggcgagaagaccgatccaattctccctattcgtaagagggtgaaaattcagacgcagaaaacaaagcccagggggccaaagaaaaaatttaaggccccgcagtccaaggcactcgccgcctcttttagtgagggcaaggaggttcgcacagtgccaaagaatctgggcctcagtgcgtgcaagggcgcatgtccgagcagcgccaaggaagagcctcgtcatcgggaacctctgacacaggaagcaggctcagtccccctcgaggacgaggctagctcggacctggatctggaacagttgatggaagatgtgggaagagagctgggacaatcaggagagttgcagcattccaatagcgatggagaggatttccccgtggctctttttggcaagtag

SEQ ID NO: 35171 - DNA, 1410 bp, Artificial Sequence
  Description of Artificial Sequence: Synthetic coding sequence
atgatgacgacattacagaataaggaggaatgcggaaagggccccaagcgcatttttgctccccccgcccagaaaagttactctttgcttccatgttcacctaacagccccaaagaggagacccccggcatatccagtccggagacagaggcgagaatctccctccccaaggcctctcttaagaaaaaagaagaaaaagcaactatgaagaacgtcccatcgagggaacaggagaagaagcgaaaggctcaaattaacaaacaggccgagaagaaggagaaggaaaagtcctcgttgacgaatgctgagttcgaagagatcgtccagatcgtcctgcagaagagcctccaggaatgcctgggcggcatgggctccgggcttgatttcgctgagacgtcctgtgcccagcctgtggtcagtacccaaagcgacaaggaacccggaattacggcctctgcaactgacaccgataatgccaacggagaagaagtacctcatactcaggaaatcagcgtctcctgggaaggcgaggcagctcctgagatccggaccagtaaactaggccagcctgatcccgccccatcaaagaaaaagagcaaccgtctcacgctcagtaaacgcaagaaggaggcccaggacgaaaaagttgaaaagacacagggtggccacgagcaccggcaggaagaccggctaaaaaaaaccgtccaggaccatagccaaatccgcgatcagcaaaaaggcgagatttcaggattcggccagtgtctggtgtgggtgcagtgtagcttccctaactgcggtaagtggcgcaggctctgtgggaacattgatccctccgtgctgcctgataattggagctgtgatcagaacaccgccgatgtgcagtacaatcgttgcgatattcctgaagagacttggacaggactggaaagcgatgtggcttacgcctcttacattcccgggtcaatcatctgggcaaagcagtatggatatccatggtggccaggaatgattgagtctgatccagatttaggggagtattttttattcacctcacacttagactcccttccgtcgaaatatcacgtaaccttctttggcgaaacagtcagtcgcgcctggatccctgtcaacatgctgaagaactttcaggaactgtctctcgagctgtctgtaatgaagaaacggagaaacgactgctctcagaagctcggggtggctttaatgatggcccaggaggctgaacagatctccatccaggagcgagtgaacctctttggcttctggagtcgttttaacgggagtaacagcaatggcgagagaaaggaccttcagctgtccggcctgaacagcccgggaagttgtctcgaaaacggcaaggagagaaggcccagggagtttcgattttag

SEQ ID NO: 35172 - DNA, 1947 bp, Artificial Sequence
  Description of Artificial Sequence: Synthetic coding sequence
atgatgactactcttcagaataaggaagaatgtggcaagggcccgaagaggatcttcgcccctcctgcccaaaagtcatactccctgctcccttgctctcctaattctcccaaagaggagaccccaggaatctcctcccccgagaccgaagcccgaatttcactccctaaagctagcctgaaaaaaaaggaggaaaaagctacaatgaagaatgtcccctcccgcgaacaggagaagaaacgaaaagcacaaatcaataaacaggccgaaaaaaaggaaaaagaaaagagctccctaaccaacgccgagtttgaggagatcgttcagatcgttctacagaagtctctccaggaatgcctgggcatggggtccggcctagactttgctgaaacgtcatgcgcgcaacctgttgtcagcactcagagcgacaaggagccgggtatcacagccagtgcaacagataccgacaatgccaatggcgaggaggtgccacatacacaggaaatctccgtgagctgggaaggggaggccgcacctgaaatcaggacatccaaactggggcagcccgatcccgcgcccagtaagaaaaagtctaataggctcaccttgtctaagaggaaaaaggaagctcacgaaaaagtggaaaagacgcagggcggccatgaacaccggcaggaggaccggctcaaaaagactgtgcaggaccatagccagattcgagaccagcagaagggagaaatttccggctttggccaatgcctagtgtgggtacagtgttcgttcccgaattgcgggaaatggaggcggttgtgcggcaacatagatccttccgtgctccccgataactggtcgtgtgatcagaacaccgatgttcaatacaataggtgtgacatccccgaagagacttggacaggactggagtcagacgtggcatatgccagttacataccggggagtatcatctgggctaagcaatatggttatccctggtggcccggaatgattgagtcagatcccgatctcggagagtattttcttttcacaagccacctggatagtctgcctagtaaatatcatgtcactttcttcggcgagaccgtgtctcgagcctggatacccgtcaatatgttgaaaaattttcaggaattatctttagagctttccgtgatgaagaaacgccgtaacgactgctcccagaaacttggcgtggcactgatgatggcccaggaagccgagcaaatatctatacaggagagggtgaacctgtttggattttggtcccgcttcaacggcagcaattccaatggcgagaggaaggatctccagttaagcgggttgaacagtccaggatcatgcttggagaagaaggaaaaggaggaggaactggaaaaagaggagggagagaagaccgatcccatcctgcctatccgcaagcgagtgaagatacagacccaaaaaactaagcctagaggattgggaggcgatgccggtaccgcggacggccgtggtagaaccctgcaacggaagatcatgaagaggtctctgggccggaagtccacagcccctcccgctccacggatgggtcgtaaggaggggcaaggtaactcagattcagaccagcctggacctaaaaaaaagtttaaagcgccacagtcaaaagccttggccgcatcgttttcggaagggaaggaggtgaggactgttcctaagaacttgggcttatctgcatgcaagggcgcatgtcctagctccgcaaaagaggaaccccgacacagagagcccctgacccaggaagccggttctgtgccccttgaagacgaggccagttctgatttagatctggaacaacttatggaggacgtcggcagagagctcgggcaaagcggagagctgcaacattccaattcggatggcgaggattttcctgttgctttgtttggaaaatag

SEQ ID NO: 35173 - DNA, 1071 bp, Artificial Sequence
  Description of Artificial Sequence: Synthetic coding sequence
atggataaggagaaactcgacgtcaagattgagtactgcaattatgctatggattctagtgtggagaatatgtatgtcaataaagtgtgggtccagtgcgagaacgaaaactgcctgaaatggcgcttattgtcttctgaggatagcgcaaaagtcgaccatgatgagccctggtattgctttatgaacaccgactcacggtacaataactgtagcataagtgaggaggacttccccgaggagtctcaactacaccagtgtggctttaaaattgtttacagccagcttcctctgggctcactggtgcttgtgaaactgcagaattggccgtcttggcctggcattctctgccctgaccgattcaaagggaagtacgtgacttatgaccctgacggaaacgtagaggagtatcacattgaattcttaggtgacccccactctcgatcttggatcaaagcgacctttgtggggcactattcaattactctcaaaccggagaaatgtaaaaacaaaaagaagtggtataagtctgccttacaggaagcctgcctgctgtatggatattcacacgagcagcgcctggagatgtgttgcctgtccaaactgcaggacaagtctgagacacatgacaaggtggccgcactggtgaaaaagagaaaacagacatccaaaaacaacatagagaaaaaaaagccaaaattcaggaagcgaaaaagaaaggccatcctgaaatgtagcttcgaaaacgtgtattcagacgacgctctgtccaaagagaatagggtcgtctgcgaaacggaggtcctattgaaggagctggagcaaatgttgcagcaggccttgcagcctacagccacacctgatgagagcgaagaaggtcacggggaagagataaacatgggggagaagctctccaagtgtagccccgaggctcccgccgggagcctcttcgaaaatcactacgaggaggactatctggttatcgatggtatcaagctgaaagcaggcgagtgtattgaagatatcacgaacaagtttaaggagatcgacgccctgatgtcagagttttag

SEQ ID NO: 35174 - DNA, 384 bp, Artificial Sequence
  Description of Artificial Sequence: Synthetic coding sequence
atggacaaggagaagttagacgtgaaaattgaatactgcaactatgcaatggattctagcgttgagaatatgtatgtcaataaggtatgggtccagtgcgagaatgagaattgtttaaagtggcggctgctcagtagcgaggatagtgctaaggtcgatcatgatgagccgtggtattgcttcatgaatactgattctaggtacaataactgttcaattagtgaagaagacttccccgaggagagtcagctccaccagtgtgggttcaaaatcgtctattcccagttacccctaggttcactggtcctcgtaaagctccaaaactggccttcctggccaggaattctgtgccccgaccgattcaaagggaaatacgtgacctag

SEQ ID NO: 35175 - DNA, 1071 bp, Artificial Sequence
  Description of Artificial Sequence: Synthetic coding sequence
atggataaggagaagcttgacgtcaaaattgaatattgcaattatgcgatggattcttccgtggaaaacatgtacgttaacaaagtgtgggtgcagtgtgagaacgagaactgcctaaaatggaggctcctgagctctgaggacagcgccaaagtcgatcacgacgaaccatggtactgctttatgaacactgatagccggtacaacaactgttcaatcagtgaggaagacttccctgaggaatcccaactgcatcaatgtggctttaaaatagtatacagccagctacccttgggatcgctcgtcttggtgaagcttcaaaactggccctcctggcccgggattctgtgtccggaccgtttcaaagggaagtacgtaacctatgatcctgacggaaatgttgaagaataccacatcgagttcctgggcgatccacactcccggtcctggattaaagccactttcgttggtcattacagcattaccctgaagcctgaaaagtgtaaaaataaaaagaaatggtacaagtccgccctacaggaggcctgcctcctctacggatactcacacgaacagcgattggagatgtgctgtcttagcaaactacaagacaagtccgagactcatgataaagtagccgccctcgtaaagaagcggaaacagactagtaaaaacaacattgagaagaaaaagccgaagttcaggaagcggaaacgcaaggctattctgaaatgttccttcgaaaacgtctacagtgacgatgcactgagcaaagaaaatagggtcgtgtgcgaaacagaggtcctgttgaaagaattagaacaaatgttacaacaggccttacagcccacagccactcccgacgaatccgaggagggacatggggaggagattaacatgggggaaaagttatccaagtgctcccccgaggcacccgctggcagcctgtttgaaaatcattatgaggaggactacttagtcattgacggaataaagctcaaagcaggcgaatgtattgaggacatcacaaacaagtttaaggagatagacgcattgatgtccgaattctag

SEQ ID NO: 35176 - DNA, 7065 bp, Artificial Sequence
  Description of Artificial Sequence: Synthetic coding sequence
atgcaaaaaagacagggctattgtagctactgccgagtgcagtacaataatctggaacagcacctgtttagcgcgcaacaccgctctctcacgcgtcagagtagacggcaaatctgtacctcgtccctgatggaacgatttctgcaggacgtcctccaacaccatccctatcattgtcaggaatcctcctccacacaagatgaaacgcacgtgaacaccggtagttcaagtgaggttgtccatttggatgatgcattttctgaggaagaggaggaggatgaagacaaggtggaggacgaggacgcaaccgaggaaagacccagtgaggtctccgagcccatcgaagaactgcacagcaggccccacaagtcgcaggaaggaacacaggaggtgtccgtccggccaagtgtgattcagaaattagaaaaaggacagcagcagccattggagtttgtacacaagattggcgcatctgtaagaaagtgcaatttagtcgatataggccaggccaccaataatcggagcaaccttgtgcgaccgcccgtgatttgcaatgcccccgcctcttgtctccccgagagctcaaacgaccgccctgtgacagccaataccactagtttacctcctgcagctcacctggatagtgtaagtaagtgcgacccaaataaggtagaaaaatatctcgaacagccggacggagcttcccgaaatccggtgccctcctcccatgttgagactacaagtttcagttatcagaagcacaaagagtccaatcgaaaatccctgcgcatgaattccgacaaattggtcttatggaaagacgtgaagtctcaggggaagacactgtctgccggattaaagttccacgaaagaatgggaaccaaagggagtttacgggtgaagagcccaagcaaactggccgtgaatccgaacaaaacagacatgccatcaaataagggcatctttgaagacactatagccaaaaaccatgaggaattcttctccaacatggactgcacacaggaggagaaacacctcgtttttaacaagactgcgttttgggagcagaagtgttccgtctcaagcgaaatgaagtttgactgtatcagtttacaatcagcgtctgaccagccgcaggagactgcccaggacctttcattgtggaaggaggagcagatcgatcaggaggacaactatgaatcgaggggtagcgaaatgtcatttgattgttcatcttcatttcactctcttaccgaccaatctaaggtttctgcgaaagaggtcaacttgtctaaagaagtacggacagatgtgcaatacaagaataacaaatcctatgtgtctaagatcagtagcgattgtgacgatatattacacttggtgacaaatcagtctcaaatgatagtgaaggaaatttcattacagaacgccagacatatcagcctggtggaccagtcttatgagagctcctcctctgaaacaaactttgactgtgacgcaagcccccagtcaacaagcgactatccacaacagtctgtcactgaagtcaatctgcctaaggaggtccacattggccttgtggacaagaattacggctctagcagctctgaggtttccgccgacagtgtgtttcccctgcagtctgtcgttgaccggccaccggtggccgttaccgaaaccaagctacgaaaaaaagctcatacctcattggtcgacaattacggctctagttgctcggagacctctttcgactgcgatgtgtctctcgagagtgttgttgaccatcctcagttgactgtgaaaggcagaaatctgaaggggcggcaggtacacctgaaacataagaagcgtaagccatccagcgccaaagctcaccttgactgtgacgtatcattaggaaccgtggcagacgaaagtcagcgcgccgtcgagaaaatcaatctgctaaaagagaaaaacgccgaccttatggacatgaactgtgagtcccacggccctgagatgggcttccaggccgacgcccaacttgctgatcagtcccaagtggccgagatcgaacgacagaaagtggatgtggatctggagaataaatcagtgcaaagttccagatcttcattatcttctgactcacctgccagcttgtaccactcagcacacgacgagccgcaggaggccctggacgaggtgaatctgaaagagcttaatatagatatggaagtgcgctcatacgactgtagcagtagtgagttgacattcgattcagacccaccgctgttgtctgtcacagaacagtcccacctcgatgctgaaggtaaggagcgtcatatcgatctggaggacgagagttgtgaatcagactcttccgagataacatttgatagcgacattcctctgtattccgtgattgatcagcccgaggtcgccgtctacgaggaggaaaccgtggacctcgaatctaaatctaatgaaagctgcgttagcgagataacatttgacagtgatattccccttcacagcggcaatgatcaccctgaggtggccgtgaaagaggtcatacaaaaggaagagtacatccacctcgagcggaaaaatgacgaaccatctggcagcgagataagctcagatagtcacgctcccctgcacagcgtgacaaactcaccggaggtagccgtcaagaagctgaacccacagaaggaggagcaggtacacctcgagaataaggaaaatgagcccatcgactcggaggtgtcacttgactacaatattatcttccattctgtcaccggaaggtccgaggacccaatcaaggagatctcactgcacaccaaagagcacatgtatcttgagaacaaatctgtattcgaaacatccctggattctgatgtgccactgcaggccgcaacccacaagcctgaggttatcgtcaaggagacttggcttcagagagagaaacacgccgagtttcagggtcgatcaaccgaatttagcggctccaaaacctcgcttgactcaggcgtgccacactactcagtgactgaacctcaggttgctgtcaacaagatcaatcggaaaaaacagtacgtcttggagaacaagaatgataaatgttcgggttctgagataattttggacagcaatgtgccccctcagagtatgaccgaccagcctcagctggcgttcttgaaggagaagcacgtgaatttaaaggacaagaattccaagtctggtgactcaaagatcacatttgactccgaacaactgcaagaagcggttaagaagatcgatcaatggaaggaggaggtgatcggcctgaagaacaagatcaacgagccaagcacctataaacttattcatcacccagatgtcagtgtacaatcggtggctgaccaacccaaggtggcaatcaaacatgtgaacttgggcaatgagaaccatatgtatttagaggtgaagaatagccaatactcctgtagtgagatgaatcttgatagtggattcctggggcagtcaattgtgaatcggcctcagatcacgattctggagcaggaacacatcgagttggaaggcaagcataaccagtgctgcgggtcagaagttagtttcgattcagacgatcccctgcagtcggtcgctgatagacttcgtgaaactgtcaaggagatcagcctttggaaggacgaggaggtcgacactgaggatagacgcaacgaagccaaaggattcgagattatgtacgacagcgacgtgctccagcctgtcgcgggacaaccggaggaggtggtgaaggaggttagcctgtggaaagagcacgtggatttggagaataaaattgtcaaacctacagactcccgaatcaactttgacagtcacgagcccctgcagagcgttacgaacaaaattcctggggccaacaaagagatcaacctgctgagggaggagcacgtgtgtctagatgacaaagggtacgttccgtcagactccgaaattatttacgtgagcaacattcctctgcagtccgttattaagcaaccccacattttggaagaggagcatgcctcacttgaggacaaatcatctaacagctacagccctgaggaatcttctgacagcaacgactcttttcaggccgcagccgacgagctgcaaaagcctgtgaaggagataaacttgtggaaagaagatcatatttatcttgaggacaagtcttataagctgggtgacttcgacgtgagctacgcatcccacatcccagtgcaattcgtgacagatcagtcctctgtgcccgtgaaagagatcaacttacagaagaaagatcacaatgaccttgaaaacaagaactgcgaggtgtgtgggagtgaaatcaagtgccacagctgtgttcatctacagtcagaagtggatcagcctcaagtgtcttacaaggaagctgacctgcaaaaggaggaacatgtagtgatggaggagaaaaccgatcaaccatcagattcagagatgatgtacgattctgacgttccgttccagatcgttgtgaatcagttccctggatccgttaaagagactcatctgcccaaagttgttttagtggatctcgtgccaggtgacagcgactacgaggtaatctctgacgatatccctttgcagctcgtcactgatccaccccagctcaccgttaaggacatatcctgcatcaataccgaatgtattgacattgaggataaatcctgcgactttttcggcagtgaagtgaggtgtaattgcaaggcatcaaccccgagcatgaccaaccagtgtaaggaaacgttcaagataattaaccgtaagaaggactatataatcttaggggagccgagttgccaatcctgcggcagcgagatgaatttcaacgtggatgctagcgatcaaagcatgacgtatgaatctcaggggcccgatgagaagatggttaaatacatagacagcgaggacaagagctgtggatataatgggtcaaaagggaagtttaacctggaagatacctctcaccggacaacgcatcgactgcagaaggcccataaagaggcctcgctgcgcaaagatcctaggaatgcaggcctgaagggcaagagttgccagtcgtctgcttcggccgtcgatttcggcgccagttccaagagcgctctccataggagagcagacaagaagaagcggtctaaactcaaacatagggacctggaagtgtcatgtgagccagatggcttcgagatgaacttccagtgcgccccacctctgccttcagacaccgaccagcctcaggaaactgtaaagaagagacacccctgtaagaaggtcagcagtgacctgaaagagaagaatcacgactcccagagcagtagtgtgcttaaggtggactcggtcagaaatctgaagaaggcaaaagatgtcatagaagataatcctgacgaaccagttctagaggctctcccccacgtgccaccctccttcgtggggaagacctggtcccagatcatgcgagaggacgatataaagattaatgccctggtgaaggagtttcgcgagggtaggttccattgttacttcgacgacgactgcgagaccaagaaggtttcctcaaagggtaagaagaaagttacatgggccgacctgcagggcaaggaggatactgcccccactcaggctgtgtctgaaagcgatgacatagtctgcgggatctctgatatcgacgatctctccgtagctcttgacaaaccctgccacagacaccctccagcagaacgtccccctaagcagaaagggagagttgcaagtcaatgtcagaccgcgaagataagtcattcaacacagacttcttgcaaaaactaccctgtgatgaaaagaaaaatcatccggcaggaggaggatccccctaagtccaaatgtagtcggctgcaggacgacagaaagacgaagaagaaagttaagattggcaccgtcgagtttccagcctcatgcaccaaggttctgaaacccatgcagcctaaagcccttgtgtgcgttctcagtagcttaaacataaagctcaaagaaggggaaggactgccgttcccaaaaatgagacaccactcatgggacaacgacatccgattcatctgtaaatacaaacggaacatctttgactactacgagcctcttataaagcaaattgtgattagcccacccctgagtgtcatagtgcccgagttcgagcggaggaactgggttaaaattcactttaataggtcaaaccaaaactcctccgcgggcgacaatgacgcggatggacaaggtagcgcctccgctcccctcatggccgtgccagcccgttacgggttcaattcccaccaggggacatctgattcatccttatttctggaggagagtaaagtcctgcatgccagagaactccctaaaaagagaaactttcagctgacttttctcaaccatgacgtagtaaaaatcagcccgaaaagcgtgcggaacaagctactggagagtcagagcaagaagaagatccatgggaagagggttactacatcgtctaacaagttgggcttcccaaagaaagtctacaaacctatcatccttcagcaaaagccacgcaaggccagcgagaaacaatcaatctggattagaactaaaccttccgacattattcgcaagtatatcagtaagtacagcgtatttctgagacacaggtatcagtcccgaagcgctttcctgggaagataccttaaaaaaaagaaatccgtggttagtaggcttaagaaagcgaaacggacagctaaggttcttctgaacagcagcgtgcctcccgctggtgctgaggagctctctagtgctatggccaatcctccacctaaacggccggttagagccagttgccgcgtggccagaagaaggaagaaaactgacgagagctaccacggcaggcaaaagggcccctccactccggtgcgcgcttatgacctacggtctagttcttgcctccagcagagagagcggatgatgacaagacttgcaaacaagctacggggcaacgaagttaagtag

SEQ ID NO: 35177 - DNA, 1116 bp, Artificial Sequence
  Description of Artificial Sequence: Synthetic coding sequence
atggacacgaggagtgggtcccaatgctcagtgacgcccgaagcaattcgcaacaacgaagagctggtgctgcctccccggattagtcgggttaatgggtggagtctcccacttcactacttccgcgttgtcacctgggcagtgttcgtaggactgtccctggcgaccttccggatatttattcccctgctcccacactcttggaaatatattgcctatgtggttaccgggggtatcttcagtttccatctcgtcgtacacctaatagcctcatgcatcgaccccgcggacagtaatgtgagactcatgaagaattattcccagccaatgcctctcttcgataggtcaaagcacgcgcacgttatacaaaaccagttctgccacctctgtaaagtgacagtgaataaaaagacaaagcactgcatttcatgcaacaagtgcgtgtctggctttgatcatcattgcaaatggattaataactgtgtcgggagccggaattattggttcttcttcagtacagtcgcatcagccacagctggaatgttgtgtctcatagctatcctgctatatgtgctggtccaatatctggtaaatcctcgagttttgaggacagatccccggtacgaggatgtcaaaaacatgaacacctggctgctcttcctgcccttatttcccgtgcaggtgcagacactgatcgtggtgattattcggatgctggttctgctgttagatttgctaggcctggtgcagctgggacaactgcttatctttcatatatacctgaaggccaagaagatgacaaccttcgagtatttgatcaatactagaaaggaggagagctctaagcaccaggctgtccgcaaggacccttatgtacagatggacaagggttttctgcaacagggtgcgggagctctgggttcttctgcccagggagtgaaggccaaaagtagcttgctgatctacaaatgcccttgccacttttgtacaagtgtgaaccaagacggcgacagtaaggctcaggaggccgacgatgccccaagcacctccacactgggcttgcagcaggaaactacagaacctatgaagaccgacagcgccgaatctgaggattag

SEQ ID NO: 35178 - DNA, 1212 bp, Artificial Sequence
  Description of Artificial Sequence: Synthetic coding sequence
atgaactatgactctcagcagcctcctttgcctccactgccttatgcgggatgccgaagagcatccgggtttcctgctctgggccgaggaggaaccgtgcccgtcggggtgtgggggggcgccggacaggggcgggagggccgttcctggggcgaggggcccagaggtcccgggctggggcgcagggatctaagctcggctgaccctgcggttctgggggctaccatggagagcagatgttacggctgcgccgttaagtttactctgtttaagaaggaatatgggtgcaagaactgcggtagggcgttctgcagtggctgtctatccttcagcgccgcagtaccgcggaccggcaatacgcaacagaaggtctgcaaacagtgtcacgaggtgctgacacggggctcatccgccaatgcctcaaagtggtcaccaccccagaactataaaaagagggtggccgcgctagaggccaagcagaagccatccacttcacagtcccaggggctgacacgacaggaccaaatgatagccgaaaggctggctcggcttcggcaggagaacaagcctaaactcgtgccgtcacaggcagagattgaagcaagactggccgccctcaaagacgagcggcagggatccattccctcaacccaggagatggaagccagacttgcagctttgcaaggacgggttcttccctctcagaccccgcagcccgcgcatcacactcctgatactagaacgcaggctcaacaaacacaagacctgctcacccagctcgcggccgaagtggcaatagacgagtcctggaagggggggggcccggtaacactgcaggactacaggctcccagatagcgatgatgacgaggatgaagaaactgcgatccagagggtgttgcaacagcttacggaagaagcatcactcgacgaagcatccggattcaatatccctgccgagcaggcgagccgcccatggacccagccgaggggggctgaacccgaagcccaggatgtggatccccgaccagaagcggaggaggaagagctcccttggtgctgtatttgcaatgaagatgctactcttaggtgcgccggatgcgatggagatctgttctgcgccaggtgtttccgggagggacacgacgcctttgaactgaaagaacatcaaaccagcgcatacagtcccccacgcgccggtcaggagcattag

SEQ ID NO: 35179 - DNA, 1386 bp, Artificial Sequence
  Description of Artificial Sequence: Synthetic coding sequence
atgcctgctgtggccgaggctctcggccaggagggcccacctgacctctccagatctgctttcctcgccacagtcttgacctcactcagcgctgccttttcttccatgccgagcagcgcgtactctctacctttctctcgatcattagagctcgactaccacactagtagctgctttcgaggcactatggttaaagctgattgtcccgtgcccatcacggaccttcccgatagttctgggaagttgcagtacggatgcaaaaattgcgggcgcgccttttgctctggctgtctcagcttctctgccgccgtgccccgcacggggaacacccaacaaaaggtgtgtaaacagtgtcacgaagtgctgacccgggggtcttctgctaatgctagtaagtggtcccccccacaaaactataaaaaaagagtggctgcactggaagccaagcagaagccatcgacgagccagagtcagggtctgactcggcaggaccaaatgatcgccgagagactggcaaggctgagacaggaaaataagcctaagcttgtccctagtcaggccgaaattgaagcacggttagctgcgcttaaagacgaacggcagggatcaatcccctctacccaggagatggaggcacgcctcgccgctctccaggggcgagtgctgccatcccagacaccccaacccgcgcatcacactcccgatacccgcactcaggctcagcagacccaagacctgctgacgcagctggctgccgaggtggcaatagatgagtcttggaaggggggagggccagccgcttcactccagaacgacctgaaccagggcggccctgggagtacgaactccaagcggcaggcaaattggtctctggaagaagagaagtctcggttgctggctgaagctgcactcgagttacgggaagaaaataccaggcaggagcgaatactggccctcgccaaacgcctcgccatgctgaggggacaggatcccgagagagtcactctccaggactacagacttcccgacagcgatgatgatgaggacgaagaaaccgctattcagcgggtgcttcagcaactaaccgaggaagcatctctagacgaggcatccgggttcaatataccagcagagcaagccagtagaccctggacgcagccccgaggagcagagcctgaggctcaggacgtggatccacgaccggaagctgaggaggaagagttgccctggtgttgcatttgtaacgaggatgctacacttcggtgtgcaggctgcgacggcgaccttttctgcgcccggtgctttcgcgaagggcatgatgccttcgaacttaaagagcaccaaacctctgcttactcaccccctcgtgctggacaagaacactag

SEQ ID NO: 35180 - DNA, 1416 bp, Artificial Sequence
  Description of Artificial Sequence: Synthetic coding sequence
atgaattacgatagtcagcaacctcccctgccacccctgccttatgccgggtgtagaagagcctcgggtttcccagcactgggacgggggggcacggttcccgtaggtgtgtggggcggcgcaggtcagggcagagaggggcggtcctggggagagggcccccgcgggcccggactgggtagacgggacctgtctagcgccgatcctgccgtattgggagctactatggaaagtcggtgctacgggtgtgctgtgaagtttactctgttcaagaaggaatacggatgtaagaactgcggtcgggccttctgcagtgggtgtctgagcttcagtgccgctgtgccaagaacaggtaacacccaacagaaggtatgcaaacaatgtcacgaggtgcttactagaggctcgagtgctaacgcttccaaatggagcccccctcagaattacaagaaaagagtggcagccctagaggctaaacaaaagccatccacgagtcaatctcaggggctcacccgccaggaccaaatgatagccgaaagactcgcgcggttgcgtcaggaaaataagccgaaacttgtgccctcacaggctgagatcgaggctagactggctgccctgaaggacgagcgccaaggatcaataccatccactcaggaaatggaagctcggctcgcagcactgcagggaagggttctgccgtctcagacaccgcagcccgcacaccatacacccgatacccgaactcaggcccagcaaacgcaggatttactcacacaactggctgccgaggtcgccatcgatgagtcctggaaaggaggtgggcctgctgcctctctccagaacgacttgaaccagggcgggcccgggtccaccaattcgaaaagacaggcgaactggagccttgaagaagagaagtcgagattattagccgaagcagccctggagctgcgcgaggagaacaccagacaggagagaatcctagcacttgcaaaaaggttggccatgctcagaggccaggatccggaacgcgttacgttgcaggactacaggctgcccgatagcgacgatgatgaagacgaggaaacagccattcagcgtgtccttcagcagctgacggaggaggccagtttggatgaggcctcaggcttcaatatccctgctgagcaggcctccaggccgtggactcagcccaggggggcggagccagaagcccaggacgttgacccacggcccgaagctgaggaagaagagttaccttggtgttgtatttgcaatgaagatgccacccttcgatgcgcagggtgtgatggtgacttgttttgcgcccggtgtttccgggaggggcacgatgcctttgaacttaaagaacaccagacctccgcttatagccctccgcgcgctgggcaggaacattag

SEQ ID NO: 35181 - DNA, 465 bp, Artificial Sequence
  Description of Artificial Sequence: Synthetic coding sequence
atggtggagaagaagacgagcgtgcgctcacaggatccaggacagagacgagtcctggaccgagccgcccggcagagaaggattaatcgccagctggaggctctggaaaatgacaattttcaagacgatccacacgccggtcttccccagctgggtaagcgcctcccgcagttcgatgatgatgccgacaccggaaaaaaaaagaaaaagactcggggtgatcactttaagcttagattcagaaagaattttcaggctctgctggaagagcagaacctttccgtggcagagggcccaaattatcttactgcttgtgcagggcccccatcaagacctcagcgtcctttctgtgctgtatgtggtttcccatctccgtatacatgtgtgagctgcggcgctaggtattgcaccgtacgctgcctaggaactcaccaggagacaagatgtcttaagtggaccgtatag

SEQ ID NO: 35182 - DNA, 1413 bp, Artificial Sequence
  Description of Artificial Sequence: Synthetic coding sequence
atggagttcgcagctgagaatgaagggaagtcaggtggaggccttcacagcgtggctgaaggagtcaggctttcccctgagcccgggcgagaaggcgtcagggacctggcaggtgccgaggagttcggtggcggagaggaagggacaggcctgaccgggataaaggagatcggcgatggagaggaaggatccggccagagaccagaggaaatccccatggatttaactgttgtaaaacaggagatcatcgactggccgggcaccgagggtaggttagctggacagtgggtggagcaagaagtggaggacagaccggaagtgaaggatgagaatgcaggcgttctggaggtaaagcaggagaccgattcctctctcgtcgtcaaggaagcaaaggtgggggaaccggaggtgaaggaagagaaagtcaaggaagaagtgatggactggtcagaggtaaaagaggaaaaggacaatctggaaattaaacaggaagaaaagttcgttgggcagtgcatcaaggaagagcttatgcacggggagtgtgtgaaggaggagaaagatttcttgaaaaaagaaattgtggacgacaccaaggtaaaagaggagcctcctattaaccaccccgtgggctgtaaaaggaagcttgccatgtcgagatgtgagacttgtggaacggaggaggcaaagtacagatgtccgcgatgcatgagatatagctgcagtttgccctgtgtaaagaagcacaaagccgagctaacatgcaatggggtaagagataagaccgcttacatatccatccaacagttcaccgagatgaatttgctgagtgattaccgttttctagaggacgtcgcacggaccgcagatcacatcagtcgcgatgccttcctgaagcgccctatcagcaataagtacatgtactttatgaagaaccgggctcgccgccagggtatcaatctgaaactacttccaaatggattcacaaagcggaaagaaaactcgacattcttcgataagaaaaaacagcagttctgttggcatgtgaagctacaattcccccaatcacaggctgagtacatcgagaaacgggtgcccgatgacaagactatcaatgaaatcctcaagccctacatcgaccccgaaaaatccgatcccgtgatcaggcagaggctgaaagcttacatccgcagtcagacaggcgtccagattctgatgaagattgagtacatgcagcaaaacctggtacgatattatgaactcgacccctacaagagcctactcgataacttgcgtaacaaagtgattatagagtacccaactctccacgtcgtcctcaaggggagtaacaatgacatgaaggtgttgcatcaggtgaaaagtgagagcactaagaacgtgggcaatgagaattag

SEQ ID NO: 35183 - DNA, 1296 bp, Artificial Sequence
  Description of Artificial Sequence: Synthetic coding sequence
atggaatttgcagctgaaaacgaaggcaagagcggcggcgggctgcattcagtagccgagggagtgcggctgagtcctgaaccaggcagagagggggtgcgtgatctggcgggcgccgaagaattcggcggtggcgaagagggcacaggcttgaccggaattaaggaaataggtgacggcgaggagggatcagggcagagacctgaggaaattccaatggacctgaccgtggtgaagcaggagaccgactccagcctcgtggtcaaggaggccaaggtgggggaacccgaggtaaaagaagaaaaggtaaaagaggaggtgatggactggtccgaggtcaaggaggagaaggacaacttggagatcaaacaggaagagaaatttgtggggcagtgcatcaaggaggaactcatgcacggggaatgcgtcaaagaagaaaaggacttcctgaagaaggagatcgtcgatgacactaaggtcaaggaggaaccccccattaatcaccccgtggggtgtaaacgcaagctggccatgagtagatgcgaaacgtgtgggaccgaggaggctaaataccgctgcccccgatgcatgagatacagctgcagtcttccctgcgtgaagaaacataaggctgagctgacttgcaatggagttcgcgacaaaaccgcctatatttcaatacagcaattcacagaaatgaacctgctgtcggactacagatttttggaagatgtggcccgaacggcagatcacatcagtagagacgcctttctcaaacgcccgattagcaacaagtacatgtactttatgaaaaatcgtgcaagaagacagggaatcaacttgaagctcctccccaacggttttactaaaagaaaggagaatagtaccttcttcgataagaagaagcagcaattttgctggcacgtcaagcttcagttcccccagtctcaggctgaatacattgagaaaagagtgcccgatgacaagaccatcaatgagattctcaaaccatatatcgatccagagaagagcgatccagtcatcagacagcgactcaaagcctacatcagaagtcagactggagtgcagatcctaatgaaaattgaatacatgcagcagaaccttgttagatactacgagctggacccttataaatcgctgcttgataatctgcgtaacaaagtgatcattgagtatcctaccttgcatgtcgtcctgaaaggatctaacaacgatatgaaggttcttcaccaggtcaagtccgagtccacgaaaaatgtggggaacgaaaactag

SEQ ID NO: 35184 - DNA, 4647 bp, Artificial Sequence
  Description of Artificial Sequence: Synthetic coding sequence
atggcggaaagagaggtcgagtcagggcccaggaaaaggttcgagcaaaaatccggagcggtgttcgatgaaattgtggagaactgcggcggcattatggatactgagatgagcgaggatatagatcacaatctgacaccaactctcgattccatgagctatggaatgccgaaccagacagggtcagagaattctttgctcgacgaggacgactattttctaaactcgggagatttagctggtatccctgtggtggggtcagacaatgaggatgaacaggacttctcctctaaggataatctagtaagttcaatacatacagatgactccctggaagtggagagacgcgtgactcagcacgagagcgataatgaaaatgaaatccaaatccagaataagctgaagaaggacttcccaaagcagtttgatcaggtctctgttttcaagagtattaggaaagacttctcattggtgagggagaactccaaagagactttcagcggaaaggaaaaaaatagagatctgacatacgaacgtgagaaacggctggacaagccacacaaggatttggactctcgtctgaagtcctctttttttgacaaggccgcaaatcaagtggaggagactctccacacccacttgccgcagactcccgaaacaaatttccgcgactcctcatatccattcgcgaacaaggaatcaatcgggtcagagcttgggaattctttcgctagcaatatcaggatcaaagaagaaccgctggatgacgagtacgacaaagctatggccccccagcagggccttctggataaaattaaggatgagcccgacaacgcacaggagtactcacacgggcagcagcagaagacacaggaaggcgaactgaaaatcagtgcagtgttcagcgtgagtggcagccccctggcccctcagttgaccactggctttcagccttcattggcctcatccgggatgaacaagatgttaccaagtgtacctgcaacggccgtgcgcgtatcttgtagcgggtgtaagaaaatcctgcaaaagggccagaccgcctatcagagaaaagggtccacacagctgttctgtagcacactctgtctgactgggtataccgttccccccgctcggcctccaccgcccctaaccaagaaaacctgttcctcatgcagtaaggacatccttaatcccaaggacgtgatttccgctcagttcgagaataccacaaccagcaaagatttttgcagtcaatcctgcctctctacatacgaactcaaaaaaaagcccatcgtgacaattaacacaaacagcatttccactaagtgtagtatgtgccagaagaatgcagtgataaggcacgaggtcaactaccagaatgtcgtgcataaactgtgtagcgatgcgtgcttcagcaaattccggagcgcaaataatttgacaatgaactgctgcgagaactgtggaggctactgctactctggatcaggtcaatgtcatatgttgcagattgagggacagtcaaagaaattttgctcatccagctgcattacagcatataaacagaaatcagctaaaatcactccgtgcgcactgtgcaaatctcttaggtcttccgcagagatgatcgagaatactaatagtctggggaagacggaactgttttgcagcgttaattgcctgtcggcctatcgggtgaagatggtaacatctgcgggtgttcaggtgcagtgcaatagctgtaaaacttccgccattcctcaatatcatttggccatgagtgatggttctatcagaaatttttgctcctattcctgtgtcgttgccttccagaatctgttcaacaagcccacgggaatgaactcatcggtagttcccctctcccaaggtcaggtgatcgtttccatacccacaggtagtactgtatccgcgggtggtggcagtacttctgctgtcagtcctaccagcatctccagttccgccgccgccggcctgcagaggctggctgctcagtcccaacacgtggggttcgcgcgttccgtcgtcaagctcaagtgccagcactgcaaccgactgtttgctaccaaaccagaacttctagattacaaaggaaagatgtttcagttttgtgggaagaactgcagtgatgagtacaagaagatcaataatgtcatggccatgtgcgagtattgtaaaatcgaaaaaatcgttaaggagaccgtccgtttttctggcgccgataaatccttctgcagcgagggctgtaagctgctgtataagcacgacctggctaaacgatggggaaatcactgcaaaatgtgtagttattgcctgcagacctctcctaagctggtccagaacaacttagggggaaaggtcgaagaattctgctgtgaggagtgcatgtcaaagtatactgttctcttttaccagatggccaaatgtgatgcatgcaaaaggcagggtaaactcagcgagtcgctgaagtggaggggagaaatgaagcatttttgcaatctcctctgtatactgatgttctgtaatcagcaatctgtgtgtgaccccccttcccagaacaacgccgccaacatttccatggtacaggccgcatccgcaggcccccccagcctgcgtaaggattccacccctgtgatagctaacgtggtgtcactggcatccgcccccgccgcacaacccaccgttaattccaatagtgttttacagggagccgttcctaccgtgaccgctaagattatcggcgacgcgtcaacgcaaacagacgccctgaagctgccgcccagccagccaccccggctgttgaaaaataaggcacttctgtgcaagcctattacgcagacgaaggccacctcctgtaaaccccatacacaaaacaaggagtgccaaaccgaagatactcctagccagccgcaaatcatcgtagtacctgttcccgttcccgttttcgtgcctatcccgctgcacctctacactcagtatgcgcccgtgccatttgggatacccgtgcccatgccggtgcccatgctcattccctcttccatggatagcgaggacaaggtcacagaatccattgaggatataaaggaaaagctgccgactcatccatttgaggccgacctcctcgaaatggccgagatgatcgccgaagacgaagagaagaagacccttagccagggagaatcccagacctcagaacatgagcttttccttgacaccaagatctttgaaaaggatcaggggtctacgtattcgggagacctggaaagcgaagctgtgagtactccccatagctgggaagaggaattaaatcactacgcccttaagtctaacgcagtgcaggaggctgattctgaactgaaacaattcagtaagggagaaacagagcaggaccttgaagccgattttccctccgacagttttgatccgcttaataaggggcagggcatccaggcccggagccgaacgagaagaagacatagggatgggttcccccagcctcgacgaagaggacgcaagaaaagcattgtcgctgtcgaaccacggtccttgatccagggggcctttcagggttgctccgttagcggcatgacattgaagtacatgtacggcgtcaacgcttggaagaattgggtacagtggaagaatgccaaggaagagcagggcgatctgaagtgcggaggcgtggaacaggcctcttcatcaccccggtctgaccctcttggttctacacaagatcacgcactttcacaggaatcctccgaaccaggatgtagggttcgttcaatcaaactgaaggaggacatcctctcctgcacctttgcagagctgtcactgggactatgccagtttattcaggaggtacggcggccaaacggggaaaaatatgatccagattctatactctatctgtgtctaggtattcagcagtacctgtttgagaacggaagaatcgacaacattttcactgaaccatattcccgattcatgatagaactgactaaactccttaaaatctgggagcctacaatcttacccaatggctacatgttcagccgaatcgaagaggagcatctgtgggaatgcaaacagttgggcgcctattcgccaattgtgctgctcaatacactgctcttcttcaatactaagtactttcaactgaaaaatgtgaccgagcatttgaagctgagttttgcacatgtgatgagacgaacaagaacgctgaagtactctactaaaatgacgtatcttcggttctttcctccccttcagaaacaggaatcagagcctgacaaactgactgtgggaaagagaaaacgcaacgaggatgatgaagtgcctgtaggggtggagatggccgaaaacacggataatccactaaggtgcccagttcggttatacgaattctacctgtctaaatgttcagaaagcgtgaaacaacggaatgacgtgttttacctacagcccgaaaggagttgtgtgccaaactctcctatgtggtattccacatttcctattgacccgggtacccttgacacgatgttaacacgcatcctgatggtccgggaagtgcacgaggaacttgcaaaggccaagagtgaagattccgacgtggagttaagcgattag

SEQ ID NO: 35185 - DNA, 4380 bp, Artificial Sequence
  Description of Artificial Sequence: Synthetic coding sequence
atggcggaaagggaagtcgaaagcggacctcgcaaacgttttgagcagaagagtggcgcggttttcgatgagatcgtggaaaactgtggcggaattatggacacggaaatgagcgaagacatagaccataacctgacgcccacactggactccatgagctacgggatgccaaatcagacgggcagcgagaacagcctcttggacgaggacgattacttcttgaattctggagatctggcggggatcccagtggtgggaagtgataacgaggacgaacaggattttagctccaaggacaatttggtgagcagcattcataccgatgattcactcgaagtggaaaggcgcgtgacccagcatgagagcgataacgaaaacgaaattcagatccagaacaagctaaagaaggactttcctaagcagttcgaccaagtttcagtgttcaagtcaatcagaaaagacttttcccttgtcagggaaaattccaaggagacttttagcgggaaagagaaaaaccgtgacctcacatacgagcgcgaaaagagacttgataagcctcacaaggatttagatagcagattaaaatcatccttttttgataaagctgcaaaccaggtagaagagactctccacacccatcttccgcagacacctgagactaactttagagatagcagctacccattcgctaacaaagaatcaattgggtcagaactgggaaattcttttgcatctaatattcgcatcaaggaagagcccctagacgacgagtatgacaaggcaatggctccccaacaggggctgctggacaagattaaagacgagccagataatgcacaagagtattctcatgggcagcagcagaagacccaggaaggggagctgaaaatttcagcagtgttcagcgtaagcggctccccattagctccacagctgaccactggctttcaaccaagcctcgcgtcgtctgggatgaataagatgctcccttccgtgcccgctaccgccgtcagagtctcatgtagcggctgcaagaagattctgcaaaaggggcagaccgcttaccagcgaaagggaagcacacagcttttctgttctacgctgtgcctaacagggtataccgtccccccggcacgccctccccctccccttaccaaaaaaacctgctccagctgcagtaaagatatcctgaaccccaaagacgtgatctctgcccagtttgagaacactactaccagtaaggacttttgcagtcaatcttgtttgtcgacctacgaactgaaaaaaaagcccatagtgactattaacactaacagcattagcactaaatgttctatgtgccagaaaaacgccgtgattagacatgaagtaaactaccagaatgtcgtgcacaagctatgcagcgatgcttgcttttccaaattccggtcagccaataatttaacgatgaactgctgtgagaattgcgggggttattgctactccggatcaggccaatgtcatatgctgcagatagagggccagtccaagaagttttgcagctcttcctgtataaccgcctataaacagaacctgtttaacaaaccgaccgggatgaactcttctgtagttcctctgtctcaggggcaggtcatcgtttccattcccaccggttccacagtgagcgcaggcggaggtagtactagtgcagtctccccgacttcgatcagctcctctgcagctgcaggcttgcagagactggctgcacaatctcagcatgttgggtttgctcgtagtgttgttaagttgaaatgtcagcactgcaataggctattcgccactaaacccgagctgttggactataagggtaaaatgttccagttctgtggcaagaattgtagtgatgagtacaaaaaaataaacaatgttatggccatgtgtgaatactgtaaaattgaaaaaatcgtgaaagagaccgtacgcttctctggcgccgataaaagcttttgttccgaaggttgtaaactactctataagcacgacctggcgaagagatggggtaaccactgtaaaatgtgttcatactgtctgcagacctctcccaagttggtgcagaacaacttgggcggcaaggtggaggagttttgctgcgaggagtgcatgtcaaaatacaccgtgctcttttaccagatggctaaatgtgatgcctgcaagcggcaagggaagttaagcgagtccctcaagtggagaggagaaatgaagcacttctgcaacctcctctgcatcctgatgttttgcaatcagcagagtgtgtgtgatcctcctagccagaataatgctgccaacatttcaatggttcaggcagcaagcgccggtccaccctccctgcgaaaagacagcacacctgtgatcgccaacgttgtgtccttggcgagtgctcctgctgcccagccaaccgttaattctaacagcgtcctgcaaggggcggtgcccacggtgacagccaagataattggcgacgcttcaacccagacagatgccctcaaactgccgcccagtcaacctcctagactgctgaagaacaaagctttgctatgcaaacctatcacccagaccaaagccacatcctgtaagcctcacactcaaaacaaggagtgtcagaccgaagacaccccatcccagccccagatcatcgtagtccccgttccggtgcccgtctttgttcccatacccttacatctttatactcagtacgctccggtcccctttggaatccctgtcccaatgccggtgcctatgttgattccttcatcaatggactctgaagataaagtgaccgagagcatcgaagacatcaaagaaaagcttcctacccatcccttcgaggcggatttgctggagatggctgagatgattgccgaagatgaggagaagaaaactttaagccaaggcgagagccagacatcagagcacgagctgttccttgacacgaaaatcttcgaaaaggatcagggcagtacatattccggtgatttagagagcgaagccgtaagcaccccacattcatgggaggaagagctgaaccattatgcgctgaagagcaacgctgttcaggaagctgactccgagcttaagcagttctccaagggggagaccgagcaagaccttgaagccgacttcccgagtgattcctttgatcctcttaataagggccagggcattcaggcaaggagccgcacacgccgccgtcaccgcgatgggttcccacagccacgacggcgtggccgtaagaagagcattgtggcggtcgagccgcgatctttgatccagggcgctttccaaggatgttctgtatccggtatgaccctaaaatacatgtatggagttaatgcttggaagaactgggtccaatggaaaaatgctaaggaggaacagggagatctgaaatgcgggggcgtggaacaggcttccagtagcccccgatctgatccacttgggtctacgcaggatcatgcattaagccaggaatcctcagaacccggctgcagggtacggtcgatcaaactgaaggaggacatcctgtcatgtaccttcgccgagctttccctcgggctgtgccagtttatccaggaggtgagaagacctaatggcgagaagtacgatcccgatagtattctttatctgtgcttgggcatacagcaatacctgtttgagaacgggaggattgacaatatcttcacggagccatactcaaggtttatgattgagctcacgaagctcttgaaaatctgggaaccgaccattttacctaatggatacatgttttccaggatagaggaagagcatttgtgggagtgtaagcagctaggtgcttatagcccaattgtgttattaaatacactgttgttctttaatactaaatacttccagttgaaaaacgtcaccgaacatctgaagctctcctttgcccatgtgatgagaagaaccagaaccctgaaatacagcacgaaaatgacttatctgagattctttccacctttacaaaaacaggagtcggaacctgataagctaaccgtcggtaagagaaagaggaacgaggacgacgaggttcccgtgggtgtcgagatggctgagaataccgacaatccccttcggtgccctgttcgtctgtatgagttttacttgtccaagtgctctgaaagtgtgaaacagcggaatgatgtcttctatcttcagcctgaaaggagctgcgtgcccaattcaccaatgtggtatagtacctttcctattgatcccggcactcttgatacgatgctgactcgcattttgatggtccgggaagtgcatgaagaactcgccaaggccaagtcagaagacagcgacgtagagctttcggattag

SEQ ID NO: 35186 - DNA, 297 bp, Artificial Sequence
  Description of Artificial Sequence: Synthetic coding sequence
atggacaccgagatgtcagaggacatcgatcacaatcttactccaacccttgattcaatgagttatggcatgccaaatcagacaggctcagaaaactctctcctcgatgaagatgattactttcttaacagcggcgatttagctggaattccagtggtgggctccgacaatgaggacgaacaggatttttcatcgaaagataatttggtgtcctccattcacactgacgactctcttgaggtggagcggagggtcacccagcatgaaagcgacaatgaaaacgaaattcagatctag

SEQ ID NO: 35187 - DNA, 3624 bp, Artificial Sequence
  Description of Artificial Sequence: Synthetic coding sequence
tgaccgcttgacgacgagtatgataaggccatggccccgcaacaggggctgcttgacaagattaaggatgagcccgacaacgctcaggaatattcccacggccagcagcagaaaacacaggagggcgaactcaagatcagtgccgtgttctcagtgtcaggctcacctctggcacctcagctcactacaggctttcagccctcacttgcatcaagtggaatgaataaaatgctgcccagtgtgcccgccaccgctgtccgggtgtcttgttctgggtgcaaaaaaatcctgcaaaagggccagactgcttaccagagaaagggttcaacacagcttttctgttcaaccctgtgccttactggctacaccgtgccacccgcccggccaccgcctcctttgaccaagaaaacgtgttctagctgcagcaaagatatccttaacccaaaagatgtcattagtgcgcagttcgagaacacaaccacttctaaagacttttgctctcaaagttgcctatccacctatgagctgaagaaaaagcccatcgtgactataaataccaactcaatatccactaaatgcagcatgtgtcagaaaaatgctgtcatccgtcatgaagtgaattatcaaaatgtggtgcataagctttgctctgatgcatgtttttctaagttccgatctgctaacaatctaaccatgaactgctgcgaaaattgcggtggatattgctactcaggaagtggacaatgtcacatgctgcaaatagagggtcagagcaagaagttttgtagcagctcttgtatcactgcttataaacagaacctgttcaacaagccaaccggtatgaatagttccgtcgtccccctgagccaaggccaagtaatcgtaagcattccaactggaagcactgtctccgcaggcgggggtagtacaagcgcggtgagtcctaccagtatatcctcatccgcagctgctggcttgcagcgcttagccgcccagtcgcagcatgttgggttcgcccgaagcgtagttaaactgaagtgtcagcactgcaatcgactgttcgctactaagcccgagctcctagattacaaaggaaagatgtttcagttttgtgggaagaattgtagcgacgaatacaaaaagattaataacgtgatggctatgtgtgagtactgcaaaatcgaaaagatcgtgaaggagacagtgcggtttagcggggctgacaagtcgttttgcagtgaagggtgcaagctcctatacaagcatgatttggcaaaaagatggggaaaccactgcaagatgtgctcctattgcctgcagacctcgccgaaactggtccagaacaatctcgggggcaaagtggaggagttttgttgcgaagagtgcatgtcgaaatataccgtactattttatcaaatggctaaatgtgatgcttgtaagcgccagggaaagctgtcagagtctttgaaatggcgcggtgaaatgaagcatttctgcaatctgttgtgcatactcatgttctgtaaccagcaatcggtctgtgatcccccgtctcagaataatgctgcgaacataagcatggtgcaagccgcttccgctggcccaccaagcctccgcaaagactcaacgccagtgattgccaacgtggtgtcactggctagcgcacccgccgcacagcctacagttaactctaatagtgtgctgcagggtgccgtgcctaccgtgacggccaagatcatcggggacgcatcaacccagaccgacgccctcaaactcccacccagtcagccccctagactacttaaaaataaagccctgctctgcaagcccattacccaaactaaagccacatcatgtaagccccacacgcagaataaagagtgccagactgatactccttctcagcctcagatcatagtcgtaccagttcccgtccctgttttcgtccccatcccactccatctttacacccaatacgcgcccgtgcccttcggcatccctgttcccatgcctgtgccaatgctgataccatcgtctatggatagtgaagacaaagtaaccgaaagcatagaagatattaaagagaaattgcctacccaccccttcgaggcggacctactcgagatggctgaaatgatcgcggaagacgaggagaaaaagactctgtcccagggggaaagccagacctccgaacacgagctgtttctcgacaccaaaatttttgagaaagaccaaggcagcacctattcaggtgacctggagagcgaggccgtcagcaccccacactcttgggaggaagaactgaaccattacgctctcaaaagcaacgctgttcaagaggccgactcagagctgaagcagttcagcaagggggagacagaacaggatttagaggctgactttccaagcgatagctttgatcctctcaacaagggtcagggaatacaggctagaagcaggactaggcgccgacaccgcgatggcttccctcaacctcggcggaggggacgtaagaagtcgatagtggctgtggagccccgttcactgatccagggtgcttttcaaggctgctccgtgtctggtatgacgctcaagtacatgtatggggtcaatgcatggaaaaactgggtgcagtggaaaaacgcgaaggaagaacagggggatctgaaatgcggaggcgtagagcaggccagcagcagtccgagaagtgatcctctgggctccacacaggaccatgccttgtcacaggaatcatctgagcctggttgtcgggtgagaagcattaagttgaaggaagacattctatcttgtaccttcgccgagctcagcctgggcctgtgtcagtttatccaggaggtgcggagacccaacggggaaaagtacgatccagacagtatcctgtatttgtgtctcggcatccagcagtatctgttcgaaaatggaagaattgataatatttttactgagccctatagcagattcatgattgagctgaccaagctgctcaagatctgggagccaactattttgcccaacgggtacatgttttctaggatcgaagaagagcacctctgggaatgtaagcaattgggcgcctacagtcctatcgtgttgttgaatacgctgcttttcttcaacacgaagtatttccaactgaaaaacgtgacagagcatctgaaactatcttttgcccatgtgatgcgacgtacaagaacgctgaagtacagtacaaaaatgacttatcttcgattttttccccctttgcagaagcaggaaagcgagccagataagttaacggtggggaagcggaaacggaacgaagatgacgaggtgcccgtcggggtcgaaatggccgaaaacaccgacaatccattaagatgccctgtgcggctctacgagttctacctgtccaagtgcagtgagagcgttaagcaaaggaacgatgtgttttatctgcagcccgagaggtcttgcgtacctaactctccaatgtggtatagcacctttccaatcgatcccggaaccctggacacaatgctcacgcggattctcatggtccgcgaggttcatgaagagcttgctaaagcaaaaagtgaggactcggacgttgaactgagcgactag

SEQ ID NO: 35188 - DNA, 1098 bp, Artificial Sequence
  Description of Artificial Sequence: Synthetic coding sequence
atgaacgtcatttatcctttagcggtgcctaaaggtagaagactgtgttgtgaggtgtgtgaagcgcccgccgaaagagtgtgtgccgcttgcaccgtaacttattattgcggagtggtgcaccaaaaagctgactgggacagcatccatgagaaaatctgtcagttactgattcctctgcgcacatccatgcctttttacaactctgaggaggagaggcagcatgggctacagcaactgcaacagaggcaaaaatacctgattgaattttgctacaccatagctcaaaagtacctgttcgaaggaaagcacgaggacgccgtgcctgctgccctgcagtctctgaggtttcgcgtgaagctctatggtctgtcgtcggtggaactagttccggcttacctgctgttggcagaggcatcactggggttgggaagaatagtacaagccgaagaatacctcttccaggcccagtggactgtccttaagagcactgactgttctaacgctactcacagcctgttgcatcgtaaccttggcctgctgtatatcgccaagaagaactacgaagaagcacgctatcatctggcaaacgacatctacttcgccagttgcgcattcggcaccgaggatatccgtacatcaggagggtatttccacttggccaatatcttttacgacttgaaaaaactcgaccttgcagacactctctacacgaaggtcagtgagatctggcatgcgtatcttaataatcactatcaggtactcagccaagctcacattcaacagatggatctgctaggtaagctgttcgagaatgacaccggactcgatgaggctcaggaggccgaggccattagaatattaacatccatcctgaatataagagaaagcacctctgacaaggccccacagaaaacaatctttgtgctgaagatcctggtaatgttctactatttgatgatgaactcctcaaaagcccaggaatatgggatgcgtgccctgtctctggccaaggaacagcagcttgatgtgcacgagcagtctacaattcaggagctgctgagcctgatctcaaccgaggatcacccaataacctag

SEQ ID NO: 35189 - DNA, 768 bp, Artificial Sequence
  Description of Artificial Sequence: Synthetic coding sequence
atgtctgctctcgacagcacagcccactttcacgcgctgctccagttccgtggaagaactgctgcatggcctgctgctgctgctgctgcagctggcttgggccgcatcgtgcaggccgaggaatatttattccaagcccagtggacagtactcaaaagtaccgactgttccaatgccacacacagtctgctacacagaaatttgggactcctgtatatcgccaagaaaaactacgaggaagctaggtaccatctggccaacgacatttattttgctagctgtgccttcggtaccgaagatatccggacgtccggcggatattttcatctcgcgaacattttctacgacttgaagaagttagacctggcggacaccctctatacaaaggtctctgagatctggcacgcctacctgaacaaccattatcaagtcctttcgcaagctcatatccaacagatggatctgttgggcaaacttttcgagaacgatacggggcttgacgaggctcaggaggctgaggccatccggatactcacgtctatcttgaacatcagggagagcaccagcgataaagcaccccagaagacaatcttcgtgttaaagatcttagtcatgttttattacctgatgatgaactcctccaaagcccaggagtatggaatgcgggccctgtctcttgccaaagagcagcagttggacgtgcatgaacaatccaccatccaggagcttttgtcactaatttccaccgaagatcatcctatcacttag

SEQ ID NO: 35190 - DNA, 1383 bp, Artificial Sequence
  Description of Artificial Sequence: Synthetic coding sequence
atggccccaagatcaaggcgtagacgccacaaaaaaccgcccagttcagtcgctcccattatcatggccccgaccacgatcgtaaccccggtgcccctgactccgtctaagcccggtccaagtatcgatactctcgggttcttttcgttggacgacaatgtgcccggactttcacagctgattcttcaaaagctgaacatgaagagctacgaagaatataagttagtggttgacggaggaactcccgtctccggcttcggcttcaggtgcccacaagaaatgtttcagaggatggaagatacctttcggttctgcgcacactgtagagccctcccctcagggttgagtgactctaaggtgctgcgccactgtaaaagatgcaggaacgtctactattgcggacctgagtgccagaaatcagattggcccgcccaccggcgggtgtgccaggaactgcgccttgtggccgtggaccggctgatggaatggctgttagtgactggggattttgttctgccttctggaccctggccatggcccccagaggccgttcaggactgggattcttggtttagcatgaaagggttacacctggacgccaccttggacgctgtactggtgtctcacgcggtgactaccctttgggctagtgtcggccggcctaggccagatccagacgtgttgcagggttccctgaagcgtctcttaacggacgtgctgtctcgacccttgactctaggtctgggcctccgggctcttgggattgacgtgagacgcacaggcggttccactgtgcatgtggtgggcgcctcccacgttgaaacctttctcacacgccccggggattatgacgaactcgggtacatgttcccaggccacctcggactgagggtggtcatggttggtgtcgatgtggctactggattttctcagtcaacgagcacttctcctctcgaaccgggaaccatccagttgtcagcacatcgaggcctctatcacgatttttgggaagagcaggtggaaaccggtcagacgcatcaccccgacctcgtcgcagctttccaccctggattccatagtagcccagacctgatggaagcttggttgcctacgcttctgctccttagagattacaaaatacctacgctgatcacagtatattcccatcaggagcttgtgtcctctctccagattctggtcgaactcgatacgcatattaccgcttttggttccaatccctttatgagtctgaagccagagcaggtttattccagtcctaataaacaaccagtgtactgttcagcctactatattatgttcttggggagcagctgccaactcgataatcgccagctcgaggaaaaagtcgacggcggcatctag

SEQ ID NO: 35191 - DNA, 1383 bp, Artificial Sequence
  Description of Artificial Sequence: Synthetic coding sequence
atggcacctagatccaggcgtaggcgccataagaagccgccctcaagtgttgcccctattataatggcacccacaacaatcgtcactcccgttccgcttactccgagtaaacccggacctagcatcgacacattgggattcttctccttggatgacaacgttccggggctttctcaactcatcctacaaaagctcaatatgaagagctacgaggaatataagcttgtggttgacggcgggaccccagtatcgggattcggcttcagatgcccccaagagatgttccaacggatggaagacacctttcgcttttgtgcccattgtcgcgctctcccatcggggctgtccgatagcaaggtgcttcggcactgtaagcggtgccgtaatgtgtattattgcggtccagagtgtcagaagtctgactggcctgcgcaccggcgcgtgtgccaggagctgagattagtggccgtggatcggcttatggagtggcttttggtgacaggtgacttcgtactgccttctggaccatggccttggccccctgaggccgtccaggactgggactcatggttttctatgaaaggtctgcacctggacgccactctggatgccgtgttagtctcccacgcagtaacgaccctatgggcatcagtcggcaggccccgcccagacccagatgtacttcagggcagtttaaagagattgttaacagacgtgctgtcgagacctcttacgctggggctgggattgcgtgccctaggaatcgacgtccggaggactggcgggtccacagttcacgtcgtgggggcgtcccacgtggagactttcctgaccagacctggagattacgatgaactcggttacatgttccctggccacctgggactgcgagtcgtgatggtgggggtagatgtagccaccggattttcccagtccacaagcacaagccccttggagcctggaacaatacagctgtctgcccatcgggggctgtaccacgatttctgggaagaacaagtggagactggccagacgcatcaccctgatctggtagcagctttccacccagggttccacagctcccctgacttgatggaggcttggctgcctaccctgctgctcctcagagactacaaaatcccaacattaatcaccgtatattcccaccaggaactagtctcatccctacagattttggtcgaactggatacgcacataaccgcatttggtagtaacccctttatgtctcttaaacctgagcaggtctactctagcccaaacaaacagcccgtctactgctccgcctactacattatgtttctgggatcctcatgtcagctcgacaataggcagctggaggagaaagtggatggcgggatctag

SEQ ID NO: 35192 - DNA, 3240 bp, Artificial Sequence
  Description of Artificial Sequence: Synthetic coding sequence
atgccccgcgtgcacaacatcaaaaagagcctcactccccatatctcttgcgtcacaaatgagagtgacaacttgcttgacttcctgcctgaccgtctgcgtgcgaagctgcttccttttcagaaagacggcattatcttcgctctcaagcgcaacgggcgctgcatggtggcggacgaaatgggtctgggtaagactatccaggctatcgggatcacgtacttttacaaggaggaatggcccctactgatcgttgtgccatcatcccttaggtacccctggacagaagaaatcgaaaagtggattccagaactctcacccgaggagataaatgtgatccaaaacaagactgacgtgcgccgcatgtccacctccaaggtgaccgtgctcggctacggcctcctcaccgctgacgccaagaccttaatcgacgcactgaataaccagaactttaaagttgtgattgtagacgagagtcactacatgaaaagcaggaacgcaacccggagccggatccttctgcctatcgtgcagaaagcacggcgggcaatcttgcttacaggcacgcctgccctggggaggccagaagagctctttatgcagattgaggctctctttccacagaaatttggtcgttggaccgactacgctaaaagatattgtaacgctcatataagatatttcggcaaaaggccacagtgggactgcagaggggcgtcaaatttgaatgagttacaccagctcctgagtgacatcatgatacggcgcctgaagaccgaagtcctcactcaattgcctcctaaagtgcgacagaggatacctttcgacctcccttccgctgccgcaaaggaactaaacactagttttgaggagtgggaaaagatcatgcgcacacccaattccggggctatggagacggtgatggggcttatcaccaggatgttcaagcagaccgccatagctaaagctggtgcagtgaaggactacataaaaatgatgcttcagaatgattccctgaaatttctcgtttttgcccatcacttgagcatgctgcaggcatgcaccgaggctgtgatcgagaataagaccagatacatcagaatcgacggaagtgtgtcctcctcggagagaatccacctggtgaatcaatttcagaaggatcctgatacacgagtggcaattctttctattcaggctgctggccagggactcacctttacagccgcatctcatgtggtgttcgccgaactgtactgggatccagggcacatcaaacaggccgaagatcgggctcaccgcatagggcaatgcagttctgttaatatccactatctgatagctaacggaacactcgacacgctcatgtggggaatgctcaaccggaaggcccaggttactggctccaccctgaacggacgcaaggaaaagatccaggcggaagagggagataaggaaaagtgggatttcctgcagtttgccgaggcctggacccccaatgacagcagcgaagagctgagaaaggaggctctctttacacatttcgagaaggagaagcaacacgatattcgaagctttttcgtgcctcagccaaaaaaacgccagcttatgacctcctgtgacgaaagcaaacgctttagggaagagaacacggtggtgagctcagacccaaccaagacagccgctagggatataatcgattatgagtctgacgttgagccagagacaaagcggctgaaacttgccgcctctgaagatcactgttctcccagcgaggagacgccaagccagtctaagcagatcaggacccccttagtcgagtctgtgcaggaggccaaagcccagctgacaactccagcatttcctgtggaaggttggcagtgttctctgtgtacttatattaacaactccgaattaccatactgtgagatgtgtgaaaccccccagggcagtgccgtgatgcagattgattcactcaatcacatccaggacaagaatgagaaggatgactcacaaaaagacacctcgaaaaaggtccagacaatttccgattgcgaaaaacaggccctggcgcaatccgagccaggccaactggctgacagcaaggaagagactccaaagattgaaaaagaggatggactcacttcccagcccggtaatgagcagtggaaatctagtgatacgctgcctgtatacgatacactcatgttctgtgcctcacgtaacaccgaccggatccatatctataccaaggacgggaagcagatgagctgtaattttataccactggatatcaaactggacctttgggaggacctgcctgcctctttccaactcaagcagtatcgctccctaatactacggtttgtcagagaatggtcttccctgaccgctatgaaacagcgaatcatccgaaaatccggtcaattattctgttcaccaattctggcactagaggaaattaccaagcagcagactaaacagaattgcactaaaaggtatataaccaaggaagatgtcgccgtcgccagtatggacaaggtaaaaaatgtaggtggccatgttagactgatcactaaagaatctaggccaagagatccgtttactaaaaagctcctagaagacggtgcgtgtgtgccctttctgaatccctataccgttcaggccgacctcaccgtaaagccttccaccagcaagggatatttgcaggctgtggacaatgagggcaacccattgtgtctgaggtgccagcagccaacatgccaaacgaaacaggcctgcaaagcgaattcttgggacagcagattctgtagcctcaagtgccaagaggaattctggatccgcagcaataattcttatctgagggcaaaagtctttgagaccgagcatggggtgtgccagttgtgtaacgtgaatgcgcaagaactgtttctgcggctccgcgacgcccctaagagccagagaaagaatcttctgtatgctacatggactagcaagctgccattggagcagctcaatgaaatgattcggaaccctggcgaaggccatttctggcaagtggaccacataaagcccgtttacggaggaggtggacagtgtagcctggataacctccagacactgtgtacagtgtgccataaggagaggacggcccgccaggcaaaagagagaagccaggtgagacgccagtccctggcttccaagcatgggtctgacatcacccgctttctcgtgaagaaatag

SEQ ID NO: 35193 - DNA, 1797 bp, Artificial Sequence
  Description of Artificial Sequence: Synthetic coding sequence
atgacgtcctgtgacgaatctaaaaggtttcgggaggaaaacaccgtcgtgagctcggaccctacaaaaaccgccgcgcgggatattatcgactacgagtcagacgttgagccagagaccaaaaggttaaagctggcagctagcgaagatcactgctccccatccgaggagaccccatctcagtccaagcagatcaggacaccccttgttgagtccgtacaggaagccaaggcacagttgactaccccggccttcccagtcgaaggctggcaatgcagtctatgcacttacatcaacaattccgaactgccgtattgcgaaatgtgcgagacacctcagggatccgcagtgatgcaaattgattccttgaaccatatccaggataaaaacgagaaggacgactcacagaaagacacatctaaaaaagtgcagacaatctcggattgtgagaaacaggctctggcacagtctgagcctggacagctcgccgactcaaaggaagaaacccccaagatcgagaaggaagatggcctcactagccagccagaacaatggaagagcagcgacacacttcctgtgtatgacactctgatgttttgtgctagccgtaataccgatcgcatccacatttatacaaaagatggcaagcaaatgtcatgcaactttatccctttggacattaagttggatctctgggaggacctgcccgcctcttttcagttaaagcagtacaggagtctgattctgaggttcgtccgggagtggtcttctctgacagctatgaaacagaggattattaggaagagcgggcagttgttttgctctccaatcctggctctcgaagagatcactaaacagcagactaagcagaactgcacaaagagatacattactaaggaggacgtcgcggtggcttccatggacaaggtgaagaacgtgggcggccacgttcgcctgattacaaaggagtcccgccctagggacccttttactaagaagctcctagaggacggtgcttgtgttcctttcctcaatccttacaccgtccaggcagatctcacggtgaagccctcaacgtcgaaaggttatctacaagccgttgacaacgagggaaatcctctctgccttagatgtcagcagccaacctgccagacaaaacaggcatgcaaagctaacagctgggattctcggttctgctcactcaaatgtcaggaagaattttggatcagatcgaataattcctacctccgggctaaggtcttcgagacagaacacggcgtgtgtcagctttgcaacgtgaacgctcaggaactgttccttaggttgagggatgcccctaaaagccagcgcaaaaacctcctttatgctacctggacaagtaaattaccacttgagcagttgaacgagatgataagaaatccgggcgagggccacttttggcaagtggaccacataaaacccgtctacggcgggggaggacagtgttctctcgataacttgcagaccctgtgcaccgtgtgtcataaggaacgcacagccaggcaggccaaggagagaagccaggtgagaaggcaatctctggcttccaagcacggctcagatattacacgatttcttgtgaaaaagaagctccatgaatcccacaaagtgacgggcgcagagcaaggcttacaagtatccggtctgccagattcggctgctccagagggaggggcggcccacactaacgaccagagacgctgtcagcgtatgaaacaaccactgaccgaagtgcaaattctcagccactcctcgtag

SEQ ID NO: 35194 - DNA, 1107 bp, Artificial Sequence
  Description of Artificial Sequence: Synthetic coding sequence
atgggcctgggcaaaactatccaggctatcggaataacctatttctacaaagaggagtggcctctgctcattgtggttcccagtagtcttcggtatccctggactgaggaaatcgaaaagtggatccctgaactgagccccgaggaaatcaacgtgatccaaaacaagactgacgtccgcagaatgtccaccagtaaggttactgtcctgggctacggactcctgacagccgatgcgaaaaccctaatagatgccctcaacaaccaaaattttaaggtcgttattgttgatgaatcacactatatgaaatcccgaaacgccaccaggagccggatcctgctcccaatcgtacaaaaggcacgccgtgccatcctgctgactggcaccccagccctcgggaggcccgaagaactttttatgcagatagaggcactcttccctcagaagtttggccggtggaccgactatgccaagaggtactgtaatgcccatatcagatattttggcaagaggcctcagtgggactgtcggggagcctcaaatctgaacgagctgcaccagcttctcagcgatattatgatacgaagactgaaaacagaggtcttgacacaactacccccaaaggttagacagagaatcccttttgatctccctagtgccgcggccaaagagctgaatactagcttcgaagagtgggagaagatcatgcgtaccccaaattccggcgcgatggaaaccgtgatgggactgatcacccgcatgtttaagcagactgcaattgcaaaagccggtgccgtgaaagattatatcaagatgatgctccagaatgattctctgaagttcctggtgtttgcccaccatttgagtatgctgcaggcttgtacggaagcggtgatcgagaataaaacccgctacatcaggatcgatggttccgtctctagctcagagcggatccatttagtgaaccagttccagaaggatccagatacccgcgttgcaatcttgtctatccaggcagccggccaagacctatatgataaagtggcgtgggggaaacgcactttggtgtccggtctctttatggagtgcttctgcttcgtcccctag

SEQ ID NO: 35195 - DNA, 3234 bp, Artificial Sequence
  Description of Artificial Sequence: Synthetic coding sequence
atgccccgagtacataatattaagaagagccttacaccccacattagctgtgtcacaaacgagtccgacaatctgctagatttcttacctgaccgcctccgagccaagctcctcccatttcagaaagacgggattattttcgcccttaagcggaatgggcggtgtatggtggccgatgagatgggcctcggtaagaccatccaagccatagggattacgtatttttacaaggaggaatggccattactgatcgtggtgccatccagtctgaggtacccctggactgaggagatcgagaaatggattcccgaattaagccccgaggagatcaatgtcatccagaataaaacagatgtgagacgcatgagcacatccaaagtgactgtcctcggctacggcttacttactgctgacgcgaagacccttattgacgctctgaataaccagaactttaaagtagtgatcgtggacgaaagccattacatgaaatcccgaaatgccacccgatccaggatattgttacccatcgtgcagaaagcgaggagagccatcttgctaacaggcactcccgcactggggaggcctgaggagctgtttatgcaaattgaagccctctttcctcaaaagttcgggcggtggaccgactacgcgaagcgctattgtaatgcccacatccgttatttcggaaagaggcctcaatgggactgtcgcggcgcatccaaccttaacgaactgcaccagcttttgtcggacatcatgattagacgccttaaaaccgaagttttgacccagcttcctcccaaggtcagacagaggattcccttcgatctaccatcggccgccgcaaaagaattgaatacatcttttgaggagtgggagaagatcatgagaaccccaaacagtggagcaatggagaccgtgatgggattgatcacccgaatgttcaaacagaccgctatcgccaaagcaggtgccgtgaaggactacatcaagatgatgctgcagaacgattctctgaaattcctggtgttcgctcatcatttatcaatgctccaggcctgtaccgaggctgtaattgaaaacaaaacaaggtacatacgcatcgatgggtcagtgagcagctctgagcgaatacaccttgtgaatcagttccagaaggatcccgacacaagggtggctatactttctatccaggccgcaggacagggcctcacattcactgcagcttcccatgtggtattcgcggaactctattgggacccagggcacattaaacaagctgaggatagagcacaccgaattggccaatgttcgagcgttaacattcactatcttattgctaatggtactctggatacactcatgtggggaatgctgaacagaaaggcccaggtgacaggttccaccctcaacggtaggaaggagaagattcaagcagaagagggtgataaggagaagtgggattttctacagtttgcggaagcctggacccccaatgacagctctgaggagcttcggaaggaagctctcttcacccatttcgaaaaggagaagcagcatgatatcaggagcttctttgtcccacagcctaagaaacgacagctgatgacttcctgcgacgagagcaagagatttcgcgaggagaacactgtggtgtcatccgaccccacaaaaacagcggcgcgagatatcatcgactacgagtcagatgttgaacccgagacgaaaagactcaagctggctgcgtcagaggaccactgcagcccttccgaggaaacacctagtcagagtaaacagattcggacaccattggtggagtccgttcaggaagcgaaggcacagctcacgaccccagctttcccagtggaggggtggcaatgcagcttgtgcacttacataaacaactctgaattgccctactgtgaaatgtgtgaaaccccgcagggcagcgctgtgatgcaaatagatagtctgaaccacatacaggataaaaacgagaaagacgatagccagaaggacacatcaaaaaaggtgcagacaatcagtgattgtgaaaagcaggcattggcacagagtgagccaggccaactggccgacagtaaggaggagacccctaagatagagaaagaagatggcttgacctcacagcccgagcagtggaaaagttccgacaccctgcccgtatacgacacattaatgttctgcgccagccgcaatacggacagaatacacatttacaccaaagacggaaaacaaatgtcgtgcaacttcatccccctggatattaaactggatctctgggaggatctccccgcctcatttcagctgaagcagtacaggagcctcatcctaaggtttgtccgagaatggagctcactcactgcgatgaagcaaagaatcatccgaaagagtggacagcttttctgcagcccaatcctggccctcgaagaaataaccaagcagcagaccaagcaaaactgcactaagcggtatatcaccaaggaggatgttgctgtggccagcatggacaaggttaagaacgtagggggacacgtccggctcatcactaaggagtcacgaccgagagacccgttcaccaagaaactcttagaggacggggcgtgtgttccatttttgaatccatataccgtgcaggccgacctgacagttaagcctagcacgtctaaaggctacctacaggcggtggataatgaaggcaatcctctgtgtctgagatgtcagcagcctacatgtcaaactaaacaggcctgtaaggcaaactcttgggacagccggttttgttctctcaaatgtcaagaagagttttggatccgatctaacaactcatacctgcgggccaaagtctttgagactgaacatggcgtctgtcagctgtgtaacgttaacgctcaagaactttttctgcgcctgagggacgcacccaagagccagagaaaaaatctgctttacgcgacttggaccagcaaattgcctctcgaacagctcaatgagatgatccgaaaccccggcgaaggacacttctggcaagtggaccatatcaagccagtgtacggaggtggtggacaatgcagtctggataatttgcagacactgtgtacagtctgccacaaagaacggacagcccgccaagctaaagagaggagccaggtccgcaggcagagtctcgccagcaagcatggaagcgacattacccggttcctagtaaagaagtag

SEQ ID NO: 35196 - DNA, 1797 bp, Artificial Sequence
  Description of Artificial Sequence: Synthetic coding sequence
atgacttcctgcgatgaatcgaaaaggttcagagaagagaatacggtggtgtcatccgatcccacgaagacggccgcaagggacatcatcgactatgagtccgatgtggagcctgaaacgaagcgtctgaaactagcagcgagtgaagatcactgtagcccttccgaagagacaccttcacaaagcaagcagattaggactccattagtggagtcagtgcaggaagccaaagcacagctgacaacccctgcatttccagttgagggatggcagtgttcactctgtacctatatcaacaatagcgagttgccttactgtgaaatgtgcgaaacccctcagggcagcgccgtgatgcagatcgattcactgaaccatatccaggacaagaacgaaaaggatgacagccagaaggatacttccaagaaagttcagacaatcagcgattgtgaaaaacaggccctggcccagagtgaacctggtcaactggccgattcaaaggaggaaacaccgaaaatcgaaaaggaggatggcctgaccagccaacccgaacagtggaagagttctgataccctgccggtatatgacacactcatgttttgtgctagtagaaatactgatcgcattcacatttacactaaagatggaaagcagatgagctgtaattttattccactcgacatcaagctggatctctgggaggatctccctgcatcctttcagctcaaacagtaccggagtcttatcctgaggttcgtgagagagtggtcatccctgacagcgatgaagcagagaattattcgcaaatccggacaactgttttgctctccaatcttagcccttgaggagataacaaaacagcaaaccaagcaaaattgtaccaaaaggtatatcactaaagaggatgtggcggtggccagtatggacaaagtcaagaatgtggggggtcatgtccggctgattaccaaggagtctaggcctagggatccgttcacaaaaaagctactggaagacggagcttgcgtcccattcctaaacccctacaccgtacaggcagatcttacagtgaaaccatcaacatcaaagggatacctgcaggcagttgataatgaaggtaatccactctgcctgagatgtcagcaacccacctgtcagacgaagcaggcctgtaaggccaacagttgggatagtcgcttttgttcactcaagtgccaggaggaattctggatccgatcgaataactcatacctgagggcaaaggtttttgagacggagcacggggtctgtcagctctgtaatgtgaatgcccaagagctgtttcttagactgcgggatgcccccaagtctcaaaggaaaaacttgctctacgccacttggacgtcaaagctccctctggaacagctgaacgagatgatccgaaacccgggcgagggccatttctggcaggtagaccacattaagcccgtttacggggggggagggcagtgttcgttagacaatctacagaccctgtgcactgtgtgccacaaggagcgcaccgccagacaggccaaggaaagatcacaggtgcggcggcagagcctggcttctaagcacggcagtgacatcacccgctttttggaaacatcaaagctgcatgagagccacaaagtgactggcgcagagcagggtctccaggtatccggcctgccagactccgccgctccggagggcggtgccgcacacaccaacgatcaacggcgttgccaacgcatgaagcagccgctaacagaggtgcaaatcctgtcgcactcaagctag

SEQ ID NO: 35197 - DNA, 3234 bp, Artificial Sequence
  Description of Artificial Sequence: Synthetic coding sequence
atgccacgcgtgcacaacataaagaaaagcctgaccccccacatcagttgtgtgacaaatgaatctgataacttacttgattttcttcccgatcggttacgcgcgaagttgctccctttccagaaagatggaatcatcttcgcactcaagcggaatggaagccgaatcgattgtgaccagatggggcttggaaagaccatacaggcaatcggcataacctatttttataaggaggagtggcctctgctgattgtcgtgccgtcatcactacgctacccttggaccgaggaaattgaaaaatggataccagagctgtctcccgaagaaattaatgtcatacagaacaagacagacgtgcggcgtatgagcacttccaaagtgacagtcctgggttacggcctgcttactgccgatgcgaaaacgctcatcgatgccctgaacaaccaaaactttaaggtagttattgtggacgagtctcactacatgaaatcccgcaacgccactaggagccgaatcctgttacccattgtgcaaaaagcccgccgggctatcctattgaccggtaccccagccctaggccgccctgaggagcttttcatgcaaatagaggcacttttccctcagaagtttggacggtggaccgactacgccaagcggtattgtaacgcccacatcagatactttgggaaacggccccaatgggactgtagaggcgcctctaatttaaatgaacttcaccaactgctgtctgacatcatgatccggcgtcttaagaccgaagtgctcactcaattgccccccaaggttagacagcggatcccttttgacctaccatcagccgcagccaaagagctgaacacctcttttgaggagtgggagaaaatcatgagaaccccaaactccggcgccatggaaactgtaatgggactaatcacgcgaatgttcaaacagacggcgatagcaaaggcgggggcggtcaaggactatatcaagatgatgctgcagaacgactccctgaagtttttagtttttgcccatcacctttctatgcttcaggcctgcacagaagcagtcatcgagaacaaaactcggtacattcgaatagacggtagcgtgagctcctctgaacgtatccatctggtgaatcagttccagaaggatccggatacccgcgtcgccatcctctctatccaggcagcgggccagggactcacattcacagcagcgagtcatgttgtcttcgccgaactctactgggatcccgggcacataaaacaagcagaggaccgggcacacagaatagggcagtgttcttccgtgaacatccattatttaatcgcgaacggaaccctggatactttgatgtgggggatgcttaaccggaaagcacaggtgaccggttcaaccttgaacgggagaaaggaaaagatccaagctgaggagggtgacaaagagaagtgggactttttgcagttcgcagaggcttggacaccaaacgacagtagcgaggaattacggaaggaagccctcttcacccacttcgagaaagagaaacagcatgacatcaggtctttcttcgtgcctcagcccaagaaacgtcagctgatgacctcatgtgatgaaagtaagagatttcgcgaggagaatactgtcgtcagcagtgaccccactaaaacagcagcacgggatattatagactacgagagtgatgtggagcccgaaactaagcggcttaagcttgctgcgtcagaagatcactgctctccaagtgaggaaacaccttcccagagtaaacagattcgtaccccactcgtagagagtgtccaggaagctaaggctcagttaactaccccagcattcccggtggagggatggcagtgctccttatgcacatatatcaataacagtgagctgccatactgcgaaatgtgcgagactccgcagggatccgcggtgatgcagatcgactcgctcaatcacatccaggataaaaatgagaaggatgatagccagaaggacacctcgaagaaagtccagacaattagcgattgtgagaaacaggcactggctcaaagcgagcctggacagctcgctgactctaaagaggagactccaaagattgaaaaggaggacggtctcacatctcagcccgagcagtggaagtctagcgatacccttcctgtctacgatacactcatgttctgcgctagccggaacactgatcgcatacacatatatactaaggatggtaaacagatgtcctgcaacttcatccctcttgacataaagctggacctgtgggaagatcttcccgcatccttccagctgaaacagtaccggtcgctgattcttcgttttgttagagaatggtcgagtctaacggctatgaagcaacggatcatccgcaaaagcggccagctattttgcagtccaatcctggccttggaagaaatcaccaagcagcagacaaagcaaaactgcaccaagagatatataacaaaggaggacgtcgctgtggcatctatggataaggtgaagaatgtgggcggacatgtccggctcatcacaaaggagtccagacctagggatccatttaccaagaaactgctggaagatggggcctgtgtgcctttcctgaacccttacaccgtgcaggccgacctcacagtcaaaccatctacttccaaggggtatttgcaggccgtggataacgaaggaaacccgctgtgcctcaggtgccagcagcccacatgtcagactaagcaggcgtgcaaagctaattcttgggattcccggttctgttccctcaagtgccaagaggagttttggattcgaagcaacaacagctatctgagagcgaaagtgttcgagactgagcacggagtctgtcaactgtgcaatgtaaacgcacaggagttgtttcttcgcttgagggacgcccccaagtctcaacgaaaaaacctcctctacgccacatggaccagcaaattaccgttggaacagctcaatgaaatgattcggaatccaggcgagggacacttttggcaagtggatcacatcaaacctgtgtatgggggaggaggacagtgcagtctggacaatttgcagacactgtgtacagtatgtcataaggagcgcaccgcgagacaggctaaagagagaagccaggtgcgtagacagtccctcgcctccaagcacggatctgatattacccgctttctggtgaaaaagtag

SEQ ID NO: 35198 - DNA, 1794 bp, Artificial Sequence
  Description of Artificial Sequence: Synthetic coding sequence
atgacatcctgcgatgaaagcaagcggtttcgcgaggagaatacagtggtttcgtccgatcccacaaagactgccgctagagatatcatcgactatgaaagcgacgtggaaccagaaactaaaagactcaagctagccgcatccgaggatcattgttcaccgtccgaagagactccttctcagtcaaagcagatccgcactcctctggtggaatccgttcaagaggctaaggcccagctgacaacccctgccttcccggtggaaggctggcagtgttctctatgcacttatatcaataatagtgagctcccatattgtgagatgtgcgaaactccacagggatccgccgtgatgcagatcgactccctaaaccacatccaggataagaatgaaaaggatgatagtcagaaagacacgtcaaagaaggttcagaccatctccgactgcgagaagcaagccctcgcacagagcgaacccgggcagctcgccgattccaaggaggaaaccccaaaaatcgagaaggaagacgggctgacaagccagcccgaacagtggaagtcctccgataccctgcccgtttatgatactctgatgttttgcgctagtaggaacactgaccgaatccacatctatacgaaagacggaaaacagatgagttgtaattttatccctcttgacatcaagcttgatctttgggaggatttgccggcatccttccagctgaaacagtaccgatcactgatcctgcgcttcgtccgagaatggagcagcctaacggcaatgaaacaaaggatcatcagaaaaagtgggcaactcttctgctcgccgattctggccctcgaggaaataactaagcaacaaacgaagcaaaattgtacgaagaggtacattaccaaggaggatgtagctgtggctagtatggacaaggtgaaaaacgtagggggccatgtaagacttatcaccaaggaaagcagacctagagacccctttacaaagaagctgcttgaagacggggcctgtgtgccatttctcaatccatacactgtccaggccgatctgacagtgaaacctagtacatccaagggctacttacaggccgtggacaacgaaggaaaccccttgtgcctgcggtgccagcagccaacttgccagacgaaacaggcttgtaaggctaactcatgggattcacggttctgttccttaaaatgccaagaggagttttggattagaagcaacaactcctatttacgggcaaaggtcttcgaaaccgagcacggagtctgtcagctctgcaacgtgaacgctcaggaactctttctgcgcttgcgcgatgcccccaaatcccagcggaagaatctgctctacgccacatggacctcaaagctgccgctagaacaactcaatgagatgatccggaacccgggagaaggtcacttctggcaggtggaccatatcaaacctgtgtacggaggcgggggtcagtgctctttagacaatctgcaaaccctatgtacagtgtgccacaaggaacgcacagctcggcaggcaaaagagcgcagccaggtccgaaggcagtcattggcttctaaacatggctccgatatcacacgttttttggtgaaaaagctgcatgagagccataaagtcactggagcagagcagggacttcaggtgtcagggttaccggactcagctgctcccgaaggaggagccgcgcatacaaacgaccagcgaaggtgccagaggatgaagcagccgctgaccgaggtccagattctgtcacattcaagctag

SEQ ID NO: 35199 - DNA, 1902 bp, Artificial Sequence
  Description of Artificial Sequence: Synthetic coding sequence
atgctgaggcggggctataaggccagcgaacggaggcgccatctaagcgaacgactatcatggcaccaagatcaggctttatcatcctccatctatctactaagggagatgggaccgaccggatttctgttaagggaggaggagcccgaatacatggattttagggtgttcttaggtaacccccacgtgtgtaattgcagcacctttcccaaagggggagagctctgcaaacatatttgttgggtcctcctgaagaaattcaaacttcccaggaatcacgaatccgcactccagctgggactgggcgaaagggagataagtgacctgctgcgtggcatacacagggtccaaacgccgcagccaggaaccaacgatgaaaacgagcacgttgaggaggacgggtacatcaagcagaaggagattgacagcgaggacatctgttctatctgtcaggagctcctgctggagaagaaacttccagtgaccttttgcagatttggatgcggcaattcaatccacatcaagtgtatgaagattctcgctaattaccaaagcacaagcaataccagtatgttaaagtgcccactctgcaggaaggaattcgcccccttaaagctgatccttgaggagtttaaaaattcctcaaagctagtggcagcagccgagaaggaaaggctggataagcacctcggaatcccctgcaacaactgtaagcagttccctatcgagggtaagtgttacaagtgcactgagtgcatagagtaccacctgtgccaggagtgttttgatagctgctgtcatcttagtcacacctttacattccgagagaaaagaaatcagaagtggagatcattagagaaaagggcagatgaggtagtaaagtatattgacaccaagaacgagatcgaagagaaaatgtcccactttcaagagaagcaggggcaggtgtatacccctaagcacatcgttcgctcccttccattacagctgatcacaaagaactccaagctgctggcgcctggctaccagtgcctgctctgcctgaaagcatttcatctgggacagcacacccgcctcctaccctgtacacacaaattccatcgcaaatgcatagacaattggctcttccataaatgcaattcttgtccaatcgacggccaagttatctacaacccccttacctggaaaaatagtgccgtcaatgggcaggcacaccagtctgtaagcaatcgcgacatcatccacctttccaagcaaaaggagcctgatctgttcattcccggaactggtttagtgttgaaacagaaccggctgggcattcttccttcaatcccgcagtgcaactttgatgaactgaacacacctcagtctcctaaagacgcctacgaaaatactacgatagacaacctttgcagtatcaaattggataatagtaactctaagaaattgacctatgactataagattagtcagcactttccccggtaccttcaagacctccccacggttagcttcgggaaaatcccttcccagacactgctgccccctatagtccacaagaacatcgtgtgtccaaccgctatggaatccccatgcataagtggcaaattccatacttccctgagcaggatgacaaaggggtgcaagtgcaataatcataacctcaagaaaacaccggccaccaagatcagagaggataataaaagaagtacactgcttcctgaggacttcaatctgatcgtcaactggagtacagctaaattgtccctcagtaaacggtacagcaactgcatgggcgaaatcacccgtaagtgttcacacttgagtcgccaacccgtgagtcactccgtcaatactaaatcaacggagctctcactgatcatcgagggcgtacaactttag

SEQ ID NO: 35200 - DNA, 2091 bp, Artificial Sequence
  Description of Artificial Sequence: Synthetic coding sequence
atggagctcggatcatgctttaaaacctacgaagattttaaggagtgtttttcggcctacaagcgagaaaacaggtgcagctttatcctcagagactgcgtgagcgtcaggttccataatctgaaccacggtacaagtattagagaagatatcctgtatgtccaggtgaagtttgtgtgcatacggacccagtccaaccgcaagcggaccagagaagctgacatgtgtcctgcctatctgctgcttaggtacaatgagcgcctggatcgcctgtttatctcagaactgaatactcaacacattcatggtgactcaaaagtagccagtccaggcggtgatactactggtaaaagccaaaagaccatgtgcttacagagacttcagccagtccagccaactacgaaaaaggacctggatactgcagaaaagtcattagtggagccctctttttgcctggataaggtacaggtgagcagtaaacctgagcaagaagggattactcccagcgatctggctaagattgccaaagtgatgaaaaactttctcaaagtagatgaggggtccatggcatccttcagcgtcggcgacagtcagcacctggacaggttaagcttccaatctagcaaaatgacagatctgtttattaggttccctgagaatctcttactgcatcgggtcgagaatacccagggccacatcctttatgcctttctggtcgagaacaaagagcgcgaaagtcgtgtcgttcacttcgcagtgcttaaagctgagacggtcacgtctgtcgccaagatgctttccatctttacagagttcaacagcgactggcctaaggttaaggtcgtcttcgttgacccctcattccactaccgggctatcctgcaagagattttccccgcagccaggattctgctctccatttaccataccacaaggctgctggagaaaaagctacatagatcaagcgccaatccttcattcaaaagactaatgaaagaagccctcagggaggccgttttcgtgacctctgaagctagtctcaagaacctctgccaaatgagtcaagccgtgttggatgaagatctgtttaattttttgcaagcacattggttcacctgcgaactgctttggtatatgcatgtcagaaagggtctgctggcttgtaacacttacatggatagtctcgatatcgttacatcgaaggtgtcatcacttttccgcgaacaacagtccttgcttgattgcatcttatgctttgtggactacattgatttttttaacaccaaaggactcaaaaaccttcccactccgccaccaaaactgaaaagagcccgccctgcgtcaatgccactgaagagcaagaaggcttttggtatttgtggcgagtccctgacatctctaccagctgaagaaactaagccagacgcacagcaagtgcaggttcagcagcagagccaagtccccccttctcaggtaggcatgttggacacccttcatcaatctggcagtgaactcgcctacaagctttgtcacaatgagtgggaggtggttcagaacagtactcacctggtcgatatggctgggtcttctgtagacgtgcaacttctggaagactcgcatcaggtgtcgaaggatggctgctcatgtagttgtagcttccaacagtggtatcatttgccatgccggcacattctggcactgctgcatacttcacagcagccagtgggggaggcaatggtgtgtcgccgctggcagaagaaataccagtaccttcttgggcccaacggcgagcttcaggatcgcggaatggtaccgaataccggccagccagaaaagcaaggacgcaacgatatgatacaagatttaagtcgcgagctcgcaaatctgctgatgcagacagagggaccagaactggaagaacggtacagcaccctgcggaagatcgtcgatatttgggccgggccctctcagccctctgagctgttccaacagcccggagacttcaaggatgtggggcgtctccccttcctttggggcaagcaggaagagggggaagggtttcctcccgcgacagcagttatgcattattag

SEQ ID NO: 35201 - DNA, 2073 bp, Artificial Sequence
  Description of Artificial Sequence: Synthetic coding sequence
atgaagacgagattggaacggcaggccgaaaccaccagtggacacccttcactcgcctcgttatattactggactgcccccgctctgcccggacccgagctcgagatggcccctccacctcactgcgctcataaccggtatgtgcaggttaagtttgtgtgtatccgcacgcagagcaacagaaaacgaaccagagaggcagacatgtgcccggcctaccttttactgcggtataacgagcggttagaccggttatttatctcagaactgaatactcagcatatccacggagactctaaggtagcaagtccgggtggtgataccacaggcaagagccagaagaccatgtgcctgcagaggctccaacctgtacagccaacaaccaaaaaagatctcgacacagctgagaaaagcctggttgaaccatcattttgtctggataaagtgcaagtaagctcgaagcctgagcaggaaggaattactcccagtgatttggcgaaaatcgctaaggtgatgaagaacttcctgaaagtggacgagggctcgatggcatctttctccgtcggtgactcacaacacctggaccgtctatccttccaatcctccaagatgactgatctgttcattcgttttcctgagaacctacttctccatagagtagagaacacgcagggccacatcctttatgctttcctggtagaaaataaagagcgagagagcagggtggttcattttgccgttctcaaggccgagaccgtcaccagcgtggcgaagatgctaagcatattcacagagtttaatagcgattggcccaaagtgaaggtggtctttgtcgatcctagctttcactatcgcgccatcctccaggagatcttccccgccgcaagaattctgttatccatctaccataccacacgactcctggagaagaagttgcacagatcctcagcaaatcccagctttaagagactgatgaaggaggccttgagagaggctgttttcgtcaccagcgaggcttctctgaagaacctgtgccagatgtcgcaagccgttttggatgaagacctgttcaatttccttcaggcacactggttcacctgcgaattgttatggtacatgcacgtgaggaagggcttactcgcctgtaatacatacatggactcacttgatatagttactagcaaggtttcaagcctcttccgtgaacagcagtcactgctagactgcattctctgcttcgttgactatatcgacttcttcaataccaaaggactgaagaatctgccaacaccacccccaaaattaaagcgggccagaccagcgtcaatgcccctgaaatccaaaaaggcctttggaatctgtggcgagtccctcacttctttgccagccgaggagacaaagccagacgcccaacaggtccaagtccaacagcaaagtcaggtccctccctcccaagtgggcatgcttgataccttacatcagtctggaagcgaactggcctataaactgtgtcacaatgagtgggaagtggttcagaactccacccacctggtagacatggcaggcagttctgtggatgtgcagctcttagaggattcacatcaagtctccaaggatggctgcagctgcagttgctcctttcagcagtggtaccatctgccatgtaggcatattctcgcactattacatacttcgcagcagcccgtgggagaggcaatggtttgtcgaagatggcagaagaagtatcagtacctgctcgggcctaatggggaactgcaggaccgggggatggtccccaacacaggacaacctgaaaagcagggccgaaatgatatgatccaggatttgagcagggaacttgcaaatttgttgatgcaaacagaagggccagaactggaagagaggtattctaccctgcgaaagattgtggacatttgggcgggcccgtctcaaccttcagagttgtttcagcaaccaggcgactttaaggatgttggtagattgcctttcctatggggtaagcaggaagagggggaaggattccccccagcgactgctgtaatgcactactag

SEQ ID NO: 35202 - DNA, 2970 bp, Artificial Sequence
  Description of Artificial Sequence: Synthetic coding sequence
atggaaccccctgccgccaaacgctcccgtgggtgccccgccggccctgaagaaagggacgcgggggccggagccgcccgggggcgcggacgtccggaggccctcttagatctatcagccaaacgtgttgcagagtcctgggcttttgagcaggtggaggagagattttctcgggttccagagccagtccagaaaagaattgtcttctggagctttcccagaagtgagcgggagatttgcatgtatagctctcttggttatccaccccccgaaggcgagcacgatgcccgagtcccatttacacgtggactgcatcttctccagtctggcgccgtcgacagagtgttgcaagtagggttccatctgtcaggcaacatcagagagcctggctccccaggcgagcccgagaggctataccacgtgagtatctctttcgatcgctgcaagatcacctcagtcagttgtggctgtgataatcgggatcttttctattgcgctcacgtggtggccctttccctgtatagaatccggcatgcccaccaagtagaactgcgccttccaatctcagaaacgctgtctcaaatgaatcgggaccagcttcagaagttcgttcagtaccttatctcagctcatcataccgaagtcctccccaccgcccagagacttgccgacgagattctgctcctcggctccgaaataaatctcgtgaatggagcccccgaccctacagccggggctggcatcgaagatgctaattgctggcacctggatgaggagcagattcaggagcaggtgaaacaactgctctccaatggcggctactatggagcttcacagcagctgaggtcaatgttcagcaaggtaagggaaatgcttcgtatgagagacagcaatggggcgcgtatgctaatacttatgactgaacaattcttgcaagatacacgactggctctctggcggcagcagggggcgggaatgactgataaatgccggcagctctgggatgaattgggtgccctctgggtgtgcgtggtcctcagtccccattgcaaacccgaagaacgagcagggtggctgcagctgctgagcaggtgggacaaactggatgtttgcccactggaagaaggcaattacagcttcgacggtccctcactacagcccaccatggcgcctgctcctgaacttcttcagaaggggtcaacttgtatcactaataccgagggctgggtggggcaccccctggatccgataggttgcttgtgccgagccttgctagaagcatgcaggctcgaggaagaaaccctgaccttataccccgactccgggccagagaaacgcaaggtggcatatcagcacgtgcccgtgccgggcagccctggtgagtcataccttgttctcgccctggaggttgccttattaggactgggccaacaacgcgctcttcccgaaggtctgtatgctcaggacaaggtggtgagaaacgaggaacagctgcttgcgctgctcgaggaggtggagcttgatgaaagactggtgcaagtgctgcgaaagcaggctggcttactcttggaaggaggccccttcagtggattcggtgaagtgctttttagggagtctgtccccatgcacacttgcgccagatacctgtttacagcattgctgccccacgatccagaccttgcatatcggttagccctcagggcgatgaggctacctatactagagacagccttccccgccggggagccccacccttcgccacttgattcaatcatgtccaacaggttcccaagatggtttattctcgggcatctggagacccgccagtgcgagctcgctagtactatgctgacagctgctaagggagacccgaagtggttgcacacagtcctcgggagtatccaacaaaatattcacagtccggcactcctttttaaacttgcccaggacgcctgcaagaccgccactccagtctccgccccgcctgataccacactgttaggcatcgctttagagttgggcttacaggtcatgaggatgactttgaacgtgatgacgtggcggcgccgagagatggtaagatggctggtgtcctgcgccaccgagatcgggccgcaggcattgatgaatatcatgcagaactggtatagtctgttcactcccgtggaagctgctacaatcgttgctgtcacaggcacaactcatgccacgttgttgcgactccaattggacacatcgaggcgtgaagagctatgggcctgtgctcgcactctggctcttcagtgcgctatgaaggaccctcagaattgtgccctccccgcgctgactctctgtgagaaaaatcactctgcttttgaggccgcctatcagatagttctggatgctgctgctggagggctcggtcatgcccacttgtttactgttgcccgctatatggaacatcgggggctccccttacgcgcctataagctggcaacactagccctggcccagttgtcaatcgcgttcaaccaggattcccaccctgctgtcaacgacgtactgtgggcatgttccctgagtcattccttaggacggcacgagcttagcgccattgttccactgattatccggagcattcactgcgcgccgatgctctcagatatcctgaggcgctggacactgagcgcgcccgggctgggtccccttggtgctcgccgtgccgctaagcccttgggggcagatcgggctccgctttgtcagcttctcgacgccgctgtcaccgcgtatatcactaccagccattcgaggttgacacatataagccccagacactatggtgactttattgaattcttgggtaaagctagagagaccttcctgctcgcacctgacggccatttgcaattctctcagttcctggaaaatttaaagcagacctataaagggaagaaaaagctgatgcttctggtgcgggaaagattcggatag

SEQ ID NO: 35203 - DNA, 2472 bp, Artificial Sequence
  Description of Artificial Sequence: Synthetic coding sequence
atgttctccaaagtgcgagagatgttacggatgcgagactccaacggagccagaatgctcatcttaatgactgaacaatttctgcaggacacccgactcgcactgtggcgccagcagggggcgggcatgacggataaatgcagacagttgtgggatgaactgggggcactgtgggtgtgtgtcgtactttctccccactgcaagcctgaggagagggccggttggctgcagctgctttcacgctgggacaaattggacgtttgccctctggaagaggggaactattcgttcgatggcccaagtttgcaaccaaccatggcccccgcaccagggtctgaggaagaagaagaggtggcggccacatccccacggcatacagtctttggtagggccctgctggcgggagagctgcattggaacgacgcctatttgcagcgcattctagcctctgattcctacggcccatcactgacaggctctgtcggaggagacaaacctacattcgaccctcagggcagaccattgtggctgggggagccatttcccaccgcctgtgctagagtagatacactcagggcgcatggatatccccggcaagcacttaggctggctagtgcaatcataaatacactccgcctgcagcagcggcatcaattagagtcttataagcaacagaagaaggagctgcttcagaaaggctccacatgcataactaatacagagggatgggtgggccaccccttggatcccataggctgcctgtgccgagccctattggaagcttgccgtctagaggaggagaccctcacactttaccccgactcgggtccagagaagcgaaaggtggcctatcagcatgtgcctgtgccaggatccccaggagaaagctatctggtgctcgctctggaagtggcgctacttggcctcggtcagcagcgcgccctccctgagggcctatatgcccaggataaagtggttcgcaatgaggagcaattgctcgccctgcttgaggaagttgaactcgatgagagactggtgcaagtgcttaggaaacaagccgggctcctgctcgagggcgggcccttttctggcttcggcgaggttttgtttcgggagtcggtgcctatgcacacttgtgctcgctatttgttcaccgccctcctcccccacgatccggacctggcgtacagactggccctgagagcaatgaggctccctattttggaaaccgcctttcctgctggtgagccacacccctctccactggacagtatcatgagcaaccgcttcccaagatggttcattctgggacacctggaaacccgacagtgcgaactcgccagcacgatgctcactgctgccaagggcgaccctaagtggctgcatactgtcctggggagcatccagcagaatattcattctccagcattgctgtttaagttggcacaggacgcctgcaaaacagccacaccagtctcggcccctcccgataccacactccttggaattgctctggagttgggattgcaggtcatgcggatgaccctcaatgtcatgacatggagacgtagggagatggtgcggtggctggtctcatgcgcgaccgaaattggtccgcaagccttgatgaacatcatgcagaattggtattccctgttcacacctgttgaagccgccacaatcgtagccgtgaccggaactacccatgctactctgctgagattacagttggacaccagtcggcgagaggaactttgggcttgtgcccggaccctggccctgcagtgcgccatgaaagacccacagaactgtgcactgcctgcgctgacactgtgtgaaaagaaccatagcgcattcgaggcagcgtatcagattgtcctggacgcggccgccggcggcttgggacatgcccatctgttcaccgtggcgaggtacatggagcacagaggcttgcccctgcgggcctataagctggcaaccctggcactcgcccaactgtccatcgcattcaaccaggatagtcaccccgcagtaaacgacgtgctttgggcctgttcattatcacactctctcggcaggcacgagcttagtgcaatcgtgcctctgatcataagaagcattcattgtgcacccatgctatcagacattttaaggagatggacactcagcgctcccggcctggggcctctcggtgcacgacgggcagccaagcccctaggggctgaccgggctcccctgtgtcagctcctggacgccgcagtcacagcatacatcaccacatcgcactctagactcactcatatcagtcctcgacactacggcgacttcatcgagttcctggggaaggctcgggagacctttttgctggcgccggacgggcatcttcagttctcccagtttctggaaaacctgaagcaaacttataaaggcaagaagaaactgatgctgctggtccgcgaacgattcggttag

SEQ ID NO: 35204 - DNA, 3558 bp, Artificial Sequence
  Description of Artificial Sequence: Synthetic coding sequence
atggcggatggcggagagcgtgaggagttactgagtccaagtcctgtttcccctgcaaagcggcagtgttcctggccctcgccccaggcccaccatcctaggggaagtccgggcgccgccggcggcggggccggtggggtgggtagctcttgccttgttctcggcgccaggccacatctccagcccgatagcctcttggactgtgcggccaagacggttgccgaaaaatgggcttacgagcgcgtggaggaacggtttgagcgtatccctgaacctgtacagcgccgcatagtctattggagctttcctaggaatgaacgagagatctgtatgtattcctcatttcaataccgcggagggccgggcgccggcgcagctggtggggccgcaggtgcatcccctgccgaggagggacctcagcctcccccaggggctgccgcacccgctggctctgcccccgggggagttgcagctggtgctagtccaggtttgggagccggcgctggggctgccggctgtggcggggaaggcttgccatttcgccggggcattcgacttctagactctggaagtgttgaaaacgtgctacaggtaggcttccacttgtctggaacagtgaccgagttagcgacagcctccgagcccgcggttacttacaaggtggctatctcctttgatcgatgtaaaattacaagcgtaacttgcggctgcggaaataaggacattttctactgtgcgcatgtggtagccttgagcctctatcgaatccgcaagccagaccaggtgaagctgagactccctatctccgaaacactcttccagatgaatagggaccagctgcaaaagtttattcaatacctaatcaccgcccatcatacagaagtcctccctaccgcccagaagcttgcggacgagattctgtctagcaacagcgagattaaccaagtaaatggggctcctgaccccaccgcaggcgcatccatcgacgacgaaaattgttggcatttagacgaagagcaagtcaaggagcaagtcaagctgttcctctcgcaaggaggctattgcggctccggaaaacagttgaattcgatgttcgcgaaggttcgcgagatgctgcggatgagagattccaacggcgctaggatgctgactttgatcactgaacagttcgtagcggacccccggctgacactctggagacagcagggtacaaacatgaccgacaaatgcaggcagctgtgggatgagctgggggccttatgggtatgcattatcttgaacccacattgtaaattagaggagaagagttgctggcttcagcagctgcagaaatggtcagacctggatgtgtgtcccctcgaagacggtaattatggacatgagttgccaaatataaccaacgcattaccgcagagcgctatccatagtccagacagtctctcaagacctcgcaggaccgtcttcaccagagccatcgagggtagggagcttcattggcaggactcacatttacagcgaattatcagcagcgatgtgtataccgcacccgcttgccagcgggagtctgaaagactcttattcaacagccaggggcagccactatggctcgagcatgtccctaccgcatgtgcacgggtggatgcactgagaagccatggctatcccaaggaagcattgagactgacggtcgcgattattaacacactccggctgcaacagcagaggcagctggagatctacaagcaccagaaaaaggagttgctgcaacgcgggactacaacaattacgaatcttgaaggatgggttggccacccacttgatcccatcgactgcttgttccttacattgaccgaggcgtgccgactgaacgacgacggttacctagaaatgagtgacatgaacgaatcccggcctccggtttaccagcatgtccccgtagctgcggggtcacccaattctagcgaaagttacctgagcctggccctagaggttgcgctgatgggcttggggcagcagcggcttatgcctgagggtctatacgcccaagacaaagtgtgccggaatgaggagcaactgctatctcaattgcaggagctgcaactagatgacgagttagtccagacgttacagaaacagtgtattctgctgttggagggtggcccgttttccggattgggggaggtcatccaccgggagtccgtgcccatgcataccttcgcaaagtacctgttctctgccctgctgccccacgatcccgatctgtcttataaattagcgttgagagcgatgcggttgccggttctggagaattccgccagcgccggtgatacatcccacccccaccacatggtgtctgtagttccttcccgctaccctcggtggtttacacttggccacttagagtcacagcagtgtgaacttgcatccaccatgctgactgcagcgaagggggacaccttgcggctcagaactatattagaggcaattcaaaagcatatacatagcagcagcctgatctttaaactggcccaggacgccttcaagatagccacacctactgatagtagcacagactcgacactgttgaatgtggctttagagctcggccttcaagtgatgcggatgaccctgagtactctgaactggaggaggcgtgagatggtccgctggctggtcacatgcgccaccgaagtgggcgttcgcgctctggttagcatcctgcagagttggtatactctcttcactcctacagaagctacttcgattgtggccgcgactgctgtgtcccacactactatactccgtctgagtctggactacccccaacgggaggaactcgccagctgcgctcgcaccctcgctttacagtgcgcgatgaaagacccacagtcttgcgccctcagcgctctgactctgtgtgagaaagatcacatcgctttcgaggctgcctaccaaatagctatcgacgccgccgcggggggtatgacccatagccaactcttcacaatcgcccgctatatggagctccgtgggtatcccttgcgggcctttaaactggccagtcttgcaatgtctcatcttaatctggcctataaccaggacactcacccggctatcaacgacgtcctctgggcctgcgccctttcacacagcctcggcaagaatgagctcgcggcactcatcccacttgttgttaaaagcgtccactgcgccaccgtgctgtcagatattttgcgcaggtgtaccgtcactgctcctggccttgctgggatccccggccggaggtcctccgggaaactgatgagcactgacaaagccccactcaggcagcttctggacgccaccataaatgcttatatcaacacaacccattcacggctaactcacatttctccacgccactacggcgaatttatcgagtttctgtctaaggcaagagaaacctttctgttgccacaagatggacatctgcagttcgcccagttcatcgacaatcttaaacagatctacaaaggcaaaaaaaagctcatgttgttggtaagggaaaggtttggatag

SEQ ID NO: 35205 - DNA, 3648 bp, Artificial Sequence
  Description of Artificial Sequence: Synthetic coding sequence
atggcagagcgggggcagcagcctccaccggccaaacgtctgtgctgtcgccctgggggtggaggtgggggtggagggtcttctgggggaggaggaggtgcaggtggtggttattctagcgcctgcaggccaggccctcgggccggtggcgctgcagcagccgcagcatgtggaggtggcgccgccttgggcctgctgccccctgggaaaacacagtctcccgagagtttgctggacatagccgcgcgccgagtcgcagagaaatggccattccaacgggtagaggaacgtttcgaacggatccccgagccggttcagcgccgaattgtttattggtcatttccccgttcagagagagagatttgcatgtattccagttttaacaccgggggaggagccgctgggggcccaggagatgattccggcgggggcggcggagcaggtggtggaggaggagggggctcatcttcctcccctgctgcaacgtctgccgccgcaacttccgcagccgccgccgccgctgccgctgccgctgctgctgccgcagccgcgggagccggggctccttcagtgggagccgctggagctgctgacggcggtgatgagacacgcctgcccttcagacggggcattgcgctgctagagtccgggtgtgtggataatgtactgcaggtgggcttccatttgagtgggaccgtcactgaaccagcaattcagagtgagcccgagaccgtttgcaacgtcgctatatcatttgaccgatgtaagattaccagcgtgacctgctcatgtggtaataaggacatcttttactgcgcacatgtggtcgcgttatccctctatcgcatcagaaaaccggatcaagtcaagttacatcttccaatatctgaaacactgtttcagatgaaccgtgaccagctgcaaaagttcgtccaatatctaatcactgtccaccatactgaggtactaccaacggcacagaagctggctgacgagatcctgtctcaaaattccgagattaaccaagttcatggcgccccggatcccactgccggagcttcaattgacgacgagaactgctggcatctggacgaggagcaagtgcaggagcaggtgaagctctttctttcacagggcggctaccacggtagtggcaagcaactcaatttgctttttgctaaggtccgcgaaatgttgaagatgagagattcaaacggtgcccgcatgctcaccttaatcaccgagcagttcatggcggacccacggttgtccctctggcgacagcagggcaccgccatgacagataagtacaggcaattatgggacgagctgggggccctctggatgtgcatcgtcttaaatccacactgtaagctcgagcagaaggccagctggctgaagcagctgaaaaagtggaactcagtcgatgtttgcccatgggaagacggaaatcatggatcagagttacctaatctcaccaacgcgctaccccaaggggctaacgctaaccaggatagtagcaatagaccccaccgcaccgtatttacacgggcaatcgaggcctgcgatctgcactggcaggactcccacctgcagcacatcatatcctctgacctgtacaccaattattgctaccacgatgacacagaaaactcactgttcgactctagggggtggccattatggcacgagcatgtcccaactgcctgcgctagagtcgatgcccttagaagtcatggatatccacgcgaagcactgagactcgccatcgcgatagtaaatacgctgcgacgacagcaacagaagcagctggagatgttccgaacgcaaaagaaggagctgccacacaaaaatattacatcaatcaccaacttggaggggtgggttgggcaccccctggatccagtcgggacactttttagttctctcatggaggcttgccgcatagacgacgaaaatctctctggatttagcgattttacggaaaacatgggccaatgcaaatccctggaatatcagcacctacctgcccataagttcctcgaggaaggcgaatcatatctgacattggcagtggaggtggcactgatcgggcttggccagcagcggatcatgccagatgggctgtacactcaggaaaaggtgtgtaggaacgaagaacagctcatttccaaactgcaggaaatcgaattggacgacaccctcgtaaaaatctttcggaaacaggcagtgtttctcctggaagctggtccatacagtggattaggggaaataatacatcgggagtctgtaccaatgcatacatttgctaaatatctctttacatccctcctgccccatgacgcagaactggcctacaagattgccctacgcgccatgagacttctggtgttagagagtacagccccctccggtgatctgacgcgtccacatcatatcgctagtgttgttcccaatcgctatcccagatggtttacgctctcccatatcgagagccagcagtgcgagctggcgagtactatgctcactgccgccaaaggtgacgtgagaaggctcgagaccgttctagagtccatccagaaaaacattcatagctcttcccacatattcaaactggcacaggacgcctttaagattgctacgctgatggactcgctccccgatatcaccctgctcaaggtgagcctggagctgggcttgcaggtgatgcgcatgaccctttccactctgaattggaggcggagagagatggtacgatggctcgtgacatgcgctaccgaggtcggtgtgtatgcactggacagtataatgcagacctggttcacccttttcacccccaccgaggccacaagcatcgtggctactacggtcatgtcaaacagcactattgtaaggctgcacctggactgtcatcagcaagaaaagctcgcctcttcagctaggacgttagccctgcagtgtgccatgaaggaccctcagaattgtgctctgagtgctctcaccctgtgtgaaaaagaccatatcgcatttgagacagcctaccagattgttctggatgcagcgacaacaggaatgtcctacactcaactgttcactatagcacgatatatggaacacagagggtatcccatgcgagcctacaagctcgccactctggccatgacccatctcaacctgagctacaatcaagatacacatccagctatcaatgacgtcctgtgggcctgtgctctgagccactctctgggaaagaatgaactggcggctatcattcccctcgtcgtaaagtcggttaaatgcgccactgtgctgtccgacatcctgagacgatgtacattgacaacacctggaatggtgggactgcacggcaggcgcaactcggggaaactgatgtcactggacaaagcgcctttaagacagctgctcgatgccactatcggggcctatatcaacaccacccattctaggctgactcatattagcccacgtcactattccgagttcatcgaatttctgagtaaagccagggagacatttctgatggcgcatgatggacatattcaattcacccagtttatagataaccttaagcaaatctataaaggcaaaaaaaaactgatgatgctggtcagagaaagatttggctag

SEQ ID NO: 35206 - DNA, 8886 bp, Artificial Sequence
  Description of Artificial Sequence: Synthetic coding sequence
atgggcaatgctccaagccactcatccgaggatgaagctgctgccgccgggggagaggggtggggtccacaccaggactgggccgctgtctcaggaacaacacctggccctggcgtagccgcccctgcgctgccacctgctgccgctctgcttgaacccgccagactacgagaggccgcggctgcattgctacctactcccccatgcgagtcgcttgtcagtaggcaccgcggcgctttattccgttggctggaggagcggcttgggcgcggcgaggaaagtgtgacactcgagcagtttagagaactgcttgaggcgagaggagccggctgcagctccgagcaattcgaggaagcattcgcccagttcgatgcagagggggacggaacagtggacgctgagaacatgctcgaggctttgaagaacagcagtggcgccaacttgcaaggggagctgtctcacatcattcggcagctccaggcttgttcgctggtgcctggctttacagatatattctcagagtcaaaggaaggcctcgacatccattcttccatgatcctccgcttcctccatagaaaccgtctgagtagcgctgtgatgccataccccatgctggaacattgtaacaatatgtgtaccatgaggtcctcggtgctgaaggaatctctcgaccagttagtccagaaggaaaaagagtcccccggcgacctgacccgaagtccagagatggacaagctgaagagcgttgctaagtgttacgcttacatagagacctcctctaactcagccgatatcgataagatgacgaacggcgagactagctcttactggcagtcggatggctcagcatgcagccattggatccggctcaaaatgaaaccagacgtggttctgaggcatctgtccattgctgttgccgccaccgatcaatcctatatgccccaacaggtcactgtggccgtaggcaggaatgcctccgatctgcaggaggttcgggatgtgcacatcccgagtaacgtcacaggatatgtaaccttgcttgagaatgctaacgttagccaactgtacgtgcagatcaacatcaagcggtgtctgtcagatggctgtgatacccgtatccatggactgcgggccgtcggatttcagcgggtgaagaagagtggggtgagcgtgtccgacgcctcggcaatctggtattggagcctgctaacctctctggtgaccgccagcatggaaaccaaccccgcctttgtgcaaacagtgttacacaatacacagaaagctctgaggcatatgccccctttgagcctaagtcctggctccaccgatttttctacatttctgtcccccaacgttttggaggaggtagactccttcctcatccgcatcaccagctgctgttctactccagaggtcgagcttactctgttggcatttgccctggccagggggtctgtggccaaagtcatgtccagcctctgtacaataactgaccatcttgatacacagtatgatgcatcctctctaattctgagtatggctagcgtgcgccagaaccttctcttaaaatatggtaagcccctccagctgacgctccaagcctgcgatgtgaaaggcaaggaagataagtcaggacccgaaaatctgttagtcgaaccgtggacacgggacggctttctgacagaaactgggaaaacgcgcgcgagtaccatcttcagcactggaaccgaaagcgctttccaggttactcagattcgcatcatggtaagacggggtgggattggcgctcagtgcggccttgtttttgcctataactcttcctccgataaattctgcgccgaagagcacttcaagaggttcgagaaatacgataaatggaagctgcaggagttgagacaattcgtcaaatcccgaattggatgctcatctgatgaccttggcgaagacgacccaatcgggtggtttgaactcgaagaggagtgggacgaagccgacgtgaaactccaacagtgccgtgttgccaaatatctgatggtgaagtttctctgtacacgccaagaatccgctgagaggctcggagttcagggactgacaatttctggctacttgaggccagcaagggccgaggccgaacagagcgttacatgcgcacactgtcggaaggataccgaggaatccgtgtgcggtgcaacgttgctgctgaggacactccagtttatccagcaactagcccacgatctggtgcagcagaaggagtcagggcttaaatataagtcgttcctggacttcgctgggctggatctgcagatcttctggaatttctattccaaactgaagcaaaaccccagagaagagtgtgtgagtgcacagacgctgctgctgcagttactgcagtcatgcttttcggtgctgcaaggcgacgtattggccgcctccgaggaggagaaggcacctattcagagcccaaaaggagtggaagccgctaaggagctttacacccacctgtgcgatgtagtggataaagtcgacggtgattccgtaccaatggagatcctgaaacaggaagtgaggaatactcttttaaacggcgcggctattttttttccaaatagacagacacgcagaaaccatctgttcactatgatgaatgtcaccgaacaagaacataagcagagcctgcagctcacctttcgctccctgtgtacatatttctcggacaaggatcccggaggactgctacttctgcctgaaaaaaatgacctggctaagatgaatatatccgaagtgctggccgtgatggatacattggtatcggtcgctgcccgcgagtgcgagctgttgatgctgagcggagctccaggagaggttggcagtgtgctgtttagtttgttctggtctgtgcagggtagcctgctgtcctggtgttacctccagctcaagtccacagactcgggcgcaaaagatctagctgtcgaccttatcgaaaaatatgtagggcagttcctggcttcgatgcgcgctattctcgaaagcttgttttcccagtactctggcaaaacgatcgtggaacgattgtgtaactccgtgttttccatggccgcgcgacagctcgtgatctttttactggacttctgcactctggacatcccacattgtgtgttattacgggagttttccgtgttaacggaactcctgaagaaattgtgcagtggaccagaaggggggctgcgcaagctcgatgtcgagacgtggcagcaagagcaacctgtcgtgctccacacatggacaaaggagtcagcccacaactacgaaaacaactgtcatgaggtaagcgtttttgtgtcccccggggctacctacttcgaggtcgagttcgacgacagatgtgagactgaaaagcgctacgactatctcgagtttactgacgccaggggtcggaagacacgttacgacactaaagtgggcactgacaaatggcccaagaaggtgacattcaaagccggtcctcgtctgcaattccttttccatagtgattccagccacaacgaatggggctacaagtttaccgtcaccgcctgtggtcttccagatgtcgcagtgtcgtgggggctggatcttcagcttctggtctctcggctgatggggcggctggctagtcaatgcatggccttaaaatccgttcggcagttaggtagcaacatggtcgtgccacaggcgaagatggctctagttctgtccagtccactgtggaagcccgtcttccgccatcaggtttgccccgagctcgagctggaggcctcctggcccacgcaccctcaccgcaacagcaaggaagtaaaaaacattcctgatgatccttgcaggcacttcctccttgattttgcccagagtgaacctgctcagaatttttgtggaccctactccgaactctttaaggggttcattcaggcttgccgtaagcaggccccgaagacagacattgtggcaggatccaccatcgaccaggccgtgaacgccacatttgccgcgctcgtttatcgaacacccgacctctatgaaaagcttcagaagtatgtgaacagcggagggaagatagcattgtcagaagaatttgctcaggtatactctcttgccgacgggatacgtatatggatgttggaaatgaaacagaagtcactgatgagcttgggcaatgaagcagaggaaaagcactcttcagaggctaccgaagtgaatccagagtccctagccaaagaatgtatcgaaaaaagtctcctgttactcaagtttctgccaaccggtatctctagcaaagagtcgtgcgaaaaattggaaaccgcagatgaaacatcccaccttcagcccctgaacaaacgccagaggacttctagtgtggtcgaggagcattttcaagcgagcgttagccccacggaagcggccccgcccgccaccggagatcagtcccccgggttgggcacacaaccaaagctgccctcctccagtgggctccccgctgcggacgtctcgccagccacagctgaagagcccctctctccatccacacctactagacgcccaccctttaccaggggtaggctccgactgttgagctttagatcaatggaagaggctagactggttccaacggtaaaagaaaagtatccagtacttaaagatgtgatggattttatcaaagaccaaagcttgagccaccgctcggttgtaaaagttctttcgctgaggaaagcacaggcccagagtatcttggaggtgttgaaaataactcagcactgtgcagaatcactgggccagccccattgctttcaccctcccttcattctctttctgttggagctgctgacctgtcagaaggatttcaccaattacttcggccacctggaggggtgcggtgctgaccttcacaaagagatccgagacacatactaccaattggtgctcttcttggtgaaggctgtgaaaggctttagctccctcaacgaccgcagtttgttacccgcactctcctgtgttcagaccgctctcttgcatcttttagatatgggttgggagccgaatgaccttgccttttttgtggacatccagttgccggatctgctcatgaaaatgtcacaggagaatatatccgtacatgactccgttatctcccagtggtcagaagaggatgaacttgccgatgcaaagcaaaactcagaatggatggacgaatgtcaggacgggatgtttgaagcctggtatgagaaaattgcacaggaggatcccgagaaacagcgaaagatgcatatgttcatcgcccgctattgtgacctcctgaatgtggacatttcctgcgatggatgcgacgagattgcaccctggcaccggtatcgatgtttgcagtgcagcgatatggatttgtgcaagacctgttttttagggggagtcaagcccgagggacacggggatgatcatgagatggtgaatatggagttcacttgtgatcactgtcagggcctgattataggaaggcgtatgaactgtaacgtttgtgacgatttcgatttgtgctacgggtgttatgccgcgaagaaatattcctacggccatcttccaacgcattctatcacagcccaccctatggtgaccatcagaatcagtgatcggcagcgactcatccagccgtacatccacaattatagctggctgctgtttgcagcactggctctctacagcgcccatctcgctagcgccgaagatgttgacggcgagaaattggaccctcaaactcgctcctcagccaccacactgcgtagccagtgtatgcagctggtgggggactgcttgatgaaggcacatcagggcaaaggcctgaaagctctggcactgctcggagtcctacctgacggcgacagtagcctggaggatcaggcgctgcctgtgaccgtacccacaggtgctagtgaagaacagctagagaaaaaagcagtgcaaggggcagaattgtccgaggcgggcaacggtaagagggcagtacacgaggagattagacctgtcgacttcaagcagaggaataaggccgacaagggagtctccctgagcaaagacccttcctgccaaacacaaatttctgacagccctgcagacgcctccccaccaaccggcctaccagacgcggaggattctgaagtatccagccagaagcccattgaggaaaaggccgttactccctccccggagcaagtcttcgcggagtgctcccaaaagaggatcctggggctcctggccgccatgctaccacctctgaaaagtgggcccacggtaccgctgatagacctcgaacatgttctgcctctgatgtttcaggtggtgatatccaatgctggacaccttaacgagacgtatcacctgactctcgggctgcttggtcagttgatcatccgccttctgccagccgaggtggatgcagcagtaatcaaagtgttaagtgcaaaacataacctgtttgccgcaggcgactcatccatcgttcccgatggttggaaaactacccacctgctgttttccctaggggcagtgtgcctggacagtagggttggcttagactgggcctgcagcatggcagaaatcctgcggagcttaaactcggcccccttgtggcgcgacgtgattgctacctttacagatcactgtataaagcagcttccattccagttgaaacacacaaatatctttacgctccttgtcctcgtggggtttccacaggtcctctgcgtgggcacacgatgcgtctacatggacaacgctaacgagccccacaacgttataattctcaagcacttcaccgagaaaaaccgggccgttatcgttgatgttaagacgaggaagagaaaaacagtgaaggattatcagctggtacagaaggggggaggacaggaatgcggcgactcgagggcccagcttagccaatactcccagcacttcgcctttatcgcctcacacctgttgcaatcatcaatggatagtcattgcccagaggcggtggaggcgacatgggttttgtctcttgccctgaaggggctttataaaactttaaaagcccacggcttcgaagagattcgcgctacattcctccaaacggacttactgaaactccttgtgaaaaagtgctcaaaggggactggcttctcaaagacgtggctccttcgcgacctggaaattttgtcaattatgctgtactcgagtaaaaaggaaatcaacgcgctggccgagcatggcgaccttgagcttgatgaacgcggagatagggaggaagaggttgaaaggcctgttagtagccccggcgatcccgaacagaagaagctggatccactggagggattagacgaacccactcggatttgtttcctcatggctcatgacgccctaaacgctcccctccacatactccgcgccatctatgagctccaaatgaaaaaaactgattacttctttctggaagtgcagaaaagatttgacggggatgaacttaccacagacgaacgcatccgttccctggctcaacgctggcaacccagcaagtctctccgtttggaggagcagagcgcgaaagccgttgatacagatatgataatcctcccctgcctttcacgccccgcccggtgtgatcaagccacagcagagagtaaccctgtgacccaaaagcttatcagttccacagaatcggagctccaacagagctacgcaaaacaaagaagatcgaaatcagctgcccttctgcataaggagctgaactgcaaatcaaagcgcgccgtgagagactatctgttccgcgtaaatgaggctacagctgtgttatatgcacggcacgtcctcgcatctctcctggccgagtggccctcccacgtgcccgtctcagaggatattctggaactatctggacctgcgcacatgacttacatcttagatatgtttatgcagttggaggagaaacacgaatgggagaaaattctgcaaaaggtcctgcagggctgccgagaggacatgcttgggaccatggccctggccgcttgccagtttatggaggagccaggaatggaagtgcaggtgagagagagtaaacatccttataataataataccaatttcgaggacaaagttcacattcccggggcaatctatcttagcatcaaatttgactcccagtgtaatacagaagaaggatgcgatgagctggccatgagttcatctagcgacttccagcaggatcggcattctttctctggctcccagcagaaatggaaggatttcgagttgcctggcgatactttgtactatcgcttcacttctgatatgagcaacacggagtgggggtaccggttcacagtgactgccgggcacctgggtaggtttcagacgggcttcgaaatccttaagcaaatgctctcggaagaaagggtcgtgccacacctgcctttggccaaaatctgggagtggttggtgggtgtggcatgccggcaaactggacaccagcgattgaaagctatacaccttctgttgcgcatagttcggtgttgcggccatagtgatctgtgtgatcttgcgctgttgaagcccttatggcaactgttcacccacatggagtatggcttatttgaggatgtaactcagccaggcatactgctgcctctgcatagggccttgactgaattgttctttgtgacagagaatagggcacaagaacttggtgtgctccaggattatttgctggctctgacaactgacgaccacttgttgcgttgcgccgcccaggcgcttcagaatatcgcggctatatctctcgctatcaactatccaaataaagctacacggctgtggaatgtcgaatgctag

SEQ ID NO: 35207 - DNA, 588 bp, Artificial Sequence
  Description of Artificial Sequence: Synthetic coding sequence
atgggagtgtggggaaaaaagcacctacgtctgacccatgcaccgagtcccacgttttcccatctcccaccctcaccacaggccggggagcctggaatagacggaattagcctagccgttgtgtgtgctgccttcatccggatacatccagcgagaaggcatccagcccgtaacgggtcccgccttgcctgtacccccacccctagacccaacgctggactggaggtagtgtcaagtgcacgggtcgcagcctctctcccgagtgaggggggttggacatccggcgctccacgcagtagcggcctgtcgctgcctggatccgcgtggcaaccccctcccctgcccgtgctacgtaaacccgcttggcctggcagccctgccgtgaagaacgagtccaaatttcccaatcgaggctctcgtaacttcccgcgccgccggttgccccctgcccctgtgtcaggcgagccccccgaaaggtgtaagcttgcacgcgaaattaggtggcgactgtggaaagcccacgaaggctggggtggaggcgccaaaaggccactcggagaccccgcttggtcaggcgtaaagcgatag

SEQ ID NO: 35208 - DNA, 7872 bp, Artificial Sequence
  Description of Artificial Sequence: Synthetic coding sequence
atggtgcctcccgtgtggactcttctacttcttgtaggagctgccctcttcagaaaagaaaaaccccctgatcagaaattggttgtacggtcatccagggataactacgtgttgacccagtgtgacttcgaggacgatgctaaaccgctctgcgattggtcccaggtctccgcagatgacgaggattgggtaagggcatcaggacctagtcctacagggtctacgggagccccgggtggataccctaatggcgaagggtcatatctgcacatggagtcaaacagcttccatcgaggaggggtggcaagattgctttctcctgacctgtgggaacaagggcctctgtgtgtacacttcgcccaccacatgttcggtttgtcctggggagctcagctgaggctcctcctgctctcaggggaagaggggagacgtcctgatgtgctatggaaacattggaacacacagcgcccctcttggatgcttactacagtcaccgtaccagcgggatttacgctgcccacccgtctaatgtttgagggaactagaggcagtacagcctatctggatatcgcactcgacgctctaagcattcggcgtggcagttgcaaccgcgtttgcatgatgcagacttgctctttcgatatacctaacgatctgtgcgactggacatggatcccgaccgccagcggcgccaagtggacacaaaaaaagggcagtagcggtaagcccggagtcgggcccgatggcgacttctccagccccggctccggctgttacatgttacttgatcctaaaaacgcccgcccagggcaaaaagctgtgttactctctcccgtttccctgtcaagcggctgtctgtccttttcttttcactatatcctacggggtcagtctccaggcgctgccttacatatctacgcctccgtgctcgggtctatcaggaaacatacactgtttagtggtcagccagggcctaattggcaggctgtgagcgtgaactacacggcagtaggcagaatccagttcgctgttgtgggggtgttcgggaagactcccgaaccagctgtcgccgttgacgccacaagcattgctccatgtggagagggctttccccagtgcgattttgaggataatgctcatcctttttgcgactgggtgcagacgagtggcgatggagggcactgggccttgggccataagaacggtcctgtccacgggatgggaccagcagggggatttcctaacgccggagggcattacatttacttggaggcggacgagtttagccaggcgggtcagagtgtgcggctggtttctcgcccattctgcgcccctggggacatatgcgtggaattcgcctatcatatgtacggcttgggagaaggcactatgctagaacttctgttgggtagccctgctggctctcctccaattcccctgtggaagcgcgtaggaagccagcggccatactggcagaacaccagtgttactgttccatccggccatcagcagccaatgcagctcatcttcaaggggatccaagggtccaatactgctagtgtcgtagccatgggcttcatcttgattaatcctggcacttgtcccgtgaaagtactgccagagttgccaccagtgtctcccgtgtcctccacaggcccgtctgagacaactggcctgacagagaacccgacaatttctaccaagaagccaacagtgtccatcgagaagccaagcgttacgactgagaagcccacagtgccgaaagagaagcccaccattcctacagagaaaccgactatctctactgagaaacccaccattccctcagaaaaaccgaacatgccttctgagaaacccaccattccttccgagaagcccaccatcctcactgaaaagccgactatacccagcgaaaagccaacaattccttcagaaaagcccacaattagcacagagaagcccactgtgcccactgaggagcccaccacgcctacagaagagacaactacgagcatggaagagcctgtgatcccaaccgagaaacctagtatcccaacagaaaaacctagcatccctaccgaaaagcccacaatcagcatggaagagacgataattagtacagagaaacccactatttcacccgagaagcccactataccaacggaaaaacccaccatcccaacggaaaagagcaccatcagccccgagaaacctacaaccccaactgaaaagcccactattcccaccgaaaagccaaccatctcccccgagaaacccacaacaccaacagaaaaacccacgatatcaccggaaaaactgactattccaacagagaagccgacaatccccactgaaaaacccactatccctacagagaagcccactatttctacagaagaacctacaacacctacggaggaaactaccatcagcactgaaaagccttctattcccatggaaaagccaaccctcccgaccgaggagaccactacttctgtcgaggaaactaccataagtaccgaaaaattgaccatcccaatggagaagccaaccattagcactgagaaacccaccattccgactgagaagcctacgattagccccgaaaaactgaccatacccactgagaaactcaccatacccacagagaagcctacaatcccaatagaggaaactactatatccactgaaaagctcactatcccgactgagaagcccaccattagccctgaaaagccaaccatttcaactgagaagcccacaattcctactgaaaagcctacaattcctacagaggagaccaccatctccaccgagaagctcacgattcccactgaaaagccaacaatcagccctgagaagctgactatacccactgaaaaacctactatctccacagagaagcctactataccaactgagaaactgactatacccaccgagaagccgacaattccaaccgagaagccaacgatcccaacggagaagctgaccgcactacgcccaccccacccgtcccccaccgcaactgggctcgccgctttggtgatgagtccacacgctccgagcacacctatgacctccgtcatcttgggtaccactactaccagtaggagctctaccgaaaggtgcccacccaatgcgaggtatgaatcatgtgcttgtcctgcatcgtgcaagagcccgcgacccagctgtgggcctctgtgccgtgagggctgcgtttgcaaccccggctttctgttcagtgacaaccattgcattcaggcatcctcgtgcaactgtttttataataacgattactatgagcctggtgctgagtggttttcacctaattgtacagagcactgccggtgttggccaggttcacgtgtggagtgtcagatctctcagtgcggtacccataccgtatgccagcttaagaatggacagtacggctgccacccttacgccggcacagcgacttgtctagtctacggcgacccacactacgtgacgtttgacggccgtcatttcgggttcatggggaagtgcacctacatcctggcgcaaccctgtggaaactcgacagacccatttttccgggtgacagcaaaaaatgaggagcagggccaagagggggtgtcctgtctgtccaaggtttatgtcaccctgccagagtctacggtcaccttactcaaaggtagacgaaccttggtcggcggtcagcaggtgaccctcccggcgatcccctccaagggcgtgttcctcggtgcctcaggccgattcgtggaactgcagaccgagttcggcctgcgtgtcagatgggatggagaccagcagctgtacgtgacggtgtcttccacatactctggcaaactttgtggactctgcggcaactacgacggcaattctgacaacgatcacctcaagctcgacggcagccccgctggagacaaggaggagctggggaactcgtggcaaaccgaccaagatgaggatcaagaatgccaaaagtaccaggtggtaaacagcccttcttgtgatagttcactgcagtctagcatgtccggaccaggattttgtggaagactcgtggacactcatgggccatttgaaacttgcctgctgcacgtcaaggccgcctctttttttgacagctgcatgctggacatgtgcgggttccaaggtctgcaacatctgctctgcacccacatgtccactatgacgaccacctgccaagatgccggacacgccgtaaaaccatggcgggaacctcatttttgtcccatggcttgccccccaaactcaaagtattcactgtgcgccaaaccatgtccagacacctgtcatagcggtttctctgggatgttttgcagcgatcgatgcgtggaagcttgtgaatgcaaccccggttttgttttgagcggcctggagtgcattccccggtcacagtgtgggtgtttacatccagctgggagttattttaaagtcggggaaaggtggtacaagccagggtgcaaagagctgtgtgtctgtgagtccaacaatcgcatccggtgccaaccttggcggtgcagggcccaggagttctgcggccaacaggatggaatctacgggtgccacgctcagggtgctgccacttgtacagcttccggagatcctcattatcttacatttgatggagcgctgcaccattttatgggcacctgcacttatgtgctcactcggccctgttggagtcgcagccaggactcatatttcgtcgtcagcgctaccaatgagaaccgggggggcatcctggaggtgtcctacatcaaggccgtgcacgttaccgtgtttgatctgagtatctctctgttgagaggctgtaaggtgatgctgaatggccacagggtcgcacttcctgtctggctggcccagggtagagttacaatccgcctctctagtaacctggtcctattgtacactaacttcgggctccaagtccgttacgatggaagtcatttagtggaggtgacagttccctccagttatggagggcagctgtgcggactttgtgggaactacaataacaacagcctggatgataatttaagaccagatcggaaactggcaggcgactcaatgcagctgggtgccgcttggaagctccccgaatcgagcgaaccgggatgcttcctggtgggtggcaaaccaagcagctgccaagagaattccatggctgatgcttggaataaaaattgtgccatcctcatcaatccacaggggccctttagccagtgtcatcaagtggtgcctccccagtcttcattcgcgagttgcgttcacggccagtgtgggacaaagggggataccacggcattgtgtcggtctctgcaggcctatgcttcattatgcgctcaggcaggccaggctccggcttggagaaatcgtacattctgcccaatgcgttgtccgcctggtagctcatatagcccttgcagtagtccctgcccagatacctgctctagcataaacaaccctcgcgattgtcccaaggccctgccctgcgccgagtcctgcgaatgtcagaagggccacattctctccggcacctcttgtgtacccctggggcaatgcgggtgcactgaccccgccgggtcttatcatccagtgggagagcgctggtacacagagaacacttgcacaagactctgtacttgtagtgtgcataataacattacttgctttcagtctacttgtaagcctaaccagatctgctgggccctggatggactgctccgccgcgcctcaggtgtcggcgtgtgccagctccccggggaaagtcactatgtttcctttgatggcagtaaccactctatccctgacgcttgtaccctggtgctggtcaaagtctgtcatccggcaatggccctccccttttttaaaatttccgcaaagcacgagaaagaggaaggcgggaccgaggcgtttagactacacgaggtatatattgatatctatgatgcacaagtgactctgcagaagggccatcgggtgcttattaattcaaaacaggtgacactcccagctatttcgcagatccctggagtgagtgttaaatccagcagtatatattctatcgtgaacatcaagataggagtgcaggtaaaattcgatggaaatcatctgttggagattgaaatacctacgacctactacggaaaagtttgcgggatgtgtgggaattttaacgatgaggaggaagatgaactcatgatgccttcagacgaagtcgctaatagtgacagcgagttcgtgaactcctggaaggacaaggatatcgatcccagctgtcagtccctactcgtggacgaacagcagattcctgcggaacagcaagagaatccttccgggaattgccgggctgcagaccttcgacgcgctcgggaaaagtgcgaggccgccttgcgggccccagtctgggcccagtgtgcatccagaattgacttgacccctttcctggtcgactgcgccaacactttgtgtgagttcgggggtctttatcaagctctgtgccaggctctgcaggctttcggggccacctgtcaatcgcaaggtctgaagccacccctatggcgcaattcatccttctgcccgctggagtgtccagcctacagcagttacacaaattgccttccgtcttgctcccctagctgctgggatctggacggtcggtgtgagggcgcaaaagtcccgtcagcatgtgctgagggctgtatctgtcagccggggtacgtcttgtcagaggataaatgcgtgccccggagccagtgtggctgtaaagatgcccacggtgggagtatccctctggggaagtcctgggtctcttccggctgtaccgagaaatgcgtctgtacaggaggtgctatacagtgtggtgactttcgctgcccgtcaggtagtcactgccagctgacatcggataactccaactctaactgcgtgagcgacaagtctgagcagtgcagtgtgtatggggaccctcgatacttaactttcgacggcttcagttaccgattgcaggggcgcatgacatacgtgctgatcaaaactgtggacgtcctgcccgagggcgtcgaaccactcctggtcgaggggaggaacaaaatggatcctccccgtagctcgatctttctgcaggaggtcattacaaccgtgtatggatacaaggttcagttgcaagccggactggaactcgtggtcaacaatcagaaaatggccgtgccatatcgtcccaacgaacacctgcgggttacactgtggggacagcgcttatacctagtgaccgatttcgagctggtggtgagcttcggaggccgcaagaacgctgtaatcagcctgccgtcgatgtatgaaggtctcgtcagcggactttgtggaaactatgataaaaaccgtaaaaacgatatgatgctgccgtctggggccctcacgcagaatttgaacacttttggaaatagttgggaggtgaaaactgaggacgcactgcttcggtttccaagggcaatcccggccgaagaggaaggccaaggtgccgagcttggtctcagaacaggcctgcaagtgagtgaatgcagcccagaacagctagcatcaaatagtactcaggcctgtcgcgtgctggcagatccgcaaggaccgtttgcagcctgtcaccagacagttgcccccgaaccgtttcaggaacattgcgtactcgatctgtgctccgctcaagaccccagagagcaggaagagctcaggtgccaggtgctcagtggctacgccatcctttgtcaggaagcgggggccgccctcgccggatggagagacagaactttgtgcgccggacagcaactatccgactag

SEQ ID NO: 35209 - DNA, 8067 bp, Artificial Sequence
  Description of Artificial Sequence: Synthetic coding sequence
atggttccgcccgtgtggactttgctcctcctggttggtgctgccttgttcagaaaagagaagccaccggaccagaaactcgtggtgcggagcagccgggataattacgtgctgacgcagtgcgacttcgaagacgacgccaaacccctctgtgactggtctcaggtgtccgctgatgatgaggactgggtcagggccagtggccctagtcccaccgggagcaccggcgctccagggggataccccaatggggaaggctcctacctgcacatggagtcaaatagtttccatagaggcggggtcgcaaggctgctgtccccagacctttgggagcaagggccactgtgtgttcactttgcccaccatatgttcggtctctcctggggggctcagctccggctgctccttctgtcaggagaagaaggccggagaccagacgtactctggaagcactggaatacccaacgcccatcatggatgctcacgaccgttacagtaccggccgggttcactctgccaacccgcctgatgtttgagggtacacgaggcagcacagcgtacctcgacatagccttagacgcgttgtctatcagacgcggtagttgtaaccgagtgtgtatgatgcagacctgctcttttgacatccctaacgatctctgtgactggacatggatccccaccgccagcggggctaagtggactcaaaaaaaaggatcttctggaaaacctggcgtaggccctgatggcgactttagctcccccggaagcggttgttacatgctgcttgatccaaagaacgcgcgccccggccagaaggccgtattgctgtcgcctgtatccctctcatccggttgcctcagtttctctttccactatattctgcgggggcagtctcccggtgctgctttgcatatctatgcctccgtgctgggaagcatcagaaagcacactctattttctggccagcctgggcccaactggcaggcagtctccgtcaattataccgccgttggtcgaattcagttcgcagtcgtaggagtcttcggcaaaaccccagaaccagcagtcgcagtggacgccacaagtatagccccttgcggagaaggcttcccccagtgcgattttgaagacaatgcacatcccttctgcgattgggtccagactagcggcgatggtggacactgggctttgggtcataagaacggtccagtgcacgggatgggtcctgcgggagggttccccaacgctggcggtcattacatttacttggaggccgatgagttttctcaggcgggtcagagtgtcagactggttagtagaccattctgtgcccccggggatatctgtgtggagtttgcatatcatatgtacggtctcggagaaggaaccatgctggagcttctgttgggtagccctgctggaagcccccctattccactgtggaaaagagtcgggtcccagcggccatactggcagaacaccagcgtgaccgtgccgtctggccatcagcaacctatgcagctgattttcaagggcattcagggctctaatactgcatccgtcgtggcgatggggtttatcctcattaatcctggaacatgtcctgtgaaagtgctgcctgaactcccccctgtctcacctgtatctagtacgggcccttcagagaccaccggactcaccgagaaccctaccatctccactaagaaaccaactgtaagcattgagaaaccatcagtcactacagagaaaccaacagtgccgaaggagaaacctaccatcccaaccgagaaaccaactatctcgacggagaagcctaccattccgagcgaaaagccgaatatgccttccgaaaaacctacaatcccttctgagaagcccactattttgaccgagaagcctacaatcccgagtgagaagcctaccattccttctgagaaacccactatctcgaccgagaagcccaccgtgcccaccgaggaacccaccactccaactgaagagactacgacatccatggaggaaccggtcattcccaccgaaaagccgtccatcccgaccgagaagccctctatccctaccgaaaagcccacaatctcaatggaagagacaatcatctccaccgaaaagccaaccattagtcctgagaaaccaactattcccactgagaagccgaccatcccaactgagaaatctaccattagcccggagaagcccacaaccccaacggaaaagcctacgattccgacagaaaaacctaccatctcaccagagaaacctacaacccctaccgagaaaccgactatctcgccggagaagctgacgatccccacagagaagcctactataccaaccgaaaagccgaccattcccaccgaaaagcccaccatctccaccgaggagccgaccacacccacagaagaaacgacaatctcaacggaaaagcccagtattccaatggagaaaccgaccttgcccacagaagagacaactacatctgttgaggagacgacaatctctactgagaagctgaccatccccatggagaaaccaaccatatccacagagaaacctaccatcccaaccgaaaagcccaccatttctcccgagaaactgacaattcccaccgagaagctgactatccctaccgagaagcctacaatccccatagaggaaaccaccatctcaacggagaagctgacaatcccaacagaaaaacccactatcagccccgagaaacctaccatcagcacagagaagcccaccatcccaaccgagaaacctaccatccccactgaggagaccacgatcagtactgagaagttaaccatacccacggaaaagccaaccatctcaccagagaagctcactatccccactgaaaagcccactatctccactgaaaaacccacaattcccactgagaagctcacaatcccaactgagaagccgaccataccaactgagaaacctactatccccaccgagaagttaacagccctgcggcccccccaccctagccccaccgctacgggactggccgccctggttatgagtccacacgccccatccacaccgatgacctccgtcattttgggaacgaccacaacatcacgcagttctaccgagcgctgcccccctaatgctcggtatgagtcttgcgcctgccctgcctcctgcaaaagccctaggccttcatgcggccccctttgtcgcgaggggtgtgtttgtaatccgggattcttgttctccgacaatcattgcattcaggcctcatcatgtaattgcttttataacaacgactattatgaacccggcgcagagtggttctcccctaattgcaccgagcactgtagatgttggcctggttcgcgcgtggagtgccagatttctcaatgcggcacacatacagtctgtcagctcaagaacggtcaatatggctgccacccttacgccgggactgctacatgcttggtgtacggggatccccattacgtgacgttcgatggccgccacttcggctttatggggaagtgtacttacatcttggcgcaaccgtgtgggaattccacagatccattcttcagagtaaccgcgaaaaatgaagaacaagggcaagagggcgttagctgcctgagcaaggtgtatgtaactctgcctgagtctaccgtgactttacttaaagggcgcaggacactggtgggagggcagcaagtgacgttacctgcaataccgagcaagggggttttcctgggggcctcagggcgtttcgttgagttgcagacagagttcggacttcgcgttagatgggacggagatcagcagctgtacgttaccgtttccagcacatactcggggaagttgtgtgggttgtgcggaaattatgatggcaatagcgataacgaccacctgaagctcgatggctcaccagcgggggataaggaagaactgggcaactcctggcaaactgaccaggatgaggaccaggagtgccagaaatatcaggtcgtgaacagcccatcttgtgattcgtccctacagtcctccatgagcgggcctggattttgcggcagattagttgatacccatggccctttcgagacttgcttacttcacgtcaaagctgcttcttttttcgactcctgtatgcttgacatgtgtgggtttcagggtcttcagcatctgctgtgcacgcatatgtcaactatgacaactacatgccaggacgccgggcacgctgtgaagccatggcgtgaaccgcacttctgccctatggcttgccctcctaatagtaagtatagtttatgtgccaagccgtgtcccgacacgtgccactccggcttttctggaatgttttgtagcgaccgctgtgtggaagcctgcgagtgtaacccagggttcgtattgtccgggctggaatgcatccctcggagtcagtgtgggtgcttacatcccgccggttcgtatttcaaggtcggcgagaggtggtacaagccggggtgtaaggaactctgcgtatgcgaaagcaataacaggattaggtgtcagccctggcggtgcagggctcaggagttctgcggccagcaggatggtatatatggatgccacgcacagggggccgccacatgcacagcatccggcgatcctcactatttgaccttcgatggtgctttgcaccacttcatgggcacctgcacctatgtgctcactcggccttgctggagccgctcccaggacagctactttgtggtttctgcgacaaacgaaaaccggggaggcatcctggaggtttcctatatcaaagccgttcacgtgaccgtgtttgacctctccatctccctcttaaggggatgtaaggttatgctgaacggccatcgcgttgctctcccggtgtggttagcccagggccgcgtaacaatccgcctttccagcaacttagtgctgctgtatacaaacttcggattacaggtccggtacgatggctcacacctggtcgaagtgaccgttccttcttcctacggtggccagctttgtggactgtgtggcaattataataataatagcctcgacgataatctgaggcccgataggaagcttgcaggggattctatgcagctaggagctgcctggaagcttccagagagcagcgaacctggttgctttctggtcgggggtaagcctagtagttgccaggagaactccatggcagacgcttggaacaaaaactgcgcgatcctcattaatccgcaagggccattttcacagtgtcaccaggtcgtgcctcctcagtcctcattcgcgtcatgtgtccacggccagtgtggtactaaaggagacactactgccttatgccgcagcttgcaggcctacgcctctttatgcgcccaggccggccaagcccccgcttggcgaaatagaacattttgccctatgcgctgtccccccgggtcttcttacagcccctgtagctccccatgccccgacacctgcagctctattaataatccccgagactgtccaaaagctctcccctgcgcagagtcttgtgagtgtcagaagggacacattctctctggcacatcgtgcgttcctctagggcaatgcggatgcacagaccccgcagggtcctatcacccagtcggggagaggtggtacaccgagaatacttgcaccaggctgtgcacctgtagtgttcacaacaatatcacctgcttccagtctacatgtaaacccaaccagatttgttgggcactggacggcctcctgcgccgggcctcaggtgtgggcgtttgtcaattgcctggtgaatcccactacgtttcttttgatggctccaaccactccatccctgacgcctgcactctggtcctagttaaggtgtgccatcccgccatggccctcccattttttaagatatccgcgaagcacgaaaaggaggaggggggaacagaggcgtttcgacttcatgaggtatacatcgatatttacgacgcccaggtgacattgcagaaaggccacagggttctgataaacagtaagcaggtgacccttcctgcaatcagtcaaattccgggggtgagtgtgaagagctcctctatttacagcatcgtgaacattaagatcggcgttcaggtcaaattcgatgggaaccacctgcttgaaattgagatcccaactacttattatggaaaagtgtgcggtatgtgtggaaactttaatgatgaagaagaagatgaacttatgatgccgtccgacgaagtggctaattcagactcagagtttgtcaatagctggaaggacaaagacatcgaccctagttgtcagtctttattagtggacgagcagcagattcccgcagaacagcaggaaaacccatctggtaactgccgtgcagcagaccttcgccgcgcccgcgagaaatgtgaggccgcactcagagctcctgtgtgggctcaatgcgccagccgaattgacctgacgccgtttctggtcgactgcgccaacactctctgcgagtttggaggactgtaccaggcactctgtcaggctcttcaggctttcggtgccacttgccagtctcaggggctgaaaccacctctctggcgcaactcgtccttctgtcccctcgaatgccccgcttacagcagctataccaattgtttgccttcgtgtagccccagctgttgggacctagacggaaggtgcgaaggcgcaaaagttccttctgcttgcgctgaaggctgtatttgtcaacctggctacgttttgagcgaggacaaatgtgtcccaaggtctcagtgtggttgcaaggacgctcatggtggaagcatccccctgggaaagtcctgggtgagtagcggatgcaccgagaaatgcgtctgcaccggtggggccattcaatgtggagacttccgttgtccatctgggagccactgccagctcacatccgacaatagcaattcgaattgtgtgtccgacaagtccgagcagtgtagcgtgtacggcgatccaaggtatctcactttcgacgggttctcctacaggctgcagggcaggatgacctacgttctcattaaaacagtcgatgtgctccctgaaggggtggaacccctgctggtggagggtcgcaataaaatggatcccccaagaagttcaatattcctccaggaggtgatcacaacggtctacggctataaggttcagctgcaagccggcctcgaactggtcgtgaataatcagaaaatggctgttccatatcggccgaatgaacacctgagggtaaccttatgggggcaacgactctacttggtgactgacttcgaactcgtggtgagtttcgggggcaggaaaaatgccgtaatcagcctcccctccatgtacgaaggcctcgtgagcgggttatgtgggaactacgacaagaatcgcaaaaatgatatgatgctgcccagcggggcccttacccagaatcttaatacctttgggaactcctgggaagtcaagactgaggatgcccttctgagatttccacgcgcaatccccgcagaggaggaaggccagggtgctgaactgggcctccggactgggttgcaggtcagcgaatgctcccctgaacaattggcctccaactccactcaggcttgcagagtgttggccgatccccaggggccattcgccgcttgtcatcagaccgtggccccagaaccgttccaggagcactgtgtgctcgatctgtgttctgctcaagatccaagggagcaagaggagcttaggtgccaagtgctgagcggttacgcgattctgtgtcaggaggccggagctgcactggccggatggcgggatcgcacgctttgtgcaatggaatgtcccgcaggaacaatttatcagtcttgcatgacgccatgccccgccagttgcgccaacctcgctgatcctggcgattgcgaaggtccctgcgtagaagggtgcgcctctatccccggctacgcctatagcggaacgcaatctctcccctggcttacagtggctgcacccgccatggcttcgactaccagctgggcagcagccttctag

SEQ ID NO: 35210 - DNA, 3555 bp, Artificial Sequence
  Description of Artificial Sequence: Synthetic coding sequence
atggcatgccccccaaattccaagtactctttatgcgctaaaccttgcccggacacttgccatagcggattctccggcatgttttgcagcgacaggtgtgtggaggcctgcgagtgtaacccaggctttgtgctgagtgggctggaatgtatcccgcgtagtcaatgtggatgtctgcaccccgccgggagctattttaaggtgggagagaggtggtataaaccaggctgcaaagaattgtgtgtttgcgagtccaataatcgaatccgatgccagccttggcggtgccgcgcccaggaattctgcggccagcaggacggcatttacgggtgtcatgcccagggggctgccacttgtaccgcctccggagatccccactatcttacattcgatggggcactgcaccactttatggggacatgtacctacgttctcactcgtccctgctggtccaggtcgcaggacagctattttgttgtaagcgcgacaaatgaaaacagggggggcatcctggaagtgtcatacattaaggccgtccacgttactgtgttcgacctctcaatctcgctgctgcgggggtgtaaggtgatgctaaacggtcatagagtcgcactgccagtgtggctggcgcaaggcagagttacaatcaggctctcctcgaacctcgttctgctctatacaaatttcggcctccaggttagatacgacggatctcacttagtggaagtgacggttccgagtagctatgggggtcagctctgcgggctttgtgggaactataataacaattccttggacgacaacctccgcccggataggaaattggccggtgattccatgcagctgggggccgcctggaaactccccgagtcatccgaaccagggtgtttcctggtgggtgggaagccttcgtcatgccaagaaaactcaatggcagatgcctggaataaaaattgcgccatcctgatcaatccacaaggcccattctcacagtgtcatcaagtcgtccccccacagtcctcatttgcctcctgtgtacatgggcagtgcgggaccaagggagacacgaccgctctgtgtagatctttgcaagcatacgcatcactgtgtgcccaagctggacaagctccagcctggaggaacagaacattttgtccaatgcggtgtcctcctgggtcttcctacagtccatgctctagcccttgtccagacacgtgttcaagcataaataacatcacctgttttcagtccacctgcaaacccaaccagatatgttgggctctggatgggctcctgcgcagggcatccggggtgggcgtgtgtcagcttcccggggagagtcattacgtgagttttgacggcagcaatcatagcatccctgatgcttgcacactggtgcttgtgaaagtgtgtcaccccgctatggccctccctttttttaaaatttctgcaaagcacgaaaaggaagaaggggggacggaagcctttagacttcatgaggtgtacattgacatttatgacgcccaggtcaccctccagaagggccaccgagtgctaattaacagtaagcaagtaacattgccggccatctctcaaataccaggtgtgtccgtgaaaagctccagtatttattccatcgtgaacatcaaaatcggcgtccaggtcaaatttgacggcaaccacctcctcgaaatcgaaatccctacaacttactatgggaaggtatgtggcatgtgtggtaactttaatgatgaagaagaggatgaactgatgatgccctcagatgaggtggccaattctgattctgaatttgttaatagttggaaagacaaggacatcgaccctagctgtcagtctctactggtggacgagcagcaaattcccgctgagcaacaagaaaatcctagcggcaactgtcgcgccgccgacctgcgccgcgctcgagagaagtgcgaggccgccctacgcgcaccagtatgggcccagtgcgcctccagaatcgacctgacaccctttctcgtggactgtgcaaataccctgtcgctggaatgccccgcctacagttcctataccaactgtttaccttcctgcagtccttcctgttgggacctcgacggtagatgcgagggagctaaggtgccttctgcttgtgctgaggggtgcatttgtcagcccgggtatgtgcttagcgaggacaagtgcgtgccccggagtcaatgtggctgcaaagatgcccacggtggctccatcccactggggaaaagttgggtgtcatctggctgtacagaaaaatgcgtgtgcacgggaggagccatccagtgtggagactttcgctgcccatccgggtcccactgccagttgactagcgataactctaactcgaattgcgtttctgataagtctgagcagtgttccgtgtacggggacccgaggtatctcacatttgacgggttttcctaccgcctgcaggggagaatgacctacgtcctgatcaagactgtcgatgtactgccggaaggcgttgagccactgcttgttgagggcagaaacaaaatggatcccccccggtcgagtatcttcctccaggaggttatcaccaccgtatacggatataaagtgcagctccaggccggtctggagctggtggttaacaatcagaagatggctgtaccatacaggcccaacgagcatctgcgagtgactttgtgggggcagcgcctgtacctggtgactgactttgagcttgtcgtgtccttcgggggtaggaaaaatgccggactgtaccaaagaaggcgcagggataagggcaggtcgtgggcctcagcgcgtgccagcaagtgtcctaatgtcgctaggagtagttggagggcaacggcaccacgacctgtggggtgctggcagaccccccgcgcacccctgctgccagttacgaggcgatggccccagtccccaagtaagtctaccgcttgctggatttgtgccctcctgaggacacaagagtcaaaaagaagctgtgtcgctaggtctagtgtgggtactcccagtagcgcgcgtagacgcgcactgccatggctggccggtggtacagctccatccgccttagggtctagcttccttaccgaggactgctcacagagatgtacctgcgcttcctccaggattctcctctgcgagcctttcagttgcagagcaggcgaggtctgtactctgggaaatcatacccaaggctgctttcctgagtcaccctgtttgcagaatccctgtcaaaacgacggacaatgcagggaacaaggcgccacctttacttgtgaatgcgaggtgggctacgggggcggcctgtgcatggaacctcgtgacgcccctccacccagaaaacctgaggcctccaatctcgtcggggtgctgctgggccttctggttccagtggtggtggtgctgcttgcagtgaccagagagtgcatttaccgcacacgaagaaagcgagagaaaacgcaggagggggatagattagcaaggctcgtagacactgatactgtgctagactgtgcttgctag

SEQ ID NO: 35211 - DNA, 8163 bp, Artificial Sequence
  Description of Artificial Sequence: Synthetic coding sequence
atggtaccaccggtctggactctgctcttactggtgggagcagcactcttccgaaaagagaagccccctgatcagaaattggtggtgcgaagctctcgcgacaattacgtcctgacacaatgcgacttcgaagatgacgccaagccgctgtgtgactggagccaggtctctgccgacgatgaggactgggtgcgggcaagtggtccttctccaaccggttcgacaggagctccaggcggctatcccaacggtgaaggaagttaccttcatatggagtctaacagcttccaccgcgggggagttgcacgcctgttatctccggatttatgggaacagggaccgctctgcgtccactttgcccaccacatgttcggtctaagttggggagctcagctgagactgctgctcctgtcaggtgaagagggcagacggcctgacgtgctgtggaagcactggaatacacaacggccaagttggatgctgaccaccgtcactgtgccagcaggatttacactgcccactaggcttatgtttgaggggaccagaggctcaacagcttatctagacatcgccctcgacgctctgtctatccgccgggggagttgtaacagggtctgtatgatgcaaacttgtagtttcgacatcccaaatgacctttgcgactggacctggatccccacagcttccggtgctaagtggactcagaagaaaggcagtagcggaaagcctggagtcggtcctgatggcgatttttcaagtcccggatccggatgttatatgctcctcgaccccaaaaacgcaagaccaggccagaaagctgtgcttttgtcccccgtaagccttagttctggctgcctgagcttcagctttcactatatcctaaggggacaaagcccaggggctgctcttcatatttacgcttcagtgttggggtccattaggaagcatacactgtttagcggccaacctgggccaaactggcaggctgtgagtgtgaactataccgccgtaggaaggattcagtttgccgtggtcggagtctttggcaaaacacctgagcccgccgtcgctgtcgacgcaactagtatcgctccctgtggcgagggatttccacagtgcgatttcgaggacaacgcccacccattctgcgactgggtccagacaagcggcgatggcggccactgggcacttggacataagaacggccccgtccatggcatgggccccgctggtggctttccgaatgcgggaggccattacatttatttagaagctgacgaatttagtcaggccggacagagcgtccggcttgtcagcagacctttctgcgctcctggggacatctgtgtagaattcgcctatcacatgtacggcttgggcgagggcacaatgctggaacttctgctgggcagcccagctgggtcacctccgattccactctggaaaagggtgggctcacagcggccttactggcagaatacatccgtgactgttccctcgggacaccaacaacctatgcagctcatcttcaagggtattcagggcagcaataccgcctctgtcgtcgccatgggtttcattctaattaatcccgggacgtgtcccgtgaaggtactgccggaattgccgcctgtgtccccagtctccagtaccggccctagtgagacgaccggattgacggagaatcctacaatctctacaaaaaaacccacagtttccattgaaaagccaagcgtgacaacggagaagcctactgtgcccaaggaaaagccaacaattcctaccgaaaagcccaccatttctacggagaaacccactattccgtccgaaaagcctaacatgccgagtgagaagcctaccattccctcagagaaaccgactatcttaaccgagaaaccgacaataccgagcgaaaaaccaactatcccatccgagaaaccaactatctcgactgaaaagcccactgtgcccactgaggagcccactacaccaacagaagaaactaccactagcatggaggagcccgttatacctaccgagaaaccgagcattcccaccgaaaaaccctcaatacccacggagaaaccgacaattagcatggaggagaccattatatccaccgaaaagccgaccattagtcctgaaaagcctaccatccccactgagaaaccgaccattccaacagagaaatcaactatctcccccgagaagcccaccacccccaccgaaaagcctactattccaactgaaaagcccaccatcagtccggaaaagccaacaacgcctactgagaagccaactatatctccagaaaagctgactattcccactgagaaaccaaccatacccaccgagaagccaacgatccctactgaaaaaccaaccatctctactgaggagccaaccaccccaactgaggagaccaccataagcactgaaaagccatccatccctatggaaaaacctaccttgcctacggaagagaccacaaccagcgtggaagaaactacaatttcaacagagaaactcactattccaatggagaaacctaccatctcaacagaaaaaccaactatacctaccgagaagcctacgatctcgcccgagaaattgacgatccccactgaaaagctgaccataccaactgaaaaaccgacaattcccatcgaggagaccactatctctactgaaaaactgacaatcccaacggaaaagcctacaatcagccctgagaaacctaccatcagtacagaaaagccaactataccaacagaaaaaccaactattccaactgaggagactaccataagcacagagaagctgaccattccaacagagaaacccacaatttcgcctgagaagctcacaattccaaccgagaaacctactatcagtactgagaaaccgacaatcccaaccgagaagttaacaattcccacggaaaaaccaacaatcccaacagagaagccaaccatccctactgaaaagctgacagccctgaggccacctcacccgagtccaacggccaccgggctcgcagccttggtaatgtcaccacatgcgccaagcactccaatgacaagtgtgattctggggacaacaactacaagcagaagctcaactgagcggtgcccacctaatgctagatatgagtcctgcgcatgtcccgcctcttgcaaatcgcccagaccgagctgtggccccctgtgcagggagggatgtgtctgtaatcccggcttcttgttctccgacaatcattgcattcaggcctcatcttgtaattgcttttataacaatgactattacgagcctggggcggaatggttttcgccgaactgcacagagcactgtcggtgctggcccggcagtagggtcgagtgccaaataagccagtgcggaacccatactgtgtgtcagctgaagaatggacagtatggctgccacccctatgcgggcaccgcgacatgtttagtgtacggcgacccacactatgtcacttttgatggtaggcattttggattcatgggaaaatgtacctatatcctcgcacagccctgtggtaattccactgacccttttttccgagtcactgctaaaaatgaagagcagggacaggagggcgtgtcatgcctgtccaaggtgtatgtgactctgcctgagtccaccgtcactcttttgaaaggaagacgaaccctcgtcggtggacagcaggttacattacccgccataccgtccaagggcgttttcctgggtgcctcgggccgatttgttgaacttcagaccgagtttggactccgggtgcggtgggacggggaccaacagctgtacgtcactgtgtcctcgacatactctggcaagctgtgcggactgtgcgggaactacgacggtaacagtgataatgaccacttaaaactcgatggcagtcctgccggcgacaaggaggaactcggcaatagctggcagacagaccaggacgaagaccaggaatgtcagaaataccaagtggtgaactcaccatcctgcgactcttctctccagtcgagcatgtcaggtcctggcttctgtggcaggctggtggacactcatggtccttttgaaacctgcctcctgcatgtgaaggcagcgagtttctttgatagttgcatgcttgacatgtgtgggtttcagggtttgcaacacttgctctgcacccatatgtcaacaatgacaaccacttgccaggacgctggccacgccgtcaagccatggcgagagccgcacttctgccctatggcgtgcccacctaactccaagtactccctttgtgctaagccctgtcccgacacctgccactccgggttctccgggatgttttgttcagaccgctgcgttgaagcctgcgagtgcaatccaggctttgtgttgtccggacttgagtgcattccccggtctcaatgtggatgccttcacccagctggaagctactttaaggtgggtgaaagatggtataagccgggctgtaaagagctctgtgtgtgtgaaagtaacaaccggattcgatgccagccatggaggtgtcgcgcccaggaattctgcggccaacaggatggaatttacggatgtcacgctcagggcgccgctacttgtaccgcttctggcgatccacactacttaactttcgacggtgccctccatcattttatgggcacatgcacctatgtgctgacacgaccatgctggtcacgctcccaagatagttacttcgttgtgtcagcgacaaacgaaaatagagggggtattctcgaggtcagctacatcaaggctgtccacgtgacagtttttgacctatccatttcactactcaggggctgtaaagtaatgcttaacgggcatagggttgcattgccggtgtggctggcgcaaggcagggttactatacggctatcctctaatcttgtcttactctacaccaactttggcctccaggttaggtacgatggctcccacctggtcgaggtgaccgtgccaagttcctatggcgggcagctctgtggcttatgcggaaattataacaataatagcttggacgataacctgaggccggataggaagttagccggtgatagcatgcaacttggggccgcatggaaactgccggaaagtagcgaaccaggttgcttcctggtaggcggcaagccttccagctgtcaggagaactccatggccgatgcctggaacaaaaactgtgctatcctgatcaacccacaggggcccttctcccagtgccaccaggttgtgcctcctcagagcagcttcgcttcgtgtgtgcatggtcagtgtggaactaaaggtgacacaaccgctctgtgtcgctcgctacaggcatatgcgtctttgtgtgctcaggccggtcaggctcctgcatggagaaataggaccttttgccccatgcgctgcccaccaggttcttcttattccccatgctcctcaccatgtccagacacttgctctagcattaacaatcctagggattgtccgaaagctctgccttgcgcagaaagctgcgaatgccagaaagggcatatcttatcagggacctcctgcgttcccctcggtcagtgcggttgtaccgacccagccggcagctatcaccccgtcggtgagagatggtatacagaaaacacctgcactcgcctgtgcacatgttccgttcacaacaacatcacatgctttcaatctacctgcaagcctaaccagatatgttgggccctcgatggcctgctgcgccgcgctagcggagtcggcgtttgtcagttgcctggcgagtctcattacgtcagctttgatggcagcaatcactctattcccgatgcctgcaccctcgtattggtgaaagtgtgtcaccctgctatggcgctgccttttttcaagataagcgcaaaacacgagaaagaggaaggcgggactgaagctttcaggctgcacgaggtttatattgacatctatgacgctcaggtgaccctgcaaaagggccaccgggtactgattaacagtaaacaggtcacactgccagcaattagccaaatccctggcgttagcgtgaagtcaagcagcatttattcaattgtgaacataaagattggagtacaggtcaaattcgacgggaaccacctcctggagattgaaatcccgaccacctattatgggaaagtgtgcggaatgtgcggcaattttaatgacgaagaggaagatgagctcatgatgccctctgacgaggtcgcgaatagcgactccgagtttgtgaactcttggaaagacaaagatattgacccgtcatgtcagtctctgcttgtagatgagcagcaaattccagccgagcagcaggagaatccatccggaaattgcagggctgccgatcttcggagggcaagagaaaagtgcgaggcggccctgagagctcccgtctgggctcagtgcgcatcccggatcgacctgaccccttttctagtggactgtgccaacacactttgcgagtttggcggcctgtaccaggcgctttgtcaggccttgcaggcatttggcgccacgtgtcagagtcagggactgaagccgcctctgtggcggaacagctcattttgccctctggagtgcccggcgtacagctcttatacaaactgtctcccgtcttgcagccccagttgctgggacctggacgggcggtgcgagggagctaaagtgccatcggcttgtgcggaaggatgcatttgccagccaggatacgttctttctgaagataaatgtgtccctcggtcccagtgcggctgtaaggatgctcacgggggcagcatcccactcgggaaaagttgggtgtcctccggctgcacagagaaatgcgtatgtaccggcggggcaattcagtgcggagacttcaggtgtccgagtggaagtcattgtcagctgaccagtgacaatagtaacagcaattgtgtgtctgataagtctgagcagtgctcagtctacggagaccctaggtacttgacctttgatggtttttcctaccgcctgcaggggcgcatgacatatgtcctcataaagacagtggacgtgctacctgagggcgtggagcccctgttagtggaaggccgtaataagatggaccctccccgatcttccatattcttgcaggaggttattacaacggtctatggctacaaggtccagttgcaggcaggcctcgaactagtcgttaacaaccagaaaatggccgtgccatacagaccgaatgaacatcttcgagtgacgctgtgggggcagcgcctgtatctagtgacagatttcgaacttgtggtttcgttcggcggcaggaaaaacgctgtcatcagtctgccatctatgtacgaaggacttgtcagcggtctgtgcggcaactatgataaaaaccgcaagaatgatatgatgctcccatctggggccctaactcagaacttgaatacgttcggcaattcgtgggaggtgaaaacagaagatgctctgttgcggtttccaagggccattccagccgaggaggagggccaaggcgcagagctgggcctacgaacagggctccaagtttcagaatgtagccccgagcagctggcaagcaacagcacacaggcttgccgcgtgctcgcagaccctcagggaccgttcgccgcatgccatcaaactgtcgcacctgagccgttccaagagcactgcgtgcttgacctgtgttccgcccaggatccccgggagcaggaggagctccgatgtcaagttttgtccgggtacgcgattttgtgtcaagaggccggcgccgcgctagctggctggcgagaccgtacactctgcgagtccccgtgcctgcagaacccctgccagaacgatggtcagtgccgagagcagggcgcaacctttacttgtgaatgtgaagttggctacggaggaggattatgcatggaaccgcgggacgcccctcccccacggaaacccgctagcaatttagtcggggtactgttgggactactcgtgcctgtggtcgtggttctccttgctgtgaccagggagtgtatttaccgtacccggaggaagagggagaaaacccaggaaggcgaccgactagctaggttagttgacactgacacagtcctggattgtgcatgctag

SEQ ID NO: 35212 - DNA, 2280 bp, Artificial Sequence
  Description of Artificial Sequence: Synthetic coding sequence
atggtccactttcttcatcctggacatacccccagaaatatagtgcccccggatgcccagaaggatgcactcggctgttgtgtggtgcaggaggaggcctcaccatacacactggtcaatatctgcctcaacgtcctgattgctaacctcgaaaagctgtgttctgagcgcccagacggcacactatgcttgcccgagcactggagctttccccaggaggtcgcagagaggttccttagagtgatgacctggcaagggaaactgaccgacagaactgccagcatttttcggggtaaccaaatgaagctaaaactggtcaacattcagaaagctaagattagcaccgcggcctttatcaaagctttttgtaggcataagctaatcgagttgaatgccaccgcggtccacgctgacctgcccgtacccgacattatctccggcctgtgtagcaatagatggatccaacagaacctccaatgtctgcttctggacagtacttctatcccccagaactcccgcctgctgtttttttctcaactgaccggtttgcggattctgagcgtgtttaatgtctgctttcatacagaagacctggccaacgtatcacagctcccccgtctggaaagcctggatatctccaacacactggttacagacatctccgccctgctgacctgtaaggacagattgaagagcctgactatgcactacctcaagtgcctggccatgaccaaatctcagatacttgctgtgatccgtgagctgaagtgtctgcttcacttggacattagcgatcacagacagttaaaatctgacctggcgttccaccttcttcagcagaaagatatacttcccaacgtggtttccctggatatcagcggcggtaattgtattactgacgaagccgtcgagctcttcatcagacttaggccggccatgcagtttgtgggtctgcttgccactgacgccgggagttcggacttctttactacaaaacagggcctgagagtagctggcggcgcctcaatgtctcaaataagcgaagcacttagtagatataggaacagatcatgcttcgtgaaagaggccctccaccggctgttcacagaaacgttcagtatggaagtgactatgccagcaatcttgaagctggtggccatcggtatgaggaaccatcctctcgacctccgggttcagttcaccgccagtgcctgcgctctgaatcttactcgccaaggcctagccaagggtatgcccgtccggctgctaagtgaagtcacttgcctcctgtttaaggctttgaagaactttccacattatcagcagctgcagaaaaattgtttattatccctcaccaactcaaggatcctggtggacgtaccattcgacaggttcgacgctgccaagttcgtgatgcgctggctctgcaagcatgagaaccctaagatgcaaactatggctgtatctgtcacaagtatcctagcattgcagctctcaccagagcagacggctcagctagaggagctgtttatggccgtgaaagagctattggccattgtcaaacagaaaactaccgagaacctggacgatgtcacgtttcttttcacactgaaggctctctggaacctcaccgacggatcccctgctgcgtgtaaacacttcatcgagaatcagggcctgcagattttcatccaagtgcttgaaaccttctccgagagtgctatccagtctaaagttctcggtctgttgaacaacatagcagaggtgcgagagctgagttcgaagttagtgacagaggatgtgctgaagcacataaactccttgctgtgctccagggagatggaggttagttatttcgccgctggcatcattgctcatttaacttccgacaggcagctgtggatttccagggacttccaaaggcggactctgctgcaagatctccacgccactatacaaaattggcccagtagcagttgtaaaatgacagcattagttacctatagaagtttcaagaccttttttccccttcttgggaatttctcccagccagaagtgcagctctgggccctgtgggcaatgtatcatgtgtgttccaagaacccatccaagtattgcaagatgctcgtggaggaagagggcttgcaacttctttgcgatatccaagaacattctgaggctactcctaaagcccagcagatcgccgcatccatcttagacgactttcgcatgcatttcatgaattatcagcgccccaccctttgtcagatgcctttctag

SEQ ID NO: 35213 - DNA, 1254 bp, Artificial Sequence
  Description of Artificial Sequence: Synthetic coding sequence
atgtcccagatttcggaggctctctcccgataccgcaaccgctcatgctttgttaaggaggctttgcacaggctattcaccgagactttctccatggaggtaacaatgcccgctattctaaaacttgtagcaatcggcatgcgcaatcaccctctcgatctgcgtgtgcagttcacagcatctgcttgcgcgctgaacttaaccaggcagggcctcgccaaagggatgcccgtgagactgctctctgaggtcacatgtctgttattcaaagctctgaagaacttcccccattatcagcagctgcaaaaaaattgtctgctttccctcacaaattcaagaattctcgtagacgttccctttgatcggtttgatgccgctaagttcgtgatgagatggctatgtaagcatgagaaccccaagatgcaaacaatggccgtctccgtgacctccatactggcattgcagctctcccctgaacaaaccgcccaactggaggagctattcatggcggttaaagagttgctggcaatagtcaagcaaaagactaccgaaaaccttgacgacgttacctttctgtttacactgaaggccttgtggaacctgacagacggctcccccgcagcatgcaagcactttatcgagaaccagggcctacaaatcttcatacaggtcctggaaactttttccgagagcgcgattcaatctaaggtgctgggcctgctgaataacatcgctgaagtcagagagttgtctagcaaactggttaccgaggacgttctgaaacacatcaactcactactgtgtagccgggagatggaagtttcttacttcgccgcaggaattatcgcccacctcacctcggatcgccagttatggatcagcagggactttcagaggaggacccttcttcaggatctacatgccacgatccaaaactggccgtcgagctcttgcaagatgactgcccttgttacctatcgatcttttaaaacgttttttccactgctgggcaacttctctcaacccgaggttcagctgtgggcactgtgggctatgtaccacgtgtgtagcaagaacccctccaaatattgcaagatgctggtggaagaagagggattgcagctcttgtgcgatatccaggagcactctgaggcgacgcccaaggcccaacagatcgccgcatccattctcgacgacttccgtatgcattttatgaattaccagagaccaacactttgccaaatgccattctag

SEQ ID NO: 35214 - DNA, 2235 bp, Artificial Sequence
  Description of Artificial Sequence: Synthetic coding sequence
atgcccgaggatcaggccggggcagccatggaagaagcatcaccctactccttgttggacatatgcttaaattttctgactacacatttggagaagttctgctctgcccgccaggacggcacattatgtctccaggaaccaggtgtgtttcctcaggaggtggcggatagactcctccgcacaatggctttccatggtttactcaatgatggaacggtcggcatcttccggggcaaccaaatgagactgaagcgcgcctgtattagaaaagccaaaatcagcgctgtcgcctttagaaaggctttctgtcaccataagctggttgaactggacgcaacaggggtcaatgcagacatcactattaccgacataattagcgggctcgggtcgaataaatggatacaacagaatctccagtgtctggtgctgaatagtctcacactcagtttggaagatccctacgagaggtgcttttctagactctctgggttacgcgctctctctataacgaatgtccttttttataacgaggacctcgccgaggtcgcttccctccctcggctggagtcgctggacatctccaacactagtatcaccgacattaccgccctcctggcttgtaaggataggctcaagtcgttgaccatgcatcaccttaagtgccttaaaatgacgaccacacagatactagacgtggtgcgggaattgaaacacctaaaccatttagacatctcggacgataagcagtttacaagcgacatcgctctgcggttgctggagcagaaagatatcttgccaaatctagtgagcctcgacgtctccggaaggaagcacgtgacagacaaagctgttgaagctttcatccagcagcggccttccatgcaatttgtcggcctcctcgctaccgacgcagggtactcagagtttctgacgggagaaggacacctgaaggtcagcggagaagctaatgaaacacaaatcgccgaggctctcaaaaggtactcagagcgagctttctttgtccgcgaggccctcttccatctgttctcactcacacatgttatggaaaaaaccaagccagaaattcttaaactcgttgtgactggcatgaggaatcatccaatgaacttaccggttcagctggccgcttcggcatgtgtgttcaacttaactaaacaggatcttgccgcggggatgcccgtgagactgttggccgatgtgacccatctcctactcaaagcaatggagcattttcccaaccatcagcaacttcagaagaactgcctcctttcactatgtagtgaccggatccttcaagacgtaccattcaacaggttcgaggctgccaaattggtcatgcagtggctgtgcaaccatgaggaccagaatatgcagcgcatggccgtagctattatttctatactggctgccaaactcagcactgaacagactgctcagctcggcaccgagcttttcatagtaagacagctcttgcagattgtgaaacaaaagaccaaccaaaacagcgtcgacactaccttaaagttcacactctccgctctgtggaacctcactgacgaatcacctacaacgtgccggcacttcatcgagaaccagggcttagagttatttatgagagtgctcgaatcattccccacagagtccagtatccaacagaaagtactgggacttctcaataacatcgcagaagttcaggaactccattccgagctcatgtggaaggatttcatcgaccacatttctagtctgctgcatagcgtggaggttgaggtcagttacttcgccgcaggcatcatcgcgcatctaatcagccgcggagaacaagcttggaccctcagtagatcgcagcgtaattcactcctggatgatctgcacagcgccattttgaagtggcctacgccagaatgtgagatggtcgcctataggtcctttaatccttttttcccactgctaggatgtttcacaacgccgggcgttcagctctgggcggtgtgggccatgcagcatgtttgctccaaaaatccgtctaggtactgttccatgttaatcgaagagggtgggctccagcatctttacaatatcaaggatcacgagcacactgatcctcacgtgcagcagattgcggtggcaatactcgattctctggagaaacacatcgtcaggcacggcagacctcctccttgcaaaaagcagccccaggccagactcaactag

SEQ ID NO: 35215 - DNA, 2025 bp, Artificial Sequence
  Description of Artificial Sequence: Synthetic coding sequence
atgccagaggaccaggcaggggcggcgatggaggaggcctcaccttacagtctcctcgatatctgcttgaactttctgacaacacatcttgagaaattttgtagcgcccgacaggatggcacgctctgtcttcaggaaccgggagtgtttccgcaagaggtggccgacaggttactgcggacgatggcatttcatggcctattaaacgacgggaccgtgggtattttcagaggcaaccagatgaggctcaagagagcatgcattagaaaggccaagattagcgccgtggcgttcaggaaggccttctgtcatcataaactggtggagcttgatgcaaccggagtgaatgcagatattaccatcaccgacatcatctctggactaggatctaacaagtggatccagcagaacctgcagtgcttagtgttaaactctctcactctgtccctcgaagatccatatgaacgctgcttttcacgactctcaggactaagagcgttaagcatcactaacgtattgttttacaatgaagacctggctgaagtggccagtctgccaagactagagtcgttggatatctctaatacaagtattaccgacattacagctttgctggcatgcaaagatcgcctcaaaagcttaacaatgcatcacctgaaatgcctgaagatgaccactacacaaattctggacgtggtgcgggaactcaagcatcttaaccatctcgatataagtgacgacaaacagttcaccagcgacatagctcttagacttctcgaacagaaggatatcctccccaacttggtgtctctcgacgtgtcagggcggaaacatgtgaccgacaaggcagttgaggccttcattcagcaacgtcctagtatgcaatttgtggggctcctggctacagatgctggctatagcgagttcctcaccggcgagggacatctgaaggtgtctggtgaagctaatgaaactcagatcgctgaggccctgaaacgctactctgaacgcgcattctttgtgcgggaagccctcttccatctcttctctctgacccacgtgatggagaagaccaagcccgagatattaaaactggtagtaacaggcatgagaaatcacccgatgaatttaccggtgcagctggccgcctcagcttgtgtgttcaatctgacaaaacaggacttagcagccggcatgcctgtccgactgctcgccgatgtcacccaccttctgttgaaggcgatggaacacttccctaatcatcagcagcttcagaaaaattgtctgctttcactgtgttccgatcgcatcctgcaggacgttccgtttaatcgtttcgaggctgccaagttggtcatgcagtggctgtgcaatcacgaggaccaaaacatgcagagaatggcagtggccatcatttctatcctcgccgcaaagctatccaccgaacagaccgctcagctcggcactgaattgtttatcgtgcggaacaacatagcagaggtgcaggaattgcatagtgagctgatgtggaaggactttatagatcacatatccagtctcctccactctgtcgaggtagaagttagctacttcgctgccgggataatagctcatctgatttcacgtggggagcaggcctggaccctttcgcgaagtcaaagaaattctctcctagacgatctccattccgccattctgaaatggccaacccctgaatgcgaaatggtcgcctatcgctcctttaatcctttctttccactcctggggtgtttcacaacacccggcgttcagctctgggctgtgtgggcaatgcaacacgtgtgttccaaaaacccgtctcggtattgttccatgctgatagaagaaggcgggcttcagcatttatacaatatcaaggatcacgaacacactgacccacatgtgcagcagattgccgtggccatcttggactcgctcgaaaagcacattgtgcgtcacggccgccccccaccttgcaagaaacagccgcaggccagattaaattag

SEQ ID NO: 35216 - DNA, 1701 bp, Artificial Sequence
  Description of Artificial Sequence: Synthetic coding sequence
atgcccgaagatcaggcaggtgcagccatggaggaagcaagcccttactcacttttggacatctgcctgaactttctcaccacacatctagagaaattttgctcggcccgccaagatggcactctgtgcctgcaggaacccggtgtcttcccacaagaagtggcagatcggctcctgagaactatggcgtttcatgggttgctgaacgacgggacggtggggatcttccggggaaatcagatgcggctgaaaagagcctgcatccgcaaggcgaagatctccgcagtggcattcaggaaagccttctgccatcataaacttgtcgaattagacgcgaccggcgtgaacgctgatattacaattaccgacattatttccggtctggggtccaataagtggatacaacagaaccttcagtgcctcgttctgaacagcctaaccctttctctcgaagacccgtatgagcgctgcttctctagactttccggtctgagggccttaagtatcacgaacgttctgttctataatgaggatcttgccgaggttgcctcacttcctcggcttgaaagcttggacatctctaatacaagtatcactgatatcactgcgctcctggcctgtaaagacagactaaagagcttaacaatgcaccacctgaagtgtttaaaaatgactaccacccagatcctggatgtggtacgtgagcttaaacatttgaatcacctggatatttctgacgacaaacagttcactagcgatatcgctctgcgcctgctggaacaaaaagatatcctgcctaatttggttagccttgatgtctcaggaaggaaacatgtgacagacaaggccgtggaggcgtttattcagcagaggcctagcatgcaatttgtcgggctcctggccacggacgctggttactcagagttcctgaccggagaaggacacctgaaggtcagtggcgaggcaaacgagacccagatcgctgaggcattgaagaggtatagtgagcgggccttctttgtgcgcgaagcgctgttccacctcttcagcctcacccatgtgatggagaaaacaaagcctgagattctgaaattggtggtgaccggaatgcgcaatcaccccatgaatctgcctgttcaactcgctgcctccgcatgcgtcttcaatctgaccaagcaggacctcgccgccggcatgcccgtgcgtctgcttgctgacgtaacccatttactgctgaaggcaatggaacactttcctaaccatcagcagctccaaaagaactgtcttctttccctgtgtagtgaccgaattctccaggacgttcccttcaataggtttgaggctgctaaactcgtaatgcagtggctctgtaatcatgaggatcagaatatgcagcgaatggccgtggcaataatatcaatattggccgcaaagcttagcaccgagcagacagctcaattgggaaccgagctcttcatcgtacgtcagctgttgcagatcgtcaaacagaagaccaaccagaactcagtagatactactcttaaatttacactctcagcactgtggaacttaactgacgaaagtcctacaacctgccggcattttattgagaatcagggcttggagctgtttatgagagttctggaatcattccccactgagagctccatccagcagaaggtgttggggctcttggggtag

SEQ ID NO: 35217 - DNA, 966 bp, Artificial Sequence
  Description of Artificial Sequence: Synthetic coding sequence
atggagagatttgtgcgggtgccttacgggctgtatcagggctatgggagcacagtccccttgggacagcccggcctttccggacacaaacagcctgattggcgccaaaatatgggacctccaacctttctggcgagacccggcctgctcgtgcccgctaacgcgcctgattactgcattgatccctataaacgcgcccagctcaaagctatcttgtcacagatgaatcccagcctgtccccacgcctgtgcaagccgaacaccaaggaggttggggtccaagtgtcaccacgagtggataaggccgtccagtgctccctcggaccacgaacgctgtctagttgctcaccttgggacggccgcgatcctcaagagccccttccggcgtgcggggtaacatctccggccactggccgacgcggactcattcgtctgaggagggacggcgacgaggcggaaagcaaggcactgcccggccccgcggaggcctctcagcctcagcccccttcacggcgctccggcgcagacagacaggaagagcctggtcagctcgaagagtcaggtgagaaagacgctccatgcccacaggagacaaagtccaagcaagtccccggagacgccgcctctgaaccactcaggcgccccaacttccaattcttagagccaaaatatggctacttccactgtaaggattgcaagacgcggtgggagtctgcttatgtctggtgtatttctgggactaacaaggtgtatttcaaacagctctgctgtaagtgtcaaaaatcttttaatccatatcgggttgaagccatccagtgtcagacttgctcaaaatcccactgtagctgcccccagaagaagagacacatcgatctgagaagaccacaccgacaggagctctgtgggcgctgtaaagacaagcgattcagttgtggaaacatctacagttttaaatatgtcatgtag

SEQ ID NO: 35218 - DNA, 78 bp, Artificial Sequence
  Description of Artificial Sequence: Synthetic coding sequence
atggagcggttcgtgagggtgccgtatggcttgtaccagggatatgggagcacggtgccgcttgggcagcccgggtag

SEQ ID NO: 35219 - DNA, 504 bp, Artificial Sequence
  Description of Artificial Sequence: Synthetic coding sequence
atgcttactgtcgcattgttggccctgctgtgtgcttctgcctccggcaacgctatacaagcaaggagttcttcttatagtggggaatacggcggtggcggaggtaaacggttcagccacagcggcaatcagcttgatgggcccatcacggccctcagggtgcgtgtcaatacctattatatcgttggcctgcaagttaggtacggaaaggtctggagtgattatgtgggcggcaggaatggggacctcgaggagatcttcctccacccaggagaatcggtgattcaggtgagcgggaaatataagtggtacttgaagaaactcctttttgtgacagacaaggggaggtacctgtccttcggcaaagatagcgggacatcattcaatgctgtccctcttcaccccaatactgtcctccggtttatttccggacggagtggctcacttatagacgccattggcctgcattgggatgtatacccctcctcttgctcacgatgttag

SEQ ID NO: 35220 - DNA, 483 bp, Artificial Sequence
  Description of Artificial Sequence: Synthetic coding sequence
atggctgctggccccagcggctgcctggtgcctgccttcggcctgcggctgctgctggccaccgtgctgcaggccgtgtctgcctttggagctgagttcagcagcgaggcctgccgggagctgggcttcagcagcaacctgctgtgcagcagctgtgacctgctgggccagttcaacctgctgcagctggaccctgactgccggggctgctgccaggaggaggcccagtttgagaccaagaagctgtatgctggggccatcctggaggtgtgtggcctgggccgcttcccccaggtgcaggcctttgtgcggagtgacaagcccaagctgttccggggcctgcagatcaagtatgtgcggggcagtgaccctgtgctgaagctgctggatgacaatggaaatattgctgaggagctgagcatcctgaagtggaacacagacagcgtggaggagttcctgtctgagaagctggagcgcatctag

SEQ ID NO: 35221 - DNA, 360 bp, Artificial Sequence
  Description of Artificial Sequence: Synthetic coding sequence
atggctgctggccccagcggctgcctggtgcctgccttcggcctgcggctgctgctggccaccgtgctgcaggccgtgtctgcctttggagctgagttcagcagcgaggcctgccgggagctgggcttcagcagcaacctgctgtgcagcagctgtgacctgctgggccagttcaacctgctgcagctggaccctgactgccggggctgctgccaggaggaggcccagtttgagaccaagaagctgtatgctggggccatcctggaggtgtgtggcctgggccgcttcccccaggtgcaggtgtgcccctggttccggccctgcatcaaggccttcggccggcagtgggagcactgctag

SEQ ID NO: 35222 - DNA, 426 bp, Artificial Sequence
  Description of Artificial Sequence: Synthetic coding sequence
atggctgctggccccagcggctgcctggtgcctgccttcggcctgcggctgctgctggccaccgtgctgcaggccgtgtctgcctttggagctgagttcagcagcgaggcctgccgggagctgggcttcagcagcaacctgctgtgcagcagctgtgacctgctgggccagttcaacctgctgcagctggaccctgactgccggggctgctgccaggaggaggcccagtttgagaccaagaagtacagcagcatcgtgtccaagcaggagtgccaccacagcaactgcatgcaggagctgttcctgaagtttgtggatgagaactgggagggcagcctgaagagcaagctgctgctgggcgtcatcaaccccaactgcagcgaggactgcaagagctccatgtctgtggtgcagaccctgtactag

SEQ ID NO: 35223 - DNA, 1707 bp, Artificial Sequence
  Description of Artificial Sequence: Synthetic coding sequence
atgagccacagaagtgacaccctgcctgtgcccagcggccagaggcggggccgggtgccccgggaccacagcatctacacccagctgctggagatcaccctgcacctgcagcaggccatgacagagcactttgtgcagctgaccagccggcagggcctgagcctggaggagcggcggcacacagaggccatctgtgaacatgaggccctgctgagccgcctcatctgcaggatgatcaacctgctgcagagcggggccgccagcggcctggagctgcaggtgcccctgcccagcgaggacagcagaggagatgtgcgctatggccagagggcccagctgagcggccagcctgaccctgtgccccagctgagtgactgtgaggccgcctttgtgaacagagacctgagcatccggggcatcgacatctctgtgttctaccagagcagcttccaggactacaatgcctaccagaaggacaagtaccacaaggacaagaacaccctgggcttcatcaacctgggcaccagcgagaacaagctgtgcatggacctgatgacagagcggctgcaggagagtgacatgaactgcatcgaggacaccctgctgcagtacccagactggaggggccagcccttcctgcgggaggaggtggcccgcttcctgacctactactgccgggcccccacccggctggaccctgaaaatgtggtggtgctgaatggctgctgcagcgtcttctgtgccctggccatggtgctgtgtgaccccggggaggccttcctggtgcctgcccccttctatggaggctttgccttcagcagccggctgtatgccaaggtggagctgatccctgtgcacctggagagcgaggtgacagtgaccaacacccaccccttccagctgactgtggacaagctggaggaggccctgctggaggcccggctggagggcaagaaggtgcggggcctggtgctgatcaacccccagaaccccctgggggacatctacagcccagacagcctgatgaagtacctggagtttgccaagcgctacaacctgcacgtgatcattgatgagatctacatgctgtctgtgtttgatgagagcatcaccttccacagcatcctgtccatgaagagcctgcctgacagcaacagaacccacgtgatctggggcaccagcaaggactttggcatcagcggcttccgctttggagccctgtacacccacaacaaggaggtggccagcgctgtgtctgccttcggctacctgcacagcatcagcggcatcacccagcacaagctgtgccagctgctgcagaacacagagtggattgacaaggtgtacctgcccaccaactgctaccgcctgcgggaggcccacaagtacatcacagctgagctgaaggccctggagatccccttccacaacagaagcagcggcctgtatgtgtggatcaacctgaagaagtacctggacccctgcacctttgaggaggagcggctgctgtactgccgcttcctggacaacaagctgctgctgagccggggcaagacctacatgtgcaaggagcccggctggttctgcctgatctttgctgatgagctgccccggctgaagctggccatgaggcgcttctgtgatgtgctgcaggagcagaaggaggccctgattgtgaagcagctggaggatgccatgagggagtag

SEQ ID NO: 35224 - DNA, 264 bp, Artificial Sequence
  Description of Artificial Sequence: Synthetic coding sequence
atggccaagcacctgaagttcatcgccaggacagtgatggtgcaggagggcaatgtggagagcgcctaccgcaccctgaaccgcatcctgaccatggatggcctgattgaggacatcaagcaccggcgctactatgagaagccctgctgccggcggcagcgggagagctatgagcgctgccgccgcatctacaacatggagatggccaggaagatcaacttcctgatgaggaagaacagagctgacccctggcagggctgctag

SEQ ID NO: 35225 - DNA, 1629 bp, Artificial Sequence
  Description of Artificial Sequence: Synthetic coding sequence
atgaatggcaagaggcctgctgagcccggccctgcccgggtgggcaagaagggcaagaaggaggtgatggccgagttcagtgatgctgtgacagaggagaccctgaagaagcaggtggccgaggcctggagcaggaggacccccttcagccatgaagtcatcgtgatggacatggaccccttcctgcactgcgtcatccccaacttcatccagagccaggacttcctggagggcctgcagaaggagctgatgaacctggacttccacgagaagtacaatgacctgtacaagttccagcagagtgatgacctgaagaagagaagagagccccacatcagcaccctgaggaagatcctgtttgaggacttccgctcctggctgagtgacatcagcaagattgacctggagagcaccatcgacatgagctgtgccaagtatgagttcacagatgccctgctgtgccatgatgatgagctggagggccgccgcatcgccttcatcctgtacctggtgcccccctgggaccgctccatgggcggcaccctggacctgtacagcattgatgagcacttccagcccaagcagatcgtgaagagcctcatccccagctggaacaagctggtgttctttgaggtgtcccctgtgtccttccaccaggtgtctgaggtgctgtctgaggagaagagccggctgagcatcagcggctggttccacggccccagcctgaccaggcctcccaactactttgagccccccatccccaggagcccccacatcccccaggaccacgagatcctgtatgactggatcaaccccacctacctggacatggactaccaggtgcagatccaggaggagtttgaggagagcagcgagatcctgctgaaggagttcctgaagccagagaagttcaccaaggtgtgtgaggccctggagcacggccacgtggagtggagcagccggggcccccccaacaagcgcttctatgagaaggccgaggagagcaagctgcctgagatcctgaaggagtgcatgaagctgttccgctctgaggccctcttcctgctgctgagcaacttcaccggcctgaagctgcacttcctggcccccagtgaagaagatgagatgaatgacaagaaggaggccgagaccacagacatcacagaggagggcaccagccacagccccccagagcctgagaacaaccagatggccatcagcaacaacagccagcagagcaatgagcagacagatcctgagccagaagaaaatgagaccaagaaggagagctctgtgcccatgtgccagggcgagctgcggcactggaagacaggccactacaccctcatccatgaccacagcaaggccgagtttgccctggacctgatcctgtactgcggctgtgagggctgggagccagaatatggaggcttcaccagctacatcgccaagggggaggatgaggagctgctgactgtgaaccctgagagcaacagcctggccctggtgtacagagaccgggagaccctgaagtttgtgaagcacatcaaccacaggagcctggagcagaagaagaccttccccaacagaacaggcttctgggacttctccttcatctactatgaatag

SEQ ID NO: 35226 - DNA, 1161 bp, Artificial Sequence
  Description of Artificial Sequence: Synthetic coding sequence
atgaacagcctgatgccctgctgtgccttcatcctgtacctggtgcccccctgggaccgctccatgggcggcaccctggacctgtacagcattgatgagcacttccagcccaagcagatcgtgaagagcctcatccccagctggaacaagctggtgttctttgaggtgtcccctgtgtccttccaccaggtgtctgaggtgctgtctgaggagaagagccggctgagcatcagcggctggttccacggccccagcctgaccaggcctcccaactactttgagccccccatccccaggagcccccacatcccccaggaccacgagatcctgtatgactggatcaaccccacctacctggacatggactaccaggtgcagatccaggaggagtttgaggagagcagcgagatcctgctgaaggagttcctgaagccagagaagttcaccaaggtgtgtgaggccctggagcacggccacgtggagtggagcagccggggcccccccaacaagcgcttctatgagaaggccgaggagagcaagctgcctgagatcctgaaggagtgcatgaagctgttccgctctgaggccctcttcctgctgctgagcaacttcaccggcctgaagctgcacttcctggcccccagtgaagaagatgagatgaatgacaagaaggaggccgagaccacagacatcacagaggagggcaccagccacagccccccagagcctgagaacaaccagatggccatcagcaacaacagccagcagagcaatgagcagacagatcctgagccagaagaaaatgagaccaagaaggagagctctgtgcccatgtgccagggcgagctgcggcactggaagacaggccactacaccctcatccatgaccacagcaaggccgagtttgccctggacctgatcctgtactgcggctgtgagggctgggagccagaatatggaggcttcaccagctacatcgccaagggggaggatgaggagctgctgactgtgaaccctgagagcaacagcctggccctggtgtacagagaccgggagaccctgaagtttgtgaagcacatcaaccacaggagcctggagcagaagaagaccttccccaacagaacaggcttctgggacttctccttcatctactatgaatag

SEQ ID NO: 35227 - DNA, 1629 bp, Artificial Sequence; identical to SEQ ID NO: 35225
  Description of Artificial Sequence: Synthetic coding sequence

SEQ ID NO: 35228 - DNA, 1308 bp, Artificial Sequence
  Description of Artificial Sequence: Synthetic coding sequence
atgctgctgccctgggccaccagcgcccctggcctggcctggggccccctggtgctgggcctgtttggcctgctggccgccagccagccccaggccgtgcccccctatgccagcgagaaccagacctgccgggaccaggagaaggagtactatgagccccagcaccgcatctgctgcagccgctgccccccaggcacctacgtgtctgccaagtgcagccgcatccgggacacagtgtgtgccacctgtgctgaaaattcctacaatgagcactggaactacctgaccatctgccagctgtgccggccctgtgaccctgtgatgggcctggaggagatcgccccctgcaccagcaagaggaagacccagtgccgctgccagcccggcatgttctgtgccgcctgggccctggagtgcacccactgtgagctgctgagtgactgccccccaggcacagaggccgagctgaaggatgaggtgggcaagggcaacaaccactgtgtgccctgcaaggccggccacttccagaacaccagcagccccagcgcccgctgccagccccacacccgctgtgagaaccagggcctggtggaggccgcccctggaacagcccagagcgacaccacctgcaagaaccccctggagcccctgcccccagagatgagcggcaccatgctgatgctggccgtgctgctgcccctggccttcttcctgctgctggccaccgtcttcagctgcatctggaagagccaccccagcctgtgcaggaagctgggcagcctgctgaagaggcggccccagggcgagggccccaaccctgtggccggctcctgggagccccccaaggcccacccctacttcccagacctggtgcagcccctgctgcccatctctggagatgtgtcccctgtgtccacaggcctgcctgctgcccctgtgctggaggccggcgtgccccagcagcagagccccctggacctgacccgggagccccagctggagcctggagagcagagccaggtggcccacggcaccaacggcatccacgtgactggaggctccatgaccatcaccggcaacatctacatctacaatggacctgtgctgggcggccccccaggccctggggacctgcctgccaccccagagcccccctaccccatccctgaggagggggaccccggccccccaggcctgagcaccccccaccaggaggatggcaaggcctggcacctggccgagacagagcactgtggggccacccccagcaacagaggccccaggaaccagttcatcacccatgactag

SEQ ID NO: 35229 - DNA, 873 bp, Artificial Sequence
  Description of Artificial Sequence: Synthetic coding sequence
atggtggagctggagcaggaggtggagcggcggcagaggctgggccaggagagcgctgccaggaaggccctgattgccagcagctaccacccagcccggcctgaggtgtatgacagcctgcaggatgctgccctggcccctgagttcctggccgtgacagagtacagcgtgtccccagatgctgacctgaagggcctgctgcagaggctggagaccgtgtctgaggagaagaggatctacagagtgcctgtgttcaccgcccccttctgccaggccctgctggaggagctggagcactttgagcagagcgacatgcccaagggccggcccaacaccatgaacaactacggcgtgctgctgcacgagctgggcctggatgagcccctgatgacccccctgcgggagcgcttcctgcagcccctgatggccctgctgtacccagactgtggcggcggccgcctggacagccaccgggcctttgtggtgaagtatgcccctggccaggacctggagctgggctgccactatgacaatgctgagctgaccctgaatgtggccctgggcaaggtgttcaccggcggggccctgtactttggaggcctcttccaggcccccacagccctgacagagcccctggaggtggagcacgtggtgggccagggcgtgctgcaccggggcggccagctgcacggggcccggcccctgggcactggagagcgctggaacctggtggtgtggctgcgggccagcgctgtgaggaacagcctgtgccccatgtgctgccgggagccagacctggtggatgatgagggctttggagatggcttcacccgggaggagcccgccaccgtggatgtgtgtgccctgacctag

SEQ ID NO: 35230 - DNA, 1023 bp, Artificial Sequence
  Description of Artificial Sequence: Synthetic coding sequence
atgggaaatgtgcccagcgctgtgaagcactgcctgagctaccagcagctgctgcgggagcacctgtggattggagacagcgtggccggggccctggaccctgcccaggagaccagccagctgagcggcctgcctgagtttgtgaagatcgtggaggtgggccccagagatggcctgcagaatgagaaggtgattgtgcccacagacatcaagattgagttcatcaaccggctgagccagacaggcctgagcgtcatcgaggtgaccagctttgtgagcagccgctgggtgccccagatggctgaccacacagaggtgatgaagggcatccaccagtacccaggagtgcgctaccctgtgctgacccccaacctgcagggcttccaccacgctgtggccgccggggccacagagatctctgtgtttggagctgccagcgagagcttcagcaagaagaacatcaactgcagcattgaggagagcatgggcaagtttgaggaggtggtgaagagcgcccggcacatgaacatcccagcccggggctacgtgtcctgtgccctgggctgcccctatgagggcagcatcaccccccagaaggtgacagaggtgtccaagaggctgtatggcatgggctgctatgagatcagcctgggggacaccatcggcgtgggcaccccaggctccatgaagaggatgctggagagcgtgatgaaggagatccccccaggggccctggccgtgcactgccacgacacctacggccaggccctggccaacatcctgacagccctgcagatgggcatcaacgtggtggacagcgctgtgtctggcctgggcggctgcccctatgccaagggggccagcggaaatgtggccacagaggacctgatctacatgctgaatggcctgggcctgaacacaggagtgaacctgtacaaggtgatggaggccggggacttcatctgcaaggctgtgaacaagaccaccaacagcaaggtggcccaggccagcttcaatgcctag

SEQ ID NO: 35231 - DNA, 162 bp, Artificial Sequence
  Description of Artificial Sequence: Synthetic coding sequence
atgggaaatgtgcccagcgctgtgaagcactgcctgagctaccagcagctgctgcgggagcacctgtggattggagacagcgtggccggggccctggaccctgcccaggagctgcagagcgtgatgctgatgctgcaccacggccccctgaggaagccctag

SEQ ID NO: 35232 - DNA, 1113 bp, Artificial Sequence
  Description of Artificial Sequence: Synthetic coding sequence
atgggaaatgtgcccagcgctgtgaagcactgcctgagctaccagcagctgctgcgggagcacctgtggattggagacagcgtggccggggccctggaccctgcccagaccagcctgctgaccaacctgcactgcttccagccagatgtgtctggcttctctgtgtccctggccggcaccgtggcctgcatccactgggagaccagccagctgagcggcctgcctgagtttgtgaagatcgtggaggtgggccccagagatggcctgcagaatgagaaggtgattgtgcccacagacatcaagattgagttcatcaaccggctgagccagacaggcctgagcgtcatcgaggtgaccagctttgtgagcagccgctgggtgccccagatggctgaccacacagaggtgatgaagggcatccaccagtacccaggagtgcgctaccctgtgctgacccccaacctgcagggcttccaccacgctgtggccgccggggccacagagatctctgtgtttggagctgccagcgagagcttcagcaagaagaacatcaactgcagcattgaggagagcatgggcaagtttgaggaggtggtgaagagcgcccggcacatgaacatcccagcccggggctacgtgtcctgtgccctgggctgcccctatgagggcagcatcaccccccagaaggtgacagaggtgtccaagaggctgtatggcatgggctgctatgagatcagcctgggggacaccatcggcgtgggcaccccaggctccatgaagaggatgctggagagcgtgatgaaggagatccccccaggggccctggccgtgcactgccacgacacctacggccaggccctggccaacatcctgacagccctgcagatgggcatcaacgtggtggacagcgctgtgtctggcctgggcggctgcccctatgccaagggggccagcggaaatgtggccacagaggacctgatctacatgctgaatggcctgggcctgaacacaggagtgaacctgtacaaggtgatggaggccggggacttcatctgcaaggctgtgaacaagaccaccaacagcaaggtggcccaggccagcttcaatgcctag

SEQ ID NO: 35233 - DNA, 1116 bp, Artificial Sequence
  Description of Artificial Sequence: Synthetic coding sequence
atggccgccccagccctgcggctgtgccacatcgccttccacgtgcctgctggccagcccctggccaggaacctgcagaggctgtttggcttccagcccctggccagccgggaggtggatggctggaggcagctggccctgcggtctggagatgctgtgttcctggtgaatgaaggagctggcagcggggagcccctgtatggcctggaccccaggcatgctgtgcccagcgccaccaacctgtgctttgatgtggctgatgctggggccgccacccgggagctggccgccctgggctgcagcgtgcctgtgccccctgtgcgggtgagagatgcccagggcgccgccacctatgctgtggtgagcagccctgctggcatcctgagcctgaccctgctggagcgggccggctaccggggccccttcctgcccggcttccggcctgtgtcctctgcccctggccctggctgggtgtcccgggtggaccacctgaccctggcctgcaccccaggcagcagccccaccctgctgcgctggttccatgactgcctgggcttctgccacctgcccctgagccctggagaagatcctgagctgggcctggagatgacagctggcttcggcctgggcggcctgcggctgacagccctgcaggcccagcccggcagcatcgtgcccaccctggtgctggccgagagcctgcccggggccaccacccggcaggaccaggtggagcagttcctggcccggcacaagggccctggcctgcagcacgtgggcctgtacacccccaacatcgtggaggccacagagggcgtggccacagctgggggccagttcctggcccctcctggggcctactaccagcagcccgggaaggagcggcagatccgggccgccggccacgagccccacctgctggcccggcagggcatcctgctggatggagacaagggcaagttcctgctgcaggtgttcaccaagagcctcttcacagaggacaccttcttcctggagctgatccagaggcagggcgccactggatttggccagggcaacatccgggccctgtggcagagcgtgcaggagcagagcgcccggagccaggaggcctag

SEQ ID NO: 35234 - DNA, 1368 bp, Artificial Sequence
  Description of Artificial Sequence: Synthetic coding sequence
atggcccagcacttcagcctggccgcctgtgatgtggtgggctttgacctggaccacaccctgtgccgctacaacctgcctgagagcgcccccctcatctacaacagctttgcccagttcctggtgaaggagaagggctatgacaaggagctgctgaatgtgaccccagaggactgggacttctgctgcaagggcctggccctggacctggaggatggcaacttcctgaagctggccaacaatggaacagtgctgcgggccagccacggcaccaagatgatgaccccagaggtgctggccgaggcctacggcaagaaggagtggaagcacttcctgagtgacaccggcatggcctgccgcagcggcaagtactacttctatgacaactactttgacctgcccggggccctgctgtgtgcccgggtggtggactacctgaccaagctgaacaacggccagaagacctttgacttctggaaggacatcgtggccgccatccagcacaactacaagatgtctgccttcaaggagaactgtggcatctacttccctgagatcaagagggaccccggccgctacctgcacagctgcccagagagcgtgaagaagtggctgcggcagctgaagaatgccggcaagatcctgctgctgatcaccagcagccacagcgactactgccgcctgctgtgtgagtacatcctgggcaatgacttcacagacctgtttgacatcgtcatcaccaatgccctgaagccaggcttcttcagccacctgcccagccagaggcccttccgcaccctggagaatgatgaggagcaggaggccctgcccagcctggacaagccaggctggtacagccagggcaatgctgtgcacctgtatgagctgctgaagaagatgaccgggaagccagagcccaaggtggtgtactttggagacagcatgcacagcgacatcttccctgcccggcactacagcaactgggagaccgtgctgatcctggaggagctgcggggagatgagggcaccaggagccagaggcctgaggagagcgagcccctggagaagaagggcaagtatgagggccccaaggccaagcccctgaacaccagcagcaagaagtggggcagcttcttcatcgacagcgtgctgggcctggagaacacagaggacagcctggtgtacacctggagctgcaagaggatcagcacctacagcaccatcgccatccccagcattgaggccatcgccgagctgcccctggactacaagttcacccgcttcagcagcagcaacagcaagacagctggctactaccccaacccccccctggtgctgagcagtgatgagaccctcatcagcaagtag

SEQ ID NO: 35235 - DNA, 588 bp, Artificial Sequence
  Description of Artificial Sequence: Synthetic coding sequence
atggcccagcacttcagcctggccgcctgtgatgtggtgggctttgacctggaccacaccctgtgccgctacaacctgcctgagagcgcccccctcatctacaacagctttgcccagttcctggtgaaggagaagggctatgacaaggagctgctgaatgtgaccccagaggactgggacttctgctgcaagggcctggccctggacctggaggatggcaacttcctgaagctggccaacaatggaacagtgctgcgggccagccacggcaccaagatgatgaccccagaggtgctggccgaggcctacggcaagaaggagtggaagcacttcctgagtgacaccggcatggcctgccgcagcggcaagtactacttctatgacaactactttgacctgcccggggccctgctgtgtgcccgggtggtggactacctgaccaagctgaacaacggccagaagacctttgacttctggaaggacatcgtggccgccatccagcacaactacaagatgtctgccttcaaggtgcggcggctggccaccagcctgctgcaggacatcagcaccagcttcatcctgatctag

SEQ ID NO: 35236 - DNA, 336 bp, Artificial Sequence
  Description of Artificial Sequence: Synthetic coding sequence
tgaagccacggcaccaagatgatgaccccagaggtgctggccgaggcctacggcaagaaggagtggaagcacttcctgagtgacaccggcatggcctgccgcagcggcaagtactacttctatgacaactactttgacctgcccggggccctgctgtgtgcccgggtggtggactacctgaccaagctgaacaacggccagaagacctttgacttctggaaggacatcgtggccgccatccagcacaactacaagatgtctgccttcaagggcaagtactgtgaggagggccccagcaacacctgcctgctgtcctatgtgtgcctggtgaactag

SEQ ID NO: 35237 - DNA, 588 bp, Artificial Sequence; identical to SEQ ID NO: 35235
  Description of Artificial Sequence: Synthetic coding sequence

SEQ ID NO: 35238 - DNA, 1563 bp, Artificial Sequence
  Description of Artificial Sequence: Synthetic coding sequence
atgagggtggagagcggcagcgcccaggagcggggcatcctgctggagagcctgagcaccctgctggagaagaccacagccagccatgagggccgggcccctggcaaccgggagctgacagacctgctgcccccagaggtgtgcagcctgctgaacccagctgccatctatgccaacaatgagatcagcctgagagatgtggaggtgtatggctttgattatgactacaccctggcccagtatgcagatgccctgcaccctgagatcttcagcacagcccgggacatcctgattgagcactacaagtacccagagggcatcagaaaatatgactacaaccccagctttgccatccggggcctgcactatgacatccagaagagcctgctgatgaagattgatgccttccactacgtgcagctgggcacagcctaccggggcctgcagcctgtgcctgatgaggaggtgattgagctgtatggaggcacccagcacatccccctgtaccagatgagcggcttctacggcaagggccccagcatcaagcagttcatggacatcttcagcctgcctgagatggccctgctgagctgtgtggtggactacttcctgggccacagcctggagtttgaccaggcccacctgtacaaggatgtgacagatgccatcagagatgtgcacgtgaagggcctgatgtaccagtggattgagcaggacatggagaagtacatcctgcggggagatgagacctttgctgtgctgagccggctggtggcccacggcaagcagctgttcctgatcaccaacagccccttctcctttgtggacaagggcatgaggcacatggtgggccctgactggaggcagctgtttgatgtggtgattgtgcaggccgacaagcccagcttcttcacagacaggaggaagcccttcaggaagctggatgagaagggcagcctgcagtgggaccgcatcacccggctggagaagggcaagatctaccggcagggcaacctgtttgacttcctgcggctgacagagtggaggggcccccgggtgctgtactttggagaccacctgtacagcgacctggccgacctgatgctgcggcacggctggaggactggagccatcatccctgagctggagcgggagatccgcatcatcaacacagagcagtacatgcacagcctgacctggcagcaggccctgaccggcctgctggagaggatgcagacctaccaggatgctgagagccggcaggtgctggccgcctggatgaaggagcggcaggagctgcgctgcatcaccaaggccctcttcaatgcccagtttggcagcatcttccgcaccttccacaaccccacctacttcagccggcggctggtgcgcttcagtgacctgtacatggccagcctgagctgcctgctgaactacagagtggacttcaccttctaccccaggaggacccccctgcagcacgaggcccccctgtggatggaccagctgtgcaccggctgcatgaagacccccttcctgggggacatggcccacatcagatag

SEQ ID NO: 35239 - DNA, 1386 bp, Artificial Sequence
  Description of Artificial Sequence: Synthetic coding sequence
atgaggcggctggtgcatgacctgctgcccccagaggtgtgcagcctgctgaacccagctgccatctatgccaacaatgagatcagcctgagagatgtggaggtgtatggctttgattatgactacaccctggcccagtatgcagatgccctgcaccctgagatcttcagcacagcccgggacatcctgattgagcactacaagagcctgctgatgaagattgatgccttccactacgtgcagctgggcacagcctaccggggcctgcagcctgtgcctgatgaggaggtgattgagctgtatggaggcacccagcacatccccctgtaccagatgagcggcttctacggcaagggccccagcatcaagcagttcatggacatcttcagcctgcctgagatggccctgctgagctgtgtggtggactacttcctgggccacagcctggagtttgaccaggcccacctgtacaaggatgtgacagatgccatcagagatgtgcacgtgaagggcctgatgtaccagtggattgagcaggacatggagaagtacatcctgcggggagatgagacctttgctgtgctgagccggctggtggcccacggcaagcagctgttcctgatcaccaacagccccttctcctttgtggacaagggcatgaggcacatggtgggccctgactggaggcagctgtttgatgtggtgattgtgcaggccgacaagcccagcttcttcacagacaggaggaagcccttcaggaagctggatgagaagggcagcctgcagtgggaccgcatcacccggctggagaagggcaagatctaccggcagggcaacctgtttgacttcctgcggctgacagagtggaggggcccccgggtgctgtactttggagaccacctgtacagcgacctggccgacctgatgctgcggcacggctggaggactggagccatcatccctgagctggagcgggagatccgcatcatcaacacagagcagtacatgcacagcctgacctggcagcaggccctgaccggcctgctggagaggatgcagacctaccaggatgctgagagccggcaggtgctggccgcctggatgaaggagcggcaggagctgcgctgcatcaccaaggccctcttcaatgcccagtttggcagcatcttccgcaccttccacaaccccacctacttcagccggcggctggtgcgcttcagtgacctgtacatggccagcctgagctgcctgctgaactacagagtggacttcaccttctaccccaggaggacccccctgcagcacgaggcccccctgtggatggaccagctgtgcaccggctgcatgaagacccccttcctgggggacatggcccacatcagatag

SEQ ID NO: 35240 - DNA, 1674 bp, Artificial Sequence
  Description of Artificial Sequence: Synthetic coding sequence
atggccggggccggcctgcgggctgctgcccggcgctggctgctgtgtggcggccatggaggcccccgggccgccagcagcagccccagctgccccggctgcggccccccaggccctggggcccactgccctggggtgcccaggtctgccccagcccaggcccccaccagcggggctgacctgagcgcccacctgtgggcccgctaccaggacatgaggcggctggtgcatgacctgctgcccccagaggtgtgcagcctgctgaacccagctgccatctatgccaacaatgagatcagcctgagagatgtggaggtgtatggctttgattatgactacaccctggcccagtatgcagatgccctgcaccctgagatcttcagcacagcccgggacatcctgattgagcactacaagtacccagagggcatcagaaaatatgactacaaccccagctttgccatccggggcctgcactatgacatccagaagagcctgctgatgaagattgatgccttccactacgtgcagctgggcacagcctaccggggcctgcagcctgtgcctgatgaggaggtgattgagctgtatggaggcacccagcacatccccctgtaccagatgagcggcttctacggcaagggccccagcatcaagcagttcatggacatcttcagcctgcctgagatggccctgctgagctgtgtggtggactacttcctgggccacagcctggagtttgaccaggcccacctgtacaaggatgtgacagatgccatcagagatgtgcacgtgaagggcctgatgtaccagtggattgagcaggacatggagaagtacatcctgcggggagatgagacctttgctgtgctgagccggctggtggcccacggcaagcagctgttcctgatcaccaacagccccttctcctttgtggacaagggcatgaggcacatggtgggccctgactggaggcagctgtttgatgtggtgattgtgcaggccgacaagcccagcttcttcacagacaggaggaagcccttcaggaagctggatgagaagggcagcctgcagtgggaccgcatcacccggctggagaagggcaagatctaccggcagggcaacctgtttgacttcctgcggctgacagagtggaggggcccccgggtgctgtactttggagaccacctgtacagcgacctggccgacctgatgctgcggcacggctggaggactggagccatcatccctgagctggagcgggagatccgcatcatcaacacagagcagtacatgcacagcctgacctggcagcaggccctgaccggcctgctggagaggatgcagacctaccaggatgctgagagccggcaggtgctggccgcctggatgaaggagcggcaggagctgcgctgcatcaccaaggccctcttcaatgcccagtttggcagcatcttccgcaccttccacaaccccacctacttcagccggcggctggtgcgcttcagtgacctgtacatggccagcctgagctgcctgctgaactacagagtggacttcaccttctaccccaggaggacccccctgcagcacgaggcccccctgtggatggaccagctgtgcaccggctgcatgaagacccccttcctgggggacatggcccacatcagatag

SEQ ID NO: 35241 - DNA, 2538 bp, Artificial Sequence
  Description of Artificial Sequence: Synthetic coding sequence
atgtctgatgacatcgactggctgcggagccacagaggagtgtgcaaggtggacctgtacaaccctgagggccagcaggaccaggacaggaaggtgatctgctttgtggatgtgtccaccctgaatgtggaggacaaggactacaaggatgctgccagcagcagcagcgagggcaacctgaacctgggcagcctggaggagaaggagatcatcgtcatcaaggacacagagaagaaggaccagagcaagacagagggctctgtgtgcctcttcaagcaggcccccagcgaccctgtgtctgtgctgaactggctgctgagtgacctgcagaagtatgccctgggcttccagcacgccctgagccccagcaccagcacctgcaagcacaaggtgggggacacagaaggagagtaccaccgggccagcagcgagaactgctacagcgtgtatgctgaccaggtgaacatcgactacctgatgaaccggccccagaacctgcggctggagatgacagctgccaagaacaccaacaacaaccagagccccagcgcccccccagccaagccacccagcacccagagagctgtgatcagcccagatggagagtgcagcattgatgacctgtccttctacgtgaaccggctgagcagcctggtgatccagatggcccacaaggagatcaaggagaagctggagggcaagagcaagtgcctgcaccacagcatctgccccagccctggcaacaaggagcgcatcagccccaggaccccagccagcaagatcgccagcgagatggcctatgaagctgtggagctgacagctgctgagatgaggggcaccggggaggagagccgggagggcggccagaagagcttcctgtacagcgagctgagcaacaagagcaagagcggggacaagcagatgagccagcgggagagcaaggagtttgctgacagcatcagcaagggcctgatggtgtatgccaaccaggtggccagtgacatgatggtgtccctgatgaagaccctgaaggtgcacagcagcggcaagcccatcccagcctctgtggtgctgaagagggtgctgctgcggcacaccaaggagatcgtgtctgacctgattgacagctgcatgaagaacctgcacaacatcactggagtgctgatgacagacagcgactttgtgtctgctgtgaagaggaacctcttcaaccagtggaagcagaatgccacagacatcatggaggccatgctgaagaggctggtgtctgccctgattggagaggagaaggagaccaagagccagagcctgtcctatgccagcctgaaggccggcagccatgaccccaagtgcaggaaccagagcctggagttcagcaccatgaaggccgagatgaaggagcgggacaagggcaagatgaagagtgacccctgcaagagcctgaccagcgctgagaaggtgggggagcacatcctgaaggagggcctgaccatctggaaccagaagcagggcaacagctgcaaggtggccaccaaggcctgcagcaacaaggatgagaagggggagaagatcaatgccagcacagacagcctggccaaggacctgattgtgtctgccctgaagctgatccagtaccacctgacccagcagaccaagggcaaggacacctgtgaggaggactgccccggcagcaccatgggctacatggcccagagcacccagtatgaaaaatgtggcggcggccagagcgccaaggccctgtctgtgaagcagctggagagccaccgggcccctggccccagcacctgccagaaggagaaccagcacctggacagccagaagatggacatgagcaacatcgtgctgatgctgatccagaagctgctgaatgaaaaccccttcaagtgtgaggacccctgtgaaggagaaaataaatgttctgagccccgggccagcaaggccgcctccatgagcaacagaagtgacaaggccgaggagcagtgccaggagcaccaggagctggactgcaccagcggcatgaagcaggccaacggccagttcatcgacaagctggtggagagcgtgatgaagctgtgcctgatcatggccaagtacagcaatgatggagctgccctggccgagctggaggagcaggccgccagcgccaacaagcccaacttccggggcacccgctgcatccacagcggggccatgccccagaactaccaggacagcctgggccacgaggtgattgtgaacaaccagtgcagcaccaacagcctgcagaagcagctgcaggccgtgctgcagtggattgctgccagccagttcaacgtgcccatgctgtacttcatgggagacaaggatggccagctggagaagctgccccaggtgtctgccaaggctgctgagaagggctacagcgtgggcggcctgctgcaggaggtgatgaagtttgccaaggagcggcagccagatgaggccgtgggcaaggtggccaggaagcagctgctggactggctgctggccaacctgtag

SEQ ID NO: 35242 - DNA, 1089 bp, Artificial Sequence
  Description of Artificial Sequence: Synthetic coding sequence
atggatgcccaggactgccaggccgccgccagccctgagcccccaggccccccagcccggagctgtgtggccgcctggtgggacatggtggacaggaacctgcgctacttcccccacagctgcagcatgctgggcaggaagattgctgccctgtatgacagcttcaccagcaagagcctgaaggagcacgtgttcctgcccctgattgacatgctgatctacttcaacttcttcaaggcccccttcctggtggacctgaagaagccagagctgaagatcccccacacagtgaacttctacctgcgggtggagcccggggtgatgctgggcatctggcacacagtgcccagctgcagaggagaagatgccaagggcaaggactgctgctggtatgaagctgccctgagagatggcaaccccatcatcgtgtacctgcacggcagcgctgagcacagagctgccagccaccggctgaagctggtgaaggtgctgagtgatggcggcttccacgtgctgtctgtggactaccggggctttggagacagcacaggcaagcccacagaggagggcctgaccacagatgccatctgtgtgtatgagtggaccaaggcccggagcggcatcacccctgtgtgcctgtggggccacagcctgggcaccggggtggccaccaatgctgccaaggtgctggaggagaagggctgccctgtggatgccatcgtgctggaggcccccttcaccaacatgtgggtggccagcatcaactaccccctgctgaagatctacagaaacatccctggcttcctgcggaccctgatggatgccctgaggaaggacaagatcatcttccccaatgatgaaaatgtgaagttcctgagcagccccctgctgatcctgcacggggaggatgacagaacagtgcccctggagtatggcaagaagctgtatgagatcgccagaaatgcctacagaaacaaggagcgggtgaagatggtgatcttccccccaggcttccagcacaacctgctgtgcaagagccccaccctgctgatcaccgtgcgggacttcctgagcaagcagtggagctag

SEQ ID NO: 35243 - DNA, 858 bp, Artificial Sequence
  Description of Artificial Sequence: Synthetic coding sequence
atggatgcccaggactgccaggccgccgccagccctgagcccccaggccccccagcccggagctgtgtggccgcctggtgggacatggtggacaggaacctgcggcacacagtgcccagctgccgcggggaggatgccaagggcaaggactgctgctggtatgaggccgccctgagagatggcaaccccatcatcgtgtacctgcacggcagcgctgagcaccgggccgccagccaccggctgaagctggtgaaggtgctgagtgatggcggcttccacgtgctgtctgtggactaccggggctttggagacagcacaggcaagcccacagaggagggcctgaccacagatgccatctgtgtgtatgagtggaccaaggcccggagcggcatcacccctgtgtgcctgtggggccacagcctgggcactggagtggccaccaatgctgccaaggtgctggaggagaagggctgccctgtggatgccatcgtgctggaggcccccttcaccaacatgtgggtggccagcatcaactaccccctgctgaagatctacagaaacatccctggcttcctgcggaccctgatggatgccctgaggaaggacaagatcatcttccccaatgatgaaaatgtgaagttcctgagcagccccctgctgatcctgcatggagaagatgacagaacagtgcccctggagtatggcaagaagctgtatgaaattgccagaaatgcctacagaaacaaggagcgggtgaagatggtgatcttccccccaggcttccagcacaacctgctgtgcaagagccccaccctgctgatcaccgtgcgggacttcctgagcaagcagtggagctag

SEQ ID NO: 35244 - DNA, 768 bp, Artificial Sequence
  Description of Artificial Sequence: Synthetic coding sequence
atgctgggcatctggcacacagtgcccagctgccgcggggaggatgccaagggcaaggactgctgctggtatgaggccgccctgagagatggcaaccccatcatcgtgtacctgcacggcagcgctgagcaccgggccgccagccaccggctgaagctggtgaaggtgctgagtgatggcggcttccacgtgctgtctgtggactaccggggctttggagacagcacaggcaagcccacagaggagggcctgaccacagatgccatctgtgtgtatgagtggaccaaggcccggagcggcatcacccctgtgtgcctgtggggccacagcctgggcactggagtggccaccaatgctgccaaggtgctggaggagaagggctgccctgtggatgccatcgtgctggaggcccccttcaccaacatgtgggtggccagcatcaactaccccctgctgaagatctacagaaacatccctggcttcctgcggaccctgatggatgccctgaggaaggacaagatcatcttccccaatgatgaaaatgtgaagttcctgagcagccccctgctgatcctgcatggagaagatgacagaacagtgcccctggagtatggcaagaagctgtatgaaattgccagaaatgcctacagaaacaaggagcgggtgaagatggtgatcttccccccaggcttccagcacaacctgctgtgcaagagccccaccctgctgatcaccgtgcgggacttcctgagcaagcagtggagctag

SEQ ID NO: 35245 - DNA, 1410 bp, Artificial Sequence
  Description of Artificial Sequence: Synthetic coding sequence
atgtgtgtgatctgctttgtgaaggccctggtgcgggtcttcaagatctacctgacagccagctacacctaccccttccggggctggcctgtggccttccgctgggatgatgtgcgggctgtgggccgcagcagcagccaccgggccctgacctgtgccgctgctgctgctggggtgtggctgctgagagatgagaccctgggcggagatgccctgggccggccccccaggggggcccggagccaggcccagtgcctgctgcagcagctgcgggagctgcccggccagctggccagctatgccctggcccacagcctgggccgctggctggtgtacccaggctctgtgtccctgatgacccgggccctgctgcccctgctgcagcagggccaggagcggctggtggagcgctaccatggaagaagagccaagctggtggcctgtgatggaaatgaaattgacaccatgttcatggaccggcggcagcaccctggcagccacgtgcacggcccccggctggtgatctgctgtgagggcaatgccggcttctatgagatgggctgcctgagcgcccccctggaggccggctacagcgtgctgggctggaaccaccctggcttcggcagcagcactggagtgcccttcccccagcatgatgccaatgccatggatgtggtggtggagtatgccctgcaccggctgcacttccccccagcccacctggtggtgtatggctggagcgtgggcggcttcaccgccacctgggccaccatgacctacccagagctgggcgccctggtgctggatgccacctttgatgacctggtgcccctggccctgaaggtgatgccccacagctggaagggcctggtggtgaggacagtgcgggagcacttcaacctgaatgtggccgagcagctgtgctgctacccaggccctgtgctgctgctgcggaggacccaggatgatgtggtgtccaccagcggccgcctgcggcccctgagccctggagatgtggagggcaacagaggaaatgagctgctgctgcggctgctggagcaccgctaccctgtggtgatggcccgggagggccgggctgtggtgacccgctggctgcgggccggcagcctggcccaggaggccgccttctacgcccgctacagagtggatgaggactggtgcctggccctgctgcggagctaccgggcccgctgtgaggaggagctggagggggaggaggccctgggcccccacggccctgccttcccctggctggtgggccagggcctgagcagcagaagaagaagaaggctggccctcttcctggccaggaagcacctgaagaatgtggaggccacccacttcagccccctggagcctgaggagttccagctgccctggaggctgtag

SEQ ID NO: 35246 - DNA, 1029 bp, Artificial Sequence
  Description of Artificial Sequence: Synthetic coding sequence
atggctgatgacctggagcagcagagccagggctggctgagctcctggctgcccacctggaggcccacctccatgagccagctgaagaatgtggaggcccgcatcctgcagtgcctgcagaacaagttcctggcccgctacgtgtccctgcccaaccagaacaagatctggacagtgacagtgtccccagagcagaatgacaggacccccctggtgatggtgcacggctttggaggcggcgtgggcctgtggatcctgaacatggacagcctgagcgcccggaggaccctgcacacctttgacctgctgggcttcggccgcagcagcaggcctgccttcccccgggaccctgagggcgcagaagatgaatttgtgaccagcattgagacctggagggagaccatgggcatccccagcatgatcctgctgggccacagcctgggcggcttcctggccaccagctacagcatcaagtacccagacagagtgaagcacctgatcctggtggacccctggggcttccccctgcggcccaccaaccccagcgagatccgggcccccccagcctgggtgaaggctgtggcctctgtgctgggccgcagcaaccccctggccgtgctgcgggtggccggcccctggggccctggcctggtgcagcgcttccggccagacttcaagaggaagtttgctgacttctttgaagatgacaccatcagcgagtacatctaccactgcaatgcccagaaccccagcggggagacagccttcaaggccatgatggagagctttggctgggcccggcggcccatgctggagcgcatccacctgatcaggaaggatgtgcccatcaccatgatctacggcagtgacacctggattgacaccagcacaggcaagaaggtgaagatgcagaggccagacagctatgtgcgggacatggagatcaagggggccagccaccacgtgtatgctgaccagccccacatcttcaatgctgtggtggaggagatctgtgacagcgtggactag

SEQ ID NO: 35247 - DNA, 1320 bp, Artificial Sequence
  Description of Artificial Sequence: Synthetic coding sequence
atgctgactggagtgacagatggcatcttctgctgcctgctgggcaccccaccaaatgctgtgggccccctggagagcgtggagagcagtgatggctacacctttgtggaggtgaagccaggccgggtgctgcgggtgaagcatgctggccctgccccagctgctgcccctcctccacccagcagcgccagcagtgatgctgcccagggcgacctgagcggcctggtgcgctgccagaggcgcatcaccgtgtacagaaatggccgcctgctggtggagaacctgggccgggcccccagggctgacctgctgcacggccagaatggcagcggggagcccccagctgccctggaggtggagctggccgaccctgctggcagtgatggccgcctggcccctggcagcgctggcagcggcagcggcagcggcagcggcggcagaagaagaagagcccggcggcccaagaggaccatccacatcgactgtgagaagaggatcaccagctgcaagggggcccaggctgatgtggtgctcttcttcatccacggcgtgggcggcagcctggccatctggaaggagcagctggacttctttgtgcggctgggctatgaggtggtggccccagacctggccggccatggagccagcagcgccccccaggtggccgccgcctacaccttctacgccctggccgaggacatgagggccatcttcaagagatatgccaagaagagaaatgtgctgattggccacagctatggagtgtccttctgcaccttcctggcccacgagtacccagacctggtgcacaaggtgatcatgatcaatggaggcggccccacagccctggagcccagcttctgcagcatcttcaacatgcccacctgtgtgctgcactgcctgagcccctgcctggcctggagcttcctgaaggccggctttgcccggcagggcgccaaggagaagcagctgctgaaggagggcaatgccttcaacgtgtcctcctttgtgctgcgggccatgatgagcggccagtactggccagaaggagatgaggtgtaccacgccgagctgactgtgcctgtgctgctggtgcacggcatgcatgacaagtttgtgcctgtggaggaggaccagaggatggccgagatcctgctgctggccttcctgaagctgattgatgagggcagccacatggtgatgctggagtgcccagagaccgtgaacaccctgctgcacgagttcctgctgtgggagcctgagcccagccccaaggccctgcctgagcccctgcctgcccctcctgaggacaagaagtag

SEQ ID NO: 35248 - DNA, 1158 bp, Artificial Sequence
  Description of Artificial Sequence: Synthetic coding sequence
atggccaccccaccacccagcagcgccagcagtgatgctgcccagggcgacctgagcggcctggtgcgctgccagaggcgcatcaccgtgtacagaaatggccgcctgctggtggagaacctgggccgggcccccagggctgacctgctgcacggccagaatggcagcggggagcccccagctgccctggaggtggagctggccgaccctgctggcagtgatggccgcctggcccctggcagcgctggcagcggcagcggcagcggcagcggcggcagaagaagaagagcccggcggcccaagaggaccatccacatcgactgtgagaagaggatcaccagctgcaagggggcccaggctgatgtggtgctcttcttcatccacggcgtgggcggcagcctggccatctggaaggagcagctggacttctttgtgcggctgggctatgaggtggtggccccagacctggccggccatggagccagcagcgccccccaggtggccgccgcctacaccttctacgccctggccgaggacatgagggccatcttcaagagatatgccaagaagagaaatgtgctgattggccacagctatggagtgtccttctgcaccttcctggcccacgagtacccagacctggtgcacaaggtgatcatgatcaatggaggcggccccacagccctggagcccagcttctgcagcatcttcaacatgcccacctgtgtgctgcactgcctgagcccctgcctggcctggagcttcctgaaggccggctttgcccggcagggcgccaaggagaagcagctgctgaaggagggcaatgccttcaacgtgtcctcctttgtgctgcgggccatgatgagcggccagtactggccagaaggagatgaggtgtaccacgccgagctgactgtgcctgtgctgctggtgcacggcatgcatgacaagtttgtgcctgtggaggaggaccagaggatggccgagatcctgctgctggccttcctgaagctgattgatgagggcagccacatggtgatgctggagtgcccagagaccgtgaacaccctgctgcacgagttcctgctgtgggagcctgagcccagccccaaggccctgcctgagcccctgcctgcccctcctgaggacaagaagtag

SEQ ID NO: 35249 - DNA, 1851 bp, Artificial Sequence
  Description of Artificial Sequence: Synthetic coding sequence
atggagctgcggaccccaggcaccaagtggagcccccagggcatcggcagcctgcggcgggtggtgtgggactacagcaccccagagatcagcctcttcagcgaggagggcctgaagggggagcaggtgaagctgacagaggccctgaagaacagccagggcctggagaagcccctgcaggtggccagcgccaccgtgtctgctggcctgtggctgctgtaccccaagcccctgtttgaggacaccccctacatcctggagcccggggagtaccccaccagcgaggcctggggcaccagtgaccccagcgtgggcagcctgaagcccatgaggctgggctgccccagcgtggagaagccaggagagcccagggctgtggtgtatgaggcccctggcttccagggccgctcctgggaggtgtcccgggacatctacaacctgcagcagcctgaggacagccagagcccccacctggcctctgtgggcagcctgcgggtgctgggcggctgctgggtgggctatgagaaggagggcttccggggccaccagtacctgctggaggagggggagtacccagactggagccactggggcggctatgatgagctgctgaccagcctgcgggtcatcagaacagactttggagaccctgctgtggtgctgtttgaggccatggactttgagggccacggcgtggaggtgtccaaggccctgcctgatgtggagctggtgcagcacggccccagcacccaggccatccacgtgctgtctggagtgtgggtggcctaccaggaggtgggcttctctggagagcagtatgtgctggagaagggcgtgtacagaaactgtgaggactggggcgccggcaacagcaccctggccagcctgcagcctgtgctgcaggtgggggagcatgacctgcactttgtgtccaagatccagctgttcagcaggccagacttcctgggggaccacttctcctttgaagatgaccaggccgccctgcctgccagcttccggccccagagctgccgggtgcatggaggctcctggatcctgtttgatgagaccaactttgaaggagaccagcacatcctgtctgagggggagttccccaccctgacagccatgggctgcctggccagcacagtgctgggcagcctgcagaaggtgtccctgcacttcagcgagcccagcatcttcctgtatggcctggagtgctttgagggcaaggagattgagctgagccgggaggtgcgcagcctgcaggccgagggcttcaacaaccacgtgctgtctgtgcgcatcaagggcggcatctgggtgctgtgtgagcacagcgacttccggggccggcagtggctggtgggcagctgtgagatcaccaactggctgacctacagcggcacccagagggtgggcagcctgtaccccatcaagcagaggagagtgtacttccggctgtggaatgctgccctgggcggcttcctggccgtgcctgaccacgtggaggacatgaaggccggccgggtggtggtggccgacccccaggccggcggcagctgcatctggtactatgaagatggcctgctgaagaaccagatggcccccaccatgagcctgcaggtgattggcccccccagccctggcagcaaggtggtgctgtgggccgagagccggctgccccggcagacctggagcatcagcgagagcggccacatctgcagccagatgtttgagggccagatcctggatgtgaagggcggccggggctatgaccgggaccacgtggtgctgtgggagccagatgaggaccgggccagccagatctggaccatccacgtgctgtag

SEQ ID NO: 35250 - DNA, 282 bp, Artificial Sequence
  Description of Artificial Sequence: Synthetic coding sequence
atggaggaggccggcggccccatggcccgggccaaggcccgggtggatggccctgtggaccccccagctgccaccgtgctgcccatggtgcgctctgagcacgtgacagtgcccggccagcccccagcccccagcaccaccaggaggaaggatgtgcccagccctggggtggacagagtgagccccagccctgggggcaccccagcccctgtgcccactggagctgaggccagcacagagagccagctggtgtctgaccccacagagggcaagacctgctag

SEQ ID NO: 35251 - DNA, 2364 bp, Artificial Sequence
  Description of Artificial Sequence: Synthetic coding sequence
atgatgaagaagcacgtggccggcaccaagggcccccacagcgagctgggcctggagctgcagggcggcagccggcccaccagccggctgggcggcagcctgctgtttggcagcctggtgcccacagccaaggaggccagcaccccagagcccctgggcaccaagctgagcgccctgctgccccacggggcccctggcctgaggaaggtgcccggccagctgcccctgctgtgcagcgagaggagcagccccacagagaagctggcctgcagcctgcccctggagggctggagccctgccctgaagacccagggcaagctgaacaccaggcctgggaaggtgatcttcttcagcgagagcggctgccagggcagcggccgggaggtgtggggagacatcgtggatgccagcggctgggcccctgtggccagcatccgggtggtgcggggctgctgggtgctgtatgaggagcctgagttccggggccagaagctggtgctgcctgagggggacatggagctgcggaccccaggcaccaagtggagcccccagggcatcggcagcctgcggcgggtggtgtgggactacagcaccccagagatcagcctcttcagcgaggagggcctgaagggggagcaggtgaagctgacagaggccctgaagaacagccagggcctggagaagcccctgcaggtggccagcgccaccgtgtctgctggcctgtggctgctgtaccccaagcccctgtttgaggacaccccctacatcctggagcctggagagtaccccaccagcgaggcctggggcaccagtgaccccagcgtgggcagcctgaagcccatgaggctgggctgccccagcgtggagaagccaggagagcccagggctgtggtgtatgaggcccctggcttccagggccgctcctgggaggtgtcccgggacatctacaacctgcagcagcctgaggacagccagagcccccacctggcctctgtgggcagcctgcgggtgctgggcggctgctgggtgggctatgagaaggagggcttccggggccaccagtacctgctggaggagggggagtacccagactggagccactggggcggctatgatgagctgctgaccagcctgcgggtcatcagaacagactttggagaccctgctgtggtgctgtttgaggccatggactttgagggccatggagtggaggtgtccaaggccctgcctgatgtggagctggtgcagcacggccccagcacccaggccatccacgtgctgagcggcgtgtgggtggcctaccaggaggtgggcttcagcggggagcagtatgtgctggagaagggcgtgtacagaaactgtgaggactggggcgccggcaacagcaccctggccagcctgcagcctgtgctgcaggtgggggagcatgacctgcactttgtgtccaagatccagctgttcagcaggccagacttcctgggggaccacttctcctttgaagatgaccaggccgccctgcctgccagcttccggccccagagctgccgggtgcacggcggctcctggatcctgtttgatgagaccaactttgaaggagaccagcacatcctgtctgagggggagttccccaccctgacagccatgggctgcctggccagcacagtgctgggcagcctgcagaaggtgtccctgcacttcagcgagcccagcatcttcctgtatggcctggagtgctttgagggcaaggagattgagctgagccgggaggtgcgcagcctgcaggccgagggcttcaacaaccacgtgctgtctgtgcgcatcaagggcggcatctgggtgctgtgtgagcacagcgacttccggggccggcagtggctggtgggcagctgtgagatcaccaactggctgacctacagcggcacccagagggtgggcagcctgtaccccatcaagcagaggagagtgtacttccggctgtggaatgctgccctgggcggcttcctggccgtgcctgaccacgtggaggacatgaaggccggccgggtggtggtggccgacccccaggccggcggcagctgcatctggtactatgaagatggcctgctgaagaaccagatggcccccaccatgagcctgcaggtgattggcccccccagccctggcagcaaggtggtgctgtgggccgagagccggctgccccggcagacctggagcatcagcgagagcggccacatctgcagccagatgtttgagggccagatcctggatgtgaagggcggccggggctatgaccgggaccacgtggtgctgtgggagccagatgaagatcgggccagccagatctggaccatccacgtgctgtag

SEQ ID NO: 35252 - DNA, 1224 bp, Artificial Sequence
  Description of Artificial Sequence: Synthetic coding sequence
atggaggaggccggcggccccatggcccgggccaaggcccgggtggtgtctgccaccctgacctggaggcagaggcctcccacccaggaggagatcaagcacggcttccacaaggtgtccctggtgtctggggcccagatggaggccccccagaaggagatgtttgagttcagcagaagagaggaggtggaggtgaatggatttgccacccaggaggaggagaccgtgaactgccagggcccccgggacacagctggcagcaagaacttccagagccacggccccatcttcagcaagaagtacatccccccacccaaggagaagaggcctgagggccgcctgaaggaggccgtggaccagagtgatggcagccggcaggcccccaggacagagcccccctgtgtgggcgccatggccaggacagagctgctggtgcccctgcccggcccccgggagcccagcccccaccctggggtgggcctgaccagcggcagcagccgcagcctggaggagtacagagtgaccaggacagtgaggaccaccaccgtggtgggcggccacgtggacaggaggatgagcagctctgtgacagtgcggcctgtgtcctctggagaggccctgccccggggccggcaggtgtccaggatggtgccccctgtggtggtgggcagccccccaggcagccccagccgcagccaggccgtgaaggtgctgagcaacctggtgcctgctggccacagccccccagccagccacctgccccggcccacagctgggggccccaggagcacaggcctgggcagcacagtgggcgccgccctgcggcagctgcctgagaccggcacagctgagctgaaggacagcagcgccctggccagcacaggcatcccagccagcgcccacctgcccaagaaccaggatgccccagctgcctgcccagaccgggaccagggccgggccccagatgcccgggcctgtgagctgtggcaggtgctgggcgcccccagcagcacagagctgcccctgcagaccagccagggccaggcctctgtgcccagcagcccccggctggagacccacgtgcccagccctggcctgacccacccagccaagcagcctgtggtgcccacccaccctggggcccggctgacccccctggtgctgccccccaagaagaggacaggcccctggacccccctgctgccccccagctgcccctggtag

SEQ ID NO: 35253 - DNA, 1128 bp, Artificial Sequence
  Description of Artificial Sequence: Synthetic coding sequence
atggaggaggagattgctgccctggtgattgacaatggcagcggcatgtgcaaggccggctttgctggagatgatgcccccagggctgtgttccccagcatcgtgggccggcccaggcaccagggcgtgatggtgggcatgggccagaaggacagctatgtgggagatgaggcccagagcaagaggggcatcctgaccctgaagtaccccattgaacatggaattgtgaccaactgggatgacatggagaagatctggcaccacaccttctacaatgagctgcgggtggcccctgaggagcaccctgtgctgctgacagaggcccccctgaaccccaaggccaaccgggagaagatgacccagatcatgtttgagaccttcaacaccccagccatgtatgtggccatccaggccgtgctgagcctgtatgccagcggccgcaccactggaattgtgatggattctggagatggagtgacccacacagtgcccatctatgagggctacgccctgccccacgccatcctgcggctggacctggccggccgggacctgacagactacctgatgaagatcctgacagagcggggctacagcttcaccaccacagctgagcgggagatcgtgcgggacatcaaggagaagctgtgctacgtggccctggactttgagcaggagatggccacagctgccagcagcagcagcctggagaagagctatgagctgcctgatggccaggtgatcaccatcggaaatgaacgcttccgctgcccagaggccctcttccagcccagcttcctgggcatggagagctgtggcatccacgagaccaccttcaacagcatcatgaagtgtgatgtggacatcaggaaggacctgtatgccaacacagtgctgagcggcggcaccaccatgtacccaggcattgctgacaggatgcagaaggagatcacagccctggcccccagcaccatgaagatcaagatcatcgcccctcctgagaggaagtacagcgtgtggattggaggcagcatcctggccagcctgagcaccttccagcagatgtggatcagcaagcaggagtatgatgaaagtggccccagcatcgtgcacaggaagtgcttctag

SEQ ID NO: 35254 - DNA, 1128 bp, Artificial Sequence; identical to SEQ ID NO: 35253
  Description of Artificial Sequence: Synthetic coding sequence

SEQ ID NO: 35255 - DNA, 1026 bp, Artificial Sequence
  Description of Artificial Sequence: Synthetic coding sequence
atgggcacagagaaggagagccctgagccagactgccagaagcagttccaggccgctgtgtctgtcatccagaacctgcccaagaatggcagctaccggcccagctatgaggagatgctgcgcttctacagctactacaagcaggccaccatgggcccctgcctggtgcccaggcctggcttctgggaccccatcggccgctacaagtgggatgcctggaacagcctgggcaagatgagccgggaggaggccatgtctgcctacatcacagagatgaagctggtggcccagaaggtgattgacacagtgcccctgggggaggtggccgaggacatgtttggctactttgagcccctgtaccaggtgatcccagacatgcccaggcctcctgagaccttcctgcggcgggtgacaggctggaaggagcaggtggtgaatggagatgtgggcgctgtgtctgagcccccctgcctgcccaaggagcccgccccacccagccctgccagcctgtgggccgtgaccctgcccaccccaccccagagccccatccaccctggcacctggaccccccgcttcagcgtcatcccctggagctcctggagcctgtcctggtttggccagagcagcggccagcacctggaggagagcgtcatccctggaacagccccctgccccccccagaggaagaggggctgtggggccgcccggcggggccccaggtcctggacctgtggctgctggggccagtttgagcactaccgccgggcctgccgccgctgcagaagaggctgccgggcctggagggcctgccccggccccctgagccggggccgcagccctggccctgtgctgggccacggccccctgggcagccggggcccccgctgcagcagcagcagctgtggccccagcagcagcagcggcagcagtgaatgttttggccccaagagaggagactgccagtggaggggcctgtgcagccagctgcggctgagctgctgtgccctgagcctgccccgggtgtag

SEQ ID NO: 35256 - DNA, 807 bp, Artificial Sequence
  Description of Artificial Sequence: Synthetic coding sequence
atgggcacagagaaggagagccctgagccagactgccagaagcagttccaggccgctgtgtctgtcatccagaacctgcccaagaatggcagctaccggcccagctatgaggagatgctgcgcttctacagctactacaagcaggccaccatgggcccctgcctggtgcccaggcctggcttctgggaccccatcggccgctacaagtgggatgcctggaacagcctgggcaagatgagccgggaggaggccatgtctgcctacatcacagagatgaagctggtggcccagaaggtgattgacacagtgcccctgggggaggtggccgaggacatgtttggctactttgagcccctgtaccaggtgatcccagacatgcccaggcctcctgagaccttcctgcggcgggtgacaggctggaaggagcaggtggtgaatggagatgtgggcgctgtgtctgagcccccctgcctgcccaaggagcccgccccacccagccctgagagccacagcccccgggacctggacagcgaggtgttctgtgacagcctggagcagctggagcctgagctgagcagcggccagcacctggaggagagcgtcatccctggaacagccccctgccccccccagaggaagaggggctgtggggccgcccggcggggccccaggtcctggacctgtggctgctggggccagtttgagcactaccgccgggcctgccgccgctgcagaagaggctgccgggcctggagggcctgccccggccccctgagcagcctgaccctgtctgtgcggctggagtag

SEQ ID NO: 35257 - DNA, 918 bp, Artificial Sequence
  Description of Artificial Sequence: Synthetic coding sequence
atgggcacagagaaggagagccctgagccagactgccagaagcagttccaggccgctgtgtctgtcatccagaacctgcccaagaatggcagctaccggcccagctatgaggagatgctgcgcttctacagctactacaagcaggccaccatgggcccctgcctggtgcccaggcctggcttctgggaccccatcggccgctacaagtgggatgcctggaacagcctgggcaagatgagccgggaggaggccatgtctgcctacatcacagagatgaagctggtggcccagaaggtgattgacacagtgcccctgggggaggtggccgaggacatgtttggctactttgagcccctgtaccaggtgatcccagacatgcccaggcctcctgagaccttcctgcggcgggtgacaggctggaaggagcaggtggtgaatggagatgtgggcgctgtgtctgagcccccctgcctgcccaaggagcccgccccacccagccctgagagccacagcccccgggacctggacagcgaggtgttctgtgacagcctggagcagctggagcctgagctggtgtggacagagcagagagctgccagcggcggcaagagggaccccaggaacagccctgtgccccccaccaagaaggagggcctgcggggcagccccccaggcccccaggagctggatgtgtggctgctgggcaccgtgcgggccctgcaggagagcatgcaggaggtgcaggcccgggtgcagagcctggagagcatgccccggcccccagagcagaggccccagccccggcccagcgcccggccctggcccctgggcctgcccggccctgccctgctcttcttcctgctgtggccctttgtggtgcagtggctgttcaggatgttccgcacccagaagaggtag

SEQ ID NO: 35258 - DNA, 1026 bp, Artificial Sequence; identical to SEQ ID NO: 35255
  Description of Artificial Sequence: Synthetic coding sequence

SEQ ID NO: 35259 - DNA, 267 bp, Artificial Sequence
  Description of Artificial Sequence: Synthetic coding sequence
atggccctgcaggccgactttgacagagctgctgaagatgtgaggaagctgaaggcccggccagatgatggagagctgaaggagctgtatggcctgtacaagcaggccatcgtgggggacatcaacatcgcctgccccggcatgctggacctgaagggcaaggccaagtgggaggcctggaacctgaagaagggcctgagcacagaagatgccaccagcgcctacatcagcaaggccaaggagctgattgagaagtatggcatctag

SEQ ID NO: 35260 - DNA, 3180 bp, Artificial Sequence
  Description of Artificial Sequence: Synthetic coding sequence
atgtgtgtgcgcagctgcttccagagcccccggctgcagtgggtgtggaggacagccttcctgaagcacacccagaggaggcaccagggcagccaccgctggacccacctgggcggcagcacctaccgggccgtcatctttgacatgggcggcgtgctgatccccagccctggccgggtggccgctgagtgggaggtgcagaaccgcatccccagcggcaccatcctgaaggccctgatggagggcggggagaatggcccctggatgaggttcatgagagctgagatcacagctgagggcttcctgcgggagtttggccgcctgtgcagcgagatgctgaagacctctgtgcctgtggacagcttcttcagcctgctgaccagcgagcgggtggccaagcagtttcctgtgatgacagaggccatcacccagatccgggccaagggcctgcagacagctgtgctgagcaacaacttctacctgcccaaccagaagagcttcctgcccctggacaggaagcagtttgatgtgattgtggagagctgcatggagggcatctgcaagccagacccccgcatctacaagctgtgcctggagcagctgggcctgcagcccagcgagagcatcttcctggatgacctgggcaccaacctgaaggaggccgcccggctgggcatccacaccatcaaggtgaatgaccctgagacagctgtgaaggagctggaggccctgctgggcttcaccctgcgggtgggcgtgcccaacaccaggcctgtgaagaagaccatggagatccccaaggacagcctgcagaagtacctgaaggacctgctgggcatccagaccaccggccccctggagctgctgcagtttgaccacggccagagcaaccccacctactacatccggctggccaacagagacctggtgctgaggaagaagcccccaggcaccctgctgcccagcgcccacgccatcgagcgggagttccgcatcatgaaggccctggccaatgccggcgtgcctgtgcccaacgtgctggacctgtgtgaggacagcagcgtcatcggcacccccttctacgtgatggagtactgccccggcctcatctacaaggaccccagcctgcccggcctggagcccagccaccggcgggccatctacacagccatgaacacagtgctgtgcaagatccacagcgtggacctgcaggccgtgggcctggaggactatggcaagcagggcgactacatcccccggcaggtgaggacctgggtgaagcagtaccgggccagcgagaccagcaccatcccagccatggagcggctcatcgagtggctgcccctgcacctgccccggcagcagaggaccaccgtggtgcatggagacttccggctggacaacctggtgttccaccctgaggagcctgaggtgctggccgtgctggactgggagctgagcaccctgggggaccccctggctgatgtggcctacagctgcctggcccactacctgcccagcagcttccctgtgctgcggggcatcaatgactgtgacctgacccagctgggcatcccagctgctgaggagtacttcaggatgtactgcctgcagatgggcctgcccccaacagagaactggaacttctacatggccttctccttcttccgggtggccgccatcctgcagggcgtgtacaagaggagcctgaccggccaggccagcagcacctatgcagagcagacaggcaagctgacagaatttgtgagcaacctggcctgggactttgctgtgaaggagggcttccgggtcttcaaggagatgcccttcaccaaccccctgaccaggagctaccacacctgggcccggccccagagccagtggtgccccaccggcagccgcagctacagctctgtgcctgaggccagccctgcccacaccagccggggcggcctggtgatcagccctgagagcctgagcccccctgtgcgggagctgtaccaccggctgaagcacttcatggagcagagggtgtacccagctgagcctgagctgcagagccaccaggccagcgctgcccgctggagccccagccccctgattgaggacctgaaggagaaggccaaggccgagggcctgtggaacctcttcctgcccctggaggccgaccctgagaagaagtacggggccggcctgaccaacgtggagtatgcccacctgtgtgagctgatgggcaccagcctgtatgcccctgaggtgtgcaactgcagcgccccagacaccggcaacatggagctgctggtgcgctatggaacagaggcccagaaggcccgctggctgatccccctgctggagggcaaggcccggagctgctttgccatgacagagccccaggtggccagcagtgatgccaccaacatcgaggccagcatccgggaggaggacagcttctacgtgatcaatggccacaagtggtggatcaccggcatcctggacccccgctgccagctgtgtgtgttcatgggcaagacagacccccacgcccccaggcaccggcagcagagcgtgctgctggtgcccatggacaccccaggcatcaagatcatccggcccctgactgtgtatggcctggaggatgcccctgggggccacggggaggtgcgctttgaacatgtgcgggtgcccaaggagaacatggtgctgggccctggccggggctttgaaattgcccagggccgcctgggccctggccgcatccaccactgcatgaggctcatcggcttcagcgagcgggccctggccctgatgaaggcccgggtgaagagccggctggccttcggcaagcccctggtggagcagggcaccgtgctggccgacatcgcccagagccgggtggagattgagcaggcccggctgctggtgctgcgggccgcccacctgatggacctggccggcaacaaggctgctgccctggacatcgccatgatcaagatggtggcccccagcatggccagcagggtcatcgaccgggccatccaggcctttggagctgctggcctgagcagtgactaccccctggcccagttcttcacctgggcccgggccctgcgctttgctgatggcccagatgaggtgcaccgggccaccgtggccaagctggagctgaagcaccgcatctag

SEQ ID NO: 35261 - DNA, 1479 bp, Artificial Sequence
  Description of Artificial Sequence: Synthetic coding sequence
atgctggagtacctgagcctgaccttcctgatctctgtgaagatccagggcgactacatcccccggcaggtgaggacctgggtgaagcagtaccgggccagcgagaccagcaccatcccagccatggagcggctcatcgagtggctgcccctgcacctgccccggcagcagaggaccaccgtggtgcatggagacttccggctggacaacctggtgttccaccctgaggagcctgaggtgctggccgtgctggactgggagctgagcaccctgggggaccccctggctgatgtggcctacagctgcctggcccactacctgcccagcagcttccctgtgctgcggggcatcaatgactgtgacctgacccagctgggcatcccagctgctgaggagtacttcaggatgtactgcctgcagatgggcctgcccccaacagagaactggaacttctacatggccttctccttcttccgggtggccgccatcctgcagggcgtgtacaagaggagcctgaccggccaggccagcagcacctatgcagagcagacaggcaagctgacagaatttgtgagcaacctggcctgggactttgctgtgaaggagggcttccgggtcttcaaggagatgcccttcaccaaccccctgaccaggagctaccacacctgggcccggccccagagccagtggtgccccaccggcagccgcagctacagctctgtgcctgaggccagccctgcccacaccagccggggcggcctggtgatcagccctgagagcctgagcccccctgtgcgggagctgtaccaccggctgaagcacttcatggagcagagggtgtacccagctgagcctgagctgcagagccaccaggccagcgctgcccgctggagccccagccccctgattgaggacctgaaggagaaggccaaggccgagggcctgtggaacctcttcctgcccctggaggccgaccctgagaagaagtacggggccggcctgaccaacgtggagtatgcccacctgtgtgagctgatgggcaccagcctgtatgcccctgaggtgtgcaactgcagcgccccagacaccggcaacatggagctgctggtgcgctatggaacagaggcccagaaggcccgctggctgatccccctgctggagggcaaggcccggagctgctttgccatgacagagccccaggtggccagcagtgatgccaccaacatcgaggccagcatccgggaggaggacagcttctacgtgatcaatggccacaagtggtggatcaccggcatcctggacccccgctgccagctgtgtgtgttcatgggcaagacagacccccacgcccccaggcaccggcagcagagcgtgctgctggtgcccatggacaccccaggcatcaagatcatccggcccctgactgtgtatggcctggaggatgcccctggctgcttcctgcccagcttcagcctgtag

SEQ ID NO: 35262 - DNA, 2673 bp, Artificial Sequence
  Description of Artificial Sequence: Synthetic coding sequence
atgtgtgtgcgcagctgcttccagagcccccggctgcagtgggtgtggaggacagccttcctgaagcacacccagaggaggcaccagggcagccaccgctggacccacctgggcggcagcacctaccgggccgtcatctttgacatgggcggcgtgctgatccccagccctggccgggtggccgctgagtgggaggtgcagaaccgcatccccagcggcaccatcctgaaggccctgatggagggcggggagaatggcccctggatgaggttcatgagagctgagatcacagctgagggcttcctgcgggagtttggccgcctgtgcagcgagatgctgaagacctctgtgcctgtggacagcttcttcagcctgctgaccagcgagcgggtggccaagcagtttcctgtgatgacagaggccatcacccagatccgggccaagggcctgcagacagctgtgctgagcaacaacttctacctgcccaaccagaagagcttcctgcccctggacaggaagcagtttgatgtgattgtggagagctgcatggagggcatctgcaagccagacccccgcatctacaagctgtgcctggagcagctgggcctgcagcccagcgagagcatcttcctggatgacctgggcaccaacctgaaggaggccgcccggctgggcatccacaccatcaaggtgaatgaccctgagacagctgtgaaggagctggaggccctgctgggcttcaccctgcgggtgggcgtgcccaacaccaggcctgtgaagaagaccatggagatccccaaggacagcctgcagaagtacctgaaggacctgctgggcatccagaccaccggccccctggagctgctgcagtttgaccacggccagagcaaccccacctactacatccggctggccaacagagacctggtgctgaggaagaagcccccaggcaccctgctgcccagcgcccacgccatcgagcgggagttccgcatcatgaaggccctggccaatgccggcgtgcctgtgcccaacgtgctggacctgtgtgaggacagcagcgtcatcggcacccccttctacgtgatggagtactgccccggcctcatctacaaggaccccagcctgcccggcctggagcccagccaccggcgggccatctacacagccatgaacacagtgctgtgcaagatccacagcgtggacctgcaggccgtgggcctggaggactatggcaagcagggcgactacatcccccggcaggtgaggacctgggtgaagcagtaccgggccagcgagaccagcaccatcccagccatggagcggctcatcgagtggctgcccctgcacctgccccggcagcagaggaccaccgtggtgcatggagacttccggctggacaacctggtgttccaccctgaggagcctgaggtgctggccgtgctggactgggagctgagcaccctgggggaccccctggctgatgtggcctacagctgcctggcccactacctgcccagcagcttccctgtgctgcggggcatcaatgactgtgacctgacccagctgggcatcccagctgctgaggagtacttcaggatgtactgcctgcagatgggcctgcccccaacagagaactggaacttctacatggccttctccttcttccgggtggccgccatcctgcagggcgtgtacaagaggagcctgaccggccaggccagcagcacctatgcagagcagacaggcaagctgacagaatttgtgagcaacctggcctgggactttgctgtgaaggagggcttccgggtcttcaaggagatgcccttcaccaaccccctgaccaggagctaccacacctgggcccggccccagagccagtggtgccccaccggcagccgcagctacagctctgtgcctgaggccagccctgcccacaccagccggggcggcctggtgatcagccctgagagcctgagcccccctgtgcgggagctgtaccaccggctgaagcacttcatggagcagagggtgtacccagctgagcctgagctgcagagccaccaggccagcgctgcccgctggagccccagccccctgattgaggacctgaaggagaaggccaaggccgagggcctgtggaacctcttcctgcccctggaggccgaccctgagaagaagtacggggccggcctgaccaacgtggagtatgcccacctgtgtgagctgatgggcaccagcctgtatgcccctgaggtgtgcaactgcagcgccccagacaccggcaacatggagctgctggtgcgctatggaacagaggcccagaaggcccgctggctgatccccctgctggagggcaaggcccggagctgctttgccatgacagagccccaggtggccagcagtgatgccaccaacatcgaggccagcatccgggaggaggacagcttctacgtgatcaatggccacaagtggtggatcaccggcatcctggacccccgctgccagctgtgtgtgttcatgggcaagacagacccccacgcccccaggcaccggcagcagagcgtgctgctggtgcccatggacaccccaggcatcaagatcatccggcccctgactgtgtatggcctggaggatgcccctggctgcttcctgcccagcttcagcctgtag

SEQ ID NO: 35263 - DNA, 3273 bp, Artificial Sequence
  Description of Artificial Sequence: Synthetic coding sequence
atgtgtgtgcgcagctgcttccagagcccccggctgcagtgggtgtggaggacagccttcctgaagcacacccagaggaggcaccagggcagccaccgctggacccacctgggcggcagcacctaccgggccgtcatctttgacatgggcggcgtgctgatccccagccctggccgggtggccgctgagtgggaggtgcagaaccgcatccccagcggcaccatcctgaaggccctgatggagggcggggagaatggcccctggatgaggttcatgagagctgagatcacagctgagggcttcctgcgggagtttggccgcctgtgcagcgagatgctgaagacctctgtgcctgtggacagcttcttcagcctgctgaccagcgagcgggtggccaagcagtttcctgtgatgacagaggccatcacccagatccgggccaagggcctgcagacagctgtgctgagcaacaacttctacctgcccaaccagaagagcttcctgcccctggacaggaagcagtttgatgtgattgtggagagctgcatggagggcatctgcaagccagacccccgcatctacaagctgtgcctggagcagctgggcctgcagcccagcgagagcatcttcctggatgacctgggcaccaacctgaaggaggccgcccggctgggcatccacaccatcaagaggcagggctttgctgtgctgcccaagctggtgagcaacagctgggcccaggccatctacccaccctacccacccaaggtggtgcggctgcaggtgaatgaccctgagacagctgtgaaggagctggaggccctgctgggcttcaccctgcgggtgggcgtgcccaacaccaggcctgtgaagaagaccatggagatccccaaggacagcctgcagaagtacctgaaggacctgctgggcatccagaccaccggccccctggagctgctgcagtttgaccacggccagagcaaccccacctactacatccggctggccaacagagacctggtgctgaggaagaagcccccaggcaccctgctgcccagcgcccacgccatcgagcgggagttccgcatcatgaaggccctggccaatgctggggtgcctgtgcccaacgtgctggacctgtgtgaggacagctctgtgattggcacccccttctacgtgatggagtactgccccggcctcatctacaaggaccccagcctgcccggcctggagcccagccacagaagagccatctacacagccatgaacacagtgctgtgcaagatccacagcgtggacctgcaggccgtgggcctggaggactatggcaagcagggcgactacatcccccggcaggtgaggacctgggtgaagcagtaccgggccagcgagaccagcaccatcccagccatggagcggctgattgagtggctgcccctgcacctgccccggcagcagaggaccaccgtggtgcacggggacttccggctggacaacctggtgttccaccctgaggagcctgaggtgctggccgtgctggactgggagctgagcaccctgggggaccccctggctgatgtggcctacagctgcctggcccactacctgcccagcagcttccctgtgctgcggggcatcaatgactgtgacctgacccagctgggcatcccagctgctgaggagtacttcaggatgtactgcctgcagatgggcctgcccccaacagagaactggaacttctacatggccttctccttcttccgggtggccgccatcctgcagggcgtgtacaagaggagcctgaccggccaggccagcagcacctacgccgagcagacaggcaagctgacagaatttgtgagcaacctggcctgggactttgctgtgaaggagggcttccgggtcttcaaggagatgcccttcaccaaccccctgaccaggagctaccacacctgggcccggccccagagccagtggtgccccaccggcagccgcagctacagctctgtgcctgaggccagccctgcccacaccagcagaggaggcctggtgatcagccctgagagcctgagcccccctgtgcgggagctgtaccaccggctgaagcacttcatggagcagagggtgtacccagctgagcctgagctgcagagccaccaggccagcgctgcccgctggagccccagccccctgattgaggacctgaaggagaaggccaaggccgagggcctgtggaacctcttcctgcccctggaggccgaccctgagaagaagtatggagctggcctgaccaacgtggagtatgcccacctgtgtgagctgatgggcaccagcctgtatgcccctgaggtgtgcaactgcagcgccccagacaccggcaacatggagctgctggtgcgctatggaacagaggcccagaaggcccgctggctgatccccctgctggagggcaaggcccggagctgctttgccatgacagagccccaggtggccagcagtgatgccaccaacatcgaggccagcatccgggaggaggacagcttctacgtgatcaatggccacaagtggtggatcaccggcatcctggacccccgctgccagctgtgtgtgttcatgggcaagacagacccccacgcccccaggcaccggcagcagagcgtgctgctggtgcccatggacaccccaggcatcaagatcatccggcccctgactgtgtatggcctggaggatgcccctgggggccatggagaggtgcgctttgagcacgtgcgggtgcccaaggagaacatggtgctgggccctggccggggctttgagatcgcccagggccgcctgggccctggccgcatccaccactgcatgaggctgattggcttcagcgagcgggccctggccctgatgaaggcccgggtgaagagccggctggccttcggcaagcccctggtggagcagggcaccgtgctggccgacatcgcccagagccgggtggagattgagcaggcccggctgctggtgctgcgggccgcccacctgatggacctggccggcaacaaggccgccgccctggacatcgccatgatcaagatggtggcccccagcatggccagccgggtgattgaccgggccatccaggccttcggggctgctggcctgagcagtgactaccccctggcccagttcttcacctgggcccgggccctgcgctttgctgatggcccagatgaggtgcaccgggccaccgtggccaagctggagctgaagcaccgcatctag

SEQ ID NO: 35264 - DNA, 291 bp, Artificial Sequence
  Description of Artificial Sequence: Synthetic coding sequence
atgtgtgtgcgcagctgcttccagagcccccggctgcagtgggtgtggaggacagccttcctgaagcacacccagaggaggcaccagggcagccaccgctggacccacctgggcggcagcacctaccgggccgtcatctttgacatgggcggcgtgctgatccccagccctggccgggtggccgctgagtgggaggtgcagaaccgcatccccagcggcaccatcctgaaggccctgatggagggcggggagaatggcccctggatgaggttcatgagagctgagatctag

SEQ ID NO: 35265 - DNA, 3312 bp, Artificial Sequence
  Description of Artificial Sequence: Synthetic coding sequence
atggccccagcctgccagatcctgcgctgggccctggccctgggcctgggcctgatgtttgaggtgacccacgccttccgcagccaggatgagttcctgagcagcctggagagctatgaaattgccttccccaccagggtggaccacaacggggccctgctggccttcagccccccaccaccccggcggcagaggcggggcaccggggccacagctgagagccgcctcttctacaaggtggccagccccagcacccacttcctgctgaacctgaccaggagcagccggctgctggccggccacgtgtctgtggagtactggacccgggagggcctggcctggcagagagctgcccggccccactgcctgtatgccggccacctgcagggccaggccagcagcagccacgtggccatcagcacctgtggcggcctgcacggcctgattgtggctgatgaggaggagtacctgattgagcccctgcacggcggccccaagggcagccgcagccctgaggagagcggcccccacgtggtgtacaagaggagcagcctgcggcacccccacctggacacagcctgtggggtgagagatgagaagccctggaagggccggccctggtggctgcggaccctgaagcccccaccagcccggcccctgggcaatgaaacagagcggggccagcccggcctgaagaggtctgtgtcccgggagcgctacgtggagaccctggtggtggccgacaagatgatggtggcctaccatggaagaagagatgtggagcagtatgtgctggccatcatgaacatcgtggccaagctgttccaggacagcagcctgggcagcacagtgaacatcctggtgaccaggctcatcctgctgacagaggaccagcccaccctggagatcacccaccacgccggcaagagcctggacagcttctgcaagtggcagaagagcatcgtgaaccacagcggccatggaaatgccatcccagaaaatggagtggccaaccacgacacagctgtgctgatcaccaggtatgacatctgcatctacaagaacaagccctgtggcaccctgggcctggcccctgtgggcggcatgtgtgagcgggagaggagctgcagcgtgaatgaagacatcggcctggccacagccttcaccatcgcccacgagatcggccacaccttcggcatgaaccatgatggagtgggcaacagctgtggggcccggggccaggaccctgccaagctgatggccgcccacatcaccatgaagaccaacccctttgtgtggagcagctgcagccgggactacatcaccagcttcctggacagcggcctgggcctgtgcctgaacaacagaccaccccggcaggactttgtgtaccccaccgtggcccctggccaggcctatgatgctgatgagcagtgccgcttccagcacggcgtgaagagccggcagtgcaagtacggggaggtgtgcagcgagctgtggtgcctgagcaagagcaaccgctgcatcaccaacagcatcccagctgctgagggcaccctgtgccagacccacaccatcgacaagggctggtgctacaagagggtgtgtgtgcccttcggcagcaggcctgagggcgtggatggagcctggggcccctggaccccctggggagactgcagcaggacctgtggcggcggcgtgagcagcagcagccgccactgtgacagcccccggcccaccatcggcggcaagtactgcctgggggagaggagaagacacaggagctgcaacacagatgactgccccccaggcagccaggacttccgggaggtgcagtgcagcgagtttgacagcatccccttccggggcaagttctacaagtggaagacctacagaggaggaggagtgaaggcctgcagcctgacctgcctggccgagggcttcaacttctacacagaaagagctgctgctgtggtggatggcaccccctgcaggccagacacagtggacatctgtgtgtctggagagtgcaagcacgtgggctgtgacagagtgctgggcagtgacctgcgggaggacaagtgccgggtgtgtggaggagatggcagcgcctgtgagaccatcgagggcgtcttcagccctgccagccctggagctggctatgaagatgtggtgtggatccccaagggctctgtgcacatcttcatccaggacctgaacctgagcctgagccacctggccctgaagggggaccaggagagcctgctgctggagggcctgcccggcaccccccagccccaccggctgcccctggccggcaccaccttccagctgcggcagggccctgaccaggtgcagagcctggaggccctgggccccatcaatgccagcctgattgtgatggtgctggccaggacagagctgcctgccctgcgctaccgcttcaatgcccccatcgcccgggacagcctgcccccctacagctggcactacgccccctggaccaagtgcagcgcccagtgtgccggcggcagccaggtgcaggccgtggagtgcaggaaccagctggacagcagcgctgtggccccccactactgcagcgcccacagcaagctgcccaagaggcagagggcctgcaacacagagccctgccccccagactgggtggtgggcaactggagcctgtgcagccgcagctgtgatgctggggtgcgcagccgctctgtggtgtgccagaggagagtgtctgctgctgaggagaaggccctggatgacagcgcctgcccccagcccaggcctcctgtgctggaggcctgccacggccccacctgccccccagagtgggccgccctggactggagcgaatgtacccccagctgtggccctggcctgcggcaccgggtggtgctgtgcaagtctgctgaccaccgggccaccctgcccccagcccactgcagccctgctgccaagcccccagccaccatgcgctgcaacctgcggcgctgccccccagcccgctgggtggccggggagtggggcgagtgcagcgcccagtgtggggtgggccagaggcagaggtctgtgcgctgcaccagccacacaggccaggccagccatgagtgcacagaggccctgcggccccccaccacccagcagtgtgaggccaagtgtgacagccccaccccaggagatggccctgaggagtgcaaggatgtgaacaaggtggcctactgccccctggtgctgaagttccagttctgcagccgggcctacttccggcagatgtgctgcaagacctgccacggccactag

SEQ ID NO: 35266 - DNA, 1998 bp, Artificial Sequence
  Description of Artificial Sequence: Synthetic coding sequence
atggccagcgccagccagggcgcagatgatgatggcagcaggaggaagccccggctggccgccagcctgcagatcagcccccagccccggccctggaggcccctgcctgcccaggcccagagcgcctggggccctgccccagccccagccacctacagagctgagggcggctggccccaggtgtctgtgctgcgggacagcggccctggagctggagctggggtgggggagctgggcgccgcccgggcctgggagaacctgggggagcagatgggcaaggccccccgggtgcctgtgcccccagctggcctgagcctgcccctgaaggaccccccagccagccaggccgtgtccctgctgacagaatatgctgccagcctgggcatcttcctgctcttccgggaggaccagcccccaggcaaggtgttcaagtaccgggcccctggaggagaggagctgaaggccatgtgcctgtggcaggtggaggtgctgcgggccttcctgctgaggacaggctggaggggcctgtggaggggggacctggacctgggccctgacagctcctgggccaaccggctgcccttcctgctgatctgtgagatggagagccgcatcccagctgtggaggagctgggcccctgcttccccttctctgtgtctgctgagctggatggagtggtgtgcccagctggaacagccaacagcaagacagaggccaagcagcaggccgccctgagcgccctgtgctacatccgcagccagctggagaaccctgagagcccccagaccagcagcaggcctcccctggcccccctgtctgtggagaacatcctgacccatgagcagagatgtgccgccctggtgtctgctggctttgacctgctgctggatgagaggagcccctactgggcctgcaagggcaccgtggccggggtcatcctggagcggggctgggccgtgtctgcccccagctgcacagagatcccccgggcccggggccacgtgaaggagatctacaagctggtggccctgggcaccggcagcagctgctgtgccggctggctggagttcagcggccagcagctgcatgactgccacggcctggtgattgcccggcgggccctgctgcgcttcctgttccggcagctgctgctggccacccagggcggccccaagggcaaggagcagagcgtgctggccccccagcccggccctggcccccccttcaccctgaagcccagggtcttcctgcacctgtacatcagcaacacccccaagggggccgcccgggacatctacctgccccccaccagcgagggcggcctgccccacagcccccccatgaggctgcaggcccacgtgctgggccagctgaagcctgtgtgctacgtggcccccagcctgtgtgacacccacgtgggctgcctgagcgccagtgacaagctggcccgctgggccgtgctgggcctgggcggggccctgctggcccacctggtgagccccctgtacagcaccagcctcatcctggccgacagctgccacgacccccccaccctgagccgggccatccacacccggccctgcctggacagcgtgctgggcccctgcctgcccccaccctacgtgaggacagccctgcacctgtttgctggcccccctgtggcccccagcgagcccaccccagacacctgccggggcctgagcctgaactggagcctgggggaccccggcatcgaggtggtggatgtggccaccggccgggtgaaggccaatgctgccctgggcccccccagccggctgtgcaaggccagcttcctgcgggccttccaccaggccgcccgggctgtgggcaagccctacctgctggccctgaagacctatgaagctgccaaggccggcccctaccaggaggcccggcggcagctgagcctgctgctggaccagcagggcctgggcgcctggcccagcaagcccctggtgggcaagttcaggaactag

SEQ ID NO: 35267 - DNA, 1752 bp, Artificial Sequence
  Description of Artificial Sequence: Synthetic coding sequence
atggccagcgccagccagggcgcagatgatgatggcagcaggaggaagccccggctggccgccagcctgcagatcagcccccagccccggccctggaggcccctgcctgcccaggcccagagcgcctggggccctgccccagccccagccacctacagagctgagggcggctggccccaggtgtctgtgctgcgggacagcggccctggagctggagctggggtgggggagctgggcgccgcccgggcctgggagaacctgggggagcagatgggcaaggccccccgggtgcctgtgcccccagctggcctgagcctgcccctgaaggaccccccagccagccaggccgtgtccctgctgacagaatatgctgccagcctgggcatcttcctgctcttccgggaggaccagcccccaggcccctgcttccccttctctgtgtctgctgagctggatggagtggtgtgcccagctggaacagccaacagcaagacagaggccaagcagcaggccgccctgagcgccctgtgctacatccgcagccagctggagaaccctgagagcccccagaccagcagcaggcctcccctggcccccctgtctgtggagaacatcctgacccatgagcagagatgtgccgccctggtgtctgctggctttgacctgctgctggatgagaggagcccctactgggcctgcaagggcaccgtggccggggtcatcctggagcgggagatcccccgggcccggggccacgtgaaggagatctacaagctggtggccctgggcaccggcagcagctgctgtgccggctggctggagttcagcggccagcagctgcatgactgccacggcctggtgattgcccggcgggccctgctgcgcttcctgttccggcagctgctgctggccacccagggcggccccaagggcaaggagcagagcgtgctggccccccagcccggccctggcccccccttcaccctgaagcccagggtcttcctgcacctgtacatcagcaacacccccaagggggccgcccgggacatctacctgccccccaccagcgagggcggcctgccccacagcccccccatgaggctgcaggcccacgtgctgggccagctgaagcctgtgtgctacgtggcccccagcctgtgtgacacccacgtgggctgcctgagcgccagtgacaagctggcccgctgggccgtgctgggcctgggcggggccctgctggcccacctggtgagccccctgtacagcaccagcctcatcctggccgacagctgccacgacccccccaccctgagccgggccatccacacccggccctgcctggacagcgtgctgggcccctgcctgcccccaccctacgtgaggacagccctgcacctgtttgctggcccccctgtggcccccagcgagcccaccccagacacctgccggggcctgagcctgaactggagcctgggggaccccggcatcgaggtggtggatgtggccaccggccgggtgaaggccaatgctgccctgggcccccccagccggctgtgcaaggccagcttcctgcgggccttccaccaggccgcccgggctgtgggcaagccctacctgctggccctgaagacctatgaagctgccaaggccggcccctaccaggaggcccggcggcagctgagcctgctgctggaccagcagggcctgggcgcctggcccagcaagcccctggtgggcaagttcaggaactag

SEQ ID NO: 35268 - DNA, 576 bp, Artificial Sequence
  Description of Artificial Sequence: Synthetic coding sequence
atggaggccaaggccgcccccaagccagctgccagcggggcctgcagcgtgtctgctgaggagacagagaagtggatggaggaggccatgcacatggccaaggaggccctggagaacacagaggtgcctgtgggctgcctgatggtgtacaacaatgaggtggtgggcaaaggaagaaatgaggtgaaccagaccaagaatgccaccaggcatgctgagatggtggccatcgaccaggtgctggactggtgccggcagagcggcaagagccccagcgaggtgtttgagcacacagtgctgtatgtgacagtggagccctgcatcatgtgtgccgccgccctgcggctgatgaagatccccctggtggtgtatggctgccagaatgaaagatttggaggctgcggctctgtgctgaacatcgccagcgctgacctgcccaacacaggccggcccttccagtgcatccctggctacagagctgaggaggccgtggagatgctgaagaccttctacaagcaggagaaccccaatgcccccaagagcaaggtgaggaagaaggagtgccagaagagctag

SEQ ID NO: 35269 - DNA, 111 bp, Artificial Sequence
  Description of Artificial Sequence: Synthetic coding sequence
atggaggccaaggccgcccccaagccagctgccagcggggcctgcagcgtgtctgctgaggagacagagaagtggatggaggaggccatgcacatggagatcttcctgtag

SEQ ID NO: 35270 - DNA, 435 bp, Artificial Sequence
  Description of Artificial Sequence: Synthetic coding sequence
atggtgtacaacaatgaggtggtgggcaagggcagaaatgaggtgaaccagaccaagaatgccaccaggcatgctgagatggtggccatcgaccaggtgctggactggtgccggcagagcggcaagagccccagcgaggtgtttgagcacacagtgctgtatgtgacagtggagccctgcatcatgtgtgccgccgccctgcggctgatgaagatccccctggtggtgtatggctgccagaatgaaagatttggaggctgcggctctgtgctgaacatcgccagcgctgacctgcccaacacaggccggcccttccagtgcatccctggctacagagctgaggaggccgtggagatgctgaagaccttctacaagcaggagaaccccaatgcccccaagagcaaggtgaggaagaaggagtgccagaagagctag

SEQ ID NO: 35271 - DNA, 1056 bp, Artificial Sequence
  Description of Artificial Sequence: Synthetic coding sequence
atggagcccgcccctggcctggtggagcagcccaagtgcctggaggccggcagccctgagcctgagcccgccccctggcaggccctgcctgtgctgtctgagaagcagagcggagatgtggagctggtgctggcctatgctgcccctgtgctggacaagaggcagaccagccggctgctgaaggaggtgtctgccctgcaccccctgcctgcccagccccacctgaagagggtgcggcccagcagagatgctggcagcccccacgccctggagatgctgctgtgcctggccggccctgccagcggccccaggagcctggccgagctgctgcccaggcctgctgtggacccccggggcctgggccagcccttcctggtgcctgtgcctgcccggccccccctgacccggggccagtttgaggaggcccgggcccactggcccaccagcttccacgaggacaagcaggtgaccagcgccctggccggccgcctcttcagcacccaggagagagctgccatgcagagccacatggagagagctgtgtgggccgccaggagagctgctgcccggggcctgcgggctgtgggcgctgtggtggtggaccctgccagtgacagagtgctggccaccggccatgactgcagctgtgccgacaaccccctgctgcatgctgtgatggtgtgtgtggacctggtggcccggggccagggccggggcacctatgacttccggcccttccctgcctgcagctttgccccagctgctgccccccaggccgtgcgggccggggctgtgaggaagctggatgctgatgaagatggcctgccctacctgtgcaccggctatgacctgtatgtgacccgggagccctgtgccatgtgtgccatggccctggtgcacgcccgcatcctgcgggtcttctacggggcccccagcccagatggagccctgggcacccgcttccgcatccacgcccggccagacctgaaccaccgcttccaggtgttccggggcgtgctggaggagcagtgccgctggctggaccctgacacctag

SEQ ID NO: 35272 - DNA, 162 bp, Artificial Sequence
  Description of Artificial Sequence: Synthetic coding sequence
atggagcccgcccctggcctggtggagcagcccaagtgcctggaggccggcagccctgagcctgagcccgccccctggcaggccctgcctgtgctgtctgagaagcagagcggagatgtggagctggtgctggcctatgctgcccctgtgctggacaagtag

SEQ ID NO: 35273 - DNA, 804 bp, Artificial Sequence
  Description of Artificial Sequence: Synthetic coding sequence
atgattgaggccgaggagcagcagccctgcaagacagacttctacagcgagctgcccaaggtggagctgcacgcccacctgaatggcagcatcagcagccacaccatgaagaagctgattgcccagaagccagacctgaagatccatgaccagatgacagtgattgacaagggcaagaagaggaccctggaggagtgcttccagatgttccagaccatccaccagctgaccagcagccctgaggacatcctgatggtgaccaaggatgtgatcaaggagtttgctgatgatggagtgaagtacctggagctgcggagcaccccaagaagagaaaatgccaccggcatgaccaagaagacctacgtggagagcatcctggagggcatcaagcagagcaagcaggagaacctggacattgatgtgcgctacctgattgctgtggacagaagaggaggccccctggtggccaaggagaccgtgaagctggccgaggagttcttcctgagcacagagggcaccgtgctgggcctggacctgagcggggaccccaccgtgggccaggccaaggacttcctggagcccctgctggaggccaagaaggccggcctgaagctggccctgcacctgtctgagatccccaaccagaagaaggagacccagatcctgctggacctgctgcctgaccgcatcggccacggcaccttcctgaacagcggggagggcggcagcctggacctggtggactttgtgcggcagcaccgcatccccctgggcaaggcctggagcttccgcagcagcaggtag

SEQ ID NO: 35274 - DNA, 1068 bp, Artificial Sequence
  Description of Artificial Sequence: Synthetic coding sequence
atgattgaggccgaggagcagcagccctgcaagacagacttctacagcgagctgcccaaggtggagctgcacgcccacctgaatggcagcatcagcagccacaccatgaagaagctgattgcccagaagccagacctgaagatccatgaccagatgacagtgattgacaagggcaagaagaggaccctggaggagtgcttccagatgttccagaccatccaccagctgaccagcagccctgaggacatcctgatggtgaccaaggatgtgatcaaggagtttgctgatgatggagtgaagtacctggagctgcggagcaccccaagaagagaaaatgccaccggcatgaccaagaagacctacgtggagagcatcctggagggcatcaagcagagcaagcaggagaacctggacattgatgtgcgctacctgattgctgtggacagaagaggaggccccctggtggccaaggagaccgtgaagctggccgaggagttcttcctgagcacagagggcaccgtgctgggcctggacctgagcggggaccccaccgtgggccaggccaaggacttcctggagcccctgctggaggccaagaaggccggcctgaagctggccctgcacctgtctgagatccccaaccagaagaaggagacccagatcctgctggacctgctgcctgaccgcatcggccacggcaccttcctgaacagcggggagggcggcagcctggacctggtggactttgtgcggcagcaccgcatccccctggagctgtgcctgaccagcaatgtgaagagccagacagtgcccagctatgaccagcaccacttcggcttctggtacagcatcgcccaccccagcgtcatctgcacagatgacaagggcgtgtttgccacccacctgagccaggagtaccagctggccgctgagaccttcaacctgacccagagccaggtgtgggacctgtcctatgagagcatcaactacatctttgccagtgacagcaccaggtctgagctgaggaagaagtggaaccacctgaagccccgggtgctgcacatctag

SEQ ID NO: 35275 - DNA, 987 bp, Artificial Sequence
  Description of Artificial Sequence: Synthetic coding sequence
atgattgaggccgaggagcagcagccctgcaagacagacttctacagcgagctgcccaaggtggagctgcacgcccacctgaatggcagcatcagcagccacaccatgaagaagctgattgcccagaagccagacctgaagatccatgaccagatgacagtgattgacaagggcaagaagaggaccctggaggagtgcttccagatgttccagaccatccaccagctgaccagcagccctgaggacatcctgatggtgaccaaggatgtgatcaaggagtttgctgatgatggagtgaagtacctggagctgcggagcaccccaagaagagaaaatgccaccggcatgaccaagaagacctacgtggagagcatcctggagggcatcaagcagagcaagcaggagaacctggacattgatgtgcgctacctgattgctgtggacagaagaggaggccccctggtggccaaggagaccgtgaagctggccgaggagttcttcctgagcacagagggcaccgtgctgggcctggacctgagcggggaccccaccatccccaaccagaagaaggagacccagatcctgctggacctgctgcctgacagaattggacatggcaccttcctgaacagcggggagggcggcagcctggacctggtggactttgtgcggcagcaccgcatccccctggagctgtgcctgaccagcaatgtgaagagccagacagtgcccagctatgaccagcaccacttcggcttctggtacagcatcgcccaccccagcgtcatctgcacagatgacaagggcgtgtttgccacccacctgagccaggagtaccagctggccgctgagaccttcaacctgacccagagccaggtgtgggacctgtcctatgagagcatcaactacatctttgccagtgacagcaccaggtctgagctgaggaagaagtggaaccacctgaagccccgggtgctgcacatctag

SEQ ID NO: 35276 - DNA, 1836 bp, Artificial Sequence
  Description of Artificial Sequence: Synthetic coding sequence
atgtctgtgcaggtggtgtctgctgctgctgctgccaaggtgcctgaggtggagctgaaggacctgagccccagcgaggccgagagccagctgggcctgagcacagctgctgtgggcgccatggcccctcctgctgggggcggggaccctgaggccccagccccagctgctgagcggccccctgtgcccggccctggcagcggccctgctgctgccctgagccctgctgctgggaaggtgccccaggccagcgccatgaagagaagtgacccccaccaccagcaccagaggcacagagatggaggagaggccctggtgtccccagatggcaccgtgacagaggcccccaggacagtgaagaagcagatccagtttgctgaccagaagcaggagttcaacaagaggcccaccaagattggaagaagaagcctgagccgcagcatcagccagagcagcacagacagctacagcagcgctgccagctacacagacagcagtgatgatgagaccagcccccgggacaagcagcagaagaacagcaagggcagcagtgacttctgtgtgaagaacatcaagcaggccgagtttggccggcgggagattgaaattgctgagcaggagatgcctgccctgatggccctgaggaagagggcccagggcgagaagcccctggccggggccaagatcgtgggctgcacccacatcacagcccagacagctgtgctgatggagaccctgggcgccctgggcgcccagtgccgctgggccgcctgcaacatctacagcaccctgaatgaggtggccgccgccctggccgagagcggcttccctgtgtttgcctggaagggggagagtgaagatgacttctggtggtgcatcgacagatgtgtgaatgtggagggctggcagcccaacatgatcctggatgatggaggagacctgacccactggatctacaagaagtaccccaacatgttcaagaagatcaagggcatcgtggaggagagcgtgactggagtgcaccggctgtaccagctgagcaaggccggcaagctgtgtgtgcctgccatgaatgtgaatgacagcgtgaccaagcagaagtttgacaacctgtactgctgccgggagagcatcctggatggcctgaagaggaccacagacatgatgtttggaggcaagcaggtggtggtgtgtggctacggggaggtgggcaagggctgctgtgccgccctgaaggccatgggcagcatcgtgtatgtgacagaaattgaccccatctgtgccctgcaggcctgcatggatggcttccggctggtgaagctgaatgaggtgatccggcaggtggacatcgtcatcacctgcaccggcaacaagaatgtggtgacccgggagcacctggacaggatgaagaacagctgcatcgtgtgcaacatgggccacagcaacacagaaattgatgtggccagcctgcggaccccagagctgacctgggagcgggtgcgcagccaggtggaccacgtgatctggccagatggcaagagaattgtgctgctggccgagggccgcctgctgaacctgagctgcagcacagtgcccacctttgtgctgagcatcacagccaccacccaggccctggccctgattgagctgtacaatgcccctgagggccgctacaagcaggatgtgtacctgctgcccaagaagatggatgaatatgtggccagcctgcacctgcccacctttgatgcccacctgacagagctgacagatgagcaggccaagtacctgggcctgaacaagaatggccccttcaagcccaactactaccgctactag

SEQ ID NO: 35277 - DNA, 1530 bp, Artificial Sequence
  Description of Artificial Sequence: Synthetic coding sequence
atggagaagtgggatggaaatgaaggcaccagcgccttccacatgcctgagtggatgcagatccagtttgctgaccagaagcaggagttcaacaagaggcccaccaagattggaagaagaagcctgagccgcagcatcagccagagcagcacagacagctacagcagcgctgccagctacacagacagcagtgatgatgagaccagcccccgggacaagcagcagaagaacagcaagggcagcagtgacttctgtgtgaagaacatcaagcaggccgagtttggccggcgggagattgaaattgctgagcaggagatgcctgccctgatggccctgaggaagagggcccagggcgagaagcccctggccggggccaagatcgtgggctgcacccacatcacagcccagacagctgtgctgatggagaccctgggcgccctgggcgcccagtgccgctgggccgcctgcaacatctacagcaccctgaatgaggtggccgccgccctggccgagagcggcttccctgtgtttgcctggaagggggagagtgaagatgacttctggtggtgcatcgacagatgtgtgaatgtggagggctggcagcccaacatgatcctggatgatggaggagacctgacccactggatctacaagaagtaccccaacatgttcaagaagatcaagggcatcgtggaggagagcgtgactggagtgcaccggctgtaccagctgagcaaggccggcaagctgtgtgtgcctgccatgaatgtgaatgacagcgtgaccaagcagaagtttgacaacctgtactgctgccgggagagcatcctggatggcctgaagaggaccacagacatgatgtttggaggcaagcaggtggtggtgtgtggctacggggaggtgggcaagggctgctgtgccgccctgaaggccatgggcagcatcgtgtatgtgacagaaattgaccccatctgtgccctgcaggcctgcatggatggcttccggctggtgaagctgaatgaggtgatccggcaggtggacatcgtcatcacctgcaccggcaacaagaatgtggtgacccgggagcacctggacaggatgaagaacagctgcatcgtgtgcaacatgggccacagcaacacagaaattgatgtggccagcctgcggaccccagagctgacctgggagcgggtgcgcagccaggtggaccacgtgatctggccagatggcaagagaattgtgctgctggccgagggccgcctgctgaacctgagctgcagcacagtgcccacctttgtgctgagcatcacagccaccacccaggccctggccctgattgagctgtacaatgcccctgagggccgctacaagcaggatgtgtacctgctgcccaagaagatggatgaatatgtggccagcctgcacctgcccacctttgatgcccacctgacagagctgacagatgagcaggccaagtacctgggcctgaacaagaatggccccttcaagcccaactactaccgctactag

SEQ ID NO: 35278 - DNA, 1833 bp, Artificial Sequence
  Description of Artificial Sequence: Synthetic coding sequence
atgtctgtgcaggtggtgtctgctgctgctgctgccaaggtgcctgaggtggagctgaaggacctgagccccagcgaggccgagagccagctgggcctgagcacagctgctgtgggcgccatggcccctcctgctgggggcggggaccctgaggccccagccccagctgctgagcggccccctgtgcccggccctggcagcggccctgctgctgccctgagccctgctgctgggaaggtgccccaggccagcgccatgaagagaagtgacccccaccaccagcaccagaggcacagagatggaggagaggccctggtgtccccagatggcaccgtgacagaggcccccaggacagtgaagaagatccagtttgctgaccagaagcaggagttcaacaagaggcccaccaagattggccgccgcagcctgagccgcagcatcagccagagcagcacagacagctacagcagcgctgccagctacacagacagcagtgatgatgagaccagcccccgggacaagcagcagaagaacagcaagggcagcagtgacttctgtgtgaagaacatcaagcaggccgagtttggaagaagagaaattgaaattgctgagcaggagatgcctgccctgatggccctgaggaagagggcccagggcgagaagcccctggccggggccaagatcgtgggctgcacccacatcacagcccagacagctgtgctgatggagaccctgggcgccctgggcgcccagtgccgctgggccgcctgcaacatctacagcaccctgaatgaggtggccgccgccctggccgagagcggcttccctgtgtttgcctggaagggggagagtgaagatgacttctggtggtgcatcgacagatgtgtgaatgtggagggctggcagcccaacatgatcctggatgatggaggagacctgacccactggatctacaagaagtaccccaacatgttcaagaagatcaagggcatcgtggaggagagcgtgactggagtgcaccggctgtaccagctgagcaaggccggcaagctgtgtgtgcctgccatgaatgtgaatgattctgtgaccaagcagaagtttgacaacctgtactgctgccgggagagcatcctggatggcctgaagaggaccacagacatgatgtttggaggcaagcaggtggtggtgtgtggctatggagaggtgggcaagggctgctgtgccgccctgaaggccatgggcagcatcgtgtatgtgacagaaattgaccccatctgtgccctgcaggcctgcatggatggcttccggctggtgaagctgaatgaagtcatccggcaggtggacatcgtcatcacctgcaccggcaacaagaatgtggtgacccgggagcacctggacaggatgaagaacagctgcatcgtgtgcaacatgggccacagcaacacagaaattgatgtggccagcctgcggaccccagagctgacctgggagcgggtgcgcagccaggtggaccacgtgatctggccagatggcaagagaattgtgctgctggccgagggccgcctgctgaacctgagctgcagcacagtgcccacctttgtgctgagcatcacagccaccacccaggccctggccctgattgagctgtacaatgcccctgagggccgctacaagcaggatgtgtacctgctgcccaagaagatggatgaatatgtggccagcctgcacctgcccacctttgatgcccacctgacagagctgacagatgagcaggccaagtacctgggcctgaacaagaatggccccttcaagcccaactactaccgctactag

SEQ ID NO: 35279 - DNA, 228 bp, Artificial Sequence
  Description of Artificial Sequence: Synthetic coding sequence
atggagaagtgggatggaaatgaaggcaccagcgccttccacatgcctgagtggatgcagatccagtttgctgaccagaagcaggagttcaacaagaggcccaccaagattggaagaagaagcctgagccgcagcatcagccagagcagcacagacagctacagcagcgctgccagctacacagacagcagtgatgatgagaccagcccccgggacaagcagcagtag

SEQ ID NO: 35280 - DNA, 1527 bp, Artificial Sequence
  Description of Artificial Sequence: Synthetic coding sequence
atggagaagtgggatggaaatgaaggcaccagcgccttccacatgcctgagtggatgatccagtttgctgaccagaagcaggagttcaacaagaggcccaccaagattggccgccgcagcctgagccgcagcatcagccagagcagcacagacagctacagcagcgctgccagctacacagacagcagtgatgatgagaccagcccccgggacaagcagcagaagaacagcaagggcagcagtgacttctgtgtgaagaacatcaagcaggccgagtttggaagaagagaaattgaaattgctgagcaggagatgcctgccctgatggccctgaggaagagggcccagggcgagaagcccctggccggggccaagatcgtgggctgcacccacatcacagcccagacagctgtgctgatggagaccctgggcgccctgggcgcccagtgccgctgggccgcctgcaacatctacagcaccctgaatgaggtggccgccgccctggccgagagcggcttccctgtgtttgcctggaagggggagagtgaagatgacttctggtggtgcatcgacagatgtgtgaatgtggagggctggcagcccaacatgatcctggatgatggaggagacctgacccactggatctacaagaagtaccccaacatgttcaagaagatcaagggcatcgtggaggagagcgtgactggagtgcaccggctgtaccagctgagcaaggccggcaagctgtgtgtgcctgccatgaatgtgaatgattctgtgaccaagcagaagtttgacaacctgtactgctgccgggagagcatcctggatggcctgaagaggaccacagacatgatgtttggaggcaagcaggtggtggtgtgtggctatggagaggtgggcaagggctgctgtgccgccctgaaggccatgggcagcatcgtgtatgtgacagaaattgaccccatctgtgccctgcaggcctgcatggatggcttccggctggtgaagctgaatgaagtcatccggcaggtggacatcgtcatcacctgcaccggcaacaagaatgtggtgacccgggagcacctggacaggatgaagaacagctgcatcgtgtgcaacatgggccacagcaacacagaaattgatgtggccagcctgcggaccccagagctgacctgggagcgggtgcgcagccaggtggaccacgtgatctggccagatggcaagagaattgtgctgctggccgagggccgcctgctgaacctgagctgcagcacagtgcccacctttgtgctgagcatcacagccaccacccaggccctggccctgattgagctgtacaatgcccctgagggccgctacaagcaggatgtgtacctgctgcccaagaagatggatgaatatgtggccagcctgcacctgcccacctttgatgcccacctgacagagctgacagatgagcaggccaagtacctgggcctgaacaagaatggccccttcaagcccaactactaccgctactag

SEQ ID NO: 35281 - DNA, 1593 bp, Artificial Sequence
  Description of Artificial Sequence: Synthetic coding sequence
atgtacttcctgtgcttcttctgcctgtttgtgtctggcaggaagtggagccggcagttcctgctgtccttctggtgcaccgtgtgcagcgcccaccagggcaccatcttcctgagcctgaagatccagtttgctgaccagaagcaggagttcaacaagaggcccaccaagattggccgccgcagcctgagccgcagcatcagccagagcagcacagacagctacagcagcgctgccagctacacagacagcagtgatgatgagaccagcccccgggacaagcagcagaagaacagcaagggcagcagtgacttctgtgtgaagaacatcaagcaggccgagtttggaagaagagaaattgaaattgctgagcaggagatgcctgccctgatggccctgaggaagagggcccagggcgagaagcccctggccggggccaagatcgtgggctgcacccacatcacagcccagacagctgtgctgatggagaccctgggcgccctgggcgcccagtgccgctgggccgcctgcaacatctacagcaccctgaatgaggtggccgccgccctggccgagagcggcttccctgtgtttgcctggaagggggagagtgaagatgacttctggtggtgcatcgacagatgtgtgaatgtggagggctggcagcccaacatgatcctggatgatggaggagacctgacccactggatctacaagaagtaccccaacatgttcaagaagatcaagggcatcgtggaggagagcgtgactggagtgcaccggctgtaccagctgagcaaggccggcaagctgtgtgtgcctgccatgaatgtgaatgattctgtgaccaagcagaagtttgacaacctgtactgctgccgggagagcatcctggatggcctgaagaggaccacagacatgatgtttggaggcaagcaggtggtggtgtgtggctatggagaggtgggcaagggctgctgtgccgccctgaaggccatgggcagcatcgtgtatgtgacagaaattgaccccatctgtgccctgcaggcctgcatggatggcttccggctggtgaagctgaatgaagtcatccggcaggtggacatcgtcatcacctgcaccggcaacaagaatgtggtgacccgggagcacctggacaggatgaagaacagctgcatcgtgtgcaacatgggccacagcaacacagaaattgatgtggccagcctgcggaccccagagctgacctgggagcgggtgcgcagccaggtggaccacgtgatctggccagatggcaagagaattgtgctgctggccgagggccgcctgctgaacctgagctgcagcacagtgcccacctttgtgctgagcatcacagccaccacccaggccctggccctgattgagctgtacaatgcccctgagggccgctacaagcaggatgtgtacctgctgcccaagaagatggatgaatatgtggccagcctgcacctgcccacctttgatgcccacctgacagagctgacagatgagcaggccaagtacctgggcctgaacaagaatggccccttcaagcccaactactaccgctactag

SEQ ID NO: 35282 - DNA, 1527 bp, Artificial Sequence
  Description of Artificial Sequence: Synthetic coding sequence
atgctgggcagcaagaagaagtacatcgtgaatggaaacagcggcatcaaggcccagatccagtttgctgaccagaagcaggagttcaacaagaggcccaccaagattggccgccgcagcctgagccgcagcatcagccagagcagcacagacagctacagcagcgctgccagctacacagacagcagtgatgatgagaccagcccccgggacaagcagcagaagaacagcaagggcagcagtgacttctgtgtgaagaacatcaagcaggccgagtttggaagaagagaaattgaaattgctgagcaggagatgcctgccctgatggccctgaggaagagggcccagggcgagaagcccctggccggggccaagatcgtgggctgcacccacatcacagcccagacagctgtgctgatggagaccctgggcgccctgggcgcccagtgccgctgggccgcctgcaacatctacagcaccctgaatgaggtggccgccgccctggccgagagcggcttccctgtgtttgcctggaagggggagagtgaagatgacttctggtggtgcatcgacagatgtgtgaatgtggagggctggcagcccaacatgatcctggatgatggaggagacctgacccactggatctacaagaagtaccccaacatgttcaagaagatcaagggcatcgtggaggagagcgtgactggagtgcaccggctgtaccagctgagcaaggccggcaagctgtgtgtgcctgccatgaatgtgaatgattctgtgaccaagcagaagtttgacaacctgtactgctgccgggagagcatcctggatggcctgaagaggaccacagacatgatgtttggaggcaagcaggtggtggtgtgtggctatggagaggtgggcaagggctgctgtgccgccctgaaggccatgggcagcatcgtgtatgtgacagaaattgaccccatctgtgccctgcaggcctgcatggatggcttccggctggtgaagctgaatgaagtcatccggcaggtggacatcgtcatcacctgcaccggcaacaagaatgtggtgacccgggagcacctggacaggatgaagaacagctgcatcgtgtgcaacatgggccacagcaacacagaaattgatgtggccagcctgcggaccccagagctgacctgggagcgggtgcgcagccaggtggaccacgtgatctggccagatggcaagagaattgtgctgctggccgagggccgcctgctgaacctgagctgcagcacagtgcccacctttgtgctgagcatcacagccaccacccaggccctggccctgattgagctgtacaatgcccctgagggccgctacaagcaggatgtgtacctgctgcccaagaagatggatgaatatgtggccagcctgcacctgcccacctttgatgcccacctgacagagctgacagatgagcaggccaagtacctgggcctgaacaagaatggccccttcaagcccaactactaccgctactag

SEQ ID NO: 35283 - DNA, 1266 bp, Artificial Sequence
  Description of Artificial Sequence: Synthetic coding sequence
atgaccagccaggagaagacagaggagtacccctttgctgacatctttgatgaagatgaaacagaaagaaacttcctgctgagcaagcctgtgtgctttgtggtgtttgggaagccaggagtgggcaagaccaccctggcccgctacatcacccaggcctggaagtgcatccgggtggaggccctgcccatcctggaggagcagattgctgctgagacagaaagtggagtgatgctgcagagcatgctgatcagcggccagagcatcccagatgagctggtgatcaagctgatgctggagaagctgaacagccctgaggtgtgccacttcggctacatcatcacagagatccccagcctgagccaggatgccatgaccaccctgcagcagatcgagctgatcaagaacctgaacctgaagccagatgtgatcatcaacatcaagtgcccagactatgacctgtgccagaggatcagcggccagaggcagcacaacaacacaggctacatctacagccgggaccagtgggaccctgaggtgattgagaaccacaggaagaagaagaaggaggcccagaaggatggcaagggggaggaggaggaggaggaggaggagcaggaggaggaggaggccttcatcgccgagatgcagatggtggccgagatcctgcaccacctggtgcagaggcctgaggactacctggagaatgtggagaacatcgtgaagctgtacaaggagaccatcctgcagaccctggaggaggtgatggccgagcacaacccccagtacctgattgagctgaatggaaacaagccagctgaggagctgttcatgattgtgatggaccggctgaagtacctgaacctgaagagagctgccatcctgaccaagctgcagggcgctgaggaggagatcaatgacaccatggagaatgatgagctgttccgcaccctggccagctacaagctgattgccccccgctaccgctggcagaggagcaagtggggccgcacctgccctgtgaacctgaaggatggcaacatctacagcggcctgcctgactacagcgtgtccttcctgggcaagatctactgcctgagcagcgaggaggccctgaagcccttcctgctgaacccccggccctacctgctgccccccatgcctggccccccctgcaaggtgttcatcctgggcccccagtacagcggcaagaccaccctgtgcaacatgctggccgagaactacaagggcaaggtgaccaactag

SEQ ID NO: 35284 - DNA, 1089 bp, Artificial Sequence
  Description of Artificial Sequence: Synthetic coding sequence
atgaaggagaggaagaggcacctgggggacaccaagcacttctgccctgtggtgctgaaggagaacttcatcctgcagcccggcaacacagaggaggccgccaagtaccgggagaagatctactacttcagcagcgctgaggccaaggagaagttcctggagcacccagaagattatgtggcccacgaggagcccctgaaggccccacccctgcgcatctgcctggtgggcccccagggcagcggcaagaccatgtgtggccggcagctggccgagaagctgaacatcttccacatccagtttgaggaggtgctgcaggagaagctgctgctgaagacagagaagaaggtgggccctgagtttgaagaagattctgaaaatgagcaggccgccaagcaggagctggaggagctggccatccaggccaacgtgaaggtggaggaggagaacaccaagaagcagctgcctgaggtgcagctgacagaggaggaggaggtgatcaagagcagcctgatggagaatgagcccctgcccccagagatcctggaggtgatcctgtctgagtggtggctgaaggagcccatccgcagcacaggcttcatcctggatggcttcccccgctacccagaggaggcccagttcctgggggaccggggcttcttcccagatgctgctgtgttcatccaggtggatgaccaggacatctttgaccggctgctgcctgcccagatcgagaagtggaagctgaagcagaagaagaagctggagaggaagaagctgatcaaggacatgaaggccaagatccgggtggacaccatcgccaagagaagagctgagctgatcctggagcgggacaagaagaggcgggagcccaacaaggagaagaggaagaggggcatcagcgagaacaccacctgctacaagtgcaaccacatgagcccctggtgtgaatatgccggcctgccctaccggggcctgctgatcctgtacagcgccacagccacagccacagctggcaccaagcactgccgcagcggggccaaggtgattgtggccctgagcaagcagaacatccacaaccagaagtag

SEQ ID NO: 35285 - DNA, 2211 bp, Artificial Sequence
  Description of Artificial Sequence: Synthetic coding sequence
atgaccagccaggagaagacagaggagtacccctttgctgacatctttgatgaagatgaaacagaaagaaacttcctgctgagcaagcctgtgtgctttgtggtgtttgggaagccaggagtgggcaagaccaccctggcccgctacatcacccaggcctggaagtgcatccgggtggaggccctgcccatcctggaggagcagattgctgctgagacagaaagtggagtgatgctgcagagcatgctgatcagcggccagagcatcccagatgagctggtgatcaagctgatgctggagaagctgaacagccctgaggtgtgccacttcggctacatcatcacagagatccccagcctgagccaggatgccatgaccaccctgcagcagatcgagctgatcaagaacctgaacctgaagccagatgtgatcatcaacatcaagtgcccagactatgacctgtgccagaggatcagcggccagaggcagcacaacaacacaggctacatctacagccgggaccagtgggaccctgaggtgattgagaaccacaggaagaagaagaaggaggcccagaaggatggcaagggggaggaggaggaggaggaggaggagcaggaggaggaggaggccttcatcgccgagatgcagatggtggccgagatcctgcaccacctggtgcagaggcctgaggactacctggagaatgtggagaacatcgtgaagctgtacaaggagaccatcctgcagaccctggaggaggtgatggccgagcacaacccccagtacctgattgagctgaatggaaacaagccagctgaggagctgttcatgattgtgatggaccggctgaagtacctgaacctgaagagagctgccatcctgaccaagctgcagggcgctgaggaggagatcaatgacaccatggagaatgatgagctgttccgcaccctggccagctacaagctgattgccccccgctaccgctggcagaggagcaagtggggccgcacctgccctgtgaacctgaaggatggcaacatctacagcggcctgcctgactacagcgtgtccttcctgggcaagatctactgcctgagcagcgaggaggccctgaagcccttcctgctgaacccccggccctacctgctgccccccatgcctggccccccctgcaaggtgttcatcctgggcccccagtacagcggcaagaccaccctgtgcaacatgctggccgagaactacaagggcaaggtggtggactatgcccagctggtgcagcccaggtttgacaaggcccgggagaccctggtggagaacaccatcgccgaggccacagctgctgccatcaaggtggtgaaggagaagctgctgcgggagctgcaggccaggaagcaggccgagacagccctgcgggagttccagaggcagtatgagaagatggagtttggagtcttccccatggaggccacccacagcagcattgatgaggagggctacatccagggcagccagagggaccggggcagcagcctggtggacacagaggaggccaagaccaagtcagaaaatgtgctgcatgaccaggccgccaaggtggacaaggatgatggcaaggagactggagagaccttcaccttcaagaggcacagccaggatgccagccaggatgtgaagctgtacagcgacacagcccccacagaggacctgattgaggaggtgacagctgaccaccctgaggtggtgaccatgattgaggagaccatcaagatgagccaggacatcaactttgagcagccctatgagaagcatgctgagatcctgcaggaggtgctgggggaggtgatggaggagaacaaggaccgcttccctggggcccccaagtatggaggctggatcgtggacaactgccccatcgtgaaggagctgtggatggccctgatcaagaagggcatcatcccagacctggtgatctacctgagtgacacagagaacaacgggaagtgcctcttcaaccgcatctacctgcagaagaagtcagaaattgacagcaagatcctggagcggctgctggaggagctgcagaagaagaagaaggaggaggaggaggccaggaaggccacagaggaggagctgcggctggaggaggagaacagaaggctgctggagctgatgaaggtgaaggccaagggcaagcaccggctgctgtag

SEQ ID NO: 35286 - DNA, 5736 bp, Artificial Sequence
  Description of Artificial Sequence: Synthetic coding sequence
atgaccagccaggagaagacagaggagtacccctttgctgacatctttgatgaagatgaaacagaaagaaacttcctgctgagcaagcctgtgtgctttgtggtgtttgggaagccaggagtgggcaagaccaccctggcccgctacatcacccaggcctggaagtgcatccgggtggaggccctgcccatcctggaggagcagattgctgctgagacagaaagtggagtgatgctgcagagcatgctgatcagcggccagagcatcccagatgagctggtgatcaagctgatgctggagaagctgaacagccctgaggtgtgccacttcggctacatcatcacagagatccccagcctgagccaggatgccatgaccaccctgcagcagatcgagctgatcaagaacctgaacctgaagccagatgtgatcatcaacatcaagtgcccagactatgacctgtgccagaggatcagcggccagaggcagcacaacaacacaggctacatctacagccgggaccagtgggaccctgaggtgattgagaaccacaggaagaagaagaaggaggcccagaaggatggcaagggggaggaggaggaggaggaggaggagcaggaggaggaggaggccttcatcgccgagatgcagatggtggccgagatcctgcaccacctggtgcagaggcctgaggactacctggagaatgtggagaacatcgtgaagctgtacaaggagaccatcctgcagaccctggaggaggtgatggccgagcacaacccccagtacctgattgagctgaatggaaacaagccagctgaggagctgttcatgattgtgatggaccggctgaagtacctgaacctgaagagagctgccatcctgaccaagctgcagggcgctgaggaggagatcaatgacaccatggagaatgatgagctgttccgcaccctggccagctacaagctgattgccccccgctaccgctggcagaggagcaagtggggccgcacctgccctgtgaacctgaaggatggcaacatctacagcggcctgcctgactacagcgtgtccttcctgggcaagatctactgcctgagcagcgaggaggccctgaagcccttcctgctgaacccccggccctacctgctgccccccatgcctggccccccctgcaaggtgttcatcctgggcccccagtacagcggcaagaccaccctgtgcaacatgctggccgagaactacaagggcaaggtggtggactatgcccagctggtgcagcccaggtttgacaaggcccgggagaccctggtggagaacaccatcgccgaggccacagctgctgccatcaaggtggtgaaggagaagctgctgcgggagctgcaggccaggaagcaggccgagacagccctgcgggagttccagaggcagtatgagaagatggagtttggagtcttccccatggaggccacccacagcagcattgatgaggagggctacatccagggcagccagagggaccggggcagcagcctggtggacacagaggaggccaagaccaagtcagaaaatgtgctgcatgaccaggccgccaaggtggacaaggatgatggcaaggagactggagagaccttcaccttcaagaggcacagccaggatgccagccaggatgtgaagctgtacagcgacacagcccccacagaggacctgattgaggaggtgacagctgaccaccctgaggtggtgaccatgattgaggagaccatcaagatgagccaggacatcaactttgagcagccctatgagaagcatgctgagatcctgcaggaggtgctgggggaggtgatggaggagaacaaggaccgcttccctggggcccccaagtatggaggctggatcgtggacaactgccccatcgtgaaggagctgtggatggccctgatcaagaagggcatcatcccagacctggtgatctacctgagtgacacagagaacaacgggaagtgcctcttcaaccgcatctacctgcagaagaagtcagaaattgacagcaagatcctggagcggctgctggaggagctgcagaagaagaagaaggaggaggaggaggccaggaaggccacagaggaggagctgcggctggaggaggagaacagaaggctgctggagctgatgaaggtgaaggccaaggaggccgaggagacagacaatgaagatgaggaggagattgaaggagatgagctggaggtgcatgaggagcctgaggccagccatgacacccggggctcctggctgcctgaggagtttgaggccagcgaggtgcctgagacagagcctgaggccgtgtctgagcccatcgaggagaccaccgtggagacagagatccccaagggcagcaaggagggcctggagattgagaagctgtctgaaacagtggtgctgcctgagttcccagaagattcctacccagatgtgcctgagatggagcccttcaaggagaagattggcagcttcatcatcctgtggaagcagctggaggccaccatcagcgaggcctacatcaagatcctgaacctggagattgctgacaggaccccccaggagctgctgcagaaggtggtggagaccatggagaagcccttccagtacacagcctgggagctgactggagaagattatgaggaggagacagaggactaccagacagaggccgaggtggatgaggagctggaggaggaggaggaggaggagggggaggacaagatgaaggagaggaagaggcacctgggggacaccaagcacttctgccctgtggtgctgaaggagaacttcatcctgcagcccggcaacacagaggaggccgccaagtaccgggagaagatctactacttcagcagcgctgaggccaaggagaagttcctggagcaccctgaggactatgtggcccacgaggagcccctgaaggccccacccctgcgcatctgcctggtgggcccccagggcagcggcaagaccatgtgtggccggcagctggccgagaagctgaacatcttccacatccagtttgaggaggtgctgcaggagaagctgctgctgaagacagagaagaaggtgggccctgagtttgaggaggacagtgaaaatgagcaggccgccaagcaggagctggaggagctggccatccaggccaacgtgaaggtggaggaggagaacaccaagaagcagctgcctgaggtgcagctgacagaggaggaggaggtgatcaagagcagcctgatggagaatgagcccctgcccccagagatcctggaggtgatcctgtctgagtggtggctgaaggagcccatccgcagcacaggcttcatcctggatggcttcccccgctacccagaggaggcccagttcctgggggaccggggcttcttcccagatgctgctgtgttcatccaggtggatgaccaggacatctttgaccggctgctgcctgcccagatcgagaagtggaagctgaagcagaagaagaagctggagaggaagaagctgatcaaggacatgaaggccaagatccgggtggacaccatcgccaagagaagagctgagctgatcctggagcgggacaagaagagaagagaaaatgtggtgagagatgatgaggagatcagcgaggaggagctggaggaggacaatgatgacatcgagaacatcctggaggatgagttccccaaggatgaggaggagatgtctggagaagaagatgaggagcaggagacagatgccatcgagcggctgcggggggagctgggggagaagtttgaagctgacacccacaacctgcagatcatccaggatgagctggagcgctacctgatccccatcatcagcatcaacggggcccggaggaaccacatcgtgcagtacaccctgaacatgaagctgaagcccctggtggagaacagagccagcatctttgagaagtgccaccccatcccagcccccctggcccagaagatgctgaccttcacctacaagtacatcagcagctttggctactgggaccctgtgaagctgtctgagggggagaccatcaagcctgtggagaatgctgagaaccccatctaccctgtgatccaccggcagtacatctacttcctgagcagcaaggagaccaaggagaagttcatgaagaaccccatcaagtacatccggcagcccaagcccaagcccaccgtgcccatccgcatcatcatcgtgggcccccccaagagcggcaagaccaccgtggccaagaagatcaccagtgaatatggcctgaagcacctgagcatcggcggggccctgcgctacgtgctgaacaaccaccctgagacagagctggccctgatgctgaactggcacctgcacaagggcatgacagccccagatgagctggccatccaggccctggagctgagcctgatggagagcgtgtgcaacacagctggggtggtgattgatggctaccctgtgaccaagcaccagatgaacctgctggaggcccggagcatcatccccatggtgatctttgagctgtctgtgcccagcaaggagatcttcaagaggctgctgctggagaaggaaaatgagcagaggctgccctaccccctgcacaacagcgcccagatcgtggccgtgaacaacgtgaagtacaggaagaacatcggggagatccggcagtactaccaggagcagcaccagaactggtacgtgattgatggcttccacagcaagtggtgggtgtggaatgaggtgatcaagaatgtgcagatggtgaacaagtacatgcagacctacctggagcgcatcaaggccggcaaggccgcctgcatcgacaagctgtgcatcaccccccaggagctgctgagccggctgggggagtttgagcagttctgccctgtgtccctggccgagagccaggagctgtttgactgcagcgccacagacagcctggagtttgctgctgagttccggggccactactacaagatgagcagccaggagaagctgaacaagttcctggagaaccctgagctgtatgtgccccccctggccccccaccccctgcccagcgctgacatgatccccaagaggctgaccctgtctgagctgaagagccgcttccccaagtgtgccgagctgcagggctactgccctgtgacctacaaggatggcaaccagagatatgaggccctggtgcccggcagcatcaactatgccctggagtaccacaaccgcatctacatctgtgagaacaaggagaagctgcagaagttcctgcggagccccctgaagtactgggagcagaagctgccccacaagctgccccccctgcgggagcccatcctgctgaccagcctgcccctgcccggctacctggagcagggcatcgccaccagcctcatcaaggccatgaatgctgctggctgcctgaagcccaagttccccttcctgagcatccgccgcagcgccctgctgtacatcgccctgcacctgaaggccttcaaccccaagggcagcgagtacaccaggaagaagtacaagaagaagatggagcagttcatggagagctgtgagctgatcacctacctgggcgccaagatgaccaggaagtacaaggagccccagttccgggccatcgactttgaccacaagctgaagaccttcctgagcctgaggaacatcgaccccatcaatggatag

SEQ ID NO: 35287 - DNA, 684 bp, Artificial Sequence
  Description of Artificial Sequence: Synthetic coding sequence
atgctgcagagcatgctgatcagcggccagagcatcccagatgagctggtgatcaagctgatgctggagaagctgaacagccctgaggtgtgccacttcggctacatcatcacagagatccccagcctgagccaggatgccatgaccaccctgcagcagatcgagctgatcaagaacctgaacctgaagccagatgtgatcatcaacatcaagtgcccagactatgacctgtgccagaggatcagcggccagaggcagcacaacaacacaggctacatctacagccgggaccagtgggaccctgaggtgattgagaaccacaggaagaagaagaaggaggcccagaaggatggaaaaggagaggaggaggaggaggaggaggagcaggaggaggaggaggccttcatcgccgagatgcagatggtggccgagatcctgcaccacctggtgcagaggcctgaggactacctggagaatgtggagaacatcgtgaagctgtacaaggagaccatcctgcagaccctggaggaggtgatggccgagcacaacccccagtacctgattgagctgaatggaaacaagccagctgaggagctgttcatgattgtgatggaccggctgaagtacctgaacctgaagagagctgccatcctgaccaagctgcagggcgctgaggaggagtag

SEQ ID NO: 35288 - DNA, 1074 bp, Artificial Sequence
  Description of Artificial Sequence: Synthetic coding sequence
atggagaagtatgtggccgccatggtgctgtctgctgctggagatgccctgggctactacaacgggaagtgggagttcctgcaggatggagagaagatccaccggcagctggcccagctgggcggcctggatgccctggatgtgggccgctggagggtgtctgatgacacagtgatgcacctggccacagctgaggccctggtggaggccggcaaggcccccaagctgacccagctgtactacctgctggccaagcactaccaggactgcatggaggacatggatggccgggcccctggaggagcctctgtgcacaatgccatgcagctgaagccaggcaagcccaacggctggaggatccccttcaacagccatgaaggaggctgtggggccgccatgagggccatgtgcatcggcctgcgcttcccccaccacagccagctggacaccctcatccaggtgtccattgagagcggccgcatgacccaccaccaccccaccggctacctgggcgccctggccagcgccctcttcaccgcctatgctgtgaacagcaggcctcccctgcagtggggcaagggcctgatggagctgctgcctgaggccaagaagtacatcgtgcagagcggctactttgtggaggagaacctgcagcactggagctacttccagaccaagtgggagaactacctgaagctgcggggcatcctggatggagagagcgcccccaccttccctgagagctttggagtgaaggagcgggaccagttctacaccagcctgagctacagcggctggggcggcagcagcggccatgatgcccccatgattgcctatgatgctgtgctggccgccggggacagctggaaggagctggcccaccgggccttcttccatggaggagacagcgacagcacagctgccatcgccggctgctggtggggcgtgatgtatggcttcaagggcgtgagccccagcaactatgagaagctggagtacagaaaccggctggaggagacagcccgggccctgtacagcctgggcagcaaagaagatactgtcatcagcctgtag

SEQ ID NO: 35289 - DNA, 1074 bp, Artificial Sequence; identical to SEQ ID NO: 35288
  Description of Artificial Sequence: Synthetic coding sequence

SEQ ID NO: 35290 - DNA, 1074 bp, Artificial Sequence; identical to SEQ ID NO: 35288
  Description of Artificial Sequence: Synthetic coding sequence

SEQ ID NO: 35291 - DNA, 1074 bp, Artificial Sequence; identical to SEQ ID NO: 35288
  Description of Artificial Sequence: Synthetic coding sequence

SEQ ID NO: 35292 - DNA, 378 bp, Artificial Sequence
  Description of Artificial Sequence: Synthetic coding sequence
atggagaagtatgtggccgccatggtgctgtctgctgctggagatgccctgggctactacaacgggaagtgggagttcctgcaggatggagagaagatccaccggcagctggcccagctgggcggcctggatgccctggatgtgggccgctggagggtgtctgatgacacagtgatgcacctggccacagctgaggccctggtggaggccggcaaggcccccaagctgacccagctgtactacctgctggccaagcactaccaggactgcatggaggacatggatggccgggcccctggaggagcctctgtgcacaatgccatgcagctgaagccaggcaagcccaacggctggaggatccccttcaacagccactag

SEQ ID NO: 35293 - DNA, 735 bp, Artificial Sequence
  Description of Artificial Sequence: Synthetic coding sequence
atggccccccggcccctgggccccctggtgctggccctgggcggcgctgctgctgtgctgggctctgtgctcttcatcctgtggaagacctacttcggccggggccgggagcggcgctgggacagaggagaggcctggtggggcgctgaggccgcccggctgcctgagtgggatgagtgggaccctgaagatgaggaggatgaggagcccgccctggaggagctggagcagcgggaggtgctggtgctgggcctggatggagctgggaagagcaccttcctgcgggtgctgagcggcaagccacccctggagggccacatccccacctggggcttcaacagcgtgcggctgcccaccaaggactttgaggtggacctgctggagattggaggcagccagaacctgcgcttctactggaaggagtttgtgtctgaggtggatgtgctggtgtttgtggtggacagcgctgaccggctgcggctgccctgggcccggcaggagctgcacaagctgctggacaaggaccctgacctgcctgtggtggtggtggccaacaagcaggacctgtctgaggccatgtccatgggagagctgcagcgggagctgggcctgcaggccatcgacaaccagcgggaggtgttcctgctggccgccagcatcgccccagctggccccacctttgaggagcccggcaccgtgcacatctggaagctgctgctggagctgctgtcctag

SEQ ID NO: 35294 - DNA, 771 bp, Artificial Sequence
  Description of Artificial Sequence: Synthetic coding sequence
atgttccggctgctgagcagctgctgcagctgcctgcggaccacagaggagaccaggagaaatgtgaccatccccatcatcggcctgaacaacagcggcaagacagtgctggtggaggccttccagaagctgctgcccagcaagacagaccactgcatgaagtctgagctgaccaccctgctgctggatgaatatgagctgagcatctatgacctgaatggagacctgaagggccgggaggcctggcccaactactatgcccaggcccacggcctggtgtttgtgctggacagcagtgacatccggaggatgcaggaggtgaagatcatcctgacccacctgctgagtgacaagagggtggccggcaagcccatcctgatcctggccaacaagcaggacaagaagaaggccctgatgccctgtgacatcatcgactacctgctgctgaagaagctggtgaaggaaaataaatgtccctgccgggtggagccctgcagcgccatccggaacctggagaggaggaaccaccagcccatcgtggagggcctgcgctggctgctggccgtcatcgacacctgccagctgccccccaccagcagcatcagcatcagcaagaacaacacaggcagcggggagcgctgcagcagccacagcttcagcaccaggacaggcatgagcaaggagaagaggcagcacctggagcagtgcagcattgaggccaagcccctgaagagcatcctgcagcccagcaaccagagctacacccactag

SEQ ID NO: 35295 - DNA, 873 bp, Artificial Sequence
  Description of Artificial Sequence: Synthetic coding sequence
atgttccggctgctgagcagctgctgcagctgcctgcggaccacagaggagaccaggagaaatgtgaccatccccatcatcggcctgaacaacagcggcaagacagtgctggtggaggccttccagaagctgctgcccagcaagacagaccactgcatgaagtctgagctgaccaccctgctgctggatgaatatgagctgagcatctatgacctgaatggagacctgaagggccgggaggcctggcccaactactatgcccaggcccacggcctggtgtttgtgctggacagcagtgacatccggaggatgcaggaggtgaagatcatcctgacccacctgctgagtgacaagagggtggccggcaagcccatcctgatcctggccaacaagcaggacaagaagaaggccctgatgccctgtgacatcatcgactacctgctgctgaagaagctggtgaaggaaaataaatgtccctgccgggtggagccctgcagcgccatccggaacctggagaggaggaaccaccagcccatcgtggagggcctgcgctggctgctggccgtcatcgacacctgccagctgccccccaccagcagcatcagcatcagcaagaacaacacaggcagcggggagcgctgcagcagccacagcttcagcaccaggacaggcatgagcaaggagaagaggcagcacctggagcagtgcagcattgaggccaagcccctgaagagcatcctgcagaaggagggcacccggctgtggagcaagaagaacatgtctgtgacctttgccctggatgagcccatgaaggagggggagtgcagcaggaggatgagggcccagaacaccaccaagctgtgctacaactag

SEQ ID NO: 35296 - DNA, 594 bp, Artificial Sequence
  Description of Artificial Sequence: Synthetic coding sequence
atgagggtggccggcggccgggccctgagcagaggagctgagctgcgggtgcctgggggcgccaagcacggcatgtgcctgctgctgggcgccaccggggtgggcaagaccctgctggtgaagaggctgcaggaggtgagcagcagagatggcaagggggacctgggggagcccccacccacccggcccaccgtgggcaccaacctgacagacatcgtggcccagaggaagatcaccatccgggagctgggcggctgcatgggccccatctggagcagctactacggcaactgccgcagcctgctgtttgtgatggatgccagtgaccccacccagctgagcgccagctgtgtgcagctgctgggcctgctgtctgctgagcagctggccgaggcctctgtgctgatcctcttcaacaagattgacctgccctgctacatgagcacagaggagatgaagagcctcatccggctgcctgacatcatcgcctgtgccaagcagaacatcaccacagctgagatcagcgcccgggagggcaccggcctggccggcgtgctggcctggctgcaggccacccaccgggccaatgactag

SEQ ID NO: 35297 - DNA, 540 bp, Artificial Sequence
  Description of Artificial Sequence: Synthetic coding sequence
atgggccagctgattgccaagctgatgagcatcttcggcaaccaggagcacacagtcatcatcgtgggcctggacaatgaaggcaagaccaccatcctgtaccgcttcctgaccaatgaggtggtgcacatgtgccccaccatcggcagcaatgtggaggagatcatcctgcccaagacccacttcttcatgtgggacatcgtgcggcctgaggccctgtccttcatctggaacacctactacagcaacacagagttcatcatcctggtgattgacagcacagaccgggaccggctgctgaccacccgggaggagctgtacaagatgctggcccacgaggccctgcaggatgcctctgtgctgatctttgccaacaagcaggatgtgaaggacagcatgaggatggtggagatcagccacttcctgaccctgagcaccatcaaggaccacagctggcacatccagggctgctgtgccctgacccgggagggcctgcctgcccggctgcagtggatggagagccaggccgccgccaactag

SEQ ID NO: 35298 - DNA, 540 bp, Artificial Sequence; identical to SEQ ID NO: 35297
  Description of Artificial Sequence: Synthetic coding sequence

SEQ ID NO: 35299 - DNA, 3936 bp, Artificial Sequence
  Description of Artificial Sequence: Synthetic coding sequence
atggacctgtttgacttcttccgggactgggacctggagcagcagtgccactatgagcaggacagaagtgccctgaagaagcgggagtgggagaggaggaaccaggaggtgcagcaggaggatgacctcttcagcagcggctttgacctgtttggagagccctacaaggtggccgagtacaccaacaagggagatgccctggccaacagagtgcagaacaccctgggcaactatgatgagatgaagaacctgctgaccaaccacagcaaccagaaccacctggtgggcatccccaagaacagcgtgccccagaaccccaacaacaagaatgagcccagcttcttccctgagcagaagaaccgcatcatccccccccaccaggacaacacccaccccagcgcccccatgcccccacccagcgtggtgatcctgaacagcaccctcatccacagcaacaggaagagcaagccagagtggagccgggacagccacaaccccagcacagtgctggccagccaggccagcggccagcccaacaagatgcagaccctgacccaggaccagagccaggccaagctggaggacttctttgtgtacccagctgagcagccccagatcggggaggtggaggagagcaaccccagcgccaaggaggacagcaaccccaacagcagtggagaagatgccttcaaggagatcttccagagcaacagccctgaggagagcgagtttgctgtgcaggcccctggcagccccctggtggccagcagcctgctggcccccagcagcggcctgtctgtgcagaacttccccccaggcctgtactgcaagacctccatgggccagcagaagcccacagcctacgtgcggcccatggatggccaggaccaggccccagacatcagccccaccctgaagcccagcattgaatttgagaacagctttggaaacctgagctttggcaccctgctggatggcaagcccagcgctgccagcagcaagaccaagctgcccaagttcaccatcctgcagaccagcgaggtgtccctgcccagcgaccccagctgtgtggaggagatcctgcgggagatgacccacagctggcccacccccctgacctccatgcacacagctggccacagcgagcagagcaccttcagcatccctggccaggagagccagcacctgaccccaggcttcaccctgcagaagtggaatgaccccaccacccgggccagcaccaagtctgtgtccttcaagtccatgctggaggatgacctgaagctgagcagtgatgaagatgacctggagcctgtgaagaccctgaccacccagtgcacagccacagagctgtaccaggccgtggagaaggccaagcccaggaacaaccctgtgaacccccccctggccaccccccagcccccacctgctgtgcaggccagcggcggcagcggcagcagcagcgagagcgagagcagcagcgagagtgacagcgacacagagagcagcaccacagattctgagagcaatgaggccccccgggtggccaccccagagcctgagccccccagcaccaacaagtggcagctggacaagtggctgaacaaggtgaccagccagaacaagagcttcatctgtggccagaatgagacccccatggagaccatcagcctgcccccacccatcatccagcccatggaggtgcagatgaaggtgaagaccaatgccagccaggtgcctgctgagcccaaggagcggcccctgctgagcctcatccgggagaaggcccggccccggcccacccagaagatccctgagaccaaggccctgaagcacaagctgagcaccaccagcgagaccgtgtcccagaggaccatcggcaagaagcagcccaagaaggtggagaagaacaccagcacagatgagttcacctggcccaagcccaacatcaccagcagcacccccaaggagaaggagagcgtggagctgcatgaccccccccggggcaggaacaaggccacagcccacaagccagcccccaggaaggagccccggcccaacatccccctggcccctgagaagaagaagtaccggggccctgggaagatcgtgcccaagagccgggagttcattgaaacagacagcagcaccagtgacagcaacacagaccaggaggagaccctgcagatcaaggtgctgcccccctgcatcatcagcggcggcaacacagccaagagcaaggagatctgtggggccagcctgaccctgagcaccctgatgagcagcagcggcagcaacaacaacctgagcatcagcaatgaggagcccaccttcagccccatccctgtgatgcagacagagatcctgagccccctgcgggaccacgagaacctgaagaacctgtgggtgaagattgacctggacctgctgagccgggtgcccggccacagcagcctgcatgctgccccagccaagccagaccacaaggagacagccaccaagcccaagaggcagacagctgtgacagctgtggagaagccagcccccaagggcaagaggaagcacaagcccatcgaggtggccgagaagatccctgagaagaagcagaggctggaggaggccaccaccatctgcctgctgcccccctgcatcagccctgccccaccccacaagccacccaacacccgggagaacaacagcagccggcgggccaacagaaggaaggaggagaagctgttccccccacccctgagccccctgcctgaggacccccccaggagaagaaatgtgtctggcaacaacggccccttcggccaggacaagaacatcgccatgacaggccagatcaccagcaccaagcccaagaggacagagggcaagttctgtgccaccttcaagggcatctctgtgaatgaaggagacacccccaagaaggccagcagcgccaccatcaccgtgaccaacacagccatcgccacagccaccgtgacagccacagccatcgtgaccaccaccgtgacagccacagccacagccacagccaccaccaccaccaccaccaccaccatcagcaccatcaccagcaccatcaccaccggcctgatggacagcagccacctggagatgacctcctgggccgccctgcccctgctgagcagcagcagcaccaacgtgagaagacccaagctgacctttgatgacagcgtgcacaatgctgactactacatgcaggaggccaagaagctgaagcacaaggcagatgccctgtttgagaagtttgggaaggctgtgaactatgcagatgctgccctgtccttcacagaatgtggaaatgccatggagcgggaccccctggaggccaagagcccctacaccatgtacagcgagaccgtggagctgctgcgctatgccatgaggctgaagaactttgccagccccctggccagtgatggagacaagaagctggccgtgctgtgctaccgctgcctgagcctgctgtacctgaggatgttcaagctgaagaaggaccacgccatgaagtacagccgcagcctgatggagtacttcaagcagaatgccagcaaggtggcccagatccccagcccctgggtgtccaatggcaagaacacccccagccctgtgtccctgaacaacgtgagccccatcaatgccatgggcaactgcaacaacggccctgtgaccatcccccagaggatccaccacatggccgccagccacgtgaacatcaccagcaatgtgctgcggggctatgagcactgggacatggctgacaagctgacccgggagaacaaggagttcttcggggacctggacaccctgatgggccccctgacccagcacagctccatgaccaacctggtgcgctacgtgcggcagggcctgtgctggctgagaattgatgcccacctgctgtag

SEQ ID NO: 35300 - DNA, 3831 bp, Artificial Sequence
  Description of Artificial Sequence: Synthetic coding sequence
atggacctgtttgacttcttccgggactgggacctggagcagcagtgccactatgagcaggacagaagtgccctgaagaagcgggagtgggagaggaggaaccaggaggtgcagcaggaggatgacctcttcagcagcggctttgacctgtttggagagccctacaagaccaacaagggagatgccctggccaacagagtgcagaacaccctgggcaactatgatgagatgaagaacctgctgaccaaccacagcaaccagaaccacctggtgggcatccccaagaacagcgtgccccagaaccccaacaacaagaatgagcccagcttcttccctgagcagaagaaccgcatcatccccccccaccaggacaacacccaccccagcgcccccatgcccccacccagcgtggtgatcctgaacagcaccctcatccacagcaacaggaagagcaagccagagtggagccgggacagccacaaccccagcacagtgctggccagccaggccagcggccagcccaacaagatgcagaccctgacccaggaccagagccaggccaagctggaggacttctttgtgtacccagctgagcagccccagatcggggaggtggaggagagcaaccccagcgccaaggaggacagcaaccccaacagcagtggagaagatgccttcaaggagatcttccagagcaacagccctgaggagagcgagtttgctgtgcaggcccctggcagccccctggtggccagcagcctgctggcccccagcagcggcctgtctgtgcagaacttccccccaggcctgtactgcaagacctccatgggccagcagaagcccacagcctacgtgcggcccatggatggccaggaccaggccccagacatcagccccaccctgaagcccagcattgaatttgagaacagctttggaaacctgagctttggcaccctgctggatggcaagcccagcgctgccagcagcaagaccaagctgcccaagttcaccatcctgcagaccagcgaggtgtccctgcccagcgaccccagctgtgtggaggagatcctgcgggagagccagcacctgaccccaggcttcaccctgcagaagtggaatgaccccaccacccgggccagcaccaagtctgtgtccttcaagtccatgctggaggatgacctgaagctgagcagtgatgaagatgacctggagcctgtgaagaccctgaccacccagtgcacagccacagagctgtaccaggccgtggagaaggccaagcccaggaacaaccctgtgaacccccccctggccaccccccagcccccacctgctgtgcaggccagcggcggcagcggcagcagcagcgagagcgagagcagcagcgagagtgacagcgacacagagagcagcaccacagacagcgagagcaatgaggccccccgggtggccaccccagagcctgagccccccagcaccaacaagtggcagctggacaagtggctgaacaaggtgaccagccagaacaagagcttcatctgtggccagaatgagacccccatggagaccatcagcctgcccccacccatcatccagcccatggaggtgcagatgaaggtgaagaccaatgccagccaggtgcctgctgagcccaaggagcggcccctgctgagcctcatccgggagaaggcccggccccggcccacccagaagatccctgagaccaaggccctgaagcacaagctgagcaccaccagcgagaccgtgtcccagaggaccatcggcaagaagcagcccaagaaggtggagaagaacaccagcacagatgagttcacctggcccaagcccaacatcaccagcagcacccccaaggagaaggagagcgtggagctgcatgaccccccccggggcaggaacaaggccacagcccacaagccagcccccaggaaggagccccggcccaacatccccctggcccctgagaagaagaagtaccggggccctgggaagatcgtgcccaagagccgggagttcatcgagacagacagcagcaccagtgacagcaacacagaccaggaggagaccctgcagatcaaggtgctgcccccctgcatcatcagcggcggcaacacagccaagagcaaggagatctgtggggccagcctgaccctgagcaccctgatgagcagcagcggcagcaacaacaacctgagcatcagcaatgaggagcccaccttcagccccatccctgtgatgcagacagagatcctgagccccctgcgggaccacgagaacctgaagaacctgtgggtgaagattgacctggacctgctgagccgggtgcccggccacagcagcctgcacgccgccccagccaagccagaccacaaggagacagccaccaagcccaagaggcagacagctgtgacagctgtggagaagccagcccccaagggcaagaggaagcacaagcccatcgaggtggccgagaagatccctgagaagaagcagaggctggaggaggccaccaccatctgcctgctgcccccctgcatcagccctgccccaccccacaagccacccaacacccgggagaacaacagcagcagaagagccaacagaaggaaggaggagaagctgtttcctccacccctgagccccctgcctgaagatcctccaagaagaagaaatgtgtctggcaacaacggccccttcggccaggacaagaacatcgccatgacaggccagatcaccagcaccaagcccaagaggacagagggcaagttctgtgccaccttcaagggcatcagcgagggggacacccccaagaaggccagcagcgccaccatcaccgtgaccaacacagccatcgccacagccaccgtgacagccacagccatcgtgaccaccaccgtgacagccacagccacagccacagccaccaccaccaccaccaccaccaccatcagcaccatcaccagcaccatcaccaccggcctgatggacagcagccacctggagatgacctcctgggccgccctgcccctgctgagcagcagcagcaccaacgtgcggcggcccaagctgacctttgatgattctgtgcacaatgctgactactacatgcaggaggccaagaagctgaagcacaaggcagatgccctgtttgagaagtttgggaaggctgtgaactatgcagatgctgccctgtccttcacagaatgtggaaatgccatggagcgggaccccctggaggccaagagcccctacaccatgtacagcgagaccgtggagctgctgcgctatgccatgaggctgaagaactttgccagccccctggccagtgatggagacaagaagctggccgtgctgtgctaccgctgcctgagcctgctgtacctgaggatgttcaagctgaagaaggaccacgccatgaagtacagccgcagcctgatggagtacttcaagcagaatgccagcaaggtggcccagatccccagcccctgggtgtccaatggcaagaacacccccagccctgtgtccctgaacaacgtgagccccatcaatgccatgggcaactgcaacaatggacctgtgaccatcccccagaggatccaccacatggccgccagccacgtgaacatcaccagcaatgtgctgcggggctatgagcactgggacatggctgacaagctgacccgggagaacaaggagttctttggagacctggacaccctgatgggccccctgacccagcacagctccatgaccaacctggtgcgctacgtgcggcagggcctgtgctggctgagaattgatgcccacctgctgtag

SEQ ID NO: 35301 - DNA, 1332 bp, Artificial Sequence
  Description of Artificial Sequence: Synthetic coding sequence
atgacccggcccaggaagcacgccgagaccctgggcggcggcaagctgtgtgacctcttctgtggccggcccggccaggtgagcagcagccggggccggcagggcatcccagacatggagcccatcgtgcacatccaccaggagctgctgactggaattgaaagtgaggccagcctgagcaagctgagccccaccagccagaagggcaccagcagcagcagcagctacatcttccagaagatcagccagggcaagcagatgtgccagaagctgaaggagcagacagaccagctgaagaccaaggtgcaggagttcagcaagaggatcaagcaggacagcccctaccacctgcaggacaagaagctggtgctggagaagctgcagggccacctggagctgctggagcagaacttcctggccaccaaggacaagcacctgaccctgcagcagcaggtgcacaagcatgagagcaccatcgtgggggactttgatcctgagaggaaggtggagggggagatcttcaagctggagatgctgctggaggatgtgaaggagaagatggatgagagcaagtacaccagcgcccccagcctgcctgtgagcagccctgtgaccctggatgacctggccagcaccttcagcagcctgagcaatgagatccccaaggagcaccctggccaccccagcggcccccggggcagcggcggcagcgaggtgacaggcaccccccagggcggcccccaggaggccccaaatgaggagctgtgtgagctggccccccagacctacctgaatggccactatggagatgctgctgcccagaacaagccagaccaggtggccatgaggctgagcagcaacagcggggaggaccccaacggcaccccccggcggcaggactgtgccgagatgacagcccccagccccagctgtgccttctgccggcggctgctggagtggaagcagaatgtggagaagaagggccacggccgcatcaactgtggccgcttcagcatcgtgctgcacgagaaggccccccacagcgacagcacccccaacagcgacaccggccacagcttctgcagcgacagcggcacagagatgcagagcaacaagtgccaggactgtggcaccaagatccccaccagccggcgggcctgcaggaaggagcccaccaaggagttccactaccgctacaacaccccaggccagaactacagcaaccacagcaagagaggagcctttgtgcagccccacagcctggatgagagcaagaacagcagcccctgcaagtacatcagctgcatgacccccagcatcagcaccacctag

SEQ ID NO: 35302 - DNA, 2169 bp, Artificial Sequence
  Description of Artificial Sequence: Synthetic coding sequence
atggatgaggccgacttcagcgagcacaccacctacaagcaggaggacctgccctatgatggagacctgagccagatcaagattggaaatgactacagcttcaccagcaagaaggatggcctggaggtgctgaaccagatcatcttcatcgcagatgacccccaggagaaggccatgcacagcgagacctgtggcaacacagctgtgaccatccccctgggcaagatcacagaaaatgctgccaacaagaaggatgagaaggagaagcagtgcacagctgccctgcacatcccagccaatgaaggagatgccagcaagagcagcatcagtgacatcctgctgcaccacctgagcaaggagcccttcctgcggggccagggcatcgactgtgagaccctgcctgagatcagcaatgctgacagctttgaggaggaggccatcatcaagagcatcatcagctgctacaacaagaacagctggcccaaggagcagaccccagagctgacagaccagctgaaccccaagagagatggagagaacagcaacaagccaggcagcgccaccaccacagaggagaacaccagtgacctggagggccctgtggccgccggggacagcagccaccaggagaatgtgaatgtgctgaccaagaccaagggccctggggacaagcagaagagctaccagggccagagcccccagaagcagcagacagagaaggccaacagcggcaacaccttcaagtatggccagggccaggtgcactaccagctgcctgacttcagcaagatcgcccccaaggtgaagatccccaagaacaagatcatcaacaagcccctggccatcgccaagcaggccagcttcagcagcaagagccgggacaagcccaccctggtgcaggacagcctggagaccaccccagagagcaactgtgtggagaagcagcaccaggagcagaagggcaagatcacagagcccagccagcagatccagatggagcccatcgtgcacatccaccaggagctgctgaccggcatcgagagcgaggccagcctgagcaagctgagccccaccagccagaagggcaccagcagcagcagcagctacatcttccagaagatcagccagggcaagcagatgtgccagaagctgaaggagcagacagaccagctgaagaccaaggtgcaggagttcagcaagaggatcaagcaggacagcccctaccacctgcaggacaagaagctggtgctggagaagctgcagggccacctggagctgctggagcagaacttcctggccaccaaggacaagcacctgaccctgcagcagcaggtgcacaagcatgagagcaccatcgtgggggactttgatcctgagaggaaggtggagggggagatcttcaagctggagatgctgctggaggatgtgaaggagaagatggatgagagcaagtacaccagcgcccccagcctgcctgtgagcagccctgtgaccctggatgacctggccagcaccttcagcagcctgagcaatgaggccccaaatgaggagctgtgtgagctggccccccagacctacctgaatggccactatggagatgctgctgcccagaacaagccagaccaggtggccatgaggctgagcagcaacagcggggaggaccccaacggcaccccccggcggcaggactgtgccgagatgacagcccccagccccagctgtgccttctgccggcggctgctggagtggaagcagaatgtggagaagaagggccacggccgcatcaactgtggccgcttcagcatcgtgctgcacgagaaggccccccacagcgacagcacccccaacagcgacaccggccacagcttctgcagcgacagcggcacagagatgcagagcaacaagtgccaggactgtggcaccaagatccccaccagcagaagagcctgcaggaaggagcccaccaaggagttccactaccgctacaacaccccaggccagaactacagcaaccacagcaagagaggagcctttgtgcagccccacagcctggatgagagcaagaacagcagcccctgcctggtgcacagcccagacaccagcaagagcagccccaccagcggctggcaggaggccgagctgggcctggagaacatgaagagccagtag

SEQ ID NO: 35303 - DNA, 2286 bp, Artificial Sequence
  Description of Artificial Sequence: Synthetic coding sequence
atggatgaggccgacttcagcgagcacaccacctacaagcaggaggacctgccctatgatggagacctgagccagatcaagattggaaatgactacagcttcaccagcaagaaggatggcctggaggtgctgaaccagatcatcttcatcgcagatgacccccaggagaaggccatgcacagcgagacctgtggcaacacagctgtgaccatccccctgggcaagatcacagaaaatgctgccaacaagaaggatgagaaggagaagcagtgcacagctgccctgcacatcccagccaatgaaggagatgccagcaagagcagcatcagtgacatcctgctgcaccacctgagcaaggagcccttcctgcggggccagggcatcgactgtgagaccctgcctgagatcagcaatgctgacagctttgaggaggaggccatcatcaagagcatcatcagctgctacaacaagaacagctggcccaaggagcagaccccagagctgacagaccagctgaaccccaagagagatggagagaacagcaacaagccaggcagcgccaccaccacagaggagaacaccagtgacctggagggccctgtggccgccggggacagcagccaccaggagaatgtgaatgtgctgaccaagaccaagggccctggggacaagcagaagagctaccagggccagagcccccagaagcagcagacagagaaggccaacagcggcaacaccttcaagtatggccagggccaggtgcactaccagctgcctgacttcagcaagatcgcccccaaggtgaagatccccaagaacaagatcatcaacaagcccctggccatcgccaagcaggccagcttcagcagcaagagccgggacaagcccaccctggtgcaggacagcctggagaccaccccagagagcaactgtgtggagaagcagcaccaggagcagaagggcaagatcacagagcccagccagcagatccagatggagcccatcgtgcacatccaccaggagctgctgaccggcatcgagagcgaggccagcctgagcaagctgagccccaccagccagaagggcaccagcagcagcagcagctacatcttccagaagatcagccagggcaagcagatgtgccagaagctgaaggagcagacagaccagctgaagaccaaggtgcaggagttcagcaagaggatcaagcaggacagcccctaccacctgcaggacaagaagctggtgctggagaagctgcagggccacctggagctgctggagcagaacttcctggccaccaaggacaagcacctgaccctgcagcagcaggtgcacaagcatgagagcaccatcgtgggggactttgatcctgagaggaaggtggagggggagatcttcaagctggagatgctgctggaggatgtgaaggagaagatggatgagagcaagtacaccagcgcccccagcctgcctgtgagcagccctgtgaccctggatgacctggccagcaccttcagcagcctgagcaatgagatccccaaggagcaccctggccaccccagcggcccccggggcagcggcggcagcgaggtgacaggcaccccccagggcggcccccaggaggccccaaatgaggagctgtgtgagctggccccccagacctacctgaatggccactatggagatgctgctgcccagaacaagccagaccaggtggccatgaggctgagcagcaacagcggggaggaccccaacggcaccccccggcggcaggactgtgccgagatgacagcccccagccccagctgtgccttctgccggcggctgctggagtggaagcagaatgtggagaagaagggccacggccgcatcaactgtggccgcttcagcatcgtgctgcacgagaaggccccccacagcgacagcacccccaacagcgacaccggccacagcttctgcagcgacagcggcacagagatgcagagcaacaagtgccaggactgtggcaccaagatccccaccagcagaagagcctgcaggaaggagcccaccaaggagttccactaccgctacaacaccccaggccagaactacagcaaccacagcaagagaggagcctttgtgcagccccacagcctggatgagagcaagaacagcagccccagcctggccagccccttctgctgccccggcctggtgcacagcccagacaccagcaagagcagccccaccagcggctggcaggaggccgagctgggcctggagaacatgaagagccagtag

SEQ ID NO: 35304 - DNA, 2511 bp, Artificial Sequence
  Description of Artificial Sequence: Synthetic coding sequence
atggatgaggccgacttcagcgagcacaccacctacaagcaggaggacctgccctatgatggagacctgagccagatcaagattggaaatgactacagcttcaccagcaagaaggatggcctggaggtgctgaaccagatcatcttcatcgcagatgacccccaggagaaggccatgcacagcgagacctgtggcaacacagctgtgaccatccccctgggcaagatcacagaaaatgctgccaacaagaaggatgagaaggagaagcagtgcacagctgccctgcacatcccagccaatgaaggagatgccagcaagagcagcatcagtgacatcctgctgcaccacctgagcaaggagcccttcctgcggggccagggcatcgactgtgagaccctgcctgagatcagcaatgctgacagctttgaggaggaggccatcatcaagagcatcatcagctgctacaacaagaacagctggcccaaggagcagaccccagagctgacagaccagctgaaccccaagagagatggagagaacagcaacaagccaggcagcgccaccaccacagaggagaacaccagtgacctggagggccctgtggccgccggggacagcagccaccaggagaatgtgaatgtgctgaccaagaccaagggccctggggacaagcagaagagctaccagggccagagcccccagaagcagcagacagagaaggccaacagcggcaacaccttcaagtatggccagggccaggtgcactaccagctgcctgacttcagcaagatcgcccccaaggtgaagatccccaagaacaagatcatcaacaagcccctggccatcgccaagcaggccagcttcagcagcaagagccgggacaagcccaccctggtgcaggacagcctggagaccaccccagagagcaactgtgtggagaagcagcaccaggagcagaagggcaagatcacagagcccagccagcagatccagatggagcccatcgtgcacatccaccaggagctgctgaccggcatcgagagcgaggccagcctgagcaagctgagccccaccagccagaagggcaccagcagcagcagcagctacatcttccagaagatcagccagggcaagcagatgtgccagaagctgaaggagcagacagaccagctgaagaccaaggtgcaggagttcagcaagaggatcaagcaggacagcccctaccacctgcaggacaagaagctggtgctggagaagctgcagggccacctggagctgctggagcagaacttcctggccaccaaggacaagcacctgaccctgcagcagcaggtgcacaagcatgagagcaccatcgtgggggactttgatcctgagaggaaggtggagggggagatcttcaagctggagatgctgctggaggatgtgaaggagaagatggatgagagcaagtacaccagcgcccccagcctgcctgtgagcagccctgtgaccctggatgacctggccagcaccttcagcagcctgagcaatgagatccccaaggagcaccctggccaccccagcggcccccggggcagcggcggcagcgaggtgacaggcaccccccagggcggcccccaggaggccccaaatgaggagctgtgtgagctggccccccagacctacctgaatggccactatggagatgctgctgcccagaacaagccagaccaggtggccatgaggctgagcagcaacagcggggaggaccccaacggcaccccccggcggcaggactgtgccgagatgacagcccccagccccagctgtgccttctgccggcggctgctggagtggaagcagaatgtggagaagaagggccacggccgcatcaactgtggccgcttcagcatcgtgctgcacgagaaggccccccacagcgacagcacccccaacagcgacaccggccacagcttctgcagcgacagcggcacagagatgcagagcaacaagtgccaggactgtggcaccaagatccccaccagcagaagagcctgcaggaaggagcccaccaaggagttccactaccgctacaacaccccaggccagaactacagcaaccacagcaagagaggagcctttgtgcagccccacagcctggatgagagcaagaacagcagccccagcttcctgaagcccaagaggatctgcagccagagggtgaacagcaagagcttcaagggggagcacgagcccacccctgggaagaagaagctgcaggccttcatgacctacagcagtgaccctgccacccccagcccccacttctacagctgccgcatcagcggcagcaagagcctgtgtgactttgacagcacagaggagatcaagtctgagatcctgaacagcgccctggaccacgccctgaggacagccaccatcctgaaggagaccacagaccagatgatcaagaccatcgccgaggacctggccaaggcccagcgctggaggaaccggctgaagtactag

SEQ ID NO: 35305 - DNA, 1035 bp, Artificial Sequence
  Description of Artificial Sequence: Synthetic coding sequence
atggtgctgcagatggagccccaggtgaacagcaccaacaacttccaccagggccccctggaccagcctgtgggccccctgaccggcctgaagagcagcctgctgaaggacaccaccagcgctggccccctgctgcggccctacccagccagcctgctgggcaaggtgaaggaggccgtgaaggtggccattgatgctgagtaccgccacatcgactgtgcctacttctatgagaaccagcacgaggtgggggaggccatccaggagaagatccaggagaaggctgtgatgagagaagatctcttcatcgtgtccaaggtgtggcccaccttctttgagcggcccctggtgaggaaggcctttgagaagaccctgaaggacctgaagctgagctacctggatgtgtacctgatccactggccccagggcttcaagacaggagatgacttcttccccaaggatgacaagggcaacatgatcagcggcaagggcaccttcctggatgcctgggaggccatggaggagctggtggatgagggcctggtgaaggccctgggcgtgagcaacttcaaccacttccagatcgagcggctgctgaacaagccaggcctgaagtacaagcctgtgaccaaccaggtggagtgccacccctacctgacccaggagaagctgatccagtactgccacagcaagggcatcaccgtgacagcctacagccccctgggcagcccagaccggccctgggccaagccagaggaccccagcctgctggaggaccccaagatcaaggagattgctgccaagcacaagaagaccacagcccaggtgctgatccgcttccacatccagagaaatgtgaccgtcatccccaagtccatgaccccagcccacatcgtggagaacatccaggtgtttgacttcaagctgagtgatgaggagatggccaccatcctgtccttcaacagaaactggagggcctttgacttcaaggagttcagccacctggaggacttcccctttgatgctgagtactag

SEQ ID NO: 35306 - DNA, 972 bp, Artificial Sequence
  Description of Artificial Sequence: Synthetic coding sequence
atggacagcaagtaccagtgtgtgaagctgaatgatggccacttcatgcctgtgctgggcttcggcacctacgccccagctgaggtgcccaagagcaaggccctggaggccaccaagctggccatcgaggccggcttccgccacattgattctgcccacctgtacaacaatgaggagcaggtgggcctggccatccgcagcaagattgctgatggctctgtgaagcgggaggacatcttctacaccagcaagctgtggtgcaacagccacaggcctgagctggtgcggcctgccctggagaggagcctgaagaacctgcagctggactatgtggacctgtacctgatccacttccctgtgtctgtgaagccaggagaggaggtgatccccaaggatgaaaatggcaagatcctgtttgacacagtggacctgtgtgccacctgggaggccgtggagaagtgcaaggatgctggcctggccaagagcattggagtgagcaacttcaacagacggcagctggagatgatcctgaacaagccaggcctgaagtacaagcctgtgtgcaaccaggtggagtgccacccctacttcaaccagaggaagctgctggacttctgcaagagcaaggacatcgtgctggtggcctacagcgccctgggcagccaccgggaggagccctgggtggaccccaacagccctgtgctgctggaggaccctgtgctgtgtgccctggccaagaagcacaagaggaccccagccctgattgccctgcgctaccagctgcagaggggcgtggtggtgctggccaagagctacaatgagcagaggatccggcagaatgtgcaggtgtttgagttccagctgaccagcgaggagatgaaggccattgatggcctgaacagaaatgtgcgctacctgaccctggacatctttgctggcccccccaactaccccttcagtgatgagtactag

SEQ ID NO: 35307 - DNA, 972 bp, Artificial Sequence
  Description of Artificial Sequence: Synthetic coding sequence
atggacagcaagtaccagtgtgtgaagctgaatgatggccacttcatgcctgtgctgggcttcggcacctacgccccagctgaggtgcccaagagcaaggccctggaggccgtgaagctggccatcgaggccggcttccaccacattgattctgcccacgtgtacaacaatgaggagcaggtgggcctggccatccgcagcaagattgctgatggctctgtgaagcgggaggacatcttctacaccagcaagctgtggagcaacagccacaggcctgagctggtgcggcctgccctggagaggagcctgaagaacctgcagctggactatgtggacctgtacctgatccacttccctgtgtctgtgaagccaggagaggaggtgatccccaaggatgaaaatggcaagatcctgtttgacacagtggacctgtgtgccacctgggaggccatggagaagtgcaaggatgctggcctggccaagagcattggagtgagcaacttcaaccaccggctgctggagatgatcctgaacaagccaggcctgaagtacaagcctgtgtgcaaccaggtggagtgccacccctacttcaaccagaggaagctgctggacttctgcaagagcaaggacatcgtgctggtggcctacagcgccctgggcagccaccgggaggagccctgggtggaccccaacagccctgtgctgctggaggaccctgtgctgtgtgccctggccaagaagcacaagaggaccccagccctgattgccctgcgctaccagctgcagaggggcgtggtggtgctggccaagagctacaatgagcagaggatccggcagaatgtgcaggtgtttgagttccagctgaccagcgaggagatgaaggccattgatggcctgaacagaaatgtgcgctacctgaccctggacatctttgctggcccccccaactaccccttcagtgatgagtactag

SEQ ID NO: 35308 - DNA, 972 bp, Artificial Sequence
  Description of Artificial Sequence: Synthetic coding sequence
atggacagcaagcaccagtgtgtgaagctgaatgatggccacttcatgcctgtgctgggcttcggcacctacgcccctcctgaggtgcccaggagcaaggccctggaggtgaccaagctggccatcgaggccggcttccgccacattgattctgcccacctgtacaacaatgaggagcaggtgggcctggccatccgcagcaagattgctgatggctctgtgaagcgggaggacatcttctacaccagcaagctgtggagcaccttccacaggcctgagctggtgcggcctgccctggagaacagcctgaagaaggcccagctggactatgtggacctgtacctgatccacagccccatgagcctgaagccaggagaggagctgagccccacagatgaaaatggcaaggtgatctttgatattgtggacctgtgcaccacctgggaggccatggagaagtgcaaggatgctggcctggccaagagcattggagtgagcaacttcaacagacggcagctggagatgatcctgaacaagccaggcctgaagtacaagcctgtgtgcaaccaggtggagtgccacccctacttcaacagaagcaagctgctggacttctgcaagagcaaggacatcgtgctggtggcctacagcgccctgggcagccagagggacaagcgctgggtggaccccaacagccctgtgctgctggaggaccctgtgctgtgtgccctggccaagaagcacaagaggaccccagccctgattgccctgcgctaccagctgcagaggggcgtggtggtgctggccaagagctacaatgagcagaggatccggcagaatgtgcaggtgtttgagttccagctgacagctgaggacatgaaggccattgatggcctggacaggaacctgcactacttcaacagcgacagctttgccagccaccccaactacccctacagtgatgagtactag

SEQ ID NO: 35309 - DNA, 972 bp, Artificial Sequence
  Description of Artificial Sequence: Synthetic coding sequence
atggaccccaagtaccagagggtggagctgaatgatggccacttcatgcctgtgctgggcttcggcacctacgcccctcctgaggtgcccaggaacagagctgtggaggtgaccaagctggccatcgaggccggcttccgccacattgattctgcctacctgtacaacaatgaggagcaggtgggcctggccatccgcagcaagattgctgatggctctgtgaagcgggaggacatcttctacaccagcaagctgtggtgcaccttcttccagccccagatggtgcagcctgccctggagagcagcctgaagaagctgcagctggactatgtggacctgtacctgctgcacttccccatggccctgaagccaggagagacccccctgcccaaggatgaaaatggcaaggtgatctttgacacagtggacctgagcgccacctgggaggtgatggagaagtgcaaggatgctggcctggccaagagcattggagtgagcaacttcaactgccggcagctggagatgatcctgaacaagccaggcctgaagtacaagcctgtgtgcaaccaggtggagtgccacccctacctgaaccagagcaagctgctggacttctgcaagagcaaggacatcgtgctggtggcccacagcgccctgggcacccagaggcacaagctgtgggtggaccccaacagccctgtgctgctggaggaccctgtgctgtgtgccctggccaagaagcacaagcagaccccagccctgattgccctgcgctaccagctgcagaggggcgtggtggtgctggccaagagctacaatgagcagaggatccgggagaacatccaggtgtttgagttccagctgaccagcgaggacatgaaggtgctggatggcctgaacagaaactaccgctacgtggtgatggacttcctgatggaccacccagactaccccttcagtgatgagtactag

SEQ ID NO: 35310 - DNA, 972 bp, Artificial Sequence; identical to SEQ ID NO: 35309
  Description of Artificial Sequence: Synthetic coding sequence

SEQ ID NO: 35311 - DNA, 951 bp, Artificial Sequence
  Description of Artificial Sequence: Synthetic coding sequence
atggccacctttgtggagctgagcaccaaggccaagatgcccatcgtgggcctgggcacctggaggagcctgctgggcaaggtgaaggaggccgtgaaggtggccattgatgctgagtaccgccacatcgactgtgcctacttctatgagaaccagcacgaggtgggggaggccatccaggagaagatccaggagaaggctgtgatgagagaagatctcttcatcgtgtccaaggtgtggcccaccttctttgagcggcccctggtgaggaaggcctttgagaagaccctgaaggacctgaagctgagctacctggatgtgtacctgatccactggccccagggcttcaagacaggagatgacttcttccccaaggatgacaagggcaacatgatcagcggcaagggcaccttcctggatgcctgggaggccatggaggagctggtggatgagggcctggtgaaggccctgggcgtgagcaacttcaaccacttccagatcgagcggctgctgaacaagccaggcctgaagtacaagcctgtgaccaaccaggtggagtgccacccctacctgacccaggagaagctgatccagtactgccacagcaagggcatcaccgtgacagcctacagccccctgggcagcccagaccggccctgggccaagccagaggaccccagcctgctggaggaccccaagatcaaggagattgctgccaagcacaagaagaccacagcccaggtgctgatccgcttccacatccagagaaatgtgaccgtcatccccaagtccatgaccccagcccacatcgtggagaacatccaggtgtttgacttcaagctgagtgatgaggagatggccaccatcctgtccttcaacagaaactggagggcctttgacttcaaggagttcagccacctggaggacttcccctttgatgctgagtactag

SEQ ID NO: 35312 - DNA, 84 bp, Artificial Sequence
  Description of Artificial Sequence: Synthetic coding sequence
aaccccaactggaagaggatccggctgaatgatggccccttcatgcctgtgctgggcttcggcacctacgccccagaccactag

SEQ ID NO: 35313 - DNA, 462 bp, Artificial Sequence
  Description of Artificial Sequence: Synthetic coding sequence
atgcacctgaccacagccccccgctggaagaggcactgtgtgcctgccaccagctgcacccggcgggccagctcctggagcctggccagccccaccatgcctcctgggaagtggcccaggtctgtgcccagcgcccgggccacagctggcagctgccccctgtgcaccagcttctggaaggagcaccactttgagggcatcgccctggtggagaaggccctgcaggccgcctacggggccagcgcccccagcatgaccagcgctgccctgcgctggatgtaccaccacagccagctgcagggcgcccatggagatgctgtgatcctgggcatgagcagcctggagcagctggagcagaacctggccgctgctgaggagggccccctggagcctgctgtggtggatgccttcaaccaggcctggcacctgtttgcccatgaatgtcccaactacttcatctag

SEQ ID NO: 35314 - DNA, 903 bp, Artificial Sequence
  Description of Artificial Sequence: Synthetic coding sequence
atggagttcccctttgatgtggatgccctcttccctgagcgcatcaccgtgctggaccagcacctgcggcccccagcccggcggcccggcaccaccaccccagcccgggtggacctgcagcagcagatcatgaccatcattgatgagctgggcaaggccagcgccaaggcccagaacctgagcgcccccatcaccagcgccagcaggatgcagagcaacagacatgtggtgtacatcctgaaggacagcagcgcccggcctgctgggaagggggccatcatcggcttcatcaaggtgggctacaagaagctgtttgtgctggatgaccgggaggcccacaatgaggtggagcccctgtgcatcctggacttctacatccatgaatctgtgcagagacatggccacggccgggagctgttccagtacatgctgcagaaggagcgggtggagccccaccagctggccatcgaccggcccagccagaagctgctgaagttcctgaacaagcactacaacctggagaccaccgtgccccaggtgaacaactttgtgatctttgagggcttctttgcccaccagcaccccccagccaggaagctgccccccaagagagctgagggggacatcaagccctacagcagcagtgaccgggagttcctgaaggtggccgtggagcccccctggcccctgaacagagccccccggcgggccaccccaccagcccaccccccacccaggagcagcagcctgggcaacagccctgagcggggccccctgcggccctttgtgcctgagcaggagctgctgcggagcctgcggctgtgccccccccaccccacagcccggctgctgctggccgctgaccccggcggcagccctgcccagaggaggaggaccaggtag

SEQ ID NO: 35315 - DNA, 933 bp, Artificial Sequence
  Description of Artificial Sequence: Synthetic coding sequence
atggagttcccctttgatgtggatgccctcttccctgagcgcatcaccgtgctggaccagcacctgcggcccccagcccggcggcccggcaccaccaccccagcccgggtggacctgcagcagcagatcatgaccatcattgatgagctgggcaaggccagcgccaaggcccagaacctgagcgcccccatcaccagcgccagcaggatgcagagcaacagacatgtggtgtacatcctgaaggacagcagcgcccggcctgctgggaagggggccatcatcggcttcatcaaggtgggctacaagaagctgtttgtgctggatgaccgggaggcccacaatgaggtggagcccctgtgcatcctggacttctacatccatgaatctgtgcagagacatggccacggccgggagctgttccagtacatgctgcagaaggagcgggtggagccccaccagctggccatcgaccggcccagccagaagctgctgaagttcctgaacaagcactacaacctggagaccaccgtgccccaggtgaacaactttgtgatctttgagggcttctttgcccaccagcaccccccagccaggaagctgccccccaagagagctgagggggacatcaagccctacagcagcagtgaccgggagttcctgaaggtggccgtggagcccccctggcccctgaacagagccccccggcgggccaccccaccagcccaccccccacccaggagcagcagcctgggcaacagccctgagcggggccccctgcggccctttgtgcctgagcaggagctgctgcggagcctgcggctgtgccccccccaccccacagcccggctgctgctggccgctgaccccggcggcagccctgcccagaggaggaggaccagcagcctgcccaggtctgaggagagccgctactag

SEQ ID NO: 35316 - DNA, 1002 bp, Artificial Sequence
  Description of Artificial Sequence: Synthetic coding sequence
atggagttcccctttgatgtggatgccctcttccctgagcgcatcaccgtgctggaccagcacctgcggcccccagcccggcggcccggcaccaccaccccagcccgggtggacctgcagcagcagatcatgaccatcattgatgagctgggcaaggccagcgccaaggcccagaacctgagcgcccccatcaccagcgccagcaggatgcagagcaacagacatgtggtgtacatcctgaaggacagcagcgcccggcctgctgggaagggggccatcatcggcttcatcaaggtgggctacaagaagctgtttgtgctggatgaccgggaggcccacaatgaggtggagcccctgtgcatcctggacttctacatccatgaatctgtgcagagacatggccacggccgggagctgttccagtacatgctgcagaaggagcgggtggagccccaccagctggccatcgaccggcccagccagaagctgctgaagttcctgaacaagcactacaacctggagaccaccgtgccccaggtgaacaactttgtgatctttgagggcttctttgcccaccagcaccggcccccagcccccagcctgcgggccaccaggcacagcagagctgctgctgtggaccccaccccagctgccccagccaggaagctgccccccaagagagctgagggggacatcaagccctacagcagcagtgaccgggagttcctgaaggtggccgtggagcccccctggcccctgaacagagccccccggcgggccaccccaccagcccaccccccacccaggagcagcagcctgggcaacagccctgagcggggccccctgcggccctttgtgcctgagcaggagctgctgcggagcctgcggctgtgccccccccaccccacagcccggctgctgctggccgctgaccccggcggcagccctgcccagaggaggaggaccagcagcctgcccaggtctgaggagagccgctactag

SEQ ID NO: 35317 - DNA, 1230 bp, Artificial Sequence
  Description of Artificial Sequence: Synthetic coding sequence
atgtggctgacctggcccttctgcttcctgaccatcaccctgcgggaggagggcgtgtgccacctggagagcgtggacctgcagcagcagatcatgaccatcattgatgagctgggcaaggccagcgccaaggcccagaacctgagcgcccccatcaccagcgccagcaggatgcagagcaacagacatgtggtgtacatcctgaaggacagcagcgcccggcctgctgggaagggggccatcatcggcttcatcaaggtgggctacaagaagctgtttgtgctggatgaccgggaggcccacaatgaggtggagcccctgtgcatcctggacttctacatccatgaatctgtgcagagacatggccacggccgggagctgttccagtacatgctgcagaaggagcgggtggagccccaccagctggccatcgaccggcccagccagaagctgctgaagttcctgaacaagcactacaacctggagaccaccgtgccccaggtgaacaactttgtgatctttgagggcttctttgcccaccagcaccggcccccagcccccagcctgcgggccaccaggcacagcagagctgctgctgtggaccccaccccagctgccccagccaggaagctgccccccaagagagctgagggggacatcaagccctacagcagcagtgaccgggagttcctgaaggtggccgtggagcccccctggcccctgaacagagccccccggcgggccaccccaccagcccaccccccacccaggagcagcagcctgggcaacagccctgagcggggccccctgcggccctttgtgcctgagcaggagctgctgcggagcctgcggctgtgccccccccaccccacagcccggctgctgctggccgctgaccccggcggcagccctgcccagaggaggaggacccggggcaccccacctggcctggtggcccagagctgctgctacagcagacatggaggagtgaacagcagcagccccaacacaggcaaccaggacagcaagcagggcgagcaggagaccaagaacagaagtgccagcgaggagcaggccctgagccaggacggcagcggggagaagcccatgcacacagccccaccccaggccccagcccccccagcccagagctggacagtgggcggggacatcctgaatgcccgcttcatccggaacctgcaggagaggaggagcacccggccctggtag

SEQ ID NO: 35318 - DNA, 1197 bp, Artificial Sequence
  Description of Artificial Sequence: Synthetic coding sequence
atggagttcccctttgatgtggatgccctcttccctgagcgcatcaccgtgctggaccagcacctgcggcccccagcccggcggcccggcaccaccaccccagcccgggtggacctgcagcagcagatcatgaccatcattgatgagctgggcaaggccagcgccaaggcccagaacctgagcgcccccatcaccagcgccagcaggatgcagagcaacagacatgtggtgtacatcctgaaggacagcagcgcccggcctgctgggaagggggccatcatcggcttcatcaaggtgggctacaagaagctgtttgtgctggatgaccgggaggcccacaatgaggtggagcccctgtgcatcctggacttctacatccatgaatctgtgcagagacatggccacggccgggagctgttccagtacatgctgcagaaggagcgggtggagccccaccagctggccatcgaccggcccagccagaagctgctgaagttcctgaacaagcactacaacctggagaccaccgtgccccaggtgaacaactttgtgatctttgagggcttctttgcccaccagcaccccccagccaggaagctgccccccaagagagctgagggggacatcaagccctacagcagcagtgaccgggagttcctgaaggtggccgtggagcccccctggcccctgaacagagccccccggcgggccaccccaccagcccaccccccacccaggagcagcagcctgggcaacagccctgagcggggccccctgcggccctttgtgcctgagcaggagctgctgcggagcctgcggctgtgccccccccaccccacagcccggctgctgctggccgctgaccccggcggcagccctgcccagaggaggaggacccggggcaccccacctggcctggtggcccagagctgctgctacagccgccacggcggcgtgaacagcagcagccccaacacaggcaaccaggacagcaagcagggcgagcaggagaccaagaacagaagtgccagcgaggagcaggccctgagccaggacggcagcggggagaagcccatgcacacagccccaccccaggccccagcccccccagcccagagctggacagtgggcggggacatcctgaatgcccgcttcatccggaacctgcaggagcggcgcagcacccggccctggtag

SEQ ID NO: 35319 - DNA, 972 bp, Artificial Sequence
  Description of Artificial Sequence: Synthetic coding sequence
atggagttcccctttgatgtggatgccctcttccctgagcgcatcaccgtgctggaccagcacctgcggcccccagcccggcggcccggcaccaccaccccagcccgggtggacctgcagcagcagatcatgaccatcattgatgagctgggcaaggccagcgccaaggcccagaacctgagcgcccccatcaccagcgccagcaggatgcagagcaacagacatgtggtgtacatcctgaaggacagcagcgcccggcctgctgggaagggggccatcatcggcttcatcaaggtgggctacaagaagctgtttgtgctggatgaccgggaggcccacaatgaggtggagcccctgtgcatcctggacttctacatccatgaatctgtgcagagacatggccacggccgggagctgttccagtacatgctgcagaaggagcgggtggagccccaccagctggccatcgaccggcccagccagaagctgctgaagttcctgaacaagcactacaacctggagaccaccgtgccccaggtgaacaactttgtgatctttgagggcttctttgcccaccagcaccggcccccagcccccagcctgcgggccaccaggcacagcagagctgctgctgtggaccccaccccagctgccccagccaggaagctgccccccaagagagctgagggggacatcaagccctacagcagcagtgaccgggagttcctgaaggtggccgtggagcccccctggcccctgaacagagccccccggcgggccaccccaccagcccaccccccacccaggagcagcagcctgggcaacagccctgagcggggccccctgcggccctttgtgcctgagcaggagctgctgcggagcctgcggctgtgccccccccaccccacagcccggctgctgctggccgctgaccccggcggcagccctgcccagaggaggaggaccaggtag

SEQ ID NO: 35320 - DNA, 1266 bp, Artificial Sequence
  Description of Artificial Sequence: Synthetic coding sequence
atggagttcccctttgatgtggatgccctcttccctgagcgcatcaccgtgctggaccagcacctgcggcccccagcccggcggcccggcaccaccaccccagcccgggtggacctgcagcagcagatcatgaccatcattgatgagctgggcaaggccagcgccaaggcccagaacctgagcgcccccatcaccagcgccagcaggatgcagagcaacagacatgtggtgtacatcctgaaggacagcagcgcccggcctgctgggaagggggccatcatcggcttcatcaaggtgggctacaagaagctgtttgtgctggatgaccgggaggcccacaatgaggtggagcccctgtgcatcctggacttctacatccatgaatctgtgcagagacatggccacggccgggagctgttccagtacatgctgcagaaggagcgggtggagccccaccagctggccatcgaccggcccagccagaagctgctgaagttcctgaacaagcactacaacctggagaccaccgtgccccaggtgaacaactttgtgatctttgagggcttctttgcccaccagcaccggcccccagcccccagcctgcgggccaccaggcacagcagagctgctgctgtggaccccaccccagctgccccagccaggaagctgccccccaagagagctgagggggacatcaagccctacagcagcagtgaccgggagttcctgaaggtggccgtggagcccccctggcccctgaacagagccccccggcgggccaccccaccagcccaccccccacccaggagcagcagcctgggcaacagccctgagcggggccccctgcggccctttgtgcctgagcaggagctgctgcggagcctgcggctgtgccccccccaccccacagcccggctgctgctggccgctgaccccggcggcagccctgcccagaggaggaggacccggggcaccccacctggcctggtggcccagagctgctgctacagcagacatggaggagtgaacagcagcagccccaacacaggcaaccaggacagcaagcagggcgagcaggagaccaagaacagaagtgccagcgaggagcaggccctgagccaggacggcagcggggagaagcccatgcacacagccccaccccaggccccagcccccccagcccagagctggacagtgggcggggacatcctgaatgcccgcttcatccggaacctgcaggagaggaggagcacccggccctggtag

SEQ ID NO: 35321 - DNA, 1230 bp, Artificial Sequence; identical to SEQ ID NO: 35317
  Description of Artificial Sequence: Synthetic coding sequence

SEQ ID NO: 35322 - DNA, 1002 bp, Artificial Sequence; identical to SEQ ID NO: 35316
  Description of Artificial Sequence: Synthetic coding sequence

SEQ ID NO: 35323 - DNA, 903 bp, Artificial Sequence; identical to SEQ ID NO: 35314
  Description of Artificial Sequence: Synthetic coding sequence

SEQ ID NO: 35324 - DNA, 1266 bp, Artificial Sequence; identical to SEQ ID NO: 35320
  Description of Artificial Sequence: Synthetic coding sequence

SEQ ID NO: 35325 - DNA, 972 bp, Artificial Sequence; identical to SEQ ID NO: 35319
  Description of Artificial Sequence: Synthetic coding sequence

SEQ ID NO: 35326 - DNA, 933 bp, Artificial Sequence; identical to SEQ ID NO: 35315
  Description of Artificial Sequence: Synthetic coding sequence

SEQ ID NO: 35327 - DNA, 972 bp, Artificial Sequence; identical to SEQ ID NO: 35319
  Description of Artificial Sequence: Synthetic coding sequence

SEQ ID NO: 35328 - DNA, 1230 bp, Artificial Sequence; identical to SEQ ID NO: 35317
  Description of Artificial Sequence: Synthetic coding sequence

SEQ ID NO: 35329 - DNA, 903 bp, Artificial Sequence; identical to SEQ ID NO: 35314
  Description of Artificial Sequence: Synthetic coding sequence

SEQ ID NO: 35330 - DNA, 903 bp, Artificial Sequence; identical to SEQ ID NO: 35314
  Description of Artificial Sequence: Synthetic coding sequence

SEQ ID NO: 35331 - DNA, 972 bp, Artificial Sequence; identical to SEQ ID NO: 35319
  Description of Artificial Sequence: Synthetic coding sequence

SEQ ID NO: 35332 - DNA, 1266 bp, Artificial Sequence; identical to SEQ ID NO: 35320
  Description of Artificial Sequence: Synthetic coding sequence

SEQ ID NO: 35333 - DNA, 903 bp, Artificial Sequence; identical to SEQ ID NO: 35314
  Description of Artificial Sequence: Synthetic coding sequence

SEQ ID NO: 35334 - DNA, 972 bp, Artificial Sequence; identical to SEQ ID NO: 35319
  Description of Artificial Sequence: Synthetic coding sequence

SEQ ID NO: 35335 - DNA, 933 bp, Artificial Sequence; identical to SEQ ID NO: 35315
  Description of Artificial Sequence: Synthetic coding sequence

SEQ ID NO: 35336 - DNA, 1230 bp, Artificial Sequence; identical to SEQ ID NO: 35317
  Description of Artificial Sequence: Synthetic coding sequence

SEQ ID NO: 35337 - DNA, 1002 bp, Artificial Sequence; identical to SEQ ID NO: 35316
  Description of Artificial Sequence: Synthetic coding sequence

SEQ ID NO: 35338 - DNA, 933 bp, Artificial Sequence; identical to SEQ ID NO: 35315
  Description of Artificial Sequence: Synthetic coding sequence

SEQ ID NO: 35339 - DNA, 1266 bp, Artificial Sequence; identical to SEQ ID NO: 35320
  Description of Artificial Sequence: Synthetic coding sequence

SEQ ID NO: 35340 - DNA, 1230 bp, Artificial Sequence; identical to SEQ ID NO: 35317
  Description of Artificial Sequence: Synthetic coding sequence

SEQ ID NO: 35341 - DNA, 1266 bp, Artificial Sequence; identical to SEQ ID NO: 35320
  Description of Artificial Sequence: Synthetic coding sequence

SEQ ID NO: 35342 - DNA, 903 bp, Artificial Sequence; identical to SEQ ID NO: 35314
  Description of Artificial Sequence: Synthetic coding sequence

SEQ ID NO: 35343 - DNA, 933 bp, Artificial Sequence; identical to SEQ ID NO: 35315
  Description of Artificial Sequence: Synthetic coding sequence

SEQ ID NO: 35344 - DNA, 1266 bp, Artificial Sequence; identical to SEQ ID NO: 35320
  Description of Artificial Sequence: Synthetic coding sequence

SEQ ID NO: 35345 - DNA, 933 bp, Artificial Sequence; identical to SEQ ID NO: 35315
  Description of Artificial Sequence: Synthetic coding sequence

SEQ ID NO: 35346 - DNA, 972 bp, Artificial Sequence; identical to SEQ ID NO: 35319
  Description of Artificial Sequence: Synthetic coding sequence

SEQ ID NO: 35347 - DNA, 1230 bp, Artificial Sequence; identical to SEQ ID NO: 35317
  Description of Artificial Sequence: Synthetic coding sequence

SEQ ID NO: 35348 - DNA, 903 bp, Artificial Sequence; identical to SEQ ID NO: 35314
  Description of Artificial Sequence: Synthetic coding sequence

SEQ ID NO: 35349 - DNA, 1002 bp, Artificial Sequence; identical to SEQ ID NO: 35316
  Description of Artificial Sequence: Synthetic coding sequence

SEQ ID NO: 35350 - DNA, 1002 bp, Artificial Sequence; identical to SEQ ID NO: 35316
  Description of Artificial Sequence: Synthetic coding sequence

SEQ ID NO: 35351 - DNA, 1266 bp, Artificial Sequence; identical to SEQ ID NO: 35320
  Description of Artificial Sequence: Synthetic coding sequence

SEQ ID NO: 35352 - DNA, 933 bp, Artificial Sequence; identical to SEQ ID NO: 35315
  Description of Artificial Sequence: Synthetic coding sequence

SEQ ID NO: 35353 - DNA, 1002 bp, Artificial Sequence; identical to SEQ ID NO: 35316
  Description of Artificial Sequence: Synthetic coding sequence

SEQ ID NO: 35354 - DNA, 1002 bp, Artificial Sequence; identical to SEQ ID NO: 35316
  Description of Artificial Sequence: Synthetic coding sequence

SEQ ID NO: 35355 - DNA, 972 bp, Artificial Sequence; identical to SEQ ID NO: 35319
  Description of Artificial Sequence: Synthetic coding sequence

SEQ ID NO: 35356 - DNA, 1230 bp, Artificial Sequence; identical to SEQ ID NO: 35317
  Description of Artificial Sequence: Synthetic coding sequence

SEQ ID NO: 35357 - DNA, 1197 bp, Artificial Sequence; identical to SEQ ID NO: 35318
  Description of Artificial Sequence: Synthetic coding sequence

SEQ ID NO: 35358 - DNA, 1197 bp, Artificial Sequence; identical to SEQ ID NO: 35318
  Description of Artificial Sequence: Synthetic coding sequence

SEQ ID NO: 35359 - DNA, 1197 bp, Artificial Sequence; identical to SEQ ID NO: 35318
  Description of Artificial Sequence: Synthetic coding sequence

SEQ ID NO: 35360 - DNA, 1197 bp, Artificial Sequence; identical to SEQ ID NO: 35318
  Description of Artificial Sequence: Synthetic coding sequence

SEQ ID NO: 35361 - DNA, 1197 bp, Artificial Sequence; identical to SEQ ID NO: 35318
  Description of Artificial Sequence: Synthetic coding sequence

SEQ ID NO: 35362 - DNA, 1197 bp, Artificial Sequence; identical to SEQ ID NO: 35318
  Description of Artificial Sequence: Synthetic coding sequence

SEQ ID NO: 35363 - DNA, 618 bp, Artificial Sequence
  Description of Artificial Sequence: Synthetic coding sequence
atgagctttgccaccaagttcagtgactacttcctgctgattgaagataatgtgttctttgcccccaactttgtgacccacatccacagccgggtgaccaccatgaagagcaacagctgggtgctgatggagttcagcaacatgggcttcctgggcaagctgttccacagccgggacctgcccctgctggcccacttcctgctgctcttctacaaggagaagcccctggacagcctcatcagccacttccacaccctgctggtgcaggagagccccatcctgtgccggcccttcctgttctactgccgggtgtcctacacagcctttgaccacaagcagaaggccacagccctgcagaagaagaatgctgatggccccaacaaccccccaggagctgtgttcacagacatgcaggtgtctgatgtgcacttcccctgggaggcctacaccctggatgagagcttcttctggacccacaacatcagcatcggcaaccacctgaccgtcatcctgaaccacccagccaacctgagccgggtgcaggtgatgacaggcagcatcgtggagtgggaggtgcggcctggagagggcgctgggggcgccggcctgcccacctag

SEQ ID NO: 35364 - DNA, 618 bp, Artificial Sequence; identical to SEQ ID NO: 35363
  Description of Artificial Sequence: Synthetic coding sequence

SEQ ID NO: 35365 - DNA, 6513 bp, Artificial Sequence
  Description of Artificial Sequence: Synthetic coding sequence
atgaaggacagcgagggcccccagaggcctcccctgtgcttcctgagcaccctgctgagccagaaggtgcctgagaagagtgatgctgtgctgcgctgcatcatcagcggccagcccaagccagaggtgacctggtacaagaatggccaggccattgatggcagcggcatcatcagcaactatgagttctttgagaaccagtacatccacgtgctgcacctgagctgctgcaccaagaatgatgctgctgtgtaccagatcagcgccaagaacagctttggcatgatctgctgcagcgcctctgtggaggtggagtgcagcagcgagaacccccagctgagccccaacctggaggatgaccgggaccggggctggaagcatgaaacaggcacccatgaggaggagcgggccaaccagattgatgagaaggagcacccctacaaggaggaggagagcatcagccctggcacccccaggtctgctgacagcagccccagcaagagcaaccacagcctgagcctgcagagcctgggcaacctggacatctctgtgagcagcagcgagaaccccctgggcgtgaagggcaccaggcacactggagaggcctatgaccccagcaacacagaggagatcgccaacggcctgctcttcctgaacagcagccacatctatgagaagcaggaccgctgctgccacaagacagtgcacagcatggccagcaagttcacagatggagacctgaacaatgatggcccccatgatgagggcctgcggagcagccagcagaaccccaaggtgcagaagtacatctccttcagcctgcccctgtctgaggccacagcccacatctacccaggggacagcgctgtggccaacaagcagcccagcccccagctgagcagcgaggacagcgacagcgactatgagctgtgcccagagatcaccctgacctacacagaggagttcagtgatgatgacctggagtacctggagtgcagtgatgtgatgacagactacagcaatgctgtgtggcagaggaacctgctgggcacagaacatgtgttcctgctggagagtgatgatgaggagatggagtttggagagcactgcctgggcggctgtgagcacttcctgagcggcatgggctgcggcagccgggtgtctggagatgctggccccatggtggccacagctggcttctgtggccaccacagccagccccaggaggtgggcgtgcgcagcagccgggtgtccaagcacggccccagcagcccccagacaggcatgaccctcatcctgggcccccaccaggacggcaccagctctgtgacagagcagggccgctacaagctgcccacagcccctgaggccgcagaaaatgactacccaggcatccagggcgagacccgggacagccaccaggcccgggaggagtttgccagtgacaacctgctgaacatggatgagagcgtgcgggagacagagatgaagctgctgagcggggagagcgagaacagcggcatgagccagtgctgggagacagctgctgacaagagggtgggcggcaaggacctgtggagcaagaggggcagcaggaagagcgcccgggtgcggcagcccggcatgaagggcaaccccaagaagcccaatgccaacctgcgggagagcaccacagagggcaccctgcacctgtgcagcgccaaggagagcgctgagccccccctgacccagagcgacaagcgggagaccagccacaccacagctgctgccaccggccgcagcagccatgctgatgccagagaatgtgccatcagcacccaggccgagcaggaggccaagaccctgcagaccagcacagattctgtgtccaaggagggcaacaccaactgcaagggggagggcatgcaggtgaacaccctgtttgagaccagccaggtgcctgactggagcgaccccccccaggtgcaggtgcaggagaccgtgcgggagaccatcagctgcagccagatgcctgccttcagcgagcctgctggggaggagagccccttcaccggcaccaccaccatctccttcagcaacctgggcggcgtgcacaaggaaaatgccagcctggcccagcacagcgaggtgaagccctgcacctgtggcccccagcacgaggagaagcaggacagagatggcaacatcccagacaacttccgggaggacctgaagtatgagcagagcatcagcgaggccaatgatgagaccatgagccctggggtcttcagccgccacctgcccaaggatgcccgggctgacttccgggagcctgtggccgtgtctgtggccagccctgagcccacagacacagccctgaccctggagaatgtgtgtgatgagccccgggaccgggaggccgtgtgtgccatggagtgctttgaagctggggaccagggcacctgctttgacaccatcgacagcctggtgggccggcctgtggacaagtacagcccccaggagatctgcagcgtggacacagagctggccgagggccagaacaaggtgtctgacctgtgcagcagcaatgacaagaccctggaggtgttcttccagacccaggtgtctgagacctctgtgtccacctgcaagagcagcaaggatggcaacagcgtgatgagccccctcttcaccagcaccttcaccctgaacatcagccacacagccagcgagggcgccactggagagaacctggccaaggtggagaacagcacctaccccctggccagcacagtgcatgctggccaggagcagcccagccccagcaacagcggcggcctggatgagacccagctgctgagcagcgagaacaaccccctggtgcagttcaaggagggcggggacaagagccccagccccagcgctgctgacaccacagccaccccagccagctacagcagcatcgtgtccttcccctgggagaagcccaccaccctgacagccaacaatgaatgcttccaggccacccgggagacagaggacaccagcacagtgaccatcgccacagaggtgcacccagccaagtacctggccgtgtccatccctgaggacaagcatgctgggggcacagaggagcgcttcccccgggccagccatgagaaggtgtcccagttccccagccaggtgcagctggaccacatcctgagcggggccaccatcaagagcaccaaggagctgctgtgccgggcccccagcgtgcctggggtgccccaccacgtgctgcagctgcctgagggggagggcttctgcagcaacagccccctgcaggtggacaacctgagcggggacaagagccagacagtggacagagctgacttccgctcctatgaggagaacttccaggagcggggcagcgagaccaagcagggcgtgcagcagcagagcctgagccagcagggcagcctgagcgccccagacttccagcagagcctgcccaccaccagcgctgcccaggaggagaggaacctggtgcccacagcccacagccctgccagcagccgggagggcgccggccagaggagcggctggggcaccagggtgtctgtggtggccgagacagctggggaggaggacagccaggccctgagcaatgtgcccagcctgagtgacatcctgctggaggagagcaaggagtacagacctggcaactgggaggccggcaacaagctgaagatcatcaccctggaggccagcgccagcgagatctggccaccccggcagctgaccaacagcgagagcaaggccagtgatggcggcctcatcatcccagacaaggtgtgggccgtgcctgacagcctgaaggcagatgctgtggtgcctgagctggcccccagcgagattgctgccctggcccacagcccagaagatgctgagagcgccctggccgacagccgggagagccacaagggggaggagcccaccatctctgtgcactggaggagcctgagcagccggggcttcagccagccccggctgctggagagctctgtggaccctgtggatgagaaggagctgtctgtgacagacagcctgtctgctgccagcgagactggaggcaaggaaaatgtgaacaacgtgtcccaggaccaggaggagaagcagctgaagatggaccacacagccttcttcaagaagttcctgacctgccccaagatcctggagagctctgtggaccccattgatgagatcagcgtcatcgagtacaccagggctgggaagccagagcccagcgagaccaccccccagggcgcccgggagggcggccagagcaatgatggcaacatgggccatgaagctgagatccagcctgccatcctgcaggtgccctgcctgcagggcaccatcctgtctgagaaccgcatcagccgcagccaggagggctccatgaagcaggaggccgagcagatccagcctgaggaggccaagacagccatctggcaggtgctgcagcccagcgagggcggggagcgcatccccagcggctgcagcatcggccagatccaggagagcagtgatggcagcctgggggaggccgagcagagcaagaaggacaaggccgagctgatcagccccaccagccccctgagcagctgcctgcccatcatgacccacgccagcctgggcgtggacacccacaacagcacaggccagatccatgatgtgcctgaaaatgacatcgtggagcccaggaagaggcagtatgtgtttcctgtgtcccagaagaggggcaccattgaaaatgaaagaggcaagcccctgcccagcagcccagacctgacccgcttcccctgcaccagcagccctgagggcaatgtgacagacttcctgatcagccacaagatggaggagcccaagattgaggtgctgcagattggagagaccaagccacccagcagcagcagcagcagcgccaagaccctggccttcatctctggagagcgggagctggagaaggcccccaagctgctgcaggacccctgccagaagggcaccctgggctgtgccaagaagagccgggagcgggagaagagcctggaggcccgggccggcaagagccctggcaccctgacagctgtgacaggcagcgaggaggtgaagaggaagccagaggcccctggcagcggccacctggccgagggcgtgaagaagaagatcctgagccgggtggccgccctgcggctgaagctggaggagaaggagaacatcaggaagaacagcgccttcctgaagaagatgcccaagctggagaccagcctgagccacacagaggagaagcaggaccccaagaagcccagctgcaagcgggagggccgggcccctgtgctgctgaagaagatccaggccgagatgtttcctgagcacagcggaaatgtgaagctgagctgccagtttgctgagatccacgaggacagcaccatctgctggaccaaggacagcaagagcatcgcccaggtgcagaggtctgctggggacaacagcacagtgtcctttgccatcgtgcaggccagccccaaggaccagggcctgtactactgctgcatcaagaacagctatggcaaggtgacagctgagttcaacctgacagctgaggtgctgaagcagctgagcagccggcaggacaccaagggctgtgaggagattgagttcagccagctgatcttcaaggaggacttcctgcatgacagctactttggaggccgcctgcggggccagatcgccacagaggagctgcactttggagagggcgtgcacaggaaggccttccgcagcacagtgatgcacggcctgatgcctgtgttcaagccaggccacgcctgtgtgctgaaggtgcacaatgccatcgcctacggcaccagaaataatgatgagctgatccagaggaactacaagctggccgcccaggagtgctacgtgcagaacacagcccgctactatgccaagatctatgctgctgaggcccagcccctggagggctttggagaggtgcctgagatcatccccatcttcctgatccacaggcctgagaacaacatcccctatgccaccgtggaggaggagctgattggagaatttgtgaagtacagcatcagagatggcaaggagatcaacttcctgcggcgggagagcgaggccggccagaagtgctgcaccttccagcactgggtgtaccagaagaccagcggctgcctgctggtgacagacatgcagggcgtgggcatgaagctgacagatgtgggcatcgccaccctggccaagggctacaagggcttcaagggcaactgcagcatgaccttcatcgaccagttcaaggccctgcaccagtgcaacaagtactgcaagatgctgggcctgaagagcctgcagaacaacaaccagaagcagaagcagcccagcatcggcaagagcaaggtgcagaccaacagcatgaccatcaagaaggccggccctgagaccccaggagagaagaagacctag

SEQ ID NO: 35366 - DNA, 1230 bp, Artificial Sequence
  Description of Artificial Sequence: Synthetic coding sequence
atgagaggagagcagggcgccgccggggcccgggtgctgcagttcaccaactgccgcatcctgcggggcggcaagctgctgcgggaggacctgtgggtgcggggcggccgcatcctggaccctgagaagctgttctttgaggagaggagagtggctgatgaaagaagagactgtggcggccgcatcctggcccctggcttcattgatgtgcagatcaatggaggcttcggcgtggacttcagccaggccacagaagatgtgggcagcggcgtggccctggtggcccggcgcatcctgagccatggagtgaccagcttctgccccaccctggtgaccagccccccagaggtgtaccacaaggtggtgccccagatccctgtgaagagcggcggcccccatggagctggggtgctgggcctgcacctggagggccccttcatcagccgggagaagagaggagcccaccctgaggcccacctgcggagctttgaagcagatgccttccaggacctgctggccacctacggccccctggacaacgtgagaattgtgaccctggcccctgagctgggccgcagccatgaggtgatccgggccctgacagcccggggcatctgtgtgtccctgggccacagcgtggccgacctgcgggctgctgaagatgctgtgtggagcggggccaccttcatcacccacctgttcaatgccatgctgcccttccaccaccgggaccccggcatcgtgggcctgctgaccagtgaccggctgcctgctggccgctgcatcttctacggcatgattgctgatggcacccacaccaacccagctgccctgcgcatcgcccaccgggcccacccccagggcctggtgctggtgacagatgccatcccagccctgggcctgggcaatggccgccacaccctgggccagcaggaggtggaggtggatggcctgacagcctacgtggccggcaccaagaccctgagcggcagcatcgcccccatggatgtgtgtgtgcgccacttcctgcaggccaccggctgcagcatggagagcgccctggaggccgccagcctgcacccagcccagctgctgggcctggagaagagcaagggcaccctggactttggagcagatgctgactttgtggtgctggatgacagcctgcacgtgcaggccacctacatctctggagagctggtgtggcaggctgatgctgcccggcagtag

SEQ ID NO: 35367 - DNA, 1320 bp, Artificial Sequence
  Description of Artificial Sequence: Synthetic coding sequence
atgagaggagagcagggcgccgccggggcccgggtgctgcagttcaccaactgccgcatcctgcggggcggcaagctgctgcgggaggacctgtgggtgcggggcggccgcatcctggaccctgagaagctgttctttgaggagaggagagtggctgatgaaagaagagactgtggcggccgcatcctggcccctggcttcattgatgtgcagatcaatggaggcttcggcgtggacttcagccaggccacagaagatgtgggcagcggcgtggccctggtggcccggcgcatcctgagccatggagtgaccagcttctgccccaccctggtgaccagccccccagaggtgtaccacaaggtggtgccccagatccctgtgaagagcggcggcccccatggagctggggtgctgggcctgcacctggagggccccttcatcagccgggagaagagaggagcccaccctgaggcccacctgcggagctttgaagcagatgccttccaggacctgctggccacctacggccccctggacaacgtgagaattgtgaccctggcccctgagctgggccgcagccatgaggtgatccgggccctgacagcccggggcatctgtgtgtccctgggccacagcgtggccgacctgcgggctgctgaagatgctgtgtggagcggggccaccttcatcacccacctgttcaatgccatgctgcccttccaccaccgggaccccggcatcgtgggcctgctgaccagtgaccggctgcctgctggccgctgcatcttctacggcatgattgctgatggcacccacaccaacccagctgccctgcgcatcgcccaccgggcccacccccagggcctggtgctggtgacagatgccatcccagccctgggcctgggcaatggccgccacaccctgggccagcaggaggtggaggtggatggcctgacagcctacgtggccggggagaggccagaccccctgggccccaggagccagcctgcctgccaggtggcccatgaccccccccgggcctgccccctgtgcagccagggcaccaagaccctgagcggcagcatcgcccccatggatgtgtgtgtgcgccacttcctgcaggccaccggctgcagcatggagagcgccctggaggccgccagcctgcacccagcccagctgctgggcctggagaagagcaagggcaccctggactttggagcagatgctgactttgtggtgctggatgacagcctgcacgtgcaggccacctacatctctggagagctggtgtggcaggctgatgctgcccggcagtag

SEQ ID NO: 35368 - DNA, 1785 bp, Artificial Sequence
  Description of Artificial Sequence: Synthetic coding sequence
atgagaggagagcagggcgccgccggggcccgggtgctgcagttcaccaactgccgcatcctgcggggcggcaagctgctgcgggaggacctgtgggtgcggggcggccgcatcctggaccctgagaagctgttctttgaggagaggagagtggctgatgaaagaagagactgtggcggccgcatcctggcccctggcttcattgatgtgcagatcaatggaggcttcggcgtggacttcagccaggccacagaagatgtgggcagcggcgtggccctggtggcccggcgcatcctgagccatggagtgaccagcttctgccccaccctggtgaccagccccccagaggtgtaccacaaggtggtgccccagatccctgtgaagagcggcggcccccatggagctggggtgctgggcctgcacctggagggccccttcatcagccgggagaagagaggagcccaccctgaggcccacctgcggagctttgaagcagatgccttccaggacctgctggccacctacggccccctggacaacgtgagaattgtgaccctggcccctgagctgggccgcagccatgaggtgatccgggccctgacagcccggggcatctgtgtgtccctgggccacagcgtggccgacctgcgggctgctgaagatgctgtgtggagcggggccaccttcatcacccacctgttcaatgccatgctgcccttccaccaccgggaccccggcatcgtgggcctgctgaccagtgaccggctgcctgctggccgctgcatcttctacggcatgattgctgatggcacccacaccaacccagctgccctgcgcatcgcccaccgggcccacccccagggcctggtgctggtgacagatgccatcccagccctgggcctgggcaatggccgccacaccctgggccagcaggaggtggaggtggatggcctgacagcctacgtggccggggagaggccagaccccctgggccccaggagccagcctgcctgccaggtggcccatgaccccccccgggcctgccccctgtgcagccagggcaccaagaccctgagcggcagcatcgcccccatggatgtgtgtgtgcgccacttcctgcaggccaccggctgcagcatggagagcgccctggaggccgccagcctgcacccagcccagctgctgggcctggagaagagcaagggcaccctggactttggagcagatgctgactttgtggtgctggatgacagcctgcacgtgcaggccacctacatcagcggccctgtgctggccggctgtggggaccctgcctggtgctggagggctgtgtgggaggcccctgtgtgcccagcccaccccatcagcgtcatcctgcccagctctgtgagcccctggccctggcacacccccatgtggcagaccagggctgtgcggctgcctgagcagctgcggggcggctgggccagcggggccctgctggccctgaggacagccaccgtgggcagtgatgtgcgggactggtgcagccccaccagcggggtcatcgtgctgaccttcagcccctttgagttctggggcggctggctgcccagccccctgctgaccggggctgtgctgggcaccggcggcacccggctggccctgcccctcttcagcagcctgtgctgcaaggcccagctgaggaagtgcctgcaggtgcagagggacaggatggtgtgggcccctcctgtgggccgggagcagcccgggaagaaccacctgcccggccagggcctggcctag

SEQ ID NO: 35369 - DNA, 933 bp, Artificial Sequence
  Description of Artificial Sequence: Synthetic coding sequence
atgggcaagaggcgctgtgtgccccccctggagcccaagctggccgccggctgctgcggcgtgaagaagcccaagctgagcggcagcggcacccacagccacggcaaccagagcaccaccgtgcccggcagcagcagcggccccctgcagaaccaccagcacgtggacagcagcagcggccgggagaatgtgtctgacctgaccctgggccctggcaacagccccatcaccaggatgaacccagccagcggggccctgagccccctgccccggcccaatggaacagccaacaccaccaagaacctggtggtgacagctgagatgtgctgctactgctttgatgtgctgtactgccacctgtatggcttcccccagccccggctgccccgcttcaccaatgacccctaccccctgtttgtgacctggaagacaggccgggacaagaggctgcggggctgcatcggcaccttcagcgccatgaacctgcacagcggcctgcgggagtacaccctgaccagcgccctgaaggacagccgcttcccccccctgacccgggaggagctgcccaagctgttctgcagcgtgtccctgctgaccaactttgaagatgccagtgactacctggactgggaggtgggcgtgcacggcatcagaattgagttcatcaatgaaaaaggagtgaagaggacagccacctacctgcctgaggtggccaaggagcaggactgggaccagatccagaccatcgacagcctgctgaggaaaggaggcttcaaggcccccatcaccagcgagttcaggaagaccatcaagctgacccgctacagaagtgagaaggtgaccatctcctatgcagagtacatcgccagccggcagcactgcttccagaatggcaccctgcacgccccacccctgtacaaccactacagctag

SEQ ID NO: 35370 - DNA, 933 bp, Artificial Sequence; identical to SEQ ID NO: 35369
  Description of Artificial Sequence: Synthetic coding sequence

SEQ ID NO: 35371 - DNA, 1728 bp, Artificial Sequence
  Description of Artificial Sequence: Synthetic coding sequence
atggacttccccaccatcagccgcagccccagcggccccccagccatggacctggagggcccccgggacatcctggtgcccagcgaggacctgaccccagacagccagtgggaccccatgcctgggggccctggcagcctgagcaggatggagctggatgagagcagcctgcaggagctggtgcagcagtttgaggccctgcccggggacctggtgggccccagccctgggggcgccccctgccccctgcacatcgccactggacatggcctggccagccaggagattgctgatgcccacggcctgctgtctgctgaggccggcagagatgacctgctgggcctgctgcactgtgaggagtgcccccccagccagacaggccctgaggagcccctggagcccgccccccggctgctgcagcccccagaagatcctgatgaagattctgacagccctgagtgggtggagggcgccagcgctgagcaggagggcagccgcagcagcagcagcagccctgagccctggctggagaccgtgcccctggtgaccccagaggagcccccagctggggcccagagccctgagaccctggccagctacccagccccccaggaggtgcccggcccctgtgaccacgaggacctgctggatggagtcatctttggagcccgctacctgggcagcacccagctggtgtctgaaagaaatccacccaccagcaccaggatggcccaggcccgggaggccatggacagagtgaaggccccagatggagagacccagcccatgacagaggtggacctgtttgtgtccaccaagaggatcaaggtgctgacagctgacagccaggaggccatgatggaccacgccctgcacaccatctcctacacagctgacatcggctgtgtgctggtgctgatggcccggcggcggctggcccggcggcctgccccccaggaccatggaagaagactctacaagatgctgtgccacgtgttctatgcagaagatgcccagctgattgcccaggccatcggccaggcctttgctgctgcctacagccagttcctgcgggagagcggcatcgaccccagccaggtgggcgtgcaccccagccctggggcctgccacctgcacaacggggacctggaccacttcagcaacagcgacaactgccgggaggtgcacctggagaagagaagaggagagggcctgggcgtggccctggtggagagcggctggggcagcctgctgcccacagctgtgattgccaacctgctgcacggcggccctgctgagaggtctggggccctgagcatcggggaccggctgacagccatcaatggcaccagcctggtgggcctgcccctggccgcctgccaggccgctgtgcgggagaccaagagccagacctctgtgaccctgagcatcgtgcactgcccccctgtgaccacagccatcatccaccggccccacgcccgggagcagctgggcttctgtgtggaggatggcatcatctgcagcctgctgcggggcggcattgctgagcggggcggcatccgggtgggccaccgcatcatcgagatcaatggccagagcgtggtggccacccctcatgcccgcatcatcgagctgctgacagaggcctacggggaggtgcacatcaagaccatgcctgctgccacctaccgcctgctgaccggccaggagcagcctgtgtacctgtag

SEQ ID NO: 35372 - DNA, 2013 bp, Artificial Sequence
  Description of Artificial Sequence: Synthetic coding sequence
atgattgccagctgcctgtgctacctgctgctgcctgccaccaggctcttccgggccctgagtgatgccttcttcacctgcaggaagaatgtgctgctggccaacagcagcagcccccaggtggagggggactttgccatggccccccggggccctgagcaggaggagtgtgagggcctgctgcagcagtggagggaggagggcctgagccaggtgctgagcacagccagcgagggccccctgattgacaagggcctggcccagagcagcctggccctgctgatggacaaccctggagaagaaaatgctgccagcgaggaccgctggagcagccggcagctgagtgacctgcgggctgctgagaacctggatgagcccttccctgagatgctgggggaggagcccctgctggaggtggagggcgtggagggctccatgtgggccgccatccccatgcagagcgagccccagtatgctgactgtgccgccctgcctgtgggcgccctggccacagagcagtgggaggaggaccctgctgtgctggcctggagcatcgcccctgagcctgtgccccaggaggaggccagcatctggccctttgagggcctgggccagctgcagcccccagctgtggagatcccctaccacgagatcctgtggagggagtgggaggacttcagcacccagccagatgcccagggcctgaaggctggagatggcccccagttccagttcaccctgatgagctacaacatcctggcccaggacctgatgcagcagagcagcgagctgtacctgcactgccacccagacatcctgaactggaactacagatttgtgaacctgatgcaggagttccagcactgggaccctgacatcctgtgcctgcaggaggtgcaggaggaccactactgggagcagctggagcccagcctgaggatgatgggcttcacctgcttctacaagagaagaacaggctgcaagacagatggctgtgctgtgtgctacaagcccacccgcttccggctgctgtgtgccagccctgtggagtacttccggcccggcctggagctgctgaacagagacaacgtgggcctggtgctgctgctgcagcccctggtgcctgagggcctgggccaggtgtctgtggcccccctgtgtgtggccaacacccacatcctgtacaaccccaggagaggagatgtgaagctggcccagatggccatcctgctggccgaggtggacaaggtggcccggctgagtgatggcagccactgccccatcatcctgtgtggggacctgaacagcgtgcctgacagccccctgtacaacttcatcagagatggagagctgcagtaccacggcatgcctgcctggaaggtgtctggccaggaggacttcagccaccagctgtaccagaggaagctgcaggcccccctgtggcccagcagcctgggcatcacagactgctgccagtatgtgaccagctgccaccccaagaggtctgagaggaggaaatatggccgggacttcctgctgcgcttccgcttctgcagcatcgcctgccagaggcctgtgggcctggtgctgatggagggcgtgacagacaccaagccagagaggcctgctggctgggccgagagcgtgctggaggaggatgccagcgagctggagcccgccttcagcaggacagtgggcaccatccagcactgcctgcacctgacctctgtgtacacccacttcctgccccagaggggccggcctgaggtgaccaccatgcccctgggcctgggcatgacagtggactacatcttcttctctgctgagagctgtgaaaatggaaacagaacagaccaccggctgtacagagatggcaccctgaagctgctgggccgcctgagcctgctgtctgaggagatcctgtgggccgccaacggcctgcccaaccccttctgcagcagtgaccacctgtgcctgctggccagctttggcatggaggtgacagccccctag

SEQ ID NO: 35373 - DNA, 789 bp, Artificial Sequence
  Description of Artificial Sequence: Synthetic coding sequence
atgttcccccaccacagccgcagcctgggccgggactggaccaccccctgggagaacctgcagcgctgctgctggaacagacacatcagcagctgcatgcgctggccaggccactacagccgggccccctacccctacttcagcagccgccacttcagcctgaactggaggcctccctgcctgtttgagagcaggacccagttccagtactgcaactggaggccagacaacctgagccagaccagcctcatccacctgagcagctatgtgatgaatgcagaaggagatgagcccagcagcaagaggaggaagcaccagggcgtcatcaagaggaactgggagtacatctgcagccatgacaaggagaagaccaagatcctgggggacaagaatgtggaccccaagtgtgaagattctgagaacaagtttgacttctctgtgatgagctacaacatcctgagccaggacctgctggaggacaacagccacctgtaccgccactgcagaagacctgtgctgcactggagcttccgcttccccaacatcctgaaggagatcaagcactttgatgctgatgtgctgtgcctgcaggaggtgcaggaggaccactacggggctgagatccggcccagcctggagagcctgggcaccatgcagctgttcttcttcttcttcttctttgaaacaggcagccacagcgtggcccagctggagtgcagcggcaccatcatggcccactacagcctgaacctgctgggcagcagcaaccccctcatcagcgccagctag

SEQ ID NO: 35374 - DNA, 1128 bp, Artificial Sequence
  Description of Artificial Sequence: Synthetic coding sequence
atgagctacaacatcctgagccaggacctgctggaggacaacagccacctgtaccgccactgccggcggcctgtgctgcactggagcttccgcttccccaacatcctgaaggagatcaagcactttgatgctgatgtgctgtgcctgcaggaggtgcaggaggaccactatggagctgagatccggcccagcctggagagcctgggctaccactgtgagtacaagatgaggacaggcaggaagccagatggctgtgccatctgcttcaagcacagcaagttcagcctgctgtctgtgaaccctgtggagttcttccggccagacatcagcctgctggaccgggacaacgtgggcctggtgctgctgctgcagcccaagatcccctatgctgcctgcccagccatctgtgtggccaacacccacctgctgtacaaccccaggagaggagacatcaagctgacccagctggccatgctgctggccgagatcagctctgtggcccaccagaaggatggcagcttctgccccatcgtgatgtgtggggacttcaacagcgtgcccggcagccccctgtacagcttcatcaaggagggcaagctgaactatgagggcctgcccatcggcaaggtgtctggccaggagcagagcagccggggccagaggatcctgagcatccccatctggccacccaacctgggcatcagccagaactgtgtgtatgaggtgcagcaggtgcccaaggtggagaagacagacagcgacctgacccagacccagctgaagcagacagaggtgctggtgacagctgagaagctgagcagcaacctgcagcaccacttcagcctgagctctgtgtacagccactacttcccagacaccggcatccctgaggtgaccacctgccacagccgcagcgccatcaccgtggactacatcttctacagcgctgagaaggaggatgtggccggccaccctggagctgaggtggccctggtgggcggcctgaagctgctggcccggctgagcctgctgacagagcaggacctgtggacagtgaatggcctgcccaatgaaaacaacagcagtgaccacctgcccctgctggccaagttccggctggagctgtag

SEQ ID NO: 35375 - DNA, 1635 bp, Artificial Sequence
  Description of Artificial Sequence: Synthetic coding sequence
atggaggcctggaggtgtgtgaggaagggctacggccactgtgtggtgggccggggccgctaccccatgttcccccaccacagccgcagcctgggccgggactggaccaccccctgggagaacctgcagcgctgctgctggaacagacacatcagcagctgcatgcgctggccaggccactacagccgggccccctacccctacttcagcagccgccacttcagcctgaactggaggcctccctgcctgtttgagagcaggacccagttccagtactgcaactggaggccagacaacctgagccagaccagcctcatccacctgagcagctatgtgatgaatgcagaaggagatgagcccagcagcaagaggaggaagcaccagggcgtcatcaagaggaactgggagtacatctgcagccatgacaaggagaagaccaagatcctgggggacaagaatgtggaccccaagtgtgaagattctgagaacaagtttgacttctctgtgatgagctacaacatcctgagccaggacctgctggaggacaacagccacctgtaccgccactgcagaagacctgtgctgcactggagcttccgcttccccaacatcctgaaggagatcaagcactttgatgctgatgtgctgtgcctgcaggaggtgcaggaggaccactacggggctgagatccggcccagcctggagagcctgggctaccactgtgagtacaagatgaggactggaaggaagccagatggctgtgccatctgcttcaagcacagcaagttcagcctgctgtctgtgaaccctgtggagttcttccggccagacatcagcctgctggaccgggacaacgtgggcctggtgctgctgctgcagcccaagatcccctatgctgcctgcccagccatctgtgtggccaacacccacctgctgtacaacccccggcggggggacatcaagctgacccagctggccatgctgctggccgagatcagctctgtggcccaccagaaggatggcagcttctgccccatcgtgatgtgtggggacttcaacagcgtgcccggcagccccctgtacagcttcatcaaggagggcaagctgaactatgagggcctgcccatcggcaaggtgtctggccaggagcagagcagccggggccagaggatcctgagcatccccatctggccacccaacctgggcatcagccagaactgtgtgtatgaggtgcagcaggtgcccaaggtggagaagacagacagcgacctgacccagacccagctgaagcagacagaggtgctggtgacagctgagaagctgagcagcaacctgcagcaccacttcagcctgagctctgtgtacagccactacttcccagacaccggcatccctgaggtgaccacctgccacagccgcagcgccatcaccgtggactacatcttctacagcgctgagaaggaggatgtggccggccaccctggagctgaggtggccctggtgggcggcctgaagctgctggcccggctgagcctgctgacagagcaggacctgtggacagtgaatggcctgcccaatgaaaacaacagcagtgaccacctgcccctgctggccaagttccggctggagctgtag

SEQ ID NO: 35376 - DNA, 639 bp, Artificial Sequence
  Description of Artificial Sequence: Synthetic coding sequence
atgagctacaacatcctgagccaggacctgctggaggacaacagccacctgtaccgccactgccggcggcctgtgctgcactggagcttccgcttccccaacatcctgaaggagatcaagcactttgatgctgatgtgctgtgcctgcaggaggtgcaggaggaccactatggagctgagatccggcccagcctggagagcctgggctaccactgtgagtacaagatgaggacaggcaggaagccagatggctgtgccatctgcttcaagcacagcaagttcagcctgctgtctgtgaaccctgtggagttcttccggccagacatcagcctgctggaccgggacaacgtgggcctggtgctgctgctgcagcccaagatcccctatgctgcctgcccagccatctgtgtggccaacacccacctgctgtacaaccccaggagaggagacatcaagctgacccagctggccatgctgctggccgagatcagctctgtggcccaccagaaggatggcagcttctgccccatcgtgatgtgtggggacttcaacagcgtgcccggcagccccctgtacagcttcatcaaggagggcaagctgaactatgagggcctgcccatcggcaagacagtcatctag

SEQ ID NO: 35377 - DNA, 1257 bp, Artificial Sequence
  Description of Artificial Sequence: Synthetic coding sequence
atggagggcgtcatcaagaggaactgggagtacatctgcagccatgacaaggagaagaccaagatcctgggggacaagaatgtggaccccaagtgtgaagattctgagaacaagtttgacttctctgtgatgagctacaacatcctgagccaggacctgctggaggacaacagccacctgtaccgccactgcagaagacctgtgctgcactggagcttccgcttccccaacatcctgaaggagatcaagcactttgatgctgatgtgctgtgcctgcaggaggtgcaggaggaccactacggggctgagatccggcccagcctggagagcctgggctaccactgtgagtacaagatgaggactggaaggaagccagatggctgtgccatctgcttcaagcacagcaagttcagcctgctgtctgtgaaccctgtggagttcttccggccagacatcagcctgctggaccgggacaacgtgggcctggtgctgctgctgcagcccaagatcccctatgctgcctgcccagccatctgtgtggccaacacccacctgctgtacaacccccggcggggggacatcaagctgacccagctggccatgctgctggccgagatcagctctgtggcccaccagaaggatggcagcttctgccccatcgtgatgtgtggggacttcaacagcgtgcccggcagccccctgtacagcttcatcaaggagggcaagctgaactatgagggcctgcccatcggcaaggtgtctggccaggagcagagcagccggggccagaggatcctgagcatccccatctggccacccaacctgggcatcagccagaactgtgtgtatgaggtgcagcaggtgcccaaggtggagaagacagacagcgacctgacccagacccagctgaagcagacagaggtgctggtgacagctgagaagctgagcagcaacctgcagcaccacttcagcctgagctctgtgtacagccactacttcccagacaccggcatccctgaggtgaccacctgccacagccgcagcgccatcaccgtggactacatcttctacagcgctgagaaggaggatgtggccggccaccctggagctgaggtggccctggtgggcggcctgaagctgctggcccggctgagcctgctgacagagcaggacctgtggacagtgaatggcctgcccaatgaaaacaacagcagtgaccacctgcccctgctggccaagttccggctggagctgtag

SEQ ID NO: 35378 - DNA, 1128 bp, Artificial Sequence; identical to SEQ ID NO: 35374
  Description of Artificial Sequence: Synthetic coding sequence

SEQ ID NO: 35379 - DNA, 2520 bp, Artificial Sequence
  Description of Artificial Sequence: Synthetic coding sequence
atgtctgctggagatggcctgcggcggggcaagagcgcccgctgtggcctgaccttctctgtgggccgcttcttccgctggatggtggacacccgcatctctgtgcgcatccacgagtatgctgccatcagcctgacagcctgcatggagaacctggtggaggagatccgggcccgggtgatggccagccacagcccagatggcggcggggccggcggcggggaggtgtctgctgaggccctggagatggtgatcaacaatgatgctgagctgtggggcgtgctgcagccctatgagcacctgatctgtgggaagaatgccaacggggtgctgagcctgcctgcctacttcagcccctacaatggaggcagcctgggccatgatgaaagagcagatgcctatgcccagctggagctgcggaccctggagcagagcctgctggccacctgtgtgggcagcatcagcgagctgagtgacctggtgtcccgggccatgcaccacatgcagggccgccaccccctgtgccctggggccagccctgcccggcaggcccggcagcccccccagcccatcacctggagcccagatgccctgcacaccctgtactacttcctgcgctgcccccagatggagagcatggagaaccccaacctggacccccccaggatgaccctgaacaatgaaagacccttcatgctgctgccccccctgatggagtggatgagggtggccatcacctacgccgagcacagaagaagcctgactgtggacagcggggacatccggcaggccgcccggctgctgctgcccggcctggactgtgagccccggcagctgaagccagagcactgcttcagcagcttccggcggctggatgcccgggccgccacagagaagttcaaccaggacctgggcttcaggatgctgaactgtggccgcacagacctgatcaaccaggccatcgaggccctgggcccagatggagtgaacaccatggatgaccagggcatgacccccctgatgtatgcctgtgccgctggagatgaggccatggtgcagatgctgattgatgctggggccaacctggacatccaggtgcccagcaacagccccaggcaccccagcatccacccagacagccgccactggaccagcctgacctttgctgtgctgcacggccacatctctgtggtgcagctgctgctggatgctggggcccacgtggagggcagcgctgtgaatggaggagaagattcctatgcagagacccccctgcagctggccagcgctgctggcaactatgagctggtgtccctgctgctgagcagaggagctgaccccctgctgtccatgctggaggcccacggcatgggcagcagcctgcacgaggacatgaactgcttcagccacagcgctgcccacggccacagaaatgtgctgaggaagctgctgacccagccccagcaggccaaggcagatgtgctgagcctggaggagatcctggccgagggcgtggaggagagtgatgccagcagccagggcagcggcagcgagggccctgtgcggctgagcaggaccaggaccaaggccctgcaggaggccatgtactacagcgctgagcacggctacgtggacatcaccatggagctgcgggccctgggcgtgccctggaagctgcacatctggattgagagcctgcggaccagcttcagccagagccgctacagcgtggtgcagagcctgctgcgggacttcagcagcatccgggaggaggagtacaatgaggagctggtgacagagggcctgcagctgatgtttgacatcctgaagaccagcaagaatgacagcgtcatccagcagctggccaccatcttcacccactgctacggcagcagccccatccccagcatccctgagatcaggaagaccctgcctgcccggctggacccccacttcctgaacaacaaggagatgtctgatgtgaccttcctggtggagggcaagctgttctacgcccacaaggtgctgctggtgacagccagcaaccgcttcaagaccctgatgaccaacaagtctgagcaggatggagacagcagcaagaccatcgagatcagtgacatgaagtaccacatcttccagatgatgatgcagtacctgtactatggaggaacagagagcatggagatccccaccacagacatcctggagctgctgtctgctgccagcctcttccagctggatgccctgcagaggcactgtgagatcctgtgcagccagaccctgtccatggagagcgctgtgaacacctacaagtatgccaagatccacaatgcccctgagctggccctcttctgtgagggcttcttcctgaagcacatgaaggccctgctggagcaggatgccttccggcagctgatctacggccgcagcagcaaggtgcagggcctggaccccctgcaggacctgcagaacaccctggccgagcgggtgcacagcgtgtacatcaccagccgggtgtag

SEQ ID NO: 35380 - DNA, 3078 bp, Artificial Sequence
  Description of Artificial Sequence: Synthetic coding sequence
atggccggcacctacagcagcaccctgaagaccctggaggacctgaccctggacagcggctatggagctggggacagctgccgcagcctgagcctgagcagcagcaagagcaacagccaggccctgaacagcagcgcccagcagcacagaggagctgcctggtggtgctacagcggctccatgaacagccgccacaacagctgggacacagtgaacacagtgctgcctgaagatcctgaggtggccgacctcttcagccgctgcccccggctgcctgagctggaggagttcccctggacagaaggagatgtggcccgggtgctgaggaagggggccggcggccgccgcctgccccagttctctgctgaggccgtgcggcggctggccggcctgctgcggcgggccctgatccgggtggcccgggaggcccagaggctgtctgtgctgcacgccaagtgcaccaggtttgaggtgcagagcgctgtgcggctggtgcacagctgggccctggccgagagctgtgccctggccgctgtgaaggccctgagcctgtacagcatgtctgctggagatggcctgcggcggggcaagagcgcccgctgtggcctgaccttctctgtgggccgcttcttccgctggatggtggacacccgcatctctgtgcgcatccacgagtatgctgccatcagcctgacagcctgcatggagaacctggtggaggagatccgggcccgggtgatggccagccacagcccagatggcggcggggccggcggcggggaggtgtctgctgaggccctggagatggtgatcaacaatgatgctgagctgtggggcgtgctgcagccctatgagcacctgatctgtgggaagaatgccaacggggtgctgagcctgcctgcctacttcagcccctacaatggaggcagcctgggccatgatgaaagagcagatgcctatgcccagctggagctgcggaccctggagcagagcctgctggccacctgtgtgggcagcatcagcgagctgagtgacctggtgtcccgggccatgcaccacatgcagggccgccaccccctgtgccctggggccagccctgcccggcaggcccggcagcccccccagcccatcacctggagcccagatgccctgcacaccctgtactacttcctgcgctgcccccagatggagagcatggagaaccccaacctggacccccccaggatgaccctgaacaatgaaagacccttcatgctgctgccccccctgatggagtggatgagggtggccatcacctacgccgagcacagaagaagcctgactgtggacagcggggacatccggcaggccgcccggctgctgctgcccggcctggactgtgagccccggcagctgaagccagagcactgcttcagcagcttccggcggctggatgcccgggccgccacagagaagttcaaccaggacctgggcttcaggatgctgaactgtggccgcacagacctgatcaaccaggccatcgaggccctgggcccagatggagtgaacaccatggatgaccagggcatgacccccctgatgtatgcctgtgccgctggagatgaggccatggtgcagatgctgattgatgctggggccaacctggacatccaggtgcccagcaacagccccaggcaccccagcatccacccagacagccgccactggaccagcctgacctttgctgtgctgcacggccacatctctgtggtgcagctgctgctggatgctggggcccacgtggagggcagcgctgtgaatggaggagaagattcctatgcagagacccccctgcagctggccagcgctgctggcaactatgagctggtgtccctgctgctgagcagaggagctgaccccctgctgtccatgctggaggcccacggcatgggcagcagcctgcacgaggacatgaactgcttcagccacagcgctgcccacggccacagaaatgtgctgaggaagctgctgacccagccccagcaggccaaggcagatgtgctgagcctggaggagatcctggccgagggcgtggaggagagtgatgccagcagccagggcagcggcagcgagggccctgtgcggctgagcaggaccaggaccaaggccctgcaggaggccatgtactacagcgctgagcacggctacgtggacatcaccatggagctgcgggccctgggcgtgccctggaagctgcacatctggattgagagcctgcggaccagcttcagccagagccgctacagcgtggtgcagagcctgctgcgggacttcagcagcatccgggaggaggagtacaatgaggagctggtgacagagggcctgcagctgatgtttgacatcctgaagaccagcaagaatgacagcgtcatccagcagctggccaccatcttcacccactgctacggcagcagccccatccccagcatccctgagatcaggaagaccctgcctgcccggctggacccccacttcctgaacaacaaggagatgtctgatgtgaccttcctggtggagggcaagctgttctacgcccacaaggtgctgctggtgacagccagcaaccgcttcaagaccctgatgaccaacaagtctgagcaggatggagacagcagcaagaccatcgagatcagtgacatgaagtaccacatcttccagatgatgatgcagtacctgtactatggaggaacagagagcatggagatccccaccacagacatcctggagctgctgtctgctgccagcctcttccagctggatgccctgcagaggcactgtgagatcctgtgcagccagaccctgtccatggagagcgctgtgaacacctacaagtatgccaagatccacaatgcccctgagctggccctcttctgtgagggcttcttcctgaagcacatgaaggccctgctggagcaggatgccttccggcagctgatctacggccgcagcagcaaggtgcagggcctggaccccctgcaggacctgcagaacaccctggccgagcgggtgcacagcgtgtacatcaccagccgggtgtag

SEQ ID NO: 35381 - DNA, 126 bp, Artificial Sequence
  Description of Artificial Sequence: Synthetic coding sequence
atgcaggaggagctggcctgggagacagatggcctgtgggatgaatgtgccagccctgtgtgcctggtgcggcccctgaccaaccccccagacctgggcaagctgcggggccaggaccccctgtag

SEQ ID NO: 35382 - DNA, 414 bp, Artificial Sequence
  Description of Artificial Sequence: Synthetic coding sequence
atgcaggagctgattggaagaagagtgaacacccgggccaggaaccacgtgggccgggtggccctgcactgggccgccggggccggccacgagcaggccgtgcggctgctgctggagcacgaggccgctgtggatgaagaagatgctgtgggcgccctgacagaggagggcaacacagccctgcacctggccgccggccggggccacatggctgtgctgcagaggctggtggacatcggcctggacctggaggagcagaatgctgagggcctgacagccctgcacagcgctgctgggggcagccacccagactgtgtgcagctgctgctgcgggccggcagcacagtgaatgccctgacccaggtggcccggcccagccaggactgtggccgcctgctggccgctgagccctag

SEQ ID NO: 35383 - DNA, 1473 bp, Artificial Sequence
  Description of Artificial Sequence: Synthetic coding sequence
atgcaggaggagctggcctgggagacagatggcctgctgcccctggagcggcagctgcacgaggccgcccggcagaacaacgtgggccgcatgcaggagctgattggaagaagagtgaacacccgggccaggaaccacgtgggccgggtggccctgcactgggccgccggggccggccacgagcaggccgtgcggctgctgctggagcacgaggccgctgtggatgaagaagatgctgtgggcgccctgacagaggcccggctgtgcttcggcatgaatgccctgctgctgagcgcctggtttggccacctgcgcatcctgcagatcctggtgaacagcggggccaagatccactgtgagagcaaggatggcctgaccctgctgcactgtgccgcccagaagggccacgtgcctgtgctggccttcatcatggaggacctggaggatgtggccctggaccacgtggacaagctgggccgcacagccttccacagagctgctgagcacggccagctggatgccctggacttcctggtgggcagcggctgtgaccacaacgtgaaggacaaggagggcaacacagccctgcacctggccgccggccggggccacatggctgtgctgcagaggctggtggacatcggcctggacctggaggagcagaatgctgagggcctgacagccctgcacagcgctgctgggggcagccacccagactgtgtgcagctgctgctgcgggccggcagcacagtgaatgccctgacccagaagaacctgagctgcctgcactatgctgccctgagcggctctgaagatgtgtcccgggtgctgattcatgctgggggctgtgccaacgtggtggaccaccagggcgccagccccctgcacctggccgtgcgccacaacttccctgccctggtgcggctgctgatcaacagcgacagtgatgtgaatgctgtggacaaccggcagcagacccccctgcacctggccgctgagcacgcctggcaggacattgctgacatgctgctgattgctggggtggacctgaacctgcgggacaaggaccaccccagcgaccccagcggcaagagcctgtccttcaagcaggaccaccggcaggagacccagcagctgcggtctgtgctgtggaggctggccagccgctacctgcagccccgggagtggaagaagctggcctacagctgggagttcacagaggcccacgtggatgccatcgagcagcagtggacaggcaccaggagctaccaggagcacggccacaggatgctgctgatctggctgcacggcgtggccacagctggggagaaccccagcaaggccctgtttgagggcctggtggccatcggccggcgggacctggccggctggagcaccatggcccggagccagctgacagccaccagcgccagccgggtgcagatgatcctggtgccccagcccccagagtag

SEQ ID NO: 35384 - DNA, 1569 bp, Artificial Sequence
  Description of Artificial Sequence: Synthetic coding sequence
atgcaggaggagctggcctgggagacagatggcctgctgcccctggagcggcagctgcacgaggccgcccggcagaacaacgtgggccgcatgcaggagctgattggaagaagagtgaacacccgggccaggaaccacgtgggccgggtggccctgcactgggccgccggggccggccacgagcaggccgtgcggctgctgctggagcacgaggccgctgtggatgaagaagatgctgtgggcgccctgacagaggcccggctgtgcttcggcatgaatgccctgctgctgagcgcctggtttggccacctgcgcatcctgcagatcctggtgaacagcggggccaagatccactgtgagagcaaggatggcctgaccctgctgcactgtgccgcccagaagggccacgtgcctgtgctggccttcatcatggaggacctggaggatgtggccctggaccacgtggacaagctgggccgcacagccttccacagagctgctgagcacggccagctggatgccctggacttcctggtgggcagcggctgtgaccacaacgtgaaggacaaggagggcaacacagccctgcacctggccgccggccggggccacatggctgtgctgcagaggctggtggacatcggcctggacctggaggagcagaatgctgagggcctgacagccctgcacagcgctgctgggggcagccacccagactgtgtgcagctgctgctgcgggccggcagcacagtgaatgccctgacccagaagaacctgagctgcctgcactatgctgccctgagcggctctgaagatgtgtcccgggtgctgattcatgctgggggctgtgccaacgtggtggaccaccagggcgccagccccctgcacctggccgtgcgccacaacttccctgccctggtgcggctgctgatcaacagcgacagtgatgtgaatgctgtggacaaccggcagcagacccccctgcacctggccgctgagcacgcctggcaggacattgctgacatgctgctgattgctggggtggacctgaacctgcgggacaagcagggcaagacagccctggccgtggccgtgcgcagcaaccacgtgtccctggtggacatgatcatcaaggctgaccgcttctaccgctgggagaaggaccaccccagcgaccccagcggcaagagcctgtccttcaagcaggaccaccggcaggagacccagcagctgcggtctgtgctgtggaggctggccagccgctacctgcagccccgggagtggaagaagctggcctacagctgggagttcacagaggcccacgtggatgccatcgagcagcagtggacaggcaccaggagctaccaggagcacggccacaggatgctgctgatctggctgcacggcgtggccacagctggggagaaccccagcaaggccctgtttgagggcctggtggccatcggccggcgggacctggccggctggagcaccatggcccggagccagctgacagccaccagcgccagccgggtgcagatgatcctggtgccccagcccccagagtag

SEQ ID NO: 35385 - DNA, 1545 bp, Artificial Sequence
  Description of Artificial Sequence: Synthetic coding sequence
atgcaggaggagctggcctgggagacagatggcctgctgcccctggagcggcagctgcacgaggccgcccggcagaacaacgtgggccgcatgcaggagctgattggaagaagagtgaacacccgggccaggaaccacgtgggccgggtggccctgcactgggccgccggggccggccacgagcaggccgtgcggctgctgctggagcacgaggccgctgtggatgaagaagatgctgtgggcgccctgacagaggcccggctgtgcttcggcatgaatgccctgctgctgagcgcctggtttggccacctgcgcatcctgcagatcctggtgaacagcggggccaagatccactgtgagagcaaggatggcctgaccctgctgcactgtgccgcccagaagggccacgtgcctgtgctggccttcatcatggaggacctggaggatgtggccctggaccacgtggacaagctgggccgcacagccttccacagagctgctgagcacggccagctggatgccctggacttcctggtgggcagcggctgtgaccacaacgtgaaggacaaggagggcaacacagccctgcacctggccgccggccggggccacatggctgtgctgcagaggctggtggacatcggcctggacctggaggagcagaatgctgagggcctgacagccctgcacagcgctgctgggggcagccacccagactgtgtgcagctgctgctgcgggccggcagcacagtgaatgccctgacccagaagaacctgagctgcctgcactatgctgccctgagcggctctgaagatgtgtcccgggtgctgattcatgctgggggctgtgccaacgtggtggaccaccagggcgccagccccctgcacctggccgtgcgccacaacttccctgccctggtgcggctgctgatcaacagcgacagtgatgtgaatgctgtggacaaccggcagcagacccccctgcacctggccgctgagcacgcctggcaggacattgctgacatgctgctgattgctggggtggacctgaacctgcgggacaagcagggcaagacagccctggccgtggccgtgcgcagcaaccacgtgtccctggtggacatgatcatcaaggctgaccgcttctaccgctgggagaaggaccaccccagcgaccccagcggcaagagcctgtccttcaagcaggaccaccggcaggagacccagcagctgcggtctgtgctgtggaggctggccagccgctacctgcagccccgggagtggaagaagctggcctacagctgggagttcacagaggcccacgtggatgccatcgagcagcagtggacaggcaccaggagctaccaggagcacggccacaggatgctgctgatctggctgcacggcgtggccacagctggggagaaccccagcaaggccctgtttgagggcctggtggccatcggccggcgggacctggccgagaacatcaggaagaaggccaatgctgcccccagcgccccccggcgctgcacagccatgtag

SEQ ID NO: 35386 - DNA, 1200 bp, Artificial Sequence
  Description of Artificial Sequence: Synthetic coding sequence
atgaatgccctgctgctgagcgcctggtttggccacctgcgcatcctgcagatcctggtgaacagcggggccaagatccactgtgagagcaaggatggcctgaccctgctgcactgtgccgcccagaagggccacgtgcctgtgctggccttcatcatggaggacctggaggatgtggccctggaccacgtggacaagctgggccgcacagccttccacagagctgctgagcacggccagctggatgccctggacttcctggtgggcagcggctgtgaccacaacgtgaaggacaaggagggcaacacagccctgcacctggccgccggccggggccacatggctgtgctgcagaggctggtggacatcggcctggacctggaggagcagaatgctgagggcctgacagccctgcacagcgctgctgggggcagccacccagactgtgtgcagctgctgctgcgggccggcagcacagtgaatgccctgacccagaagaacctgagctgcctgcactacgccgccctgagcggctctgaagatgtgtcccgggtgctgattcatgctgggggctgtgccaacgtggtggaccaccagggcgccagccccctgcacctggccgtgcgccacaacttccctgccctggtgcggctgctgatcaacagcgacagtgatgtgaatgctgtggacaaccggcagcagacccccctgcacctggccgctgagcacgcctggcaggacattgctgacatgctgctgattgctggggtggacctgaacctgcgggacaaggaccaccccagcgaccccagcggcaagagcctgtccttcaagcaggaccaccggcaggagacccagcagctgcggtctgtgctgtggaggctggccagccgctacctgcagccccgggagtggaagaagctggcctacagctgggagttcacagaggcccacgtggatgccatcgagcagcagtggacaggcaccaggagctaccaggagcacggccacaggatgctgctgatctggctgcatggagtggccacagctggggagaaccccagcaaggccctgtttgagggcctggtggccatcggcagaagagacctggccggctggagcaccatggcccggagccagctgacagccaccagcgccagccgggtgcagatgatcctggtgccccagcccccagagtag

SEQ ID NO: 35387 - DNA, 546 bp, Artificial Sequence
  Description of Artificial Sequence: Synthetic coding sequence
atgaatgccctgctgctgagcgcctggtttggccacctgcgcatcctgcagatcctggtgaacagcggggccaagatccactgtgagagcaaggatggcctgaccctgctgcactgtgccgcccagaagggccacgtgcctgtgctggccttcatcatggaggacctggaggatgtggccctggaccacgtggacaagctgggccgcacagccttccacagagctgctgagcacggccagctggatgccctggacttcctggtgggcagcggctgtgaccacaacgtgaaggacaaggagggcaacacagccctgcacctggccgccggccggggccacatggctgtgctgcagaggctggtggacatcggcctggacctggaggagcagaatgctgagggcctgacagccctgcacagcgctgctgggggcagccacccagactgtgtgcagctgctgctgcgggccggcagcacagtgaatgccctgacccaggtggcccggcccagccaggactgtggccgcctgctggccgctgagccctag

SEQ ID NO: 35388 - DNA, 270 bp, Artificial Sequence
  Description of Artificial Sequence: Synthetic coding sequence
atgctgggcggcctgggcaagctggccgctgagggcctggcccacaggacagagaaggccacagaaggagccatccatgctgtggaggaggtggtgaaggaggtggtgggccacgccaaggagaccggggagaaggccatcgccgaggccatcaagaaggcccaggagagcggggacaagaagatgaaggagatcacagagaccgtgaccaacacagtgaccaatgccatcacccacgccgctgagagcctggacaagctgggccagtag

SEQ ID NO: 35389 - DNA, 3270 bp, Artificial Sequence
  Description of Artificial Sequence: Synthetic coding sequence
atgggcaacaccaccaccaagttcaggaaggccctgatcaatggagatgagaacctggcctgccagatctatgagaacaacccccagctgaaggagagcctggaccccaacaccagctatggagagccctaccagcacaacacccccctgcactatgctgcccggcacggcatgaacaagatcctgggcaccttcctgggcagagatggcaaccccaacaagagaaatgtgcacaatgagacctccatgcacctgctgtgcatgggcccccagatcatgatcagcgagggcgccctgcacccccggctggcccggcccacagaagatgacttccggcgggctgactgcctgcagatgatcctgaagtggaagggggccaagctggaccagggcgagtatgagcgggccgccattgatgctgtggacaacaagaagaacacccccctgcactacgccgccgccagcggcatgaaggcctgtgtggagctgctggtgaagcatggaggagacctgtttgctgaaaatgaaaacaaggacaccccctgtgactgtgccgagaagcagcaccacaaggacctggccctgaacctggagagccagatggtgttcagccgggaccctgaggccgaggagattgaggccgagtatgctgccctggacaagcgggagccctatgagggcctgcggccccaggacctgcggcggctgaaggacatgctgattgtggagacagctgacatgctgcaggcccccctcttcaccgctgaggccctgctgcgggcccatgactgggaccgggagaagctgctggaggcctggatgagcaaccctgagaactgctgccagaggtctggagtgcagatgcccaccccaccacccagcggctacaatgcctgggacaccctgcccagccccaggacccccaggaccaccaggagctctgtgaccagcccagatgagatcagcctgagccctggggacctggacaccagcctgtgtgacatctgcatgtgcagcatctctgtgtttgaggaccctgtggacatgccctgtggccatgacttctgccggggctgctgggagagcttcctgaacctgaagatccaggagggggaggcccacaacatcttctgcccagcctatgactgcttccagctggtgcctgtggacatcatcgagagcgtggtgtccaaggagatggacaagcgctacctgcagtttgacatcaaggcctttgtggagaacaacccagccatcaagtggtgccccaccccaggctgtgacagagctgtgcggctgaccaagcagggcagcaacaccagcggcagtgacaccctgtccttccccctgctgcgggccccagctgtggactgtgggaagggccacctgttctgctgggagtgcctgggggaggcccacgagccctgtgactgccagacctggaagaactggctgcagaagatcacagagatgaagccagaggagctggtgggcgtgtctgaggcctatgaagatgctgccaactgcctgtggctgctgaccaacagcaagccctgtgccaactgcaagagccccatccagaagaatgaaggctgcaaccacatgcagtgtgccaagtgcaagtatgacttctgctggatctgcctggaggagtggaagaagcacagcagcagcactggaggctactaccgctgcaccaggtatgaggtgatccagcacgtggaggagcagagcaaggagatgacagtggaggccgagaagaagcacaagcgcttccaggagctggaccgcttcatgcactactacacccgcttcaagaaccacgagcacagctaccagctggagcagaggctgctgaagacagccaaggagaagatggagcagctgagccgggccctgaaggagacagagggcggctgcccagacaccaccttcattgaagatgctgtgcacgtgctgctgaagacccggcgcatcctgaagtgcagctacccctacggcttcttcctggagcccaagagcaccaagaaggagatctttgagctgatgcagacagacctggagatggtgacagaggacctggcccagaaggtgaaccggccctacctgcggacccccaggcacaagatcatcaaggccgcctgcctggtgcagcagaagaggcaggagttcctggcctctgtggcccggggcgtggccccagctgacagccctgaggccccccggcgcagctttgctgggggcacctgggactgggagtacctgggctttgccagccctgaggagtatgcagagttccagtacagaagaagacaccggcagaggagaagaggagatgtgcacagcctgctgagcaaccccccagaccctgatgagcccagcgagagcaccctggacatccctgagggcggcagcagcagccggcggcccggcacctctgtggtgtcctctgcctccatgtctgtgctgcacagcagcagcctgcgggactacaccccagccagccgctctgagaaccaggacagcctgcaggccctgagcagcctggatgaagatgaccccaacatcctgctggccatccagctgagcctgcaggagagcggcctggccctggatgaggagacccgggacttcctgagcaatgaggccagcctgggcgccatcggcaccagcctgcccagccggctggacagcgtgcccaggaacacagacagcccccgggccgccctgagcagcagcgagctgctggagctgggggacagcctgatgaggctgggcgcagaaaatgaccccttcagcacagacaccctgagcagccaccccctgtctgaggcccggagtgacttctgccccagcagcagtgaccctgacagcgctggccaggaccccaacatcaatgacaacctgctgggcaacatcatggcctggttccatgacatgaacccccagagcatcgccctgatccccccagccaccacagagatctctgctgacagccagctgccctgcatcaaggatggcagcgagggcgtgaaggatgtggagctggtgctgcctgaggacagcatgtttgaagatgcctctgtgtctgagggccggggcacccagatcgaggagaaccccctggaggagaacatcctggccggggaggccgccagccaggccggggacagcggaaatgaggccgccaacagaggagatggcagtgatgtgagcagccagaccccccagaccagcagtgactggctggagcaggtgcacctggtgtag

SEQ ID NO: 35390 - DNA, 405 bp, Artificial Sequence
  Description of Artificial Sequence: Synthetic coding sequence
atgggcaacaccaccaccaagttcaggaaggccctgatcaatggagatgagaacctggcctgccagatctatgagaacaacccccagctgaaggagagcctggaccccaacaccagctatggagagccctaccagcacaacacccccctgcactatgctgcccggcacggcatgaacaagatcctgggcaccttcctgggcagagatggcaaccccaacaagagaaatgtgcacaatgagacctccatgcacctgctgtgcatgggcccccagatcatgatcagcgagggcgccctgcacccccggctggcccggcccacagaagatgacttccggcgggctgactgcctgcagatgatcctgaagtggaagggggccaagctggaccagggcgagtatgaatag

SEQ ID NO: 35391 - DNA, 1947 bp, Artificial Sequence
  Description of Artificial Sequence: Synthetic coding sequence
atgctgtggccccggctggccgctgctgagtgggccgccctggcctgggagctgctgggcgcctctgtgctgctgattgctgtgcgctggctggtgcggcggctgggccccaggcctgggggcctgggccgcagcggcacccctgtgcccccaccttctgctgctgctgccccagccagcggggagatgaccatggatgccctgctggcccggctgaagctgctgaacccagatgacctgcgggaggagatcgtgaaggccggcctgaagtgtggccccatcaccagcaccacccgcttcatctttgagaagaagctggcccaggccctgctggagcagggcggccgcctgagcagcttctaccaccatgaagctggggtgacagccctgagccaggacccccagaggatcctgaagccagctgagggcaaccccacagaccaggccggcttctctgaagatcgggactttggctacagcgtgggcctgaaccccccagaggaggaggccgtgaccagcaagacctgcagcgtgcccccaagtgacacagacacctaccgggccggggccacagccagcaaggagccccccctgtactacggcgtgtgccctgtgtatgaagatgtgcctgccagaaatgaaagaatttatgtgtatgagaacaagaaggaggccctgcaggccgtgaagatgatcaagggcagccgcttcaaggccttcagcacccgggaggatgctgagaagtttgcccggggcatctgtgactacttccccagccccagcaagaccagcctgcccctgagccctgtgaagacagcccccctcttcagcaatgaccggctgaaggatggcctgtgcctgtctgagagcgagaccgtgaacaaggagcgggccaacagctacaagaaccccaggacccaggacctgacagccaagctgaggaaggctgtggagaagggggaggaggacaccttcagtgacctgatctggagcaacccccgctacctgattggcagcggggacaaccccaccatcgtgcaggagggctgccgctacaacgtgatgcacgtggccgccaaggagaaccaggccagcatctgccagctgaccctggatgtgctggagaacccagacttcatgaggctgatgtacccagatgatgatgaggccatgctgcagaagaggatccgctacgtggtggacctgtacctgaacaccccagacaagatgggctatgacacccccctgcactttgcctgcaagtttggaaatgctgatgtggtgaatgtgctgagcagccaccacctgattgtgaagaacagcaggaacaagtatgacaagaccccagaagatgtgatctgtgagaggagcaagaacaagtctgtggagctgaaggagcgcatccgggagtacctgaagggccactactacgtgcccctgctgcgggcagaggagaccagcagccctgtgattggagagctgtggagcccagaccagacagctgaggccagccacgtgagccgctatggaggcagcccccgggaccctgtgctgaccctgcgggcctttgctggccccctgagccctgccaaggccgaggacttcaggaagctgtggaagaccccaccccgggagaaggccggcttcctgcaccacgtgaagaagagtgaccctgagcggggctttgagcgggtgggccgggagctggcccacgagctgggctacccctgggtggagtactgggagttcctgggctgctttgtggacctgagcagccaggagggcctgcagaggctggaggagtacctgacccagcaggagatcggcaagaaggcccagcaggagaccggggagcgggaggccagctgccgggacaaggccaccacctctgtggagatgaggttccacagaattgaccaggccggcctggagctgctgaccagctag

SEQ ID NO: 35392 - DNA, 2817 bp, Artificial Sequence
  Description of Artificial Sequence: Synthetic coding sequence
atgctgtggccccggctggccgctgctgagtgggccgccctggcctgggagctgctgggcgcctctgtgctgctgattgctgtgcgctggctggtgcggcggctgggccccaggcctgggggcctgggccgcagcggcacccctgtgcccccaccttctgctgctgctgccccagccagcggggagatgaccatggatgccctgctggcccggctgaagctgctgaacccagatgacctgcgggaggagatcgtgaaggccggcctgaagtgtggccccatcaccagcaccacccgcttcatctttgagaagaagctggcccaggccctgctggagcagggcggccgcctgagcagcttctaccaccatgaagctggggtgacagccctgagccaggacccccagaggatcctgaagccagctgagggcaaccccacagaccaggccggcttctctgaagatcgggactttggctacagcgtgggcctgaaccccccagaggaggaggccgtgaccagcaagacctgcagcgtgcccccaagtgacacagacacctaccgggccggggccacagccagcaaggagccccccctgtactacggcgtgtgccctgtgtatgaagatgtgcctgccagaaatgaaagaatttatgtgtatgagaacaagaaggaggccctgcaggccgtgaagatgatcaagggcagccgcttcaaggccttcagcacccgggaggatgctgagaagtttgcccggggcatctgtgactacttccccagccccagcaagaccagcctgcccctgagccctgtgaagacagcccccctcttcagcaatgaccggctgaaggatggcctgtgcctgtctgagagcgagaccgtgaacaaggagcgggccaacagctacaagaaccccaggacccaggacctgacagccaagctgaggaaggctgtggagaagggggaggaggacaccttcagtgacctgatctggagcaacccccgctacctgattggcagcggggacaaccccaccatcgtgcaggagggctgccgctacaacgtgatgcacgtggccgccaaggagaaccaggccagcatctgccagctgaccctggatgtgctggagaacccagacttcatgaggctgatgtacccagatgatgatgaggccatgctgcagaagaggatccgctacgtggtggacctgtacctgaacaccccagacaagatgggctatgacacccccctgcactttgcctgcaagtttggaaatgctgatgtggtgaatgtgctgagcagccaccacctgattgtgaagaacagcaggaacaagtatgacaagaccccagaagatgtgatctgtgagaggagcaagaacaagtctgtggagctgaaggagcgcatccgggagtacctgaagggccactactacgtgcccctgctgcgggcagaggagaccagcagccctgtgattggagagctgtggagcccagaccagacagctgaggccagccacgtgagccgctatggaggcagcccccgggaccctgtgctgaccctgcgggcctttgctggccccctgagccctgccaaggccgaggacttcaggaagctgtggaagaccccaccccgggagaaggccggcttcctgcaccacgtgaagaagagtgaccctgagcggggctttgagcgggtgggccgggagctggcccacgagctgggctacccctgggtggagtactgggagttcctgggctgctttgtggacctgagcagccaggagggcctgcagaggctggaggagtacctgacccagcaggagatcggcaagaaggcccagcaggagaccggggagcgggaggccagctgccgggacaaggccaccaccagcggcagcaacagcatctctgtgcgggccttcctggatgaagatgacatgagcctggaggagatcaagaaccggcagaatgctgccaggaacaacagccccccaacagtgggcgccttcggccacacccgctgcagcgccttccccctggagcaggaggccgacctgattgaggccgctgagcccggcggcccccacagcagcagaaatggcctgtgccaccccctgaaccacagcaggaccctggccggcaagaggcccaaggcccccagaggagaggaggcccacctgccccctgtgtctgacctgactgtggagtttgacaagctgaacctgcagaacatcggccgctctgtgtccaagaccccagatgagagcaccaagaccaaggaccagatcctgaccagccgcatcaatgctgtggagcgggacctgctggagcccagccctgctgaccagctgggcaatggccacagaagaacagagagcgagatgtctgcccgcatcgccaagatgagcctgagccccagcagccccaggcatgaggaccagctggaggtgacccgggagcccgcccggcggctcttcctgtttggagaggagcccagcaagctggaccaggatgtgctggccgccctggagtgtgctgatgtggacccccaccagtttcctgctgtgcaccgctggaagtctgctgtgctgtgctacagccccagcgaccggcagagctggcccagccctgctgtgaagggccgcttcaagagccagctgcctgacctgagcggcccccacagctacagccctggaagaaattctgtggccggcagcaacccagccaagccaggcctgggcagccctggccgctacagccctgtgcacggcagccagctgcggaggatggcccggctggccgagctggccgccctgtag

SEQ ID NO: 35393 - DNA, 2631 bp, Artificial Sequence
  Description of Artificial Sequence: Synthetic coding sequence
atgaccatggatgccctgctggcccggctgaagctgctgaacccagatgacctgcgggaggagatcgtgaaggccggcctgaagtgtggccccatcaccagcaccacccgcttcatctttgagaagaagctggcccaggccctgctggagcagggcggccgcctgagcagcttctaccaccatgaagctggggtgacagccctgagccaggacccccagaggatcctgaagccagctgagggcaaccccacagaccaggccggcttctctgaagatcgggactttggctacagcgtgggcctgaaccccccagaggaggaggccgtgaccagcaagacctgcagcgtgcccccaagtgacacagacacctaccgggccggggccacagccagcaaggagccccccctgtactacggcgtgtgccctgtgtatgaagatgtgcctgccagaaatgaaagaatttatgtgtatgagaacaagaaggaggccctgcaggccgtgaagatgatcaagggcagccgcttcaaggccttcagcacccgggaggatgctgagaagtttgcccggggcatctgtgactacttccccagccccagcaagaccagcctgcccctgagccctgtgaagacagcccccctcttcagcaatgaccggctgaaggatggcctgtgcctgtctgagagcgagaccgtgaacaaggagcgggccaacagctacaagaaccccaggacccaggacctgacagccaagctgaggaaggctgtggagaagggggaggaggacaccttcagtgacctgatctggagcaacccccgctacctgattggcagcggggacaaccccaccatcgtgcaggagggctgccgctacaacgtgatgcacgtggccgccaaggagaaccaggccagcatctgccagctgaccctggatgtgctggagaacccagacttcatgaggctgatgtacccagatgatgatgaggccatgctgcagaagaggatccgctacgtggtggacctgtacctgaacaccccagacaagatgggctatgacacccccctgcactttgcctgcaagtttggaaatgctgatgtggtgaatgtgctgagcagccaccacctgattgtgaagaacagcaggaacaagtatgacaagaccccagaagatgtgatctgtgagaggagcaagaacaagtctgtggagctgaaggagcgcatccgggagtacctgaagggccactactacgtgcccctgctgcgggcagaggagaccagcagccctgtgattggagagctgtggagcccagaccagacagctgaggccagccacgtgagccgctatggaggcagcccccgggaccctgtgctgaccctgcgggcctttgctggccccctgagccctgccaaggccgaggacttcaggaagctgtggaagaccccaccccgggagaaggccggcttcctgcaccacgtgaagaagagtgaccctgagcggggctttgagcgggtgggccgggagctggcccacgagctgggctacccctgggtggagtactgggagttcctgggctgctttgtggacctgagcagccaggagggcctgcagaggctggaggagtacctgacccagcaggagatcggcaagaaggcccagcaggagaccggggagcgggaggccagctgccgggacaaggccaccaccagcggcagcaacagcatctctgtgcgggccttcctggatgaagatgacatgagcctggaggagatcaagaaccggcagaatgctgccaggaacaacagccccccaacagtgggcgccttcggccacacccgctgcagcgccttccccctggagcaggaggccgacctgattgaggccgctgagcccggcggcccccacagcagcagaaatggcctgtgccaccccctgaaccacagcaggaccctggccggcaagaggcccaaggcccccagaggagaggaggcccacctgccccctgtgtctgacctgactgtggagtttgacaagctgaacctgcagaacatcggccgctctgtgtccaagaccccagatgagagcaccaagaccaaggaccagatcctgaccagccgcatcaatgctgtggagcgggacctgctggagcccagccctgctgaccagctgggcaatggccacagaagaacagagagcgagatgtctgcccgcatcgccaagatgagcctgagccccagcagccccaggcatgaggaccagctggaggtgacccgggagcccgcccggcggctcttcctgtttggagaggagcccagcaagctggaccaggatgtgctggccgccctggagtgtgctgatgtggacccccaccagtttcctgctgtgcaccgctggaagtctgctgtgctgtgctacagccccagcgaccggcagagctggcccagccctgctgtgaagggccgcttcaagagccagctgcctgacctgagcggcccccacagctacagccctggaagaaattctgtggccggcagcaacccagccaagccaggcctgggcagccctggccgctacagccctgtgcacggcagccagctgcggaggatggcccggctggccgagctggccgccctgtag

SEQ ID NO: 35394 - DNA, 2826 bp, Artificial Sequence
  Description of Artificial Sequence: Synthetic coding sequence
atgtaccagggcgagtttggcctgaacatgaagctgggctacggcaagttctcctggcccactggagagagctaccacggccagttctacagagaccactgccacggcctgggcacctacatgtggccagatggcagcagcttcaccggcaccttctacctgagccaccgggagggctacggcaccatgtacatgaagaccaggctcttccagggcctgtacaaggctgaccagcgcttcggccctggggtggagacctacccagatggcagccaggatgtgggcctgtggttccgggagcagctgatcaagctgtgcacccagatccccagcggcttcagcctgctgcgctacccagagttcagcagcttcatcacccacagccctgcccgcatcagcctgtctgaggaggagaagacagagtggggcctgcaggagggccaggaccccttcttctatgactacaagcgcttcctgctgaatgacaacctgaccctgcccccagagatgtatgtgtacagcaccaacagcgaccacctgcccatgaccagcagcttcaggaaggagctggatgcccgcatcttcctgaatgagatccccccatttgtggaggatggagagccctggttcatcatcaatgagacccccctgctggtgaagatccagaagcagacctacaagttcaggaacaagccagcccacacctcctggaacatgggcgccatcctggagggcaagaggagcggctttgccccctgtggccccaaggagcagctgtccatggagatgatcctgaaggccgaggagggcaaccacgagtggatctgccgcatcctgaaggacaactttgccagcgcagatgtggctgatgccaagggctacacagtgctggccgccgccgccacccactgccacaatgacatcgtgaacctgctgctggactgtggggctgatgtgaacaagtgcagtgatgagggcctgacagccctgtccatgtgcttcctgctgcactacccagcccagagcttcaagcccaacgtggccgagaggaccatccctgagccccaggagccccccaagtttcctgtggtgcccatcctgagcagcagcttcatggacaccaacctggagagcctgtactatgaggtgaatgtgcccagccagggcagctatgagctgcggcccccaccagcccccctgctgctgccccgggtgtctggcagccatgaaggaggccacttccaggacaccggccagtgtggcggcagcattgaccacaggagcagcagcctgaagggggacagccccctggtgaagggcagcctgggccacgtggagagcggcctggaggatgtgctgggcaacacagaccggggcagcctgtgcagcgctgagaccaagtttgagagcaatgtgtgtgtgtgtgacttcagcattgagctgagccaggccatgctggagaggtctgcccagagccacagcctgctgaagatggccagccccagcccctgcaccagcagctttgacaagggcaccatgaggaggatggccctgtccatgattgaaagaaggaagcgctggaggaccatcaagctgctgctgcggagaggagctgaccccaacctgtgctgcgtgcccatgcaggtgctcttcctggccgtgaaggctggagatgtggatggagtgcggctgctgctggagcacggggccaggacagacatctgcttccccccccagctgagcaccctgacccccctgcacatcgccgccgccctgcctggagaggagggcgtgcagatcgtggagctgctgctgcacgccatcacagatgtggatgccaaggccagtgatgaagatgacacctacaagccaggcaagctggacctgctgcccagcagcctgaagctgagcaatgagcccggccccccccaggcctactacagcacagacacagccctgcctgaggagggcggccgcacagccctgcacatggcctgtgaaagagaagatgacaacaagtgtgcccgggacatcgtgcggctgctgctgagccatggagccaaccccaacctgctgtggagcggccacagccccctgagcctgagcatcgccagcggaaatgagctggtggtgaaggagctgctgacccagggcgctgaccccaacctgcccctgaccaagggcctgggcagcgccctgtgtgtggcctgtgacctgacctatgagcaccagaggaacatggacagcaagctggccctgattgacaggctcatcagccacggggctgacatcctgaagcctgtgatgctgcggcagggcgagaaggaggccgtgggcacagctgtggactatggctacttccgcttcttccaggacagaagaattgcccgctgccccttccacaccctgatgcctgctgagcgggagaccttcctggccaggaagaggctgctggagtacatgggcctgcagctgcggcaggccgtgtttgccaaggagagccagtgggaccccacctggctgtacctgtgcaagagagctgagctgatccccagccacaggatgaagaagaagggccccagcctgccccggggcctggatgtgaaggagcagggccagatccccttcttcaagttctgctaccagtgtggccgcagcattggagtgcggctgctgccctgcccccgctgctacggcatcctgacctgcagcaagtactgcaagaccaaggcctggacagagttccacaagaaggactgtggggacctggtggccatcgtgacccagctggagcaggtgtccagaagaagagaggagttccagtag

SEQ ID NO: 35395 - DNA, 2154 bp, Artificial Sequence
  Description of Artificial Sequence: Synthetic coding sequence
atggagggcgcccacgccagcctgagcctggaggatgaggtgtctggagctggcagccggcagaggcccctggagggcaaaggaggagagaccccagctgctgaggagcccggcagcctgaagaactatgctgtgtttgccaccagagatgtgtctgctgcccctgagaaggaggaggaggaggccgagggccccctgcgggcccaggacctgcgggagagctacatccagctggtgcagggcgtgcaggagtggcaggacggctgcatgtaccagggcgagtttggcctgaacatgaagctgggctacggcaagttctcctggcccaccggggagagctaccacggccagttctacagagaccactgccacggcctgggcacctacatgtggccagatggcagcagcttcaccggcaccttctacctgagccaccgggagggctacggcaccatgtacatgaagaccaggctcttccagacccactgccacaatgacatcgtgaacctgctgctggactgtggggctgatgtgaacaagtgcagtgatgagggcctgacagccctgtccatgtgcttcctgctgcactacccagcccagagcttcaagcccaacgtggccgagaggaccatccctgagccccaggagccccccaagtttcctgtggtgcccatcctgagcagcagcttcatggacaccaacctggagagcctgtactatgaggtgaatgtgcccagccagggcagctatgagctgcggcccccaccagcccccctgctgctgccccgggtgtctggcagccatgagggcggccacttccaggacaccggccagtgtggcggcagcattgaccacaggagcagcagcctgaagggggacagccccctggtgaagggcagcctgggccacgtggagagcggcctggaggatgtgctgggcaacacagaccggggcagcctgtgcagcgctgagaccaagtttgagagcaatgtgtgtgtgtgtgacttcagcattgagctgagccaggccatgctggagaggtctgcccagagccacagcctgctgaagatggccagccccagcccctgcaccagcagctttgataaaggcaccatgaggaggatggccctgtccatgattgaaagaaggaagcgctggaggaccatcaagctgctgctgcggagaggagctgaccccaacctgtgctgcgtgcccatgcaggtgctcttcctggccgtgaaggctggagatgtggatggagtgcggctgctgctggagcacggggccaggacagacatctgcttccccccccagctgagcaccctgacccccctgcacatcgctgctgccctgcccggggaggagggcgtgcagatcgtggagctgctgctgcacgccatcacagatgtggatgccaaggccagtgatgaagatgacacctacaagccaggcaaggtggtgaaggagctgctgacccagggcgctgaccccaacctgcccctgaccaagggcctgggcagcgccctgtgtgtggcctgtgacctgacctatgagcaccagaggaacatggacagcaagctggccctgattgacaggctcatcagccacggggctgacatcctgaagcctgtgatgctgcggcagggcgagaaggaggccgtgggcacagctgtggactatggctacttccgcttcttccaggacagaagaattgcccgctgccccttccacaccctgatgcctgctgagcgggagaccttcctggccaggaagaggctgctggagtacatgggcctgcagctgcggcaggccgtgtttgccaaggagagccagtgggaccccacctggctgtacctgtgcaagagagctgagctgatccccagccacaggatgaagaagaagggccccagcctgccccggggcctggatgtgaaggagcagggccagatccccttcttcaagttctgctaccagtgtggccgcagcattggagtgcggctgctgccctgcccccgctgctacggcatcctgacctgcagcaagtactgcaagaccaaggcctggacagagttccacaagaaggactgtggggacctggtggccatcgtgacccagctggagcaggtgtccagaagaagagaggagttccagtag

SEQ ID NO: 35396 - DNA, 2136 bp, Artificial Sequence
  Description of Artificial Sequence: Synthetic coding sequence
atgtaccagggcgagtttggcctgaacatgaagctgggctacggcaagttctcctggcccactggagagagctaccacggccagttctacagagaccactgccacggcctgggcacctacatgtggccagatggcagcagcttcaccggcaccttctacctgagccaccgggagggctacggcaccatgtacatgaagaccaggctcttccagacccactgccacaatgacatcgtgaacctgctgctggactgtggggctgatgtgaacaagtgcagtgatgagggcctgacagccctgtccatgtgcttcctgctgcactacccagcccagagcttcaagcccaacgtggccgagaggaccatccctgagccccaggagccccccaagtttcctgtggtgcccatcctgagcagcagcttcatggacaccaacctggagagcctgtactatgaggtgaatgtgcccagccagggcagctatgagctgcggcccccaccagcccccctgctgctgccccgggtgtctggcagccatgaaggaggccacttccaggacaccggccagtgtggcggcagcattgaccacaggagcagcagcctgaagggggacagccccctggtgaagggcagcctgggccacgtggagagcggcctggaggatgtgctgggcaacacagaccggggcagcctgtgcagcgctgagaccaagtttgagagcaatgtgtgtgtgtgtgacttcagcattgagctgagccaggccatgctggagaggtctgcccagagccacagcctgctgaagatggccagccccagcccctgcaccagcagctttgacaagggcaccatgaggaggatggccctgtccatgattgaaagaaggaagcgctggaggaccatcaagctgctgctgcggagaggagctgaccccaacctgtgctgcgtgcccatgcaggtgctcttcctggccgtgaaggctggagatgtggatggagtgcggctgctgctggagcacggggccaggacagacatctgcttccccccccagctgagcaccctgacccccctgcacatcgccgccgccctgcctggagaggagggcgtgcagatcgtggagctgctgctgcacgccatcacagatgtggatgccaaggccagtgatgaagatgacacctacaagccaggcaagctggacctgctgcccagcagcctgaagctgagcaatgagcccggccccccccaggcctactacagcacagacacagccctgcctgaggagggcggccgcacagccctgcacatggcctgtgaaagagaagatgacaacaagtgtgcccgggacatcgtgcggctgctgctgagccatggagccaaccccaacctgctgtggagcggccacagccccctgagcctgagcatcgccagcggaaatgagctggtggtgaaggagctgctgacccagggcgctgaccccaacctgcccctgaccaagggcctgggcagcgccctgtgtgtggcctgtgacctgacctatgagcaccagaggaacatggacagcaagctggccctgattgacaggctcatcagccacggggctgacatcctgaagcctgtgatgctgcggcagggcgagaaggaggccgtgggcacagctgtggactatggctacttccgcttcttccaggacagaagaattgcccgctgccccttccacaccctgatgcctgctgagcgggagaccttcctggccaggaagaggctgctggagtacatgggcctgcagctgcggcaggccgtgtttgccaaggagagccagtgggaccccacctggctgtacctgtgcaagagagctgagctgatccccagccacaggatgaagaagaagggccccagcctgccccggggcctggatgtgaaggagcagggccagatccccttcttcaagttctgctaccagtgtggccgcagcattggagtgcggctgctgccctgcccccgctgctacggcatcctgacctgcagcaagtactgcaagaccaaggcctggacagagttccacaagaaggactgtggggacctggtggccatcgtgacccagctggagcaggtgtccagaagaagagaggagttccagtag

SEQ ID NO: 35397 - DNA, 2826 bp, Artificial Sequence; identical to SEQ ID NO: 35394
  Description of Artificial Sequence: Synthetic coding sequence

SEQ ID NO: 35398 - DNA, 1320 bp, Artificial Sequence
  Description of Artificial Sequence: Synthetic coding sequence
atggagggcgcccacgccagcctgagcctggaggatgaggtgtctggagctggcagccggcagaggcccctggagggcaaaggaggagagaccccagctgctgaggagcccggcagcctgaagaactatgctgtgtttgccaccagagatgtgtctgctgcccctgagaaggaggaggaggaggccgagggccccctgcgggcccaggacctgcgggagagctacatccagctggtgcagggcgtgcaggagtggcaggacggctgcatgtaccagggcgagtttggcctgaacatgaagctgggctacggcaagttctcctggcccaccggggagagctaccacggccagttctacagagaccactgccacggcctgggcacctacatgtggccagatggcagcagcttcaccggcaccttctacctgagccaccgggagggctacggcaccatgtacatgaagaccaggctcttccagacccactgccacaatgacatcgtgaacctgctgctggactgtggggctgatgtgaacaagtgcagtgatgagggcctgacagccctgtccatgtgcttcctgctgcactacccagcccagagcttcaagcccaacgtggccgagaggaccatccctgagccccaggagccccccaagtttcctgtggtgcccatcctgagcagcagcttcatggacaccaacctggagagcctgtactatgaggtgaatgtgcccagccagggcagctatgagctgcggcccccaccagcccccctgctgctgccccgggtgtctggcagccatgagggcggccacttccaggacaccggccagtgtggcggcagcattgaccacaggagcagcagcctgaagggggacagccccctggtgaagggcagcctgggccacgtggagagcggcctggaggatgtgctgggcaacacagaccggggcagcctgtgcagcgctgagaccaagtttgagagcaatgtgtgtgtgtgtgacttcagcattgagctgagccaggccatgctggagaggtctgcccagagccacagcctgctgaagatggccagccccagcccctgcaccagcagctttgataaaggcaccatgaggaggatggccctgtccatgattgaaagaaggaagcgctggaggaccatcaagctgctgctgcggagaggagctgaccccaacctgtgctgcgtgcccatgcaggtgctcttcctggccgtgaaggctggagatgtggatggagtgcggctgctgctggagcacggggccaggacagacatctgcttccccccccagtgctag

SEQ ID NO: 35399 - DNA, 225 bp, Artificial Sequence
  Description of Artificial Sequence: Synthetic coding sequence
atggagggcgcccacgccagcctgagcctggaggatgaggtgtctggagctggcagccggcagaggcccctggagggcaaaggaggagagaccccagctgctgaggagcccggcagcctgaagaactatgctgtgtttgccaccagagatgtgtctgctgcccctgagaaggaggaggaggaggccgagggccccctgcgggcccaggacctgcgggagagctag

SEQ ID NO: 35400 - DNA, 684 bp, Artificial Sequence
  Description of Artificial Sequence: Synthetic coding sequence
atgtaccagggcgagtttggcctgaacatgaagctgggctacggcaagttctcctggcccactggagagagctaccacggccagttctacagagaccactgccacggcctgggcacctacatgtggccagatggcagcagcttcaccggcaccttctacctgagccaccgggagggctacggcaccatgtacatgaagaccaggctcttccagggcctgtacaaggctgaccagcgcttcggccctggggtggagacctacccagatggcagccaggatgtgggcctgtggttccgggagcagctgatcaagctgtgcacccagatccccagcggcttcagcctgctgcgctacccagagttcagcagcttcatcacccacagccctgcccgcatcagcctgtctgaggaggagaagacagagtggggcctgcaggagggccaggaccccttcttctatgactacaagcgcttcctgctgaatgacaacctgaccctgcccccagagatgtatgtgtacagcaccaacagcgaccacctgcccatgaccagcagcttcaggaaggagctggatgcccgcatcttcctgaatgagatccccccatttgtggaggatggagagccctggttcatcatcaatgagacccccctgctggtgaagatccagaagcagacctacaagtag

SEQ ID NO: 35401 - DNA, 1020 bp, Artificial Sequence
  Description of Artificial Sequence: Synthetic coding sequence
atgagagatgtgtctgctgcccctgagaaggaggaggaggaggccgagggccccctgcgggcccaggacctgcgggagagctacatccagctggtgcagggcgtgcaggagtggcaggacggctgcatgtaccagggcgagtttggcctgaacatgaagctgggctacggcaagttctcctggcccactggagagagctaccacggccagttctacagagaccactgccacggcctgggcacctacatgtggccagatggcagcagcttcaccggcaccttctacctgagccaccgggagggctacggcaccatgtacatgaagaccaggctcttccagacccactgccacaatgacatcgtgaacctgctgctggactgtggggctgatgtgaacaagtgcagtgatgagggcctgacagccctgtccatgtgcttcctgctgcactacccagcccagagcttcaagcccaacgtggccgagaggaccatccctgagccccaggagccccccaagtttcctgtggtgcccatcctgagcagcagcttcatggacaccaacctggagagcctgtactatgaggtgaatgtgcccagccagggcagctatgagctgcggcccccaccagcccccctgctgctgccccgggtgtctggcagccatgaaggaggccacttccaggacaccggccagtgtggcggcagcattgaccacaggagcagcagcctgaagggggacagccccctggtgaagggcagcctgggccacgtggagagcggcctggaggatgtgctgggcaacacagaccggggcagcctgtgcagcgctgagaccaagtttgagagcaatgtgtgtgtgtgtgacttcagcattgagctgagccaggccatgctggagaggtctgcccagagccacagcctgctgaagatggccagccccagcccctgcaccagcagctttgacaagggcaccatgaggaggatggccctgtccatgattgagagctgcagcctgctgtag

SEQ ID NO: 35402 - DNA, 741 bp, Artificial Sequence
  Description of Artificial Sequence: Synthetic coding sequence
atgtaccagggcgagtttggcctgaacatgaagctgggctacggcaagttctcctggcccactggagagagctaccacggccagttctacagagaccactgccacggcctgggcacctacatgtggccagatggcagcagcttcaccggcaccttctacctgagccaccgggagggctacggcaccatgtacatgaagaccaggctcttccagggcctgtacaaggctgaccagcgcttcggccctggggtggagacctacccagatggcagccaggatgtgggcctgtggttccgggagcagctgatcaagctgtgcacccagatccccagcggcttcagcctgctgcgctacccagagttcagcagcttcatcacccacagccctgcccgcatcagcctgtctgaggaggagaagacagagtggggcctgcaggagggccaggaccccttcttctatgactacaagcgcttcctgctgaatgacaacctgaccctgcccccagagatgtatgtgtacagcaccaacagcgaccacctgcccatgaccagcagcttcaggaaggagctggatgcccgcatcttcctgaatgagatccccccatttgtggaggatggagagccctggttcatcatcaatgagacccccctgctggtgaagatccagaagcagacctacaagttccggctgacagccaccaccaccctgagcaccttctcctggacagtgggccccacctag

SEQ ID NO: 35403 - DNA, 1326 bp, Artificial Sequence
  Description of Artificial Sequence: Synthetic coding sequence
atggtgcacatcaagaagggggagctgacccaggaggagaaggagctgctggaggtgattggcaagggcaccgtgcaggaggccggcaccctgctgagcagcaagaatgtgcgggtgaactgcctggatgaaaatggcatgacccccctgatgcatgctgcctacaagggcaagctggacatgtgcaagctgctgctgcggcacggggctgatgtgaactgccaccagcatgaacatggctacacagccctgatgtttgctgccctgagcggcaacaaggacatcacctgggtgatgctggaggccggggctgagacagatgtggtgaacagcgtgggccgcacagctgcccagatggccgcctttgtgggccagcacgactgtgtgaccatcatcaacaacttcttcccccgggagcggctggactactacaccaagccccagggcctggacaaggagcccaagctgccccccaagctggccggccccctgcacaagatcatcaccaccaccaacctgcaccctgtgaagatcgtgatgctggtgaatgaaaaccccctgctgacagaggaggccgccctgaacaagtgctacagagtgatggacctgatctgtgagaagtgcatgaagcagagggacatgaatgaggtgctggccatgaagatgcactacatcagctgcatcttccagaagtgcatcaacttcctgaaggatggagagaacaagctggacaccctcatcaagagcctgctgaagggccgggccagtgatggcttccctgtgtaccaggagaagatcatccgggagagcatcaggaagttcccctactgtgaggccaccctgctgcagcagctggtgcgcagcatcgcccctgtggagatcggcagtgaccccacagccttctctgtgctgacccaggccatcaccggccaggtgggctttgtggatgtggagttctgcaccacctgtggggagaagggggccagcaagcgctgcagcgtgtgcaagatggtgatctactgtgaccagacctgccagaagacccactggttcacccacaagaagatctgcaagaacctgaaggacatctatgagaagcagcagctggaggccgccaaggagaagaggcaggaggagaaccacggcaagctggatgtgaacagcaactgtgtgaatgaggagcagcctgaggccgaggtgggcatcagccagaaggacagcaaccctgaggacagcggggagggcaagaaggagagcctggagagcgaggccgagctggagggcctgcaggatgccccagctggcccccaggtgtctgaggagtag

SEQ ID NO: 35404 - DNA, 1290 bp, Artificial Sequence
  Description of Artificial Sequence: Synthetic coding sequence
atgctgatgtcctggagcccagaagaatgtaaaggccagggcgagcccctggatgacagacaccccctgtgtgcccggctggtggagaagcccagccggggcagcgaggagcacctgaagagcggccctggccccatcgtgaccaggacagccagcggccctgccctggccttctggcaggccgtgctggccggagatgtgggctgtgtgagccgcatcctggccgacagcagcacaggcctggccccagattctgtgtttgacaccagtgaccctgagcgctggagggacttccgcttcaacatccgggccctgcggctgtggagcctgacctatgaggaggagctgaccacccccctgcacgtggccgccagccggggccacacagaggtgctgcggctgctgctgcggcggcgggcccggccagacagcgcccctgggggccgcacagccctgcacgaggcctgtgccgccggccacacagcctgtgtgcacgtgctgctggtggccggggctgaccccaacattgctgaccaggacggcaagaggcccctgcacctgtgccggggccctggcaccctggagtgtgccgagctgctgctgcgctttggagcccgggtggatggccgctctgaggaggaggaggagacccccctgcacgtggccgcccggctgggccacgtggagctggccgacctgctgctgcggcggggggcctgcccagatgccagaaatgctgagggctggacccccctgctggccgcctgtgatgtgcgctgccagagcatcacagatgctgaggccaccacagcccgctgcctgcagctgtgcagcctgctgctgtctgctggagcagatgctgatgctgctgaccaggacaagcagaggcccctgcacctggcctgcagaagaggacatgctgctgtggtggagctgctgctgagctgtggggtgtctgccaacaccatggactatggaggccacacccccctgcactgtgccctgcagggccctgctgctgccctggcccagagccctgagcacgtggtgcgggccctgctgaaccacggggctgtgcgggtgtggccaggggccctgcccaagaagcaccagcgcttctacagcagcctgtttgccctggtgcggcagcccaggagcctgcagcacctgagccgctgtgccctgcggagccacctggagggcagcctgccccaggccctgccccggctgcccctgcccccccggctgctgcgctacctgcagctggactttgagggcgtgctgtactag

SEQ ID NO: 35405 - DNA, 1359 bp, Artificial Sequence
  Description of Artificial Sequence: Synthetic coding sequence
atgccctggggcaagaacagcagcccccactggggccaccacctgggctgcctgcccagcgccccagcctgccgcatctggaggccccacagcaggcctgcctgggagcccccccggcccagccccctgctgtgccaggacatggccctgcagaatgccctgtacaccggggacctggcccggctgcaggagctgtttcctccccacagcacagctgacctgctgctggagagcagagctgctgagccccgctggagcagccaccagaggggcctgtggagcctgacctatgaggaggagctgaccacccccctgcacgtggccgccagccggggccacacagaggtgctgcggctgctgctgcggcggcgggcccggccagattctgcccctgggggccgcacagccctgcacgaggcctgtgccgccggccacacagcctgtgtgcacgtgctgctggtggccggggctgaccccaacattgctgaccaggacggcaagaggcccctgcacctgtgccggggccctggcaccctggagtgtgccgagctgctgctgcgctttggagcccgggtggatggccgctctgaggaggaggaggagacccccctgcacgtggccgcccggctgggccacgtggagctggccgacctgctgctgcggcggggggcctgcccagatgccagaaatgctgagggctggacccccctgctggccgcctgtgatgtgcgctgccagagcatcacagatgctgaggccaccacagcccgctgcctgcagctgtgcagcctgctgctgtctgctggagcagatgctgatgctgctgaccaggacaagcagaggcccctgcacctggcctgccggcggggccacgccgctgtggtggagctgctgctgagctgtggggtgtctgccaacaccatggactatggaggccacacccccctgcactgtgccctgcagggccctgctgctgccctggcccagagccctgagcacgtggtgcgggccctgctgaaccacggggctgtgcgggtgtggccaggggccctgcccaaggtgctggagcgctggagcacctgccccaggaccatcgaggtgctgatgaacacctacagcgtggtgcagctgcctgaggaggccgtgggcctggtgaccccagagaccctgcagaagcaccagcgcttctacagcagcctgtttgccctggtgcggcagcccaggagcctgcagcacctgagccgctgtgccctgcggagccacctggagggcagcctgccccaggccctgccccggctgcccctgcccccccggctgctgcgctacctgcagctggactttgaaggagtgctgtactag

SEQ ID NO: 35406 - DNA, 1404 bp, Artificial Sequence
  Description of Artificial Sequence: Synthetic coding sequence
atgctgatgtcctggagcccagaagaatgtaaaggccagggcgagcccctggatgacagacaccccctgtgtgcccggctggtggagaagcccagccggggcagcgaggagcacctgaagagcggccctggccccatcgtgaccaggacagccagcggccctgccctggccttctggcaggccgtgctggccggagatgtgggctgtgtgagccgcatcctggccgacagcagcacaggcctggccccagattctgtgtttgacaccagtgaccctgagcgctggagggacttccgcttcaacatccgggccctgcggctgtggagcctgacctatgaggaggagctgaccacccccctgcacgtggccgccagccggggccacacagaggtgctgcggctgctgctgcggcggcgggcccggccagacagcgcccctgggggccgcacagccctgcacgaggcctgtgccgccggccacacagcctgtgtgcacgtgctgctggtggccggggctgaccccaacattgctgaccaggacggcaagaggcccctgcacctgtgccggggccctggcaccctggagtgtgccgagctgctgctgcgctttggagcccgggtggatggccgctctgaggaggaggaggagacccccctgcacgtggccgcccggctgggccacgtggagctggccgacctgctgctgcggcggggggcctgcccagatgccagaaatgctgagggctggacccccctgctggccgcctgtgatgtgcgctgccagagcatcacagatgctgaggccaccacagcccgctgcctgcagctgtgcagcctgctgctgtctgctggagcagatgctgatgctgctgaccaggacaagcagaggcccctgcacctggcctgcagaagaggacatgctgctgtggtggagctgctgctgagctgtggggtgtctgccaacaccatggactatggaggccacacccccctgcactgtgccctgcagggccctgctgctgccctggcccagagccctgagcacgtggtgcgggccctgctgaaccacggggctgtgcgggtgtggccaggggccctgcccaaggtgctggagcgctggagcacctgccccaggaccatcgaggtgctgatgaacacctacagcgtggtgcagctgcctgaggaggccgtgggcctggtgaccccagagaccctgcagaagcaccagcgcttctacagcagcctgtttgccctggtgcggcagcccaggagcctgcagcacctgagccgctgtgccctgcggagccacctggagggcagcctgccccaggccctgccccggctgcccctgcccccccggctgctgcgctacctgcagctggactttgagggcgtgctgtactag

SEQ ID NO: 35407 - DNA, 1539 bp, Artificial Sequence
  Description of Artificial Sequence: Synthetic coding sequence
atgaggggccaggtgtccctgggcgcctgggacaccggggccttctgcctgagcgtcttccccagctgcagcctgagcctgagcctgcccctggcctacaccagccccccaccccacagccccttccctgcccacatgctgatgtcctggagccctgaggagtgcaagggccagggcgagcccctggatgacagacaccccctgtgtgcccggctggtggagaagcccagccggggcagcgaggagcacctgaagagcggccctggccccatcgtgaccaggacagccagcggccctgccctggccttctggcaggccgtgctggccggagatgtgggctgtgtgagccgcatcctggccgacagcagcacaggcctggccccagacagcgtgtttgacaccagtgaccctgagcgctggagggacttccgcttcaacatccgggccctgcggctgtggagcctgacctatgaggaggagctgaccacccccctgcacgtggccgccagccggggccacacagaggtgctgcggctgctgctgcggcggcgggcccggccagattctgcccctgggggccgcacagccctgcacgaggcctgtgccgccggccacacagcctgtgtgcacgtgctgctggtggccggggctgaccccaacattgctgaccaggacggcaagaggcccctgcacctgtgccggggccctggcaccctggagtgtgccgagctgctgctgcgctttggagcccgggtggatggccgctctgaggaggaggaggagacccccctgcacgtggccgcccggctgggccacgtggagctggccgacctgctgctgcggcggggggcctgcccagatgccagaaatgctgagggctggacccccctgctggccgcctgtgatgtgcgctgccagagcatcacagatgctgaggccaccacagcccgctgcctgcagctgtgcagcctgctgctgtctgctggagcagatgctgatgctgctgaccaggacaagcagaggcccctgcacctggcctgccggcggggccacgccgctgtggtggagctgctgctgagctgtggggtgtctgccaacaccatggactatggaggccacacccccctgcactgtgccctgcagggccctgctgctgccctggcccagagccctgagcacgtggtgcgggccctgctgaaccacggggctgtgcgggtgtggccaggggccctgcccaaggtgctggagcgctggagcacctgccccaggaccatcgaggtgctgatgaacacctacagcgtggtgcagctgcctgaggaggccgtgggcctggtgaccccagagaccctgcagaagcaccagcgcttctacagcagcctgtttgccctggtgcggcagcccaggagcctgcagcacctgagccgctgtgccctgcggagccacctggagggcagcctgccccaggccctgccccggctgcccctgcccccccggctgctgcgctacctgcagctggactttgaaggagtgctgtactag

SEQ ID NO: 35408 - DNA, 1425 bp, Artificial Sequence
  Description of Artificial Sequence: Synthetic coding sequence
atgaggggccaggtgtccctgggcgcctgggacaccggggccttctgcctgagcgtcttccccagctgcagcctgagcctgagcctgcccctggcctacaccagccccccaccccacagccccttccctgcccacatgctgatgtcctggagccctgaggagtgcaagggccagggcgagcccctggatgacagacaccccctgtgtgcccggctggtggagaagcccagccggggcagcgaggagcacctgaagagcggccctggccccatcgtgaccaggacagccagcggccctgccctggccttctggcaggccgtgctggccggagatgtgggctgtgtgagccgcatcctggccgacagcagcacaggcctggccccagacagcgtgtttgacaccagtgaccctgagcgctggagggacttccgcttcaacatccgggccctgcggctgtggagcctgacctatgaggaggagctgaccacccccctgcacgtggccgccagccggggccacacagaggtgctgcggctgctgctgcggcggcgggcccggccagattctgcccctgggggccgcacagccctgcacgaggcctgtgccgccggccacacagcctgtgtgcacgtgctgctggtggccggggctgaccccaacattgctgaccaggacggcaagaggcccctgcacctgtgccggggccctggcaccctggagtgtgccgagctgctgctgcgctttggagcccgggtggatggccgctctgaggaggaggaggagacccccctgcacgtggccgcccggctgggccacgtggagctggccgacctgctgctgcggcggggggcctgcccagatgccagaaatgctgagggctggacccccctgctggccgcctgtgatgtgcgctgccagagcatcacagatgctgaggccaccacagcccgctgcctgcagctgtgcagcctgctgctgtctgctggagcagatgctgatgctgctgaccaggacaagcagaggcccctgcacctggcctgccggcggggccacgccgctgtggtggagctgctgctgagctgtggggtgtctgccaacaccatggactatggaggccacacccccctgcactgtgccctgcagggccctgctgctgccctggcccagagccctgagcacgtggtgcgggccctgctgaaccacggggctgtgcgggtgtggccaggggccctgcccaagaagcaccagcgcttctacagcagcctgtttgccctggtgcggcagcccaggagcctgcagcacctgagccgctgtgccctgcggagccacctggagggcagcctgccccaggccctgccccggctgcccctgcccccccggctgctgcgctacctgcagctggactttgaaggagtgctgtactag

SEQ ID NO: 35409 - DNA, 861 bp, Artificial Sequence
  Description of Artificial Sequence: Synthetic coding sequence
atgagaattgtgctgcagctggccaagatgaacctgatggacatcaccaagatcttcagcctgctgcagcctgacaaggaggaggaggacacagacacagaggagaagcaggccctgaaccaggccgtgtatgacaatgacagctacaccctggaccagctgctgcggcaggagcgctacaagcgcttcatcaacagccgcagcggctggggcgtgcccggcacccccctgcggctggccgccagctatggccacctgagctgcctgcaggtgctgctggcccatggagcagatgtggacagcctggatgtgaaggcccagacccccctcttcaccgctgtgagccacggccacctggactgtgtgcgggtgctgctggaggccggggccagccctgggggcagcatctacaacaactgcagccctgtgctgacagctgccagagatggagctgtggccatcctgcaggagctgctggaccatggagctgaggccaacgtgaaggccaagctgcctgtgtgggccagcaacatcgccagctgcagcggccccctgtacctggccgctgtgtatggccacctggactgcttccggctgcaccacaactgtgagcctgagtacatccagctgctgattgactttggagccaacatctacctgcccagcctgagcctggacctgaccagccaggatgacaagggcatcgccctgctgctgcaggcccgggccacccccaggagcctgctgagccaggtgcggctggtggtgagaagagccctgtgccaggccggccagccccaggccatcaaccagctggacatcccccccatgctgatctcctacctgaagcaccagctgtag

SEQ ID NO: 35410 - DNA, 957 bp, Artificial Sequence
  Description of Artificial Sequence: Synthetic coding sequence
atgagaattgtgctgcagctggccaagatgaacctgatggacatcaccaagatcttcagcctgctgcagcctgacaaggaggaggaggacacagacacagaggagaagcaggccctgaaccaggccgtgtatgacaatgacagctacaccctggaccagctgctgcggcaggagcgctacaagcgcttcatcaacagccgcagcggctggggcgtgcccggcacccccctgcggctggccgccagctatggccacctgagctgcctgcaggtgctgctggcccatggagcagatgtggacagcctggatgtgaaggcccagacccccctcttcaccgctgtgagccacggccacctggactgtgtgcgggtgctgctggaggccggggccagccctgggggcagcatctacaacaactgcagccctgtgctgacagctgccagagatggagctgtggccatcctgcaggagctgctggaccatggagctgaggccaacgtgaaggccaagctgcctgtgtgggccagcaacatcgccagctgcagcggccccctgtacctggccgctgtgtatggccacctggactgcttccggctgctgctgctgcatggagctgaccctgactacaactgcacagaccagggcctgctggcccgggtgccccggcccaggaccctgctggagatctgcctgcaccacaactgtgagcctgagtacatccagctgctgattgactttggagccaacatctacctgcccagcctgagcctggacctgaccagccaggatgacaagggcatcgccctgctgctgcaggcccgggccacccccaggagcctgctgagccaggtgcggctggtggtgagaagagccctgtgccaggccggccagccccaggccatcaaccagctggacatcccccccatgctgatctcctacctgaagcaccagctgtag

SEQ ID NO: 35411 - DNA, 930 bp, Artificial Sequence
  Description of Artificial Sequence: Synthetic coding sequence
atgaacctgatggacatcaccaagatcttcagcctgctgcagcctgacaaggaggaggaggacacagacacagaggagaagcaggccctgaaccaggccgtgtatgacaatgacagctacaccctggaccagctgctgcggcaggagcgctacaagcgcttcatcaacagccgcagcggctggggcgtgcccggcacccccctgcggctggccgccagctatggccacctgagctgcctgcaggtgctgctggcccacggggctgatgtggacagcctggatgtgaaggcccagacccccctcttcaccgctgtgagccacggccacctggactgtgtgcgggtgctgctggaggccggggccagccctgggggcagcatctacaacaactgcagccctgtgctgacagctgccagagatggagctgtggccatcctgcaggagctgctggaccacggggctgaggccaacgtgaaggccaagctgcctgtgtgggccagcaacatcgccagctgcagcggccccctgtacctggccgctgtgtatggccacctggactgcttccggctgctgctgctgcacggggctgaccctgactacaactgcacagaccagggcctgctggcccgggtgccccggcccaggaccctgctggagatctgcctgcaccacaactgtgagcctgagtacatccagctgctgattgactttggagccaacatctacctgcccagcctgagcctggacctgaccagccaggatgacaagggcatcgccctgctgctgcaggcccgggccacccccaggagcctgctgagccaggtgcggctggtggtgcggcgggccctgtgccaggccggccagccccaggccatcaaccagctggacatcccccccatgctgatctcctacctgaagcaccagctgtag

SEQ ID NO: 35412 - DNA, 1764 bp, Artificial Sequence
  Description of Artificial Sequence: Synthetic coding sequence
atggacaactacaccagtgatgaggacattgatgaggactttgacacccagctgatcatccagcagagcctgcaggacatctacaagccaggcacagcccagcacgcccccaaggatgagagcctgcacagcttcctgtctgctgactacaagaagatcgtggagaccatcgagaaggtgggcaaggaggatgccctgagccacctgaccaagtaccacagcgccttcggggaggctgatgagatcggctggatccccctgcacaaggctgctgtgcagctgaacaggaagatcctggagatcaccctgagcgccagtgaccccagcctgtgggagcagaccacccacaatggagagacccccctcttcctggccgtgagcagctgcctgctggagaatgccaccttcctgctgctgaatggctgcaaccccaatgccaagaactttgagggcaacagccccctgctggccgctgtgctgcgggactgctatgacatggccgccctgctgatcaactatggagcagatgtgaacctgcgctgtgccaatgaaagaacagccctgcatgaagctgccaagctgggccgggaggacatggtgaagctgatgctggtgtctggggcccacccagacccccagagcacctacggcttcacccccctggccctggccgcccagagcggccacacagagatcatggagatgctgctgaggaagggcaagatcttctgcctggccagtgacagcagcagcatcctgctggaggccgccagcggcggcaacccagatgctgtggccctgctgctggagtatggagcagatgccaacatccccaagaacagcggccacctgcccatccacgtggccgctgaccggggccacctgctggccctgaagatcctgatccctgtgacagacctggccgccatcaagcagagcggcatcagccctgtgcactgtgccgctgctggggcccacccccagtgcctggagctgctgatccaggccggctttgatgtgaacttcatgctggaccagaggatcaacaagcactatgatgaccacaggaagagcgccctgtactttgctgtgagcaacagcgacctgagctctgtgaagctgctgctgtctgctggggccctgcccaaccaggaccctgtgaactgcctgcagatcgccctgaggatgggcaactatgagctgatcagcctgctgctgcggcacggggccaacgtgaactacttctgccgggtgaaccccctgcacttccccagcgccctgcagtacaccctgaaggatgaggtgatgctgaggatgctgctgaactacggctatgacacagagcgctgctttgactgcccccatggagacaaggtgcaccccagctacacagtggagggctggaccagcaccgtcatcaaggacaccaagttctgtgaggtgatcaccctgtcctggctgcagcacctgagcggcaaggtggtgcgggtgatgctggactatgtggaccaggtgcgcatctgcagcaagctgaaggctgtgctgcagaagcagggcatctggagcgagatccacttcatcctgaccaaccccaggagcctgaagcacctgtgccgcctgaagatcaggaagtgcatgggccgcctgcacctgcgctgccctgtgttcatgtccttcctgcccctgcccaaccggctgaaggcctacgtgctgtacaaggagtatgacctgtatggccagggcatcttcaccggcacctggtag

SEQ ID NO: 35413 - DNA, 1272 bp, Artificial Sequence
  Description of Artificial Sequence: Synthetic coding sequence
atggccgccctgctgatcaactacggggctgatgtgaacctgcgctgtgccaatgaaagaacagccctgcacgaggccgccaagctgggccgggaggacatggtgaagctgatgctggtgtctggggcccacccagacccccagagcacctacggcttcacccccctggccctggccgcccagagcggccacacagagatcatggagatgctgctgaggaagggggccaatgcccacggccaggccagtgacagcagcagcatcctgctggaggccgccagcggcggcaacccagatgctgtggccctgctgctggagtatggagcagatgccaacatccccaagaacagcggccacctgcccatccacgtggccgctgaccggggccacctgctggccctgaagatcctgatccctgtgacagacctggccgccatcaagcagagcggcatcagccctgtgcactgtgccgctgctggggcccacccccagtgcctggagctgctgatccaggccggctttgatgtgaacttcatgctggaccagaggatcaacaagcactatgatgaccacaggaagagcgccctgtactttgctgtgagcaacagcgacctgagctctgtgaagctgctgctgtctgctggggccctgcccaaccaggaccctgtgaactgcctgcagatcgccctgaggatgggcaactatgagctgatcagcctgctgctgcggcacggggccaacgtgaactacttctgccgggtgaaccccctgcacttccccagcgccctgcagtacaccctgaaggatgaggtgatgctgaggatgctgctgaactacggctatgacacagagcgctgctttgactgcccccatggagacaaggtgcaccccagctacacagtggagggctggaccagcaccgtcatcaaggacaccaagttctgtgaggtgatcaccctgtcctggctgcagcacctgagcggcaaggtggtgcgggtgatgctggactatgtggaccaggtgcgcatctgcagcaagctgaaggctgtgctgcagaagcagggcatctggagcgagatccacttcatcctgaccaaccccaggagcctgaagcacctgtgccgcctgaagatcaggaagtgcatgggccgcctgcacctgcgctgccctgtgttcatgtccttcctgcccctgcccaaccggctgaaggcctacgtgctgtacaaggagtatgacctgtatggccagggcatcttcaccggcacctggtag

SEQ ID NO: 35414 - DNA, 1764 bp, Artificial Sequence
  Description of Artificial Sequence: Synthetic coding sequence
atggacaactacaccagtgatgaggacattgatgaggactttgacacccagctgatcatccagcagagcctgcaggacatctacaagccaggcacagcccagcacgcccccaaggatgagagcctgcacagcttcctgtctgctgactacaagaagatcgtggagaccatcgagaagggcaaggaggatgccctgagccacctgaccaagtaccacagcgcctttggagaggctgatgaaattggctggatccccctgcacaaggctgctgtgcagctgaacaggaagatcctggagatcaccctgagcgccagtgaccccagcctgtgggagcagaccacccacaacggggagacccccctcttcctggccgtgagcagctgcctgctggagaatgccaccttcctgctgctgaatggctgcaaccccaatgccaagaactttgagggcaacagccccctgctggccgctgtgctgcgggactgctatgacatggccgccctgctgatcaactacggggctgatgtgaacctgcgctgtgccaatgaaagaacagccctgcacgaggccgccaagctgggccgggaggacatggtgaagctgatgctggtgtctggggcccacccagacccccagagcacctacggcttcacccccctggccctggccgcccagagcggccacacagagatcatggagatgctgctgaggaagggggccaatgcccacggccaggccagtgacagcagcagcatcctgctggaggccgccagcggcggcaacccagatgctgtggccctgctgctggagtatggagcagatgccaacatccccaagaacagcggccacctgcccatccacgtggccgctgaccggggccacctgctggccctgaagatcctgatccctgtgacagacctggccgccatcaagcagagcggcatcagccctgtgcactgtgccgctgctggggcccacccccagtgcctggagctgctgatccaggccggctttgatgtgaacttcatgctggaccagaggatcaacaagcactatgatgaccacaggaagagcgccctgtactttgctgtgagcaacagcgacctgagctctgtgaagctgctgctgtctgctggggccctgcccaaccaggaccctgtgaactgcctgcagatcgccctgaggatgggcaactatgagctgatcagcctgctgctgcggcacggggccaacgtgaactacttctgccgggtgaaccccctgcacttccccagcgccctgcagtacaccctgaaggatgaggtgatgctgaggatgctgctgaactacggctatgacacagagcgctgctttgactgcccccatggagacaaggtgcaccccagctacacagtggagggctggaccagcaccgtcatcaaggacaccaagttctgtgaggtgatcaccctgtcctggctgcagcacctgagcggcaaggtggtgcgggtgatgctggactatgtggaccaggtgcgcatctgcagcaagctgaaggctgtgctgcagaagcagggcatctggagcgagatccacttcatcctgaccaaccccaggagcctgaagcacctgtgccgcctgaagatcaggaagtgcatgggccgcctgcacctgcgctgccctgtgttcatgtccttcctgcccctgcccaaccggctgaaggcctacgtgctgtacaaggagtatgacctgtatggccagggcatcttcaccggcacctggtag

SEQ ID NO: 35415 - DNA, 1767 bp, Artificial Sequence
  Description of Artificial Sequence: Synthetic coding sequence
atggacaccaatgatgatcctgatgaggaccacctgaccagctatgacatccagctgagcatccaggagagcattgaggccagcaagacagccctgtgcccagagagatttgtgcccctgagcgcccagaacaggaagctggtggaggccatcaagcagggccacatccctgagctgcaggagtatgtgaagtacaagtatgccatggatgaagcagatgagaagggctggttccccctgcatgaagctgtggtgcagcccatccagcagatcctggagatcgtgctggatgccagctacaagaccctgtgggagttcaagacctgtgatggagagacccccctgaccctggccgtgaaggccggcctggtggagaatgtgaggaccctgctggagaagggcgtgtggcccaacaccaagaatgacaagggggagacccccctgctgattgctgtgaagaagggcagctatgacatggtgtccaccctcatcaagcacaacaccagcctggaccagccctgtgtgaagcgctggagcgccatgcatgaggccgccaagcagggcaggaaggacatcgtggccctgctgctgaagcatggaggaaatgtgcacctgagagatggctttggagtgacccccctgggcgtggccgcagaatatggccactgtgatgtgctggagcacctgatccacaagggaggagatgtgctggccctggctgatgatggagcctctgtgctgtttgaggccgccggcggcggcaacccagactgcatcagcctgctgctggagtatggaggcagcggaaatgtgcccaacagagctggccacctgcccatccacagagctgcctatgagggccactacctggccctgaagtacctgatccctgtgaccagcaagaatgccatcaggaagagcggcctgacccccatccacagcgctgctgatggccagaatgcccagtgcctggagctgctgattgaaaatggatttgatgtgaacaccctgctggccgaccacatcagccagagctatgatgatgagaggaagacagccctgtactttggagtgagcaacaatgatgtgcactgcacagaggtgctgctggccgccggggctgaccccaacctggaccccctgaactgcctgctggtggccgtgcgggccaacaactatgaaattgtgcggctgctgctgagccacggggccaacgtgaactgctacttcatgcacgtgaatgacacccgcttccccagcgtcatccagtatgccctgaatgatgaggtgatgctgcggctgctgctgaacaacggctaccaggtggagatgtgctttgactgcatgcacggggacatcttcggcaacagctttgtgtggagcgagatccaggaggaggtgctgcccggctggaccagctgtgtgatcaaggacaaccccttctgtgagttcatcaccgtgccctggatgaagcacctggtgggccgggtgaccagggtgctgattgactacatggactatgtgcccctgtgtgccaagctgaagagcgccctggaggtgcagcgggagtggccagagatccggcagatcctggagaacccctgcagcctgaagcacctgtgccgcctgaagatccggcggctgatgggcctgcagaagctgtgccagcctgcctctgtggagaagctgcccctgcccccagccatccagcgctacatcctcttcaaggagtatgacctgtatggccaggagctgaagctgacctag

SEQ ID NO: 35416 - DNA, 1767 bp, Artificial Sequence; identical to SEQ ID NO: 35415
  Description of Artificial Sequence: Synthetic coding sequence

SEQ ID NO: 35417 - DNA, 294 bp, Artificial Sequence
  Description of Artificial Sequence: Synthetic coding sequence
atggacaccaatgatgatcctgatgaggaccacctgaccagctatgacatccagctgagcatccaggagagcattgaggccagcaagacagccctgtgcccagagagatttgtgcccctgagcgcccagaacaggaagctggtggaggccatcaagcagggccacatccctgagctgcaggagtatgtgaagtacaagtatgccatggatgaagcagatgagaagggctggttccccctgcatgaagctgtggtgcagcccatccagcagatcctggagatcgtgctggactag

SEQ ID NO: 35418 - DNA, 726 bp, Artificial Sequence
  Description of Artificial Sequence: Synthetic coding sequence
atggacaccaatgatgatcctgatgaggaccacctgaccagctatgacatccagctgagcatccaggagagcattgaggccagcaagacagccctgtgcccagagagatttgtgcccctgagcgcccagaacaggaagctggtggaggccatcaagcagggccacatccctgagctgcaggagtatgtgaagtacaagtatgccatggatgaagcagatgagaagggctggttccccctgcatgaagctgtggtgcagcccatccagcagatcctggagatcgtgctggatgccagctacaagaccctgtgggagttcaagacctgtgatggagagacccccctgaccctggccgtgaaggccggcctggtggagaatgtgaggaccctgctggagaagggcgtgtggcccaacaccaagaatgacaagggggagacccccctgctgattgctgtgaagaagggcagctatgacatggtgtccaccctcatcaagcacaacaccagcctggaccagccctgtgtgaagcgctggagcgccatgcatgaggccgccaagcagggcaggaaggacatcgtggccctgctgctgaagcatggaggaaatgtgcacctgagagatggctttggagtgacccccctgggcgtggccgcagaatatggccactgtgatgtgctggagcacctgatccacaagggaggagatgtgctggccctggccgactag

SEQ ID NO: 35419 - DNA, 1767 bp, Artificial Sequence; identical to SEQ ID NO: 35415
  Description of Artificial Sequence: Synthetic coding sequence

SEQ ID NO: 35420 - DNA, 1767 bp, Artificial Sequence; identical to SEQ ID NO: 35415
  Description of Artificial Sequence: Synthetic coding sequence

SEQ ID NO: 35421 - DNA, 1767 bp, Artificial Sequence; identical to SEQ ID NO: 35415
  Description of Artificial Sequence: Synthetic coding sequence

SEQ ID NO: 35422 - DNA, 750 bp, Artificial Sequence
  Description of Artificial Sequence: Synthetic coding sequence
atgaagcagcccagcaaggccgagtatggccactgtgatgtgctggagcacctgatccacaagggaggagatgtgctggccctggctgatgatggagcctctgtgctgtttgaagctgctgggggcggcaacccagactgcatcagcctgctgctggagtatggaggcagcggaaatgtgcccaacagagctggccacctgcccatccaccgggccgcctatgagggccactacctggccctgaagtacctgatccctgtgaccagcaagaatgccatcaggaagagcggcctgacccccatccacagcgctgctgatggccagaatgcccagtgcctggagctgctgattgaaaatggatttgatgtgaacaccctgctggccgaccacatcagccagagctatgatgatgagaggaagacagccctgtactttggagtgagcaacaatgatgtgcactgcacagaggtgctgctggccgccggggctgaccccaacctggaccccctgaactgcctgctggtggccgtgcgggccaacaactatgagatcgtgcggctgctgctgagccatggagccaacgtgaactgctacttcatgcacgtgaatgacacccgcttccccagcgtcatccagtatgccctgaatgatgaggtgatgctgcggctgctgctgaacaacggctaccaggtggagatgtgctttgactgcatgcatggagacatctttggaaacagctttgtgtgctag

SEQ ID NO: 35423 - DNA, 1362 bp, Artificial Sequence
  Description of Artificial Sequence: Synthetic coding sequence
atggcccgggagaccttccccttcaccagctccatgctgcggagcctgcggctgcagcaggagtggctggagtgggaggacagaagaagagctgctgcccagcagtgccgcagccgccgctgccccagcagcccccgggcccggctgacccggccccacaggagctgccgggaccctgctgtgcaccaggccctcttcagcggcaacctgcagcaggtgcaggccctcttccaggatgaggaggccgccaacatgattgtggagaccgtgagcaaccagctggcctggagcgctgagcagggcttctgggtgctgacccccaagaccaagcagacagcccccctggccatcgccacagcccggggctacacagactgtgcccggcacctgatccggcagggcgctgagctggatgcccgggtgggcggccgggccgccctgcacgaggcctgtgcccgggcccagtttgactgtgtgcggctgctgctgacctttggagccaaggccaacgtgctgacagaggagggcaccacccccctgcacctgtgcaccatccctgagagcctgcagtgtgccaagctgctgctggaggccggggccaccgtgaacctggccgccggggagagccaggagacccccctgcacgtggccgccgcccggggcctggagcagcacgtggccctgtacctggagcacggggctgatgtgggcctgcggaccagccagggcgagacagccctgaacacagcctgtgccggggctgagggccctggcagctgcagaagacaccaggccgccgcccggcggctgctggaggccggggctgatgcccgggccgccggcaggaagaggcacacccccctgcacaatgcctgtgccaacggctgcggcggcctggccgagctgctgctgcgctacggggcccgggcagaggtgcccaacggggccggccacacccccatggactgtgccctgcaggccgtgcaggacagccccaactgggagcctgaggtgctgtttgctgccctgctggactatggagcccagcctgtgcggcctgagatgctgaagcactgtgccaacttcccccgggccctggaggtgctgctgaatgcctacccctgtgtgcccagctgtgagacctgggtggaggccgtgctgcctgagctgtggaaggagcacgaggccttctacagcagcgccctgtgcatggtgaaccagccccggcagctgcagcacctggcccggctggccgtgcgggcccggctgggcagccgctgccggcagggcgccacccggctgcccctgccccccctgctgcgggactacctgctgctgcgggtggagggctgcatccagtag

SEQ ID NO: 35424 - DNA, 888 bp, Artificial Sequence
  Description of Artificial Sequence: Synthetic coding sequence
atgagcaagagcaccaagctgtgtgggaagaccagctgccccaggagcaacatcttctgcaacctgctggacaagatcgtgaagaggcccagcctgcagttcctgggccagtggggctaccactgctatgagccccgcatctaccgcagcctggccaagatcctgcgctacgtggacctggatggctttgatgccctgctgacagactacatcgcctttgtggagaagagcggctacagatttgaggtgtccttcaacctggacttcacagagatctgtgtgaacaccatcctgtactgggtgtttgccaggaaaggaaatccagactttgtggagctgctgctgaagaagaccaaggactatgtgcaggacaggagctgcaacctggccctgatctggaggaccttcacccctgtgtactgccccagccccctgagcggcatcacccccctcttctacgtggcccagacccggcagagcaacatcttcaagatcctgctgcagtatggcatcctggagcgggagaagaaccccatcaacatcgtgctgaccatcgtgctgtaccccagccgggtgcgggtgatggtggaccgggagctggccgacatccatgaagatgccaagacctgcctggtgctgtgcagccgggtgctgagcgtcatctctgtgaaggagatcaagacccagctgagcctgggccgccaccccatcatcagcaactggtttgactacatccccagcacccgctacaaggacccctgtgagctgctgcacctgtgccgcctgaccatccggaaccagctgctgaccaacaacatgctgcctgatggcatcttcagcctgctgatcccagcccggctgcagaactacctgaacctggagatctag

SEQ ID NO: 35425 - DNA, 1314 bp, Artificial Sequence
  Description of Artificial Sequence: Synthetic coding sequence
atggagcggcagcccggccctgtgcggggcaagctgcagatcttccagaagacagagaaggacccccaggcccgggccggcagccctgtgcaggagtaccacacagccctggtggccggggacctggaccacctgaagcccctgatggaccagttcttccaggatgccaacgtggtgtttgagatcaacaaggatgagatggagtggcaggtgaagagccctgccaccttcggcctgagcggcctgtggaccctggagtacaagcgggagctgaccacccccctgtgcatcgctgctgcccacggccacacagcctgtgtgcgccacctgctgggcagaggagctgaccctgatgccagccctgggggccgcggggccctgcacgaggcctgcctgggcggccacacagcctgtgtgcggctgctgctgcagcacagagctgaccctgacctgctgtctgctgagggcctggcccccctgcacctgtgcaggacagctgccagcctgggctgtgcccaggccctgctggagcacggggcctctgtgcagagggtgggcggcaccggccgggacacccccctgcacgtggccgcccagaggggcctggatgaacatgcccggctgtacctgggccgcggggcccacgtggatgccagaaatggccgcggggagacagccctgtctgctgcctgtggggccgcccggcggccagatgagcacggccgctgcctgcggctgtgtgccctgctgctgcggagaggagctgaggctgatgccagagatgaagatgagaggagccccctgcacaaggcctgtggccacgccagccacagcctggcccggctgctgctgcggcacggggctgatgctggggccctggactatggaggagccagccccctgggccgggtgctgcagacagccagctgtgccctgcaggccagcccccagaggacagtgcaggccctgctgaaccacggcagccccaccgtgtggccagatgccttccccaaggtgctgaagacctgtgcctctgtgcctgctgtgattgaggtgctcttcaacagctacccccagctgtgcctgtctgagagctggaaggaggtgattcctgaggaggtgttccagatgcacaagcccttctaccagagcctgtttgccctggccctgaccccccgctgcctgcagcacctgtgccgctgtgccctgcggcggctgtttgggaagcgctgctttgacctgatccccctgctgcccctgcccaagcccctgcagaactacctgctgctggagccccagggcgtgctgcactag

SEQ ID NO: 35426 - DNA, 1401 bp, Artificial Sequence
  Description of Artificial Sequence: Synthetic coding sequence
atgagcaacagcgactacctgcctgactaccccctgaacagcgacctggtgaagaggctgaagagcgccctggatgccaaggatgaggagcgggtgcgggacctgatctgcacagagatcacccctgtggatgctgtgattgagctggccaatgatgactggatgaaggaccccagcgcccagctgcccaccggcatgctgctgggggacctggaccacctgaagcccctgatggaccagttcttccaggatgccaacgtggtgtttgagatcaacaaggatgagatggagtggcaggtgaagagccctgccaccttcggcctgagcggcctgtggaccctggagtacaagcgggagctgaccacccccctgtgcatcgccgccgcccacggccacacagcctgtgtgcgccacctgctgggccgcggggctgaccctgatgccagccctgggggccgcggggccctgcacgaggcctgcctgggcggccacacagcctgtgtgcggctgctgctgcagcacagagctgaccctgacctgctgtctgctgagggcctggcccccctgcacctgtgcaggacagctgccagcctgggctgtgcccaggccctgctggagcacggggcctctgtgcagagggtgggcggcaccggccgggacacccccctgcacgtggccgcccagaggggcctggatgagcacgcccggctgtacctgggccgcggggcccacgtggatgccagaaatggccgcggggagacagccctgtctgctgcctgtggggccgcccggcggccagatgaacatggccgctgcctgcggctgtgtgccctgctgctgcggagaggagctgaggctgatgccagagatgaagatgagaggagccccctgcacaaggcctgtggccacgccagccacagcctggcccggctgctgctgcggcatggagcagatgctggggccctggactatggaggagccagccccctgggccgggtgctgcagacagccagctgtgccctgcaggccagcccccagaggacagtgcaggccctgctgaaccacggcagccccaccgtgtggccagatgccttccccaaggtgctgaagacctgtgcctctgtgcctgctgtgattgaggtgctcttcaacagctacccccagctgtgcctgtctgagagctggaaggaggtgattcctgaggaggtgttccagatgcacaagcccttctaccagagcctgtttgccctggccctgaccccccgctgcctgcagcacctgtgccgctgtgccctgcggcggctgtttgggaagcgctgctttgacctgatccccctgctgcccctgcccaagcccctgcagaactacctgctgctggagccccagggcgtgctgcactag

SEQ ID NO: 35427 - DNA, 990 bp, Artificial Sequence
  Description of Artificial Sequence: Synthetic coding sequence
atgtctgtgctggaggagaaccggccctttgcccagcagctgagcaatgtgtacttcaccatcctgagcctcttctgcttcaagctgtttgtgaagatcagcctggccatcctgagccacttctacatcgtgaagggcaacaggaaggaggccgccagaattgctgctgagttctatggagtgacccagggccagggctcctgggccgacaggagccccctgcatgaagctgccagccagggccgcctgctggccctgcggaccctgctgagccagggctacaacgtgaatgctgtgaccctggaccacgtgacccccctgcacgaggcctgcctgggggaccacgtggcctgtgcccggaccctgctggaggccggggccaacgtgaatgccatcaccattgatggagtgacccccctcttcaatgcctgcagccagggcagccccagctgtgccgagctgctgctggagtatggagccaaggcccagctggagagctgcctgcccagccccacccatgaagctgccagcaagggccaccacgagtgcctggacatcctgatctcctggggcattgatgtggaccaggagatcccccacctgggcacccccctgtatgtggcctgcatgagccagcagttccactgcatctggaagctgctgtatgctggagcagatgtgcagaagggcaagtactgggacacccccctgcatgctgctgcccagcagagcagcacagagatcgtgaacctgctgctggagtttggagctgacatcaatgccaagaacacagagctgctgcggcccattgatgtggccaccagcagctccatggtggagcgcatcctgctgcagcacgaggccacccccagcagcctgtaccagctgtgccgcctgtgcatccgcagctacatcggcaagccccggctgcacctgatcccccagctgcagctgcccaccctgctgaagaacttcctgcagtacagatag

SEQ ID NO: 35428 - DNA, 63 bp, Artificial Sequence
  Description of Artificial Sequence: Synthetic coding sequence
atgtctgtgctggaggagaaccggccctttgcccagcagctgagcaatgtgtacttcacctag

SEQ ID NO: 35429 - DNA, 957 bp, Artificial Sequence
  Description of Artificial Sequence: Synthetic coding sequence
atgctgcaccaccactgcagaagaaatcctgagctgcaggaggagctgcagatccaggccgctgtggccgctggagatgtgcacacagtgaggaagatgctggagcagggctacagccccaacggcagagatgccaacggctggaccctgctgcacttctctgctgcccggggcaaggagcgctgtgtgcgggtcttcctggagcacggggctgaccccaccgtgaaggacctgattggaggcttcaccgccctgcactacgccgccatgcacggccgggcccgcatcgcccggctgatgctggagagcgagtacagaagtgacatcatcaatgccaagagcaatgatggctggacccccctgcacgtggccgcccactacggccgggacagctttgtgcggctgctgctggagttcaaggccgaggtggaccccctgagtgacaagggcaccacccccctgcagctggccatcatccgggagaggagcagctgtgtgaagatcctgctggaccacaatgccaacatcgacatccagaatggcttcctgctgcgctatgctgtgatcaagagcaaccacagctactgcaggatgttcctgcagagaggagctgacaccaacctgggccgcctggaggatggccagacccccctgcacctgagcgccctgagagatgatgtgctgtgtgccaggatgctgtacaactacggggctgacaccaacaccagaaattatgagggccagacccccctggccgtgtccatcagcatcagcggcagcagccggccctgcctggacttcctgcaggaggtgacccggcagcccaggaacctgcaggacctgtgccgcatcaagatccggcagtgcatcggcctgcagaacctgaagctgctggatgagctgcccatcgccaaggtgatgaaggactacctgaagcacaagtttgatgacatctag

SEQ ID NO: 35430 - DNA, 825 bp, Artificial Sequence
  Description of Artificial Sequence: Synthetic coding sequence
atgctgcaccaccactgcagaagaaatcctgagctgcaggaggagctgcagatccaggccgctgtggccgctggagatgtgcacacagtgaggaagatgctggagcagggctacagccccaacggcagagatgccaacggctggaccctgctgcacttctctgctgcccggggcaaggagcgctgtgtgcgggtcttcctggagcacggggctgaccccaccgtgaaggacctgattggaggcttcaccgccctgcactacgccgccatgcacggccgggcccgcatcgcccggctgatgctggagagcgagtacagaagtgacatcatcaatgccaagagcaatgatggctggacccccctgcacgtggccgcccactacggccgggacagctttgtgcggctgctgctggagttcaaggccgaggtggaccccctgagtgacaagggcaccacccccctgcagctggccatcatccgggagaggagcagctgtgtgaagatcctgctggaccacaatgccaacatcgacatccagaatggcttcctgctgcgctatgctgtgatcaagagcaaccacagctactgcaggatgttcctgcagagaggagctgacaccaacctgggccgcctggaggatggccagacccccctgcacctgagcgccctgagagatgatgtgctgtgtgccaggatgctgtacaactacggggctgacaccaacaccagaaattatgagggccagacccccctggccgtgtccatcagcatcagcggcagcagccggccctgcctggacttcctgcaggaggtgacctccatgtag

SEQ ID NO: 35431 - DNA, 759 bp, Artificial Sequence
  Description of Artificial Sequence: Synthetic coding sequence
atggatggcaagcagggcggcatggatggcagcaagccagctggcccccgggacttccctggcatccggctgctgagcaaccccctgatgggagatgctgtgtctgactggagccccatgcatgaagctgccatccacggccaccagctgagcctgaggaacctgatcagccagggctgggccgtgaacatcatcacagctgaccacgtgagccccctgcacgaggcctgcctgggcggccacctgagctgtgtgaagatcctgctgaagcatggagcccaggtgaatggagtgacagctgactggcacacccccctcttcaatgcctgtgtgtctggctcctgggactgtgtgaacctgctgctgcagcacggggcctctgtgcagcctgagagtgacctggccagccccatccatgaagctgcccggcgggcctacggcggcaacatcgaccacaagatcagccacctgggcacccccctgtacctggcctgtgagaaccagcagagggcctgtgtgaagaagctgctggagagcggggctgatgtgaaccagggcaagggccaggacagccccctgcatgctgtggccaggacagccagcgaggagctggcctgcctgctgatggactttggagctgacacccaggccaagaatgctgagggcaagaggcctgtggagctggtgcccccagagagccccctggcccagctgttcctggagcgggagggcgccagcctgcccaagcccaagccctag

SEQ ID NO: 35432 - DNA, 789 bp, Artificial Sequence
  Description of Artificial Sequence: Synthetic coding sequence
atggatggcaagcagggcggcatggatggcagcaagccagctggcccccgggacttccctggcatccggctgctgagcaaccccctgatgggagatgctgtgtctgactggagccccatgcatgaagctgccatccacggccaccagctgagcctgaggaacctgatcagccagggctgggccgtgaacatcatcacagctgaccacgtgagccccctgcacgaggcctgcctgggcggccacctgagctgtgtgaagatcctgctgaagcatggagcccaggtgaatggagtgacagctgactggcacacccccctcttcaatgcctgtgtgtctggctcctgggactgtgtgaacctgctgctgcagcacggggcctctgtgcagcctgagagtgacctggccagccccatccatgaagctgcccggcggggccacgtggagtgtgtgaacagcctcatcgcctacggcggcaacatcgaccacaagatcagccacctgggcacccccctgtacctggcctgtgagaaccagcagagggcctgtgtgaagaagctgctggagagcggggctgatgtgaaccagggcaagggccaggacagccccctgcatgctgtggccaggacagccagcgaggagctggcctgcctgctgatggactttggagctgacacccaggccaagaatgctgagggcaagaggcctgtggagctggtgcccccagagagccccctggcccagctgttcctggagcgggagggcgccagcctgcccaagcccaagccctag

SEQ ID NO: 35433 - DNA, 885 bp, Artificial Sequence
  Description of Artificial Sequence: Synthetic coding sequence
atggatggcaagcagggcggcatggatggcagcaagccagctggcccccgggacttccctggcatccggctgctgagcaaccccctgatgggagatgctgtgtctgactggagccccatgcatgaagctgccatccacggccaccagctgagcctgaggaacctgatcagccagggctgggccgtgaacatcatcacagctgaccacgtgagccccctgcacgaggcctgcctgggcggccacctgagctgtgtgaagatcctgctgaagcatggagcccaggtgaatggagtgacagctgactggcacacccccctcttcaatgcctgtgtgtctggctcctgggactgtgtgaacctgctgctgcagcacggggcctctgtgcagcctgagagtgacctggccagccccatccatgaagctgcccggcggggccacgtggagtgtgtgaacagcctcatcgcctacggcggcaacatcgaccacaagatcagccacctgggcacccccctgtacctggcctgtgagaaccagcagagggcctgtgtgaagaagctgctggagagcggggctgatgtgaaccagggcaagggccaggacagccccctgcatgctgtggccaggacagccagcgaggagctggcctgcctgctgatggactttggagctgacacccaggccaagaatgctgagggcaagaggcctgtggagctggtgcccccagagagccccctggcccagctgttcctggagcgggagggcccccccagcctgatgcagctgtgccgcctgcgcatcaggaagtgcttcggcatccagcagcaccacaagatcaccaagctggtgctgcctgaggacctgaagcagttcctgctgcacctgtag

SEQ ID NO: 35434 - DNA, 789 bp, Artificial Sequence; identical to SEQ ID NO: 35432
  Description of Artificial Sequence: Synthetic coding sequence

SEQ ID NO: 35435 - DNA, 1971 bp, Artificial Sequence
  Description of Artificial Sequence: Synthetic coding sequence
atgtctgagctgagtgatgaggccagcgagcctgagctgctgaacagaagcctgtccatgtggcacggcctgggcacccaggtgtctggagaggagctggatgtgcccctggacctgcacacagctgccagcatcggccagtatgaggtggtgaaggaatgtgtgcagaggcgggagctggacctgaacaagaagaatggaggcggctggacccccctgatgtatgccagctacatcggccatgacaccatcgtgcacctgctgctggaggccggcgtgtctgtgaatgtgcccaccccagagggccagacccccctgatgctggccagcagctgtggaaatgaaagcatcgcctacttcctgctgcagcagggcgctgagctggagatgaaggacatccagggctggacagccctcttccactgcaccagcgctggccaccagcacatggtgcgcttcctgctggacagcggggccaatgccaacgtgcgggagcccatctgtggcttcacccccctgatggaggccgctgctgctggccacgagatcatcgtgcagtacttcctgaaccacggcgtgaaggtggatgcccgggaccacagcggggccacagccaggatgctggccaagcagtatggccacatgaagatcgtggccctgatggacacctacagccccagcctgcccaagagcctgtaccgcagccctgagaagtatgaggacctgagcagcagtgatgagagctgcccagccccccagaggcagaggccctgcaggaagaagggcgtgtccatccacgagggcccccgggccctggcccgcatcaccggcatcggcctgggcggccgggccccccggcccaggtatgagcaggccccaccccggggctacgtgaccttcaacagcagtggagagaaccccctggaggaggagggcctgtgctgcagagatgtgaccagccccatcaatgaaagagatgtggagagcagcagcagcagcagcagccgggaggagcacgccttctgtgccaacctgggccctgtgcagagcagcagcagcagcgagggcctggcccgggcccagggcctgagcagcgaggcctctgtggagagcaatgaagattctgaccacgcctgcaagagcagcgccaggaagcaggccaagagctacatgaagaccaagaacccagacagccagtggccaccccgggccgccacagaccgggagggcttcctggccgagagcagcccccagacccagagggccccctacagcggcccccaggacctggccgccctgctggagcagatcggctgcctgaagtacctgcaggtgtttgaggagcaggatgtggacctgcgcatcttcctgaccctgacagaaagtgacctgaaggagatcggcatcaccctgtttggccccaagaggaagatgaccagcgccatcgcccgctggcacagcagcgcccggcccccaggagatgccctggagctggcctatgctgaccggctggaggccgagatgcaggagctggccatccagctgcacaagagatgtgaggaggtggaggccacccggggccaggtgtgccaggagcaggagctgcgggctgtggtggagagctgcctgctggagcaggaccgggcccgggaggacctgcaggcccggctgcgggagacctgggccctggccagagatgctgccctggtgctggaccagctgcgggcctgccaggccgagctgagcagccgggtgcggcaggaccagcccccaggagctgccaccctgggcctggccgtgcccccagctgacagcaagggctggcaggccagcctgcaggccatgagcctgcctgagctgagcggggccctggaggacagagtgcgggagatgggccaggccctgtgcctggtgacccagagcctggagaagctgcaggtgctgaatggcaagaagtggagggagacctag

SEQ ID NO: 35436 - DNA, 1584 bp, Artificial Sequence
  Description of Artificial Sequence: Synthetic coding sequence
atgaaggacatccagggctggacagccctcttccactgcaccagcgctggccaccagcacatggtgcgcttcctgctggacagcggggccaatgccaacgtgcgggagcccatctgtggcttcacccccctgatggaggccgctgctgctggccacgagatcatcgtgcagtacttcctgaaccacggcgtgaaggtggatgcccgggaccacagcggggccacagccaggatgctggccaagcagtatggccacatgaagatcgtggccctgatggacacctacagccccagcctgcccaagagcctgtaccgcagccctgagaagtatgaggacctgagcagcagtgatgagagctgcccagccccccagaggcagaggccctgcaggaagaagggcgtgtccatccacgagggcccccgggccctggcccgcatcactggaattggcctgggcggccgggccccccggcccaggtatgagcaggccccaccccggggctacgtgaccttcaacagcagcggggagaaccccctggaggaggagggcctgtgctgcagagatgtgaccagccccatcaatgaaagagatgtggagagcagcagcagcagcagcagccgggaggagcacgccttctgtgccaacctgggccctgtgcagagcagcagcagcagcgagggcctggcccgggcccagggcctgagcagcgaggcctctgtggagagcaatgaagacagcgaccacgcctgcaagagcagcgccaggaagcaggccaagagctacatgaagaccaagaacccagacagccagtggccacccagggctgccacagaccgggagggcttcctggccgagagcagcccccagacccagagggccccctacagcggcccccaggacctggccgccctgctggagcagatcggctgcctgaagtacctgcaggtgtttgaggagcaggatgtggacctgcgcatcttcctgaccctgacagaaagtgacctgaaggagatcggcatcaccctgtttggccccaagaggaagatgaccagcgccatcgcccgctggcacagcagcgcccggcccccaggagatgccctggagctggcctatgctgaccggctggaggccgagatgcaggagctggccatccagctgcacaagagatgtgaggaggtggaggccacccggggccaggtgtgccaggagcaggagctgcgggctgtggtggagagctgcctgctggagcaggaccgggcccgggaggacctgcaggcccggctgcgggagacctgggccctggccagagatgctgccctggtgctggaccagctgcgggcctgccaggccgagctgagcagccgggtgcggcaggaccagcccccaggggccgccaccctgggcctggccgtgcccccagctgacagcaagggctggcaggccagcctgcaggccatgagcctgcctgagctgagcggggccctggaggacagagtgcgggagatgggccaggccctgtgcctggtgacccagagcctggagaagctgcaggtgctgaatggcaagaagtggagggagacctag

SEQ ID NO: 35437 - DNA, 921 bp, Artificial Sequence
  Description of Artificial Sequence: Synthetic coding sequence
atgctggccaagcagtatggccacatgaagatcgtggccctgatggacacctacagccccagcctgcccaagagcctgtaccgcagccctgagaagtatgaggacctgagcagcagtgatgagagctgcccagccccccagaggcagaggccctgcaggaagaagggcgtgtccatccacgagggcccccgggccctggcccgcatcaccggcatcggcctgggcggccgggccccccggcccaggtatgagcaggccccaccccggggctacgtgaccttcaacagcagtggagagaaccccctggaggaggagggcctgtgctgcagagatgtgaccagccccatcaatgaaagagatgtggagagcagcagcagcagcagcagccgggaggagcacgccttctgtgccaacctgggccctgtgcagagcagcagcagcagcgagggcctggcccgggcccagggcctgagcagcgaggcctctgtggagagcaatgaagattctgaccacgcctgcaagagcagcgccaggaagcaggccaagagctacatgaagaccaagaacccagacagccagtggccaccccgggccgccacagaccgggagggcttcctggccgagagcagcccccagacccagagggccccctacagcggcccccaggtgcggcccctggtgaagctggaggtgaccctgagagatggcaccttctgtgacctgggcggcatgtgctgcgtgtatgatgtgcctggagctgccaggagaacagagtggcgctggcacccccacggcctgctgggcagcacaggcagccagcctgccccctggctggccgcccccctgcagcgcttctacagcgtgcccctgcacggcaaggacctgagcccctgcttcccctactggagctggcccccatag

SEQ ID NO: 35438 - DNA, 1275 bp, Artificial Sequence
  Description of Artificial Sequence: Synthetic coding sequence
atgaggatcttcatcgcctttgagggcagctttgagccctttgatgtgtctgcagatgaaacagtggaggtggtgaagctgatgatcaaggactacttccacatccccctgtctgaggacaagcagggccgccgctacctggagctgatgtatgctggggccgccctgaaggacagctggagcctggctgatgtgggcatctccttctgcagcaccctgaagtgctttgtgaaggaggaggacaagcccaccctgtatgtgttcaatgctgtgacccaggacaccatgcctgtgatggagagcatcagcctgctggacaagacagtgtctgacctgcggaccctggtgaccctgcgctgtggcctgcctgtgtctgtgtactgcctgcggaccccccggggcctggagatgtatgactgcaacaccctgaaggactaccagacagacatcggcaccaccctgcggctggatgtgtgggatggctggaaggagttcctgatgggctgcctgctgggccagaagctgaaggtgcagcgctacctgagcaaggagggccctgtgctgaagtaccagaagagggtggccctgtacatcgccgccttctgtggctacatcgagctgacagagtgggccctgaagcagggcgcccggccccatgaagctgtgggcgtgcacccctaccgggcctggtgccacgaggccctgcatgctgatgtgtccaaatgtcccatccacgccgctgctgaggccggccagctgctgatcctgaaggcctttgtgaactacagcgtgctgtgcctggagtgcaagaatgctgctggccagacccccctgaccatcgtgttcaagcacaagcacaaggactgtgtgctgtacctgctgagcaagatgtggagcacagtgtccttccccaagatctctgtgcccatgaggatctacatcaagatcaagcagtggatcctgcgggcccagagccacagcctgcacaagagccagttctgtggggcccgggtgtttggagccaaggtgggggacacagtgatggtggatggcttcaccaagcccaagatgaccagcaagtcctggcacaaggccggcaacagcgacagccagagcatcgtgctgaagctgcccagcctgagcaagcagacagccagcagcaagcctgtgaaccccctggccatcagccagcctgacaccaggaagcaggccctgaagttccaccccctgaagggggagagccccaaggctgacaagagcagcggcatcatgtag

SEQ ID NO: 35439 - DNA, 1635 bp, Artificial Sequence
  Description of Artificial Sequence: Synthetic coding sequence
atgaggatcttcatcgcctttgagggcagctttgagccctttgatgtgtctgcagatgaaacagtggaggtggtgaagctgatgatcaaggactacttccacatccccctgtctgaggacaagcagggccgccgctacctggagctgatgtatgctggggccgccctgaaggacagctggagcctggctgatgtgggcatctccttctgcagcaccctgaagtgctttgtgaaggaggaggacaagcccaccctgtatgtgttcaatgctgtgacccaggacaccatgcctgtgatggagagcatcagcctgctggacaagacagtgtctgacctgcggaccctggtgaccctgcgctgtggcctgcctgtgtctgtgtactgcctgcggaccccccggggcctggagatgtatgactgcaacaccctgaaggactaccagacagacatcggcaccaccctgcggctggatgtgtgggatggctggaaggagttcctgatgggctgcctgctgggccagaagctgaaggtgcagcgctacctgagcaaggagggccctgtgctgaagtaccagaagagggtggccctgtacatcgccgccttctgtggctacatcgagctgacagagtgggccctgaagcagggcgcccggccccatgaagctgtgggcgtgcacccctaccgggcctggtgccacgaggccctgcatgctgatgtgtccaaatgtcccatccacgccgctgctgaggccggccagctgctgatcctgaaggcctttgtgaactacagcgtgctgtgcctggagtgcaagaatgctgctggccagacccccctgaccatcgtgttcaagcacaagcacaaggactgtgtgctgtacctgctgagcaagatgtggagcacagtgtccttccccaagatctctgtgcccatgaggatctacatcaagatcaagcagtggatcctgcgggcccagagccacagcctgcacaagagccagttctgtggggcccgggtgtttggagccaaggtgggggacacagtgatggtggatggcttcaccaagcccaagatgaccagcaagtcctggcacaaggccggcaacagcgacagccagagcatcgtgctgaagctgcccagcctgagcaagcagacagccagcagcaagcctgtgaaccccctggccatcagccagcctgacaccaggaagcaggccctgaagttccaccccctggtgaatgccagcagcttcagcgagctgcagaagcaccagcagcagaaccagaagaagatcacagccacagccaggaagaaggagaagctgatcaagaacacctacctgccccaggtgcccctgccccctgtgtcccgggtgggctacagccaccccagcttcttctacgccacccccagcgctgacttcctgctgaagagcagcttcagcagcttcctggagcacagcggcaagaccccctgggagaatgccatctactgcctggccgtggccagcgccttcaaggagaagcgctggctgcagcagctggagatcgcccgggtgctggccaagaagagcatcagcaacctgaccacccggggcggcctgacagcctgtgagaacagcctggagaccgtgctgtag

SEQ ID NO: 35440 - DNA, 2181 bp, Artificial Sequence
  Description of Artificial Sequence: Synthetic coding sequence
atgagccctgccccagatgctgccccagccccagccagcatcagcctgtttgacctgtctgcagatgcccctgtgttccagggcctgagcctggtgagccacgcccctggagaggccctggcccgggcccccaggaccagctgcagcggcagcggggagcgggagagccctgagaggaagctgctgcagggccccatggacatcagcgagaagctgttctgcagcacctgtgaccagaccttccagaaccaccaggagcagcgggagcactacaagctggactggcaccgcttcaacctgaagcagaggctgaaggacaagcccctgctgagcgccctggactttgagaagcagagcagcactggagacctgagcagcatcagcggctctgaagattctgattctgccagcgaggaggacctgcagaccctggaccgggagcgggccacctttgagaagctgagcaggcctcctggcttctacccccaccgggtgctcttccagaatgcccagggccagttcctgtatgcctaccgctgtgtgctgggcccccaccaggaccccccagaggaggccgagctgctgctgcagaacctgcagagccggggcccccgggactgtgtggtgctgatggctgctgctggccactttgctggggccatcttccagggccgggaggtggtgacccacaagaccttccaccgctacacagtgcgggccaagaggggcacagcccagggcctgagagatgcccggggcggccccagccacagcgctggggccaacctgcggcgctacaatgaggccaccctgtacaaggatgtgcgggacctgctggccggccccagctgggccaaggccctggaggaggccggcaccatcctgctgcgggcccccaggagcggccgcagcctcttctttggaggcaagggggcccccctgcagagaggagacccccggctgtgggacatccccctggccacccggcggcccaccttccaggagctgcagagggtgctgcacaagctgaccaccctgcacgtgtatgaggaggacccccgggaggccgtgcggctgcacagcccccagacccactggaagacagtgcgggaggagaggaagaagcccacagaggaggagatcaggaagatctgcagagatgagaaggaggccctgggccagaatgaggagagccccaagcagggcagcggcagcgagggggaggatggcttccaggtggagctggagctggtggagctgactgtgggcaccctggacctgtgtgagagcgaggtgctgcccaagagaagaagaaggaagaggaacaagaaggagaagagccgggaccaggaggccggggcccacaggaccctgctgcagcagacccaggaggaggagcccagcacccagagcagccaggccgtggccgcccccctgggccccctgctggatgaggccaaggcccctggccagcctgagctgtggaatgccctgctggccgcctgcagagctggagatgtgggcgtgctgaagctgcagctggcccccagccctgctgacccccgggtgctgagcctgctgagcgcccccctgggcagcggcggcttcaccctgctgcatgctgctgctgctgctggccggggctctgtggtgcggctgctgctggaggccggggctgaccccaccgtgcaggacagccgggcccggcccccctacacagtggccgctgacaagagcaccagaaatgagttccgccgcttcatggagaagaacccagatgcctatgactacaacaaggcccaggtgcccggccccctgaccccagagatggaggcccggcaggccaccaggaagcgggagcagaaggccgcccggcggcagcgggaggagcagcagcagaggcagcaggagcaggaggagcgggagcgggaggagcagaggagatttgctgccctgagtgaccgggagaagagggccctggccgctgagcggcggctggccgcccagctgggcgcccccaccagccccatcccagacagcgccatcgtgaacacccggcgctgctggagctgtggggccagcctgcagggcctgacccccttccactacctggacttctccttctgcagcacccgctgcctgcaggaccaccggcggcaggccggccggcccagcagctag

SEQ ID NO: 35441 - DNA, 2181 bp, Artificial Sequence; identical to SEQ ID NO: 35440
  Description of Artificial Sequence: Synthetic coding sequence

SEQ ID NO: 35442 - DNA, 273 bp, Artificial Sequence
  Description of Artificial Sequence: Synthetic coding sequence
atgagccctgccccagatgctgccccagccccagccagcatcagcctgtttgacctgtctgcagatgcccctgtgttccagggcctgagcctggtgagccacgcccctggagaggccctggcccgggcccccaggaccagctgcagcggcagcggggagcgggagagccctgagaggaagctgctgcagggccccatggacatcagcgagaagctgttctgcagcacctgtgaccagaccttccagaaccaccaggagcagcgggagcactag

SEQ ID NO: 35443 - DNA, 423 bp, Artificial Sequence
  Description of Artificial Sequence: Synthetic coding sequence
atgagccctgccccagatgctgccccagccccagccagcatcagcctgtttgacctgtctgcagatgcccctgtgttccagggcctgagcctggtgagccacgcccctggagaggccctggcccgggcccccaggaccagctgcagcggcagcggggagcgggagagccctgagaggaagctgctgcagggccccatggacatcagcgagaagctgttctgcagcacctgtgaccagaccttccagaaccaccaggagcagcgggagcactacaagctggactggcaccgcttcaacctgaagcagaggctgaaggacaagcccctgctgagcgccctggactttgagaagcagagcagcactggagacctgagcagcatcagcggctctgaagattctgattctgcctctgaagaagattag

SEQ ID NO: 35444 - DNA, 1263 bp, Artificial Sequence
  Description of Artificial Sequence: Synthetic coding sequence
atgtctgctgctggggccggggccggcgtggaggccggcttcagcagcgaggagctgctgagcctgcgcttccccctgcaccgggcctgcagagatggagacctggccaccctgtgcagcctgctgcagcagacccctcatgcccacctggcctctgaagattccttctacggctggacccctgtgcactgggccgcccactttgggaagctggagtgcctggtgcagctggtgcgggccggggccaccctgaatgtgtccaccaccaggtatgcccagaccccagcccacatcgccgcctttggaggccacccccagtgcctggtgtggctgatccaggccggggccaacatcaacaagccagactgtgagggggagacccccatccacaaggccgcccggagcggcagcctggagtgcatcagcgccctggtggccaatggagcccacgtggacctgagaaatgccagcggcctgacagctgctgacatcgcccagacccagggcttccaggagtgtgcccagttcctgctgaacctgcagaactgccacctgaaccacttctacaacaacggcatcctgaatggaggccaccagaatgtgttccccaaccacatctctgtgggcaccaacaggaagcgctgcctggaggacagcgaggactttggagtgaagaaggccaggacagaggcccagagcctggacagcgctgtgcccctgaccaacggggacacagaagatgatgctgacaagatgcacgtggaccgggagtttgctgtggtgacagacatgaagaacagcagctctgtgagcaacaccctgaccaacggctgcgtcatcaatggccacctggacttccccagcaccacccccctgagcggcatggagagcagaaatggccagtgcctgaccggcaccaacggcatcagcagcggcctggcccctggccagcccttccccagcagccagggcagcctgtgcatctctggaacagaggagcctgagaagaccctgcgggccaaccctgagctgtgtggcagcctgcacctgaatggcagccccagcagctgcatcgccagccggcccagctgggtggaggacatcggggacaacctgtactacggccactaccacggctttggagacacagctgagagcatccctgagctgaacagcgtggtggagcacagcaagtctgtgaaggtgcaggagagatatgacagcgctgtgctgggcaccatgcacctgcaccacggcagctag

SEQ ID NO: 35445 - DNA, 663 bp, Artificial Sequence
  Description of Artificial Sequence: Synthetic coding sequence
atgtctgctgctggggccggggccggcgtggaggccggcttcagcagcgaggagctgctgagcctgcgcttccccctgcaccgggcctgcagagatggagacctggccaccctgtgcagcctgctgcagcagacccctcatgcccacctggcctctgaagattccttctacggctggacccctgtgcactgggccgcccactttgggaagctggagtgcctggtgcagctggtgcgggccggggccaccctgaatgtgtccaccaccaggtatgcccagaccccagcccacatcgccgcctttggaggccacccccagtgcctggtgtggctgatccaggccggggccaacatcaacaagccagactgtgagggggagacccccatccacaaggccgcccggagcggcagcctggagtgcatcagcgccctggtggccaatggagcccacgtggagttcatcagccagagctctgtgcacagctgcctgcccggggagctgcagcacggcgtgacctttgaccccagcgtgctgatccagtgcctgaagccagagaagtgccagtggccagacagcagccgccactgcaccaaccctggcttcccccgggtgtgccctgtgtccctggagcccccagagctgagcagcgagcccttcctgtag

SEQ ID NO: 35446 - DNA, 1557 bp, Artificial Sequence
  Description of Artificial Sequence: Synthetic coding sequence
atggtgcagctggtgctgcagtacagagactaccagagggccacccagaggctggccggcatccctgagctgctgaacaagctgcggcaggccccagacttctacgtggagatgaagtgggagttcacctcctgggtgcccctggtgtccaagatgtgccccagtgatgtgtacagagtgtggaagagaggagagagcctgcgggtggacaccagcctgctgggctttgagcacatgacctggcagagaggaagaagaagcttcatcttcaagggccaggaggccggggccctggtgatggaggtggaccatgaccggcaggtggtgcacgtggagaccctgggcctgaccctgcaggagcctgagaccctgctggccgccatgaggccttctgaggagcacgtggccagccggctgaccagccccatcgtgtccacccacctggacaccagaaatgtggcctttgaaagaaataaatgtggcatctggggctggaggtctgagaagatggagaccgtgtctggctatgaggccaaggtgtacagcgccaccaacgtggagctggtgaccaggaccaggacagagcacctgagtgaccaggacaagagccgcagcaaggccggcaagacccccttccagagcttcctgggcatggcccagcagcacagcagccacactggagcccctgtgcagcaggccgccagccccaccaaccccacagccatcagccctgaggagtactttgaccccaacttcagcctggagagcagaaatattggccggcccatcgagatgagcagcaaggtgcagcgcttcaaggccaccctgtggctgtctgaggagcaccccctgagcctgggggaccaggtgacccccatcatcgacctgatggccatcagcaatgcccactttgccaagctgcgggacttcatcaccctgcggctgcccccaggcttccctgtgaagattgagatccccctcttccacgtgctgaatgcccgcatcaccttcagcaacctgtgtggctgtgatgagcccctgagctctgtgtgggtgcctgcccccagcagcgctgtggccgccagcggcaaccccttcccctgtgaggtggaccccaccgtgtttgaggtgcccaacggctacagcgtgctgggcatggagagaaatgagcccctgagagatgaagatgatgacctgctgcagtttgccatccagcagagcctgctggaggccggcacagaagctgagcaggtgacagtgtgggaggccctgaccaacaccaggcctggggcccggcccccaccccaggccaccgtgtatgaggagcagctgcagctggagcgggccctgcaggagagcctgcagctgagcacagagccccggggccctggcagcccccccaggaccccaccagcccctggccccccatcctttgaggagcagctgcggctggccctggagctgagcagccgggagcaggaggagcgggagcggcggggccagcaggaggaggaggacctgcagaggatcctgcagctgagcctgacagagcactag

SEQ ID NO: 35447 - DNA, 1557 bp, Artificial Sequence; identical to SEQ ID NO: 35446
  Description of Artificial Sequence: Synthetic coding sequence

SEQ ID NO: 35448 - DNA, 1818 bp, Artificial Sequence
  Description of Artificial Sequence: Synthetic coding sequence
atggccggccctggccccaccttccccctgcaccggctggtgtgggccaacagacaccgggagctggaggccgccctgcacagccaccagcacgacatcgagcaggaggacccccggggccgcacccccctggagctggccgtgtccctgggcaacctggagagcgtgcgggtgctgctgcggcacaatgccaacgtgggcaaggaaaatcggcagggctgggccgtgctgcaggaggccgtgtccactggagaccctgagatggtgcagctggtgctgcagtacagagactaccagagggccacccagaggctggccggcatccctgagctgctgaacaagctgcggcaggccccagacttctacgtggagatgaagtgggagttcacctcctgggtgcccctggtgtccaagatgtgccccagtgatgtgtacagagtgtggaagagaggagagagcctgcgggtggacaccagcctgctgggctttgagcacatgacctggcagaggggccgccgctccttcatcttcaagggccaggaggccggggccctggtgatggaggtggaccatgaccggcaggtggtgcacgtggagaccctgggcctgaccctgcaggagcctgagaccctgctggccgccatgaggcccagcgaggagcacgtggccagccggctgaccagccccatcgtgtccacccacctggacaccagaaatgtggcctttgagaggaacaagtgtggcatctggggctggaggtctgagaagatggagaccgtgtctggctatgaggccaaggtgtacagcgccaccaacgtggagctggtgaccaggaccaggacagagcacctgagtgaccaggacaagagccgcagcaaggccggcaagacccccttccagagcttcctgggcatggcccagcagcacagcagccacactggagcccctgtgcagcaggccgccagccccaccaaccccacagccatcagccctgaggagtactttgaccccaacttcagcctggagagcaggaacatcggccggcccatcgagatgagcagcaaggtgcagcgcttcaaggccaccctgtggctgtctgaggagcaccccctgagcctgggggaccaggtgacccccatcatcgacctgatggccatcagcaatgcccactttgccaagctgcgggacttcatcaccctgcggctgcccccaggcttccctgtgaagattgagatccccctcttccacgtgctgaatgcccgcatcaccttcagcaacctgtgtggctgtgatgagcccctgagctctgtgtgggtgcctgcccccagcagcgctgtggccgccagcggcaaccccttcccctgtgaggtggaccccaccgtgtttgaggtgcccaacggctacagcgtgctgggcatggagagaaatgagcccctgagagatgaagatgatgacctgctgcagtttgccatccagcagagcctgctggaggccggcacagaggccgagcaggtgacagtgtgggaggccctgaccaacaccaggcctggggcccggcccccaccccaggccaccgtgtatgaggagcagctgcagctggagcgggccctgcaggagagcctgcagctgagcacagagccccggggccctggcagcccccccaggaccccaccagcccctggcccccccagctttgaggagcagctgcggctggccctggagctgagcagccgggagcaggaggagcgggagcggcggggccagcaggaggaggaggacctgcagaggatcctgcagctgagcctgacagagcactag

SEQ ID NO: 35449 - DNA, 1557 bp, Artificial Sequence; identical to SEQ ID NO: 35446
  Description of Artificial Sequence: Synthetic coding sequence

SEQ ID NO: 35450 - DNA, 768 bp, Artificial Sequence
  Description of Artificial Sequence: Synthetic coding sequence
atgagctgtggccgcctgggccgcttcaaggccaccctgtggctgtctgaggagcaccccctgagcctgggggaccaggtgacccccatcatcgacctgatggccatcagcaatgcccactttgccaagctgcgggacttcatcaccctgcggctgcccccaggcttccctgtgaagattgagatccccctcttccacgtgctgaatgcccgcatcaccttcagcaacctgtgtggctgtgatgagcccctgagctctgtgtgggtgcctgcccccagcagcgctgtggccgccagcggcaaccccttcccctgtgaggtggaccccaccgtgtttgaggtgcccaacggctacagcgtgctgggcatggagagaaatgagcccctgagagatgaagatgatgacctgctgcagtttgccatccagcagagcctgctggaggccggcacagaggccgagcaggtgacagtgtgggaggccctgaccaacaccaggcctggggcccggcccccaccccaggccaccgtgtatgaggagcagctgcagctggagcgggccctgcaggagagcctgcagctgagcacagagccccggggccctggcagcccccccaggaccccaccagcccctggcccccccagctttgaggagcagctgcggctggccctggagctgagcagccgggagcaggaggagcgggagcggcggggccagcaggaggaggaggacctgcagaggatcctgcagctgagcctgacagagcactag

SEQ ID NO: 35451 - DNA, 1011 bp, Artificial Sequence
  Description of Artificial Sequence: Synthetic coding sequence
atgaagcccaagagccgggaggtggagcggcggctgaccagccctgtgatcaacaccagcctggacaccaagaacatcgcctttgagaggaccaagagcggcttctggggctggaggacagacaaggccgaggtggtgaatggctatgaggccaaggtgtacacagtgaacaacgtgaatgtcatcaccaagatcagaacagagcacctgacagaggaggagaagaagcgctacaaggacaggaaccccctggagagcctgctgggcaccgtggagcaccagtttggagcccagggcgacctgaccacagaatgtgccacagccaacaaccccacagccatcaccccagatgagtacttcaatgaggagtttgacctgaaggaccgggacatcggccggcccaaggagctgaccatccgcacccagaagttcaaggccatgctgtggatgtgtgaggagttccccctgagcctggtggagcaggtgatccccatcatcgacctgatggcccggaccagcgcccactttgcccggctgcgggacttcatcaagctggagttccccccaggcttccctgtgaagatcgccagccacatcaccaactttgaggtggaccagagcgtgtttgagatccctgagagctactacgtgcaggacaatggaagaaatgtgcacctgcaggatgaagattatgagatcatgcagtttgccatccagcagagcctgctggagagcagccgcagccaggagctgagcggccctgccagcaatggaggcatcagccagaccaacacctatgatgcccagtatgaaagagccatccaggagagcctgctgaccagcacagagggcctgtgccccagcgccctgtctgagaccagcagatttgacaatgacctgcagctggccatggagctgagcgccaaggagctggaggagtgggagctgcggctgcaggaggaggaggccgagctgcagcaggtgctgcagctgagcctgacagacaagtag

SEQ ID NO: 35452 - DNA, 1773 bp, Artificial Sequence
  Description of Artificial Sequence: Synthetic coding sequence
atgagcagcgcctgtgatgctggggaccactaccccctgcacctgctggtgtggaagaatgactaccggcagctggagaaggagctgcagggccagaatgtggaggccgtggacccccggggccgcaccctgctgcacctggccgtgtccctgggccacctggagagcgcccgggtgctgctgcggcacaaggcagatgtgaccaaggagaaccggcagggctggacagtgctgcatgaagctgtgtccactggagaccctgagatggtgtacacagtgctgcagcaccgggactaccacaacacctccatggccctggagggcgtgcctgagctgctgcagaagatcctggaggccccagacttctacgtgcagatgaagtgggagttcacctcctgggtgcccctggtgagccgcatctgccccaatgatgtgtgccgcatctggaagagcggggccaagctgcgggtggacatcaccctgctgggctttgagaacatgtcctggatccggggcagaagaagcttcatcttcaagggggaggacaactgggccgagctgatggaggtgaaccatgatgacaaggtggtgaccacagaaagatttgacctgagccaggagatggagcggctgaccctggacctgatgaagcccaagagccgggaggtggagcggcggctgaccagccctgtgatcaacaccagcctggacaccaagaacatcgcctttgagaggaccaagagcggcttctggggctggaggacagacaaggccgaggtggtgaatggctatgaggccaaggtgtacacagtgaacaacgtgaatgtcatcaccaagatcagaacagagcacctgacagaggaggagaagaagcgctacaaggctgacaggaaccccctggagagcctgctgggcaccgtggagcaccagtttggagcccagggcgacctgaccacagaatgtgccacagccaacaaccccacagccatcaccccagatgagtacttcaatgaggagtttgacctgaaggaccgggacatcggccggcccaaggagctgaccatccgcacccagaagttcaaggccatgctgtggatgtgtgaggagttccccctgagcctggtggagcaggtgatccccatcatcgacctgatggcccggaccagcgcccactttgcccggctgcgggacttcatcaagctggagttccccccaggcttccctgtgaagattgagatccccctcttccacgtgctgaatgcccgcatcacctttggaaatgtgaatggctgcagcacagctgaggagagcgtgtcccagaatgtggagggcacccaggccgacagcgccagccacatcaccaactttgaggtggaccagagcgtgtttgagatccctgagagctactacgtgcaggacaatggaagaaatgtgcacctgcaggatgaagattatgagatcatgcagtttgccatccagcagagcctgctggagagcagccgcagccaggagctgagcggccctgccagcaatggaggcatcagccagaccaacacctatgatgcccagtatgaaagagccatccaggagagcctgctgaccagcacagagggcctgtgccccagcgccctgtctgagaccagcagatttgacaatgacctgcagctggccatggagctgagcgccaaggagctggaggagtgggagctgcggctgcaggaggaggaggccgagctgcagcaggtgctgcagctgagcctgacagacaagtag

SEQ ID NO: 35453 - DNA, 1881 bp, Artificial Sequence
  Description of Artificial Sequence: Synthetic coding sequence
atgatcccagccaatgccagcgccaggaagggccctgagggcaagtaccccctgcactacctggtgtggcacaacagacaccgggagctggagaaggaggtgcgggccggccaggtggacatcgagcagctggacccccggggccgcacccccctgcacctggccaccaccctgggccacctggagtgtgcccgggtgctgctggcccacggggctgatgtgggcagagaaaatagaagtggctggacagtgctgcaggaggccgtgtccacccgggacctggagctggtgcagctggtgctgcgctacagagactaccagagggtggtgaagaggctggccggcatccctgtgctgctggagaagctgaggaaggcccaggacttctacgtggagatgaagtgggagttcacctcctgggtgcccctggtgtccaagatctgccccagcgacacctacaaggtgtggaagagcggccagaacctgcgggtggacaccaccctgctgggctttgaccacatgacctggcagaggggcaacagaagctttgtgttccggggccaggacaccagcgctgtggtgatggagattgaccatgacagaagagtggtgtacacagagaccctggccctggccggccaggaccgggagctgctgctggccgccgcccagcccacagaggagcaggtgctgagccggctgacagcccctgtggtgaccacccagctggacaccaagaacatcagctttgagaggaacaagacaggcatcctgggctggaggtctgagaagacagagatggtgaatggctatgaggccaaggtgtatggagccagcaatgtggagctgatcaccaggaccaggacagagcacctgtctgagcagcacaagggcaaggtgaagggctgcaagacccccctgcagagcttcctgggcattgctgagcagcacggcggcccccagaatggcaccctcatcacccagaccctgagccaggccaaccccacagccatcacagctgaggagtacttcaaccccaactttgagctgggcaacagagacatgggccggcccatggagctgaccaccaagacccagaagttcaaggccaagctgtggctgtgtgaggagcaccccctgagcctgtgtgagcaggtggcccccatcatcgacctgatggctgtgtccaatgccctgtttgccaagctgcgggacttcatcaccctgcggctgcccccaggcttccctgtgaagattgagatccccatcttccacatcctgaatgcccgcatcacctttggaaacctgaatggctgtgatgagcctgtgcccagcgtgcggggcagccccagcagcgagacccccagccctggcagtgacagcagctctgtgagcagcagcagcagcaccaccagctgccggggctgtgagatcagccctgccctgtttgaggccccccggggctacagcatgatgggcggccagcgggaggccgccaccagagatgatgatgatgacctgctgcagtttgccatccagcagagcctgctggaggccggctctgaatatgaccaggtgaccatctgggaggccctgaccaacagcaagccaggcacccaccccatgtcctatgagggccggcggcaggacagaagtgccccacccaccccccagaggcagcctgcccccccagcctctgtgcccagcccccggcccagcagcggccctggcagcggcggccacgtgttccgctcctatgatgagcagctgcggctggccatggagctgagcgcccaggagcaggaggagaggagaagaagagcccggcaggaggaggaggagctggagcgcatcctgcggctgagcctgacagagcagtag

SEQ ID NO: 35454 - DNA, 915 bp, Artificial Sequence
  Description of Artificial Sequence: Synthetic coding sequence
atggcccagcccggggacccccggcggctgtgccgcctggtgcaggagggccgcctgcgggccctgaaggaggagctgcaggccgccggcggctgccccggccctgctggggacaccctgctgcactgtgccgcccggcacggccacagagatgtgctggcctacctggccgaggcctggggcatggacatcgaggccaccaacagagactacaagaggcccctgcacgaggccgcctccatgggccaccgggactgtgtgcgctacctgctgggcagaggagctgctgtggactgcctgaagaaggctgactggacccccctgatgatggcctgcaccaggaagaacctgggcgtcatccaggagctggtggagcacggggccaaccccctgctgaagaacaaggatggctggaacagcttccacatcgccagccgggagggggaccccctcatcctgcagtacctgctgactgtgtgccctggggcctggaagacagagagcaagatccggaggacccccctgcacacagctgccatgcacggccacctggaggccgtgaaggtgctgctgaagcgctgccagtatgagccagactacagagacaactgtggggtgacagccctgatggatgccatccagtgtggccacattgatgtggcccggctgctgctggatgagcacggggcctgcctgtctgctgaggacagcctgggcgcccaggccctgcacagagctgctgtgacaggccaggatgaggccatccgcttcctggtgtctgagctgggcgtggatgtggatgtgcgggccaccagcacccacctgacagccctgcactatgctgccaagccctgcatctggcctgtgcaggtgtccacctggcctgtgcccagcttcagctgcagccgggactag

SEQ ID NO: 35455 - DNA, 1086 bp, Artificial Sequence
  Description of Artificial Sequence: Synthetic coding sequence
atggcccagcccggggacccccggcggctgtgccgcctggtgcaggagggccgcctgcgggccctgaaggaggagctgcaggccgccggcggctgccccggccctgctggggacaccctgctgcactgtgccgcccggcacggccacagagatgtgctggcctacctggccgaggcctggggcatggacatcgaggccaccaacagagactacaagaggcccctgcacgaggccgcctccatgggccaccgggactgtgtgcgctacctgctgggcagaggagctgctgtggactgcctgaagaaggctgactggacccccctgatgatggcctgcaccaggaagaacctgggcgtcatccaggagctggtggagcacggggccaaccccctgctgaagaacaaggatggctggaacagcttccacatcgccagccgggagggggaccccctcatcctgcagtacctgctgactgtgtgccctggggcctggaagacagagagcaagatccggaggacccccctgcacacagctgccatgcacggccacctggaggccgtgaaggtgctgctgaagcgctgccagtatgagccagactacagagacaactgtggggtgacagccctgatggatgccatccagtgtggccacattgatgtggcccggctgctgctggatgagcacggggcctgcctgtctgctgaggacagcctgggcgcccaggccctgcacagagctgctgtgacaggccaggatgaggccatccgcttcctggtgtctgagctgggcgtggatgtggatgtgcgggccaccagcacccacctgacagccctgcactatgctgccaaggagggccacaccagcaccatccagaccctgctgagcctgggcgctgacatcaacagcaaggatgagaagaacagaagtgccctgcacctggcctgtgccggccagcacctggcctgtgccaagttcctgctgcagagcggcctgaaggacagcgaggacatcaccggcaccctggcccagcagctgcccaggagagcagatgtgctgcagggcagcggccacagcgccatgacctag

SEQ ID NO: 35456 - DNA, 1086 bp, Artificial Sequence; identical to SEQ ID NO: 35455
  Description of Artificial Sequence: Synthetic coding sequence

SEQ ID NO: 35457 - DNA, 618 bp, Artificial Sequence
  Description of Artificial Sequence: Synthetic coding sequence
atgaagacagcctatgaggaggtgaccacagagctggaggagttcaaggaggcctttgctggagctgtgaaggccaacaacagcatgagcaagaagctgatgaagagtgacaagaagattgctgtgatcagcaccaagctgttcacagagaagcagaggatgaagtacttcctgagcaccctgcccaccaggcctgagcctgagctgccctgtgtggagaacctgaacagcattgagctgaacaggaagtacatccccaagacagccatccgcatccccaccagcaacccccagaccagcaacaactgcaagaacttcctgacagagatggagctggacagagtggagcagatcatcaccggcaccaagaagagctttgccatgctgagcacctgcagccggctgctgagctttgtggagagcacagcccccaggaagcaccggcgggccctgcccatcatgaggagcctggtgcccaacagaaggaccaccgtggccagcacagagagcaggaccaacagacctggaggagtgcgcagccctggcctgcagctggagggcaccagcaccctgcagtgggagcagggccccatcgcccaccccaggcaccgctgctag

SEQ ID NO: 35458 - DNA, 654 bp, Artificial Sequence
  Description of Artificial Sequence: Synthetic coding sequence
atgaagacagcctatgaggaggtgaccacagagctggaggagttcaaggaggcctttgctggagctgtgaaggccaacaacagcatgagcaagaagctgatgaagagtgacaagaagattgctgtgatcagcaccaagctgttcacagagaagcagaggatgaagtacttcctgagcaccctgcccaccaggcctgagcctgagctgccctgtgtggagaacctgaacagcattgagctgaacaggaagtacatccccaagacagccatccgcatccccaccagcaacccccagaccagcaacaactgcaagaacttcctgacagagatggagctggacagagtggagcagatcatcaccggcaccaagaagagctttgccatgctgagcacctgcagccggctgctgagctttgtggagagcacagcccccaggaagcaccggcgggccctgcccatcatgaggagcctggtgcccaacagaaggaccaccgtggccagcacagagatgagccagctgctgtacaagggcgtgcccttccagagcaggaccaacagacctggaggagtgcgcagccctggcctgcagctggagggcaccagcaccctgcagtgggagcagggccccatcgcccaccccaggcaccgctgctag

SEQ ID NO: 35459 - DNA, 2979 bp, Artificial Sequence
  Description of Artificial Sequence: Synthetic coding sequence
atgaggaagctgttctcctttggaagaaggctgggccaggccctgctgagctccatggaccaggagtatgccggccctggctatgacatccgggactgggagctgaggaagatccacagagctgccatcaagggagatgctgctgaggtggagcgctgcctgacccggcgcttccgggacctggatgcccgggacaggaaggacagaacagtgctgcacctggcctgtgcccacggccgggtgcaggtggtgaccctgctgctgcaccggcgctgccagattgacatctgtgaccggctgaacagaacacccctgatgaaggctgtgcacagccaggaggaggcctgtgccatcgtgctgctggagtgtggggccaaccccaacatcgaggacatctacggcaacacagccctgcactatgctgtgtacaacaagggcaccagcctggccgagcggctgctgagccaccacgccaacatcgaggccctgaacaaggagggcaacacccccctgctgtttgccatcaacagccggcggcagcacatggtggagttcctgctgaagaaccaggccaacatccatgctgtggacaacttcaagaggacagccctgatcctggccgtgcagcacaacctgagcagcatcgtgaccctgctgctgcagcagaacatccgcatcagcagccaggacatgtttggccagacagcagaagattatgccctgtgcagcgacctgcggagcatccggcagcagatcctggagcacaagaacaagatgctgaagaaccacctgagaaatgacaaccaggagacagctgccatgaagccagccaacctgaagaagaggaaggagcgggccaaggccgagcacaacctgaaggtggccagcgaggagaagcaggagcggctgcagaggtctgagaacaagcagccccaggacagccagagctatggcaagaagaaggatgccatgtatggcaacttcatgctgaagaaggacatcgccatgctgaaggaggagctgtatgccatcaagaatgacagcctgaggaaggagaagaagtacatccaggagatcaagagcatcacagagatcaatgccaactttgagaagtctgtgcggctgaatgagaagatgatcaccaagacagtggcccgctacagccagcagctgaatgacctgaaggcagaaaatgcccggctgaacagcgagctggagaaggagaagcacaacaaggagcggctggaggccgaggtggagagcctgcacagcagcctggccacagccatcaatgagtacaatgagatcgtggagaggaaggacctggagctggtgctgtggagggcagatgatgtgtccagacatgagaagatgggcagcaacatcagccagctgacagacaagaatgagctgctgacagagcaggtgcacaaggcccgggtgaagttcaacaccctgaagggcaagctgcgggagaccagagatgccctgcgggagaagaccctggccctgggctctgtgcagctggacctgcggcaggcccagcaccgcatcaaggagatgaagcagatgcaccccaatggagaggccaaggagagccagagcatcggcaagcagaacagcctggaggagcgcatccggcagcaggagctggagaacctgctgctggagcggcagctggaggatgccaggaaggagggggacaacaaggagatcgtcatcaacatccaccgggactgcctggagaatggcaaggaggacctgctggaggagaggaacaaggagctgatgaaggagtacaactacctgaaggagaagctgctgcagtgtgagaaggagaaggccgagcgggaggtgattgtgcgggagttccaggaggagctggtggaccacctgaagaccttcagcatcagcgagagccccctggagggcaccagccactgccacatcaacctgaatgagacctggaccagcaagaagaagctgttccaggtggagatccagcctgaggagaagcatgaggagttcaggaagctgtttgagctgatcagcctgctgaactacacagctgaccagatcaggaagaagaaccgggagctggaggaggaggccaccggctacaagaagtgcctggagatgaccatcaacatgctgaatgcctttgccaatgaagacttcagctgccacggggacctgaacacagaccagctgaagatggacatcctcttcaagaagctgaagcagaagttcaatgacctggtggccgagaaggaggccgtgtccagtgaatgtgtgaacctggccaaggacaatgaggtgctgcaccaggagctgctgtccatgagaaatgtgcaggagaagtgtgagaagctggagaaggacaagaagatgctggaggaggaggtgctgaacctgaagacccacatggagaaggacatggtggagctgggcaagctgcaggagtacaagtctgagctggatgaaagagctgtgcaggagattgagaagctggaggagatccacctgcagaagcaggccgagtatgagaagcagctggagcagctgaacaaggacaacacagccagcctgaagaagaaggagctgaccctgaaggatgtggagtgcaagttcagcaagatgaagacagcctatgaggaggtgaccacagagctggaggagttcaaggaggcctttgctggagctgtgaaggccaacaacagcatgagcaagaagctgatgaagagtgacaagaagattgctgtgatcagcaccaagctgttcacagagaagcagaggatgaagtacttcctgagcaccctgcccaccaggcctgagcctgagctgccctgtgtggagaacctgaacagcattgagctgaacaggaagtacatccccaagacagccatccgcatccccaccagcaacccccagaccagcaacaactgcaagaacttcctgacagaggtgctgctgtgctag

SEQ ID NO: 35460 - DNA, 3036 bp, Artificial Sequence
  Description of Artificial Sequence: Synthetic coding sequence
atgaggaagctgctgagctttggaagaaggctgggccaggccctgctgagctccatggaccaggagtatgccggccggggctaccacatccgggactgggagctgaggaagatccacagagctgccatcaagggagatgctgctgaggtggagcactgcctgacccggcgcttccgggacctggatgtgcgggacaggaaggacagaacagtgctgcacctggcctgtgcccacggccgggtgcaggtggtgaccctgctgctggacaggaagtgccagatcaacatctgtgaccggctgaacagaacacccctgatgaaggctgtgcactgccaggaggaggcctgtgccatcatcctgctgaagagaggagccaaccccaacatcaaggacatctacggcaacacagccctgcactatgctgtgtacaatgaaggcaccagcctggccgagcggctgctgagccaccacgccaacatcgaggccctgaacaaggagggcaacacccccctgctgtttgccatcaacagccggcggcagcacatggtggagttcctgctgaagaaccaggccaacatccatgctgtggacaacttcaagaggacagccctgatcctggccgtgcagcacaacctgagcagcatcgtgaccctgctgctgcagcagaacatccacatcagcagccaggacatgtttggccagacagcagaagattatgccttctgctgtgacctgcggagcatccagcagcagatcctggagcacaagaacaagatgctgaagaaccacctgagaaatgacaaccaggagacagctgccatgaagccagagaacctgaagaagaggaagaagaggaagaagctgaagaagaggaaggagggcgccaaggccgagcacaacctgaaggtggccagcgaggagaagcaggagcggctggagaggtctgagaacaagcagccccaggacagccagagctatggcaagaagaaggatgagatgtttggaaacttcatgctgaagagggacatcgccatgctgaaggaggagctgtatgccatcaagaatgacagcctgaggaaggagaagaagtacatccaggagatcaagagcatcacagagatcaatgccaactttgagaagtctgtgcggctgaatgaggagatgatcaccaagaaggtggcccagtacagccagcagctgaatgacctgaaggccgagaatgcccggctgaacagcaagctggagaaggagaagcacaacaaggagcggctggaggccgaggtggagagcctgcacagcaacctggccacagccatcaatgagtacaatgagatcctggagaggaaggacctggagctggtgctgtggagggcagatgatgtgtccagacatgagaccatgggcagcaacatcagccagctgacagacaagaatgagctgctgacagagcaggtgcacaaggcccgggtgaagttcaacaccctgaagggcaagctgcgggagaccagagatgccctgcgggagaagaccctggccctggagagcgtgcagctggacctgaagcaggcccagcaccgcatcaaggagatgaagcagatgcaccccaacggggaggccaaggagagccagagcatcggcaagcagaacagcagcgaggagcgcatccggcagcgggagctggagaacctgctgctggagcggcagctggaggatgccaggaaggagggggacaacaaggagatcgtcatcaacatccaccgggactgcctggagaatggcaaggaggacctgctggaggagaggaacaaggagctgatgaatgagtacaactacctgaaggagaagctgctgcagtatgagaaggagaaggccgagcgggaggtgattgtgcgggagttccaggaggagctggtggaccacctgaagaagttctccatgtctgagagccccctggagggcaccagccactgccacatcaacctggatgagacctggaccagcaagaagaagctgttccaggtggagatccagcctgaggagaagcatgaggagttcaggaaggtgtttgagctgatcagcctgctgaactacacagctgaccagatcaggaagaagaaccgggagctggaggaggaggccaccggctacaagaagtgcctggagatgaccatcaacatgctgaatgcctttgccaatgaagacttcagctgccacggggacctgaacacagaccagctgaagatggacatcctcttcaagaagctgaagcagaagtttgatgacctgatggccgagaaggaggccgtgagcagcaaatgtgtgaacctggccaaggacaatgaggtgctgcaccaggagctgctgtccatgggcaaggtgcaggagaagtgtgagaagctggagaaggacaagaagatgctggaggagaaggtgctgaacctgaagacccacatggagaaggacatggtggagctgggcaaggtgcaggagtacaagtctgagctggatgagcgggccatgcaggccatcgagaagctggaggagatccacctgcagaagcaggccgagtatgagaagcagctggagcagctgaacaaggacaacacagccagcctgaagaagaaggagctgaccctgaaggatgtggagtgcaagttcagcaagatgaagacagcctatgaagatgtgaccacagagctggaggagtacaaggaggcctttgctgtggccctgaaggccaacagctccatgtctgagaagatcaccaagagtgacaagaagattgctgtgatcagcaccaagctgttcatggagaaggagaggatggagtacttcctgagcaccctgcccatgaggccagaccctgagctgccctgtgtggagaacctgaacagcattgagctgaacaggaagtacatccccaagatggccatccgcatccccaccagcaacccccagaccagcaacaactgcaagaacagcctgacagagctgctgctgcgctgggccctggcccccatctacttcctgctgtag

SEQ ID NO: 35461 - DNA, 1206 bp, Artificial Sequence
  Description of Artificial Sequence: Synthetic coding sequence
gagaaggagaaggccgagcgggaggtgattgtgcgggagttccaggaggagctggtggaccacctgaagaagttctccatgtctgagagccccctggagggcaccagccactgccacatcaacctggatgagacctggaccagcaagaagaagctgttccaggtggagatccagcctgaggagaagcatgaggagttcaggaaggtgtttgagctgatcagcctgctgaactacacagctgaccagatcaggaagaagaaccgggagctggaggaggaggccaccggctacaagaagtgcctggagatgaccatcaacatgctgaatgcctttgccaatgaagacttcagctgccacggggacctgaacacagaccagctgaagatggacatcctcttcaagaagctgaagcagaagtttgatgacctgatggccgagaaggaggccgtgagcagcaaatgtgtgaacctggccaaggacaatgaggtgctgcaccaggagctgctgtccatgggcaaggtgcaggagaagtgtgagaagctggagaaggacaagaagatgctggaggagaaggtgctgaacctgaagacccacatggagaaggacatggtggagctgggcaaggtgcaggagtacaagtctgagctggatgagcgggccatgcaggccatcgagaagctggaggagatccacctgcagaagcaggccgagtatgagaagcagctggagcagctgaacaaggacaacacagccagcctgaagaagaaggagctgaccctgaaggatgtggagtgcaagttcagcaagatgaagacagcctatgaagatgtgaccacagagctggaggagtacaaggaggcctttgctgtggccctgaaggccaacagctccatgtctgagaagatcaccaagagtgacaagaagattgctgtgatcagcaccaagctgttcatggagaaggagaggatggagtacttcctgagcaccctgcccatgaggccagaccctgagctgccctgtgtggagaacctgaacagcattgagctgaacaggaagtacatccccaagatggccatccgcatccccaccagcaacccccagaccagcaacaactgcaagaacagcctgacagagatggagctggactgtgccgagcagatcatcacagagaccaagaagtccatgctgcccaagtgcatcaactag

SEQ ID NO: 35462 - DNA, 2472 bp, Artificial Sequence
  Description of Artificial Sequence: Synthetic coding sequence
atgaagctgtttggcttcggcagcagaagaggccagacagcccagggcagcattgaccacgtgtacacaggcagcggctaccgcatccgggacagcgagctgcagaagatccacagagctgctgtgaagggagatgctgctgaggtggagcgctgcctggccaggagaagtggggacctggatgccctggacaagcagcacaggacagccctgcacctggcctgtgccagcggccacgtgcaggtggtgaccctgctggtgaacaggaagtgccagattgatgtgtgtgacaaggaaaatagaacacccctcatccaggccgtgcactgccaggaggaggcctgtgccgtcatcctgctggagcacggggccaaccccaacctgaaggacatctacggcaacacagccctgcactatgctgtgtacagcgagagcaccagcctggccgagaagctgctgagccatggagcccacatcgaggccctggacaaggacaacaacacccccctgctgtttgccatcatctgcaagaaggagaagatggtggagttcctgctgaagaggaaggccagcagccatgctgtggaccggctgcggcgcagcgccctgatgctggccgtgtactatgacagccctggcatcgtgaacatcctgctgaagcagaacattgatgtgtttgcccaggacatgtgtggcagagatgctgaggactatgccatcagccaccacctgaccaagatccagcagcagatcctggagcacaagaagaagatcctgaagaaggagaagagtgatgtgggcagcagtgatgagagcgctgtgtccatcttccacgagctgcgggtggacagcctgcctgccagtgatgacaaggacctgaatgtggccaccaagcagtgtgtgcctgagaaggtgtctgagcccctgcccggcagcagccatgagaagggcaaccgcatcgtgaatggccagggcgagggccccccagccaagcaccccagcctgaagcccagcacagaggtggaggaccctgctgtgaagggagctgtgcagaggaagaatgtgcagaccctgcgggcagagcaggccctgcctgtggccagcgaggaggagcaggagagacatgagaggtctgagaagaagcagccccaggtgaaggagggcaacaacaccaacaagtctgagaagatccagctgtctgagaacatctgtgacagcaccagcagcgctgctgctggccgcctgacccagcagaggaagattggcaagacctacccccagcagttccccaagaagctgaaggaggagcatgaccgctgcaccctgaagcaggagaatgaggagaagaccaacgtgaacatgctgtacaagaagaaccgggaggagctggagaggaaggagaagcagtacaagaaggaggtggaggccaagcagctggagcccaccgtgcagagcctggagatgaagagcaagacagccaggaacacccccaacagagacttccacaaccacgaggagatgaagggcctgatggatgagaactgcatcctgaaggctgacatcgccatcctgcggcaggagatctgcaccatgaagaatgacaacctggagaaggagaacaagtacctgaaggacatcaagatcgtgaaggagaccaatgctgccctggagaagtacatcaagctgaatgaggagatgatcacagaaacagccttccgctaccagcaggagctgaatgacctgaaggccgagaacacccggctgaatgctgagctgctgaaggagaaggagagcaagaagaggctggaggccgacatcgagagctaccagagccggctggccgccgccatcagcaagcacagcgagagcgtgaagacagagaggaacctgaagctggccctggagaggaccagagatgtgtctgtgcaggtggagatgagcagcgccatcagcaaggtgaaggatgaaaatgagttcctgacagagcagctgtctgagacccagatcaagttcaatgccctgaaggacaagttcaggaagacccgggacagcctgaggaagaagagcctggccctggagaccgtgcagaatgacctgagccagacccagcagcagacccaggagatgaaggagatgtaccagaatgctgaggccaaggtgaacaacagcacaggcaagtggaactgtgtggaggagcgcatctgccacctgcagcgggagaatgcctggctggtgcagcagctggatgatgtgcaccagaaggaggaccacaaggagatcgtgaccaacatccagaggggcttcattgaaagtggcaagaaggacctggtgctggaggagaagagcaagaagctgatgaatgaatgtgaccacctgaaggagagcctcttccagtatgagcgggagaagacagagggcgtggtgtccatcaaggaggacaagtacttccagaccagcaggaagaagatctag

SEQ ID NO: 35463 - DNA, 2472 bp, Artificial Sequence
  Description of Artificial Sequence: Synthetic coding sequence
atgaagctgtttggcttcggcagcagaagaggccagacagcccagggcagcattgaccacgtgtacacaggcagcggctaccgcatccgggacagcgagctgcagaagatccacagagctgctgtgaagggagatgctgctgaggtggagcgctgcctggccaggagaagtggggacctggatgccctggacaagcagcacaggacagccctgcacctggcctgtgccagcggccacgtgcaggtggtgaccctgctggtgaacaggaagtgccagattgatgtgtgtgacaaggaaaatagaacacccctcatccaggccgtgcactgccaggaggaggcctgtgccgtcatcctgctggagcacggggccaaccccaacctgaaggacatctacggcaacacagccctgcactatgctgtgtacagcgagagcaccagcctggccgagaagctgctgagccatggagcccacatcgaggccctggacaaggacaacaacacccccctgctgtttgccatcatctgcaagaaggagaagatggtggagttcctgctgaagaggaaggccagcagccatgctgtggaccggctgcggcgcagcgccctgatgctggccgtgtactatgacagccctggcatcgtgaacatcctgctgaagcagaacattgatgtgtttgcccaggacatgtgtggcagagatgctgaggactatgccatcagccaccacctgaccaagatccagcagcagatcctggagcacaagaagaagatcctgaagaaggagaagagtgatgtgggcagcagtgatgagagcgctgtgtccatcttccacgagctgcgggtggacagcctgcctgccagtgatgacaaggacctgaatgtggccaccaagcagtgtgtgcctgagaaggtgtctgagcccctgcccggcagcagccatgagaagggcaaccgcatcgtgaatggccagggcgagggccccccagccaagcaccccagcctgaagcccagcacagaggtggaggaccctgctgtgaagggagctgtgcagaggaagaatgtgcagaccctgcgggcagagcaggccctgcctgtggccagcgaggaggagcaggagagacatgagaggtctgagaagaagcagccccaggtgaaggagggcaacaacaccaacaagtctgagaagatccagctgtctgagaacatctgtgacagcaccagcagcgctgctgctggccgcctgacccagcagaggaagattggcaagacctacccccagcagttccccaagaagctgaaggaggagcatgaccgctgcaccctgaagcaggagaatgaggagaagaccaacgtgaacatgctgtacaagaagaaccgggaggagctggagaggaaggagaagcagtacaagaaggaggtggaggccaagcagctggagcccaccgtgcagagcctggagatgaagagcaagacagccaggaacacccccaacagagacttccacaaccacgaggagatgaagggcctgatggatgagaactgcatcctgaaggctgacatcgccatcctgcggcaggagatctgcaccatgaagaatgacaacctggagaaggagaacaagtacctgaaggacatcaagatcgtgaaggagaccaatgctgccctggagaagtacatcaagctgaatgaggagatgatcacagaaacagccttccgctaccagcaggagctgaactacctgaaggccgagaacacccggctgaatgctgagctgctgaaggagaaggagagcaagaagaggctggaggccgacatcgagagctaccagagccggctggccgccgccatcagcaagcacagcgagagcgtgaagacagagaggaacctgaagctggccctggagaggaccagagatgtgtctgtgcaggtggagatgagcagcgccatcagcaaggtgaaggatgaaaatgagttcctgacagagcagctgtctgagacccagatcaagttcaatgccctgaaggacaagttcaggaagacccgggacagcctgaggaagaagagcctggccctggagaccgtgcagaatgacctgagccagacccagcagcagacccaggagatgaaggagatgtaccagaatgctgaggccaaggtgaacaacagcacaggcaagtggaactgtgtggaggagcgcatctgccacctgcagcgggagaatgcctggctggtgcagcagctggatgatgtgcaccagaaggaggaccacaaggagatcgtgaccaacatccagaggggcttcattgaaagtggcaagaaggacctggtgctggaggagaagagcaagaagctgatgaatgaatgtgaccacctgaaggagagcctcttccagtatgagcgggagaagacagagggcgtggtgtccatcaaggaggacaagtacttccagaccagcaggaagaccatctag

SEQ ID NO: 35464 - DNA, 2472 bp, Artificial Sequence
  Description of Artificial Sequence: Synthetic coding sequence
atgaagctgtttggcttcggcagcagaagaggccagacagcccagggcagcattgaccacgtgtacacaggcagcggctaccgcatccgggacagcgagctgcagaagatccacagagctgctgtgaagggagatgctgctgaggtggagcgctgcctggccaggagaagtggagagctggatgccctggacaagcagcacaggacagccctgcacctggcctgtgccagcggccacgtgcaggtggtgaccctgctggtgaacaggaagtgccagattgatgtgtgtgacaaggaaaatagaacacccctcatccaggccgtgcactgccaggaggaggcctgtgccgtcatcctgctggagcacggggccaaccccaacctgaaggacatctacggcaacacagccctgcactatgctgtgtacagcgagagcaccagcctggccgagaagctgctgagccatggagcccacatcgaggccctggacaaggacaacaacacccccctgctgtttgccatcatctgcaagaaggagaagatggtggagttcctgctgaagaagaaggccagcagccatgctgtggaccggctgcggcgcagcgccctgatgctggccgtgtactatgacagccctggcatcgtgaacatcctgctgaagcagaacattgatgtgtttgcccaggacatgtgtggcagagatgctgaggactatgccatcagccaccacctgaccaagatccagcagcagatcctggagcacaagaagaagatcctgaagaaggagaagagtgatgtgggcagcagtgatgagagcgctgtgtccatcttccacgagctgcgggtggacagcctgcctgccagtgatgacaaggacctgaatgtggccaccaagcagtgtgtgcctgagaaggtgtctgagcccctgcccggcagcagccatgagaagggcaaccgcatcgtgaatggccagggcgagggccccccagccaagcaccccagcctgaagcccagcacagaggtggaggaccctgctgtgaagggagctgtgcagaggaagaatgtgcagaccctgcgggcagagcaggccctgcctgtggccagcgaggaggagcagcagagacatgagaggtctgagaagaagcagccccaggtgaaggagggcaacaacaccaacaagtctgagaagatccagctgtctgagaacatctgtgacagcaccagcagcgctgctgctggccgcctgacccagcagaggaagattggcaagacctacccccagcagttccccaagaagctgaaggaggagcatgaccgctgcaccctgaagcaggagaatgaggagaagaccaacgtgaacatgctgtacaagaagaaccgggaggagctggagaggaaggagaagcagtacaagaaggaggtggaggccaagcagctggagcccaccgtgcagagcctggagatgaagagcaagacagccaggaacacccccaactgggacttccacaaccacgaggagatgaagggcctgatggatgagaactgcatcctgaaggctgacatcgccatcctgcggcaggagatctgcaccatgaagaatgacaacctggagaaggagaacaagtacctgaaggacatcaagatcgtgaaggagaccaatgctgccctggagaagtacatcaagctgaatgaggagatgatcacagaaacagccttccgctaccagcaggagctgaatgacctgaaggccgagaacacccggctgaatgctgagctgctgaaggagaaggagagcaagaagaggctggaggccgacatcgagagctaccagagccggctggccgccgccatcagcaagcacagcgagagcgtgaagacagagaggaacctgaagctggccctggagaggacccaggatgtgtctgtgcaggtggagatgagcagcgccatcagcaaggtgaaggatgaaaatgagttcctgacagagcagctgtctgagacccagatcaagttcaatgccctgaaggacaagttcaggaagacccgggacagcctgaggaagaagagcctggccctggagaccgtgcagaacaacctgagccagacccagcagcagacccaggagatgaaggagatgtaccagaatgctgaggccaaggtgaacaacagcacaggcaagtggaactgtgtggaggagcgcatctgccacctgcagcgggagaatgcctggctggtgcagcagctggatgatgtgcaccagaaggaggaccacaaggagatcgtgaccaacatccagaggggcttcattgaaagtggcaagaaggactttgtgctggaggagaagagcaagaagctgatgaatgaatgtgaccacctgaaggagagcctcttccagtatgagcgggagaagacagaggtggtggtgtccatcaaggaggacaagtacttccagaccagcaggaagaagatctag

SEQ ID NO: 35465 - DNA, 576 bp, Artificial Sequence
  Description of Artificial Sequence: Synthetic coding sequence
atgggcatcctgtacagcgagcccatctgccaggccgcctaccagaatgactttggccaggtgtggcgctgggtgaaggaggacagcagctatgccaacgtgcaggacggcttcaatggagacacccccctcatctgtgcctgcagaagaggccacgtgagaattgtgtccttcctgctgcggagaaatgccaacgtgaacctgaagaaccagaaggagaggacctgcctgcactatgctgtgaagaagaagttcaccttcatcgactacctgctgatcatcctgctgatgcctgtgctgctgattggctacttcctgatggtgtccaagaccaagcagaatgaggccctggtgaggatgctgctggatgctggggtggaggtgaatgccacagactgctacggctgcacagccctgcactacgcctgtgagatgaagaaccagagcctcatccccctgctgctggaggcccgggctgaccccaccatcaagaacaagcatggagagagcagcctggacatcgcccggcggctgaagttcagccagatcgagctgatgctgaggaaggccctgtag

SEQ ID NO: 35466 - DNA, 3711 bp, Artificial Sequence
  Description of Artificial Sequence: Synthetic coding sequence
atgcagcctgctgcctgtgccggggagggcgccggccccccagccccccggcccccccaccccccaggggacaaggtgagaagaggccggggcggggcccccagcctgagcccccagcccccagccccctacctgggcctgcccatccccagcagaggaggcggcggctggaggggcggccagggcggcggcggcggcacccgggagggcggcaccggccgggccggcggggccggcagcagcggcagcgcccagccccggcccccagctgccccccggggccccagccggcccagcggccgccgcctgctgctggagccccgggcccccccagccccccgggccccagatgccatgaagcagctgtgcctgtgtgccgccgccagctttgccagccaggactggggcaagagtgatgagcggctgctgcaggccgtggagaacaatgatgccccccgggtggccgccctgattgccaggaagggcctggtgcccaccaagctggaccctgagggcaagagcgccttccacctggccgccatgagaggagctgccagctgcctggaggtgatgattgcccacggcagcaatgtgatgtctgcagatggagctggctacaatgccctgcacctggccgccaagtatggccacccccagtgcctgaagcagctgctgcaggccagctgtgtggtggatgtggtggacagcagcggctggacagccctgcaccacgccgctgctgggggctgcctgagctgcagcgaggtgctgtgcagcttcaaggcccacctgaacccccaggacagaagtggggccacccccctcatcatcgccgcccagatgtgccacacagacctgtgccgcctgctgctgcagcagggcgccgccgccaatgaccaggacctgcagggccgcacagccctgatgctggcctgtgagggcgccagccctgagaccgtggaggtgctgctgcagggcggggcccagcccggcatcacagatgccctgggccaggatgctgcccactatggagccctggccggggacaagctgatcctgcacctgctgcaggaggccgcccagaggcccagccccccatctgccctgacagaagatgacagcggggaggccagcagccagaacagcatgagcagccacggcaagcagggcgcccccaagaagaggaaggcccctcctcctccagccagcatccccatgccagatgacagagatgcctatgaggagatcgtgcggctgcggcaggagcggggccgcctgctgcagaagatccggggcctggagcagcacaaggagcggcggcagcaggagagccctgaggccagcagcctgcacatcctggagcggcaggtgcaggagctgcagcagctgctggtggagcggcaggaggagaaggagagcctgggccgggaggtggagagcctgcagagccggctgagcctgctggagaatgaaagagagaacaccagctatgatgtgaccaccctgcaggatgaggagggggagctgcctgacctgcctggagctgaggtgctgctgagccggcagctgagccccagcgcccaggagcacctggccagcctgcaggagcaggtggccgtgctgacccggcagaaccaggagctgatggagaaggtgcagatcctggagaactttgagaaggatgagacccagatggaggtggaggccctggccgaggtgatccccctggccctgtatgacagcctgcgggcagagtttgaccagctgcggcggcagcacgccgaggccctgcaggccctgcggcagcaggagacccgggaggtgccccgggaggagggcgccgcctgtggggagagcgaggtggccggggccacagccaccaagaatggccccacccacatggagctgaatggatctgtggcccctgagaccaaggtgaatggagctgagaccattgatgaggaggccgctggagatgagaccatggaggcccggaccatggaggccgaggccaccggggctgaggccactggagctgaggccaccggggccaaggtgacagagaccaagcccaccggggctgaggtgcgggagatggagaccacagaggaggaggccaacatggagaccaagcccactggagcccaggccacagacacagagaccactggagtggaggccatgggcgtggaggccaccaagaccaaggccgaggaggccgagatgcaggcctatggagtgggcgccggccaggccgagccccctgtgacaggcaccaccaacatggaggccaccggcagccgggccaccggcatggagagcactggagtgtctgccaccggggtggagaaccctggggtggaggccaccgtgcccggcatctctgctggccccatcctgcaccctggagctgctgaggccagcgagaagctgcaggtggagctggagacccgcatccggggcctggaggaggccctgcggcagcgggagcgggaggccgctgctgagctggaggccgccctgggcaaatgtgaggccgctgaggccgaggccggccgcctgcgggagcgggtgcgggaggccgagggcagcggggccagcggcggcggcggcggggacaccacccagctgcgggccgccctggagcaggcccgggaggacctgcgggaccgggacagccggctgcgggagctggaggccgccagcgcctgcctggatgaggcccgggccagccggctgctggccgaggaggaggcccggggcctgcgggcagagctggcccagcgggaggaggcccggctggagcagagccgggagctggaggtgctgcgggagcagctggccacagcccgggccactggagagcagcagaggacagctgctgctgagctgggccgggccagagatgctgctgaggcccgggtggccgagctgcctgctgcctgtgaggaggcccggcagggcctggccgagctgcgggaggccagcgaggccctgcggcagagcgtggtgcctgccagcgagcaccggcggctgcaggaggaggccctggagctgcggggccgggccgccagcctggagcaggaggtggtggccaccgggaaggaggccgcccggctgcgggcagagctggagcgggagcgggtgtgcagcgtggccctgtctgaacatgagcgcatcgtgggcaccctgcaggccaacgtggcccagctggagggccagctggaggagctgggcagaagacatgagaagaccagcgctgaggtgttccaggtgcagcgggaggccctcttcatgaagtcagaaagacatgctgctgaggcccagctggccacagctgagcagcagctgcggggcctgaggacagaggccgagcgggcccggcaggcccagagccgggcccaggaggccctggacaaggccaaggagaaggacaagaagatcacagagctgagcaaggaggtgttcaacctgaaggaggccctgaaggagcagcctgctgccctggccaccccagaggtggaggccctgcgggaccaggtgaaggacctgcagcagcagctgcaggaggccgcccgggaccacagctctgtggtggccctgtaccgcagccacctgctgtatgccatccagggccagatggatgaagatgtgcagaggatcctgagccagatcctgcagatgcagaggctgcaggcccagggccgctag

SEQ ID NO: 35467 - DNA, 3441 bp, Artificial Sequence
  Description of Artificial Sequence: Synthetic coding sequence
atgaagaccctgcgggcccgcttcaagaagacagagctgcggctgagccccacagacctgggcagctgccccccctgtggcccctgccccatccccaagccagctgcccggggccggcggcagagccaggactggggcaagagtgatgagcggctgctgcaggccgtggagaacaatgatgccccccgggtggccgccctgattgccaggaagggcctggtgcccaccaagctggaccctgagggcaagagcgccttccacctggccgccatgagaggagctgccagctgcctggaggtgatgattgcccacggcagcaatgtgatgtctgcagatggagctggctacaatgccctgcacctggccgccaagtatggccacccccagtgcctgaagcagctgctgcaggccagctgtgtggtggatgtggtggacagcagcggctggacagccctgcaccacgccgctgctgggggctgcctgagctgcagcgaggtgctgtgcagcttcaaggcccacctgaacccccaggacagaagtggggccacccccctcatcatcgccgcccagatgtgccacacagacctgtgccgcctgctgctgcagcagggcgccgccgccaatgaccaggacctgcagggccgcacagccctgatgctggcctgtgagggcgccagccctgagaccgtggaggtgctgctgcagggcggggcccagcccggcatcacagatgccctgggccaggatgctgcccactatggagccctggccggggacaagctgatcctgcacctgctgcaggaggccgcccagaggcccagccccccatctgccctgacagaagatgacagcggggaggccagcagccagaacagcatgagcagccacggcaagcagggcgcccccaagaagaggaaggcccctcctcctccagccagcatccccatgccagatgacagagatgcctatgaggagatcgtgcggctgcggcaggagcggggccgcctgctgcagaagatccggggcctggagcagcacaaggagcggcggcagcaggagagccctgaggccagcagcctgcacatcctggagcggcaggtgcaggagctgcagcagctgctggtggagcggcaggaggagaaggagagcctgggccgggaggtggagagcctgcagagccggctgagcctgctggagaatgaaagagagaacaccagctatgatgtgaccaccctgcaggatgaggagggggagctgcctgacctgcctggagctgaggtgctgctgagccggcagctgagccccagcgcccaggagcacctggccagcctgcaggagcaggtggccgtgctgacccggcagaaccaggagctgatggagaaggtgcagatcctggagaactttgagaaggatgagacccagatggaggtggaggccctggccgaggtgatccccctggccctgtatgacagcctgcgggcagagtttgaccagctgcggcggcagcacgccgaggccctgcaggccctgcggcagcaggagacccgggaggtgccccgggaggagggcgccgcctgtggggagagcgaggtggccggggccacagccaccaagaatggccccacccacatggagctgaatggatctgtggcccctgagaccaaggtgaatggagctgagaccattgatgaggaggccgctggagatgagaccatggaggcccggaccatggaggccgaggccaccggggctgaggccactggagctgaggccaccggggccaaggtgacagagaccaagcccaccggggctgaggtgcgggagatggagaccacagaggaggaggccaacatggagaccaagcccactggagcccaggccacagacacagagaccactggagtggaggccatgggcgtggaggccaccaagaccaaggccgaggaggccgagatgcaggcctatggagtgggcgccggccaggccgagccccctgtgacaggcaccaccaacatggaggccaccggcagccgggccaccggcatggagagcactggagtgtctgccaccggggtggagaaccctggggtggaggccaccgtgcccggcatctctgctggccccatcctgcaccctggagctgctgaggccagcgagaagctgcaggtggagctggagacccgcatccggggcctggaggaggccctgcggcagcgggagcgggaggccgctgctgagctggaggccgccctgggcaaatgtgaggccgctgaggccgaggccggccgcctgcgggagcgggtgcgggaggccgagggcagcggggccagcggcggcggcggcggggacaccacccagctgcgggccgccctggagcaggcccgggaggacctgcgggaccgggacagccggctgcgggagctggaggccgccagcgcctgcctggatgaggcccgggccagccggctgctggccgaggaggaggcccggggcctgcgggcagagctggcccagcgggaggaggcccggctggagcagagccgggagctggaggtgctgcgggagcagctggccacagcccgggccactggagagcagcagaggacagctgctgctgagctgggccgggccagagatgctgctgaggcccgggtggccgagctgcctgctgcctgtgaggaggcccggcagggcctggccgagctgcgggaggccagcgaggccctgcggcagagcgtggtgcctgccagcgagcaccggcggctgcaggaggaggccctggagctgcggggccgggccgccagcctggagcaggaggtggtggccaccgggaaggaggccgcccggctgcgggcagagctggagcgggagcgggtgtgcagcgtggccctgtctgaacatgagcgcatcgtgggcaccctgcaggccaacgtggcccagctggagggccagctggaggagctgggcagaagacatgagaagaccagcgctgaggtgttccaggtgcagcgggaggccctcttcatgaagtcagaaagacatgctgctgaggcccagctggccacagctgagcagcagctgcggggcctgaggacagaggccgagcgggcccggcaggcccagagccgggcccaggaggccctggacaaggccaaggagaaggacaagaagatcacagagctgagcaaggaggtgttcaacctgaaggaggccctgaaggagcagcctgctgccctggccaccccagaggtggaggccctgcgggaccaggtgaaggacctgcagcagcagctgcaggaggccgcccgggaccacagctctgtggtggccctgtaccgcagccacctgctgtatgccatccagggccagatggatgaagatgtgcagaggatcctgagccagatcctgcagatgcagaggctgcaggcccagggccgctag

SEQ ID NO: 35468 - DNA, 3441 bp, Artificial Sequence; identical to SEQ ID NO: 35467
  Description of Artificial Sequence: Synthetic coding sequence

SEQ ID NO: 35469 - DNA, 807 bp, Artificial Sequence
  Description of Artificial Sequence: Synthetic coding sequence
atggaggagaacagcttccagaaggagacccccctggccaatgctgccttctgggccgcccggcggggcaacctggccctgctgaagctgctgctgaacagcggccgggtggatgtggactgccgggacagccacggcaccaccctgctgatggtggccgcctatgccggccacatcgactgtgtgcgggagctggtgctgcagggcgctgacatcaacctgcagcgggagagcggcaccacagccctcttctttgctgcccagcagggccacaatgatgtggtgcgcttcctgtttggatttggagccagcacagagttccgcaccaaggatggcggcacagccctgctggccgccagccagtatggccacatgcaggtggtggagaccctgctgaagcacggggccaacatccatgaccagctgtatgatggagccacagccctcttcctggccgcccagggcggctacctggatgtgatccggctgctgctggccagcggggccaaggtgaaccagccccggcaggatggaacagcccccctgtggatcgccagccagatgggccacagcgaggtggtgcgggtgatgctgctgcggggagctgacagagatgctgccagaaatgatggcaccacagccctgctgaaggccgccaacaagggctacaatgatgtgatcaaggagctgctgaagttcagccccaccctgggcatcctgaaggccaatgagctgcctgctgagctgaccaagaatgaaagaatcctgcggctgctgcggagcaaggagggccccaggaagagctag

SEQ ID NO: 35470 - DNA, 906 bp, Artificial Sequence
  Description of Artificial Sequence: Synthetic coding sequence
atgtgcaggatgtccttcaagaaggagacccccctggccaatgctgccttctgggccgcccggcggggcaacctggccctgctgaagctgctgctgaacagcggccgggtggatgtggactgccgggacagccacggcaccaccctgctgatggtggccgcctatgccggccacatcgactgtgtgcgggagctggtgctgcagggcgctgacatcaacctgcagcgggagagcggcaccacagccctcttctttgctgcccagcagggccacaatgatgtggtgcgcttcctgtttggatttggagccagcacagagttccgcaccaaggatggcggcacagccctgctggccgccagccagtatggccacatgcaggtggtggagaccctgctgaagcacggggccaacatccatgaccagctgtatgatggagccacagccctcttcctggccgcccagggcggctacctggatgtgatccggctgctgctggccagcggggccaaggtgaaccagccccggcaggatggaacagcccccctgtggatcgccagccagatgggccacagcgaggtggtgcgggtgatgctgctgcggggagctgacagagatgctgccagaaatgatggcaccacagccctgctgaaggccgccaacaagggctacaatgatgtgatcaaggagctgctgaagttcagccccaccctgggcatcctgaagaatggcaccagcgccctgcatgctgctgtgctgagcggcaacatcaagacagtggccctgctgctggaggccggggctgaccccagcctgaggaacaaggccaatgagctgcctgctgagctgaccaagaatgaaagaatcctgcggctgctgcggagcaaggagggccccaggaagagctag

SEQ ID NO: 35471 - DNA, 906 bp, Artificial Sequence; identical to SEQ ID NO: 35470
  Description of Artificial Sequence: Synthetic coding sequence

SEQ ID NO: 35472 - DNA, 2439 bp, Artificial Sequence
  Description of Artificial Sequence: Synthetic coding sequence
ccctgcaagaccctgctgcagaatgatgtgtgcctgcccaaggccacccaccagaaggagtttgacaccctgagcggcaagctggaggtgtacttctgccccatcggcatgctgaccaacaccaagacccagaagacccccaagcccagcgtcatccccttccagagcaagcatgacttcctgctggagagcccagacaaggatggcctgctgaagcccacctgtggcaggaaggtgtccctgcccaacaaggccctggagctgaaggaccgggagaccctgaaggccgagagcccagacaaggatggcctgctgaagcccacctgtgtgaggaaggtgtccctgcccaacaaggccctggagctgaaggaccgggagaccctgaaggccgcccagatgttccccagcgagagcaagcagaaggatgatgaagaaaattcctgggactttgagagcttcctggaggccctgctgcagaatgatggctgcctgcccaaggccacccaccagaaggagtttgacaccctgagcggcaagctggaggagagcccagacaaggatggcctgctgaagcccacctgtggcatgaagatcagcctgcccaacaaggccctggagctgaaggaccgggagaccttcaaggccgaggatgtgtcctctgtggagagcaccttcagcctgtttgggaagcccaccacagagaacagccagagcaccaaggtggaggaggacttcaacctgaccaccaaggagggcgccaccaagacagtgacaggccagcaggagcgggacatcggcatcatcgagcgggccccccaggaccagaccaacaagatgcccaccagcgagctgggcaggaaggaggacaccaagagcaccagtgacagcgagatcatctctgtgtctgacacccagaactatgagtgcctgcctgaggccacctaccagaaggagatcaagaccaccaacgggaagattgaggagagccctgagaagcccagccactttgagcccgccacagagatgcagaacagcgtgcccaacaagggcctggagtggaagaacaagcagaccctgcgggctgacagcaccaccctgagcaagatcctggatgccctgcccagctgtgagcggggccgggagctgaagaaggacaactgtgagcagatcacagccaagatggagcagaccaagaacaagttctgtgtgctgcagaaggagctgtctgaggccaaggagatcaagagccagctggagaaccagaaggccaagtgggagcaggagctgtgcagcgtgcggctgaccctgaaccaggaggaggagaagagaagaaatgtggacatcctgaaggagaagatccggcctgaggagcagctgaggaagaagctggaggtgaagcagcagctggagcagaccctgcgcatccaggacatcgagctgaagtctgtgaccagcaacctgaaccaggtgagccacacccatgaaagtgaaaatgacctcttccacgagaactgcatgctgaagaaggagatcgccatgctgaagctggaggtggccaccctgaagcaccagcaccaggtgaaggagaacaagtactttgaggacatcaagatcctgcaggagaagaatgctgagctgcagatgaccctgaagctgaagcagaagacagtgaccaagagggccagccagtaccgggagcagctgaaggtgctgacagctgagaacaccatgctgaccagcaagctgaaggagaagcaggacaaggagatcctggagacagaaattgagagccaccacccccggctggccagcgccctgcaggaccatgaccagagcgtgaccagcaggaagaaccaggagctggccttccacagcgctggagatgcccccctgcagggcatcatgaatgtggatgtgagcaacaccatctacaacaatgaggtgctgcaccagcccctgtatgaggcccagaggaagagcaagagccccaagatcaacctgaactatgctggagatgacctgcgggagaatgccctggtgtctgaacatgcccagagggacagatgtgagacccagtgccagatgaagaaggccgagcacatgtaccagaatgagcaggacaacgtggacaagcacacagagcagcaggagagcctggagcagaagctgttccagctggagagcaagaaccgctggctgcggcagcagctggtgtatgcccacaagaaggtgaacaagagcaaggtgaccatcaacatccagtttcctgagatgaagatgcagaggcacctgaatgagaagaatgaggaggtgttcaactacggcaaccacctgaaggagagaattgaccagtatgagaaggagaaggccgagcgggaggtgtccatcaagaagtacaagtacttcagcaacttcctgaaggagagcggcctgggctag

SEQ ID NO: 35473 - DNA, 2361 bp, Artificial Sequence
  Description of Artificial Sequence: Synthetic coding sequence
aatgcctgggacctgaacagcttcctggagaccctgctgcagaatgatgtgtgcctgcccaaggccacccaccagaaggagtttgacaccctgagcggcaagctggaggagagcccagacaaggatggcctgctgaagcccacctgtggcaggaaggtgtccctgcccaacaaggccctggagctgaaggaccgggagaccctgaaggccgagagcccagacaaggatggcctgctgaagcccacctgtgtgaggaaggtgtccctgcccaacaaggccctggagctgaaggaccgggagaccctgaaggccgcccagatgttccccagcgagagcaagcagaaggatgatgaagaaaattcctgggactttgagagcttcctggaggccctgctgcagaatgatggctgcctgcccaaggccacccaccagaaggagtttgacaccctgagcggcaagctggaggagagcccagacaaggatggcctgctgaagcccacctgtggcatgaagatcagcctgcccaacaaggccctggagctgaaggaccgggagaccttcaaggccgaggatgtgtcctctgtggagagcaccttcagcctgtttgggaagcccaccacagagaacagccagagcaccaaggtggaggaggacttcaacctgaccaccaaggagggcgccaccaagacagtgacaggccagcaggagcgggacatcggcatcatcgagcgggccccccaggaccagaccaacaagatgcccaccagcgagctgggcaggaaggaggacaccaagagcaccagtgacagcgagatcatctctgtgtctgacacccagaactatgagtgcctgcctgaggccacctaccagaaggagatcaagaccaccaacgggaagattgaggagagccctgagaagcccagccactttgagcccgccacagagatgcagaacagcgtgcccaacaagggcctggagtggaagaacaagcagaccctgcgggctgacagcaccaccctgagcaagatcctggatgccctgcccagctgtgagcggggccgggagctgaagaaggacaactgtgagcagatcacagccaagatggagcagaccaagaacaagttctgtgtgctgcagaaggagctgtctgaggccaaggagatcaagagccagctggagaaccagaaggccaagtgggagcaggagctgtgcagcgtgcggctgaccctgaaccaggaggaggagaagagaagaaatgtggacatcctgaaggagaagatccggcctgaggagcagctgaggaagaagctggaggtgaagcagcagctggagcagaccctgcgcatccaggacatcgagctgaagtctgtgaccagcaacctgaaccaggtgagccacacccatgaaagtgaaaatgacctcttccacgagaactgcatgctgaagaaggagatcgccatgctgaagctggaggtggccaccctgaagcaccagcaccaggtgaaggagaacaagtactttgaggacatcaagatcctgcaggagaagaatgctgagctgcagatgaccctgaagctgaagcagaagacagtgaccaagagggccagccagtaccgggagcagctgaaggtgctgacagctgagaacaccatgctgaccagcaagctgaaggagaagcaggacaaggagatcctggagacagaaattgagagccaccacccccggctggccagcgccctgcaggaccatgaccagagcgtgaccagcaggaagaaccaggagctggccttccacagcgctggagatgcccccctgcagggcatcatgaatgtggatgtgagcaacaccatctacaacaatgaggtgctgcaccagcccctgtatgaggcccagaggaagagcaagagccccaagatcaacctgaactatgctggagatgacctgcgggagaatgccctggtgtctgaacatgcccagagggacagatgtgagacccagtgccagatgaagaaggccgagcacatgtaccagaatgagcaggacaacgtggacaagcacacagagcagcaggagagcctggagcagaagctgttccagctggagagcaagaaccgctggctgcggcagcagctggtgtatgcccacaagaaggtgaacaagagcaaggtgaccatcaacatccagtttcctgagatgaagatgcagaggcacctgaatgagaagaatgaggaggtgttcaactacggcaaccacctgaaggagagaattgaccagtatgagaaggagaaggccgagcgggaggtgtccatcaagaagtacaagtacttcagcaacttcctgaaggagagcggcctgggctag

SEQ ID NO: 35474 - DNA, 4179 bp, Artificial Sequence
  Description of Artificial Sequence: Synthetic coding sequence
atgaagaggctgctggccgccgccggcaagggcgtgcggggccctgagccccccaaccccttcagcgagcgggtgtacacagagaaggactatggcaccatctactttggagacctgggcaagatccacacagctgccagccggggccaggtgcagaagctggagaagatgacagtgggcaagaagcctgtgaacctgaacaagagggacatgaagaagaggacagccctgcactgggcctgtgtgaatggacatgctgaggtggtgaccttcctggtggacaggaagtgccagctgaatgtgctggatggagagggccgcacccccctgatgaaggccctgcagtgtgagcgggaggcctgtgccaacatcctgattgatgctggagctgacctgaactacgtggatgtgtatggcaacacagccctgcactatgctgtgtacagcgagaacctgctgatggtggccaccctgctgtcctatggagctgtgattgaggtgcagaacaaggccagcctgacccccctgctgctggccatccagaagaggagcaagcagacagtggagttcctgctgaccaagaatgccaatgccaatgccttcaatgaaagcaaatgtacagccctgatgctggccatctgtgagggcagcagcgagatcgtgggcatgctgctgcagcagaatgtggatgtgtttgctgaggacatccacggcatcacagctgagagatatgctgctgcctgtggggtgaactacatccaccagcagctgctggagcacatcaggaagctgcccaagaacccccagaacaccaaccctgagggcaccagcacaggcaccccagatgaggccgcccccctggccgagaggaccccagacacagctgagagcctgctggagaagaccccagatgaggccgcccggctggtggagggcaccagcgccaagatccagtgcctgggcaaggccaccagcggcaagtttgagcagagcacagaggagacccccaggaagatcctgcggcccaccaaggagaccagcgagaagttctcctggccagccaaggagaggagcaggaagatcacctgggaggagaaggagacctctgtgaagacagaatgtgtggccggcgtgacccccaacaagacagaggtgctggagaagggcaccagcaacatgattgcctgccccaccaaggagaccagcaccaaggccagcaccaacgtggatgtgtcctctgtggagcccatcttcagcctgtttggcaccaggaccatcgagaacagccagtgcaccaaggtggaggaggacttcaacctggccaccaagatcatcagcaagtctgctgcccagaactacacctgcctgcctgatgccacctaccagaaggacatcaagaccatcaaccacaagattgaggaccagatgttccccagcgagagcaagcgggaggaggatgaggagtacagctgggacagcggcagcctgtttgagagcagcgccaagacccaggtgtgcatccctgagagcatgtaccagaaggtgatggagatcaaccgggaggtggaggagctgcctgagaagcccagcgccttcaagccagctgtggagatgcagaagacagtgcccaacaaggcctttgagctgaagaatgagcagaccctgcgggccgcccagatgttccccagcgagagcaagcagaaggatgatgaggagaacagctgggacagcgagagcccctgtgaaacagtgtcccagaaggatgtgtacctgcccaaggccacccaccagaaggagtttgacaccctgagcggcaagctggaggagagccctgtgaaggatggcctgctgaagcccacctgtggcaggaaggtgtccctgcccaacaaggccctggagctgaaggaccgggagaccttcaaggccgagagcccagacaaggatggcctgctgaagcccacctgtggcaggaaggtgtccctgcccaacaaggccctggagctgaaggaccgggagaccctgaaggccgagagcccagacaatgatggcctgctgaagcccacctgtggcaggaaggtgtccctgcccaacaaggccctggagctgaaggaccgggagaccttcaaggccgcccagatgttccccagcgagagcaagcagaaggatgatgaagaaaattcctgggactttgagagcttcctggagaccctgctgcagaatgatgtgtgcctgcccaaggccacccaccagaaggagtttgacaccctgagcggcaagctggaggagagcccagacaaggatggcctgctgaagcccacctgtggcatgaagatcagcctgcccaacaaggccctggagctgaaggaccgggagaccttcaaggccgaggatgtgtcctctgtggagagcaccttcagcctgtttgggaagcccaccacagagaacagccagagcaccaaggtggaggaggacttcaacctgaccaccaaggagggcgccaccaagacagtgacaggccagcaggagcgggacatcggcatcatcgagcgggccccccaggaccagaccaacaagatgcccaccagcgagctgggcaggaaggaggacaccaagagcaccagtgacagcgagatcatctctgtgtctgacacccagaactatgagtgcctgcctgaggccacctaccagaaggagatcaagaccaccaacgggaagattgaggagagccctgagaagcccagccactttgagcccgccacagagatgcagaacagcgtgcccaacaagggcctggagtggaagaacaagcagaccctgcgggctgacagcaccaccctgagcaagatcctggatgccctgcccagctgtgagcggggccgggagctgaagaaggacaactgtgagcagatcacagccaagatggagcagaccaagaacaagttctgtgtgctgcagaaggagctgtctgaggccaaggagatcaagagccagctggagaaccagaaggccaagtgggagcaggagctgtgcagcgtgcggctgaccctgaaccaggaggaggagaagagaagaaatgtggacatcctgaaggagaagatccggcctgaggagcagctgaggaagaagctggaggtgaagcagcagctggagcagaccctgcgcatccaggacatcgagctgaagtctgtgaccagcaacctgaaccaggtgagccacacccatgaaagtgaaaatgacctcttccacgagaactgcatgctgaagaaggagatcgccatgctgaagctggaggtggccaccctgaagcaccagcaccaggtgaaggagaacaagtactttgaggacatcaagatcctgcaggagaagaatgctgagctgcagatgaccctgaagctgaagcagaagacagtgaccaagagggccagccagtaccgggagcagctgaaggtgctgacagctgagaacaccatgctgaccagcaagctgaaggagaagcaggacaaggagatcctggagacagaaattgagagccaccacccccggctggccagcgccctgcaggaccatgaccagagcgtgaccagcaggaagaaccaggagctggccttccacagcgctggagatgcccccctgcagggcatcatgaatgtggatgtgagcaacaccatctacaacaatgaggtgctgcaccagcccctgtatgaggcccagaggaagagcaagagccccaagatcaacctgaactatgctggagatgacctgcgggagaatgccctggtgtctgaacatgcccagagggacagatgtgagacccagtgccagatgaagaaggccgagcacatgtaccagaatgagcaggacaacgtggacaagcacacagagcagcaggagagcctggagcagaagctgttccagctggagagcaagaaccgctggctgcggcagcagctggtgtatgcccacaagaaggtgaacaagagcaaggtgaccatcaacatccagtttcctgagatgaagatgcagaggcacctgaatgagaagaatgaggaggtgttcaactacggcaaccacctgaaggagagaattgaccagtatgagaaggagaaggccgagcgggaggtgtccatcaagaagtacaagtacttcagcaacttcctgaaggagagcggcctgggctag

SEQ ID NO: 35475 - DNA, 1860 bp, Artificial Sequence
  Description of Artificial Sequence: Synthetic coding sequence
atgaagaggctgctggccgccgccggcaagggcgtgcggggccctgagccccccaaccccttcagcgagcgggtgtacacagagaaggactatggcaccatctactttggagacctgggcaagatccacacagctgccagccggggccaggtgcagaagctggagaagatgacagtgggcaagaagcctgtgaacctgaacaagagggacatgaagaagaggacagccctgcactgggcctgtgtgaatggacatgctgaggtggtgaccttcctggtggacaggaagtgccagctgaatgtgctggatggagagggccgcacccccctgatgaaggccctgcagtgtgagcgggaggcctgtgccaacatcctgattgatgctggagctgacctgaactacgtggatgtgtatggcaacacagccctgcactatgctgtgtacagcgagaacctgctgatggtggccaccctgctgtcctatggagctgtgattgaggtgcagaacaaggccagcctgacccccctgctgctggccatccagaagaggagcaagcagacagtggagttcctgctgaccaagaatgccaatgccaatgccttcaatgaaagcaaatgtacagccctgatgctggccatctgtgagggcagcagcgagatcgtgggcatgctgctgcagcagaatgtggatgtgtttgctgaggacatccacggcatcacagctgagagatatgctgctgcctgtggggtgaactacatccaccagcagctgctggagcacatcaggaagctgcccaagaacccccagaacaccaaccctgagggcaccagcacaggcaccccagatgaggccgcccccctggccgagaggaccccagacacagctgagagcctgctggagaagaccccagatgaggccgcccggctggtggagggcaccagcgccaagatccagtgcctgggcaaggccaccagcggcaagtttgagcagagcacagaggagacccccaggaagatcctgcggcccaccaaggagaccagcgagaagttctcctggccagccaaggagaggagcaggaagatcacctgggaggagaaggagacctctgtgaagacagaatgtgtggccggcgtgacccccaacaagacagaggtgctggagaagggcaccagcaacatgattgcctgccccaccaaggagaccagcaccaaggccagcaccaacgtggatgtgtcctctgtggagcccatcttcagcctgtttggcaccaggaccatcgagaacagccagtgcaccaaggtggaggaggacttcaacctggccaccaagatcatcagcaagtctgctgcccagaactacacctgcctgcctgatgccacctaccagaaggacatcaagaccatcaaccacaagattgaggaccagatgttccccagcgagagcaagcgggaggaggatgaggagtacagctgggacagcggcagcctgtttgagagcagcgccaagacccaggtgtgcatccctgagagcatgtaccagaaggtgatggagatcaaccgggaggtggaggagctgcctgagaagcccagcgccttcaagccagctgtggagatgcagaagacagtgcccaacaaggcctttgagctgaagaatgagcagaccctgcgggccgcccagatgttccccagcgagagcaagcagaaggatgatgaggagaacagctgggacagcgagagcccctgtgaaacagtgtcccagaaggatgtgtacctgcccaaggccacccaccagaaggagtttgacaccctgagcggcaagctggaggcctacctgtggaaggagagcttcagcagcaagtag

SEQ ID NO: 35476 - DNA, 5622 bp, Artificial Sequence
  Description of Artificial Sequence: Synthetic coding sequence
atggaggagggcgtgcaggccccagactgggacagtgatgaaacagtgattgagggctctgtgacagaaagtgacctggaggagaaggagctgccctggaggcggctgctgtttgaccaggatgccagcctgaagtctgagttcagcctgcacccagacacccggggcatgtgcaagggcatgcccagccctgagatccagctgggcttcaagctgcgggaggacctgcaggagcagatgaacaagaacaagatgatgcctgtgctgtctgaggacaccatcctgcagagccaggatgaaacagaaagaaaccaggccctgctgcagaccaggaagaactgcagcatgttcatcggcagcttccggcagagcggcctgagcctgaaccaccagaacatcgagggccctgaggccgagagccctgaggtgctgccccacatcgagaaggagctgtctgagggccgggacagccctgaggtgtccctgctgagcggcacagccatcaccgtgtctgacacagtggccgtgaaggagaccagcctggtggagcctgagaagatcctggccgcccccaacaccttctttgagcccaggaaggaggtgaccatgaccatgaccagcgaggagaccaaggatgaggagagcagcctggagacctttgtgtctgccctggagagcctgctgaccagccctgagagcacccaggaggagcggctgtttgagctggtgtctgactttgacaggaaggagctgatgaaccccctgagtgacagcctgagcagcatcagcatccccctgaacagctggagcgcctgccaccgggacctgctggaggatgccaaggatgatgccctgcctgctgagctgctggaggccctgaacaccctgtctgaggccaaggtggagaccatctgccacaggaaggagggcggcagcagcctgattgccagaaatgaatgtctggaggtggagttcaacaccagccagaccaatgaagactgcacccagattgctgagaccctgcaggaccccaaccccagcggcctgcagaccctggcccaccagaacatcaccagctgtgagcccctgagcaacaagaggaacagcaacagcgtgaccaacagcagtgaccaggagacagcctgtgtgctgcggcgcagcagccggctggagaagctgaaggtgtccagagatgccaagtacagcgaccacatgtacaagatgcctgagaagatcctgcccaagatcctgggctgtgaggacctgaccaacaacaacagcagcgcccagaacttcaggatgcaggaccctgccctgatgattgatggcaaggagaagaacatgcacagcgcccgcttcaagaatggcaagcagatcaggaagaatgagcagttcagcggcaagaaggagaagatgaaggtgaacaagatcagcctgcacagcatcaacagaagaaacatctttggagagaacctggtgtacaaggccgccctgcatgatgatgctgacctggtgcaccactgcatcaagaagggcggcaatgtgaaccagcccagctatgccggctggacagccctgcacgaggcctctgtgggcggcttctacagaacagccagcgagctgctgaagggcggcgcagatgtgaacatcaagggcctgtaccagatcacccccctgcatgatgctgtgatgaatggccactacaaggtggccgagctgctgctgctgaatggagctgaccccctcttcagaaatgatgatggaaaatgtgccctggatgaggccaaggacctgtgcatgaagaggctgctggagcgctacatccccaagcaccagaagtgcctgaccagcgcccagaggagcagcattgaccccctggacattgaagatgtgtaccagcacaagaagcccaagttcagcagcaagagccacatctggcacgtgtacaatgaaaacagcaaccggcagaagctggagcacgtgaaggtgaacaagggcagcaaggccagcctcttcatcaacaaggaggatgtgtatgagtactaccagaaggaccccaagaacaccaagtttgggaagagcaagcacaagcagagcaccctggaccagatctacagcacaggcctgaggaaaggaaacctgcacaacgtgaaggaccccaacaccaacgtgcccaagggcatcggccgcaggaagacccagcacaagaggacccaggtggatgatgtggactgcaaccccaggaagatcctggccgtgagccccagccgccgcatcaaccggctggtgacctaccagcagcacatccctgagacccacaatgacctgcctgaggagctgtgtgagcccagcagcctgaccctgagcagcctgagaaatggcctggacagcagcacagaggcctgcagcgtgtccaaggagaagcacatccagaacctggacctgagtgacagccaggaggtgcagtgcctggagctggagagcgtggaccagacagaggccgtgtccttccctggcctgctgctgcacaaggagatcaagctgcctgtggtgaccacagacaagcagccccacaccctgcaggagcagcaccacgtgctgtacaagagccatgagaacagcaacctggtgcccaaggatgagcgcttcaacaagtgggagaacagcttcctgagctttgtgaaggagaacagcgacaatgatgatgatgatgactgcagcaccagcgagaaggccatcaccagcaagaaggtgctgtgcagcactggaggcaagaagcactacaacttcaaggagaacctgaccaacaagaaggagatgggcttccagcagttcctgctgtctgaggaccacctgagccaggagaatgagctgaaggctgtgtccctgaccaccctgcctgagcaggaggccgtgaacttctcctacagcgacaatgctgtgatcagcgagcacgtggccaactatgagcagtgcatcttcggccccagctttgaccacagcaatggaaatcctgagcagaacagcctggcctgcatgaggaccctgctgacccatgaggccagcaagctgaccaaccacgtggagctgttcaagaagccccaggactacatcccccgggcccccaccttcctgatgaaccagacagacacccacatcgtggagaagatggccaagaactgtgacacagaaagaaactacatcgaccgggaccagaagatcatctacagcaatgagcccctgagcatcgtggcccacagccaggtgattgagaccaccaaggtggagaagaggcggcagaaccacctggagagcgagaccatccacaacatcgacagccacagcacagacaacatgagcaaggagctggccaacatcagcaagctgagccagcgggagaagaaggagatcagccacaagccaggcatgaaggccggccgcatcaacaagagaaatgcccggggggagagccagctgcacctggccgtgcggcggggcaacctgcccctggtgaaggccctgattgaaagtggagcagatgtgaacctgaatgacaatgccggctggacccccctgcacgaggccagcaatgaaggcagcattgacatcatcgtggagctgctgaaggccggggccaaggtgaactgtgaaaatattgatggcatcctgcccctgcatgatgctgtggccaacaaccacctgaaggctgctgagatcctgctgcagaatggagccaaccccaaccagaaggaccagaagcagaagagcgccctggatgaagcagatgatgagaagatgaaggagctgctgcggagctatggagccatcgagaccgtgaacagagatgaaagtgatgccatcgtgaatgagaagatcccagctgtgcgcagcaagaggcacaagcagtgcttctgtgatgatggcaagaccatcgacagcagcagcctgagccaccaggagaggagccgggagagcctgtctgtgcaccagaccctgagcgccatcctgcaggacatcgaggagaagcaggagtacctgctggagtttgagatccggaacccagaagatgctgagcagtacatcgagaagatgctgaagatcaagaagatcatggacaacgtgctggccaagcagaaggccgagagagatgacctggccaagaagtacagagtgtccattgagagcttcaagcacggggccctgcgggagcagctggccaacctggccgcccggcagaagagcctgctggtggtggccaagaagcagaagaagatcagcctgaagatccagaactgcagaaatgtgaccagcctgccctgcctgagcctgaggaagctgcccccaagaagtgagatcagcagcgagaaggacagccaggagctgaccagcctggagaacctggagcacccccagagcggcagcctgagccctgtgtctggctccatgcaggagacccagctgagcctggagacctggaactacagccagaacaccaacatctgcctgaacagcgaggccgtgcggcggggggagttctctggaaatgacatgaacagcaagcagaatggaagtgactgcaccctggatggcttccccaagagccgccacagtgatggaacagagaagaacaagctgcccagccagcctgtggccttcatcggccagacagagtacagccagaaggaaaatgacctgacagaggccacagacaaggaccacgagttctacgtgagcagccctgtgattggcaagctgaacatcagcgagacagcctctgtgctggccgagaatgctgcccaccccagcaacatcatctgtgaccaggacctgagcaactatgaccccaagaggggcaacaggaagaccagcagccagcagagccccactggagccagcgagagcctggcccaccagggcattgctgtgctgggcagtgacacagtgcaccagatgaagccctacctgaagaagtctgtgtctgtggtgccctgtgctgatgacagccagatcagcagcagcagcggcagcggccagcaggacaccatcaagaaggccctgaactacagcacagcccccaagaagaagtgcatccagatcaaggacctgatcctgctgggccgcatcaaccctggcaacaacatcctggagttcaagacccaggagaccacccacaaggccagcatcctgctgaatggcaagctgaaggtggagagcggccagatctacaagaaccctgtgacctggctgaaggacctgctgggcggcaacagctatgtgacctggaactatgcctggagcaaggtgacctacctgggcaaggagctgctgcgctacgtgtctgaagatgcccccatcctgcctgagcccaacagcgtgccccagcagtaccagccctgcctgcctgaggtggcctgcctggatgatcctgtgcaggagcccaacaagtccatgtttgagaagaccaagtttggccagggcaccagccgggagagcatgcagagcagcccccgctacctgcagatcaatgagatcctgctgatcagtgaccaggagttcctgccctgccacatcatggaccagcactggaagttctgtgtggagtgtgaggagctgaccccctag

SEQ ID NO: 35477 - DNA, 819 bp, Artificial Sequence
  Description of Artificial Sequence: Synthetic coding sequence
atggtggcctgctaccacggcttccagagcgtggtggccctgctgagccactgccccttcctggatgtgaaccagcaggacaagggcggggacacagccctgatgctggccgcccaggccggccacgtgcccctggtgtccctgctgctgaactactacgtgggcctggacctggagcggcgggaccagaggggcctgacagccctgatgaaggccgccatgaggaacagatgtgaatgtgtggccaccctgctgatggccggggctgacctgacagctgtggaccctgtgcggggcaagacagccctggagtgggccgtgctgacagacagctttgacacagtgtggaggatccggcagctgctgcggcggccccaggtggagcagctgagccagcactacaagccagagtggccagccctgagcggcctggtggcccaggcccaggcccaggcccaggtggcccccagcctgctggagcggctgcaggccaccctgagcctgccctttgcccccagcccccaggagggcggcgtgctggaccacctggtgacagccaccaccagcctggccagcccctttgtgaccacagcctgccacaccctgtgcccagaccacccccccagcctgggcaccaggagcaagtctgtgcctgagctgctggtgcctgctgaggcccagagcttccgcacccccaagagcggccccagcagcctggccatccctggggcccaggaccgggaggaggagactggaggcggcggccagaatggaacagaggtgggagaagatggcatcggccaggccggcaacagatag

SEQ ID NO: 35478 - DNA, 612 bp, Artificial Sequence
  Description of Artificial Sequence: Synthetic coding sequence
atgaaggccgccatgaggaacagatgtgaatgtgtggccaccctgctgatggccggggctgacctgacagctgtggaccctgtgcggggcaagacagccctggagtgggccgtgctgacagacagctttgacacagtgtggaggatccggcagctgctgcggcggccccaggtggagcagctgagccagcactacaagccagagtggccagccctgagcggcctggtggcccaggcccaggcccaggcccaggtggcccccagcctgctggagcggctgcaggccaccctgagcctgccctttgcccccagcccccaggagggcggcgtgctggaccacctggtgacagccaccaccagcctggccagcccctttgtgaccacagcctgccacaccctgtgcccagaccacccccccagcctgggcaccaggagcaagtctgtgcctgagctgctggtgcctgctgaggcccagagcttccgcacccccaagagcggccccagcagcctggccatccctggggcccaggaccgggaggaggagaccggcggcggcggccagaatggaacagaggtgggggaggatggcatcggccaggccggcaacagatag

SEQ ID NO: 35479 - DNA, 1485 bp, Artificial Sequence
  Description of Artificial Sequence: Synthetic coding sequence
atggtgctgctggccggcactggacctgagggcggcggggcccgctgcatgaccccacctccacccagcccccccaggggggcccaggtggaggaggaccctgctgactatgaggagtttgaggacttcagcagcctgcctgacaccaggagcatcgccagtgatgacagcttctacccctttgaagatgaggaggagcacggcgtggagagcgctgagagcgtgcctgagggcgtgcctgagagcgtgcctgagacagccaccctgctgcgggccgcctgtgccaacaacgtgggcctgctgcggaccctggtgcggcggggcgtgtctgtggaggaggcccaggagacagacagaaatggccgcacaggcctcatcgtggcctgctaccacggctttgtggacacagtggtggccctggccgagtgcccccacgtggatgtgaactggcaggacagcgagggcaacacagccctgatcacagctgcccaggccggccacgccatcatcaccaactacctgctgaactacttccctggcctggacctggagaggagaaatgccttcggcttcaccgccctgatgaaggccgccatgcagggccgcacagactgcatccgggccctgatgctggccggggctgatgtgcacgcccgggacccccggcggggcatgagcccccaggagtgggccacctacacaggccgggtggatgctgtgcggctgatgcagaggctgctggagcggccctgcccagagcagttctgggagaagtacagacctgagctgcccccacctcctgaggccgccaggaagccagctggcagcaagaactgcctgcagaggctgacagactgtgtgctgtctgtgctgacccccaggtctgtgcggggcccagaagatggaggagtgctggaccacatggtgaggatgaccaccagcctgtacagccctgctgtggccatcgtgtgccagacagtgtgcccagagagcccccccagcgtgggcaagaggcggctggccgtgcaggagatcctggccgcccgggccgcccggggcccccaggcccaggaggaggatgaggtgggcggggccggccagaggggccgcacaggccaggaggatgctgacagccgggagggcagccccagggctggcctgcccccagccctgggcagccggggccctgctgccccagcccccaggaaggccagcctgctgcccctgcagaggctgcggcggcgctctgtgcggcctggggtggtggtgccccgggtgcgggtgtccaaggccccagcccccaccttccagcctgagaggcctgccaggaagggcagcaccaaggacagcggccacctgcagatccccaagtggagatacaaggaggccaaggaggagaagaggaaggccgaggaggccgagaagaagaggcaggccgaggcccagaaggagaggagaacagccccctggaagaagaggacatag

SEQ ID NO: 35480 - DNA, 1491 bp, Artificial Sequence
  Description of Artificial Sequence: Synthetic coding sequence
atgctgcacacagagggccacgccctgctgcgggctgtgggccagggcaagctgcggctggcccggctgctgctggagggcggggcctacgtgaatgaaggagatgcccagggcgagacagccctgatggccgcctgccgggcccgctatgatgacccccagaacaaggccaggatggtgcgctacctgctggagcagggcgctgaccccaacattgctgaccggctgggccgcacagccctgatgcacgcctgtgccggcggcggcggcgctgctgtggccagcctgctgctggcccacggggctgaccccagcgtgcgggaccacgccggggccagcgccctggtgcacgccctggacagaggagaccgggagaccctggccaccctgctggatgcctgcaaggccaagggcacagaggtgatcatcatcaccacagacaccagccccagcggcaccaagaagacccggcagtacctgaacagcccccccagccctggggtggaggaccctgccccagccagccccagccctggcttctgcaccagccccagcgagatccagctgcagacagctgggggcggcggccggggcatgctgagcccccgggcccaggaggaggaggagaagagagatgtgtttgagttccccctgcccaagcccccagatgaccccagccccagcgagcccctgcccaagccacccaggcacccccccaagcccctgaagaggctgaacagcgagccctggggcctggtggccccaccccagcctgtgcccccaacagagggccggcccggcatcgagcggctgacagctgagttcaacggcctgaccctgaccggccggccccggctgagccgccgccacagcacagagggccctgaggaccccccaccctgggccgagaaggtgaccagcggcggccccctgagcagaagaaacacagcccctgaggcccaggagagcggccccccatctggcctgcggcagaagctgagcaggatggagcctgtggagctggacaccccaggccacctgtgcccagacagccctgagagcagccggctgagcctggagcggcggcgctacagcgccagccccctgaccctgcccccagctggcagcgcccccagcccccggcagagccaggagagcctgcccggggctgtgagccccctgtctggaagaagaagaagccctggcctgctggagcggcggggcagcggcaccctgctgctggaccacatcagccagacccggcccggcttcctgccccccctgaatgtgagcccccacccccccatcccagacatccggccccagcccggcggccgggcccccagcctgcctgccccaccctatgctggggcccctggcagccccaggaccaagaggaagctggtgcggcggcacagcatgcagacagagcagatccggctgctgggcggcttccagagcctgggcggccctggagagcccggccgctag

SEQ ID NO: 35481 - DNA, 1608 bp, Artificial Sequence
  Description of Artificial Sequence: Synthetic coding sequence
atgatggatgatgacacagagctgaggacagatggcaacagcctgctgaaggctgtgtggctgggccgcctgcggctgacccggctgctgctggagggcggggcctacatcaatgaaagcaatgacaagggggagacagccctgatggtggcctgcatcaccaagcacgtggaccagcagagcatcagcaagagcaagatggtgaagtacctgctggacaacagagctgaccccaacatccaggacaagagcggcaagacagccctgattcatgcctgcatcagaagagctggaggagaggtggtgtccctgctgctggagaatggagctgaccccagcctggaggacagaactggagccagcgccctggtgtatgccatcaatgctgatgacaaggatgccctgaagcacctgctggatgcctgcaaggccaagggcaaggaggtgatcatcatcaccacagacaagagcagcagcggcaccaagaccaccaagcagtacctgaatgtgccccccagccccaaggtggaggacagacacagcccccccctgtgtgccagccccagcgacatcgagctgaaggccctgggcctggacagccccctgacagagaaggaggatgacttcttcagcctgcaggccggccaccccagcagctgcaacaccagcaaggctgtgaatgaacctggcagccccaccaggaaggtgagcaacctgaagagggcccggctgccccagctgaagaggctgcagagcgagccctggggcctcatcgcccccagcgtgctggccgccagcacccggcaggatgagacccatggagccagcacagacaatgaagtcatcaagagcatcagtgacatctccttccccaagaggggccccctgagcaggaccaacagcattgacagcaaggaccccaccctcttccacacagtgacagagcaggtgctgaagatccctgtgagcagcgccccagcctcctggaaggccgcctatgagaagggccaggccccccacccccggctggcccggcggggcaccctgcctgtggaccaggagaagtgtggcatgggccccagcggccccagcgccctgaaggagcccgccagcctgaagtggctggagaatgacctgtatgacctggacatccagcccggccctgacccccccaacagcatcagcctggagagcggcaagggccccctggacaggaagaagctgaacagcagccacctgagcctcttccacggcagccgggagagcctggacacagtgcccagcaccagccccagcagcgcccggcggcggcccccccacctgctggagcggcggggcagcggcaccctgctgctggaccgcatcagccacacccggcccggcttcctgccccccctgaatgtgaacctgaacccccccatcccagacatccgcagcagcagcaagcccagctgcagcctggccagcggcctgaagtccatggtgcctgtggcccccagcagccccaagagggtggacctgcggagcaagaagaagctgctgcggcggcacagcatgcagatcgagcagatgaagcagctgagtgactttgaggagatcatgacctag

SEQ ID NO: 35482 - DNA, 3006 bp, Artificial Sequence
  Description of Artificial Sequence: Synthetic coding sequence
atgaagaggatcttcagctgcagcagcacccaggtggccgtggagcgctggaacagacatgaccagaagctgctggaggccgtgcacagaggagatgtgggccgggtggccgccctggccagcaggaagagcgcccggcccaccaagctggacagcaatggccagagccccttccacctggccgccagcaagggcctgacagagtgcctgaccatcctgctggccaacggggctgacatcaacagcaagaatgaagatggcagcacagccctgcacctggccaccatcagctgccagccccagtgtgtgaaggtgctgctgcagcacggggccaatgaagatgctgtggatgctgaaaatagaagccccctgcactgggccgccagcagcggctgtgccagctctgtgctgctgctgtgtgaccacgaggccttcctggatgtgctggacaatgatggccgcacccccctgatgattgccagcctgggcggccacgccgccatctgcagccagctgctgcagagaggagcccgggtgaatgtgacagacaagaatgacaagagcgccctgatcctggcctgtgagaagggcagcgctgaggtggccgagctgctgctgagccacggggctgatgctggagctgtggacagcacaggccatgatgccctgcactacgccctgcacacccaggacaaggccctgtggaggcacctgcagcaggccctgagcagaagaagaagaggaggccagaggctggtgcagcacccagacctggccagccaggccagccccagcgagccccaggccggcagcccccccaagagctcctggagggctgagcctgaggaggagcaggaggagaaggaggatgaggacccctgcagcgaggagtggcgctggaagtatgaggaggagaggaggaaggtggtgcggctggagcaggagctggtgcagaagacagaggagtgcaagacccaggccgccgcctacctggacctggagaaccagatccgggagcaggcccaggagctgggcgtgctgctgtcctgggagccccgggccagcggcaagcagggcagcagcctgcggcctggaggagatggcatggagcagggctgccccaaggacctgctggccgagagcacccaggagctgaagaagcagcagcaggccgccgccaccgtgaaccctgtgctggcccccaagaaggcagaagattctgcccctgggaagatccagtatgaggtgcacggccgcagccagcctgaggagcagggccccccccagagccctgccagcgagaccatcaggaaggccaccggccagcagctgaccaccaatggagcccagaccttcggccctgaccatgctgaccagctgcctgctggccagaaggagagcagccaggtgctgggcgtggagcccggcggcaccgtggccgagcctgtgggccctgctgccatgaaccagctgctgctgcagctgcgggaggagctggccgctgtgtggagggagaaggatgctgcccggggggccctgagcaggcctgtgatggagggcgccctgggcacccccagggctgaggccgctgctgctgcctgggagaagatggaggcccggctggagcgggtgctggcccggctggagtgggccaaggccggcctgcaggtgaagccagaggtgcccagccaggagagccgggagggcgccctgaaggccgcccctggcagcatcaagcaggatgaggagaaggagaagagggtgcctggggcccggggggagcccctgggcgccctgggcggggagaaggccctgggcggcctggccaagggccagctggagaaggagatgtctgtgctgcggctgagcaacagcaacctgctggaggagctgggggagctgggccgggagcggcagaggctgcagcgggagctgcagagcctgagccagaggctgcagcgggagtttgtgcccaagccagaggcccaggtgcagctgcagcagctgcggcagagcgtgggcctgctgaccaatgagctggccatggagaaggaggccacagagaagctgaggaagctgctggccagccagagcagcggcctgcggggcctgtgggactgcctgcctgctgacctggtgggggagaggtctgcccagagcaaggctgctgagagcctggaggagctgcgggcctgcatcagcaccctggtggacagacaccgggaggcccagcaggtgctggcccggctgcaggaggagaaccagcagctgcggggcagcctgagcccctgccgggagcccggcaccagcctgaaggccccagccagcccccaggtggccgccctggagcaggacctgggcaagctggaggaggagctgcgggctgtgcaggccaccatgtctgggaagagccaggagatcggcaagctgaagcagctgctgtaccaggccacagaggaggtggccgagctgcgggcccgggaggccgccagcctgcggcagcacgagaagacccggggcagcctggtggcccaggcccaggcctggggccaggagctgaaggccctgctggagaagtacaacacagcctgccgggaggtgggccgcctgcgggaggccgtggccgaggagaggagaagaagtggggacctggccgcccaggccgctgagcaggagcggcaggccagcgagatgaggggccgctctgagcagtttgagaagacagctgagctgctgaaggagaagatggagcacctgattggagcctgccgggacaaggaggccaagatcaaggagctgctgaagaagctggagcagctgtctgaggaggtgctggccatccggggggagaatgcccggctggccctgcagctgcaggacagccagaagaaccacgaggagatcatcagcacctacagaaaccacctgctgaatgctgcccggggctacatggagcacgaggtgtacaacatcctgctgcagatcctgtccatggaggaggagtag

SEQ ID NO: 35483 - DNA, 2733 bp, Artificial Sequence
  Description of Artificial Sequence: Synthetic coding sequence
atgaagaggatcttcagctgccagccccagtgtgtgaaggtgctgctgcagcacggggccaatgaagatgctgtggatgctgagaacagaagccccctgcactgggccgccagcagcggctgtgccagctctgtgctgctgctgtgtgaccacgaggccttcctggatgtgctggacaatgatggccgcacccccctgatgattgccagcctgggcggccatgctgccatctgcagccagctgctgcagagaggagcccgggtgaatgtgacagacaagaatgacaagagcgccctgatcctggcctgtgagaagggcagcgctgaggtggccgagctgctgctgagccatggagcagatgctggagctgtggacagcactggacatgatgccctgcactacgccctgcacacccaggacaaggccctgtggaggcacctgcagcaggccctgagcagaagaagaagaggaggccagaggctggtgcagcacccagacctggccagccaggccagccccagcgagccccaggccggcagcccccccaagagctcctggagggctgagcctgaggaggagcaggaggagaaggaggatgaggacccctgcagcgaggagtggcgctggaagtatgaggaggagaggaggaaggtggtgcggctggagcaggagctggtgcagaagacagaggagtgcaagacccaggccgccgcctacctggacctggagaaccagatccgggagcaggcccaggagctgggcgtgctgctgtcctgggagccccgggccagcggcaagcagggcagcagcctgcggcctggaggagatggcatggagcagggctgccccaaggacctgctggccgagagcacccaggagctgaagaagcagcagcaggccgccgccaccgtgaaccctgtgctggcccccaagaaggccgaggacagcgcccctgggaagatccagtatgaggtgcacggccgcagccagcctgaggagcagggccccccccagagccctgccagcgagaccatcaggaaggccaccggccagcagctgaccaccaacggggcccagacctttggaccagaccacgccgaccagctgcctgctggccagaaggagagcagccaggtgctgggcgtggagcccggcggcaccgtggccgagcctgtgggccctgctgccatgaaccagctgctgctgcagctgcgggaggagctggccgctgtgtggagggagaaggatgctgcccggggggccctgagcaggcctgtgatggagggcgccctgggcacccccagggctgaggccgctgctgctgcctgggagaagatggaggcccggctggagcgggtgctggcccggctggagtgggccaaggccggcctgcaggtgaagccagaggtgcccagccaggagagccgggagggcgccctgaaggccgcccctggcagcatcaagcaggatgaggagaaggagaagagggtgcctggggcccggggggagcccctgggcgccctgggcggggagaaggccctgggcggcctggccaagggccagctggagaaggagatgtctgtgctgcggctgagcaacagcaacctgctggaggagctgggggagctgggccgggagcggcagaggctgcagcgggagctgcagagcctgagccagaggctgcagcgggagtttgtgcccaagccagaggcccaggtgcagctgcagcagctgcggcagagcgtgggcctgctgaccaatgagctggccatggagaaggaggccacagagaagctgaggaagctgctggccagccagagcagcggcctgcggggcctgtgggactgcctgcctgctgacctggtgggggagaggtctgcccagagcaaggctgctgagagcctggaggagctgcgggcctgcatcagcaccctggtggacagacaccgggaggcccagcaggtgctggcccggctgcaggaggagaaccagcagctgcggggcagcctgagcccctgccgggagcccggcaccagcctgaaggccccagccagcccccaggtggccgccctggagcaggacctgggcaagctggaggaggagctgcgggctgtgcaggccaccatgtctgggaagagccaggagatcggcaagctgaagcagctgctgtaccaggccacagaggaggtggccgagctgcgggcccgggaggccgccagcctgcggcagcacgagaagacccggggcagcctggtggcccaggcccaggcctggggccaggagctgaaggccctgctggagaagtacaacacagcctgccgggaggtgggccgcctgcgggaggccgtggccgaggagcggcggcgcagcggggacctggccgcccaggccgctgagcaggagcggcaggccagcgagatgaggggccgctctgagcagtttgagaagacagctgagctgctgaaggagaagatggagcacctgattggagcctgccgggacaaggaggccaagatcaaggagctgctgaagaagctggagcagctgtctgaggaggtgctggccatcagaggagaaaatgcccggctggccctgcagctgcaggacagccagaagaaccacgaggagatcatcagcacctacagaaaccacctgctgaatgctgcccggggctacatggagcacgaggtgtacaacatcctgctgcagatcctgtccatggaggaggagtag

SEQ ID NO: 35484 - DNA, 414 bp, Artificial Sequence
  Description of Artificial Sequence: Synthetic coding sequence
atgaagaggatcttcagctgcagcagcacccaggtggccgtggagcgctggaacagacatgaccagaagctgctggaggccgtgcacagaggagatgtgggccgggtggccgccctggccagcaggaagagcgcccggcccaccaagctggacagcaatggccagagccccttccacctggccgccagcaagggcctgacagagtgcctgaccatcctgctggccaacggggctgacatcaacagcaagaatgaagatggcagcacagccctgcacctggccaccatcagctgccagccccagtgtgtgaaggtgctgctgcagccccccctggccgtgccccaggtgtgcagctgctgcgtgaccaccaagcccagctggacctgctggatcatgatggatgtgcacccctag

SEQ ID NO: 35485 - DNA, 489 bp, Artificial Sequence
  Description of Artificial Sequence: Synthetic coding sequence
atggaggatggcaagcgggagcgctggcccaccctgatggagcggctgtgcagtgatggctttgccttcccccagtaccccatcaagccctaccacctgaagaggatccacagagctgtgctgcacggcaacctggagaagctgaagtacctgctgctgacctactatgatgccaacaagagggacaggaaggagaggacagccctgcacctggcctgtgccaccggccagcctgagatggtgcacctgctggtgtccagaagatgtgagctgaacctgtgtgaccgggaggacaggacccccctcatcaaggctgtgcagctgcggcaggaggcctgtgccaccctgctgctgcagaatggagccaaccccaacatcacagacttcttcggccgcacagccctgcactatgctgtgtacaatgaagacacctccatgattgagaagctgctgagccacggcaccaacattgaagaatgttccaagtag

SEQ ID NO: 35486 - DNA, 384 bp, Artificial Sequence
  Description of Artificial Sequence: Synthetic coding sequence
atgctgctgcagcagcagctggatgatgccaggaacaaggctgacaaccaggagaaggccatcctgaacatccaggcccgctgtgatgcccgggtgcagaacctgcaggccgagtgcaggaagcaccggctgctgctggaggaggacaacaagatgctggtgaatgagctgaaccacagcaaggagaaggagtgccagtatgagaaggagaaggccgagcgggaggtggccgtgcggcagctgcagcagaagagagatgatgtgctgaacaagggcagcgccaccaaggccctgctggatgccagcagccgccactgcacctacctggagaatggcatgcaggacagcaggaagaagctggaccagatgaggagccaggcctag

SEQ ID NO: 35487 - DNA, 1041 bp, Artificial Sequence
  Description of Artificial Sequence: Synthetic coding sequence
atggaggatggcaagcgggagcgctggcccaccctgatggagcggctgtgcagtgatggctttgccttcccccagtaccccatcaagccctaccacctgaagaggatccacagagctgtgctgcacggcaacctggagaagctgaagtacctgctgctgacctactatgatgccaacaagagggacaggaaggagaggacagccctgcacctggcctgtgccaccggccagcctgagatggtgcacctgctggtgtccagaagatgtgagctgaacctgtgtgaccgggaggacaggacccccctcatcaaggctgtgcagctgcggcaggaggcctgtgccaccctgctgctgcagaatggagccaaccccaacatcacagacttcttcggccgcacagccctgcactatgctgtgtacaatgaagacacctccatgattgagaagctgctgagccacggcaccaacattgaagaatgttccaaatgtgagtaccagcccctgctgtttgctgtgtccaggaggaaggtgaagatggtggagttcctgctgaagaagaaggccaacgtgaatgccatcgactacctgggccgcagcgccctgattcatgctgtgaccctgggggagaaggacatcgtcatcctgctgctgcagcacaacattgatgtgctgagcagagatgccttcaggaagattgctggggactatgccatcgaggccaagaacagagtcatctttgacctgatctatgaatatgaaaggaagagatatgaggacctgcccatcaacagcaaccctgtgagcagccagaagccacccaccctgaagggcaccagtgatgaggaggacagcgtgctgggcatcgcccgggagaacaaggatggagagaagagcaggacagtgtcctctgagaagcccccaggcctgaaggccagcagcgctgagaaggacagcgtgctgaacatcgcccggggcaagaaggatggagagaagaccaagagggtgagcagcaggaagaagcccagcctggaggccacctag

SEQ ID NO: 35488 - DNA, 5826 bp, Artificial Sequence
  Description of Artificial Sequence: Synthetic coding sequence
atggaggatggcaagcgggagcgctggcccaccctgatggagcggctgtgcagtgatggctttgccttcccccagtaccccatcaagccctaccacctgaagaggatccacagagctgtgctgcacggcaacctggagaagctgaagtacctgctgctgacctactatgatgccaacaagagggacaggaaggagaggacagccctgcacctggcctgtgccaccggccagcctgagatggtgcacctgctggtgtccagaagatgtgagctgaacctgtgtgaccgggaggacaggacccccctcatcaaggctgtgcagctgcggcaggaggcctgtgccaccctgctgctgcagaatggagccaaccccaacatcacagacttcttcggccgcacagccctgcactatgctgtgtacaatgaagacacctccatgattgagaagctgctgagccacggcaccaacattgaagaatgttccaaatgtgagtaccagcccctgctgtttgctgtgtccaggaggaaggtgaagatggtggagttcctgctgaagaagaaggccaacgtgaatgccatcgactacctgggccgcagcgccctgattcatgctgtgaccctgggggagaaggacatcgtcatcctgctgctgcagcacaacattgatgtgctgagcagagatgccttcaggaagattgctggggactatgccatcgaggccaagaacagagtcatctttgacctgatctatgaatatgaaaggaagagatatgaggacctgcccatcaacagcaaccctgtgagcagccagaagcagcctgccctgaaggccaccagcggcaaggaggacagcatcagcaacatcgccacagagatcaaggatggccagaagagcggcaccgtgagcagccagaagcagcctgccctgaaggacaccagtgacaaggatgacagcgtgagcaacacagccacagagatcaaggatgagcagaagagcggcaccgtgctgcctgctgtggagcagtgcctgaacagaagcctgtacagaccagatgctgtggcccagcctgtgacagaaaatgagttcagcctggagagcgagatcatcagcaagctgtacatccccaagaggaagatcatcagccccaggagcatcaaggatgtgctgccccctgtggaggaggccgtggaccgctgcctgtacctgctggacagatttgcccagcctgtgaccaaggacaagtttgccctggagagcgagaacatcagcgagccctacttcaccaacagaaggaccatcagccagcagagcgctgagaacctggatgctgcctgtggcatcgacaagacagaaaatggaaacatgtttgaggaccagaatgtggacaaggagggcaaggccctgcctgccaccggccagaaggccaacgtgtccccagagcagcccccactcttcacccacacagtgaaggaccgggaccacatcagcacccgcttcctgggcggcatggacagcctgaccagcagcgaggagagcagcgagcggccccccctgagcaccctgaccctgaaggaggccgaccccagcagcaaggccgccatgaggaggaaggacagccccccacctgggaaggtgagcagccagaagcagcctgctgagaaggccaccagtgatgacaaggacagcgtgagcaacatcgccacagagatcaaggagggccccatcagcggcaccgtgagcagccagaagcagcctgctgagaaggccaccagtgatgagaaggacagcgtgagcaacatcgccacagagatcaagaagggccagcagagcggcaccgtgagcccccagaagcagagcgcctggaaggtgatcttcaagaagaaggtgtccctgctgaacatcgccacccgcatcatgggcggcggcaagagcggcaccgtgagcagccagaagcagcctgccagcaaggccaccagtgacaagacagacagcgccctgaacatcgccacagagatcaaggatggcctgcagtgtggcaccgtgagcagccagaagcagcctgccctgaaggccaccacagatgaggaggacagcgtgagcaacatcgccacagagatcaaggatggagagaagagcggcaccgtgagcagccagaagcagcctgccctgaaggccaccacagatgaggaggacagcgtgagcaacatcgccacagagatcaaggatggagagaagagcggcaccgtgagcagccagaagcagcctgccctgaaggccaccacagatgagaaggacagcgtgagcaacatcgccacagagatcaaggatggagagaagagcggcaccgtgagcagccagaagcccccagccctgacagccaccagtgatgaggagggctctgtgctgagcatcgcccgggagaacaaggatggagagaagagcaggacagtgagcagcaggaagaagccagccctgaaggccaccagtgatgagaaggacagcttcagcaacatcacccggggcaagaaggatggagagatcagcaggaaggtgagcagccagaagccacccaccctgaagggcaccagtgatgaggaggacagcgtgctgggcatcgcccgggagaacaaggatggagagaagagcaggacagtgtcctctgagaagcccccaggcctgaaggccagcagcgctgagaaggacagcgtgctgaacatcgcccggggcaagaaggatggagagaagaccaagagggtgagcagcaggaagaagcccagcctggaggccaccagtgatgagaaggacagcttcagcaacatcacccgggagaagaaggatggagagatcagcaggaaggtgagcagccagaagcccccagccctgaagggcaccagtgatgaggaggacagcgtgctgggcatcgcccgggagaacaaggatggagagaagagcaggacagtgtcctctgagaagcccccaggcctgaaggccaccagtgatgagaaggacagcgtgctgaacatcgcccggggcaagaaggatggagagaagaccaggacagtgagcagccagaagccacccaccctgaaggccaccagtgatgaggaggacagcgtgctgagcatcgcccgggagaacaaggatggagagaagagcaggacagtgtcctctgagaagcccagcggcctgaaggccaccagcgctgagaaggacagcgtgctgaacatcgcccggggcaagaagtacggggagaagaccaagagggtgagcagcaggaagaagccagccctgaaggccaccagtgatgagaaggacagcgtgctgtacatcgcccgggagaagaaggatggagagaagagcaggacagtgagcagccccaagcagcctgccctgaaggccatctgtgacaaggaggacagcgtgcccaacatggccacagagaagaaggatgagcagatcagcggcaccgtgtcctgccagaagcagcctgccctgaaggccaccagtgacaagaaggacagcgtgagcaacatccccacagagatcaaggatggccagcagagcggcaccgtgagcagccagaagcagcctgcctggaaggccacctctgtgaagaaggacagcgtgagcaacatcgccacagagatcaaggatggccagatccggggcaccggcatcctggagtacaccttcaacgtgatgtttgaccagatcgaggagaagttcaccagcctgaacaagtctgctggggtgagcccccagaagcagagcgcccagaaggtgatcttcaagaagaaggtgtccctgctgaacatcgccacccgcatcactggaggctggaagagcggcacagagtacccagagaacctgcccaccctgaaggccaccatcgagaacaagaacagcgtgctgaacacagccaccaagatgaaggatgtgcagaccagcaccccagctgagcaggacctggagatggccagcgagggggagcagaagaggctggaggagtatgagaacaaccagccccaggtgaagaaccagatccacagcagagatgacctggatgacatcatccagagcagccagacagtgtctgaagatggagacagcctgtgctgcaactgcaagaatgtcatcctgctgattgaccagcacgagatgaagtgcaaggactgtgtgcacctgctgaagatcaagaacaccttctgcctgtggaagaggctcatcaagctgaaggacaaccactgtgagcagctgcgggtgaagatcaggaagctgaagaacaaggcctctgtgctgcagaagaggatcagcgagaaggaggagatcaagagccagctgaagcatgagatcctggagctggagaaggagctgtgcagcctgcgctttgccatccagcaggagaagaagaagagaagaaatgtggaggaggtgcaccagaaggtgcgggagaagctgcgcatcacagaggagcagtacagaattgaagcagatgtgaccaagcccatcaagccagccctgaagtctgctgaggtggagctgaagacaggaggcaacaacagcaaccaggtgtctgaaacagatgagaaggaggacctgctgcacgagaaccggctgatgcaggatgagatcgcccggctgcggctggagaaggacaccatcaagaaccagaacctggagaagaagtacctgaaggactttgaaattgtgaagaggaagcatgaggacctgcagaaggccctgaagagaaatggagagaccctggccaagaccatcgcctgctacagcggccagctggccgccctgacagatgagaacaccaccctgcggagcaagctggagaagcagcgggagagccggcagaggctggagacagagatgcagagctaccactgccgcctgaatgctgcccgctgtgaccatgaccagagccacagcagcaagagggaccaggagctggccttccagggcaccgtggacaagtgccgccacctgcaggagaacctgaacagccacgtgctgatcctgagcctgcagctgagcaaggccgagagcaagagccgggtgctgaagacagagctgcactacacaggagaggccctgaaggagaaggccctggtgtttgagcacgtgcagagcgagctgaagcagaagcagagccagatgaaggacatcgagaagatgtacaagagcggctacaacaccatggagaagtgcatcgagaagcaggagcgcttctgccagctgaagaagcagaacatgctgctgcagcagcagctggatgatgccaggaacaaggctgacaaccaggagaaggccatcctgaacatccaggcccgctgtgatgcccgggtgcagaacctgcaggctgaatgtaggaagcaccggctgctgctggaggaggacaacaagatgctggtgaatgagctgaaccacagcaaggagaaggagtgccagtatgagaaggagaaggccgagcgggaggtggccgtgcggcagctgcagcagaagagagatgatgtgctgaacaagggcagcgccaccaaggccctgctggatgccagcagccgccactgcacctacctggagaatggcatgcaggacagcaggaagaagctggaccagatgaggagccagttccaggagatccaggaccagctgacagccaccatccgctgcaccaaggagatggagggggacacccagaagctggaggtggagcacgtgatgatgaggaagatcatcaagaagcaggatgaccagatcgagcggctggagaagatcctgcagcacagcagcctgatgctgcaggtgtttgagagctag

SEQ ID NO: 35489 - DNA, 930 bp, Artificial Sequence
  Description of Artificial Sequence: Synthetic coding sequence
atggaggatggcaagcgggagcgctggcccaccctgatggagcggctgtgcagtgatggctttgccttcccccagtaccccatcaagccctaccacctgaagaggatccacagagctgtgctgcacggcaacctggagaagctgaagtacctgctgctgacctactatgatgccaacaagagggacaggaaggagaggacagccctgcacctggcctgtgccaccggccagcctgagatggtgcacctgctggtgtccagaagatgtgagctgaacctgtgtgaccgggaggacaggacccccctcatcaaggctgtgcagctgcggcaggaggcctgtgccaccctgctgctgcagaatggagccaaccccaacatcacagacttcttcggccgcacagccctgcactatgctgtgtacaatgaagacacctccatgattgagaagctgctgagccacggcaccaacattgaagaatgttccaaatgtgagtaccagcccctgctgtttgctgtgtccaggaggaaggtgaagatggtggagttcctgctgaagaagaaggccaacgtgaatgccatcgactacctgggccgcagcgccctgattcatgctgtgaccctgggggagaaggacatcgtcatcctgctgctgcagcacaacattgatgtgctgagcagagatgccttcaggaagattgctggggactatgccatcgaggccaagaacagagtcatctttgacctgatctatgaatatgaaaggaagagatatgaggacctgcccatcaacagcaaccctgtgagcagccagaagcagcctgccctggccacagagcaggacagcatgagcaagatcaagaagaggaagctgattgtgatgaagaagaagtccatggtgatccagcgcttcctggtgaccttctgcaagtag

SEQ ID NO: 35490 - DNA, 5826 bp, Artificial Sequence; identical to SEQ ID NO: 35488
  Description of Artificial Sequence: Synthetic coding sequence

SEQ ID NO: 35491 - DNA, 3627 bp, Artificial Sequence
  Description of Artificial Sequence: Synthetic coding sequence
atgggcggcggcaagagcggcaccgtgagcagccagaagcagcctgccagcaaggccaccagtgacaagacagacagcgccctgaacatcgccacagagatcaaggatggcctgcagtgtggcaccgtgagcagccagaagcagcctgccctgaaggccaccacagatgaggaggacagcgtgagcaacatcgccacagagatcaaggatggagagaagagcggcaccgtgagcagccagaagcagcctgccctgaaggccaccacagatgaggaggacagcgtgagcaacatcgccacagagatcaaggatggagagaagagcggcaccgtgagcagccagaagcagcctgccctgaaggccaccacagatgagaaggacagcgtgagcaacatcgccacagagatcaaggatggagagaagagcggcaccgtgagcagccagaagcccccagccctgacagccaccagtgatgaggagggctctgtgctgagcatcgcccgggagaacaaggatggagagaagagcaggacagtgagcagcaggaagaagccagccctgaaggccaccagtgatgagaaggacagcttcagcaacatcacccggggcaagaaggatggagagatcagcaggaaggtgagcagccagaagccacccaccctgaagggcaccagtgatgaggaggacagcgtgctgggcatcgcccgggagaacaaggatggagagaagagcaggacagtgtcctctgagaagcccccaggcctgaaggccagcagcgctgagaaggacagcgtgctgaacatcgcccggggcaagaaggatggagagaagaccaagagggtgagcagcaggaagaagcccagcctggaggccaccagtgatgagaaggacagcttcagcaacatcacccgggagaagaaggatggagagatcagcaggaaggtgagcagccagaagcccccagccctgaagggcaccagtgatgaggaggacagcgtgctgggcatcgcccgggagaacaaggatggagagaagagcaggacagtgtcctctgagaagcccccaggcctgaaggccaccagtgatgagaaggacagcgtgctgaacatcgcccggggcaagaaggatggagagaagaccaggacagtgagcagccccaagcagcctgccctgaaggccatctgtgacaaggaggacagcgtgcccaacatggccacagagaagaaggatgagcagatcagcggcaccgtgtcctgccagaagcagcctgccctgaaggccaccagtgacaagaaggacagcgtgagcaacatccccacagagatcaaggatggccagcagagcggcaccgtgagcagccagaagcagcctgcctggaaggccacctctgtgaagaaggacagcgtgagcaacatcgccacagagatcaaggatggccagatccggggcaccgtgagcccccaggtgcccatccccaggcacaaggtgggcaacatcaagagctaccccaacacaggaagacgcatccagctggatgccaacaccttctctgtgagcccccagaagcagagcgcccagaaggtgatcttcaagaagaaggtgtccctgctgaacatcgccacccgcatcaccggcggctggaagtctggaacagagtacccagagaacctgcccaccctgaaggccaccatcgagaacaagaacagcgtgctgaacacagccaccaagatgaaggatgtgcagaccagcaccccagctgagcaggacctggagatggccagcgagggggagcagaagaggctggaggagtatgagaacaaccagccccaggtgaagaaccagatccacagcagagatgacctggatgacatcatccagagcagccagacagtgtctgaagatggagacagcctgtgctgcaactgcaagaatgtcatcctgctgattgaccagcacgagatgaagtgcaaggactgtgtgcacctgctgaagatcaagaacaccttctgcctgtggaagaggctcatcaagctgaaggacaaccactgtgagcagctgcgggtgaagatcaggaagctgaagaacaaggcctctgtgctgcagaagaggatcagcgagaaggaggagatcaagagccagctgaagcatgagatcctggagctggagaaggagctgtgcagcctgcgctttgccatccagcaggagaagaagaagagaagaaatgtggaggaggtgcaccagaaggtgcgggagaagctgcgcatcacagaggagcagtaccgcatcgaggctgatgtgaccaagcccatcaagccagccctgaagtctgctgaggtggagctgaagacaggaggcaacaacagcaaccaggtgtctgaaacagatgagaaggaggacctgctgcatgaaaatcggctgatgcaggatgaaattgcccggctgcggctggagaaggacaccatcaagaaccagaacctggagaagaagtacctgaaggactttgagatcgtgaagaggaagcatgaggacctgcagaaggccctgaagagaaatggagagaccctggccaagaccatcgcctgctacagcggccagctggccgccctgacagatgagaacaccaccctgcggagcaagctggagaagcagcgggagagccggcagaggctggagacagagatgcagagctaccactgccgcctgaatgctgcccgctgtgaccatgaccagagccacagcagcaagagggaccaggagctggccttccagggcaccgtggacaagtgccgccacctgcaggagaacctgaacagccacgtgctgatcctgagcctgcagctgagcaaggccgagagcaagagccgggtgctgaagacagagctgcactacaccggggaggccctgaaggagaaggccctggtgtttgaacatgtgcagagcgagctgaagcagaagcagagccagatgaaggacatcgagaagatgtacaagagcggctacaacaccatggagaagtgcatcgagaagcaggagcgcttctgccagctgaagaagcagaacatgctgctgcagcagcagctggatgatgccaggaacaaggctgacaaccaggagaaggccatcctgaacatccaggcccgctgtgatgcccgggtgcagaacctgcaggccgagtgcaggaagcaccggctgctgctggaggaggacaacaagatgctggtgaatgagctgaaccacagcaaggagaaggagtgccagtatgagaaggagaaggccgagcgggaggtggccgtgcggcagctgcagcagaagagagatgatgtgctgaacaagggcagcgccaccaaggccctgctggatgccagcagccgccactgcacctacctggagaatggcatgcaggacagcaggaagaagctggaccagatgaggagccagttccaggagatccaggaccagctgacagccaccatccgctgcaccaaggagatggagggggacacccagaagctggaggtggagcacgtgatgatgaggaagatcatcaagaagcaggatgaccagatcgagcggctggagaagatcctgcagcacagcagcctgctgctgctgaactttgagacctag

SEQ ID NO: 35492 - DNA, 1821 bp, Artificial Sequence
  Description of Artificial Sequence: Synthetic coding sequence
agcagcaggaagaagccagccctgaaggccaccagtgatgagaaggacagcttcagcaacatcacccgggagaagaaggatggagagaccagcaggacagtgagcagccagaagcccccagccctgaaggccaccagtgatgaagaagattctgtgctgagcatcgcccgggaggagaaggatggagagaagagcaggacagtgagcagcgagcagcccccaggcctgaaggccaccagagatgagaaggacagcctgctgaacatcgcccgggtcatccaggccggcggccagagcttctctgtgagcagcaggaagaaggccgccctgaaggccaccagtgatgagaaggacagcttcagcaacatcacccgggagaggaaggatggagagaccagcaggacagtgagcagccagaagcccccagccctgaaggccaccagtgatgaagaagattctgtgctgaacatcgcccgggagaagaaggatggagagaagagcaggacagtgagcagcaggaagaaggccgccctgaaggccaccagtgatgagaaggacagcttcagcaacatcacccgggagaggaaggatggagagaccagcaggacagtgagcagccagaagcccccagccctgaaggccaccagtgatgaagaagattctgtgctgaacatcgcccgggagaagaaggatggagagaagagcaggacagtgagcagcgagcagcccccaggcctgaaggccaccagagatgagaaggacagcctgctgaacatcgcccggggcaagaagcatggagagaagacccggcgggtgagcagcaggaagaaggccgccctgaaggccaccagtgatgagaaggacagcttcagcaacatcacccgggagaggaaggatggagagaccagcaggacagtgagcagccagaagcccccagccctgaaggccactggagatgaagaagattctgtgctgaacatcgcccgggagaagaaggatggagagaagagcaggacagtgagcagcgagaagcccagcggcctgaaggccaccagtgatgagaaggacagcgtgctgaacatcgcccggggcaagaagcatggagagaagacccggcgggtgagcagccacaagcagcctgccctgaaggccaccagtgacaaggaaaattctgtgcccaacatggccacagagaccaaggatgagcagatctctggaacagtgagcagccagaagcagcctgccctgaaggccaccagtgacaagaaggacagcgtgagcaacatccccacagagatcaaggatggccagcagagcggcaccgtgagcagccagaagcagctggcctggaaggccacctctgtgaagaaggacagcgtgagcaacatcgccacagagatcaaggatggccagatccggggcaccgtgagcagccagaggcagcctgccctgaaggccactggagatgagaaggacagcgtgagcaacatcgcccgggagatcaaggatggagagaagtctggaacagtgagcccccagaagcagagcgcccagaaggtgatcttcaagaagaaggtgtccctgctgaacatcgccacccgcatcaccggcggctggaagtctggaacagagtacccagagaacctgcccaccctgaaggccaccatcgagaacaagaacagcgtgctgaacacagccaccaagatgaaggatgtgcagaccagcaccccagagcaggacctggagatggccagcgagggggagcagaagaggctggaggagtatgagaacaaccagccccaggtgtacttctccttctag

SEQ ID NO: 35493 - DNA, 2400 bp, Artificial Sequence
  Description of Artificial Sequence: Synthetic coding sequence
atggccacagagaccaaggatgagcagatctctggaacagtgagcagccagaagcagcctgccctgaaggccaccagtgacaagaaggacagcgtgagcaacatccccacagagatcaaggatggccagcagagcggcaccgtgagcagccagaagcagctggcctggaaggccacctctgtgaagaaggacagcgtgagcaacatcgccacagagatcaaggatggccagatccggggcaccgtgagcagccagaggcagcctgccctgaaggccactggagatgagaaggacagcgtgagcaacatcgcccgggagatcaaggatggagagaagtctggaacagtgagcccccagaagcagagcgcccagaaggtgatcttcaagaagaaggtgtccctgctgaacatcgccacccgcatcaccggcggctggaagtctggaacagagtacccagagaacctgcccaccctgaaggccaccatcgagaacaagaacagcgtgctgaacacagccaccaagatgaaggatgtgcagaccagcaccccagagcaggacctggagatggccagcgagggggagcagaagaggctggaggagtatgagaacaaccagccccaggtgaagaaccagatccacagcagagatgacctggatgacatcatccagagcagccagacagtgtctgaagatggagacagcctgtgctgcaactgcaagaatgtcatcctgctgattgaccagcacgagatgaagtgcaaggactgtgtgcacctgctgaagatcaagaagaccttctgcctgtgcaagaggctgacagagctgaaggacaaccactgtgagcagctgcgggtgaagatcaggaagctgaagaacaaggcctctgtgctgcagaagaggctgtctgagaaggaggagatcaagagccagctgaagcatgagaccctggagctggagaaggagctgtgcagcctgcgctttgccatccagcaggagaagaagaagagaagaaatgtggaggagctgcaccagaaggtgcgggagaagctgcgcatcacagaggagcagtacagaattgaagcagatgtgaccaagcccatcaagccagccctgaagtctgctgaggtggagctgaagacaggaggcaacaacagcaaccaggtgtctgaaacagatgagaaggaggacctgctgcacgagaaccggctgatgcaggatgagatcgcccggctgcggctggagaaggacaccatcaagaaccagaacctggagaagaagtacctgaaggactttgaaattgtgaagaggaagcatgaggacctgcagaaggccctgaagagaaatgaggagaccctggccgagaccatcgcctgctacagcggccagctggccgccctgacagatgagaacaccaccctgcggagcaagctggagaagcagcgggagagcggccagaggctggagacagagatgcagagctaccgctgccgcctgaatgctgccctgtgtgaccatgaccagagccacagcagcaagagggaccaggagctggccttccagggcaccgtggacaagtgctgccacctgcaggagaacctgaacagccacgtgctgatcctgagcctgcagctgagcaaggccgagagcaagttccgggtgctggagacagagctgcactacacaggagaggccctgaaggagaaggccctggtgtttgagcacgtgcagagcgagctgaagcagaagcagagccagatgaaggacatcgagaagatgtacaagagcggctacaacaccatggagaagtgcatcgagaagcaggagcgcttctgccagctgaagaagcagaacatgctgctgcagcagcagctggatgatgccaggaacaaggctgacaaccaggagaaggccatcctgaacatccaggcccgctgtgatgcccgggtggagaacctgcaggctgaatgtaggaagcaccggctgctgctggaggaggacaacaagatgctggtgaatgagctgaaccacagcaaggagaagaagtgccagtatgagaaggagaaggccgagcgggaggtggccgtgcggcagctgcagcagaagcaggatgatgtgctgaacaagaggtctgccaccaaggccctgctggatgccagcagccgccactgcatctacctggagaatggcatgcaggacagcaggaagaagctggaccagatgaggagccagttccaggagatccaggaccagctgacagccaccatccgctgcaccaaggagatggagggagatgcccagaagctggaggtggagaatgtgatgatgaggaagatcatcaagaagcaggatgagcagatcgagagatttgagaagatcctgcagcacagcagcctggtgtag

SEQ ID NO: 35494 - DNA, 3090 bp, Artificial Sequence
  Description of Artificial Sequence: Synthetic coding sequence
agcagcaggaagaaggccgccctgaaggccaccagtgatgagaaggacagcttcagcaacatcacccgggagaggaaggatggagagaccagcaggacagtgagcagccagaagcccccagccctgaaggccaccagtgatgaagaagattctgtgctgaacatcgcccgggagaagaaggatggagagaagagcaggacagtgagcagcgagcagcccccaggcctgaaggccaccagagatgagaaggacagcctgctgaacatcgcccggggcaagaagcatggagagaagacccggcgggtgagcagcaggaagaaggccgccctgaaggccaccagtgatgagaaggacagcttcagcaacatcacccgggagaggaaggatggagagaccagcaggacagtgagcagccagaagcccccagccctgaaggccactggagatgaagaagattctgtgctgaacatcgcccgggagaagaaggatggagagaagagcaggacagtgagcagcgagaagcccagcggcctgaaggccaccagtgatgagaaggacagcgtgctgaacatcgcccggggcaagaagcatggagagaagacccggcgggtgagcagccacaagcagcctgccctgaaggccaccagtgacaaggaaaattctgtgcccaacatggccacagagaccaaggatgagcagatctctggaacagtgagcagccagaagcagcctgccctgaaggccaccagtgacaagaaggacagcgtgagcaacatccccacagagatcaaggatggccagcagagcggcaccgtgagcagccagaagcagctggcctggaaggccacctctgtgaagaaggacagcgtgagcaacatcgccacagagatcaaggatggccagatccggggcaccgtgagcagccagaggcagcctgccctgaaggccactggagatgagaaggacagcgtgagcaacatcgcccgggagatcaaggatggagagaagtctggaacagtgagcccccagaagcagagcgcccagaaggtgatcttcaagaagaaggtgtccctgctgaacatcgccacccgcatcaccggcggctggaagtctggaacagagtacccagagaacctgcccaccctgaaggccaccatcgagaacaagaacagcgtgctgaacacagccaccaagatgaaggatgtgcagaccagcaccccagagcaggacctggagatggccagcgagggggagcagaagaggctggaggagtatgagaacaaccagccccaggtgaagaaccagatccacagcagagatgacctggatgacatcatccagagcagccagacagtgtctgaagatggagacagcctgtgctgcaactgcaagaatgtcatcctgctgattgaccagcacgagatgaagtgcaaggactgtgtgcacctgctgaagatcaagaagaccttctgcctgtgcaagaggctgacagagctgaaggacaaccactgtgagcagctgcgggtgaagatcaggaagctgaagaacaaggcctctgtgctgcagaagaggctgtctgagaaggaggagatcaagagccagctgaagcatgagaccctggagctggagaaggagctgtgcagcctgcgctttgccatccagcaggagaagaagaagagaagaaatgtggaggagctgcaccagaaggtgcgggagaagctgcgcatcacagaggagcagtacagaattgaagcagatgtgaccaagcccatcaagccagccctgaagtctgctgaggtggagctgaagacaggaggcaacaacagcaaccaggtgtctgaaacagatgagaaggaggacctgctgcacgagaaccggctgatgcaggatgagatcgcccggctgcggctggagaaggacaccatcaagaaccagaacctggagaagaagtacctgaaggactttgaaattgtgaagaggaagcatgaggacctgcagaaggccctgaagagaaatgaggagaccctggccgagaccatcgcctgctacagcggccagctggccgccctgacagatgagaacaccaccctgcggagcaagctggagaagcagcgggagagcggccagaggctggagacagagatgcagagctaccgctgccgcctgaatgctgccctgtgtgaccatgaccagagccacagcagcaagagggaccaggagctggccttccagggcaccgtggacaagtgctgccacctgcaggagaacctgaacagccacgtgctgatcctgagcctgcagctgagcaaggccgagagcaagttccgggtgctggagacagagctgcactacacaggagaggccctgaaggagaaggccctggtgtttgagcacgtgcagagcgagctgaagcagaagcagagccagatgaaggacatcgagaagatgtacaagagcggctacaacaccatggagaagtgcatcgagaagcaggagcgcttctgccagctgaagaagcagaacatgctgctgcagcagcagctggatgatgccaggaacaaggctgacaaccaggagaaggccatcctgaacatccaggcccgctgtgatgcccgggtggagaacctgcaggctgaatgtaggaagcaccggctgctgctggaggaggacaacaagatgctggtgaatgagctgaaccacagcaaggagaagaagtgccagtatgagaaggagaaggccgagcgggaggtggccgtgcggcagctgcagcagaagcaggatgatgtgctgaacaagaggtctgccaccaaggccctgctggatgccagcagccgccactgcatctacctggagaatggcatgcaggacagcaggaagaagctggaccagatgaggagccagttccaggagatccaggaccagctgacagccaccatccgctgcaccaaggagatggagggagatgcccagaagctggaggtggagaatgtgatgatgaggaagatcatcaagaagcaggatgagcagatcgagagatttgagaagatcctgcagcacagcagcctggtgtccatcatctttgagacctag

SEQ ID NO: 35495 - DNA, 5337 bp, Artificial Sequence
  Description of Artificial Sequence: Synthetic coding sequence
atggatgacaaggagcccaagcgctggcccaccctgcgggaccggctgtgcagtgatggcttcctgttcccccagtaccccatcaagccctaccacctgaagggcatccacagagctgtgttctacagagacctggaggagctgaagtttgtgctgctgaccaggtatgacatcaacaagagggacaggaaggagaggacagccctgcacctggcctgtgccaccggccagcctgagatggtgcacctgctggtgtccagaagatgtgagctgaacctgtgtgaccgggaggacaggacccccctcatcaaggctgtgcagctgcggcaggaggcctgtgccaccctgctgctgcagaatggagctgaccccaacatcacagatgtgtttggccgcacagccctgcactatgctgtgtacaatgaagacacctccatgattgagaagctgctgtcctatggagccaacattgaagaatgttctgaagatgagtacccacccctcttcctggccgtgtcccagaggaaggtgaagatggtggagttcctgctgaagaagaaggccaacatcaatgctgtggactacctgggccgcagcgccctgattcatgctgtgaccctgggggagaaggacatcgtcatcctgctgctgcagcacaacattgatgtgttcagcagagatgtgtatggcaagctggccgaggactatgccagcgaggccaagaacagagtcatctttgagctgatctatgaatatgaaaggaagaagcatgaggagctgagcatcaacagcaaccctgtgagcagccagaagcagcctgccctgaaggccaccagcggcaaggaggacagcatcagcaacatcgccacagagatcaaggatggccagaagagcggcaccgtgagcagccagaagcagcctgccctgaagggcaccagtgacaagaatgacagcgtgagcaacacagccacagagatcaaggatgagcagaagagcggcaccgtgagcagccagaagcagcctgccctgaaggacaccagtgacaagaatgacagcgtgagcaacacagccacagagatcaaggatgagcagaagagcggcaccgtgctgcctgctgtggagcagtgcctgaacagaagcctgtacagaccagatgctgtggcccagcctgtgacagaagatgaatttgccctggagagcgagatcatcagcaagctgtacatccccaagaggaagatcatcagccccaggagcattgaagatgtgctgccccctgtggaggaggccgtggaccgctgcctgtacctgctggacagatttgcccaggccgtgaccaaggacaagtttgccctggagagcgagaacatcagcgagccctacttcaccaacagaaggaccatcagccagcagagcgctgagaagctggatgctgcctgtggcatcgacaagacagaaaatggcaccctgtttgaggaccagaatgtggacaaggagggcaaggccctgcctgccaccggccagaaggccaacgtgtccccagagcagcccccactcttcacccacacagtgaaggacagcgaccacatcagcacccgcttcctgggctccatggacagcctgaccagcagcgaggagagcagcgagcggccccccctgagcaccctgaccctgaaggaggccgaccccagcagcaaggccgccatgaggaggaaggacagccccccacctgggaaggtgagcagccagaagcagcctgctgagaaggccaccagtgatgacaaggacagcgtgagcaacatcgccacagagatcaaggagggccccatcagcggcaccgtgagcagccagaagcagcctgctgagaaggccaccagtgatgagaaggacagcgtgagcaacatcgccacagagatcaaggagggccagcagagcggcaccgtgagcccccagaagcagagcgcctggaaggtgatcttcaagaagaaggtgtccctgctgaacatcgccacccgcatcactggaggcggcaagagcggcaccgtgagcagccagaagcagccccccagcaaggccaccagtgacaagacagacagcgccctgaacatcgccacagagatcaaggatggcctgcagtgtggcaccgtgagcagccagaagcagcctgccctgaaggccaccacagatgaggaggacagcgtgagcaacatcgccacagagatcaaggatggagagaagagcggcaccgtgagcagccagaagcagcctgccctgaaggccaccacagatgaggaggacagcgtgtccatcatcgccacagagatcaaggatggagagaagagcggcaccgtgagcagcaggaagaagccagccctgaaggccaccagtgatgagaaggacagcttcagcaacatcacccgggagaagaaggatggagagatcagcaggacagtgaccagcgagaagccagctggcctgaaggccaccagtgatgaggaggacagcgtgctgaacatcgcccggggcaaggaggatggagagaagaccaggagagtgagcagcaggaagaagccagccctgaaggccaccagtgatgagaaggacagcttcagcaacatcacccgggagaagaaggatggagagaccagcaggacagtgagcagccagaagcccccagccctgaaggccaccagtgatgaggaggacagcgtgctgaacatcgcccgggagaagaaggatggagagaagagcaggacagtgtcctctgagaagcccagcggcctgaaggccaccagtgatgagaaggacagcgtgctgaacatcgcccggggcaagaagcacggggagaagaccaggagagtgagcagccacaagcagcctgccctgaaggccaccagtgacaaggagaacagcgtgcccaacatggccacagagaccaaggatgagcagatcagcggcaccgtgagcagccagaagcagcctgccctgaaggccaccagtgacaagaaggacagcgtgagcaacatccccacagagatcaaggatggccagcagagcggcaccgtgagcagccagaagcagctggcctggaaggccacctctgtgaagaaggacagcgtgagcaacatcgccacagagatcaaggatggccagatccggggcaccgtgagcagccagaggcagcctgccctgaaggccactggagatgagaaggacagcgtgagcaacatcgcccgggagatcaaggatggagagaagagcggcaccgtgagcccccagaagcagagcgcccagaaggtgatcttcaagaagaaggtgtccctgctgaacatcgccacccgcatcactggaggctggaagagcggcacagagtacccagagaacctgcccaccctgaaggccaccatcgagaacaagaacagcgtgctgaacacagccaccaagatgaaggatgtgcagaccagcaccccagagcaggacctggagatggccagcgagggggagcagaagaggctggaggagtatgagaacaaccagccccaggtgaagaaccagatccacagcagagatgacctggatgacatcatccagagcagccagacagtgtctgaagatggagacagcctgtgctgcaactgcaagaatgtcatcctgctgattgaccagcacgagatgaagtgcaaggactgtgtgcacctgctgaagatcaagaagaccttctgcctgtgcaagaggctgacagagctgaaggacaaccactgtgagcagctgcgggtgaagatcaggaagctgaagaacaaggcctctgtgctgcagaagaggctgtctgagaaggaggagatcaagagccagctgaagcatgagaccctggagctggagaaggagctgtgcagcctgcgctttgccatccagcaggagaagaagaagagaagaaatgtggaggagctgcaccagaaggtgcgggagaagctgcgcatcacagaggagcagtaccgcatcgaggctgatgtgaccaagcccatcaagccagccctgaagtctgctgaggtggagctgaagacaggaggcaacaacagcaaccaggtgtctgaaacagatgagaaggaggacctgctgcatgaaaatcggctgatgcaggatgaaattgcccggctgcggctggagaaggacaccatcaagaaccagaacctggagaagaagtacctgaaggactttgagatcgtgaagaggaagcatgaggacctgcagaaggccctgaagagaaatgaggagaccctggccgagaccatcgcctgctacagcggccagctggccgccctgacagatgagaacaccaccctgcggagcaagctggagaagcagcgggagagcggccagaggctggagacagagatgcagagctaccgctgccgcctgaatgctgccctgtgtgaccatgaccagagccacagcagcaagagggaccaggagctggccttccagggcaccgtggacaagtgctgccacctgcaggagaacctgaacagccacgtgctgatcctgagcctgcagctgagcaaggccgagagcaagttccgggtgctggagacagagctgcactacaccggggaggccctgaaggagaaggccctggtgtttgaacatgtgcagagcgagctgaagcagaagcagagccagatgaaggacatcgagaagatgtacaagagcggctacaacaccatggagaagtgcatcgagaagcaggagcgcttctgccagctgaagaagcagaacatgctgctgcagcagcagctggatgatgccaggaacaaggctgacaaccaggagaaggccatcctgaacatccaggcccgctgtgatgcccgggtggagaacctgcaggccgagtgcaggaagcaccggctgctgctggaggaggacaacaagatgctggtgaatgagctgaaccacagcaaggagaagaagtgccagtatgagaaggagaaggccgagcgggaggtggccgtgcggcagctgcagcagaagcaggatgatgtgctgaacaagaggtctgccaccaaggccctgctggatgccagcagccgccactgcatctacctggagaatggcatgcaggacagcaggaagaagctggaccagatgaggagccagttccaggagatccaggaccagctgacagccaccatccgctgcaccaaggagatggagggagatgcccagaagctggaggtggagaatgtgatgatgaggaagatcatcaagaagcaggatgagcagatcgagagatttgagaagatcctgcagcacagcagcctgatgctgcaggtgtttgagagctag

SEQ ID NO: 35496 - DNA, 552 bp, Artificial Sequence
  Description of Artificial Sequence: Synthetic coding sequence
atggccaccccccggccctgtgctgatggcccctgctgcagccaccccagcgctgtgctgggcgtgcagcagaccctggaggagatggactttgagcggggcatctggagcgctgccctgaatggagacctgggccgggtgaagcacctgatccagaaggccgaggaccccagccagcctgacagcgctggctacacagccctgcactacgccagcagaaatggccactatgctgtgtgccagttcctgctggagagcggggccaagtgtgatgcccagacccatggaggagccacagccctgcaccgggccagctactgcggccacacagagatcgcccggctgctgctgagccacggcagcaacccccgggtggtggatgatgatggcatgaccagcctgcacaaggctgctgagcggggccacggggacatctgcagcctgctgctgcagcacagccctgccctgaaggccatccgggacaggaaggcccggctggcctgtgacctgctgccctgcaacagcgacctgcgggacctgctgagcagctag

SEQ ID NO: 35497 - DNA, 1107 bp, Artificial Sequence
  Description of Artificial Sequence: Synthetic coding sequence
atgaatgccctgctggagcagaaggagcagcaggagcggctgcgggaggccgccgccctgggggacatccgggaggtgcagaagctggtggagagcggcgtggatgtgaacagccagaatgaggtgaatggctggacctgcctgcactgggcctgcaagaggaaccacggccaggtggtgtcctacctgctgaagagcggggctgacaaggagatcctgaccaccaagggggagatgcctgtgcagctgaccagccggcgggagatcaggaagatcatgggcgtggaggaggaggatgatgatgatgatgatgatgacaacctgccccagctgaagaaggagagcgagctgccctttgtgcccaactacctggccaacccagccttccccttcatctacacccccacagctgaggacagcgcccagatgcagaatggaggccccagcaccccaccagccagccccccagcagatggcagcccccccctgctgcccccaggagagccccccctgctgggcaccttcccccgggaccacaccagcctggccctggtgcagaatggagatgtgtctgcccccagcgccatcctgcggaccccagagagcaccaagccaggccctgtgtgccagccccctgtgtcccagagccgcagcctcttcagctctgtgcccagcaagccacccatgagcctggagccccagaatggcacctacgccggccctgccccagccttccagcccttcttcttcaccggggccttccccttcaacatgcaggagctggtgctgaaggtgcgcatccagaaccccagcctgcgggagaatgacttcatcgagattgagctggaccggcaggagctgacctaccaggagctgctgcgggtgtgctgctgtgagctgggcgtgaacccagaccaggtggagaagatcaggaagctgcccaacaccctgctgaggaaggacaaggatgtggcccggctgcaggacttccaggagctggagctggtgctgatgatcagcgagaacaacttcctgttcagaaatgctgccagcaccctgacagagcggccctgctacaacagaagagccagcaagctgacctactag

SEQ ID NO: 35498 - DNA, 777 bp, Artificial Sequence
  Description of Artificial Sequence: Synthetic coding sequence
ggggagaccctggccttccctggccacgtggccgccttcaagggggacctgggcatgctgaagaagctggtggaggatggagtcatcaacatcaatgaaagagctgacaatggcagcacccccatgcacaaggccgccggccagggccacatcgagtgcctgcagtggctgatcaagatgggcgctgacagcaacatcaccaacaaggccggggagcggcccagtgatgtggccaagagatttgcccacctggccgctgtgaagctgctggaggagctgcagaagtatgacattgatgatgaaaatgaaattgatgaaaatgatgtgaagtacttcatcagacatggagtggagggcagcacagatgccaaggatgacctgtgcctgagtgacctggacaagacagatgccaggatgagggcctacaagaagatcgtggagctgcggcacctgctggagattgctgagagcaactacaagcacctgggcggcatcacagaggaggacctgaagcagaagaaggagcagctggagagcgagaagaccatcaaggagctgcagggccagctggagtatgaaaggctgcggcgggagaagctggagtgccagctggatgagtacagagctgaggtggaccagctgcgggagaccctggagaagatccaggtgcccaactttgtggccatggaggacagcgccagctgtgagagcaacaaggagaagagaagagtgaagaagaaggtgagcagcggcggcgtgtttgtgcggcgctactag

SEQ ID NO: 35499 - DNA, 597 bp, Artificial Sequence
  Description of Artificial Sequence: Synthetic coding sequence
atgcctggggtggccaacagcggccccagcaccagcagccgggagacagccaacccctgcagcaggaagaaggtgcacttcggcagcatccatgatgctgtgcgggctggagatgtgaagcagctgtctgaaattgtggtgcggggggccagcatcaatgagctggatgtgctgcacaagttcacccccctgcactgggccgcccacagcggcagcctggagtgcctgcactggctgctgtggcacggggctgacatcacccacgtgaccacccggggctggacagccagccacatcgccgccatccggggccaggatgcctgtgtgcaggccctgatcatgaatggagccaacctgacagcccaggatgaccggggctgcacccccctgcacctggccgccacccacggccacagcttcaccctgcagatcatgctgcggtctggagtggaccccagcgtgacagacaagcgggagtggaggcctgtgcactacgccgccttccacggccgcctgggctgcctgcagctgctggtgaagtggggctgcagcattgaagatgtggactacaatggaaacctgcctgagcccccatag

SEQ ID NO: 35500 - DNA, 1170 bp, Artificial Sequence
  Description of Artificial Sequence: Synthetic coding sequence
atgcctggggtggccaacagcggccccagcaccagcagccgggagacagccaacccctgcagcaggaagaaggtgcacttcggcagcatccatgatgctgtgcgggctggagatgtgaagcagctgtctgaaattgtgtgcctgcactggctgctgtggcacggggctgacatcacccacgtgaccacccggggctggacagccagccacatcgccgccatccggggccaggatgcctgtgtgcaggccctgatcatgaatggagccaacctgacagcccaggatgaccggggctgcacccccctgcacctggccgccacccacggccacagcttcaccctgcagatcatgctgcggtctggagtggaccccagcgtgacagacaagcgggagtggaggcctgtgcactacgccgccttccacggccgcctgggctgcctgcagctgctggtgaagtggggctgcagcattgaagatgtggactacaatggaaacctgcctgtgcacctggccgccatggagggccacctgcactgcttcaagttcctggtgtccaggatgagcagcgccacccaggtgctgaaggccttcaatgacaacggggagaatgtgctggacctggcccagcgcttcttcaagcagaacatcctgcagttcatccagggcgcagaatatgagggcaaggacctggaggaccaggagaccctggccttccctggccacgtggccgccttcaagggggacctgggcatgctgaagaagctggtggaggatggagtcatcaacatcaatgaaagagctgacaatggcagcacccccatgcacaaggccgccggccagggccacatcgagtgcctgcagtggctgatcaagatgggcgctgacagcaacatcaccaacaaggccggggagcggcccagtgatgtggccaagagatttgcccacctggccgctgtgaagctgctggaggagctgcagaagtatgacattgatgatgaaaatgaaattgatgaaaatgatgtgaagtacttcatcagacatggagtggagggcagcacagatgccaaggatgacctgtgcctgagtgacctggacaagacagatgcccggcggcccagcaagaactgccgggcctcctggagcatgaatgactatgtggagaagaactag

SEQ ID NO: 35501 - DNA, 1776 bp, Artificial Sequence
  Description of Artificial Sequence: Synthetic coding sequence
tccttccccaggagaagaccctgctgcctgagcagccaggtggccggcgtgggccgcctggagcgggacagcgagaaggtgcctgctgagggcggcagaagatatggagacagccagggcgtggctgatgaagatggcggccgccgcaccagccaccacgtgtggaggatcaatggcctgcacggccacagcggggctgagagccgggagcgggtgtctgatgatggagagaggaaatgtgaggagagtgacagaagaagccgggtggccgccggcagcctgtctgcagatgctggcttcagcagaagtgacctgcggcgggtgtctgagaacctgggccactgccgctctgtgtcccgggagcgggtgcggggggacagcggccacagccacagctgctcctgggagcgggtgcggggggacagcaccttctgcagcagtgatgtgaacttcagcgaggtgggcggccaccagaccacagacagccggggcacagcccgggaggaccggggcctgcggctgagcggcccctgggagggcgtgtctgacatccgggaccccaggaccagtgactttggagacagagtgtctgatgacaggagccgccgcttcagcggctcctgggagggcggctctgtggagggcggccacagcgtgggcagctcctgggaggaggtgtctggggaccggggctatgctgccagtgacagcagcggcgtgtctggctctgaagatgccagctaccgcttcagcggcttctgggagcgggagagtgaagatgagggcttccgctgcagcttctgggagcgggcccgggaggacctgggcccccggcccagtgatgatggagaggagggccgctgccgctgcagcggctcctgggtgcgggcctctgaagatagaagaagcatccggggcctggacagcaccccaccccagagccgccgctgctgtgccatgcctggggtggccaacagcggccccagcaccagcagccgggagacagccaacccctgcagcaggaagaaggtgcacttcggcagcatccatgatgctgtgcgggctggagatgtgaagcagctgtctgagatcgtggtgcggggggccagcatcaatgagctggatgtgctgcacaagttcacccccctgcactgggccgcccacagcggcagcctggagtgcctgcactggctgctgtggcatggagctgacatcacccacgtgaccacccggggctggacagccagccacatcgccgccatccggggccaggatgcctgtgtgcaggccctgatcatgaatggagccaacctgacagcccaggatgaccggggctgcacccccctgcacctggccgccacccacggccacagcttcaccctgcagatcatgctgcggtctggagtggaccccagcgtgacagacaagcgggagtggaggcctgtgcactatgctgccttccacggccgcctgggctgcctgcagctgctggtgaagtggggctgcagcattgaagatgtggactacaacggcaacctgcctgtgcacctggccgccatggagggccacctgcactgcttcaagttcctggtgtccaggatgagcagcgccacccaggtgctgaaggccttcaatgacaatggagaaaatgtgctggacctggcccagcgcttcttcaagcagaacatcctgcagttcatccagggcagccccaagccagccacagacctgcagggcgagactggagccacagagctggccccccgggagagctag

SEQ ID NO: 35502 - DNA, 1650 bp, Artificial Sequence
  Description of Artificial Sequence: Synthetic coding sequence
atggccctggccgctgctgctgctgctgctgctgctggggtgtcccaggccgctgtgctgggcttcctgcaggagcacggcggcaaggtgagaaattctgagctgctgagccgcttcaagcccctgctggatgctggggacccccggggccgggccgcccggcgggaccgcttcaagcagtttgtgaacaacgtggccgtggtgaaggagctggatggagtgaagtttgtggtgctgaggaagaagcccaggcctcctgagcctgagcccgccccctttggacctcctggagctgctgcccagcccagcaagcccaccagcacagtgctgcccaggtctgccagcgcccctggggccccacccctggtgcgggtgcccaggcctgtggagcccccaggggacctgggcctgcccacagagccccaggacaccccaggcggccctgccagcgagcccgcccagcccccaggagagaggtctgctgacccccccctgcctgccctggagctggcccaggccacagagcggcccagcgcagatgctgcccccccaccccgggcccccagcgaggccgccagcccctgcagcgaccccccagatgctgagcccggccctggagctgccaagggccccccccagcagaagccctgcatgctgcctgtgcgctgtgtgcctgccccagccaccctgcggctgcgggcagaggagcccggcctgcggcggcagctgtctgaggagcccagccccaggagcagccccctgctgctgcggcggctgtctgtggaggagagcggcctgggcctgggcctgggccctggccgcagcccccacctgcggcggctgagccgggccggcccccggctgctgagcccagatgctgaggagctgcctgctgcccctcctccttctgctgtgcccctggagcccagcgagcacgagtggctggtgaggacagctgggggccgctggacccaccagctgcacggcctgctgctgcgggaccggggcctggccgccaagagggacttcatgagcggcttcaccgccctgcactgggccgccaagtctggagatggagagatggccctgcagctggtggaggtggcccggcgcagcggggcccctgtggatgtgaatgcccggagccatggaggctacacccccctgcacctggccgccctgcacggccatgaagatgctgctgtgctgctggtggtgcggctgggcgcccaggtgcacgtgcgggaccacagcggccggcgggcctaccagtacctgcggcccggcagcagctatgccctgcggcggctgctgggggaccccggcctgcggggcaccacagagccagatgccaccggcggcggcagcggcagcctggccgcccggcggcctgtgcaggtggccgccaccatcctgagcagcaccaccagcgccttcctgggcgtgctggctgatgacctgatgctgcaggacctggcccggggcctgaagaagagcagcagcttcagcaagttcctgagcgccagccccatggcccccaggaagaagaccaagatccggggcggcctgcctgccttcagcgagatcagcagaagacccaccccaggccccctggccggcctggtgcccagcttcccccccaccacctag

SEQ ID NO: 35503 - DNA, 2958 bp, Artificial Sequence
  Description of Artificial Sequence: Synthetic coding sequence
cagccccccctggtgcaggccatcttcagcggggaccctgaggagatccgcatgctgatccacaagacagaagatgtgaacaccctggacagcgagaagaggacccccctgcacgtggccgccttcctgggagatgctgagatcatcgagctgctgatcctgagcggggcccgggtgaatgccaaggacaacatgtggctgacccccctgcacagagctgtggccagccgctctgaggaggccgtgcaggtgctgatcaagcacagcgcagatgtgaatgcccgggacaagaactggcagacccccctgcacgtggccgccgccaacaaggctgtgaagtgtgccgaggtgatcatccccctgctgagctctgtgaatgtgtctgacagaggaggccgcacagccctgcaccacgccgccctgaatggccacgtggagatggtgaacctgctgctggccaagggggccaacatcaatgcctttgacaagaaggaccggcgggccctgcactgggccgcctacatgggccacctggatgtggtggccctgctgatcaaccacggggctgaggtgacctgcaaggacaagaagggctacacccccctgcacgccgccgccagcaatggccagatcaacgtggtgaagcacctgctgaacctgggcgtggagattgatgagatcaacgtgtatggcaacacagccctgcacatcgcctgctacaacggccaggatgctgtggtgaatgagctgattgattatggagccaacgtgaaccagcccaacaacaacggcttcacccccctgcactttgctgctgccagcacccacggggccctgtgcctggagctgctggtgaacaatggagcagatgtgaacatccagagcaaggatggcaagagccccctgcacatgacagctgtgcacggccgcttcaccaggagccagaccctcatccagaatggaggagaaattgactgtgtggacaaggatggcaacacccccctgcacgtggccgcccgctatggccacgagctgctgatcaacaccctcatcaccagcggggctgacacagccaagtgtggcatccacagcatgttccccctgcacctggccgccctgaatgcccacagcgactgctgcaggaagctgctgagcagcggctttgaaattgacaccccagacaagtttggccgcacctgcctgcatgctgctgctgctggaggaaatgtggagtgcatcaagctgctgcagagcagtggagctgacttccacaagaaggacaagtgtggccgcacccccctgcactatgctgctgccaactgccacttccactgcatcgagaccctggtgaccaccggggccaacgtgaatgaaacagatgactggggccgcacagccctgcactacgccgccgccagtgacatggacaggaacaagaccatcctgggcaatgcccatgacaacagcgaggagctggagcgggcccgggagctgaaggagaaggaggccaccctgtgcctggagttcctgctgcagaatgatgccaaccccagcatccgggacaaggagggctacaacagcatccactatgctgctgcctacggccaccggcagtgcctggagctgctgctggagaggaccaacagcggctttgaggagagtgacagcggggccaccaagagccccctgcacctggccgcctacaacggccaccaccaggccctggaggtgctgctgcagagcctggtggacctggacatcagagatgagaagggccgcacagccctggacctggccgccttcaagggccacacagaatgtgtggaggccctgatcaaccagggcgccagcatctttgtgaaggacaacgtgaccaagaggacccccctgcacgccagcgtcatcaatggccacaccctgtgcctgcggctgctgctggagattgctgacaaccctgaggccgtggatgtgaaggatgccaagggccagacccccctgatgctggccgtggcctacggccacattgatgctgtgtccctgctgctggagaaggaggccaacgtggacacagtggacatcctgggctgcacagccctgcaccggggcatcatgactggacatgaagaatgtgtgcagatgctgctggagcaggaggtgtccatcctgtgcaaggacagccggggccgcacccccctgcactatgctgctgcccggggccacgccacctggctgtctgagctgctgcagatggccctgtctgaggaggactgctgcttcaaggacaaccagggctacacccccctgcactgggcctgctacaatggaaatgaaaactgcatcgaggtgctgctggagcagaagtgcttcaggaagttcatcggcaaccccttcacccccctgcactgtgccatcatcaatgaccacggcaactgtgccagcctgctgctgggcgccatcgacagcagcatcgtgtcctgcagagatgacaagggccgcacccccctgcatgctgctgcctttgctgaccacgtggagtgcctgcagctgctgctgcggcacagcgcccctgtgaatgctgtggacaacagcggcaagacagccctgatgatggccgcagaaaatggccaggccggggctgtggacatcctggtgaacagcgcccaggccgacctgactgtgaaggacaaggacctgaacacccccctgcacctggcctgcagcaagggccacgagaagtgtgccctgctgatcctggacaagatccaggatgagagcctcatcaatgagaagaacaatgccctgcagacccccctgcacgtggccgccagaaatggcctgaaggtggtggtggaggagctgctggccaagggggcctgtgtgctggccgtggatgaaaatgccagccgcagcaatggccccaggagcaccccaggcacagctgtgcagaaggaggagtag

SEQ ID NO: 35504 - DNA, 2760 bp, Artificial Sequence
  Description of Artificial Sequence: Synthetic coding sequence
atgctgatccacaagacagaagatgtgaacaccctggacagcgagaagaggacccccctgcacgtggccgccttcctgggagatgctgagatcatcgagctgctgatcctgagcggggcccgggtgaatgccaaggacaacatgtggctgacccccctgcacagagctgtggccagccgctctgaggaggccgtgcaggtgctgatcaagcacagcgcagatgtgaatgcccgggacaagaactggcagacccccctgcacgtggccgccgccaacaaggctgtgaagtgtgccgaggtgatcatccccctgctgagctctgtgaatgtgtctgaccggggcggccgcacagccctgcaccacgccgccctgaatggacatgtggagatggtgaacctgctgctggccaagggggccaacatcaatgcctttgacaagaaggacagaagagccctgcactgggccgcctacatgggccacctggatgtggtggccctgctgatcaaccacggggctgaggtgacctgcaaggacaagaagggctacacccccctgcatgctgctgccagcaatggccagatcaacgtggtgaagcacctgctgaacctgggcgtggagattgatgagatcaacgtgtatggcaacacagccctgcacatcgcctgctacaacggccaggatgctgtggtgaatgagctgattgattatggagccaacgtgaaccagcccaacaacaacggcttcacccccctgcactttgctgctgccagcacccatggagccctgtgcctggagctgctggtgaacaacggggctgatgtgaacatccagagcaaggatggcaagagccccctgcacatgacagctgtgcacggccgcttcaccaggagccagaccctcatccagaatggaggagaaattgactgtgtggacaaggatggcaacacccccctgcacgtggccgcccgctatggccacgagctgctgatcaacaccctcatcaccagcggggctgacacagccaagtgtggcatccacagcatgttccccctgcacctggccgccctgaatgcccacagcgactgctgcaggaagctgctgagcagcggctttgaaattgacaccccagacaagtttggaagaacctgcctgcacgccgctgctgctggaggaaatgtggagtgcatcaagctgctgcagagcagcggggctgacttccacaagaaggacaagtgtggccgcacccccctgcactacgccgccgccaactgccacttccactgcatcgagaccctggtgaccactggagccaacgtgaatgaaacagatgactggggccgcacagccctgcactatgctgctgccagtgacatggacaggaacaagaccatcctgggcaatgcccatgacaacagcgaggagctggagcgggcccgggagctgaaggagaaggaggccaccctgtgcctggagttcctgctgcagaatgatgccaaccccagcatccgggacaaggagggctacaacagcatccactacgccgccgcctacggccaccggcagtgcctggagctgctgctggagaggaccaacagcggctttgaggagagtgacagcggggccaccaagagccccctgcacctggccgcctacaacggccaccaccaggccctggaggtgctgctgcagagcctggtggacctggacatcagagatgagaagggccgcacagccctggacctggccgccttcaagggccacacagaatgtgtggaggccctgatcaaccagggcgccagcatctttgtgaaggacaacgtgaccaagaggacccccctgcacgccagcgtcatcaatggccacaccctgtgcctgcggctgctgctggagattgctgacaaccctgaggccgtggatgtgaaggatgccaagggccagacccccctgatgctggccgtggcctacggccacattgatgctgtgtccctgctgctggagaaggaggccaacgtggacacagtggacatcctgggctgcacagccctgcaccggggcatcatgacaggccacgaggagtgtgtgcagatgctgctggagcaggaggtgtccatcctgtgcaaggacagccggggccgcacccccctgcactacgccgccgcccggggccacgccacctggctgtctgagctgctgcagatggccctgtctgaggaggactgctgcttcaaggacaaccagggctacacccccctgcactgggcctgctacaatggaaatgaaaactgcatcgaggtgctgctggagcagaagtgcttcaggaagttcatcggcaaccccttcacccccctgcactgtgccatcatcaatgaccacggcaactgtgccagcctgctgctgggcgccatcgacagcagcatcgtgtcctgcagagatgacaagggccgcacccccctgcacgccgccgcctttgctgaccacgtggagtgcctgcagctgctgctgcggcacagcgcccctgtgaatgctgtggacaacagcggcaagacagccctgatgatggctgctgaaaatggccaggccggggctgtggacatcctggtgaacagcgcccaggccgacctgactgtgaaggacaaggacctgaacacccccctgcacctggcctgcagcaaaggacatgagaagtgtgccctgctgatcctggacaagatccaggatgagagcctcatcaatgagaagaacaatgccctgcagacctag

SEQ ID NO: 35505 - DNA, 2760 bp, Artificial Sequence
  Description of Artificial Sequence: Synthetic coding sequence
ctgctgatctacaagacagagatcatcagcaccctggacagcgagaagaggacccccctgcacgtggccgccttcctgggagatgctgagatcatcgagctgctgatcctgagcggggcccgggtgaatgccaaggacaacatgtggctgacccccctgcacagagctgtggccagccgctctgaggaggccgtgcaggtgctgatcaagcacagcgcagatgtgaatgcccgggacaagaactggcagacccccctgcacgtggccgccgccaacaaggctgtgaagtgtgccgaggtgatcatccccctgctgagctctgtgaatgtgtctgaccggggcggccgcacagccctgcaccacgccgccctgaatggacatgtggagatggtgaacctgctgctggccaagggggccaacatcaatgcctttgacaagaaggacagaagagccctgcactgggccgcctacatgggccacctggatgtggtggccctgctgatcaaccacggggctgaggtgacctgcaaggacaagaagggctacacccccctgcatgctgctgccagcaatggccagatcaacgtggtgaagcacctgctgaacctgggcgtggagattgatgagatcaacgtgtatggcaacacagccctgcacatcgcctgctacaacggccaggatgctgtggtgaatgagctgattgattatggagccaacgtgaaccagcccaacaacaacggcttcacccccctgcactttgctgctgccagcacccatggagccctgtgcctggagctgctggtgaacaacggggctgatgtgaacatccagagcaaggatggcaagagccccctgcacatgacagctgtgcacggccgcttcaccaggagccagaccctcatccagaatggaggagaaattgactgtgtggacaaggatggcaacacccccctgcacgtggccgcccgctatggccacgagctgctgatcaacaccctcatcaccagcggggctgacacagccaagtgtggcatccacagcatgttccccctgcacctggccgccctgaatgcccacagcgactgctgcaggaagctgctgagcagcggctttgaaattgacaccccagacaagtttggaagaacctgcctgcacgccgctgctgctggaggaaatgtggagtgcatcaagctgctgcagagcagcggggctgacttccacaagaaggacaagtgtggccgcacccccctgcactacgccgccgccaactgccacttccactgcatcgagaccctggtgaccactggagccaacgtgaatgaaacagatgactggggccgcacagccctgcactatgctgctgccagtgacatggacaggaacaagaccatcctgggcaatgcccatgacaacagcgaggagctggagcgggcccgggagctgaaggagaaggaggccaccctgtgcctggagttcctgctgcagaatgatgccaaccccagcatccgggacaaggagggctacaacagcatccactacgccgccgcctacggccaccggcagtgcctggagctgctgctggagaggaccaacagcggctttgaggagagtgacagcggggccaccaagagccccctgcacctggccgcctacaacggccaccaccaggccctggaggtgctgctgcagagcctggtggacctggacatcagagatgagaagggccgcacagccctggacctggccgccttcaagggccacacagaatgtgtggaggccctgatcaaccagggcgccagcatctttgtgaaggacaacgtgaccaagaggacccccctgcacgccagcgtcatcaatggccacaccctgtgcctgcggctgctgctggagattgctgacaaccctgaggccgtggatgtgaaggatgccaagggccagacccccctgatgctggccgtggcctacggccacattgatgctgtgtccctgctgctggagaaggaggccaacgtggacacagtggacatcctgggctgcacagccctgcaccggggcatcatgacaggccacgaggagtgtgtgcagatgctgctggagcaggaggtgtccatcctgtgcaaggacagccggggccgcacccccctgcactacgccgccgcccggggccacgccacctggctgtctgagctgctgcagatggccctgtctgaggaggactgctgcttcaaggacaaccagggctacacccccctgcactgggcctgctacaatggaaatgaaaactgcatcgaggtgctgctggagcagaagtgcttcaggaagttcatcggcaaccccttcacccccctgcactgtgccatcatcaatgaccacggcaactgtgccagcctgctgctgggcgccatcgacagcagcatcgtgtcctgcagagatgacaagggccgcacccccctgcacgccgccgcctttgctgaccacgtggagtgcctgcagctgctgctgcggcacagcgcccctgtgaatgctgtggacaacagcggcaagacagccctgatgatggctgctgaaaatggccaggccggggctgtggacatcctggtgaacagcgcccaggccgacctgactgtgaaggacaaggacctgaacacccccctgcacctggcctgcagcaaaggacatgagaagtgtgccctgctgatcctggacaagatccaggatgagagcctcatcaatgagaagaacaatgccctgcagacctag

SEQ ID NO: 35506 - DNA, 1740 bp, Artificial Sequence
  Description of Artificial Sequence: Synthetic coding sequence
atggctgtgctgaagctgacagaccagccccccctggtgcaggccatcttcagcggggaccctgaggagatccgcatgctgatccacaagacagaagatgtgaacaccctggacagcgagaagaggacccccctgcacgtggccgccttcctgggagatgctgagatcatcgagctgctgatcctgagcggggcccgggtgaatgccaaggacaacatgtggctgacccccctgcacagagctgtggccagccgctctgaggaggccgtgcaggtgctgatcaagcacagcgcagatgtgaatgcccgggacaagaactggcagacccccctgcacgtggccgccgccaacaaggctgtgaagtgtgccgaggtgatcatccccctgctgagctctgtgaatgtgtctgacagaggaggccgcacagccctgcaccacgccgccctgaatggccacgtggagatggtgaacctgctgctggccaagggggccaacatcaatgcctttgacaagaaggaccggcgggccctgcactgggccgcctacatgggccacctggatgtggtggccctgctgatcaaccacggggctgaggtgacctgcaaggacaagaagggctacacccccctgcacgccgccgccagcaatggccagatcaacgtggtgaagcacctgctgaacctgggcgtggagattgatgagatcaacgtgtatggcaacacagccctgcacatcgcctgctacaacggccaggatgctgtggtgaatgagctgattgattatggagccaacgtgaaccagcccaacaacaacggcttcacccccctgcactttgctgctgccagcacccacggggccctgtgcctggagctgctggtgaacaatggagcagatgtgaacatccagagcaaggatggcaagagccccctgcacatgacagctgtgcacggccgcttcaccaggagccagaccctcatccagaatggaggagaaattgactgtgtggacaaggatggcaacacccccctgcacgtggccgcccgctatggccacgagctgctgatcaacaccctcatcaccagcggggctgacacagccaagtgtggcatccacagcatgttccccctgcacctggccgccctgaatgcccacagcgactgctgcaggaagctgctgagcagcggctttgaaattgacaccccagacaagtttggccgcacctgcctgcatgctgctgctgctggaggaaatgtggagtgcatcaagctgctgcagagcagtggagctgacttccacaagaaggacaagtgtggccgcacccccctgcactatgctgctgccaactgccacttccactgcatcgagaccctggtgaccaccggggccaacgtgaatgaaacagatgactggggccgcacagccctgcactacgccgccgccagtgacatggacaggaacaagaccatcctgggcaatgcccatgacaacagcgaggagctggagcgggcccgggagctgaaggagaaggaggccaccctgtgcctggagttcctgctgcagaatgatgccaaccccagcatccgggacaaggagggctacaacagcatccactatgctgctgcctacggccaccggcagtgcctggagctggtgtcctgctttgtgctcttcagcctgacccacacccacacccacacccccaaccaccggggcatcaactgcttcttccctgagctgtag

SEQ ID NO: 35507 - DNA, 1104 bp, Artificial Sequence
  Description of Artificial Sequence: Synthetic coding sequence
atggctgtgctgaagctgacagaccagccccccctggtgcaggccatcttcagcggggaccctgaggagatccgcatgctgatccacaagacagaagatgtgaacaccctggacagcgagaagaggacccccctgcacgtggccgccttcctgggagatgctgagatcatcgagctgctgatcctgagcggggcccgggtgaatgccaaggacaacatgtggctgacccccctgcacagagctgtggccagccgctctgaggaggccgtgcaggtgctgatcaagcacagcgcagatgtgaatgcccgggacaagaactggcagacccccctgcacgtggccgccgccaacaaggctgtgaagtgtgccgaggtgatcatccccctgctgagctctgtgaatgtgtctgacagaggaggccgcacagccctgcaccacgccgccctgaatggccacgtggagatggtgaacctgctgctggccaagggggccaacatcaatgcctttgacaagaaggaccggcgggccctgcactgggccgcctacatgggccacctggatgtggtggccctgctgatcaaccacggggctgaggtgacctgcaaggacaagaagggctacacccccctgcacgccgccgccagcaatggccagatcaacgtggtgaagcacctgctgaacctgggcgtggagattgatgagatcaacgtgtatggcaacacagccctgcacatcgcctgctacaacggccaggatgctgtggtgaatgagctgattgattatggagccaacgtgaaccagcccaacaacaacggcttcacccccctgcactttgctgctgccagcacccacggggccctgtgcctggagctgctggtgaacaatggagcagatgtgaacatccagagcaaggatggcaagagccccctgcacatgacagctgtgcacggccgcttcaccaggagccagaccctcatccagaatggaggagaaattgactgtgtggacaaggatggcaacacccccctgcacgtggccgcccgctatggccacgagctgctgatcaacaccctcatcaccagcggggctgacacagccaagtag

SEQ ID NO: 35508 - DNA, 2760 bp, Artificial Sequence; identical to SEQ ID NO: 35504
  Description of Artificial Sequence: Synthetic coding sequence

SEQ ID NO: 35509 - DNA, 1524 bp, Artificial Sequence
  Description of Artificial Sequence: Synthetic coding sequence
atgtggctgacccccctgcacagagctgtggccagccgctctgaggaggccgtgcaggtgctgatcaagcacagcgcagatgtgaatgcccgggacaagaactggcagacccccctgcacgtggccgccgccaacaaggctgtgaagtgtgccgaggtgatcatccccctgctgagctctgtgaatgtgtctgacagaggaggccgcacagccctgcaccacgccgccctgaatggccacgtggagatggtgaacctgctgctggccaagggggccaacatcaatgcctttgacaagaaggaccggcgggccctgcactgggccgcctacatgggccacctggatgtggtggccctgctgatcaaccacggggctgaggtgacctgcaaggacaagaagggctacacccccctgcacgccgccgccagcaatggccagatcaacgtggtgaagcacctgctgaacctgggcgtggagattgatgagatcaacgtgtatggcaacacagccctgcacatcgcctgctacaacggccaggatgctgtggtgaatgagctgattgattatggagccaacgtgaaccagcccaacaacaacggcttcacccccctgcactttgctgctgccagcacccacggggccctgtgcctggagctgctggtgaacaatggagcagatgtgaacatccagagcaaggatggcaagagccccctgcacatgacagctgtgcacggccgcttcaccaggagccagaccctcatccagaatggaggagaaattgactgtgtggacaaggatggcaacacccccctgcacgtggccgcccgctatggccacgagctgctgatcaacaccctcatcaccagcggggctgacacagccaagtgtggcatccacagcatgttccccctgcacctggccgccctgaatgcccacagcgactgctgcaggaagctgctgagcagcggctttgaaattgacaccccagacaagtttggccgcacctgcctgcatgctgctgctgctggaggaaatgtggagtgcatcaagctgctgcagagcagtggagctgacttccacaagaaggacaagtgtggccgcacccccctgcactatgctgctgccaactgccacttccactgcatcgagaccctggtgaccaccggggccaacgtgaatgaaacagatgactggggccgcacagccctgcactacgccgccgccagtgacatggacaggaacaagaccatcctgggcaatgcccatgacaacagcgaggagctggagcgggcccgggagctgaaggagaaggaggccaccctgtgcctggagttcctgctgcagaatgatgccaaccccagcatccgggacaaggagggctacaacagcatccactatgctgctgcctacggccaccggcagtgcctggagctggtgtcctgctttgtgctcttcagcctgacccacacccacacccacacccccaaccaccggggcatcaactgcttcttccctgagctgtag

SEQ ID NO: 35510 - DNA, 801 bp, Artificial Sequence
  Description of Artificial Sequence: Synthetic coding sequence
atggagagcgagggccccccagagagcgagagcagcgagttcttcagccagcaggaggaggagaatgaggaggaggaggcccaggagcctgaggagaccggccccaagaaccccctgctgcagcctgccctgactggagatgtggagggcctgcagaagatctttgaggaccctgagaacccccaccacgagcaggccatgcagctgctgctggaggaggacatcgtgggcaggaacctgctgtatgctgcctgcatggccggccagagtgatgtgatccgggccctggccaagtatggagtgaacctgaatgagaagaccacccggggctacaccctgctgcactgtgccgccgcctggggccgcctggagaccctgaaggccctggtggagctggatgtggacatcgaggccctgaacttccgggaggagcgggccagagatgtggccgcccgctacagccagacagaatgtgtggagttcctggactgggcagatgcccggctgaccctgaagaagtacatcgccaaggtgtccctggccgtgacagacacagagaagggcagcggcaagctgctgaaggaggacaagaacaccatcctgagcgcctgccgggccaagaatgagtggctggagacccacacagaggccagcatcaatgagctgtttgagcagaggcagcagctggaggacatcgtgacccccatcttcaccaagatgaccaccccctgccaggtgaagagcgccaagtctgtgaccagccatgaccagaagaggagccaggatgacaccagcaactag

SEQ ID NO: 35511 - DNA, 2331 bp, Artificial Sequence
  Description of Artificial Sequence: Synthetic coding sequence
atggccctggccgacaagaggctggagaacctgcagatctacaaggtgctgcagtgtgtgaggaacaaggacaagaagcagatcgagaagctgaccaagctgggctacccagagctgatcaactacacagagcccatcaatggcctgagcgccctgcacctggcctctgtgtccaatgacatcgacatggtgtccttcctgctggacctgggcgcccacccagatgtgcaggacaggatgggctgcacccccaccatgagagctgctgagctgggccacgagctgtccatggagatcctggccaaggccaaggctgacatgaccatcgtggacaatgaaggaaaaggagtgctcttctactgcatcctgcccaccaagaggcactaccgctgtgccctgattgccctggagcacggggctgatgtgaacaacagcacctatgagggcaagcccatcttcctgcgggcctgtgaagatgcccatgatgtgaaggatgtgtgcctgaccttcctggagaagggggccaaccccaatgccatcaacagcagcacaggccgcacagccctgatggaggccagccgggagggcgtggtggagatcgtgcggggcatcctggagcggggcggggaggtgaatgcctttgacaatgacagacaccacgccgcccactttgctgccaagggcggcttctttgacatcctgaagctgctgtttgcctacaatggagatgtgggcctcatcagcatcaatggaaacacccccctgcactacgccgccatgggcggctttgctgactgctgcaagtacatcgcccagaggggctgtgacctgaagtggaagaacctggaccacaagacccccagggctgtggccaaggagggcggcttcaaggccgccagcaaggagatccggcgggcagagagaattgccaacaagctggcccggcctggggccaagaaccccaaccccctgtgggccctgcggctgcatgactggagcgtggagcgggaggccttcctgcgggaggcctttgctgtgctggacagaggagatggcagcatcagcaagaatgactttgtgatggtgctggaggagcggcaggactatgccagcagcgagcagctggccgccatcgcccacctgcacgagaagacccggggcggcggcgtgaacatcaatgagttcttcaagggcacccgctacctgaacaagagctttgtgctgggcagctatggccccaagaagaaggagaagggcatgggcaagaagggcaagaagggcaagtttgtgctgcccctgcccatctgtgtgatcccagaatatgccttcccccggcggcaggacggcggccccccctactacatgattgagacctacaagaatgtgacagacagcagccgcttcaacagagaccaccccccagagcaccccatccaggatgacagcgtgtggtacattgatgattctgagaaggtgttcagcaacatcaacatcatcaccaaggccggggacctggccagcctgaagaaggcctttgagagcggcatccctgtggacatgaaggacaactactacaagacccccctgatgacagcctgtgccagcggcaacattgatgtggtgaagttcctgctggagaagggggccaacgtgaatgccacagacaacttcctgtggacccccctgcactttgcctgccacgccggccagcaggacatcgtggagctgctggtggagagcggggccctgattgatgctgccagcatcaacaacagcacccccctgaacagagccatcgagagctgccgcctggacacagtgaagtacctgctggacattggagccaagttccagctggagaacaggaagggccacagcgccatggatgtggccaaggcctatgctgactaccgcatcatcgacctgatcaaggagaagctggacaacctgcccaagccagctgagaaccagaagctgaagggcaagaccccacccatcctgaagacagagggccctgagatcaagaaggaggaggagctgctgagcagcatctatggagtgcccaccaccagcgagggcaagaaggtgcagaagggaaatgtggtgcacctgaacagcctcatcaccagcggctacaccaagaaggtggacatcaccttcatcccccggcgcatctggagccctgaggccaccacagctgagctgatcaggaagcgggagctgcggcgggagcgcttcacccatgaggtggactttgatgacttcatgatgcccttccagaagaacatcacagagaaggcccgggccctggaggccgccctgaagacctag

SEQ ID NO: 35512 - DNA, 2331 bp, Artificial Sequence; identical to SEQ ID NO: 35511
  Description of Artificial Sequence: Synthetic coding sequence

SEQ ID NO: 35513 - DNA, 4290 bp, Artificial Sequence
  Description of Artificial Sequence: Synthetic coding sequence
atgaccaacccctgggaggagaaggtgtgcaagatggcccagaccagcctgctgcagggcaagcagttctactgccgggagtgggtgttccacaagctgcagcactgcctgcaggagaagagcaactgctgcaacagcgctgtgaatgcccccagcctggtgatgaacagcggcaacaatgccagcggcgtgtctggaaaaggagctgcctggggcgtgctgctggtgggcggccctggcagcggcaagacagccctgtgcacagagctgctgtggcccagcagccctgccagcctgcagaggggcctgcaccggcaggccctggccttccacttctgcaaggcccaggacagcgacaccctgtgtgtgggcggcttcatccggggcctggtggcccagatctgccgcagcggcctgctgcagggctatgaggacaagctgcgggaccctgctgtgcagagcctgctgcagcccggggagtgtgaaagaaatcctgctgaggccttcaagagatgtgtgctgctgcccctgctgggcatgaagccaccccagcagagcctgtacctgctggtggacagcgtggatgagggctgcaacatcacagaaggagagcagaccagcaccagcctgtctggaacagtggccgccctgctggccggccaccacgagttcttccccccctggctgctgctgctgtgcagcgccaggaagcagagcaaggctgtgaccaagatgttcaccggcttcaggaagatcagcctggatgacctgaggaaggcctacatcgtgaaggatgtgcagcagtacatcctgcaccggctggaccaggaggaggccctgcggcagcacctgaccaaggagacagctgagatgctgaaccagctgcacatcaagagcagcggctgcttcctgtacctggagcgggtgctggatggagtggtggagaacttcatcatgctgcgggagatccgggacatccctggcaccctgaatggcctgtacctgtggctgtgccagaggctgtttgtgaggaagcagtttgccaaggtgcagcccatcctgaatgtcatcctggccgcctgccggcccctgaccatcacagagctgtaccacgctgtgtggaccaagaacatgagcctgaccctggaggacttccagaggaagctggacatcctgagcaagctgctggtggatggcctgggcaacaccaagatcctcttccactacagctttgctgagtggctgctggatgtgaagcactgcacccagaagtacctgtgcaatgctgctgagggccacaggatgctggccatgagctacacctgccaggccaagaacctgacccccctggaggcccaggagtttgccctgcacctgatcaacagcaacctgcagctggagacagctgagctggccctgtggatgatctggaatggcacccctgtgcgggacagcctgagcaccctcatccccaaggagcaggaggtgctgcagctgctggtgaaggccggggcccacgtgaacagtgaagatgacaggaccagctgcatcgtgcggcaggccctggagagagaagattccatccgcaccctgctggacaacggggcctctgtgaaccagtgtgacagcaatggccgcaccctgctggccaatgctgcctacagcggcagcctggatgtggtgaacctgctggtgtccagaggagctgacctggagattgaagatgcccacggccacacccccctgaccctggccgcccggcagggccacaccaaggtggtgaactgcctgattggctgtggggccaacatcaaccacacagaccaggacggctggacagccctgcggtctgctgcctggggcggccacacagaggtggtgtctgccctgctgtatgccggcgtgaaggtggactgtgctgatgctgacagcaggacagccctgcgggctgctgcctggggcggccatgaagatattgtgctgaacctgctgcagcacggggctgaggtgaacaaggctgacaatgaaggccgcacagccctgattgctgctgcctacatgggccaccgggagatcgtggagcacctgctggaccatggagctgaggtgaaccatgaagatgtggatggccgcacagccctgtctgtggccgccctgtgtgtgcctgccagcaaaggacatgcctctgtggtgtccctgctgattgacagaggagctgaggtggaccactgtgacaaggatggcatgacccccctgctggtggccgcctatgagggccacgtggatgtggtggacctgctgctggagggcggcgcagatgtggaccacacagacaacaacggccgcacccccctgctggccgccgcctccatgggccacgcctctgtggtgaacaccctgctcttctggggcgctgctgtggacagcattgacagcgagggccgcacagtgctgagcatcgccagcgcccagggcaatgtggaggtggtgaggaccctgctggaccggggcctggatgagaaccacagagatgatgctggctggacccccctgcacatggccgcctttgagggccacaggctcatctgtgaggccctgattgagcagggcgcccggaccaatgaaattgacaatgatggccgcatccccttcatcctggccagccaggagggccactatgactgtgtgcagatcctgctggagaacaagagcaacatcgaccagaggggctatgatggaagaaatgccctgcgggtggccgccctggagggccaccgggacatcgtggagctgctcttcagccatggagcagatgtgaactgcaaggatgctgatggccggcccaccctgtacatcctggccctggagaaccagctgaccatggccgagtacttcctggagaatggagccaacgtggaggccagtgatgctgagggccgcacagccctgcacgtgtcctgctggcagggccacatggagatggtgcaggtgctgattgcctaccacgcagatgtgaatgctgctgacaatgagaagaggtctgccctgcagagcgctgcctggcagggccacgtgaaggtggtgcagctgctgattgagcacggggctgtggtggaccacacctgcaaccagggcgccacagccctgtgcatcgccgcccaggagggccacattgatgtggtgcaggtgctgctggagcacggggctgaccccaaccacgccgaccagtttggaagaacagccatgagggtggccgccaagaatggccacagccagatcatcaagctgctggagaagtacggggccagcagcctgaatggctgcagccccagccctgtgcacaccatggagcagaagcccctgcagagcctgagcagcaaggtgcagagcctgaccatcaagagcaacagcagcggcagcactggaggaggagacatgcagcccagcctgcggggcctgcccaacggccccacccacgccttcagcagccccagcgagagcccagacagcacagtggaccggcagaagagcagcctgagcaacaacagcctgaagagcagcaagaacagcagcctgcggaccaccagcagcacagccacagcccagacagtgcccatcgacagcttccacaacctgtccttcacagagcagatccagcagcacagcctgcccaggagccgcagccggcagagcatcgtgagccccagcagcaccacccagagcctgggccagagccacaacagccccagcagcgagtttgagtggagccaggtgaagcccagcctgaagagcaccaaggccagcaaaggaggcaagtctgagaacagcgccaagagcggcagcgctgggaagaaggccaagcagagcaacagcagccagcccaaggtgctggagtatgagatgacccagtttgaccggcggggccccatcgccaagtctggaacagctgccccacccaagcagatgcctgctgagagccagtgcaagatcatgatccccagcgcccagcaggagatcggccgcagccagcagcagttcctgatccaccagcagagcggggagcagaagaagagaaatggcatcatgaccaaccccaactaccacctgcagagcaaccaggtgttcctgggccgggtgtctgtgcccaggaccatgcaggaccggggccaccaggaggtgctggagggctaccccagcagcgagacagagctgagcctgaagcaggccctgaagctgcagatcgagggcagtgaccccagcttcaactacaagaaggagacccccctgtag

SEQ ID NO: 35514 - DNA, 3753 bp, Artificial Sequence
  Description of Artificial Sequence: Synthetic coding sequence
atgaagccaccccagcagagcctgtacctgctggtggacagcgtggatgagggctgcaacatcacagaaggagagcagaccagcaccagcctgagcggcaccgtggccgccctgctggccggccaccacgagttcttccccccctggctgctgctgctgtgcagcgccaggaagcagagcaaggctgtgaccaagatgttcaccggcttcaggaagatcagcctggatgacctgaggaaggcctacatcgtgaaggatgtgcagcagtacatcctgcaccggctggaccaggaggaggccctgcggcagcacctgaccaaggagacagctgagatgctgaaccagctgcacatcaagagcagcggctgcttcctgtacctggagcgggtgctggatggagtggtggagaacttcatcatgctgcgggagatccgggacatccctggcaccctgaatggcctgtacctgtggctgtgccagaggctgtttgtgaggaagcagtttgccaaggtgcagcccatcctgaatgtcatcctggccgcctgccggcccctgaccatcacagagctgtaccacgctgtgtggaccaagaacatgagcctgaccctggaggacttccagaggaagctggacatcctgagcaagctgctggtggatggcctgggcaacaccaagatcctcttccactacagctttgctgagtggctgctggatgtgaagcactgcacccagaagtacctgtgcaatgctgctgagggccacaggatgctggccatgagctacacctgccaggccaagaacctgacccccctggaggcccaggagtttgccctgcacctgatcaacagcaacctgcagctggagacagctgagctggccctgtggatgatctggaatggcacccctgtgcgggacagcctgagcaccctcatccccaaggagcaggaggtgctgcagctgctggtgaaggccggggcccacgtgaacagtgaagatgacaggaccagctgcatcgtgcggcaggccctggagcgggaggacagcatccgcaccctgctggacaatggagcctctgtgaaccagtgtgacagcaatggaagaaccctgctggccaatgctgcctacagcggcagcctggatgtggtgaacctgctggtgtccagaggagctgacctggagattgaagatgcccacggccacacccccctgaccctggccgcccggcagggccacaccaaggtggtgaactgcctgattggctgtggggccaacatcaaccacacagaccaggacggctggacagccctgcggtctgctgcctggggcggccacacagaggtggtgtctgccctgctgtatgctggggtgaaggtggactgtgctgatgctgacagcaggacagccctgcgggccgccgcctggggcggccacgaggacatcgtgctgaacctgctgcagcacggggctgaggtgaacaaggctgacaatgaaggaagaacagccctgattgctgctgcctacatgggccaccgggagatcgtggagcacctgctggaccacggggctgaggtgaaccatgaagatgtggatggccgcacagccctgtctgtggccgccctgtgtgtgcctgccagcaagggccacgcctctgtggtgtccctgctgattgacagaggagctgaggtggaccactgtgacaaggatggcatgacccccctgctggtggccgcctatgagggccacgtggatgtggtggacctgctgctggagggcggcgcagatgtggaccacacagacaacaatggaagaacacccctgctggccgccgcctccatgggccacgcctctgtggtgaacaccctgctcttctggggcgctgctgtggacagcattgattctgagggccgcacagtgctgagcatcgccagcgcccagggcaatgtggaggtggtgaggaccctgctggaccggggcctggatgagaaccacagagatgatgctggctggacccccctgcacatggccgcctttgagggccacaggctcatctgtgaggccctgattgagcagggcgcccggaccaatgaaattgacaatgatggccgcatccccttcatcctggccagccaggagggccactatgactgtgtgcagatcctgctggagaacaagagcaacatcgaccagaggggctatgatggaagaaatgccctgcgggtggccgccctggagggccaccgggacatcgtggagctgctcttcagccacggggctgatgtgaactgcaaggatgctgatggccggcccaccctgtacatcctggccctggagaaccagctgaccatggccgagtacttcctggagaatggagccaacgtggaggccagtgatgctgagggccgcacagccctgcacgtgtcctgctggcagggccacatggagatggtgcaggtgctgattgcctaccacgcagatgtgaatgctgctgacaatgagaagaggtctgccctgcagagcgctgcctggcagggccacgtgaaggtggtgcagctgctgattgaacatggagctgtggtggaccacacctgcaaccagggcgccacagccctgtgcatcgccgcccaggagggccacattgatgtggtgcaggtgctgctggagcacggggctgaccccaaccacgccgaccagtttggccgcacagccatgagggtggccgccaagaatggccacagccagatcatcaagctgctggagaagtatggagccagcagcctgaatggctgcagccccagccctgtgcacaccatggagcagaagcccctgcagagcctgagcagcaaggtgcagagcctgaccatcaagagcaacagcagcggcagcactggaggaggagacatgcagcccagcctgcggggcctgcccaacggccccacccacgccttcagcagccccagcgagagcccagacagcacagtggaccggcagaagagcagcctgagcaacaacagcctgaagagcagcaagaacagcagcctgcggaccaccagcagcacagccacagcccagacagtgcccatcgacagcttccacaacctgtccttcacagagcagatccagcagcacagcctgcccaggagccgcagccggcagagcatcgtgagccccagcagcaccacccagagcctgggccagagccacaacagccccagcagcgagtttgagtggagccaggtgaagcccagcctgaagagcaccaaggccagcaagggcggcaagtcagaaaattctgccaagagcggcagcgctgggaagaaggccaagcagagcaacagcagccagcccaaggtgctggagtatgagatgacccagtttgacagaagaggccccatcgccaagagcggcacagctgccccacccaagcagatgcctgctgagagccagtgcaagatcatgatccccagcgcccagcaggagatcggccgcagccagcagcagttcctgatccaccagcagagcggggagcagaagaagagaaatggcatcatgaccaaccccaactaccacctgcagagcaaccaggtgttcctgggccgggtgtctgtgcccaggaccatgcaggaccggggccaccaggaggtgctggagggctaccccagcagcgagacagagctgagcctgaagcaggccctgaagctgcagatcgagggcagtgaccccagcttcaactacaagaaggagacccccctgtag

SEQ ID NO: 35515 - DNA, 3231 bp, Artificial Sequence
  Description of Artificial Sequence: Synthetic coding sequence
atgggcatcctgagcatcacagaccagccccccctggtgcaggccatcttcagcagagatgtggaggaggtgcgcagcctgctgagccagaaggagaacatcaacgtgctggaccaggagaggaggacccccctgcatgctgctgcctacgtgggagatgtgcccatcctgcagctgctgctgatgtctggggccaacgtgaatgccaaggacaccctgtggctgacccccctgcacagagctgctgccagcagaaatgagaaggtgctgggcctgctgctggcccacagcgcagatgtgaatgcccgggacaagctgtggcagacccccctgcacgtggccgccgccaacagagccaccaagtgtgccgaggccctggcccccctgctgagcagcctgaatgtggccgacagaagtggccgcagcgccctgcaccacgctgtgcacagcggccacctggagaccgtgaacctgctgctgaacaagggggccagcctgaatgtgtgtgacaagaaggagcggcagcccctgcactgggccgccttcctgggccacctggaggtgctgaagctgctggtggcccggggagctgacctgggctgcaaggacaggaagggctacggcctgctgcacacagctgctgccagcggccagatcgaggtggtgaagtacctgctgaggatgggcgctgagattgatgagcccaatgccttcggcaacacagccctgcacatcgcctgctacctgggccaggatgctgtggccatcgagctggtgaatgctggggccaacgtgaaccagcccaatgacaagggcttcacccccctgcacgtggccgctgtgtccaccaacggggccctgtgcctggagctgctggtgaacaatggagcagatgtgaactaccagagcaaggagggcaagagccccctgcacatggccgccatccacggccgcttcaccaggagccagatcctgatccagaatggcagcgagattgactgtgccgacaagtttggaaacacccccctgcacgtggccgcccgctatggccacgagctgctgatcagcaccctgatgaccaatggagctgacacagcccggcggggcatccatgacatgttccccctgcacctggccgtgctgtttggcttcagtgactgctgcaggaagctgctgagcagcggccagctgtacagcatcgtgagcagcctgagcaatgagcacgtgctgtctgctggctttgacatcaacaccccagacaacctgggccgcacctgcctgcatgctgctgccagcggcggcaatgtggagtgcctgaacctgctgctgagcagtggagctgacctgcggcggcgggacaagtttggaagaacacccctgcactatgctgctgccaacggcagctaccagtgtgctgtgaccctggtgacagctggggccggcgtgaatgaagctgactgcaagggctgcagccccctgcactacgccgccgccagtgacacctacagaagagctgagccccacacccccagcagccatgatgctgaagaagatgagcccctgaaggagagcaggaggaaggaggccttcttctgcctggagttcctgctggacaatggagctgaccccagcctgcgggaccggcagggctacacagctgtgcactatgctgctgcctacggcaaccggcagaacctggagctgctgctggagatgtccttcaactgcctggaggatgtggagagcaccatccctgtgagccccctgcacctggccgcctacaacggccactgtgaggccctgaagaccctggccgagaccctggtgaacctggatgtgcgggaccacaagggccgcacagccctcttcctggccacagagcggggcagcacagaatgtgtggaggtgctgacagcccacggggccagcgccctgatcaaggagaggaagaggaagtggacccccctgcacgccgccgccgccagcggccacacagacagcctgcacctgctgattgacagcggggagagagctgacatcacagatgtgatggatgcctacggccagacccccctgatgctggccatcatgaatggccacgtggactgtgtgcacctgctgctggagaagggcagcacagcagatgctgctgacctgcggggccgcacagccctgcacagaggagctgtgacaggctgtgaggactgcctggccgccctgctggaccatgatgcctttgtgctgtgccgggacttcaagggccgcacccccatccacctggccagcgcctgtggccacacagctgtgctgcggaccctgctgcaggccgccctgagcacagaccccctggatgctggggtggactacagcggctacagccccatgcactgggccagctacacaggccacgaggactgcctggagctgctgctggagcacagccccttctcctacctggagggcaaccccttcacccccctgcactgtgccgtcatcaacaaccaggacagcaccacagagatgctgctgggcgccctgggcgccaagatcgtgaacagcagagatgccaagggccgcacccccctgcacgccgccgcctttgctgacaacgtgtctggcctgaggatgctgctgcagcaccaggccgaggtgaatgccacagaccacacaggccgcacagccctgatgacagctgctgaaaatggccagacagctgctgtggagttcctgctgtaccggggcaaggctgacctgactgtgctggatgagaacaagaacacagccctgcacctggcctgcagcaaaggacatgagaagtgtgccctgatgatcctggccgagacccaggacctgggcctcatcaatgccaccaacagcgccctgcagatgcccctgcacatcgccgccagaaatggcctggcctctgtggtgcaggccctgctgagccatggagccaccgtgctggccgtggatgaggagggccacaccccagccctggcctgtgcccccaacaaggatgtggccgactgcctggccctgatcctgagcaccatgaagcccttcccccccaaggatgctgtgagccccttctccttcagcctgctgaagaactgcagcattgctgctgccaagacagtgggcggctgtggggccctgccccacggggccagctgcccctacagccaggagaggcctggggccatcggcctggatggctgctacagcgagtag

SEQ ID NO: 35516 - DNA, 3231 bp, Artificial Sequence; identical to SEQ ID NO: 35515
  Description of Artificial Sequence: Synthetic coding sequence

SEQ ID NO: 35517 - DNA, 1032 bp, Artificial Sequence
  Description of Artificial Sequence: Synthetic coding sequence
atggccagcgctggcagcacagccaggagagctggcagcggctcctggcacagcgagcggggggagggccgcggggcccggccccagcccaccccatctggctccatgcagcaggccaacaaggtgtccctgaaggccacctggacagatgctgagagcaagcagcccagccagcccctgcctgacctggccgaccacctgagcgcccaggccacagccctggcccggccccggcggcctgccagcctgaccccacccagggctgaccccagccccagcaaggagagtgaccagacagccatcgaccagacagccatcggcagctactaccagctgtttgctgctgctgtgggcaatgtggagtggctgcgcttctgcctgaaccagagcctgcgggagatccccacagatgacaagggcttcaccgccatccactttgctgcccagtggggcaagctggcctgcctgcaggtgctggtggaggagtacaagtttcctgtggacctgctgaccaacaacagccagacccccctgcacctggtgatccaccgggacaacaccaccgtggccctgccctgcatctactacctgctggagaagggagctgacctgaatgcccagacctgcaatggcagcacccccctgcacctggccgccagagatggcctgctggactgtgtgaaggtgctggtgcagagcggggccaacgtgcacgcccaggatgccatgggctacaagcccatcgacttctgcaagatctggaaccaccgggcctgtgcccgcttcctgaaggatgccatgtggaagaaggacaagaaggactttgcccgggagatgaccaagatgaagatgttcaagagccagctgaccctgatggagcacaactacctgattgagtaccagggccagggctgcagcgtgcacttcccctttgccttcagccccatcaccccagagaccctgctgtggcaggacatcagcctgctgagtgactgtggcttcctgtggaggcggcgggagctgtccttctag

SEQ ID NO: 35518 - DNA, 1593 bp, Artificial Sequence
  Description of Artificial Sequence: Synthetic coding sequence
atggccagcgctggcagcacagccaggagagctggcagcggctcctggcacagcgagcggggggagggccgcggggcccggccccagcccaccccatctggctccatgcagcaggccaacaaggtgtccctgaaggccacctggacagatgctgagagcaagcagcccagccagcccctgcctgacctggccgaccacctgagcgcccaggccacagccctggcccggccccggcggcctgccagcctgaccccacccagggctgaccccagccccagcaaggagagtgaccagacagccatcgaccagacagccatcggcagctactaccagctgtttgctgctgctgtgggcaatgtggagtggctgcgcttctgcctgaaccagagcctgcgggagatccccacagatgacaagggcttcaccgccatccactttgctgcccagtggggcaagctggcctgcctgcaggtgctggtggaggagtacaagtttcctgtggacctgctgaccaacaacagccagacccccctgcacctggtgatccaccgggacaacaccaccgtggccctgccctgcatctactacctgctggagaagggagctgacctgaatgcccagacctgcaatggcagcacccccctgcacctggccgccagagatggcctgctggactgtgtgaaggtgctggtgcagagcggggccaacgtgcacgcccaggatgccatgggctacaagcccatcgacttctgcaagatctggaaccaccgggcctgtgcccgcttcctgaaggatgccatgtggaagaaggacaagaaggactttgcccgggagatgaccaagatgaagatgttcaagagccagctgaccctgatggagcacaactacctgattgagtaccagaaggagcacaagatcctgcgggaggccgccatcaggaagtggctgcacggcaagctgcaccctggccacagcctggtgagcaacaccaagcaggcccgggccacagccctgagcaagaccccagagcagcgggagagccagaggagccgctccttccaccccagcgtggatgcccggctgcagtgcatcccccagcccacagagatgcccaagcccatctacaggaagcccaccgtgaagaggcccaccatgtggaatgtgagcaacaacccagcccggccccccaccacccagatcagccacagccagggcatccggctgggcgtgcacccagaccccaccccagagcatgacttcagcagcttcctggaggtgcggccagatggccatggaggagcccggctgcacacagtggatggccactgggtggcccctgtgccccggctgccctttgaggtgctgctgaggatgctgtacccccgggtgtggccctacaggatgaaggtgccccagggcttctaccccatctccatgagggaggtgcccaggaagaggcacctgggggacaacaccttctggacagacaccctggccatgaacctgcgggacacctttgatgaggccttcctggccgctgtgcgcagccaccagggcctgcccaccctgcccagcccccagaccaacccctag

SEQ ID NO: 35519 - DNA, 1845 bp, Artificial Sequence
  Description of Artificial Sequence: Synthetic coding sequence
atgatgaggcaggccaccatggacttcagcaccccatctgtgtttgaccagcagagaggagacagcagcgaggaggtggacctgaccatggtgtaccaggccgccagcaatggagatgtgaatgccctgacagctgtgatccgggaggaccccagcatcctggagtgctgtgacagcgagggctgcacccccctgatgcatgctgtgtctggccggcaggccgacacagtgaagctgctgctgaagatgggcgccaacatcaacatgcaggatgcctacggccgcaccagcctgtgcctggccacctacctgggctggctggagggctgtgtgtccctgctgagaaatggagccaagcacaacatcccagacaagaatggccgcctgcccctgcatgctgccacagctgagccagacatgaggctgctgactgtgctgctgcagcagagcaacatcagcgagatcaaccaccaggacaatgaaggcatgacccccctgcactgggccgccttccacaaccagccccagcacacccagatgctgctgaagaagggagctgaccccaccctggtggacaaggacttcaagacagccctgcactgggccgtgcagagcggcaaccgcatcctgtgcagcatcatcctgagccaccaccagggccccagcatcatcaactatgatgatgagagcggcaagacctgtgtgcacatcgctgctgctgctggcttcagtgacatcatccacgagctggcccgggtgcctgagtgcaacctgcaggccctggatgtggatgacaggacccccctgcactgggccgctgctgctgggaaggcagaatgtgtgcagagcctgctggagctgggcatggacagcaacctgcgggacatcaatgaaagcacccccctggcctatgccctgtactgcggccacacagcctgtgtgaagctgctgagccaggagagcaggacagagcccacccggcccccacccagccagagcagccggccccagaagaaggagcggcgcttcaacgtgctgaaccagatcttctgcaagaacaagaaggaggagcagagggcccaccagaaggaccccagccgggaccgctaccgggaggaggacaccagcgaggtgaatgacatcatcaccacctttgacagcatcgtgggcaccaactgccaggagcagcccggggaccaggtggccatggtggagttcaagaagaagaccagtgacaacagcaagtacctgctgcctgagaagaagcccctggccaggaagggcctgccccccatccgcacccagagcctgccccccatcaccctgggcaacaacttcctgacagccagccaccgggccaccagccatgctggcctgagcagcgccccccaccacatggcccagaggagccagaagagccgctctgagcaggacctgctgaacaacagaacaggctgccagatgctgctggacaacccctggaagagtgacagcaaccaggtgttctcctacaaggtgtggacagtgagcagcagtgacaagctgctggaccggctgctgtctgtgcggcccggccaccaggaggtgtctgtgcccccccacctgcggcacctgcacaaccccagcagcggccagaacttccagcacctgagccccaacagacacaagatccgggacctgcccttcaccaggaacaacctggcccccctgcctgaccagaagttcctgtctggagagcccctgcggaccaacagagtgctgcctgccatccccagccagaggaggcacagcacagctgctgaggagagcgagcacagcgccaaccccaccagtgatgaaaattag

SEQ ID NO: 35520 - DNA, 981 bp, Artificial Sequence
  Description of Artificial Sequence: Synthetic coding sequence
atggacagcaacctgcgggacatcaatgaaagcacccccctggcctatgccctgtactgcggccacacagcctgtgtgaagctgctgagccaggagagcaggacagagcccacccggcccccacccagccagagcagccggccccagaagaaggagcggcgcttcaacgtgctgaaccagatcttctgcaagaacaagaaggaggagcagagggcccaccagaaggaccccagccgggaccgctaccgggaggaggacaccagcgaggtgaatgacatcatcaccacctttgacagcatcgtgggcaccaactgccaggagcagcccggggaccaggtggccatggtggagttcaagaagaagaccagtgacaacagcaagtacctgctgcctgagaagaagcccctggccaggaagggcctgccccccatccgcacccagagcctgccccccatcaccctgggcaacaacttcctgacagccagccaccgggccaccagccatgctggcctgagcagcgccccccaccacatggcccagaggagccagaagagccgctctgagcaggacctgctgaacaacagaacaggctgccagatgctgctggacaacccctggaagagtgacagcaaccaggtgttctcctacaaggtgtggacagtgagcagcagtgacaagctgctggaccggctgctgtctgtgcggcccggccaccaggaggtgtctgtgcccccccacctgcggcacctgcacaaccccagcagcggccagaacttccagcacctgagccccaacagacacaagatccgggacctgcccttcaccaggaacaacctggcccccctgcctgaccagaagttcctgtctggagagcccctgcggaccaacagagtgctgcctgccatccccagccagaggaggcacagcacagctgctgaggagagcgagcacagcgccaaccccaccagtgatgaaaattag

SEQ ID NO: 35521 - DNA, 1845 bp, Artificial Sequence; identical to SEQ ID NO: 35519
  Description of Artificial Sequence: Synthetic coding sequence

SEQ ID NO: 35522 - DNA, 2382 bp, Artificial Sequence
  Description of Artificial Sequence: Synthetic coding sequence
atggcccgggagctgagccaggaggccctgctggacttcctgtgccaggccggcggccgggtgaccaatgctgccctgctgagccacttcaagagcttcctgcgggaccctgatgccagccccagccagcaccagcacagaagagagctgttcaagggctttgtgaacagcgtggccgctgtgcggcaggaccctgatggcaccaagtatgtggtgctgaagaggcgctacagagacctgctgggggaggagggcctgcagaggccccgggagcccccagctgctgcccccagcgctggaggagctgccccctgcagccccaggggggccaggagaggagagcccccccagcagcagcccaggagaagaagaagagagaaggagcctgaggaggagcctgctggagctgctgcccgggctgctgatgctgcctgcaatggcctgcccggcagtgacagccggcgggcccctggaaaaggaggcggcagcaagggcagccctggccagaggcctcctgtgcctgctgctgctgctgctggggcccaggcccgggccagctgtgccgccgccaagacccagggccgctgctgctgggagtgcctgcagaacaacctggccgtgctgcctggagagctgggcgccctgccccacagcgccacagctgaggagaagccagcccgggccctgcctgcccaggatgacagaggagccagccgggagcgggaggagggcgccctggccgagcccgcccctgtgcctgctgtggcccacagccccccagccaccgtggaggccgccaccagccgggccagccccccagccctgctgcccggccctgcccccaggggggacaggcctgagctgctgacccccagcagcctgcactacagcaccctgcagcagcagcagcagaggacccgggagtgggtggcccggcacccccaggtgcctgaggcccgggaccagggccccatccgggcctggagcgtgctgcctgacaacttcctgcagctgcccctggagcccggcagcacagagcccaacagcgagcccccagacccctgcctgagcagccacagcctcttccctgtggtgcctgatgagagctgggagagctgggccggcaaccccagcctgaccgtcttccgcagcatccgctgccagctgagcctgcaggacctggatgactttgtggaccaggagagtgatggcagcgaggagagcagcagcggccccaaggacagccctggggccagcgaggagggcctgcaggtggtgctgggcaccccagaccggggcaagctgaggaacccagctgggggcctgtctgtgtccaggaaggagggcagccccagccgcagcccccagggcctgaggaacagaggagatggccacatcagccagcaggtgcctgctggggccaacggcctggccggccaccccctgaagcccctgccctggcctgtgcccaagctgcggcgcagcctgcggcgcagcagcctggccggccgggccaagctgagcagcagtgatgaggagtacctggatgagggcctgctgaagaggagccggcggccccccaggagcaggaagcccagcaaggccggcacagcccccagcccccgggtggatgctggcctgagcctgaagctggccgaggtgaaggctgtggtggccgagcggggctggaggcacagcctgtgggtgcccagcggggagggcagcgctgccctggccccccacaggaccagcgagcacaagagcagcctggtgcccctggatgcccgggagcacgagtggatcgtgaagctggccagcggctcctggatccaggtgtggaccctcttctgggaggacccccagctggccctgcacaaggacttcctgaccggctacacagccctgcactggatcgccaagcatggagacctgcgggccctgcaggacctggtgtctggggccaagaaggccggcatcgtgctggatgtgaatgtgcgcagcagctgtggctacacccccctgcacctggccgccatccacggccaccagggcgtcatcaagctgctggtgcagaggctggccagccgggtgaatgtgcgggacagcagcggcaagaagccctggcagtacctgaccagcaacaccagcggggagatctggcagctgctgggcgccccccggggcaagcccatcttccctgtgtaccccctggtgggcagcagcagccccaccaggaaggccaagagcaaggagatcagccgctctgtgaccaggaagaccagctttgctgccctgctgaagagccagcacaacaagtggaagctggccaaccagtatgagaagttccacagcccccgggagcgggaggagtacagcgactag

SEQ ID NO: 35523 - DNA, 1578 bp, Artificial Sequence
  Description of Artificial Sequence: Synthetic coding sequence
atggagggccctgctgagtggggccctgaggccgccctgggccctgaggccgtgctgcgcttcctggccgagcggggcggccgggccctgcacgccgagctggtgcagcacttccggggggccctgggcggggagcctgagcagagggcccgggcccgggcccacttcaaggagctggtgaatgctgtggccaccgtgcgggtggaccctgcagatggagccaagtatgtgcacctgaagaagcgcttctgtgagggccccagcgagcccagcggggaccccccacgcatccaggtgacagctgagcctgaggccccagatggccctgctggccctgaggcccgggaccggctgcctgatgctgctgcccctgagagcctgcccggccagggccgggagctgggggagggggagcccccagccccagcccactggccacccctgtctgctggggcccggaggaagaacagcagaagagatgtgcagcccctgcccaggaccccagcccctggccccagcgaggacctggagctgccccctcatggctgtgaggaggccgaccggggcagcagcctggtgggcgccacagcccagaggcctgcccggcagaacctgcgggacctggtgatgggcagcagcccccagctgaagaggtctgtgtgccctgggggcagcagccctggcagcagcagcggcggcggccggggccggggcggcggggacagcgacagcgcctctgtggccagcagcagcgctgaggaggagagcagcggcggcggctctgtgaccctggaccccctggagcacgcctggatgctgagcgccagtgatggcaagtgggacagcctggagggcctgctgacctgtgagcccggcctgctggtgaagagggacttcatcaccggcttcacctgcctgcactgggccgccaagcacggccggcaggagctgctggccatgctggtgaactttgccaacaagcaccagctgcctgtgaacattgatgcccggaccagcggcggctacacagccctgcacctggccgccatgcacggccacgtggaggtggtgaagctgctggtgggcgcctatgatgctgatgtggacatccgggactacagcggcaagaaggccagccagtacctgagccgcagcattgctgaggagatcaagaacctggtgggcgccctggatgaaggagatggagagagcgctgctggcagcggcggcggccgctggaggctgagcaaggtgctgcccagccacctgatcacctacaagctgagccacgccctggaggatggaggagaccaccaccaccaccaccacagcgctgagggctgggtgggcggcaaggccaaggaccccggcaggaaggccagcggcagcagcagcggccgcatcaagccccggctgaacaagatccgcttccgcacccagatcgtgcacaccacccccagcttccgggaccctgagcagcccctggagggccgcggggaggagggcgtgggggaggagaggcctgtgaagggccacagccccttcaccctgcggcccaagagcaatgtgtttggatag

SEQ ID NO: 35524 - DNA, 948 bp, Artificial Sequence
  Description of Artificial Sequence: Synthetic coding sequence
atggcccagctgggcggggccgccaacagagcccccacagccagcctggcccccaccagccagagcctgcgctgtgccccccagccccggcccagcagagctgacaccggcagcctgggccgctactggggcaaggctgctgctgctgccagccgggagcaccccttccctggcaccctgatgcacagcgctgctggcagcggcagaagaagaggagccctgcgggagctgctgggcctgcagagagctgccccagctggctggctgtctgaggagcgggcagaggagctgggcggccccagcggccctggcagcagccggctgtgcctggagccccgggagcacgcctggatcctggccgctgctgagggccgctatgaggtgctgcgggagctgctggaggccgagcctgagctgctgctgcggggggaccccatcaccggctacagcgtgctgcactggctggccaagcacggcagacatgaggagctgatcctggtgcatgactttgccctgcggcggggcctgcggctggatgtgtctgcccctggcagcggcggcctgacccccctgcacctggccgccctgcagggccatgacatggtgatcaaggtgctggtgggcgccctgggcgcagatgccacccggcgggaccacagcggccaccgggcctgccactacctgcggccagatgccccctggaggctgcgggagctgagcggggctgaggagtgggagatggagagcggcagcggctgcaccaacctgaacaacaacagcagcggcaccacagcctggagggctgccagcgctgtgggcgccacagctgtggagaccagcagaagagtggccgccagcaggaccaaggccaaggacacagctggcagccgggtggcccagatgcacagcctcttccgccacctgttccccagcttccaggacagatag

SEQ ID NO: 35525 - DNA, 1026 bp, Artificial Sequence
  Description of Artificial Sequence: Synthetic coding sequence
tgagcctggggcatgagaagagctgctgctggggccggcggggcccgggccgccggccccactggaggagccagccggctgcaccccaatgccggcagaagaagtggggcccgggccggggcccagggctgcggcggcccccgggtgggcagcgctgacagccgggccctgcctgcccagcccctggcctgtgcccggggccgcagccagaggctggtgtgtgaccccaaggccgccagcgccctgcctgacctggccccagatgtgtttgtgctgcgggtgcggctggaggagactggagagatgttccgggtggccaactgccgcggggacatgacagtgcgggagctgaaggaggagctggacctgatggtgggcatccccttcaacctgcagaggctgcagtacctggatgagggcgtgctgatggatgacaccaccctgaagttccatgatgtggtgcctgggggcatcatcagcctgtgcatctggcaccatgatggctggacagagctggtgctggccgctgtggagggggaccccagcaagctgagctgcctgggcctgacagaagattccttctacagaacagccaacagcgagcactttgaaggagagaagtggaagcactggaccagccagagggcctttgtggccctgtatgtggccagccaccggggccactttgatgctgtgcagtacctgctggagcacggggccagctgcctgagccgcagccccctgggccgcacccccctgcacgtggccgccgccatgggccgcagtgactgcatcatcctgctgctgcagcacggggccagcatccatgacagagatgccaagggggagacccccatcagcatcgcccaccggctgaaccacaccctgtctgagcggcagatggtgctgctgcacagaattgccaagagcggcatccgggacctgaatgacctggtgatgaagaatgccctgcagagggtgaagagcggcttccgctctgagaagatgaccatgaccccccactag

SEQ ID NO: 35526 - DNA, 1038 bp, Artificial Sequence
  Description of Artificial Sequence: Synthetic coding sequence
atgacccggggccgggcctggggcatgagaagagctgctgctggggccggcggggcccgggccgccggccccactggaggagccagccggctgcaccccaatgccggcagaagaagtggggcccgggccggggcccagggctgcggcggcccccgggtgggcagcgctgacagccgggccctgcctgcccagcccctggcctgtgcccggggccgcagccagaggctggtgtgtgaccccaaggccgccagcgccctgcctgacctggccccagatgtgtttgtgctgcgggtgcggctggaggagactggagagatgttccgggtggccaactgccgcggggacatgacagtgcgggagctgaaggaggagctggacctgatggtgggcatccccttcaacctgcagaggctgcagtacctggatgagggcgtgctgatggatgacaccaccctgaagttccatgatgtggtgcctgggggcatcatcagcctgtgcatctggcaccatgatggctggacagagctggtgctggccgctgtggagggggaccccagcaagctgagctgcctgggcctgacagaagattccttctacagaacagccaacagcgagcactttgaaggagagaagtggaagcactggaccagccagagggcctttgtggccctgtatgtggccagccaccggggccactttgatgctgtgcagtacctgctggagcacggggccagctgcctgagccgcagccccctgggccgcacccccctgcacgtggccgccgccatgggccgcagtgactgcatcatcctgctgctgcagcacggggccagcatccatgacagagatgccaagggggagacccccatcagcatcgcccaccggctgaaccacaccctgtctgagcggcagatggtgctgctgcacagaattgccaagagcggcatccgggacctgaatgacctggtgatgaagaatgccctgcagagggtgaagagcggcttccgctctgagaagatgaccatgaccccccactag

SEQ ID NO: 35527 - DNA, 2712 bp, Artificial Sequence
  Description of Artificial Sequence: Synthetic coding sequence
atggccacctggaggaagaacagagacaaggatggcttcagcaaccctggctacagagtgcggcagaaggacctgggcatgatccacaaggccgccatcgctggagatgtgaacaaggtgatggagagcatcctgctgcggctgaatgacctgaatgaccgggacaagaagaacagaacagccctgctgctggcctgtgcccacggccggcctggggtggtggccgacctggtggccaggaagtgccagctgaacctgacagattctgagaacagaacagccctgatcaaggctgtgcagtgccaggaggaggtgtgtgccagcatcctgctggagcacggggccaaccccaacgtgcgggacatgtatggcaacacagccctgcactacgccatcgacaatgaaaacatctccatggccaggaagctgctggcctacggggctgacatcgaggcccggagccaggacggccacaccagcctgctgctggccgtgaacaggaagaaggagcagatggtggccttcctgctgaagaagaagccagacctgacagccatcgacaactttggaagaacagccctgatcctggccgccagaaatggcagcacctctgtggtgtaccagctgctgcagcacaacattgatgtgttctgccaggacatcagcggctggacagcagaagattatgctgtggccagcaagttccaggccatccggggcatgatcagcgagtacaaggccaacaagcgctgcaagagcctgcagaacagcaacagcgagcaggacctggagatgaccagcgagggggagcaggagcggctggagggctgtgagagcagccagccccaggtggaggagaagatgaagaagtgcaggaacaagaagatggaggtgtccagaaatgtgcatgctgatgacagcgacaactacaatgatgatgtggatgagctgatccacaagatcaagaacaggaagccagacaaccaccagagccctgggaaggaaaatggagaatttgaccggctggccaggaagaccagcaatgagaagagcaaggtgaagagccagatctacttcacagatgacctgaatgacatcagcggcagcagcgagaagaccagtgaagatgatgagctgccctacagtgatgatgagaacttcatgctgctgattgagcagagcggcatggagtgcaaggactttgtgtccctgagcaagagcaagaatgccacagctgcctgtggccgcagcattgaggaccagaagtgctactgtgagcggctgaaggtgaagttccagaagatgaagaacaacatctctgtgctgcagaaggtgctgtctgaaacagacaagaccaagagccagagcgagcaccagaacctgcagggcaagaagaagctgtgcaacctgcgcttcatcctgcagcagcaggaggaggagcgcatcaaggccgaggagctgtatgagaaggacatcgaggagctgaagatcatggaggagcagtaccgcacccagacagaggtgaagaagcagagcaagctgaccctgaagagcctggaggtggagctgaagacagtgcgcagcaacagcaaccagaacttccacacccatgagcgggagcgggacctgtggcaggagaaccacctgatgagagatgagatcgcccggctgcggctggagattgacaccatcaagcaccagaaccaggagacagagaacaagtacttcaaggacatcgagatcatcaaggagaacaatgaagacctggagaagaccctgaagagaaatgaggaggccctgaccaagaccatcacccgctacagcaaggagctgaatgtgctgatggatgagaacaccatgctgaacagcgagctgcagaaggagaagcagagcatgagccggctggagacagagatggagagctaccgctgccgcctggccgccgccctgtgtgaccatgaccagaggcagagcagcaagagggacctgcagctggccttccagagcacagtgaatgagtggtgccacctgcaggaggacaccaacagccacatccagatcctgagccagcagctgagcaaggccgagagcaccagcagcggcctggagacagagctgcactatgaaagagaggccctgaaggagaagaccctgcacatcgagcacatgcagggcgtgctgagcaggacccagaggcggctggaggacatcgagcacatgtaccagaatgaccagcccatcctggagaagtatgtgaggaagcagcagagcgtggaggatggcctcttccagctgcagagccagaacctgctgtaccagcagcagtgcaatgatgccaggaagaaggctgacaaccaggagaagaccatcatcaacatccaggtgaagtgtgaggacacagtggagaagctgcaggctgaatgtaggaagctggaggagaacaacaagggcctgatgaaggaatgtaccctgctgaaggagcggcagtgccagtatgagaaggagaaggaggagcgggaggtggtgcggcggcagctgcagcgggaggtggatgatgccctgaacaagcagctgctgctggaggccatgctggagatcagcagcgagcggcgcatcaacctggaggatgaggcccagagcctgaagaagaagctgggccagatgaggagccaggtgtgcatgaagctgtccatgagcacagtgaccctgtag

SEQ ID NO: 35528 - DNA, 1920 bp, Artificial Sequence
  Description of Artificial Sequence: Synthetic coding sequence
atgaccagcgagggggagcaggagcggctggagggctgtgagagcagccagccccaggtggaggagaagatgaagaagtgcaggaacaagaagatggaggtgtccagaaatgtgcatgctgatgacagcgacaactacaatgatgatgtggatgagctgatccacaagatcaagaacaggaagccagacaaccaccagagccctgggaaggaaaatggagaatttgaccggctggccaggaagaccagcaatgagaagagcaaggtgaagagccagatctacttcacagatgacctgaatgacatcagcggcagcagcgagaagaccagtgaagatgatgagctgccctacagtgatgatgagaacttcatgctgctgattgagcagagcggcatggagtgcaaggactttgtgtccctgagcaagagcaagaatgccacagctgcctgtggccgcagcattgaggaccagaagtgctactgtgagcggctgaaggtgaagttccagaagatgaagaacaacatctctgtgctgcagaaggtgctgtctgaaacagacaagaccaagagccagagcgagcaccagaacctgcagggcaagaagaagctgtgcaacctgcgcttcatcctgcagcagcaggaggaggagcgcatcaaggccgaggagctgtatgagaaggacatcgaggagctgaagatcatggaggagcagtaccgcacccagacagaggtgaagaagcagagcaagctgaccctgaagagcctggaggtggagctgaagacagtgcgcagcaacagcaaccagaacttccacacccatgagcgggagcgggacctgtggcaggagaaccacctgatgagagatgagatcgcccggctgcggctggagattgacaccatcaagcaccagaaccaggagacagagaacaagtacttcaaggacatcgagatcatcaaggagaacaatgaagacctggagaagaccctgaagagaaatgaggaggccctgaccaagaccatcacccgctacagcaaggagctgaatgtgctgatggatgagaacaccatgctgaacagcgagctgcagaaggagaagcagagcatgagccggctggagacagagatggagagctaccgctgccgcctggccgccgccctgtgtgaccatgaccagaggcagagcagcaagagggacctgcagctggccttccagagcacagtgaatgagtggtgccacctgcaggaggacaccaacagccacatccagatcctgagccagcagctgagcaaggccgagagcaccagcagcggcctggagacagagctgcactatgaaagagaggccctgaaggagaagaccctgcacatcgagcacatgcagggcgtgctgagcaggacccagaggcggctggaggacatcgagcacatgtaccagaatgaccagcccatcctggagaagtatgtgaggaagcagcagagcgtggaggatggcctcttccagctgcagagccagaacctgctgtaccagcagcagtgcaatgatgccaggaagaaggctgacaaccaggagaagaccatcatcaacatccaggtgaagtgtgaggacacagtggagaagctgcaggctgaatgtaggaagctggaggagaacaacaagggcctgatgaaggaatgtaccctgctgaaggagcggcagtgccagtatgagaaggagaaggaggagcgggaggtggtgcggcggcagctgcagcgggaggtggatgatgccctgaacaagcagctgctgctggaggccatgctggagatcagcagcgagcggcgcatcaacctggaggatgaggcccagagcctgaagaagaagctgggccagatgaggagccaggtgtgcatgaagctgtccatgagcacagtgaccctgtag

SEQ ID NO: 35529 - DNA, 1143 bp, Artificial Sequence
  Description of Artificial Sequence: Synthetic coding sequence
atgctgaagcccaaggacctgtgccccagggctggcaccaggaccttcctggaggccatgcaggccggcaaggtgcacctggccaggtttgtgctggatgccctggacaggagcatcatcgactgcagagctgagcagggccgcacccccctgatggtggccgtgggcctgcctgaccctgccctgcgggccaggtttgtgcggctgctgctggagcagggcgctgctgtgaacctgagagatgagcggggccgcacagccctgagcctggcctgtgagcggggccacctggatgctgtgcagctgctggtgcagttcagcggggaccctgaggccgctgacagcgctggcaacagccctgtgatgtgggccgccgcctgtggccatggagctgtgctggagttcctggtgcgctccttccggcggctgggcctgcggctggacaggaccaacagagctggcctgacagccctgcagctggccgccgcccggggccacggcacctgtgtgcaggccctgaccggcccctggggccgggctgctgctgctgctgctgcccggggcagcaacagcgacagccccccaggccggcctgccccagctgccagccctgagcacagaagacccagcccccggcggctgccccggcccctgctggccaggtttgcccgggccgccggcggccatggaggagaggccggcagcgctgggaagaacagcggccgccaccgggcccagggcagcgagaggcctgagctgggccgctccatgagcctggccctgggcgctgtgacagaggaggaggccgcccggctgcgggccggggccctgatggccctgcccaacagcccccagagcagcggcaccggccgctggaggagccaggaggtgctggagggcgccccacccaccctggcccaggcccccatcggcctgagcccccaccctgagggcggccctggcagcggccgcctgggcctgcggcggcgcagcacagccccagacatccccagcctggtgggggaggcccctggccctgagagcggccctgagctggaggccaatgccctgtctgtgtctgtgcccggccccaacccctggcaggccggcacagaagctgtggtgctgcgggcccagaggtag

SEQ ID NO: 35530 - DNA, 1200 bp, Artificial Sequence
  Description of Artificial Sequence: Synthetic coding sequence
atggacagccagaggcctgagccccgggaggaggaggaggaggagcaggagctgcgctggatggagctggacagcgaggaggccctgggcaccaggacagagggccccagcgtggtgcagggctggggccacctgctgcaggccgtgtggaggggccctgctggcctggtgacccagctgctgcggcagggcgcctctgtggaggagcgggaccatgctggccgcacccccctgcacctggccgtgctgcggggccacgcccccctggtgcggctgctgctgcagagaggagcccctgtgggcgctgtggaccgggccggccgcacagccctgcacgaggccgcctggcacggccacagccgggtggccgagctgctgctgcagagaggagccagcgctgctgcccggtctggaacaggcctgacccccctgcactgggccgccgccctgggccacaccctgctggccgcccggctgctggaggcccctggccctggccctgctgctgctgaggctgaagatgcccggggctggacagctgcccactgggccgccgccggcggccgcctggccgtgctggagctgctggccgccggcggggccggcctggatggagccctgctggtggccgctgctgctggaagaggagctgccctgcgcttcctgctggcccggggggcccgggtggatgccagagatggagctggggccacagccctgggcctggccgccgccctgggccgcagccaggacatcgaggtgctgctgggccacggggctgaccccggcatccgggacagacatggccgcagcgccctgcacagagctgctgcccggggccacctgctggccgtgcagctgctggtgacccagggcgctgaggtggatgcccgggacaccctgggcctgacccccctgcaccacgccagccgggagggccacgtggaggtggccggctgcctgctggacagaggagcccaggtggatgccaccggctggctgaggaagacccccctgcacctggccgctgagcggggccacggccccaccgtgggcctgctgctgagcagaggagccagccccaccctgcggacccagtgggccgaggtggcccagatgcctgagggggacctgccccaggccctgcctgagctgggcggcggggagaaggaatgtgagggcatcgagagcactggatag

SEQ ID NO: 35531 - DNA, 525 bp, Artificial Sequence
  Description of Artificial Sequence: Synthetic coding sequence
atggacagccagaggcctgagccccgggaggaggaggaggaggagcaggagctgcgctggatggagctggacagcgaggaggccctgggcaccaggacagagggccccagcgtggtgcagggctggggccacctgctgcaggccgtgtggaggggccctgctggcctggtgacccagctgctgcggcagggcgcctctgtggaggagaggaccctgcgctgctgctgggccaccggccagacccaggccagcggcaccggcatggccgccctgcgctgcaccggcctgcccccagaggacacctgcctgcccagcagctgctggagcccccggggcccccgctggatgaggggcaccccctgggccagccacccctgcatcacccccctgggcaaggccacctggaggctgcctgctgcctgctggacaggagtgccccgctggatgctgcctgctggcagcgagaggcctccctacacctggctgcagagcgagggcatgggcctgccctggggcttctgctag

SEQ ID NO: 35532 - DNA, 198 bp, Artificial Sequence
  Description of Artificial Sequence: Synthetic coding sequence
atggacagccagaggcctgagccccgggaggaggaggaggaggagcaggagctgcgctggatggagctggacagcgaggaggccctgggcaccaggacagagggccccagcgtggtgcagggctggggccacctgctgcaggccgtgtggaggggccctgctggcctggtgacccagctgctgcggcagggccactag

SEQ ID NO: 35533 - DNA, 954 bp, Artificial Sequence
  Description of Artificial Sequence: Synthetic coding sequence
atgccctgggatgcccggcggcctgggggcggcgcagatggcggccctgaggccagcggggccgcccggagccgggcccagaagcagtgcaggaagagcagctttgccttctaccaggccgtgcgggacctgctgcctgtgtggctgctggaggacatgagggccagcgaggccttccactgggatgagcggggccgggccgccgcctacagccccagcgaggccctgctgtatgccctggtgcatgaccaccaggcctatgcccactacctgctggccaccttcccccggcgggccctggccccacccagcgctggcttccgctgctgtgccgcccctggcccccacgtggccctggccgtgcgctacaacagagtgggcatcctgcggcgcatcctgcggaccctgcgggacttccctgctgaggagcgggcccgggtgctggaccggcggggctgcagccgggtggagggcggcggcaccagcctgcacgtggcctgtgagctggcccggccagaatgtctcttcctgctgctgggccatggagccagccctggcctgagagatggcggcggcctgacccccctggagctgctgctgcggcagctgggcagagatgctggggccacccccagcgctgctggggccccagccagcgcccctggagagccccggcagaggcggctgctgctgctggacctgctggccctgtacacccctgtgggcgccgccggcagcgcccggcaggagctgctgggggaccggccccgctggcagaggctgctgggggaggacaagttccagtggctggccggcctggccccacccagcctgtttgcccgggccatgcaggtgctggtgacagccatcagccctggccgcttccctgaggccctggatgagctgcccctgccccccttcctgcagcccctggacctgaccgggaagggctag

SEQ ID NO: 35534 - DNA, 318 bp, Artificial Sequence
  Description of Artificial Sequence: Synthetic coding sequence
atgccctgggatgcccggcggcctgggggcggcgcagatggcggccctgaggccagcggggccgcccggagccgggcccagaagcagtgcaggaagagcagctttgccttctaccaggccgtgcgggacctgctgcctgtgtggctgctggaggacatgagggccagcgaggccttccactgggatgagcggggccgggccgccgcctacagccccagcgaggccctgctgtatgccctggtgcatgaccaccaggcctatgcccactacctgctggccaccttcccccggcgggccctggccccacccagcgcctag

SEQ ID NO: 35535 - DNA, 783 bp, Artificial Sequence
  Description of Artificial Sequence: Synthetic coding sequence
atgccctgggatgcccggcggcctgggggcggcgcagatggcggccctgaggccagcggggccgcccggagccgggcccagaagcagtgcaggaagagcagctttgccttctaccaggccgtgcgggacctgctgcctgtgtggctgctggaggacatgagggccagcgaggccttccactgggatgagcggggccgggccgccgcctacagccccagcgaggccctgctgtatgccctggtgcatgaccaccaggcctatgcccactacctgctggccaccttcccccggcgggccctggccccacccagcgctggcttccgctgctgtgccgcccctggcccccacgtggccctggccgtgcgctacaacagagtgggcatcctgcggcgcatcctgcggaccctgcgggacttccctgctgaggagcgggcccgggtgctggaccggcggggctgcagccgggtggagggcggcggcaccagcctgcacgtggcctgtgagctggcccggccagaatgtctcttcctgctgctgggccatggagccagccctggcctgagagatggcggcggcctgacccccctggagctgctgctgcggcagctgggcagagatgctggggccacccccagcgctgctggggccccagccagcgcccctggagagccccggcagaggcggctgctgctgctggacctgctggccctgtacacccctgtgggcgccgccggcagcgcccggcaggagctgctgggggaccggccccgctggcagaggtag

SEQ ID NO: 35536 - DNA, 954 bp, Artificial Sequence; identical to SEQ ID NO: 35533
  Description of Artificial Sequence: Synthetic coding sequence

SEQ ID NO: 35537 - DNA, 954 bp, Artificial Sequence; identical to SEQ ID NO: 35533
  Description of Artificial Sequence: Synthetic coding sequence

SEQ ID NO: 35538 - DNA, 2292 bp, Artificial Sequence
  Description of Artificial Sequence: Synthetic coding sequence
atggaggccagcctgacccggcggctgctcttcaaggacagacacttcacctgcagcaagatcatcggccgccgctttgcctgctttgcccagaggctgagccacaggaggaagcagagccagtgtgacctgctgaatgaaagcacaggccagctgcccaccacctgcagcagcgctgccagcaacagcatcaactggaactgccgggtgaagatgacccagcagatgcagaacctgcacctgtgccagagcaagaagcacagcgcccccagcagccccaatgctgccaagaggctgtacagaaacctgtctgagaagctgaagggcagccacagcagctttgatgaggcctacttccgcaccaggacagaccggctgagcctgaggaagacctctgtgaacttccagggcaatgaggccatgtttgaggccgtggagcagcaggacatggatgctgtgcagatcctgctgtaccagtacaccccagaggagctggacctgaacacccccaacagcgagggcctgacccccctggacatcgccatcatgaccaacaacgtgcccatcgcccgcatcctgctgaggactggagcccgggagagcccccactttgtgtccctggagagccgggccatgcacctgaacaccctggtgcaggaggcccaggagcgggtgtctgagctgagcgcccaggtggagaatgaaggcttcaccctggacaacacagagaaggagaagcagctgaaggcctgggagtggagataccgcctgtacagaaggatgaagacaggctttgaacatgcccgggcccctgagatgcccaccaacgtgtgcctgatggtgaccagcagcaccagcctgactgtgtccttccaggagcccctgtctgtgaatgctgctgtggtgacccgctacaaggtggagtggagcatgtctgaggacttcagccccctggccggggagatcatcatggacaacctgcagaccctgcgctgcaccatcaccggcctgaccatgggccagcagtactttgtgcaggtgtctgcctacaacatgaagggctggggccctgcccagaccaccaccccagcctgtgccagccccagcaactggaaggactatgatgaccgggagcccaggcacaagggccagagcgaggtgctggagggcctgctgcagcaggtgcgggccctgcaccagcactacagctgccgggagagcaccaagctgcagaccactggaaggaagcagagcgtgagccgcagcctgaagcacctgttccacagcagcaacaagtttgtgaagaccctgaagaggggcctgtacatcgccgtcatcttctactacaaggacaacatcctggtgaccaatgaagaccaggtgcccatcgtggagattgatgacagccacaccagcagcatcacccaggacttcctgtggttcaccaagctgagctgcatgtgggaggacatccgctggctgcggcagagcatccccatcagcagcagcagcagcacagtgctgcagacccggcagaagatgctggccgccacagcccagctgcagaacctgctgggcacccacaacctgggccgggtgtactatgagcccatcaaggacagacatggcaacatcctgattgtgaccatccgggaggtggagatgctgtacagcttcttcaacgggaagtggatgcagatcagcaagctgcagagccagaggaagagcctgagcaccccagaggagcccacagccctggacatcctgctgatcaccatccaggacatcctgagctaccacaagaggagccaccagaggctcttccctggcctgtacctgggctacctgaagctgtgcagctctgtggaccagatcaaggtgctggtgacccagaagctgcccaacatcctgtgccacgtgaagatccgggagaacaacaacatcagccgggaggagtgggagtggatccagaagctgagcggcagcgagagcatggagagcgtggaccacaccagtgactgccccatgcagctgttcttctatgagctgcagatggctgtgaaggccctgctgcagcagatcaacatccccctgcaccaggccaggaacttccggctgtacacccaggaggtgctggagatgggccacaacgtgtccttcctgctgctgctgcctgccagtgatgatgtgtgcacagcccctggccagaacaacccctacaccccccacagcggcttcctgaacctgcccctgcagatgtttgagctgggcatcgtggcctgcttcacctag

SEQ ID NO: 35539 - DNA, 831 bp, Artificial Sequence
  Description of Artificial Sequence: Synthetic coding sequence
atggcctggtggaagtcctggattgagcaggagggcgtgacagtgaagagcagcagccacttcaacccagaccctgatgctgagaccctgtaccaggccatgaagggcattggagtgggcagccagctgctgagccaccaggccgccgcctttgccttccccagcagcgccctgacctctgtgagcccctggggccagcagggccacctgtgctgcaacccagctggcaccaatgagcaggccatcattgatgtgctgaccaagaggagcaacacccagaggcagcagatcgccaagagcttcaaggcccagtttgggaaggacctgacagagaccctgaagtctgagctgagcggcaagtttgagcggctgattgtggccctgatgtacccaccctaccgctatgaggccaaggagctgcatgatgccatgaagggcagcagagatgatgtgtcctcctttgtggaccccggcctggccctgcaggatgcccaggacctgtatgctgctggggagaagatccggggcacagatgagatgaagttcatcaccatcctgtgcaccaggtctgccacccacctgctgcgggtgaagtgcacccagaacctgcacagctactttgctgagcggctgtactatgccatgaagggggccggcaccagagatggcaccctcatcagaaatattgtgagccgctcagaaattgacctgaacctgatcaagtgccacttcaagaagatgtatggcaagaccctgagctccatgatcatggaggacaccagcggggactacaagaatgccctgctgagcctggtgggcagtgacccctag

SEQ ID NO: 35540 - DNA, 984 bp, Artificial Sequence
  Description of Artificial Sequence: Synthetic coding sequence
atggcctggtggaagtcctggattgagcaggagggcgtgacagtgaagagcagcagccacttcaacccagaccctgatgctgagaccctgtaccaggccatgaagggcatcggcaccaatgagcaggccatcattgatgtgctgaccaagaggagcaacacccagaggcagcagatcgccaagagcttcaaggcccagtttgggaaggacctgacagagaccctgaagtctgagctgagcggcaagtttgagcggctgattgtggccctgatgtacccaccctaccgctatgaggccaaggagctgcatgatgccatgaagggcctgggcaccaaggagggcgtcatcatcgagatcctggccagcaggaccaagaaccagctgcgggagatcatgaaggcctatgaagaagattatggcagcagcctggaggaggacatccaggccgacaccagcggctacctggagcgcatcctggtgtgcctgctgcagggcagcagagatgatgtgagcagctttgtggaccccggcctggccctgcaggatgcccaggacctgtatgctgctggggagaagatccggggcacagatgagatgaagttcatcaccatcctgtgcaccaggtctgccacccacctgctgcgggtgtttgaggagtatgagaagatcgccaacaagagcattgaagattccatcaagtctgagacccacggcagcctggaggaggccatgctgactgtggtgaagtgcacccagaacctgcacagctactttgctgagcggctgtactatgccatgaagggagctggcaccagagatggcaccctcatccggaacatcgtgagccgctcagaaattgacctgaacctgatcaagtgccacttcaagaagatgtatggcaagaccctgagctccatgatcatggaggacaccagcggggactacaagaatgccctgctgagcctggtgggcagtgacccctag

SEQ ID NO: 35541 - DNA, 798 bp, Artificial Sequence
  Description of Artificial Sequence: Synthetic coding sequence
atggcctggtggaagtcctgggacctgacagagaccctgaagtctgagctgagcggcaagtttgagcggctgattgtggccctgatgtacccaccctaccgctatgaggccaaggagctgcatgatgccatgaagggcctgggcaccaaggagggcgtcatcatcgagatcctggccagcaggaccaagaaccagctgcgggagatcatgaaggcctatgaagaagattatggcagcagcctggaggaggacatccaggccgacaccagcggctacctggagcgcatcctggtgtgcctgctgcagggcagcagagatgatgtgagcagctttgtggaccccggcctggccctgcaggatgcccaggacctgtatgctgctggggagaagatccggggcacagatgagatgaagttcatcaccatcctgtgcaccaggtctgccacccacctgctgcgggtgtttgaggagtatgagaagatcgccaacaagagcattgaagattccatcaagtctgagacccacggcagcctggaggaggccatgctgactgtggtgaagtgcacccagaacctgcacagctactttgctgagcggctgtactatgccatgaagggagctggcaccagagatggcaccctcatccggaacatcgtgagccgctcagaaattgacctgaacctgatcaagtgccacttcaagaagatgtatggcaagaccctgagctccatgatcatggaggacaccagcggggactacaagaatgccctgctgagcctggtgggcagtgacccctag

SEQ ID NO: 35542 - DNA, 426 bp, Artificial Sequence
  Description of Artificial Sequence: Synthetic coding sequence
atggcctggtggaagtcctggattgagcaggagggcgtgacagtgaagagcagcagccacttcaacccagaccctgatgctgagaccctgtaccaggccatgaagggcatcggcaccaatgagcaggccatcattgatgtgctgaccaagaggagcaacacccagaggcagcagatcgccaagagcttcaaggcccagtttgggaaggacctgacagagaccctgaagtctgagctgagcggcaagtttgagcggctgattgtggccctgatgtacccaccctaccgctatgaggccaaggagctgcatgatgccatgaagggcctgggcaccaaggagggcgtcatcatcgagatcctggccagcaggaccaagaaccagctgcgggagatcatgaaggcctatgaggagggccagcagggctag

SEQ ID NO: 35543 - DNA, 831 bp, Artificial Sequence
  Description of Artificial Sequence: Synthetic coding sequence
atggcctggtggaaggcctggattgagcaggagggcgtgacagtgaagagcagcagccacttcaacccagaccctgatgctgagaccctgtacaaggccatgaagggcattggagtgggcagccagctgctgagccaccaggccgccgcctttgccttccccagcagcgccctgacctctgtgagcccctggggccagcagggccacctgtgctgcaacccagctggcaccaatgagcaggccatcattgatgtgctgaccaagaggagcaacacccagaggcagcagatcgccaagagcttcaaggcccagtttgggaaggacctgacagagaccctgaagtctgagctgagcggcaagtttgagcggctgattgtggccctgatgtacccaccctaccgctatgaggccaaggagctgcatgatgccatgaagggcagcagagatgatgtgtcctcctttgtggaccctgccctggccctgcaggatgcccaggacctgtatgctgctggggagaacatccggggcacagatgagatgaagttcatcaccatcctgtgcaccaggtctgccacccacctgctgcgggtgaagtgcacccagaacctgcacagctactttgctgagcggctgtactatgccatgaagggggccggcaccagagatggcaccctcatcagaaatattgtgagccgctcagaaattgacctgaacctgatcaagtgccacttcaagaagatgtatggcaagaccctgagctccatgatcatggaggacaccagcggggactacaagaatgccctgctgagcctggtgggcagtgacccctag

SEQ ID NO: 35544 - DNA, 984 bp, Artificial Sequence
  Description of Artificial Sequence: Synthetic coding sequence
atggcctggtggaaggcctggattgagcaggagggcgtgacagtgaagagcagcagccacttcaacccagaccctgatgctgagaccctgtacaaggccatgaagggcatcggcaccaatgagcaggccatcattgatgtgctgaccaagaggagcaacacccagaggcagcagatcgccaagagcttcaaggcccagtttgggaaggacctgacagagaccctgaagtctgagctgagcggcaagtttgagcggctgattgtggccctgatgtacccaccctaccgctatgaggccaaggagctgcatgatgccatgaagggcctgggcaccaaggagggcgtcatcatcgagatcctggccagcaggaccaagaaccagctgcgggagatcatgaaggcctatgaagaagattatggcagcagcctggaggaggacatccaggccgacaccagcggctacctggagcgcatcctggtgtgcctgctgcagggcagcagagatgatgtgagcagctttgtggaccctgccctggccctgcaggatgcccaggacctgtatgctgctggggagaacatccggggcacagatgagatgaagttcatcaccatcctgtgcaccaggtctgccacccacctgctgcgggtgtttgaggagtatgagaagatcgccaacaagagcattgaagattccatcaagtctgagacccacggcagcctggaggaggccatgctgactgtggtgaagtgcacccagaacctgcacagctactttgctgagcggctgtactatgccatgaagggagctggcaccagagatggcaccctcatccggaacatcgtgagccgctcagaaattgacctgaacctgatcaagtgccacttcaagaagatgtatggcaagaccctgagctccatgatcatggaggacaccagcggggactacaagaatgccctgctgagcctggtgggcagtgacccctag

SEQ ID NO: 35545 - DNA, 426 bp, Artificial Sequence
  Description of Artificial Sequence: Synthetic coding sequence
atggcctggtggaaggcctggattgagcaggagggcgtgacagtgaagagcagcagccacttcaacccagaccctgatgctgagaccctgtacaaggccatgaagggcatcggcaccaatgagcaggccatcattgatgtgctgaccaagaggagcaacacccagaggcagcagatcgccaagagcttcaaggcccagtttgggaaggacctgacagagaccctgaagtctgagctgagcggcaagtttgagcggctgattgtggccctgatgtacccaccctaccgctatgaggccaaggagctgcatgatgccatgaagggcctgggcaccaaggagggcgtcatcatcgagatcctggccagcaggaccaagaaccagctgcgggagatcatgaaggcctatgaggagggccagcagggctag

SEQ ID NO: 35546 - DNA, 798 bp, Artificial Sequence
  Description of Artificial Sequence: Synthetic coding sequence
atggcctggtggaaggcctgggacctgacagagaccctgaagtctgagctgagcggcaagtttgagcggctgattgtggccctgatgtacccaccctaccgctatgaggccaaggagctgcatgatgccatgaagggcctgggcaccaaggagggcgtcatcatcgagatcctggccagcaggaccaagaaccagctgcgggagatcatgaaggcctatgaagaagattatggcagcagcctggaggaggacatccaggccgacaccagcggctacctggagcgcatcctggtgtgcctgctgcagggcagcagagatgatgtgagcagctttgtggaccctgccctggccctgcaggatgcccaggacctgtatgctgctggggagaacatccggggcacagatgagatgaagttcatcaccatcctgtgcaccaggtctgccacccacctgctgcgggtgtttgaggagtatgagaagatcgccaacaagagcattgaagattccatcaagtctgagacccacggcagcctggaggaggccatgctgactgtggtgaagtgcacccagaacctgcacagctactttgctgagcggctgtactatgccatgaagggagctggcaccagagatggcaccctcatccggaacatcgtgagccgctcagaaattgacctgaacctgatcaagtgccacttcaagaagatgtatggcaagaccctgagctccatgatcatggaggacaccagcggggactacaagaatgccctgctgagcctggtgggcagtgacccctag

SEQ ID NO: 35547 - DNA, 306 bp, Artificial Sequence
  Description of Artificial Sequence: Synthetic coding sequence
tgacatgtgcacctgggcttcatcatcgcctttgaaaatgtggtgttcttcttcctgtgccccaatgaccggctggtgcctgatgtgcctgccctggccaccaagatcacagcccgggccctgcccggccaggccggcggcggccggcagcctggagatgctgtgtctgtgtccaagctgcgcatctgggccgtgtcccagggccgcagcggctcctggatgaggggcctggagttccctggggacctgcagacctgcacagccaccctgccctgcagctgcctgctggcctctgtgcagtgctag

SEQ ID NO: 35548 - DNA, 777 bp, Artificial Sequence
  Description of Artificial Sequence: Synthetic coding sequence
atgccccggcccaggagagtgtcccagctgctggacctgtgcctgtggtgcttcatgaagaacatcagccgctacctgacagacatcaagcccctgccccccaacatcaaggacaggctcatcaagatcatgtccatgcagggccagatcacagacagcaacatcagcgagatcctgcaccctgaggtgcagaccctggacctgcggagctgtgacatcagtgatgctgccctgctgcacctgagcaactgcaggaagctgaagaagctgaacctgaatgccagcaagggcaacagagtgtctgtgaccagcgagggcatcaaggctgtggccagcagctgcagctacctgcacgaggccagcctgaagcgctgctgcaacctgacagatgagggcgtggtggccctggccctgaactgccagctgctgaagatcatcgacctgggcggctgcctgagcatcacagatgtgtccctgcacgccctgggcaagaactgccccttcctgcagtgtgtggacttcagcgccacccaggtgtctgacagcggcgtgattgccctggtgtctggcccctgtgccaagaagctggaggagatccacatgggccactgtgtgaacctgacagatggagctgtggaggccgtgctgacctactgcccccagatccgcatcctgctcttccacggctgccccctcatcacagaccacagccgggaggtgctggagcagctggtgggccccaacaagctgaagcaggtgacctggacagtgtactag

SEQ ID NO: 35549 - DNA, 588 bp, Artificial Sequence
  Description of Artificial Sequence: Synthetic coding sequence
atgggcgctgctgtgttcttcggctgcacctttgtggccttcggccctgcctttgccctcttcctgatcaccgtggccggggaccccctgcgggtcatcatcctggtggccggccgctgcagcgccctgcccaccaccagctgcctgatcagcggcctgagctttggcatcatctctggagtcttcagcgtcatcaacatcctggctgatgccctgggccctggggtggtgggcatccacggggacagcccctactacttcctgaccagcgccttcctgacagctgccatcatcctgctgcacaccttctggggcgtggtgttctttgatgcctgtgagcggcggcgctactgggccctgggcctggtggtgggcagccacctgctgaccagcggcctgaccttcctgaacccctggtatgaggccagcctgctgcccatctatgctgtgacagtgtccatgggcctgtgggccttcatcacagctgggggcagcctgcggagcatccagaggagcctgctgtgccggcggcaggaggacagccgggtgatggtgtacagcgccctgcgcatccccccagaggactag

SEQ ID NO: 35550 - DNA, 495 bp, Artificial Sequence
  Description of Artificial Sequence: Synthetic coding sequence
atggaggaggaggccgagacagaggagcagcagcgcttctcctaccagcagaggctgaaggctgctgtgcactacacagtgggctgcctgtgtgaggaggtggccctggacaaggagatgcagttcagcaagcagaccatcgccgccatcagcgagctgaccttccggcagtgtgaaaattttgccaaggacctggagatgtttgcccggcatgccaagaggaccaccatcaacacagaagatgtgaagctgctggcccggcgcagcaacagcctgcacatgcaggaggccgccggcatcaggaagagcagcctgctgaccttcctggcctggtggtttgagtggaccagccaggccagcgctggccccctgattggagaggaggcccgggaggtggcccggcggcaggagggcgccccaccccagcagagcgcccggcgggacaggatgccctgcaggaacttcttctggaagaccttcagcagctgcaagtag

SEQ ID NO: 35551 - DNA, 234 bp, Artificial Sequence
  Description of Artificial Sequence: Synthetic coding sequence
atggaggaggaggccgagacagaggagcagcagcgcttctcctaccagcagaggctgaaggctgctgtgcactacacagtgggctgcctgtgtgaggaggtggccctggacaaggagatgcagttcagcaagcagaccatcgccgccatcagcgagctgaccttccggcagtgtgaaaattttgccaaggacctggagatgtttgccagcatctgcaggaagaggcaggagtag

SEQ ID NO: 35552 - DNA, 600 bp, Artificial Sequence
  Description of Artificial Sequence: Synthetic coding sequence
atggaggccagccctgccagcggccccaggcacctgatggacccccacatcttcaccagcaacttcaacaacggcatcggccgccacaagacctacctgtgctatgaggtggagcggctggacaatggcacctctgtgaagatggaccagcaccggggcttcctgcacaaccaggccaagaacctgctgtgtggcttctacggcagacatgctgagctgcgcttcctggacctggtgcccagcctgcagctggaccctgcccagatctacagagtgacctggttcatctcctggagcccctgcttctcctggggctgtgccggggaggtgcgggccttcctgcaggagaacacccacgtgcggctgcgcatctttgctgcccgcatctatgactatgaccccctgtacaaggaggccctgcagatgctgagagatgctggggcccaggtgtccatcatgacctatgatgagttcaagcactgctgggacacctttgtggaccaccagggctgccccttccagccctgggatggcctggatgagcacagccaggccctgagcggccgcctgcgggccatcctgcagaaccagggcaactag

SEQ ID NO: 35553 - DNA, 1161 bp, Artificial Sequence
  Description of Artificial Sequence: Synthetic coding sequence
atgcacgcccggggcccccacggccagctgagccctgccctgcccctggccagctctgtgctgatgctgctgatgagcaccctgtggctggtgggcgccggccctggcctggtgctggcccctgagctgctgctggacccctggcaggtgcaccggctgctgacccacgccctgggccacacagccctgcccggcctgctgctgagcctgctgctgctgcccaccgtgggctggcagcaggagtgccacctgggcaccctgcgcttcctgcacgccagcgccctgctggccctggccagcggcctgctggccgtgctgctggccggcctgggcctgagcagcgctgctggcagctgtggctacatgcctgtgcacctggccatgctggccggggagggccaccggccccggcggcccaggggggccctgcccccctggctgagcccctggctgctgctggccctgacccccctgctgagcagcgagccccccttcctgcagctgctgtgtggcctgctggccggcctggcctatgctgctggggccttccgctggctggagcccagcgagcggcggctgcaggtgctgcaggagggcgtgctgtgcaggaccctggccggctgctggcccctgcggctgctggccaccccaggcagcctggccgagctgcctgtgacccaccctgctggggtgcggccccccatccctggccccccctacgtggccagcccagacctgtggagccactgggaggacagcgccctgcccccacccagcctgcggcctgtgcagcccacctgggagggcagcagcgaggccggcctggactgggccggggccagcttcagccctggcacccccatgtgggccgccctggatgagcagatgctgcaggagggcatccaggccagcctgctggatggccctgcccaggagccccagagcgccccctggctgagcaagagctctgtgagcagcctgcggctgcagcagctggagaggatgggcttccccacagagcaggccgtggtggccctggccgccaccggccgggtggagggcgctgtgtccctgctggtgggcggccaggtgggcacagagaccctggtgacccacggcaagggcggccctgcccacagcgagggccctggccccccatag

SEQ ID NO: 35554 - DNA, 1161 bp, Artificial Sequence
  Description of Artificial Sequence: Synthetic coding sequence
atgaacccccagatccggaaccccatggagaggatgtacagagacaccttctatgacaactttgaaaatgagcccatcctgtatggccgcagctacacctggctgtgctatgaggtgaagatcaagaggggccgcagcaacctgctgtgggacaccggggtcttccggggccctgtgctgcccaagaggcagagcaaccaccggcaggaggtgtacttccgctttgagaaccacgccgagatgtgcttcctgtcctggttctgtggcaaccggctgcctgccaacagacgcttccagatcacctggtttgtgtcctggaacccctgcctgccctgtgtggtgaaggtgaccaagttcctggccgagcaccccaacgtgaccctgaccatctctgctgcccggctgtactactacagagaccgggactggcgctgggtgctgctgcggctgcacaaggccggggcccgggtgaagatcatggactatgaagattttgcctactgctgggagaactttgtgtgcaatgaaggccagcccttcatgccctggtacaagtttgatgacaactatgccagcctgcacaggaccctgaaggagatcctgaggaaccccatggaggccatgtacccccacatcttctacttccacttcaagaacctgctgaaggcctgtggcagaaatgaatcctggctgtgcttcaccatggaggtgaccaagcaccacagcgctgtgttcaggaagaggggcgtcttcaggaaccaggtggaccctgagacccactgccacgccgagcgctgcttcctgtcctggttctgtgatgacatcctgagccccaacaccaactatgaggtgacctggtacacctcctggagcccctgcccagaatgtgccggggaggtggccgagttcctggcccggcacagcaatgtgaacctgaccatcttcaccgcccggctgtgctacttctgggacacagactaccaggagggcctgtgcagcctgagccaggagggcgcctctgtgaagatcatgggctacaaggactttgtgtcctgctggaagaactttgtgtacagtgatgatgagcccttcaagccctggaagggcctgcagaccaacttccggctgctgaagaggcggctgcgggagatcctgcagtag

SEQ ID NO: 35555 - DNA, 609 bp, Artificial Sequence
  Description of Artificial Sequence: Synthetic coding sequence
atgaacccccagatccggaaccccatggagaggatgtacagagacaccttctatgacaactttgaaaatgagcccatcctgtatggccgcagctacacctggctgtgctatgaggtgaagatcaagaggggccgcagcaacctgctgtgggacaccggggtcttccggggccctgtgctgcccaagaggcagagcaaccaccggcaggaggtggaccctgagacccactgccacgccgagcgctgcttcctgtcctggttctgtgatgacatcctgagccccaacaccaactatgaggtgacctggtacacctcctggagcccctgcccagaatgtgccggggaggtggccgagttcctggcccggcacagcaatgtgaacctgaccatcttcaccgcccggctgtgctacttctgggacacagactaccaggagggcctgtgcagcctgagccaggagggcgcctctgtgaagatcatgggctacaaggactttgtgtcctgctggaagaactttgtgtacagtgatgatgagcccttcaagccctggaagggcctgcagaccaacttccggctgctgaagaggcggctgcgggagatcctgcagtag

SEQ ID NO: 35556 - DNA, 3210 bp, Artificial Sequence
  Description of Artificial Sequence: Synthetic coding sequence
atggacttcctgcggctgtacctgcccggcctgcaccaggccctgcggggggccctggacagcctgggcacctttgtgtcctacctgctgggagatgctgtgcccaccgtggagcgggaggcccaggccgctgaggagctgggcgtggtggccgtgggcaagacaggcaagatcgtggaggaggaggcccaggaggacctggagggcctgcggggcagccagaatgaaggagctggccgcctgcggggccctggagatgacagaagacatgaggtgggcagcagcgctgtggagcagacctggggctggggagatggcagcagccacggcagccaggccgagcggcaggacagcggggccggggagacagccaaggccgcccgctgccaggagcccagcgcccacctggaggccaggaagaagagcaaggccggcagcggggcctgccaggacagaagtggccaggcccaggagcggcaggagagccatgagcaggaggtgaaccgggaggagcggctgcgctcctgggagcaggaggaggaggaggaggaggtgcgggcccgggagcccggcatggcccggggagctgagagcgagtggacctggcatggagaaacagagggcaaggccggggctgtgggccccaaggccgccggggacaaccgggagatggagcagggcgtgcgggaggctgatgctggggagacagaggagcctggagctgagggcgctgggaagggggaggaggtggtggtggtggagaaggcctgtgagagcacccgggcctggggcacctggggccctggagctgagcctgaggactggggcatcctgggccgggaggaggcccggaccaccccaggccgggaggaggcccgggccatcctggatggagaggaggcccggaccatctctggaggagaggaggccgagacagccagcggcggggaggaggccgagacagccagcggcggggaggaggccggcacagccagcggcggggaggaggccggcatcgccagcggcggggaggccggcacagccagcggcggggaggaggccggcacagccagcggaggagatgaggcctggaccaccagcggcaaggaggaggccgacctgctgggcgtgcggcagacagaatatggagctgtgcctggagagcggctgctggaggccaccgggaaggtgtgggtgctggaggaggagggagatgaggagcgggaggccgaggtgagccccttccccaagcagccccaggtgctgggcacagagaggacagaggaggccgctgagagccagacagctggccgggaggccgtgggcggccaggaggccggggagagctttgagggccaggtggacctgcggggcaaggaggccgagatgaggcaggacctgggcatccgggctgaccgggccaggatggaggagctggtgcaggccgaggaggcccaggaggagcggggcagcagccgggaccctgtggccgagctgcccagtgatggagaggccgagggcacagctgacctggaggccaccccagaggcccggcctgaggaggagctgaccggggaggagagcgaggccgcccagaccagctgtggcctgctgggcgtggagtggggcggcctgacccacagcgtgaccaagggccagggccctgagctgatgggcggggcccagacccccaccaagcagcctgaggagcgggaggccggggaggtggagctgatgggcgtgctggccctgagcaaggaggagcaggagaggagcctggaggccggccccaggcatgctggctctgtgaagccagaggccagcgaggccttccctggggcctgggagaacagaaccaggaaggacatggagcggggcaacacccaggaggatgctgctgatggagagcagcgggaggaggaggagacagctgggggccagaccctggccgctgaggccgagggggaccgggagagcgagctgtctgaggtgcctgaggccggcggggagggcctgaccacccaggatgctggctgcggcacagaggagggggaggcctctgtgtctgagaaccaggagctggatggcagcactggagcagatgctggcccctgccccagcctgggggaggcctatgcccgggagacagaagatgaggaggccgaggccgacaggaccagccggcggggctggaggctgcaggccgtggccgtgggcctgcctgaccgggaggatgcccagacaggctctgtggccgccggcatcatgggaggagatgtggtgccccacatctctgctgctggagctggggaggccctggagggcgtgctgggccagggctgggacagcaaggagaaggaggaggccgctgctggggagcacgccggcggccaggagtttggcctggagggcagcgctgaggaggaggtgacaggccggggcagccaggtggaggcctttgagagccgggagggcggcccctggggcggccgggtggaggccgaggagagcgctggagctgaggacagctgtggcctggaccctgctggcagccagacagcccgggcagagggcatgggcgccatggtggaggccggcggcctgctggagaagtggaccctgctggaggaggaggccgtgggctggcaggagcgggagcagagagaagattctgagggccgctgtggggactaccaccctgagggggaggccccccggctgctggatgctgagggcctgatggtgactggaggaagaagagctgaggccaaggagacagagcctgagagcctggagcacgtgcggggccaggaggagcagcccacccaccaggccccagctgaggccgcccctgagagcgtgggggaggccgagacagctgaggccatgggcagcgcccggggcggggccgccaacagctggagcgaggcccccctgcccggcagcctgctggatgtgtctgtgcccaggagccgggtgcacctgagccgcagcagcagccagaggaggagccggcccagcttccggaggaccccagcctgggagcagcaggaggagcccccagcccccaaccccccagaggaggagctgagcgcccctgagcagaggcccctgcagctggaggagcccctggagccccgctgggaggaccggctgcggcctggggtgcgggaccagcccggccagcacagcaagatccccatcttctag

SEQ ID NO: 35557 - DNA, 3267 bp, Artificial Sequence
  Description of Artificial Sequence: Synthetic coding sequence
atggacttcctgcggctgtacctgcccggcctgcaccaggccctgcggggggccctggacagcctgggcacctttgtgtcctacctgctgggagatgctgtgcccaccgtggagcgggaggcccaggccgctgaggagctgggcgtggtggccgtgggcaagacaggcaagatcgtggaggaggaggcccaggaggacctggagggcctgcggggcagccagaatgaaggagctggccgcctgcggggccctggagatgacagaagacatgaggtgggcagcagcgctgtggagcagacctggggctggggagatggcagcagccacggcagccaggccgagcggcaggacagcggggccggggagacagccaaggccgcccgctgccaggagcccagcgcccacctggaggccaggaagaagagcaaggccggcagcggggcctgccaggacagaagtggccaggcccaggagcggcaggagagccatgagcaggaggtgaaccgggaggagcggctgcgctcctgggagcaggaggaggaggaggaggaggtgcgggcccgggagcccggcatggcccggggagctgagagcgagtggacctggcatggagaaacagagggcaaggccggggctgtgggccccaaggccgccggggacaaccgggagatggagcagggcgtgcgggaggctgatgctggggagacagaggagcctggagctgagggcgctgggaagggggaggaggtggtggtggtggagaaggcctgtgagagcacccgggcctggggcacctggggccctggagctgagcctgaggactggggcatcctgggccgggaggaggcccggaccaccccaggccgggaggaggcccgggccatcctggatggagaggaggcccggaccatctctggaggagaggaggccgagacagccagcggcggggaggaggccgagacagccagcggcggggaggaggccggcacagccagcggcggggaggaggccggcatcgccagcggcggggaggccggcacagccagcggcggggaggaggccggcacagccagcggaggagatgaggcctggaccaccagcggcaaggaggaggccgacctgctgggcgtgcggcagacagaatatggagctgtgcctggagagcggctgctggaggccaccgggaaggtgtgggtgctggaggaggagggagatgaggagcgggaggccgaggtgagccccttccccaagcagccccaggtgctgggcacagagaggacagaggaggccgctgagagccagacagctggccgggaggccgtgggcggccaggaggccggggagagctttgagggccaggtggacctgcggggcaaggaggccgagatgaggcaggacctgggcatccgggctgaccgggccaggatggaggagctggtgcaggccgaggaggcccaggaggagcggggcagcagccgggaccctgtggccgagctgcccagtgatggagaggccgagggcacagctgacctggaggccaccccagaggcccggcctgaggaggagctgaccggggaggagagcgaggccgcccagaccagctgtggcctgctgggcgtggagtggggcggcctgacccacagcgtgaccaagggccagggccctgagctgatgggcggggcccagacccccaccaagcagcctgaggagcgggaggccggggaggtggagctgatgggcgtgctggccctgagcaaggaggagcaggagaggagcctggaggccggccccaggcatgctggctctgtgaagccagaggccagcgaggccttccctggggcctgggagaacagaaccaggaaggacatggagcggggcaacacccaggaggatgctgctgatggagagcagcgggaggaggaggagacagctgggggccagaccctggccgctgaggccgagggggaccgggagagcgagctgtctgaggtgcctgaggccggcggggagggcctgaccacccaggatgctggctgcggcacagaggagggggaggcctctgtgtctgagaaccaggagctggatggcagcactggagcagatgctggcccctgccccagcctgggggaggcctatgcccgggagacagaagatgaggaggccgaggccgacaggaccagccggcggggctggaggctgcaggccgtggccgtgggcctgcctgaccgggaggatgcccagacaggctctgtggccgccggcatcatgggaggagatgtggtgccccacatctctgctgctggagctggggaggccctggagggcgtgctgggccagggctgggacagcaaggagaaggaggaggccgctgctggggagcacgccggcggccaggagtttggcctggagggcagcgctgaggaggaggtgacaggccggggcagccaggtggaggcctttgagagccgggagggcggcccctggggcggccgggtggaggccgaggagagcgctggagctgaggacagctgtggcctggaccctgctggcagccagacagcccgggcagagggcatgggcgccatggtggaggccggcggcctgctggagaagtggaccctgctggaggaggaggccgtgggctggcaggagcgggagcagagagaagattctgagggccgctgtggggactaccaccctgagggggaggccccccggctgctggatgctgagggcctgatggtgactggaggaagaagagctgaggccaaggagacagagcctgagagcctggagcacgtgcggggccaggaggagcagcccacccaccaggccccagctgaggccgcccctgagagcgtgggggaggccgagacagctgaggccatgggcagcgcccggggcggggccgccaacagctggagcgaggcccccctgcccggcagcctgctggatgtgtctgtgcccaggagccgggtgcacctgagccgcagcagcagccagaggaggagccggcccagcttccggaggaccccagcctgggagcagcaggaggagcccccagcccccaaccccccagaggaggagctgagcgcccctgagcagaggcccctgcagctggaggagcccctggagcccagccccctgcggcatgatggcacccctgtgcctgcccggcggcggcccctgggccacggcttcggcctggcccaccctggcatgatgcaggagctgcaggcccggctgggccggcccaagccccagtag

SEQ ID NO: 35558 - DNA, 3294 bp, Artificial Sequence
  Description of Artificial Sequence: Synthetic coding sequence
atggacttcctgcggctgtacctgcccggcctgcaccaggccctgcggggggccctggacagcctgggcacctttgtgtcctacctgctgggagatgctgtgcccaccgtggagcgggaggcccaggccgctgaggagctgggcgtggtggccgtgggcaagacaggcaagatcgtggaggaggaggcccaggaggacctggagggcctgcggggcagccagaatgaaggagctggccgcctgcggggccctggagatgacagaagacatgaggtgggcagcagcgctgtggagcagacctggggctggggagatggcagcagccacggcagccaggccgagcggcaggacagcggggccggggagacagccaaggccgcccgctgccaggagcccagcgcccacctggaggccaggaagaagagcaaggccggcagcggggcctgccaggacagaagtggccaggcccaggagcggcaggagagccatgagcaggaggtgaaccgggaggagcggctgcgctcctgggagcaggaggaggaggaggaggaggtgcgggcccgggagcccggcatggcccggggagctgagagcgagtggacctggcatggagaaacagagggcaaggccggggctgtgggccccaaggccgccggggacaaccgggagatggagcagggcgtgcgggaggctgatgctggggagacagaggagcctggagctgagggcgctgggaagggggaggaggtggtggtggtggagaaggcctgtgagagcacccgggcctggggcacctggggccctggagctgagcctgaggactggggcatcctgggccgggaggaggcccggaccaccccaggccgggaggaggcccgggccatcctggatggagaggaggcccggaccatctctggaggagaggaggccgagacagccagcggcggggaggaggccgagacagccagcggcggggaggaggccggcacagccagcggcggggaggaggccggcatcgccagcggcggggaggccggcacagccagcggcggggaggaggccggcacagccagcggcggggaggaggccggcacagccagcggaggagatgaggcctggaccaccagcggcaaggaggaggccgacctgctgggcgtgcggcagacagaatatggagctgtgcctggagagcggctgctggaggccaccgggaaggtgtgggtgctggaggaggagggagatgaggagcgggaggccgaggtgagccccttccccaagcagccccaggtgctgggcacagagaggacagaggaggccgctgagagccagacagctggccgggaggccgtgggcggccaggaggccggggagagctttgagggccaggtggacctgcggggcaaggaggccgagatgaggcaggacctgggcatccgggctgaccgggccaggatggaggagctggtgcaggccgaggaggcccaggaggagcggggcagcagccgggaccctgtggccgagctgcccagtgatggagaggccgagggcacagctgacctggaggccaccccagaggcccggcctgaggaggagctgactggagaggagagcgaggccgcccagaccagctgtggcctgctgggcgtggagtggggcggcctgacccacagcgtgaccaagggccagggccctgagctgatgggcggggcccagacccccaccaagcagcctgaggagcgggaggccggggaggtggagctgatgggcgtgctggccctgagcaaggaggagcaggagaggagcctggaggccggccccaggcatgctggctctgtgaagccagaggccagcgaggccttccctggggcctgggagaacagaaccaggaaggacatggagcggggcaacacccaggaggatgctgctgatggagagcagcgggaggaggaggagacagctgggggccagaccctggccgctgaggccgagggggaccgggagagcgagctgtctgaggtgcctgaggccggcggggagggcctgaccacccaggatgctggctgcggcacagaggagggggaggcctctgtgtctgagaaccaggagctggatggcagcactggagcagatgctggcccctgccccagcctgggggaggcctatgcccgggagacagaagatgaggaggccgaggccgacaggaccagcagaagaggctggaggctgcaggccgtggccgtgggcctgcctgacagagaagatgcccagacaggctctgtggccgccggcatcatgggaggagatgtggtgccccacatctctgctgctggggccggggaggccctggagggcgtgctgggccagggctgggacagcaaggagaaggaggaggccgccgccggggagcacgccggcggccaggagtttggcctggagggcagcgctgaggaggaggtgacaggccggggcagccaggtggaggcctttgagagccgggagggcggcccctggggcggccgggtggaggccgaggagagcgctggagctgaggacagctgtggcctggaccctgctggcagccagacagcccgggcagagggcatgggcgccatggtggaggccggcggcctgctggagaagtggaccctgctggaggaggaggccgtgggctggcaggagcgggagcagcgggaggacagcgagggccgctgtggggactaccaccctgagggggaggccccccggctgctggatgctgagggcctgatggtgactggaggccggcgggcagaggccaaggagacagagcctgagagcctggagcacgtgcggggccaggaggagcagcccacccaccaggccccagctgaggccgcccctgagagcgtgggggaggccgagacagctgaggccatgggcagcgcccggggcggggccgccaacagctggagcgaggcccccctgcccggcagcctgctggatgtgtctgtgcccaggagccgggtgcacctgagccgcagcagcagccagaggaggagccggcccagcttccggaggaccccagcctgggagcagcaggaggagcccccagcccccaaccccccagaggaggagctgagcgcccctgagcagaggcccctgcagctggaggagcccctggagcccagccccctgcggcatgatggcacccctgtgcctgccaggagaagacccctgggccacggcttcggcctggcccaccctggcatgatgcaggagctgcaggcccggctgggccggcccaagccccagtag

SEQ ID NO: 35559 - DNA, 384 bp, Artificial Sequence
  Description of Artificial Sequence: Synthetic coding sequence
atgagcctgctgaggaaccggctgcaggccctgcctgccctgtgcctgtgtgtgctggtgctggcctgcatcggggcctgccagcctgaggcccaggagggcaccctgagccccccacccaagctgaagatgagccgctggagcctggtgcggggccgcatgaaggagctgctggagaccgtggtgaacagaacaagagatggctggcagtggttctggagccccagcaccttccggggcttcatgcagacctactatgatgaccacctgcgggacctgggccccctgaccaaggcctggttcctggagagcaaggacagcctgctgaagaagacccacagcctgtgcccccggctggtgtgtggggacaaggaccagggctag

SEQ ID NO: 35560 - DNA, 924 bp, Artificial Sequence
  Description of Artificial Sequence: Synthetic coding sequence
atggccggcctgaatgtgtccctgtccttcttctttgccaccttcaccctgtgtgaggccgcccggcgggccagcaaggccctgctgcctgtgggcgcctatgaggtgtttgcccgggaggccgtgggcgctgtgcagctgggcgcctgcttcctggagatgaggaccctggtggagctgggcccctgggccggggactttggaccagacctgctgctgaccctgctcttcctgctcttcctggcccatggagtgaccctggatggagccagcgccaaccccaccgtgtccctgcaggagttcctgatggccgaggagagcctgcccggcaccctgctgaagctggccgcccagggcctgggcatgcaggccgcctgcaccctgacccggctgtgctgggcctgggagctgagtgacctgcacctgctgcagagcctgatggcccagagctgcagcagcgccctgcggacctctgtgccccatggagccctggtggaggccgcctgtgccttctgcttccacctgaccctgctgcacctgcggcacagccccccagcctacagcggccctgctgtggccctgctggtgacagtgacagcctacacagctggccccttcaccagcgccttcttcaacccagccctggccgcctctgtgacctttgcctgcagcggccacaccctgctggagtatgtgcaggtgtactggctgggccccctgaccggcatggtgctggccgtgctgctgcaccagggccgcctgccccacctgttccagaggaacctcttctacggccagaagaacaagtaccgggccccccggggcaagccagccccagccagcggggacacccagaccccagccaagggcagctctgtgcgggagcccggccgctctggagtggagggcccccacagcagctag

SEQ ID NO: 35561 - DNA, 1497 bp, Artificial Sequence
  Description of Artificial Sequence: Synthetic coding sequence
atgctgcagtgcaggcctgcccaggagttctcctttggcccccgggccctgaaggatgccctggtgtccacagatgctgccctgcagcagctgtatgtgtctgccttcagccctgctgagcggctcttcctggccgaggcctacaacccccagaggaccctcttctgcaccctgctgatcagaacaggctttgactggctgctgagcaggcctgaggcccctgaggacttccagaccttccacgccagcctgcagcacaggaagccccggctggccaggaagcacatctacctgcagcccatcgacctgtctgaggagcctgtgggcagcagcctgctgcaccagctgtgcagctgcacagaggccttcttcctgggcctgcgggtgaagtgcctgcccagcgtggccgccgccagcatccgctgcagcagccggcccagccgggacagcgaccggctgcagctgcacacagatggcatcctgtccttcctgaagaacaacaagccaggagatgccctgtgtgtgctgggcctgaccctgagtgacctgtacccccatgaggcctggagcttcaccttcagcaagttcctgcccggccacgaggtgggcgtgtgcagctttgcccgcttctctggagagttccccaagagcggccccagcgccccagacctggccctggtggaggccgctgctgatggccctgaggcccccctgcaggaccggggctgggccctgtgcttcagcgccctgggcatggtgcagtgctgcaaggtgacctgccacgagctgtgccacctgctgggcctgggcaactgccgctggctgcgctgcctgatgcagggcgccctgagcctggatgaggccctgcggcggcccctggacctgtgccccatctgcctgaggaagctgcagcacgtgctgggcttccgcctcatcgagcgctaccagaggctgtacacctggacccaggccgtggtgggcacctggcccagccaggaggccggggagcccagcgtgtgggaggacaccccaccagccagcgctgacagcggcatgtgctgtgagagtgacagcgagcccggcacctctgtgtctgagcccctgaccccagatgctggcagccacacctttgccagcggccctgaggagggcctgagctacctggccgccagcgaggcccccctgcccccaggcggccctgctgaggccatcaaggagcacgagcgctggctggccatgtgcatccaggccctgcagcgggaggtggccgaggaggacctggtgcaggtggacagagctgtggatgccctggaccgctgggagatgttcaccggccagctgcctgccacccggcaggacccccccagcagccgggacagcgtgggcctgaggaaggtgctgggggacaagttcagcagcctgcggaggaagctgagcgccaggaagctggcccgggcagagagcgccccccggccctgggatggagaggagagctag

SEQ ID NO: 35562 - DNA, 909 bp, Artificial Sequence
  Description of Artificial Sequence: Synthetic coding sequence
atgcagatcatccgccacagcgagcagaccctgaagacagccctgatcagcaagaaccctgtgctggtgtcccagtatgagaagctgaatgctggggagcagaggctgatgaatgaggccttccagcctgccagtgacctgtttggccccatcaccctgcacagccccagcgactggatcaccagccaccctgaggccccccaggactttgagcagttcttcagtgacccctacaggaagacccccagccccaacaagaggagcatctacatccagagcatcggggacatcctgaagttcctgaagaagaagaagccagaagatgccttctgtgtggtgggcatcaccatgattgacctgtacccccgggacagctggaactttgtgtttggccaggccagcctgacagatggagtgggcatcttctcctttgcccgctatggcagtgacttctacagcatgcactacaagggcaaggtgaagaagctgaagaagaccagcagcagtgactacagcatctttgacaactactacatccctgagatcacctctgtgctgctgctgcggagctgcaagaccctgacccatgagatcggccacatcttcggcctgcggcactgccagtggctggcctgcctgatgcagggcagcaaccacctggaggaggccgacagaagacccctgaacctgtgccccatctgcctgcacaagctgcagtgtgctgtgggcttcagcatcgtggagcgctacaaggccctggtgcgctggattgatgatgagagcagtgacacccctggggccaccccagagcacagccatgaggacaatggaaacctgcccaagcctgtggaggccttcaaggagtggaaggagtggatcatcaagtgcctggccgtgctgcagaagtag

SEQ ID NO: 35563 - DNA, 1083 bp, Artificial Sequence
  Description of Artificial Sequence: Synthetic coding sequence
atgcagatcatccgccacagcgagcagaccctgaagacagccctgatcagcaagaaccctgtgctggtgtcccagtatgagaagctgaatgctggggagcagaggctgatgaatgaggccttccagcctgccagtgacctgtttggccccatcaccctgcacagccccagcgactggatcaccagccaccctgaggccccccaggactttgagcagttcttcagtgacccctacaggaagacccccagccccaacaagaggagcatctacatccagagcatcggcagcctgggcaacacccgcatcatcagcgaggagtacatcaagtggctgaccggctactgcaaggcctacttctacggcctgcgggtgaagctgctggagcctgtgcctgtgtctgtgacccgctgcagcttccgggtgaatgaaaacacccacaacctgcagatccacgccggggacatcctgaagttcctgaagaagaagaagccagaagatgccttctgtgtggtgggcatcaccatgattgacctgtacccccgggacagctggaactttgtgtttggccaggccagcctgacagatggagtgggcatcttctcctttgcccgctatggcagtgacttctacagcatgcactacaagggcaaggtgaagaagctgaagaagaccagcagcagtgactacagcatctttgacaactactacatccctgagatcacctctgtgctgctgctgcggagctgcaagaccctgacccatgagatcggccacatcttcggcctgcggcactgccagtggctggcctgcctgatgcagggcagcaaccacctggaggaggccgacagaagacccctgaacctgtgccccatctgcctgcacaagctgcagtgtgctgtgggcttcagcatcgtggagcgctacaaggccctggtgcgctggattgatgatgagagcagtgacacccctggggccaccccagagcacagccatgaggacaatggaaacctgcccaagcctgtggaggccttcaaggagtggaaggagtggatcatcaagtgcctggccgtgctgcagaagtag

SEQ ID NO: 35564 - DNA, 1083 bp, Artificial Sequence; identical to SEQ ID NO: 35563
  Description of Artificial Sequence: Synthetic coding sequence

SEQ ID NO: 35565 - DNA, 1083 bp, Artificial Sequence; identical to SEQ ID NO: 35563
  Description of Artificial Sequence: Synthetic coding sequence

SEQ ID NO: 35566 - DNA, 1083 bp, Artificial Sequence; identical to SEQ ID NO: 35563
  Description of Artificial Sequence: Synthetic coding sequence

SEQ ID NO: 35567 - DNA, 1083 bp, Artificial Sequence; identical to SEQ ID NO: 35563
  Description of Artificial Sequence: Synthetic coding sequence

SEQ ID NO: 35568 - DNA, 2505 bp, Artificial Sequence
  Description of Artificial Sequence: Synthetic coding sequence
atgacagtggagtttgaagaatgtgtgaaggacagcccccgcttccgggccaccattgatgaggtggagacagatgtggtggagattgaggccaagctggacaagctggtgaagctgtgcagcggcatggtggaggccggcaaggcctacgtgtccaccagccggctgtttgtgtctggagtgcgggacctgagccagcagtgccagggcgacaccgtcatcagcgagtgcctgcagagatttgctgacagcctgcaggaggtggtgaactaccacatgatcctgtttgaccaggcccagaggtctgtgcggcagcagctgcagagctttgtgaaggaggatgtgaggaagttcaaggagaccaagaagcagtttgacaaggtgcgggaggacctggagctgagcctggtgagaaatgcccaggcccccaggcaccggccccatgaggtggaggaggccaccggggccctgaccctgaccaggaagtgcttccgccacctggccctggactatgtgctgcagatcaacgtgctgcaggccaagaagaagtttgagatcctggacagcatgctgtccttcatgcacgcccagagcagcttcttccagcagggctacagcctgctgcaccagctggacccctacatgaagaagctggccgctgagctggaccagctggtgattgattctgctgtggagaagcgggagatggagaggaagcatgctgccatccagcagaggaccctgctgcaggacttctcctatgatgagagcaaggtggagtttgatgtggatgcccccagcggcgtggtgatggagggctacctgttcaagagggccagcaatgccttcaagacctggaacagacgctggttcagcatccagaacagccagctggtgtaccagaagaagctgaaggatgccctgactgtggtggtggatgacctgcggctgtgcagcgtgaagccctgtgaggacatcgagcggcgcttctgctttgaggtgctgagccccaccaagagctgcatgctgcaggccgacagcgagaagctgcggcaggcctgggtgcaggccgtgcaggccagcatcgccagcgcctaccgggagagcccagacagctgctacagcgagcggctggacagaacagccagccccagcaccagcagcattgattctgccacagacacccgggagcggggcgtgaagggggagagcgtgctgcagagggtgcagagcgtggccggcaacagccagtgtggggactgtggccagcctgacccccgctgggccagcatcaacctgggcgtgctgctgtgcatcgagtgcagcggcatccacaggagcctgggcgtgcactgcagcaaggtgcgcagcctgaccctggacagctgggagcctgagctgctgaagctgatgtgtgagctgggcaacagcgctgtgaaccagatctatgaggcccagtgtgagggcgccggcagcaggaagcccacagccagcagcagccggcaggacaaggaggcctggatcaaggacaagtatgtggagaagaagttcctgaggaaggcccccatggccccagccctggaggccccccggcgctggagggtgcagaagtgcctgcggccccacagcagcccccgggcccccacagcccggaggaaggtgcggctggagcctgtgctgccctgtgtggccgccctgagctctgtgggcaccctggacaggaagttcagaagagacagcctcttctgcccagatgagctggacagcctcttctcctactttgatgctggagctgctggagctggccccaggagcctgagcagtgacagcggcctgggcggcagcagtgatggcagcagtgatgtgctggcctttggaagtggctctgtggtggacagcgtgacagaggaggagggcgctgagagcgaggagagcagcggggaggctgatggagacacagaagctgaggcctggggcctggctgatgtgcgggagctgcaccctggcctgctggcccacagagctgcccgggcccgggacctgcctgccctggccgccgccctggcccacggggctgaggtgaactgggcagatgctgaagatgagggcaagacccccctggtgcaggccgtgctgggcggcagcctgattgtgtgtgagttcctgctgcagaatggagcagatgtgaaccagagggacagccggggccgggcccccctgcaccacgccaccctgctgggccgcacaggccaggtgtgcctcttcctgaagagaggagctgaccagcacgccctggaccaggagcagagggaccccctggccatcgctgtgcaggccgccaatgctgacatcgtgaccctgctgcggctggccaggatggccgaggagatgagggaggccgaggccgcccctggccccccaggggccctggccggcagccccacagagctgcagttccgccgctgcatccaggagttcatcagcctgcacctggaggagagctag

SEQ ID NO: 35569 - DNA, 2280 bp, Artificial Sequence
  Description of Artificial Sequence: Synthetic coding sequence
atggtggaggccggcaaggcctacgtgtccaccagccggctgtttgtgtctggagtgcgggacctgagccagcagtgccagggcgacaccgtcatcagcgagtgcctgcagagatttgctgacagcctgcaggaggtggtgaactaccacatgatcctgtttgaccaggcccagaggtctgtgcggcagcagctgcagagctttgtgaaggaggatgtgaggaagttcaaggagaccaagaagcagtttgacaaggtgcgggaggacctggagctgagcctggtgagaaatgcccaggcccccaggcaccggccccatgaggtggaggaggccaccggggccctgaccctgaccaggaagtgcttccgccacctggccctggactatgtgctgcagatcaacgtgctgcaggccaagaagaagtttgagatcctggacagcatgctgtccttcatgcacgcccagagcagcttcttccagcagggctacagcctgctgcaccagctggacccctacatgaagaagctggccgctgagctggaccagctggtgattgattctgctgtggagaagcgggagatggagaggaagcatgctgccatccagcagaggaccctgctgcaggacttctcctatgatgagagcaaggtggagtttgatgtggatgcccccagcggcgtggtgatggagggctacctgttcaagagggccagcaatgccttcaagacctggaacagacgctggttcagcatccagaacagccagctggtgtaccagaagaagctgaaggatgccctgactgtggtggtggatgacctgcggctgtgcagcgtgaagccctgtgaggacatcgagcggcgcttctgctttgaggtgctgagccccaccaagagctgcatgctgcaggccgacagcgagaagctgcggcaggcctgggtgcaggccgtgcaggccagcatcgccagcgcctaccgggagagcccagacagctgctacagcgagcggctggacagaacagccagccccagcaccagcagcattgattctgccacagacacccgggagcggggcgtgaagggggagagcgtgctgcagagggtgcagagcgtggccggcaacagccagtgtggggactgtggccagcctgacccccgctgggccagcatcaacctgggcgtgctgctgtgcatcgagtgcagcggcatccacaggagcctgggcgtgcactgcagcaaggtgcgcagcctgaccctggacagctgggagcctgagctgctgaagctgatgtgtgagctgggcaacagcgctgtgaaccagatctatgaggcccagtgtgagggcgccggcagcaggaagcccacagccagcagcagccggcaggacaaggaggcctggatcaaggacaagtatgtggagaagaagttcctgaggaaggcccccatggccccagccctggaggccccccggcgctggagggtgcagaagtgcctgcggccccacagcagcccccgggcccccacagcccggaggaaggtgcggctggagcctgtgctgccctgtgtggccgccctgagctctgtgggcaccctggacaggaagttcagaagagacagcctcttctgcccagatgagctggacagcctcttctcctactttgatgctggagctgctggagctggccccaggaaaggagctgagagcgaggagagcagtggagaggctgatggagacacagaggccgaggcctggggcctggctgatgtgcgggagctgcaccctggcctgctggcccaccgggccgcccgggcccgggacctgcctgccctggccgccgccctggcccatggagctgaggtgaactgggcagatgctgaagatgagggcaagacccccctggtgcaggccgtgctgggcggcagcctcatcgtgtgtgagttcctgctgcagaatggagcagatgtgaaccagagggacagccggggccgggcccccctgcaccacgccaccctgctgggccgcacaggccaggtgtgcctcttcctgaagagaggagctgaccagcacgccctggaccaggagcagagggaccccctggccatcgctgtgcaggccgccaatgctgacatcgtgaccctgctgcggctggccaggatggccgaggagatgagggaggccgaggccgcccctggccccccaggggccctggccggcagccccacagagctgcagttccgccgctgcatccaggagttcatcagcctgcacctggaggagagctag

SEQ ID NO: 35570 - DNA, 468 bp, Artificial Sequence
  Description of Artificial Sequence: Synthetic coding sequence
atggtgatggccgccaagaagggccctggccctgggggcggcgtgtctgggggcaaggccgaggccgaggccgccagcgaggtgtggtgcagaagagtgcgggagctgggcggctgcagccaggccggcaacagacactgctttgaatgtgcccagaggggcgtgacctacgtggacatcaccgtgggcagctttgtgtgcaccacctgcagcggcctgctgcggggcctgaaccccccccaccgggtgaagagcatctccatgaccaccttcacagagcctgaggtggtgttcctgcagagcagaggaaatgaggtgtgcaggaagatctggctgggcctgtttgatgcccggaccagcctggtgcctgacagccgggacccccagaaggtgaaggagttcctgcaggagaagtatgagaagaagcgctggccagacaccttcccccggcggctgtgccagctgtag

SEQ ID NO: 35571 - DNA, 1446 bp, Artificial Sequence
  Description of Artificial Sequence: Synthetic coding sequence
atggtgatggccgccaagaagggccctggccctgggggcggcgtgtctgggggcaaggccgaggccgaggccgccagcgaggtgtggtgcagaagagtgcgggagctgggcggctgcagccaggccggcaacagacactgctttgaatgtgcccagaggggcgtgacctacgtggacatcaccgtgggcagctttgtgtgcaccacctgcagcggcctgctgcggggcctgaaccccccccaccgggtgaagagcatctccatgaccaccttcacagagcctgaggtggtgttcctgcagagcagaggaaatgaggtgtgcaggaagatctggctgggcctgtttgatgcccggaccagcctggtgcctgacagccgggacccccagaaggtgaaggagttcctgcaggagaagtatgagaagaagcgctggtacgtgcccccagaccaggtgaagggccccacctacaccaagggcagcgccagcacccctgtgcagggcagcatccctgagggcaagcccctgcggaccctgctgggggaccctgcccccagcctgtctgtggccgccagcaccagcagccagcctgtgtcccagagccacgcccggaccagccaggcccggagcacccagcccccaccccacagctctgtgaagaaggccagcacagacctgctggccgacattggaggagacccctttgctgccccccagatggccccagcctttgctgccttccctgcctttggaggccagacccccagccagggcggctttgccaactttgatgccttcagcagcggccccagcagctctgtgtttggcagcctgcccccagctggccaggccagcttccaggcccagcccaccccagctggcagcagccagggcaccccatttggagccacccccctggccccagccagccagcccaacagcctggctgatgtgggcagcttcctgggccctggggtgcctgctgctggggtgcccagcagcctgtttggcatggccggccaggtgccccccctgcagagcgtgaccatgggcggcggcggcggcagcagcacaggcctggcctttggagccttcaccaaccccttcaccgccccagctgcccagagccccctgcccagcaccaaccccttccagcccaacggcctggcccctggccctggcttcggcatgagcagcgctggccctggcttcccccaggccgtgccccccaccggggcctttgccagcagcttccctgcccccctcttccccccccagacccccctggtgcagcagcagaatggcagcagctttggagacctgggcagcgccaagctgggccagaggcccctgagccagcctgctggcatcagcaccaaccccttcatgacaggccccagcagcagcccctttgccagcaagccacccaccaccaaccccttcctgtag

SEQ ID NO: 35572 - DNA, 1992 bp, Artificial Sequence
  Description of Artificial Sequence: Synthetic coding sequence
gagctgctgcgcatcagcccagacctgctggccgctgctgtgatcagcgcccaggaggagcccctgaccaacatccagagggccagcggccccaccggcctgctgtggagcgtgtccctggagtttgaccagcagcagggctctgtgtgccccagcgagagcgagatctatgaagctggagctgaggacaggatggccggggcccccatggctgctgctgtgcagcctgctgaggtgacagtggaggtgggggaggacctgcacatgcaccaggtgcgggaccgggagatgcctgaggccctggagttcaacctgagcgccaaccctgaggccagcaccatcttccagaggaacagccagacagatgccctggagttcaacagcagcgccaaccctgaggccagcaccatcttccagaggaacagccagacagatgtggtggagatccgccgcagcaactgcaccaaccacgtgtccacagagcgcttcagccagcagtacagcagctgcagcaccatcttcctggatgacagcacagccatccagcactacctgaccatgaccatcatctctgtgaccctggagatcccccaccacatcacccagagagatgctgacaggagcctgagcatcccagatgagcagctgcacagctttgctgtgtccacagtgcacatcatgaagaagagaaatggaggcggcagcctgaacaactacagcagcagcatcccccccacccccagcaccagccaggaggacccccagttctctgtgcccccaacagccaacacccccacccctgtgtgcaagctgtccatgcgctggagcaacctcttcaccagcgagaagggcagtgaccctgacaaggagaggaaggccccagaaaatcatgctgacaccatcggcagcggccgggccatccccatcaagcagggcatgctgctgaagaggtctgggaagtggctgaagacctggaagaagaagtatgtgaccctgtgcagcaatggagtgctgacctactacagcagcctgggggactacatgaagaacatccacaagaaggagattgacctgcggaccagcaccatcaaggtgcctgggaagtggcccagcctggccaccagcgcctgtgcccccatcagcagcagcaagagcaatggcctgagcaaggacatggacaccggcctgggggacagcatctgcttcagccctggcatcagcagcaccaccagccccaagctgaaccccccacccagcccccacgccaacaagaagaagcacctgaagaagaagagcaccaacaacttcatgattgtgtctgccaccggccagacctggcactttgaggccaccacctatgaggagagagatgcctgggtgcaggccatccagagccagagcgaggccatggccctgcagagcatccagaacatgagaggaaatgcccactgtgtggactgtgagacccagaaccccaagtgggccagcctgaacctgggcgtgctgatgtgcatcgagtgcagcggcatccacaggagctttggcacccggctgagccgggtgcgcagcctggagctggatgactggcctgtggagctgaggaaggtgatgagcagcattggaaatgagctggccaacagcatctgggagggcagcagccagggccagaccaagcccagcatcaagagcacccgggaggagaaggagtggtggatccgcagcaaatatgaggagaagctgttcctggcccccctgccctgcacagagctgagcctgggccagcagctgctgcgggccaccacagatgaggacctgcagacagccatcctgctgctggcccacggcagccgggaggaggtgaatgagacctgtggggagggagatggctgcacagccctgcacctggcctgcaggaaaggaaatgtggtgctggagcagctgctgaccggctggacctcctggccagagatgcccaccggcacccagaggtag

SEQ ID NO: 35573 - DNA, 2112 bp, Artificial Sequence
  Description of Artificial Sequence: Synthetic coding sequence
atgtttgaagatgtgttcagtgacagcggcaacacaggcaactttgaccggggcaagaagaggcggctgaccatcattgaatgtggctgtgacatcaacatgatgattgacctggccaaggtggccgacctggtgctgatgctgattgatgccagctttggatttgagatggagatgtttgagttcctgaacatctgccaggcccacggcttccccaagatcctgggcgtgctgacccacctggacagcttcaagcacaacaagcagctgaagaagaccaagaagaggctgaagcaccgcttctggacagaggtgtaccaggacaaggtgggcctgacccatgagctggtgcagagcctcatcagcacctacagcaccattgatgccaagatggccagcagccgggtgaccctgctgagcaacagcaagcccctgggcagcgaggccatcgacaaccagggcgtgtccctggagtttgaccagcagcagggctctgtgtgccccagcgagagcgagatctatgaggccggggctgaggacaggatggccggggcccccatggctgctgctgtgcagcctgctgaggtgacagtggaggtgggggaggacctgcacatgcaccaggtgcgggaccgggagatgcctgaggtggtggagatcagaagaagcaactgcaccaaccactgtgacctgggggacaccagcagctaccacaccaaggtgtccacagtgcacatcatgaagaagagaaatggaggcggcagcctgaacaactacagcagcagcatcccccccacccccagcaccagccaggaggacccccagttctctgtgcccccaacagccaacacccccacccctgtgtgcaagctgtccatgcgctggagcaacctcttcaccagcgagaagggcagtgaccctgacaaggagaggaaggccccagaaaatcatgctgacaccatcggcagcggccgggccatccccatcaagcagggcatgctgctgaagaggtctgggaagtggctgaagacctggaagaagaagtatgtgaccctgtgcagcaatggagtgctgacctactacagcagcctgggggactacatgaagaacatccacaagaaggagattgacctgcggaccagcaccatcaaggtgcctgggaagtggcccagcctggccaccagcgcctgtgcccccatcagcagcagcaagagcaatggcctgagcaaggacatggacaccggcctgggggacagcatctgcttcagccctggcatcagcagcaccaccagccccaagctgaaccccccacccagcccccacgccaacaagaagaagcacctgaagaagaagagcaccaacaacttcatgattgtgtctgccaccggccagacctggcactttgaggccaccacctatgaggagagagatgcctgggtgcaggccatccagagccagatcctggccagcctgcagagctgcaagagcagcaagagcaagagccagctgaccagccagagcgaggccatggccctgcagagcatccagaacatgagaggaaatgcccactgtgtggactgtgagacccagaaccccaagtgggccagcctgaacctgggcgtgctgatgtgcatcgagtgcagcggcatccacaggagctttggcacccggctgagccgggtgcgcagcctggagctggatgactggcctgtggagctgaggaaggtgatgagcagcattggaaatgagctggccaacagcatctgggagggcagcagccagggccagaccaagcccagcatcaagagcacccgggaggagaaggagtggtggatccgcagcaaatatgaggagaagctgttcctggcccccctgccctgcacagagctgagcctgggccagcagctgctgcgggccaccacagatgaggacctgcagacagccatcctgctgctggcccacggcagccgggaggaggtgaatgagacctgtggggagggagatggctgcacagccctgcacctggcctgcaggaaaggaaatgtggtgctggagcagctgctgaccggctggacctcctggccagagatgcccaccggcacccagaggtag

SEQ ID NO: 35574 - DNA, 1977 bp, Artificial Sequence
  Description of Artificial Sequence: Synthetic coding sequence
atgggcaacatcctgacctgccgggtgcaccccagcgtgtccctggagtttgaccagcagcagggctctgtgtgccccagcgagagcgagatctatgaggccggggctgaggacaggatggccggggcccccatggctgctgctgtgcagcctgctgaggtgacagtggaggtgggggaggacctgcacatgcaccaggtgcgggaccgggagatgcctgaggccctggagttcaacctgagcgccaaccctgaggccagcaccatcttccagaggaacagccagacagatgccctggagttcaacagcagcgccaaccctgaggccagcaccatcttccagaggaacagccagacagatgtggtggagatcagaagaagcaactgcaccaaccacgtgtccacagagcgcttcagccagcagtacagcagctgcagcaccatcttcctggatgacagcacagccatccagcactacctgaccatgaccatcatctctgtgaccctggagatcccccaccacatcacccagagagatgctgacaggagcctgagcatcccagatgagcagctgcacagctttgctgtgtccacagtgcacatcatgaagaagagaaatggaggcggcagcctgaacaactacagcagcagcatcccccccacccccagcaccagccaggaggacccccagttctctgtgcccccaacagccaacacccccacccctgtgtgcaagctgtccatgcgctggagcaacctcttcaccagcgagaagggcagtgaccctgacaaggagaggaaggcccctgagaaccacgccgacaccatcggcagcggccgggccatccccatcaagcagggcatgctgctgaagaggtctgggaagtggctgaagacctggaagaagaagtatgtgaccctgtgcagcaatggagtgctgacctactacagcagcctgggggactacatgaagaacatccacaagaaggagattgacctgcggaccagcaccatcaaggtgcctgggaagtggcccagcctggccaccagcgcctgtgcccccatcagcagcagcaagagcaatggcctgagcaaggacatggacaccggcctgggggacagcatctgcttcagccctggcatcagcagcaccaccagccccaagctgaaccccccacccagcccccacgccaacaagaagaagcacctgaagaagaagagcaccaacaacttcatgattgtgtctgccaccggccagacctggcactttgaggccaccacctatgaggagagagatgcctgggtgcaggccatccagagccagatcctggccagcctgcagagctgcaagagcagcaagagcaagagccagctgaccagccagagcgaggccatggccctgcagagcatccagaacatgagaggaaatgcccactgtgtggactgtgagacccagaaccccaagtgggccagcctgaacctgggcgtgctgatgtgcattgaatgttctggcatccacaggagctttggcacccggctgagccgggtgcgcagcctggagctggatgactggcctgtggagctgaggaaggtgatgagcagcattggaaatgagctggccaacagcatctgggagggcagcagccagggccagaccaagcccagcatcaagagcacccgggaggagaaggagtggtggatccgcagcaaatatgaggagaagctgttcctggcccccctgccctgcacagagctgagcctgggccagcagctgctgcgggccaccacagatgaggacctgcagacagccatcctgctgctggcccacggcagccgggaggaggtgaatgagacctgtggggagggagatggctgcacagccctgcacctggcctgcaggaaaggaaatgtggtgctggagcagctgctgaccggctggacctcctggccagagatgcccaccggcacccagaggtag

SEQ ID NO: 35575 - DNA, 1320 bp, Artificial Sequence
  Description of Artificial Sequence: Synthetic coding sequence
atgcgctggagcaacctcttcaccagcgagaagggcagtgaccctgacaaggagaggaaggccccagaaaatcatgctgacaccatcggcagcggccgggccatccccatcaagcagggcatgctgctgaagaggtctgggaagtggctgaagacctggaagaagaagtatgtgaccctgtgcagcaatggagtgctgacctactacagcagcctgggggactacatgaagaacatccacaagaaggagattgacctgcagaccagcaccatcaaggtgcctgggaagtggcccagcctggccaccagcgcctgcacccccatcagcaccagcaagagcaatggcctgagcaaggacatggacaccggcctgggggacagcatctgcttcagccccagcatcagcagcaccaccagccccaagctgaaccccccacccagcccccacgccaacaagaagaagcacctgaagaagaagagcaccaacaacttcatgattgtgtctgccaccggccagacctggcactttgaggccaccacctatgaggagagagatgcctgggtgcaggccatccagagccagatcctggccagcctgcagagctgtgagagcagcaagagcaagagccagctgaccagccagagcaaggccatggccctgcagagcatccagaacatgagaggaaatgcccactgtgtggactgtgagacccagaaccccaagtgggccagcctgaacctgggcgtgctgatgtgcatcgagtgcagcggcatccacaggagcctgggcacccggctgagccgggtgcgcagcctggagctggatgactggcctgtggagctgaggaaggtgatgagcagcattggaaatgacctggccaacagcatctgggagggcagcagccagggccagaccaagcccagcgagaagagcacccgggaggagaaggagcgctggatccgcagcaaatatgaggagaagctgttcctggcccccctgccctgcacagagctgagcctgggccagcagctgctgcgggccacagcagatgaggacctgcagacagccatcctgctgctggcccacggcagccgggaggaggtgaatgagacctgtggggagggagatggctgcacagccctgcacctggcctgcaggaaaggaaatgtggtgctggcccagctgctgatctggtatggagtggatgtgatggccagagatgcccacggcaacacagccctgacctacgcccggcaggccagcagccaggagtgcatcaacgtgctgctgcagtatggctgcccagacaagtgtgtgtag

SEQ ID NO: 35576 - DNA, 1992 bp, Artificial Sequence
  Description of Artificial Sequence: Synthetic coding sequence
atgggcaacatcctgacctgccgggtgcaccccagcgtgtccctggagtttgaccagcagcagggctctgtgtgccccagcgagagcgagatctatgaggccggggccggggacaggatggccggggcccccatggctgctgctgtgcagcctgctgaggtgacagtggaggtgggggaggacctgcacatgcaccacgtgcgggaccgggagatgcctgaggccctggagttcaaccccagcgccaaccctgaggccagcaccatcttccagaggaacagccagacagatgtggtggagatccgccgcagcaactgcaccaaccacgtgtccacagtgcgcttcagccagcagtacagcctgtgcagcaccatcttcctggatgacagcacagccatccagcactacctgaccatgaccatcatctctgtgaccctggagatcccccaccacatcacccagagagatgctgacaggagcctgagcatcccagatgagcagctgcacagctttgctgtgtccacagtgcacatcatgaagaagagaaatggaggcggcagcctgaacaactacagcagcagcatccccagcacccccagcaccagccaggaggacccccagttctctgtgcccccaacagccaacacccccacccctgtgtgcaagaggtccatgcgctggagcaacctcttcaccagcgagaagggcagtgaccctgacaaggagaggaaggccccagaaaatcatgctgacaccatcggcagcggccgggccatccccatcaagcagggcatgctgctgaagaggtctgggaagtggctgaagacctggaagaagaagtatgtgaccctgtgcagcaatggagtgctgacctactacagcagcctgggggactacatgaagaacatccacaagaaggagattgacctgcagaccagcaccatcaaggtgcctgggaagtggcccagcctggccaccagcgcctgcacccccatcagcaccagcaagagcaatggcctgagcaaggacatggacaccggcctgggggacagcatctgcttcagccccagcatcagcagcaccaccagccccaagctgaaccccccacccagcccccacgccaacaagaagaagcacctgaagaagaagagcaccaacaacttcatgattgtgtctgccaccggccagacctggcactttgaggccaccacctatgaggagagagatgcctgggtgcaggccatccagagccagatcctggccagcctgcagagctgtgagagcagcaagagcaagagccagctgaccagccagagcaaggccatggccctgcagagcatccagaacatgagaggaaatgcccactgtgtggactgtgagacccagaaccccaagtgggccagcctgaacctgggcgtgctgatgtgcatcgagtgcagcggcatccacaggagcctgggcacccggctgagccgggtgcgcagcctggagctggatgactggcctgtggagctgaggaaggtgatgagcagcattggaaatgacctggccaacagcatctgggagggcagcagccagggccagaccaagcccagcgagaagagcacccgggaggagaaggagcgctggatccgcagcaaatatgaggagaagctgttcctggcccccctgccctgcacagagctgagcctgggccagcagctgctgcgggccacagcagatgaggacctgcagacagccatcctgctgctggcccacggcagccgggaggaggtgaatgagacctgtggggagggagatggctgcacagccctgcacctggcctgcaggaaaggaaatgtggtgctggcccagctgctgatctggtatggagtggatgtgatggccagagatgcccacggcaacacagccctgacctacgcccggcaggccagcagccaggagtgcatcaacgtgctgctgcagtatggctgcccagacaagtgtgtgtag

SEQ ID NO: 35577 - DNA, 2061 bp, Artificial Sequence
  Description of Artificial Sequence: Synthetic coding sequence
atgggcaacatcctgacctgctgcgtgcaccccagcgtgtccctggagtttgaccagcagcagggctctgtgtgccccagcgagagcgagatctatgaggccggggccggggacaggatggccggggcccccatggctgctgctgtgcagcctgctgaggtgacagtggaggtgggggaggacctgcacatgcaccacatccgggaccaggagatgcctgaggccctggagttcagcctgagcgccaaccctgaggccagcaccatcttccagaggaacagccagacagatgccctggagttcaaccccagcgccaaccctgaggccagcaccatcttccagaggaacagccagacagatgtggtggagatcagaagaagcaactgcaccaaccacgtgtccacagagcgcttcagccagcagtacagcagctgcagcaccatcttcctggatgacagcacagccagccagcactacctgaccatgaccatcatctctgtgaccctggagatcccccaccacatcacccagagagatgctgacaggagcctgagcatcccagatgagcagctgcacagctttgctgtgtccacagtgcacatcaccaagaacagaaatggaggcggcagcctgaacaactacagcagcagcatccccagcacccccagcaccagccaggaggacccccagttctctgtgcccccaacagccaacacccccacccctgtgtgcaagaggtccatgcgctggagcaacctcttcaccagcgagaagggcagccacccagacaaggagaggaaggcccctgagaaccacgccgacaccatcggcagcggccgggccatccccatcaagcagggcatgctgctgaagaggtctgggaagtggctgaagacctggaagaagaagtatgtgaccctgtgcagcaatggagtgctgacctactacagcagcctgggggactacatgaagaacatccacaagaaggagattgacctgcggaccagcaccatcaaggtgcctgggaagtggcccagcctggccaccagcgcctgtgcccccatcagcagcagcaagagcaatggcctgagcaaggacatggacaccggcctgggggacagcatctgcttcagccccagcatcagcagcaccaccagccccaagctgaaccccccacccagcccccacgccaacaagaagaagcacctgaagaagaagagcaccaacaacttcatgattgtgtctgccaccggccagacctggcactttgaggccaccacctatgaggagagagatgcctgggtgcaggccatccagagccagatcctggccagcctgcagagctgtgagagcagcaagagcaagagccagctgaccagccagagcgaggccatggccctgcagagcatccagaacatgagaggaaatgcccactgtgtggactatgagacccagaaccccaagtgggccagcctgaacctgggcgtgctgatgtgcattgaatgttctggcatccacaggagcctgggcacccggctgagccgggtgcgcagcctggagctggatgactggcctgtggagctgaggaaggtgatgagcagcattggaaatgacctggccaacagcatctgggagggcagcagccagggccagaccaagcccagcgtgaagagcacccgggaggagaaggagcgctggatccgcagcaaatatgaggagaagctgttcctggcccccctgccctgcacagagctgagcctgggccagcacctgctgcgggccacagcagatgaggacctgcagacagccatcctgctgctggcccacggcagccgggaggaggtgaatgagacctgtggggagggagatggctgcacagccctgcacctggcctgcaggaaaggaaatgtggtgctggcccagctgctgatctggtacggcgtggatgtgatggccagagatgcccacggcaacacagccctgacctacgcccggcaggccagcagccaggagtgcatcaacgtgctgctgcagtatggctgcccagatgaatgtgtgtag

SEQ ID NO: 35578 - DNA, 1992 bp, Artificial Sequence
  Description of Artificial Sequence: Synthetic coding sequence
atgggcaacatcctgacctgctgcgtgcaccccagcgtgtccctggagtttgaccagcagcagggctctgtgtgccccagcgagagcgagatctatgaggccggggccggggacaggatggccggggcccccatggctgctgctgtgcagcctgctgaggtgacagtggaggtgggggaggacctgcacatgcaccacatccgggaccaggagatgcctgaggccctggagttcaaccccagcgccaaccctgaggccagcaccatcttccagaggaacagccagacagatgtggtggagatccgccgcagcaactgcaccaaccacgtgtccacagagcgcttcagccagcagtacagcagctgcagcaccatcttcctggatgacagcacagccagccagcactacctgaccatgaccatcatctctgtgaccctggagatcccccaccacatcacccagagagatgctgacaggagcctgagcatcccagatgagcagctgcacagctttgctgtgtccacagtgcacatcaccaagaacagaaatggaggcggcagcctgaacaactacagcagcagcatccccagcacccccagcaccagccaggaggacccccagttctctgtgcccccaacagccaacacccccacccctgtgtgcaagaggtccatgcgctggagcaacctcttcaccagcgagaagggcagccacccagacaaggagaggaaggccccagaaaatcatgctgacaccatcggcagcggccgggccatccccatcaagcagggcatgctgctgaagaggtctgggaagtggctgaagacctggaagaagaagtatgtgaccctgtgcagcaatggagtgctgacctactacagcagcctgggggactacatgaagaacatccacaagaaggagattgacctgcggaccagcaccatcaaggtgcctgggaagtggcccagcctggccaccagcgcctgtgcccccatcagcagcagcaagagcaatggcctgagcaaggacatggacaccggcctgggggacagcatctgcttcagccccagcatcagcagcaccaccagccccaagctgaaccccccacccagcccccacgccaacaagaagaagcacctgaagaagaagagcaccaacaacttcatgattgtgtctgccaccggccagacctggcactttgaggccaccacctatgaggagagagatgcctgggtgcaggccatccagagccagatcctggccagcctgcagagctgtgagagcagcaagagcaagagccagctgaccagccagagcgaggccatggccctgcagagcatccagaacatgagaggaaatgcccactgtgtggactatgagacccagaaccccaagtgggccagcctgaacctgggcgtgctgatgtgcatcgagtgcagcggcatccacaggagcctgggcacccggctgagccgggtgcgcagcctggagctggatgactggcctgtggagctgaggaaggtgatgagcagcattggaaatgacctggccaacagcatctgggagggcagcagccagggccagaccaagcccagcgtgaagagcacccgggaggagaaggagcgctggatccgcagcaaatatgaggagaagctgttcctggcccccctgccctgcacagagctgagcctgggccagcacctgctgcgggccacagcagatgaggacctgcagacagccatcctgctgctggcccacggcagccgggaggaggtgaatgagacctgtggggagggagatggctgcacagccctgcacctggcctgcaggaaaggaaatgtggtgctggcccagctgctgatctggtatggagtggatgtgatggccagagatgcccacggcaacacagccctgacctacgcccggcaggccagcagccaggagtgcatcaacgtgctgctgcagtatggctgcccagatgaatgtgtgtag

SEQ ID NO: 35579 - DNA, 2061 bp, Artificial Sequence
  Description of Artificial Sequence: Synthetic coding sequence
atgggcaacatcctgacctgccgggtgcaccccagcgtgtccctggagtttgaccagcagcagggctctgtgtgccccagcgagagcgagacctatgaggccggggcccgggacaggatggccggggcccccatggctgctgctgtgcagcctgctgaggtgacagtggaggtgggggaggacctgcacatgcaccacgtgcgggaccgggagatgcctgaggccctggagttcaacctgagcgccaaccctgagagcagcaccatcttccagaggaacagccagacagaggccctggagttcaaccccagcgccaaccctgaggccagcaccatcttccagaggaacagccagacagatgtggtggagatcagaagaagcaactgcaccaaccacgtgtctgctgtgcgcttcagccagcagtacagcctgtgcagcaccatcttcctggatgacagcacagccatccagcactacctgaccatgaccatcatctctgtgaccctggagatcccccaccacatcacccagagagatgctgacaggaccctgagcatcccagatgagcagctgcacagctttgctgtgtccacagtgcacatcatgaagaagagaaatggaggcggcagcctgaacaactacagcagcagcatccccagcacccccagcaccagccaggaggacccccagttctctgtgcccccaacagccaacacccccacccctgtgtgcaagaggtccatgcgctggagcaacctcttcaccagcgagaagggcagtgaccctgacaaggagaggaaggcccctgagaaccacgccgacaccatcggcagcggccgggccatccccatcaagcagggcatgctgctgaagaggtctgggaagtggctgaagacctggaagaagaagtatgtgaccctgtgcagcaatggcatgctgacctactacagcagcctgggggactacatgaagaacatccacaagaaggagattgacctgcagaccagcaccatcaaggtgcctgggaagtggcccagcctggccaccagcgcctgcacccccatcagcagcagcaagagcaatggcctgagcaaggacatggacaccggcctgggggacagcatctgcttcagccccagcatcagcagcaccaccagccccaagctgaaccccccacccagcccccacgccaacaagaagaagcacctgaagaagaagagcaccaacaacttcatgattgtgtctgccaccggccagacctggcactttgaggccaccacctatgaggagagagatgcctgggtgcaggccatccagagccagatcctggccagcctgcagagctgtgagagcagcaagagcaagagccagctgaccagccagagcgaggccatggccctgcagagcatccagaacatgagaggaaatgcccactgtgtggactgtgagacccagaaccccaagtgggccagcctgaacctgggcgtgctgatgtgcattgaatgttctggcatccacaggagcctgggcccccacctgagccgggtgcgcagcctggagctggatgactggcctgtggagctgaggaaggtgatgagcagcatcgtgaatgacctggccaacagcatctgggagggcagcagccagggccagaccaagcccagcgagaagagcacccgggaggagaaggagcgctggatccgcagcaaatatgaggagaagctgttcctggcccccctgccctgcacagagctgagcctgggccagcagctgctgcgggccacagcagatgaggacctgcagacagccatcctgctgctggcccacggcagctgtgaggaggtgaatgagacctgtggggagggagatggctgcacagccctgcacctggcctgcaggaaaggaaatgtggtgctggcccagctgctgatctggtacggcgtggatgtgatggccagagatgcccacggcaacacagccctgacctacgcccggcaggccagcagccaggagtgcatcaacgtgctgctgcagtatggctgcccagatgaatgtgtgtag

SEQ ID NO: 35580 - DNA, 1992 bp, Artificial Sequence
  Description of Artificial Sequence: Synthetic coding sequence
atgggcaacatcctgacctgccgggtgcaccccagcgtgtccctggagtttgaccagcagcagggctctgtgtgccccagcgagagcgagacctatgaggccggggcccgggacaggatggccggggcccccatggctgctgctgtgcagcctgctgaggtgacagtggaggtgggggaggacctgcacatgcaccacgtgcgggaccgggagatgcctgaggccctggagttcaaccccagcgccaaccctgaggccagcaccatcttccagaggaacagccagacagatgtggtggagatccgccgcagcaactgcaccaaccacgtgtctgctgtgcgcttcagccagcagtacagcctgtgcagcaccatcttcctggatgacagcacagccatccagcactacctgaccatgaccatcatctctgtgaccctggagatcccccaccacatcacccagagagatgctgacaggaccctgagcatcccagatgagcagctgcacagctttgctgtgtccacagtgcacatcatgaagaagagaaatggaggcggcagcctgaacaactacagcagcagcatccccagcacccccagcaccagccaggaggacccccagttctctgtgcccccaacagccaacacccccacccctgtgtgcaagaggtccatgcgctggagcaacctcttcaccagcgagaagggcagtgaccctgacaaggagaggaaggccccagaaaatcatgctgacaccatcggcagcggccgggccatccccatcaagcagggcatgctgctgaagaggtctgggaagtggctgaagacctggaagaagaagtatgtgaccctgtgcagcaatggcatgctgacctactacagcagcctgggggactacatgaagaacatccacaagaaggagattgacctgcagaccagcaccatcaaggtgcctgggaagtggcccagcctggccaccagcgcctgcacccccatcagcagcagcaagagcaatggcctgagcaaggacatggacaccggcctgggggacagcatctgcttcagccccagcatcagcagcaccaccagccccaagctgaaccccccacccagcccccacgccaacaagaagaagcacctgaagaagaagagcaccaacaacttcatgattgtgtctgccaccggccagacctggcactttgaggccaccacctatgaggagagagatgcctgggtgcaggccatccagagccagatcctggccagcctgcagagctgtgagagcagcaagagcaagagccagctgaccagccagagcgaggccatggccctgcagagcatccagaacatgagaggaaatgcccactgtgtggactgtgagacccagaaccccaagtgggccagcctgaacctgggcgtgctgatgtgcatcgagtgcagcggcatccacaggagcctgggcccccacctgagccgggtgcgcagcctggagctggatgactggcctgtggagctgaggaaggtgatgagcagcatcgtgaatgacctggccaacagcatctgggagggcagcagccagggccagaccaagcccagcgagaagagcacccgggaggagaaggagcgctggatccgcagcaaatatgaggagaagctgttcctggcccccctgccctgcacagagctgagcctgggccagcagctgctgcgggccacagcagatgaggacctgcagacagccatcctgctgctggcccacggcagctgtgaggaggtgaatgagacctgtggggagggagatggctgcacagccctgcacctggcctgcaggaaaggaaatgtggtgctggcccagctgctgatctggtatggagtggatgtgatggccagagatgcccacggcaacacagccctgacctacgcccggcaggccagcagccaggagtgcatcaacgtgctgctgcagtatggctgcccagatgaatgtgtgtag

SEQ ID NO: 35581 - DNA, 1992 bp, Artificial Sequence
  Description of Artificial Sequence: Synthetic coding sequence
atgggcaacatcctgacctgccgggtgcaccccagcgtgtccctggagtttgaccagcagcagggctctgtgtgccccagcgagagcgagatctatgaggccggggctgaggacaggatggccggggcccccatggctgctgctgtgcagcctgctgaggtgacagtggaggtgggggaggacctgcacatgcaccacgtgcgggaccgggagatgcctgaggccctggagttcaaccccagcgccaaccctgaggccagcaccatcttccagaggaacagccagacagatgtggtggagatccgccgcagcaactgcaccaaccacgtgtccacagtgcacttcagccagcagtacagcctgtgcagcaccatcttcctggatgacagcacagccatccagcactacctgaccatgaccatcatctctgtgaccctggagatcccccaccacatcacccagagagatgctgacaggagcctgagcatcccagatgagcagctgcacagctttgctgtgtccacagtgcacatcaccaagaacagaaatggaggcggcagcctgaacaactacagcagcagcatccccagcacccccagcaccagccaggaggacccccagttctctgtgcccccaacagccaacacccccacccctgtgtgcaagaggtccatgcgctggagcaacctcttcaccagcgagaagggcagtgaccctgacaaggagaggaaggccccagaaaatcatgctgacaccatcggcagcggccgggccatccccatcaagcagggcatgctgctgaagaggtctgggaagtggctgaagacctggaagaagaagtatgtgaccctgtgcagcaatggagtgctgacctactacagcagcctgggggactacatgaagtacatccacaagaaggagattgacctgcagaccagcaccatcaaggtgcctgggaagtggcccagcctggccaccctggcctgcacccccatcagcagcagcaagagtgatggcctgagcaaggacatggacaccggcctgggggacagcatctgcttcagccccagcatcagcagcaccaccatccccaagctgaaccccccacccagcccccacgccaacaagaagaagcacctgaagaagaagagcaccaacaacttcatgattgtgtctgccaccggccagacctggcactttgaggccaccacctatgaggagagagatgcctgggtgcaggccatccagagccagatcctggccagcctgcagagctgtgagagcagcaagagcaagagccagctgaccagccagagcgaggccatggccctgcagagcatccagaacatgagaggaaatgcccactgtgtggactgtgagacccagaaccccaagtgggccagcctgaacctgggcgtgctgatgtgcatcgagtgcagcggcatccacaggagcctgggcacccggctgagccgggtgcgcagcctggagctggatgactggcctgtggagctgaggaaggtgatgagcagcattggaaatgacctggccaacagcatctgggagggcagcagccagggccgcaccaagcccacagagaagagcacccgggaggagaaggagcgctggatccgcagcaaatatgaggagaagctgttcctggcccccctgccctgcacagagctgagcctgggccagcagctgctgcgggccacagcagatgaggacctgcagacagccatcctgctgctggcccacggcagccgggaggaggtgaatgagacctgtggggagggagatggctgcacagccctgcacctggcctgcaggaaaggaaatgtggtgctggcccagctgctgatctggtatggagtggatgtgatggccagagatgcccacggcaacacagccctgacctacgcccggcaggccagcagccaggagtgcatcaacgtgctgctgcagtatggctgcccagatgaatgtgtgtag

SEQ ID NO: 35582 - DNA, 1320 bp, Artificial Sequence
  Description of Artificial Sequence: Synthetic coding sequence
atgcgctggagcaacctcttcaccagcgagaagggcagtgaccctgacaaggagaggaaggccccagaaaatcatgctgacaccatcggcagcggccgggccatccccatcaagcagggcatgctgctgaagaggtctgggaagtggctgaagacctggaagaagaagtatgtgaccctgtgcagcaatggagtgctgacctactacagcagcctgggggactacatgaagaacatccacaagaaggagattgacctgcagaccagcaccatcaaggtgcctgggaagtggcccagcctggccaccagcgcctgcacccccatcagcagcagcaagagcaatggcctgagcaaggacatggacaccggcctgggggacagcatctgcttcagccccagcatcagcagcaccaccagccccaagctgaaccccccacccagcccccacgccaacaagaagaagcacctgaagaagaagagcaccaacaacttcatgattgtgtctgccaccggccagacctggcactttgaggccaccacctatgaggagagagatgcctgggtgcaggccatccagagccagatcctggccagcctgcagagctgtgagagcagcaagagcaagagccagctgaccagccagagcgaggccatggccctgcagagcatccagaacatgagaggaaatgcccactgtgtggactgtgagacccagaaccccaagtgggccagcctgaacctgggcgtgctgatgtgcatcgagtgcagcggcatccaccacagcctgggcacccggctgagccgggtgcgcagcctggagctggatgactggcctgtggagctgaggaaggtgatgagcagcattggaaatgacctggccaacagcatctgggagggcagcagccagggccagaccaagcccagcgagaagagcacccgggaggagaaggagcgctggatccgcagcaaatatgaggagaagctgttcctggcccccctgccctgcacagagctgagcctgggccagcagctgctgtgggccacagcagatgaggacctgcagacagccatcctgctgctggcccacggcagccgggaggaggtgaatgagacctgtggggagggagatggctgcacagccctgcacctggcctgcaggaaaggaaatgtggtgctggcccagctgctgatctggtatggagtggatgtgatggccagagatgcccacggcaacacagccctgacctacgcccggcaggccagcagccaggagtgcatcaacgtgctgctgcagtatggctgcccagatgaatgtgtgtag

SEQ ID NO: 35583 - DNA, 1992 bp, Artificial Sequence
  Description of Artificial Sequence: Synthetic coding sequence
atgggcaacatcctgacctgccgggtgcaccccagcgtgtccctggagtttgaccagcagcagggctctgtgtgccccagcgagagcgagatctatgaggccggggccggggacaggatggccggggcccccatggctgctgctgtgcagcctgctgaggtgacagtggaggtgggggaggacctgcacatgcaccacgtgcgggaccgggagatgcctgaggccctggagttcaaccccagcgccaaccctgaggccagcaccatcttccagaggaacagccagacagatgtggtggagatccgccgcagcaactgcaccaaccacgtgtccacagtgcgcttcagccagcagtacagcctgtgcagcaccatcttcctggatgacagcacagccatccagcactacctgaccatgaccatcatctctgtgaccctggagatcccccaccacatcacccagagagatgctgacaggagcctgagcatcccagatgagcagctgcacagctttgctgtgtccacagtgcacatcatgaagaagagaaatggaggcggcagcctgaacaactacagcagcagcatccccagcacccccagcaccagccaggaggacccccagttctctgtgcccccaacagccaacacccccacccctgtgtgcaagaggtccatgcgctggagcaacctcttcaccagcgagaagggcagtgaccctgacaaggagaggaaggccccagaaaatcatgctgacaccatcggcagcggccgggccatccccatcaagcagggcatgctgctgaagaggtctgggaagtggctgaagacctggaagaagaagtatgtgaccctgtgcagcaatggagtgctgacctactacagcagcctgggggactacatgaagaacatccacaagaaggagattgacctgcagaccagcaccatcaaggtgcctgggaagtggcccagcctggccaccagcgcctgcacccccatcagcagcagcaagagcaatggcctgagcaaggacatggacaccggcctgggggacagcatctgcttcagccccagcatcagcagcaccaccagccccaagctgaaccccccacccagcccccacgccaacaagaagaagcacctgaagaagaagagcaccaacaacttcatgattgtgtctgccaccggccagacctggcactttgaggccaccacctatgaggagagagatgcctgggtgcaggccatccagagccagatcctggccagcctgcagagctgtgagagcagcaagagcaagagccagctgaccagccagagcgaggccatggccctgcagagcatccagaacatgagaggaaatgcccactgtgtggactgtgagacccagaaccccaagtgggccagcctgaacctgggcgtgctgatgtgcatcgagtgcagcggcatccaccacagcctgggcacccggctgagccgggtgcgcagcctggagctggatgactggcctgtggagctgaggaaggtgatgagcagcattggaaatgacctggccaacagcatctgggagggcagcagccagggccagaccaagcccagcgagaagagcacccgggaggagaaggagcgctggatccgcagcaaatatgaggagaagctgttcctggcccccctgccctgcacagagctgagcctgggccagcagctgctgtgggccacagcagatgaggacctgcagacagccatcctgctgctggcccacggcagccgggaggaggtgaatgagacctgtggggagggagatggctgcacagccctgcacctggcctgcaggaaaggaaatgtggtgctggcccagctgctgatctggtatggagtggatgtgatggccagagatgcccacggcaacacagccctgacctacgcccggcaggccagcagccaggagtgcatcaacgtgctgctgcagtatggctgcccagatgaatgtgtgtag

SEQ ID NO: 35584 - DNA, 1992 bp, Artificial Sequence
  Description of Artificial Sequence: Synthetic coding sequence
gagctgctgcgcatcagcccagacctgctggccgctgctgtgatcagcgcccaggaggagcccctgaccaacatccagagggccagcggccccaccggcctgctgtggagcgtgtccctggagtttgaccagcagcagggctctgtgtgccccagcgagagcgagatctatgaagctggagctgaggacaggatggccggggcccccatggctgctgctgtgcagcctgctgaggtgacagtggaggtgggggaggacctgcacatgcaccaggtgcgggaccgggagatgcctgaggccctggagttcaacctgagcgccaaccctgaggccagcaccatcttccagaggaacagccagacagatgccctggagttcaacagcagcgccaaccctgaggccagcaccatcttccagaggaacagccagacagatgtggtggagatccgccgcagcaactgcaccaaccacgtgtccacagagcgcttcagccagcagtacagcagctgcagcaccatcttcctggatgacagcacagccatccagcactacctgaccatgaccatcatctctgtgaccctggagatcccccaccacatcacccagagagatgctgacaggagcctgagcatcccagatgagcagctgcacagctttgctgtgtccacagtgcacatcatgaagaagagaaatggaggcggcagcctgaacaactacagcagcagcatcccccccacccccagcaccagccaggaggacccccagttctctgtgcccccaacagccaacacccccacccctgtgtgcaagaggtccatgcgctggagcaacctcttcaccagcgagaagggcagtgaccctgacaaggagaggaaggccccagaaaatcatgctgacaccatcggcagcggccgggccatccccatcaagcagggcatgctgctgaagaggtctgggaagtggctgaagacctggaagaagaagtatgtgaccctgtgcagcaatggagtgctgacctactacagcagcctgggggactacatgaagaacatccacaagaaggagattgacctgcggaccagcaccatcaaggtgcctgggaagtggcccagcctggccaccagcgcctgtgcccccatcagcagcagcaagagcaatggcctgagcaaggacatggacaccggcctgggggacagcatctgcttcagccctggcatcagcagcaccaccagccccaagctgaaccccccacccagcccccacgccaacaagaagaagcacctgaagaagaagagcaccaacaacttcatgattgtgtctgccaccggccagacctggcactttgaggccaccacctatgaggagagagatgcctgggtgcaggccatccagagccagagcgaggccatggccctgcagagcatccagaacatgagaggaaatgcccactgtgtggactgtgagacccagaaccccaagtgggccagcctgaacctgggcgtgctgatgtgcatcgagtgcagcggcatccacaggagctttggcacccggctgagccgggtgcgcagcctggagctggatgactggcctgtggagctgaggaaggtgatgagcagcattggaaatgagctggccaacagcatctgggagggcagcagccagggccagaccaagcccagcatcaagagcacccgggaggagaaggagtggtggatccgcagcaaatatgaggagaagctgttcctggcccccctgccctgcacagagctgagcctgggccagcagctgctgcgggccaccacagatgaggacctgcagacagccatcctgctgctggcccacggcagccgggaggaggtgaatgagacctgtggggagggagatggctgcacagccctgcacctggcctgcaggaaaggaaatgtggtgctggagcagctgctgaccggctggacctcctggccagagatgcccaccggcacccagaggtag

SEQ ID NO: 35585 - DNA, 1047 bp, Artificial Sequence
  Description of Artificial Sequence: Synthetic coding sequence
tgagctgaggacaggatggccggggcccccatggctgctgctgtgcagcctgctgaggtgacagtggaggtgggggaggacctgcacatgcaccaggtgcgggaccgggagatgcctgaggccctggagttcaacctgagcgccaaccctgaggccagcaccatcttccagaggaacagccagacagatgccctggagttcaacagcagcgccaaccctgaggccagcaccatcttccagaggaacagccagacagatgtggtggagatcagaagaagcaactgcaccaaccacgtgtccacagagcgcttcagccagcagtacagcagctgcagcaccatcttcctggatgacagcacagccatccagcactacctgaccatgaccatcatctctgtgaccctggagatcccccaccacatcacccagagagatgctgacaggagcctgagcatcccagatgagcagctgcacagctttgctgtgtccacagtgcacatcatgaagaagagaaatggaggcggcagcctgaacaactacagcagcagcatcccccccacccccagcaccagccaggaggacccccagttctctgtgcccccaacagccaacacccccacccctgtgtgcaagaggtccatgcgctggagcaacctcttcaccagcgagaagggcagtgaccctgacaaggagaggaaggcccctgagaaccacgccgacaccatcggcagcggccgggccatccccatcaagcagggcatgctgctgaagaggtctgggaagtggctgaagacctggaagaagaagtatgtgaccctgtgcagcaatggagtgctgacctactacagcagcctgggggactacatgaagaacatccacaagaaggagattgacctgcggaccagcaccatcaaggtgcctgggaagtggcccagcctggccaccagcgcctgtgcccccatcagcagcagcaagagcaatggcctgagcaaggacatggacaccggcctgggggacagcatctgcttcagccctggcatctcctag

SEQ ID NO: 35586 - DNA, 2112 bp, Artificial Sequence
  Description of Artificial Sequence: Synthetic coding sequence
atgtttgaagatgtgttcagtgacagcggcaacacaggcaactttgaccggggcaagaagaggcggctgaccatcattgaatgtggctgtgacatcaacatgatgattgacctggccaaggtggccgacctggtgctgatgctgattgatgccagctttggatttgagatggagatgtttgagttcctgaacatctgccaggcccacggcttccccaagatcctgggcgtgctgacccacctggacagcttcaagcacaacaagcagctgaagaagaccaagaagaggctgaagcaccgcttctggacagaggtgtaccaggacaaggtgggcctgacccatgagctggtgcagagcctcatcagcacctacagcaccattgatgccaagatggccagcagccgggtgaccctgctgagcaacagcaagcccctgggcagcgaggccatcgacaaccagggcgtgtccctggagtttgaccagcagcagggctctgtgtgccccagcgagagcgagatctatgaggccggggctgaggacaggatggccggggcccccatggctgctgctgtgcagcctgctgaggtgacagtggaggtgggggaggacctgcacatgcaccaggtgcgggaccgggagatgcctgaggtggtggagatcagaagaagcaactgcaccaaccactgtgacctgggggacaccagcagctaccacaccaaggtgtccacagtgcacatcatgaagaagagaaatggaggcggcagcctgaacaactacagcagcagcatcccccccacccccagcaccagccaggaggacccccagttctctgtgcccccaacagccaacacccccacccctgtgtgcaagaggtccatgcgctggagcaacctcttcaccagcgagaagggcagtgaccctgacaaggagaggaaggccccagaaaatcatgctgacaccatcggcagcggccgggccatccccatcaagcagggcatgctgctgaagaggtctgggaagtggctgaagacctggaagaagaagtatgtgaccctgtgcagcaatggagtgctgacctactacagcagcctgggggactacatgaagaacatccacaagaaggagattgacctgcggaccagcaccatcaaggtgcctgggaagtggcccagcctggccaccagcgcctgtgcccccatcagcagcagcaagagcaatggcctgagcaaggacatggacaccggcctgggggacagcatctgcttcagccctggcatcagcagcaccaccagccccaagctgaaccccccacccagcccccacgccaacaagaagaagcacctgaagaagaagagcaccaacaacttcatgattgtgtctgccaccggccagacctggcactttgaggccaccacctatgaggagagagatgcctgggtgcaggccatccagagccagatcctggccagcctgcagagctgcaagagcagcaagagcaagagccagctgaccagccagagcgaggccatggccctgcagagcatccagaacatgagaggaaatgcccactgtgtggactgtgagacccagaaccccaagtgggccagcctgaacctgggcgtgctgatgtgcatcgagtgcagcggcatccacaggagctttggcacccggctgagccgggtgcgcagcctggagctggatgactggcctgtggagctgaggaaggtgatgagcagcattggaaatgagctggccaacagcatctgggagggcagcagccagggccagaccaagcccagcatcaagagcacccgggaggagaaggagtggtggatccgcagcaaatatgaggagaagctgttcctggcccccctgccctgcacagagctgagcctgggccagcagctgctgcgggccaccacagatgaggacctgcagacagccatcctgctgctggcccacggcagccgggaggaggtgaatgagacctgtggggagggagatggctgcacagccctgcacctggcctgcaggaaaggaaatgtggtgctggagcagctgctgaccggctggacctcctggccagagatgcccaccggcacccagaggtag

SEQ ID NO: 35587 - DNA, 1977 bp, Artificial Sequence
  Description of Artificial Sequence: Synthetic coding sequence
atgggcaacatcctgacctgccgggtgcaccccagcgtgtccctggagtttgaccagcagcagggctctgtgtgccccagcgagagcgagatctatgaggccggggctgaggacaggatggccggggcccccatggctgctgctgtgcagcctgctgaggtgacagtggaggtgggggaggacctgcacatgcaccaggtgcgggaccgggagatgcctgaggccctggagttcaacctgagcgccaaccctgaggccagcaccatcttccagaggaacagccagacagatgccctggagttcaacagcagcgccaaccctgaggccagcaccatcttccagaggaacagccagacagatgtggtggagatcagaagaagcaactgcaccaaccacgtgtccacagagcgcttcagccagcagtacagcagctgcagcaccatcttcctggatgacagcacagccatccagcactacctgaccatgaccatcatctctgtgaccctggagatcccccaccacatcacccagagagatgctgacaggagcctgagcatcccagatgagcagctgcacagctttgctgtgtccacagtgcacatcatgaagaagagaaatggaggcggcagcctgaacaactacagcagcagcatcccccccacccccagcaccagccaggaggacccccagttctctgtgcccccaacagccaacacccccacccctgtgtgcaagaggtccatgcgctggagcaacctcttcaccagcgagaagggcagtgaccctgacaaggagaggaaggcccctgagaaccacgccgacaccatcggcagcggccgggccatccccatcaagcagggcatgctgctgaagaggtctgggaagtggctgaagacctggaagaagaagtatgtgaccctgtgcagcaatggagtgctgacctactacagcagcctgggggactacatgaagaacatccacaagaaggagattgacctgcggaccagcaccatcaaggtgcctgggaagtggcccagcctggccaccagcgcctgtgcccccatcagcagcagcaagagcaatggcctgagcaaggacatggacaccggcctgggggacagcatctgcttcagccctggcatcagcagcaccaccagccccaagctgaaccccccacccagcccccacgccaacaagaagaagcacctgaagaagaagagcaccaacaacttcatgattgtgtctgccaccggccagacctggcactttgaggccaccacctatgaggagagagatgcctgggtgcaggccatccagagccagatcctggccagcctgcagagctgcaagagcagcaagagcaagagccagctgaccagccagagcgaggccatggccctgcagagcatccagaacatgagaggaaatgcccactgtgtggactgtgagacccagaaccccaagtgggccagcctgaacctgggcgtgctgatgtgcattgaatgttctggcatccacaggagctttggcacccggctgagccgggtgcgcagcctggagctggatgactggcctgtggagctgaggaaggtgatgagcagcattggaaatgagctggccaacagcatctgggagggcagcagccagggccagaccaagcccagcatcaagagcacccgggaggagaaggagtggtggatccgcagcaaatatgaggagaagctgttcctggcccccctgccctgcacagagctgagcctgggccagcagctgctgcgggccaccacagatgaggacctgcagacagccatcctgctgctggcccacggcagccgggaggaggtgaatgagacctgtggggagggagatggctgcacagccctgcacctggcctgcaggaaaggaaatgtggtgctggagcagctgctgaccggctggacctcctggccagagatgcccaccggcacccagaggtag

SEQ ID NO: 35588 - DNA, 4635 bp, Artificial Sequence
  Description of Artificial Sequence: Synthetic coding sequence
atggccgccccccaggacctggacattgctgtgtggctggccaccgtgcacctggagcagtatgctgacaccttccgccgccacggcctggccacagctggagctgcccggggcctgggccacgaggagctgaagcagctgggcatcagcgccaccggccacaggaagaggatcctgcggctgctgcagacaggaacagaggagggcagcctggaccccaagagtgacagcgccatggagcccagccccagccctgccccccaggcccagccccccaagcctgtgcccaagcccaggacagtgtttggaggcctgagcggccctgccaccacccagaggcctggcctgagccctgccctgggcggccctggggtgagccgcagccctgagcccagcccccggcccccacccctgcccaccagcagcagcgagcagagcagcgccctgaacacagtggagatgatgcccaacagcatctacttcggcctggacagccggggccgggcccaggccgcccaggacaaggccccagacagcagccagatcagcgcccccaccccagccctgcggcccaccactggaacagtgcacatcatggaccccggctgcctgtactacggcgtgcagcctgtgggcacccctggggccccagacagaagagagagccggggcgtgtgccagggccgggcagagcaccggctgagccggcaggacctggaggccagagaagatgctggctacgccagcctggagctgcccggggacagcaccctgctgagccccaccctggagacagaggagaccagtgatgacctgatcagcccctatgccagcttctccttcaccgctgaccggctgacccccctgctgagcggctggctggacaagctgagcccccagggcaactacgtgttccagaggagatttgtgcagttcaacggccgcagcctgatgtacttcggcagtgacaaggaccccttccccaagggcgtcatccccctgacagccatcgagatgaccaggagcagcaaggacaacaagttccaggtgatcaccggccagagggtgtttgtgttcagaacagaaagtgaggcccagagggacatgtggtgcagcaccctgcagagctgcctgaaggagcagaggctgctgggccaccccaggcctccccagcccccccggcccctgaggacaggcatgctggagctgcggggccacaaggccaaggtgtttgctgccctgagccctggagagctggccctgtacaagtctgagcaggccttcagcctgggcatcggcatctgcttcatcgagctgcagggctgcagcgtgcgggagaccaagagccgcagctttgacctgctgaccccccaccgctgcttctccttcaccgctgagagcggcggggcccggcagagctgggccgccgccctgcaggaggccgtgacagagaccctgagtgactatgaggtggccgagaagatctggagcaacagagccaaccggcagtgtgccgactgtggcagcagcaggccagactgggccgctgtgaacctgggcgtggtgatctgcaagcagtgtgccggccagcaccgggccctgggcagcggcatcagcaaggtgcagagcctgaagctggacacctctgtgtggagcaatgaaattgtgcagctgttcatcgtgctgggcaatgaccgggccaaccgcttctgggccggcaccctgcccccaggagagggcctgcacccagatgccaccccaggccccagaggagagttcatcagcaggaagtaccgcctgggcctcttcaggaagccccacccccagtacccagaccacagccagctgctgcaggccctgtgtgccgctgtggcccggcccaacctgctgaagaacatgacccagctgctgtgtgtggaggcctttgaaggagaggagccctggttccccccagccccagatggcagctgccccggcctgctgcccagcgaccccagccctggggtgtacaatgaggtggtggtgcgggccacctacagcggcttcctgtactgcagccctgtgagcaacaaggccggccccagccccccccggcggggcagagatgccccaccccggctgtggtgtgtgctgggcgccgccctggagatgtttgccagcgagaacagccctgagcccctgagcctcatccagccccaggacatcgtgtgcctgggcgtgagccccccacccacagatcctggggaccgcttccccttctcctttgagctgatcctggccggcggccgcatccagcactttggaacagatggagctgacagcctggaggcctggaccagcgctgtgggcaagtggttcagccccctgagctgccaccagctgctgggccctggcctgctgcggctgggccgcctgtggctgcggagccccagccacacagccccagcccctggcctgtggctgagcggcttcggcctgctgcggggggaccacctgttcctgtgcagcgcccctggccctggccccccagcccctgaggacatggtgcacctgcggcggctgcaggagatctctgtggtgtctgctgctgacaccccagacaagaaggagcacctggtgctggtggagactggaagaaccctgtacctgcagggcgagggccgcctggacttcaccgcctggaatgctgccatcggcggggccgccggcggcggcggcaccggcctgcaggagcagcagatgagcagaggagacatccccatcatcgtggatgcctgcatcagctttgtgacccagcacggcctgcggctggagggcgtgtacagaaaaggaggagcccgggcccggagcctgcggctgctggccgagttcagaagagatgcccggtctgtgaagctgcggcctggagagcactttgtggaggatgtgacagacaccctgaagcgcttcttccgggagctggatgatcctgtgaccagcgcccggctgctgccccgctggagggaggccgctgagctgccccagaagaaccagaggctggagaagtacaaggatgtgattggctgcctgccccgggtgaacagaaggaccctggccaccctgattggccacctgtacagagtgcagaagtgtgccgccctgaaccagatgtgcaccaggaacctggccctgctgtttgcccccagcgtcttccagacagatggccgcggggagcacgaggtgcgggtgctgcaggagctgattgatggctacatctctgtgtttgacatcgacagcgaccaggtggcccagattgacctggaggtgtccctcatcaccacctggaaggatgtgcagctgagccaggccggggacctgatcatggaggtgtacatcgagcagcagctgcctgacaactgtgtgaccctgaaggtgagccccaccctgacagctgaggagctgaccaaccaggtgctggagatgaggggcacagctgctggcatggacctgtgggtgacctttgagatccgggagcacggggagctggagcggcccctgcaccccaaggagaaggtgctggagcaggccctgcagtggtgccagctgcctgagccctgcagcgccagcctgctgctgaagaaggtgcccctggcccaggccggctgcctcttcaccggcatcagaagagagagcccccgggtgggcctgctgcgctgccgggaggagcccccccggctgctgggcagccgcttccaggagcgcttcttcctgctgcggggccgctgcctgctgctgctgaaggagaagaagagcagcaagccagagcgggagtggcccctggagggcgccaaggtgtacctgggcatcaggaagaagctgaagccacccaccccctggggcttcaccctcatcctggagaagatgcacctgtacctgagctgcacagatgaagatgagatgtgggactggaccaccagcatcctgaaggcccagcatgatgaccagcagcctgtggtgctgcggcggcacagcagcagtgacctggcccggcagaagtttggcaccatgcccctgctgcccatcagaggagatgattctggggccaccctgctgagcgccaaccagaccctgcggcggctgcacaacagaaggaccctgtccatgttcttccccatgaagagcagccagggctctgtggaggagcaggaggagctggaggagcctgtgtatgaggagcctgtgtatgaggaggtgggcgccttccctgagctgatccaggacaccagcaccagcttcagcaccacccgggagtggacagtgaagccagagaaccccctgaccagccagaagagcctggaccagcccttcctgagcaagagcagcaccctgggccaggaggagcggcccccagagcccccacctggcccccccagcaagagcagcccccaggcccggggcagcctggaggagcagctgctgcaggagctgagcagcctcatcctgaggaagggggagaccacagctggcctgggcagccccagccagcccagcagcccccagagccccagccccaccggcctgcccacccagaccccaggcttccccacccagcccccctgcaccagcagcccccccagcagccagcccctgacctag

SEQ ID NO: 35589 - DNA, 1422 bp, Artificial Sequence
  Description of Artificial Sequence: Synthetic coding sequence
atggccgccccccaggacctggacattgctgtgtggctggccaccgtgcacctggagcagtatgctgacaccttccgccgccacggcctggccacagctggagctgcccggggcctgggccacgaggagctgaagcagctgggcatcagcgccaccggccacaggaagaggatcctgcggctgctgcagacaggaacagaggagggcagcctggaccccaagagtgacagcgccatggagcccagccccagccctgccccccaggcccagccccccaagcctgtgcccaagcccaggacagtgtttggaggcctgagcggccctgccaccacccagaggcctggcctgagccctgccctgggcggccctggggtgagccgcagccctgagcccagcccccggcccccacccctgcccaccagcagcagcgagcagagcagcgccctgaacacagtggagatgatgcccaacagcatctacttcggcctggacagccggggccgggcccaggccgcccaggacaaggccccagacagcagccagatcagcgcccccaccccagccctgcggcccaccactggaacagtgcacatcatggaccccggctgcctgtactacggcgtgcagcctgtgggcacccctggggccccagacagaagagagagccggggcgtgtgccagggccgggcagagcaccggctgagccggcaggacctggaggccagagaagatgctggctacgccagcctggagctgcccggggacagcaccctgctgagccccaccctggagacagaggagaccagtgatgacctgatcagcccctatgccagcttctccttcaccgctgaccggctgacccccctgctgagcggctggctggacaagctgagcccccagggcaactacgtgttccagaggagatttgtgcagttcaacggccgcagcctgatgtacttcggcagtgacaaggaccccttccccaagggcgtcatccccctgacagccatcgagatgaccaggagcagcaaggacaacaagttccaggtgatcaccggccagagggtgtttgtgttcagaacagaaagtgaggcccagagggacatgtggtgcagcaccctgcagagctgcctgaaggagcagaggctgctgggccaccccaggcctccccagcccccccggcccctgaggacaggcatgctggagctgcggggccacaaggccaaggtgtttgctgccctgagccctggagagctggccctgtacaagtctgagcaggccttcagcctgggcatcggcatctgcttcatcgagctgcagggctgcagcgtgcgggagaccaagagccgcagctttgacctgctgaccccccaccgctgcttctccttcaccgctgagagcggcggggcccggcagagctag

SEQ ID NO: 35590 - DNA, 4128 bp, Artificial Sequence
  Description of Artificial Sequence: Synthetic coding sequence
atggagcccagccccagccctgccccccaggcccagccccccaagcctgtgcccaagcccaggacagtgtttggaggcctgagcggccctgccaccacccagaggcctggcctgagccctgccctgggcggccctggggtgagccgcagccctgagcccagcccccggcccccacccctgcccaccagcagcagcgagcagagcagcgccctgaacacagtggagatgatgcccaacagcatctacttcggcctggacagccggggccgggcccaggccgcccaggacaaggccccagacagcagccagatcagcgcccccaccccagccctgcggcccaccactggaacagtgcacatcatggaccccggctgcctgtactacggcgtgcagcctgtgggcacccctggggccccagacagaagagagagccggggcgtgtgccagggccgggcagagcaccggctgagccggcaggacctggaggccagagaagatgctggctacgccagcctggagctgcccggggacagcaccctgctgagccccaccctggagacagaggagaccagtgatgacctgatcagcccctatgccagcttctccttcaccgctgaccggctgacccccctgctgagcggctggctggacaagctgagcccccagggcaactacgtgttccagaggagatttgtgcagttcaacggccgcagcctgatgtacttcggcagtgacaaggaccccttccccaagggcgtcatccccctgacagccatcgagatgaccaggagcagcaaggacaacaagttccaggtgatcaccggccagagggtgtttgtgttcagaacagaaagtgaggcccagagggacatgtggtgcagcaccctgcagagctgcctgaaggagcagaggctgctgggccaccccaggcctccccagcccccccggcccctgaggacaggcatgctggagctgcggggccacaaggccaaggtgtttgctgccctgagccctggagagctggccctgtacaagtctgagcaggccttcagcctgggcatcggcatctgcttcatcgagctgcagggctgcagcgtgcgggagaccaagagccgcagctttgacctgctgaccccccaccgctgcttctccttcaccgctgagagcggcggggcccggcagagctgggccgccgccctgcaggaggccgtgacagagaccctgagtgactatgaggtggccgagaagatctggagcaacagagccaaccggcagtgtgccgactgtggcagcagcaggccagactgggccgctgtgaacctgggcgtggtgatctgcaagcagtgtgccggccagcaccgggccctgggcagcggcatcagcaaggtgcagagcctgaagctggacacctctgtgtggagcaatgaaattgtgcagctgttcatcgtgctgggcaatgaccgggccaaccgcttctgggccggcaccctgcccccaggagagggcctgcacccagatgccaccccaggccccagaggagagttcatcagcaggaagtaccgcctgggcctcttcaggaagccccacccccagtacccagaccacagccagctgctgcaggccctgtgtgccgctgtggcccggcccaacctgctgaagaacatgacccagctgctgtgtgtggaggcctttgaggaccccagccctggggtgtacaatgaggtggtggtgcgggccacctacagcggcttcctgtactgcagccctgtgagcaacaaggccggccccagccccccccggcggggcagagatgccccaccccggctgtggtgtgtgctgggcgccgccctggagatgtttgccagcgagaacagccctgagcccctgagcctcatccagccccaggacatcgtgtgcctgggcgtgagccccccacccacagatcctggggaccgcttccccttctcctttgagctgatcctggccggcggccgcatccagcactttggaacagatggagctgacagcctggaggcctggaccagcgctgtgggcaagtggttcagccccctgagctgccaccagctgctgggccctggcctgctgcggctgggccgcctgtggctgcggagccccagccacacagccccagcccctggcctgtggctgagcggcttcggcctgctgcggggggaccacctgttcctgtgcagcgcccctggccctggccccccagcccctgaggacatggtgcacctgcggcggctgcaggagatctctgtggtgtctgctgctgacaccccagacaagaaggagcacctggtgctggtggagactggaagaaccctgtacctgcagggcgagggccgcctggacttcaccgcctggaatgctgccatcggcggggccgccggcggcggcggcaccggcctgcaggagcagcagatgagcagaggagacatccccatcatcgtggatgcctgcatcagctttgtgacccagcacgagctgccccagaagaaccagaggctggagaagtacaaggatgtgattggctgcctgccccgggtgaacagaaggaccctggccaccctcatcggccacctgtacagagtgcagaagtgtgccgccctgaaccagatgtgcaccaggaacctggccctgctgtttgcccccagcgtcttccagacagatggccgcggggagcacgaggtgcgggtgctgcaggagctgattgatggctacatctctgtgtttgatattgacagcgaccaggtggcccagattgacctggaggtgtccctcatcaccacctggaaggatgtgcagctgagccaggccggggacctgatcatggaggtgtacatcgagcagcagctgcctgacaactgtgtgaccctgaaggtgagccccaccctgacagctgaggagctgaccaaccaggtgctggagatgaggggcacagctgctggcatggacctgtgggtgacctttgagatccgggagcacggggagctggagcggcccctgcaccccaaggagaaggtgctggagcaggccctgcagtggtgccagctgcctgagccctgcagcgccagcctgctgctgaagaaggtgcccctggcccaggccggctgcctcttcaccggcatccggcgggagagcccccgggtgggcctgctgcgctgccgggaggagcccccccggctgctgggcagccgcttccaggagcgcttcttcctgctgcggggccgctgcctgctgctgctgaaggagaagaagagcagcaagccagagcgggagtggcccctggagggcgccaaggtgtacctgggcatcaggaagaagctgaagccacccaccccctggggcttcaccctcatcctggagaagatgcacctgtacctgagctgcacagatgaagatgagatgtgggactggaccaccagcatcctgaaggcccagcatgatgaccagcagcctgtggtgctgcggcggcacagcagcagtgacctggcccggcagaagtttggcaccatgcccctgctgcccatcagaggagatgacagcggggccaccctgctgagcgccaaccagaccctgcggcggctgcacaacagaaggaccctgtccatgttcttccccatgaagagcagccagggctctgtggaggagcaggaggagctggaggagcctgtgtatgaggagcctgtgtatgaggaggtgggcgccttccctgagctgatccaggacaccagcaccagcttcagcaccacccgggagtggacagtgaagccagagaaccccctgaccagccagaagagcctggaccagcccttcctgagcaagagcagcaccctgggccaggaggagaggcctcctgagcccccacctggcccccccagcaagagcagcccccaggcccggggcagcctggaggagcagctgctgcaggagctgagcagcctcatcctgaggaaaggagagaccacagctggcctgggcagccccagccagcccagcagcccccagagccccagccccaccggcctgcccacccagaccccaggcttccccacccagcccccctgcaccagcagcccccccagcagccagcccctgacctag

SEQ ID NO: 35591 - DNA, 3582 bp, Artificial Sequence
  Description of Artificial Sequence: Synthetic coding sequence
atgaccaggagcagcaaggacaacaagttccaggtgatcaccggccagagggtgtttgtgttcagaacagaaagtgaggcccagagggacatgtggtgcagcaccctgcagagctgcctgaaggagcagaggctgctgggccaccccaggcctccccagcccccccggcccctgaggacaggcatgctggagctgcggggccacaaggccaaggtgtttgctgccctgagccctggagagctggccctgtacaagtctgagcaggccttcagcctgggcatcggcatctgcttcatcgagctgcagggctgcagcgtgcgggagaccaagagccgcagctttgacctgctgaccccccaccgctgcttctccttcaccgctgagagcggcggggcccggcagagctgggccgccgccctgcaggaggccgtgacagagaccctgagtgactatgaggtggccgagaagatctggagcaacagagccaaccggcagtgtgccgactgtggcagcagcaggccagactgggccgctgtgaacctgggcgtggtgatctgcaagcagtgtgccggccagcaccgggccctgggcagcggcatcagcaaggtgcagagcctgaagctggacacctctgtgtggagcaatgaaattgtgcagctgttcatcgtgctgggcaatgaccgggccaaccgcttctgggccggcaccctgcccccaggagagggcctgcacccagatgccaccccaggccccagaggagagttcatcagcaggaagtaccgcctgggcctcttcaggaagccccacccccagtacccagaccacagccagctgctgcaggccctgtgtgccgctgtggcccggcccaacctgctgaagaacatgacccagctgctgtgtgtggaggcctttgaaggagaggagccctggttccccccagccccagatggcagctgccccggcctgctgcccagcgaccccagccctggggtgtacaatgaggtggtggtgcgggccacctacagcggcttcctgtactgcagccctgtgagcaacaaggccggccccagccccccccggcggggcagagatgccccaccccggctgtggtgtgtgctgggcgccgccctggagatgtttgccagcgagaacagccctgagcccctgagcctcatccagccccaggacatcgtgtgcctgggcgtgagccccccacccacagatcctggggaccgcttccccttctcctttgagctgatcctggccggcggccgcatccagcactttggaacagatggagctgacagcctggaggcctggaccagcgctgtgggcaagtggttcagccccctgagctgccaccagctgctgggccctggcctgctgcggctgggccgcctgtggctgcggagccccagccacacagccccagcccctggcctgtggctgagcggcttcggcctgctgcggggggaccacctgttcctgtgcagcgcccctggccctggccccccagcccctgaggacatggtgcacctgcggcggctgcaggagatctctgtggtgtctgctgctgacaccccagacaagaaggagcacctggtgctggtggagactggaagaaccctgtacctgcagggcgagggccgcctggacttcaccgcctggaatgctgccatcggcggggccgccggcggcggcggcaccggcctgcaggagcagcagatgagcagaggagacatccccatcatcgtggatgcctgcatcagctttgtgacccagcacggcctgcggctggagggcgtgtacagaaaaggaggagcccgggcccggagcctgcggctgctggccgagttcagaagagatgcccggtctgtgaagctgcggcctggagagcactttgtggaggatgtgacagacaccctgaagcgcttcttccgggagctggatgatcctgtgaccagcgcccggctgctgccccgctggagggaggccgctgagctgccccagaagaaccagaggctggagaagtacaaggatgtgattggctgcctgccccgggtgaacagaaggaccctggccaccctgattggccacctgtacagagtgcagaagtgtgccgccctgaaccagatgtgcaccaggaacctggccctgctgtttgcccccagcgtcttccagacagatggccgcggggagcacgaggtgcgggtgctgcaggagctgattgatggctacatctctgtgtttgacatcgacagcgaccaggtggcccagattgacctggaggtgtccctcatcaccacctggaaggatgtgcagctgagccaggccggggacctgatcatggaggtgtacatcgagcagcagctgcctgacaactgtgtgaccctgaaggtgagccccaccctgacagctgaggagctgaccaaccaggtgctggagatgaggggcacagctgctggcatggacctgtgggtgacctttgagatccgggagcacggggagctggagcggcccctgcaccccaaggagaaggtgctggagcaggccctgcagtggtgccagctgcctgagccctgcagcgccagcctgctgctgaagaaggtgcccctggcccaggccggctgcctcttcaccggcatcagaagagagagcccccgggtgggcctgctgcgctgccgggaggagcccccccggctgctgggcagccgcttccaggagcgcttcttcctgctgcggggccgctgcctgctgctgctgaaggagaagaagagcagcaagccagagcgggagtggcccctggagggcgccaaggtgtacctgggcatcaggaagaagctgaagccacccaccccctggggcttcaccctcatcctggagaagatgcacctgtacctgagctgcacagatgaagatgagatgtgggactggaccaccagcatcctgaaggcccagcatgatgaccagcagcctgtggtgctgcggcggcacagcagcagtgacctggcccggcagaagtttggcaccatgcccctgctgcccatcagaggagatgattctggggccaccctgctgagcgccaaccagaccctgcccatgaagagcagccagggctctgtggaggagcaggaggagctggaggagcctgtgtatgaggagcctgtgtatgaggaggtgggcgccttccctgagctgatccaggacaccagcaccagcttcagcaccacccgggagtggacagtgaagccagagaaccccctgaccagccagaagagcctggaccagcccttcctgagcaagagcagcaccctgggccaggaggagaggcctcctgagcccccacctggcccccccagcaagagcagcccccaggcccggggcagcctggaggagcagctgctgcaggagctgagcagcctcatcctgaggaaaggagagaccacagctggcctgggcagccccagccagcccagcagcccccagagccccagccccaccggcctgcccacccagaccccaggcttccccacccagcccccctgcaccagcagcccccccagcagccagcccctgacctag

SEQ ID NO: 35592 - DNA, 1116 bp, Artificial Sequence
  Description of Artificial Sequence: Synthetic coding sequence
atgctgatggccagcaccaccagcgctgtgcccggccaccccagcctgcccagcctgcccagcaacagcagccaggagcggcccctggacacccgggaccccctgctggcccgggcagagctggccctgctgagcatcgtgtttgtggccgtggccctgagcaatggcctggtgctggccgccctggcccggcggggcagaagaggccactgggcccccatccacgtgttcatcggccacctgtgcctggccgacctggccgtggccctcttccaggtgctgccccagctggcctggaaggccacagaccgcttccggggcccagatgccctgtgcagagctgtgaagtacctgcagatggtgggcatgtatgccagcagctacatgatcctggccatgaccctggacagacaccgggccatctgccggcccatgctggcctaccgccacggcagcggggcccactggaacagacctgtgctggtggcctgggccttcagcctgctgctgagcctgccccagctgttcatctttgcccagagaaatgtggagggcggcagcggcgtgacagactgctgggcctgctttgctgagccctggggccgccgcacctacgtgacctggatcgccctgatggtgtttgtggcccccaccctgggcattgctgcctgccaggtgctgatcttccgggagatccacgccagcctggtgcccggccccagcgagaggcctgggggcagaagaagaggaagaagaacaggcagccctggagagggcgcccacgtgtctgctgctgtggccaagacagtgaggatgaccctggtgattgtggtggtgtatgtgctgtgctgggcccccttcttcctggtgcagctgtgggccgcctgggaccctgaggcccccctggagggcgccccctttgtgctgctgatgctgctggccagcctgaacagctgcaccaacccctggatctatgccagcttcagcagctctgtgagcagcgagctgcggagcctgctgtgctgtgcccggggccgcaccccacccagcctgggcccccaggatgagagctgcaccacagccagcagcagcctggccaaggacaccagcagctag

SEQ ID NO: 35593 - DNA, 444 bp, Artificial Sequence
  Description of Artificial Sequence: Synthetic coding sequence
atgggcaccccagcctctgtggtgtctgagcccccaccctggcaggcccccatcgaggcccggggcaggaagcaggccagcgccaacatcttccaggatgctgagctgctgcagatccaggccctcttccagaggtctggggaccagctggccgaggagcgggcccagatcatctgggagtgtgccggggaccaccgggtggccgaggccctgaagaggctgcggaggaagaggcctccccggcagaagcccctgggccacagcctgcaccactgcagccggctgcgcatcctggagccccacagcgccctggccaacccccagagcgccacagaaacagccagcagcgagcagtacctgcacagcaggaagaagagcgcccgcatcagaagaaactggaggaagagcggccccaccagctacctgcaccagatccgccactag

SEQ ID NO: 35594 - DNA, 1305 bp, Artificial Sequence
  Description of Artificial Sequence: Synthetic coding sequence
atggccgccagtgacacagaaagagatggcctggcccctgagaagaccagcccagaccgggacaagaagaaggagcagagcgaggtgtctgtgagcccccgggccagcaagcaccactacagccgcagccgcagccgcagccgggagaggaagaggaagagtgacaatgaaggaaggaagcacaggagccgcagccgcagcaaggagggcagaagacatgagagcaaggacaagagcagcaagaagcacaagtctgaggagcacaatgacaaggagcacagcagtgacaagggccgggagcggctgaacagcagtgaaaatggagaagatagacacaagaggaaggagaggaagagcagccggggccgcagccacagccgcagccgcagccgggagaggaggcacaggagccgcagccgggagaggaagaagagccgcagccgcagccgggagaggaagaagagccgcagccgcagccgggagaggaagaagagccgcagccgcagccgggagaggaagaggcgcatccgcagccgcagccgcagccgcagccgccaccgccacaggaccaggagccgcagcaggaccaggagccgcagccgggacaggaagaagagaattgagaagccccggcgcttcagccgcagcctgagcaggacccccagccccccacccttccggggcaggaacacagccatggatgcccaggaggccctggcccggcggctggagcgggccaagaagctgcaggagcagcgggagaaggagatggtggagaagcagaagcagcaggagattgctgctgctgctgccaccggcggctctgtgctgaatgtggccgccctgctggccagcggcacccaggtgaccccccagatcgccatggccgcccagatggccgccctgcaggccaaggccctggccgagaccggcattgctgtgcccagctactacaacccagctgctgtgaaccccatgaagtttgctgagcaggagaagaagaggaagatgctgtggcagggcaagaaggagggggacaagagccagagcgctgagatctgggagaagctgaactttggaaacaaggaccagaatgtgaagttcaggaagctgatgggcatcaagtcagaagatgaggccggctgcagctctgtggatgaggagagctacaagaccctgaagcagcaggaggaggtgttcaggaacctggatgcccagtatgagatggcccggagccagacccacacccagaggggcatgggcctgggcttcaccagctccatgaggggcatggatgctgtgtag

SEQ ID NO: 35595 - DNA, 1161 bp, Artificial Sequence
  Description of Artificial Sequence: Synthetic coding sequence
atgaaggaggagaacacaggagctggagctgaggccaagaggaccaacttcttcctgaagcagggcagaagacatgagagcaaggacaagagcagcaagaagcacaagtctgaggagcacaatgacaaggagcacagcagtgacaagggccgggagcggctgaacagcagtgaaaatggagaagatagacacaagaggaaggagaggaagagcagccggggccgcagccacagccgcagccgcagccgggagaggaggcacaggagccgcagccgggagaggaagaagagccgcagccgcagccgggagaggaagaagagccgcagccgcagccgggagaggaagaagagccgcagccgcagccgggagaggaagaggcgcatccgcagccgcagccgcagccgcagccgccaccgccacaggaccaggagccgcagcaggaccaggagccgcagccgggacaggaagaagagaattgagaagccccggcgcttcagccgcagcctgagcaggacccccagccccccacccttccggggcaggaacacagccatggatgcccaggaggccctggcccggcggctggagcgggccaagaagctgcaggagcagcgggagaaggagatggtggagaagcagaagcagcaggagattgctgctgctgctgccaccggcggctctgtgctgaatgtggccgccctgctggccagcggcacccaggtgaccccccagatcgccatggccgcccagatggccgccctgcaggccaaggccctggccgagaccggcattgctgtgcccagctactacaacccagctgctgtgaaccccatgaagtttgctgagcaggagaagaagaggaagatgctgtggcagggcaagaaggagggggacaagagccagagcgctgagatctgggagaagctgaactttggaaacaaggaccagaatgtgaagttcaggaagctgatgggcatcaagtcagaagatgaggccggctgcagctctgtggatgaggagagctacaagaccctgaagcagcaggaggaggtgttcaggaacctggatgcccagtatgagatggcccggagccagacccacacccagaggggcatgggcctgggcttcaccagctccatgaggggcatggatgctgtgtag

SEQ ID NO: 35596 - DNA, 1110 bp, Artificial Sequence
  Description of Artificial Sequence: Synthetic coding sequence
atggccgccagtgacacagaaagagatggcctggcccctgagaagaccagcccagaccgggacaagaagaaggagcagagcgaggtgtctgtgagcccccgggccagcaagcaccactacagccgcagccgcagccgcagccgggagaggaagaggaagagtgacaatgaaggaaggaagcacaggagccgcagccgcagcaaggagggcagaagacatgagagcaaggacaagagcagcaagaagcacaagtctgaggagcacaatgacaaggagcacagcagtgacaagggccgggagcggctgaacagcagtgaaaatggagaagatagacacaagaggaaggagaggaagagcagccggggccgcagccacagccgcagccgcagccgggagaggaggcacaggagccgcagccgggagaggaagaagagccgcagccgcagccgggagaggaagaagagccgcagccgcagccgggagaggaagaagagccgcagccgcagccgggagaggaagaggcgcatccgcagccgcagccgcagccgcagccgccaccgccacaggaccaggagccgcagcaggaccaggagccgcagccgggacaggaagaagagaattgagaagccccggcgcttcagccgcagcctgagcaggacccccagccccccacccttccggggcaggaacacagccatggatgcccaggaggccctggcccggcggctggagcgggccaagaagctgcaggagcagcgggagaaggagatggtggagaagcagaagcagcaggagattgctgctgctgctgctgccactggaggctctgtgctgaatgtggccgccctgctggccagcggcacccaggtgaccccccagatcgccatggccgcccagatggccgccctgcaggccaaggccctggccgagactggaattgctgtgcccagctactacaacccagctgctgtgaaccccatgaagtttgctgagcaggagaagaagaggaagatgctgtggcagggcaagaaggagggcttcatccccaactacctggagatcatgggcaagattgagttctggaagcagggccagaatgtgaagttctag

SEQ ID NO: 35597 - DNA, 333 bp, Artificial Sequence
  Description of Artificial Sequence: Synthetic coding sequence
ggggcccggagccctggcagcacccaccagggcagcctggccagcggcgtgctgcccatcaagtgcagccacgtggagtttggcatgtggaagggcggccgcagccaccccttcctgccccacagcagccgctgtgccggcagcggcggccagctggacagcatcctgccccaccagagccctgcctggggcccctggggctgcaaggacctgagcagcggcttccccagcttcctgaccagcagcatcctgtggaagtctgctgtggtgcgggagccccacatcagcccccaccaggccccaccctacaagaccagtgactgcatcacctag

SEQ ID NO: 35598 - DNA, 1104 bp, Artificial Sequence
  Description of Artificial Sequence: Synthetic coding sequence
atgggcaagagcatcccccagtacctgggccagctggacatcaggaagtctgtggtgtccctggccactggagctggggccatctacctgctgtacaaggccatcaaggccggcatcaagtgcaagccacccctgtgcagcaacagccccatctgcatcgcccgggagtgccccggccctggagagcgggccctgccccaggaggccccagcccctgaggccagcgctgtgggcggccccaagggcctggccgtggagcgggagcggcacggccgggacagcggggagctgcggcggctgctgaacagcctggagtgcaagcaggatgaatatgccaagtccatgatcctgcacagcatcacccgctgtgtgtacctgctggaggccgaggccagcgcctgcaccacagatgacatcgtgctgctgggctacatgctggatgacaaggacaacagcgtgaagacccaggccctgaacaccctgaaggccttcagcggcatcaggaagttccggctgaagatccaggagcacagcatcaaggtgctggagctgatcagcaccatctgggacacagagctgcacatcgccggcctgcggctgctgaacaacctgcccctgcctgactatgtgcacccccagctgcggcgggtgatgcctgccctgatggagatcctgcagagcgactacatcctggcccaggtgcaggccgtgcggctgctgagctacctggcccagaagaatgacctgctgtatgacatcctgaactgccaggtgcacagcaacttcctgaacctcttccagcccacccagagcggcagcctgctgtatgaggtgctggtgtttgctgagcggctgtctgagggcagaaatgccccccactaccacgtggtgaagtggcactacaatgagcagagcctgcacgagagcctgtttggagaggagagccggctggccgaccggctgctggccctggtgatccaccctgaggaggatgtgcagatccaggcctgcaaggtgattgtgtccctgcagtacccccaggacctgcgggcccggcccagcagctgccagcccagccgcagctacttcaagaacacagaatag

SEQ ID NO: 35599 - DNA, 1023 bp, Artificial Sequence
  Description of Artificial Sequence: Synthetic coding sequence
atgggcaagagcatcccccagtacctgggccagctggacatcaggaagtctgtggtgtccctggccactggagctggggccatctacctgctgtacaaggccatcaaggccggcatcaagtgcaagccacccctgtgcagcaacagccccatctgcatcgcccggctggccgtggagcgggagagacatggccgggacagcggggagctgcggcggctgctgaacagcctggagtgcaagcaggatgaatatgccaagtccatgatcctgcacagcatcacccgctgtgtgtacctgctggaggccgaggccagcgcctgcaccacagatgacatcgtgctgctgggctacatgctggatgacaaggacaacagcgtgaagacccaggccctgaacaccctgaaggccttcagcggcatcaggaagttccggctgaagatccaggagcacagcatcaaggtgctggagctgatcagcaccatctgggacacagagctgcacatcgccggcctgcggctgctgaacaacctgcccctgcctgactatgtgcacccccagctgcggcgggtgatgcctgccctgatggagatcctgcagagcgactacatcctggcccaggtgcaggccgtgcggctgctgagctacctggcccagaagaatgacctgctgtatgacatcctgaactgccaggtgcacagcaacttcctgaacctcttccagcccacccagagcggcagcctgctgtatgaggtgctggtgtttgctgagcggctgtctgagggcagaaatgccccccactaccacgtggtgaagtggcactacaatgagcagagcctgcacgagagcctgtttggagaggagagccggctggccgaccggctgctggccctggtgatccacccagaagaagatgtgcagatccaggcctgcaaggtgattgtgtccctgcagtacccccaggacctgcgggcccggcccagcagctgccagcccagccgcagctacttcaagaacacagaatag

SEQ ID NO: 35600 - DNA, 993 bp, Artificial Sequence
  Description of Artificial Sequence: Synthetic coding sequence
atgggcaagagcatcccccagtacctgggccagctggacatcaggaagtctgtggtgtccctggccactggagctggggccatctacctgctgtacaaggccatcaaggccggcatcaagtgcaagccacccctgtgcagcaacagccccatctgcatcgcccggctggccgtggagcgggagagacatggccgggacagcggggagctgcggcggctgctgaacagcctggagtgcaagcaggatgaatatgccaagtccatgatcctgcacagcatcacccgctgtgtgtacctgctggaggccgaggccagcgcctgcaccacagatgacatcgtgctgctgggctacatgctggatgacaaggacaacagcgtgaagacccaggccctgaacaccctgaaggccttcagcggcatcaggaagttccggctgaagatccaggagcacagcatcaaggtgctggagctgatcagcaccatctgggacacagagctgcacatcgccggcctgcggctgctgaacaacctgcccctgcctgactatgtgcacccccagctgcggcgggtgatgcctgccctgatggagatcctgcagagcgactacatcctggcccaggtgcaggccgtgcggctgctgagctacctggcccagaagaatgacctgctgtatgacatcctgaactgccagcccacccagagcggcagcctgctgtatgaggtgctggtgtttgctgagcggctgtctgagggcagaaatgccccccactaccacgtggtgaagtggcactacaatgagcagagcctgcacgagagcctgtttggagaggagagccggctggccgaccggctgctggccctggtgatccacccagaagaagatgtgcagatccaggcctgcaaggtgattgtgtccctgcagtacccccaggacctgcgggcccggcccagcagctgccagcccagccgcagctacttcaagaacacagaatag

SEQ ID NO: 35601 - DNA, 672 bp, Artificial Sequence
  Description of Artificial Sequence: Synthetic coding sequence
atgctgagccccaatgacaagatgctgggcaagctggaccccttctaccagcccagcgtgtccaagcagaagaccagcgctgagatcatcagcgaggccagaaatgccctgaggacagtgaggacccagaggcccttcaccccccaggaggcccagaggaagctgtttggacctgccagcagcaggaccagtgaaaatcggccccccagcagcttcagcctgcacgccagcagctttgagagcagtgacagccggcccatcagcggcacccggctgagccccctggagctgaagcccaaggtgcctgccagccccacccgggaggaggacagctgcttctccttccccaagccccctgtggaccctgccaagatccggcgggtgtccaatgcccgggcccggctcttccgggccgccagccagagggccctgctgcctgacaggagcctgcccccaagtgacagcaagaagacagtggagagcaaggagaccgtgatgatgggagacagcatggtgaagatcaatggcatctacctgaccaagagcaatgccatctgccacctgaagagccaccccctgcagctgacagatgatggcggcttcagcgagatcaaggagcaggagatgttcaagggcaccaccagcctgcccagccacctgaagaatggatag

SEQ ID NO: 35602 - DNA, 2109 bp, Artificial Sequence
  Description of Artificial Sequence: Synthetic coding sequence
atgatgggagacagcatggtgaagatcaatggcatctacctgaccaagagcaatgccatctgccacctgaagagccaccccctgcagctgacagatgatggcggcttcagcgagatcaaggagcaggagatgttcaagggcaccaccagcctgcccagccacctgaagaatggaggagaccagggcaagagacatgcccgggccagcagctgccccagcagcagtgacctgagccggctgcagaccaaggctgtgcccaaggctgacctgcaggaggaggatgctgagattgaggtggatgaggtgttctggaacacccgcatcgtgcccatcctgcgggagctggagaaggaggagaacattgaaacagtgtgtgccgcctgcacccagctgcaccacgccctggaggagggcaacatgctgggcaacaagttcaagggccgcagcatcctgctgaagaccctgtgcaagctggtggatgtgggcagtgacagcctgagcctgaagctggccaagatcatcctggccctgaaggtgtccaggaagaacctgctgaatgtgtgcaagctgatcttcaagatcagcagaaatgagaagaatgacagcctcatccagaatgacagcatcctggagagcctgctggaggtgctgcggtctgaggacctgcagaccaacatggaggccttcctgtactgcatgggcagcatcaagttcatcagcggcaacctgggcttcctgaatgagatgatcagcaaaggagctgtggagatcctgatcaacctgatcaagcagatcaatgaaaacatcaagaagtgtggcaccttcctgcccaacagcggccacctgctggtgcaggtgacagccaccctgaggaacctggtggacagcagcctggtgcgcagcaagttcctgaacatcagcgccctgccccagctgtgcacagccatggagcagtacaagggggacaaggatgtgtgcaccaacatcgcccgcatcttcagcaagctgaccagctacagagactgctgcacagccctggccagctacagccgctgctacgccctcttcctgaacctgatcaacaagtaccagaagaagcaggacctggtggtgcgggtggtgttcatcctgggcaacctgacagccaagaacaaccaggcccgggagcagttcagcaaggagaagggcagcatccagaccctgctgagcctcttccagaccttccaccagctggacctgcacagccagaagcctgtgggccagagaggagagcagcaccgggcccagaggcctccttctgaggccgaggatgtgctgatcaagctgaccagggtgctggccaacatcgccatccaccctggggtgggccctgtgctggccgccaaccctggcatcgtgggcctgctgctgaccaccctggagtacaagagcctggatgactgtgaggagctggtgatcaatgccacagccaccatcaacaacctgagctactaccaggtgaagaacagcatcatccaggacaagaagctgtacatcgccgagctgctgctgaagctgctggtgagcaacaacatggatggcatcctggaggccgtgcgggtgtttggaaacctgagccaggaccatgatgtgtgtgacttcatcgtgcagaacaacgtgcaccgcttcatgatggccctgctggatgcccagcaccaggacatctgcttcagcgcctgtggggtgctgctgaacctgactgtggacaaggacaagagggtcatcctgaaggagggcggcggcatcaagaagctggtggactgcctgcgggacctgggccccacagactggcagctggcctgcctggtgtgcaagaccctgtggaacttcagcgagaacatcaccaatgccagcagctgctttggaaatgaagacaccaacaccctgctgctgctgctgagcagcttcctggatgaggagctggccctggatggcagctttgatcctgacctgaagaactaccacaagctgcactgggagacagagttcaagcctgtggcccagcagctgctgaaccgcatccagaggcaccacaccttcctggagcccctgcccatccccagcttctag

SEQ ID NO: 35603 - DNA, 2604 bp, Artificial Sequence
  Description of Artificial Sequence: Synthetic coding sequence
atgctgagccccaatgacaagatgctgggcaagctggaccccttctaccagcccagcgtgtccaagcagaagaccagcgctgagatcatcagcgaggccagaaatgccctgaggacagtgaggacccagaggcccttcaccccccaggaggcccagaggaagctgtttggacctgccagcagcaggaccagtgaaaatcggccccccagcagcttcagcctgcacgccagcagctttgagagcagtgacagccggcccatcagcggcacccggctgagccccctggagctgaagcccaaggtgcctgccagccccacccgggaggaggacagctgcttctccttccccaagccccctgtggaccctgccaagatccggcgggtgtccaatgcccgggcccggctcttccgggccgccagccagagggccctgctgcctgacaggagcctgcccccaagtgacagcaagaagacagtggagagcaaggagaccgtgatgatgggagacagcatggtgaagatcaatggcatctacctgaccaagagcaatgccatctgccacctgaagagccaccccctgcagctgacagatgatggcggcttcagcgagatcaaggagcaggagatgttcaagggcaccaccagcctgcccagccacctgaagaatggaggagaccagggcaagagacatgcccgggccagcagctgccccagcagcagtgacctgagccggctgcagaccaaggctgtgcccaaggctgacctgcaggaggaggatgctgagattgaggtggatgaggtgttctggaacaccagaattgtgcccatcctgcgggagctggagaaggaggagaacatcgagaccgtgtgtgccgcctgcacccagctgcaccacgccctggaggagggcaacatgctgggcaacaagttcaagggccgcagcatcctgctgaagaccctgtgcaagctggtggatgtgggcagtgacagcctgagcctgaagctggccaagatcatcctggccctgaaggtgtccaggaagaacctgctgaatgtgtgcaagctgatcttcaagatcagcagaaatgagaagaatgacagcctcatccagaatgacagcatcctggagagcctgctggaggtgctgcggtctgaggacctgcagaccaacatggaggccttcctgtactgcatgggcagcatcaagttcatcagcggcaacctgggcttcctgaatgagatgatcagcaaaggagctgtggagatcctgatcaacctgatcaagcagatcaatgaaaacatcaagaagtgtggcaccttcctgcccaacagcggccacctgctggtgcaggtgacagccaccctgaggaacctggtggacagcagcctggtgcgcagcaagttcctgaacatcagcgccctgccccagctgtgcacagccatggagcagtacaagggggacaaggatgtgtgcaccaacatcgcccgcatcttcagcaagctgaccagctacagagactgctgcacagccctggccagctacagccgctgctacgccctcttcctgaacctgatcaacaagtaccagaagaagcaggacctggtggtgcgggtggtgttcatcctgggcaacctgacagccaagaacaaccaggcccgggagcagttcagcaaggagaagggcagcatccagaccctgctgagcctcttccagaccttccaccagctggacctgcacagccagaagcctgtgggccagagaggagagcagcaccgggcccagaggcctcccagcgaggctgaagatgtgctgatcaagctgaccagggtgctggccaacatcgccatccaccctggggtgggccctgtgctggccgccaaccctggcatcgtgggcctgctgctgaccaccctggagtacaagagcctggatgactgtgaggagctggtgatcaatgccacagccaccatcaacaacctgagctactaccaggtgaagaacagcatcatccaggacaagaagctgtacatcgccgagctgctgctgaagctgctggtgagcaacaacatggatggcatcctggaggccgtgcgggtgtttggaaacctgagccaggaccatgatgtgtgtgacttcatcgtgcagaacaacgtgcaccgcttcatgatggccctgctggatgcccagcaccaggacatctgcttcagcgcctgtggggtgctgctgaacctgactgtggacaaggacaagagggtcatcctgaaggagggcggcggcatcaagaagctggtggactgcctgcgggacctgggccccacagactggcagctggcctgcctggtgtgcaagaccctgtggaacttcagcgagaacatcaccaatgccagcagctgctttggaaatgaagacaccaacaccctgctgctgctgctgagcagcttcctggatgaggagctggccctggatggcagctttgatcctgacctgaagaactaccacaagctgcactgggagacagagttcaagcctgtggcccagcagctgctgaaccgcatccagaggcaccacaccttcctggagcccctgcccatccccagcttctag

SEQ ID NO: 35604 - DNA, 2619 bp, Artificial Sequence
  Description of Artificial Sequence: Synthetic coding sequence
atgggcaagaagatcaagaaggaggtggagcccccacccaaggatgtgtttgaccccctgatgattgagagcaagaaggccgccaccgtggtgctgatgctgaacagccctgaggaggagatcctggccaaggcctgtgaggccatctacaagtttgccctgaagggggaggagaacaagaccaccctgctggagctgggcgctgtggagcccctgaccaagctgctgacccatgaggacaagatcgtgagaagaaatgccaccatgatcttcggcatcctggccagcaacaatgatgtgaagaagctgctgcgggagctggatgtgatgaacagcgtcatcgcccagctggcccctgaggaggaggtggtgatccacgagtttgccagcctgtgcctggccaacatgtctgctgagtacaccagcaaggtgcagatctttgaacatggaggcctggagcccctcatccggctgctgagcagcccagaccctgatgtgaagaagaacagcatggagtgcatctacaacctggtgcaggacttccagtgccgggccaagctgcaggagctgaatgccatcccccccatcctggacctgctgaagtctgagtaccctgtgatccagctgctggccctgaagaccctgggcgtcatcgccaatgacaaggagagcaggaccatgctgcgggacaaccagggcctggaccacctgatcaagatcctggagaccaaggagctgaatgacctgcacatcgaggccctggccgtgattgccaactgcctggaggacatggacaccatggtgcagatccagcagacaggaggcctgaagaagctgctgagctttgctgagaacagcaccatcccagacatccagaagaatgctgccaaggccatcaccaaggccgcctatgaccctgaaaataggaagctgttccacgagcaggaggtggagaagtgcctggtggccctgctgggctctgaaaatgatggcaccaagattgctgccagccaggccatcagcgccatgtgtgaaaattctggcagcaaggacttcttcaacaaccagggcatcccccagctgatccagctgctgaagagtgacaatgaggaggtgcgggaggccgccgccctggccctggccaacctgaccacctgcaacccagccaatgccaatgctgctgctgaggctgatggcatcgaccccctcatcaacctgctgagcagcaagagagatggagccatcgccaatgctgccaccgtgctgaccaacatggccatgcaggagcccctgcggctgaacatccagaaccacgacatcatgcacgccatcatcagccccctgcggagcgccaacacagtggtgcagagcaaggccgccctggccgtgacagccacagcctgtgatgtggaggccaggacagagctgagaaattctgggggcctggagcccctggtggagctgctgcggagcaagaatgatgaggtgaggaagcacgcctcctgggccgtgatggtgtgtgctggagatgagctgacagccaatgagctgtgccgcctgggcgccctggacatcctggaggaggtgaatgtgtctggcaccaggaagaacaagttcagcgaggccgcctacaacaagctgctgaacaacaacctgagcctgaagtacagccagacaggctacctgagcagcagcaacatcatcaatgatggcttctatgactatggccgcatcaaccctggcaccaagctgctgcccctgaaggagctgtgcctgcaggagcccagcgacctgcgggctgtgctgctgatcaacagcaagagctatgtgagcccccccagctccatggaggacaagagtgatgtgggctacggccgcagcatcagcagcagcagcagcctgcggcgcagcagcaaggagaagaacaagaagaacagctaccacttctctgctggcttcggcagccccatcgaggacaagtctgagcccgccagcggcaggaacacagtgctgagcaagagcgccaccaaggagaagggctggaggaagagcaagggcaagaaggaggaggagaaggtgaaggaggaggaggaggtgatggtggtgcccaagtttgtgggggagggcagcagtgacaaggagtggtgccccccaagtgaccctgacttctccatgtatgtgtatgaggtgaccaagagcatcctgcccatcaccaacatcaaggagcagatcgaggacctggccaagtatgtggccgagaagatgggcggcaagatccccaaggagaagctgcctgacttctcctgggagctgcacatcagcgagctgaagttccagctgaagagcaatgtcatccccatcggccacgtgaagaagggcatcttctaccaccgggccctgctcttcaaggccctggccgacagaattggaattggctgcagcctggtgcggggggagtatggccgggcctggaatgaggtgatgctgcagaatgacagcaggaaaggagtcatcggcggcctgcctgcccctgagatgtatgtgattgacctgatgttccaccctgggggcctgatgaagctgcggagccgggaggccgacctgtaccgcttcatctag

SEQ ID NO: 35605 - DNA, 1830 bp, Artificial Sequence
  Description of Artificial Sequence: Synthetic coding sequence
atggacaccatggtgcagatccagcagacaggaggcctgaagaagctgctgagctttgctgagaacagcaccatcccagacatccagaagaatgctgccaaggccatcaccaaggccgcctatgaccctgagaacaggaagctgttccacgagcaggaggtggagaagtgcctggtggccctgctgggctctgaaaatgatggcaccaagattgctgccagccaggccatcagcgccatgtgtgagaacagcggcagcaaggacttcttcaacaaccagggcatcccccagctgatccagctgctgaagagtgacaatgaggaggtgcgggaggccgccgccctggccctggccaacctgaccacctgcaacccagccaatgccaatgctgctgctgaggctgatggcatcgaccccctcatcaacctgctgagcagcaagagagatggagccatcgccaatgctgccaccgtgctgaccaacatggccatgcaggagcccctgcggctgaacatccagaaccacgacatcatgcacgccatcatcagccccctgcggagcgccaacacagtggtgcagagcaaggccgccctggccgtgacagccacagcctgtgatgtggaggccaggacagagctgaggaacagcggcggcctggagcccctggtggagctgctgcggagcaagaatgatgaggtgaggaagcacgcctcctgggccgtgatggtgtgtgctggagatgagctgacagccaatgagctgtgccgcctgggcgccctggacatcctggaggaggtgaatgtgtctggcaccaggaagaacaagttcagcgaggccgcctacaacaagctgctgaacaacaacctgagcctgaagtacagccagacaggctacctgagcagcagcaacatcatcaatgatggcttctatgactatggccgcatcaaccctggcaccaagctgctgcccctgaaggagctgtgcctgcaggagcccagcgacctgcgggctgtgctgctgatcaacagcaagagctatgtgtccccacccagctccatggaggacaagagtgatgtgggctacggccgcagcatcagcagcagcagcagcctgcggcgcagcagcaaggagaagaacaagaagaacagctaccacttctctgctggcttcggcagccccatcgaggacaagtctgagcccgccagcggcaggaacacagtgctgagcaagagcgccaccaaggagaagggctggaggaagagcaagggcaagaaggaggaggagaaggtgaaggaggaggaggaggtgatggtggtgcccaagtttgtgggggagggcagcagtgacaaggagtggtgcccccccagcgaccctgacttctccatgtatgtgtatgaggtgaccaagagcatcctgcccatcaccaacatcaaggagcagatcgaggacctggccaagtatgtggccgagaagatgggcggcaagatccccaaggagaagctgcctgacttctcctgggagctgcacatcagcgagctgaagttccagctgaagagcaatgtcatccccatcggccacgtgaagaagggcatcttctaccaccgggccctgctcttcaaggccctggccgaccgcatcggcatcggctgcagcctggtgcggggggagtatggccgggcctggaatgaggtgatgctgcagaatgacagcaggaagggcgtgattggaggcctgcctgcccctgagatgtatgtgattgacctgatgttccaccctgggggcctgatgaagctgcggagccgggaggccgacctgtaccgcttcatctag

SEQ ID NO: 35606 - DNA, 2067 bp, Artificial Sequence
  Description of Artificial Sequence: Synthetic coding sequence
atgggcaagaagatcaagaaggaggtggagcccccacccaaggatgtgtttgaccccctgatgattgagagcaagaaggccgccaccgtggtgctgatgctgaacagccctgaggaggagatcctggccaaggcctgtgaggccatctacaagtttgccctgaagggggaggagaacaagaccaccctgctggagctgggcgctgtggagcccctgaccaagctgctgacccatgaggacaagatcgtgagaagaaatgccaccatgatcttcggcatcctggccagcaacaatgatgtgaagaagctgctgcgggagctggatgtgatgaacagcgtcatcgcccagctggcccctgaggaggaggtggtgatccacgagtttgccagcctgtgcctggccaacatgtctgctgagtacaccagcaaggtgcagatctttgaacatggaggcctggagcccctcatccggctgctgagcagcccagaccctgatgtgaagaagaacagcatggagtgcatctacaacctggtgcaggacttccagtgccgggccaagctgcaggagctgaatgccatcccccccatcctggacctgctgaagtctgagtaccctgtgatccagctgctggccctgaagaccctgggcgtcatcgccaatgacaaggagagcaggaccatgctgcgggacaaccagggcctggaccacctgatcaagatcctggagaccaaggagctgaatgacctgcacatcgaggccctggccgtgattgccaactgcctggaggacatggacaccatggtgcagatccagcagacaggaggcctgaagaagctgctgagctttgctgagaacagcaccatcccagacatccagaagaatgctgccaaggccatcaccaaggccgcctatgaccctgaaaataggaagctgttccacgagcaggaggtggagaagtgcctggtggccctgctgggctctgaaaatgatggcaccaagattgctgccagccaggccatcagcgccatgtgtgaaaattctggcagcaaggacttcttcaacaaccagggcatcccccagctgatccagctgctgaagagtgacaatgaggaggtgcgggaggccgccgccctggccctggccaacctgaccacctgcaacccagccaatgccaatgctgctgctgaggctgatggcatcgaccccctcatcaacctgctgagcagcaagagagatggagccatcgccaatgctgccaccgtgctgaccaacatggccatgcaggagcccctgcggctgaacatccagaaccacgacatcatgcacgccatcatcagccccctgcggagcgccaacacagtggtgcagagcaaggccgccctggccgtgacagccacagcctgtgatgtggaggccaggacagagctgagaaattctgggggcctggagcccctggtggagctgctgcggagcaagaatgatgaggtgaggaagcacgcctcctgggccgtgatggtgtgtgctggagatgagctgacagccaatgagctgtgccgcctgggcgccctggacatcctggaggaggtgaatgtgtctggcaccaggaagaacaagttcagcgaggccgcctacaacaagctgctgaacaacaacctgagcctgaagtacagccagacaggctacctgagcagcagcaacatcatcaatgatggcttctatgactatggccgcatcaaccctggcaccaagctgctgcccctgaaggagctgtgcctgcaggagcccagcgacctgcgggctgtgctgctgatcaacagcaagagctatgtgagcccccccagctccatggaggacaagagtgatgtgggctacggccgcagcatcagcagcagcagcagcctgcggcgcagcagcaaggagaagaacaagaagaacagctaccacttctctgctggcttcggcagccccatcgaggacaagtctgagcccgccagcggcaggaacacagtgctgagcaagagcgccaccaaggagaagggctggagcagcctgcccaccagcaggtag

SEQ ID NO: 35607 - DNA, 2598 bp, Artificial Sequence
  Description of Artificial Sequence: Synthetic coding sequence
atgggcaagaagatcaagaaggaggtggagcccccacccaaggatgtgtttgaccccctgatgattgagagcaagaaggccgccaccgtggtgctgatgctgaacagccctgaggaggagatcctggccaaggcctgtgaggccatctacaagtttgccctgaagggggaggagaacaagaccaccctgctggagctgggcgctgtggagcccctgaccaagctgctgacccatgaggacaagatcgtgagaagaaatgccaccatgatcttcggcatcctggccagcaacaatgatgtgaagaagctgctgcgggagctggatgtgatgaacagcgtcatcgcccagctggcccctgaggaggaggtggtgatccacgagtttgccagcctgtgcctggccaacatgtctgctgagtacaccagcaaggtgcagatctttgaacatggaggcctggagcccctcatccggctgctgagcagcccagaccctgatgtgaagaagaacagcatggagtgcatctacaacctggtgcaggacttccagtgccgggccaagctgcaggagctgaatgccatcccccccatcctggacctgctgaagtctgagtaccctgtgatccagctgctggccctgaagaccctgggcgtcatcgccaatgacaaggagagcaggaccatgctgcgggacaaccagggcctggaccacctgatcaagatcctggagaccaaggagctgaatgacctgcacatcgaggccctggccgtgattgccaactgcctggaggacatggacaccatggtgcagatccagcagacaggaggcctgaagaagctgctgagctttgctgagaacagcaccatcccagacatccagaagaatgctgccaaggccatcaccaaggccgcctatgaccctgaaaataggaagctgttccacgagcaggaggtggagaagtgcctggtggccctgctgggctctgaaaatgatggcaccaagattgctgccagccaggccatcagcgccatgtgtgaaaattctggcagcaaggacttcttcaacaaccagggcatcccccagctgatccagctgctgaagagtgacaatgaggaggtgcgggaggccgccgccctggccctggccaacctgaccacctgcaacccagccaatgccaatgctgctgctgaggctgatggcatcgaccccctcatcaacctgctgagcagcaagagagatggagccatcgccaatgctgccaccgtgctgaccaacatggccatgcaggagcccctgcggctgaacatccagaaccacgacatcatgcacgccatcatcagccccctgcggagcgccaacacagtggtgcagagcaaggccgccctggccgtgacagccacagcctgtgatgtggaggccaggacagagctgagaaattctgggggcctggagcccctggtggagctgctgcggagcaagaatgatgaggtgaggaagcacgcctcctgggccgtgatggtgtgtgctggagatgagctgacagccaatgagctgtgccgcctgggcgccctggacatcctggaggaggtgaatgtgtctggcaccaggaagaacaagttcagcgaggccgcctacaacaagctgctgaacaacaacctgagcctgaagtacagccagacaggctacctgagcagcagcaacatcatcaatgatggcttctatgactatggccgcatcaaccctggcaccaagctgctgcccctgaaggagctgtgcctgcaggagcccagcgacctgcgggctgtgctgctgatcaacagcaagagctatgtgagcccccccagctccatggaggacaagagtgatgtgggctacggccgcagcatcagcagcagcagcagcctgcggcgcagcagcaaggagaagaacaatgccggcttcggcagccccatcgaggacaagtctgagcccgccagcggcaggaacacagtgctgagcaagagcgccaccaaggagaagggctggaggaagagcaagggcaagaaggaggaggagaaggtgaaggaggaggaggaggtgatggtggtgcccaagtttgtgggggagggcagcagtgacaaggagtggtgcccccccagcgaccctgacttctccatgtatgtgtatgaggtgaccaagagcatcctgcccatcaccaacatcaaggagcagatcgaggacctggccaagtatgtggccgagaagatgggcggcaagatccccaaggagaagctgcctgacttctcctgggagctgcacatcagcgagctgaagttccagctgaagagcaatgtcatccccatcggccacgtgaagaagggcatcttctaccaccgggccctgctcttcaaggccctggccgaccgcatcggcatcggctgcagcctggtgcggggggagtatggccgggcctggaatgaggtgatgctgcagaatgacagcaggaagggcgtgattggaggcctgcctgcccctgagatgtatgtgattgacctgatgttccaccctgggggcctgatgaagctgcggagccgggaggccgacctgtaccgcttcatctag

SEQ ID NO: 35608 - DNA, 1059 bp, Artificial Sequence
  Description of Artificial Sequence: Synthetic coding sequence
atgaaggaaaattccatcgccctgaacatcctgggcaagatcaccagagatgatgatcctgagagcgagatcaagatgaagatcgccatgctgctgaagcagctggacctgcacctgctgaaccacagcctgaagcacatcagcctggagatcagcctgagccccatgacagtgaagaaggacatcgagctgctgaagcgcttctctggaaaaggaaaccagacagtgctggagagcattgagtacaccagtgactatgagttcagcaatggctgccgggccccaccctggaggcagatccggggggagatctgctacgtgctggtgaagccccatgatggagagaccctgtgcatcacctgcagcgctggaggagtcttcctgaatggaggcaagacagatgatgaaggagatgtgaactatgaaaggaagggcagcatctacaagaacctggtgaccttcctgcgggagaagagccccaagttcagcgagaacatgagcaagctgggcatctccttcagcgaggaccagcagaaggagaaggaccagctgggcaaggcccccaagaaggaggaggccgccgccctgaggaaggacatcagcggcagtgacaagaggagcctggagaagaaccagatcaacttctggaggaaccagatgaccaagcgctgggagcccagcctgaactggaagaccaccgtgaactacaagggcaaaggaagtgccaaggagatccaggaggacaagcacacaggcaagctggagaagccccggcccagcgtgagccacggccgggcccagctgctgaggaagtctgctgagaagattgaggagaccgtgtctgacagcagcagcgagagtgaagaagatgaggagcccccagaccaccggcaggaggccagcgctgacctgcccagcgagtactggcagatccagaagctggtgaagtacctgaagcagaaggagaccagccagaatggaagaaacaagcgctggatcaggaagcagaacaccagggtcatccgctccatgatctttgatgtgggcaagaccagctag

SEQ ID NO: 35609 - DNA, 3135 bp, Artificial Sequence
  Description of Artificial Sequence: Synthetic coding sequence
atgggcgtggccctgaggaagctgacccagtggacagctgctggccacggcaccggcatcctggagatcacccccctgaatgaggccatcctgaaggagatcatcgtgtttgtggagagcttcatctacaagcacccccaggaggccaagtttgtgtttgtggagcccctggagtggaacaccagcctggcccccagcgcctttgagagcggctacgtggtgtctgagaccaccgtgaagtctgaggaggtggacaagaatggccagcccctgctcttcctgtctgtgccccagatcaagatccgcagctttggccagctgagccggctgctgctgattgccaagacaggcaagctgaaggaggcccaggcctgtgtggaggccaacagagaccccatcgtgaagatcctgggcagtgactacaacaccatgaaggagaacagcatcgccctgaacatcctgggcaagatcaccagagatgatgatcctgagagcgagatcaagatgaagatcgccatgctgctgaagcagctggacctgcacctgctgaaccacagcctgaagcacatcagcctggagatcagcctgagccccatgacagtgaagaaggacatcgagctgctgaagcgcttcagcggcaagggcaaccagacagtgctggagagcattgagtacaccagtgactatgagttcagcaatggctgccgggccccaccctggaggcagatccggggggagatctgctacgtgctggtgaagccccatgatggagagaccctgtgcatcacctgcagcgctgggggcgtcttcctgaatggaggcaagacagatgatgaaggagatgtgaactatgaaaggaagggcagcatctacaagaacctggtgaccttcctgcgggagaagagccccaagttcagcgagaacatgagcaagctgggcatctccttcagcgaggaccagcagaaggagaaggaccagctgggcaaggcccccaagaaggaggaggccgccgccctgaggaaggacatcagcggcagtgacaagaggagcctggagaagaaccagatcaacttctggaggaaccagatgaccaagcgctgggagcccagcctgaactggaagaccaccgtgaactacaagggcaagggcagcgccaaggagatccaggaggacaagcacacaggcaagctggagaagccccggcccagcgtgagccacggccgggcccagctgctgaggaagtctgctgagaagattgaggagaccgtgtctgacagcagcagcgagagcgaggaggatgaggagcccccagaccaccggcaggaggccagcgctgacctgcccagcgagtactggcagatccagaagctggtgaagtacctgaagggcggcaaccagacagccaccgtgattgccctgtgcagcatgagggacttcagcctggcccaggagacctgccagctggccatcagagatgtgggcggcctggaggtgctgatcaacctgctggagacagatgaggtgaagtgcaagattggcagcctgaagatcctgaaggagatcagccacaacccccagatccggcagaacatcgtggacctgggcggcctgcccatcatggtgaacatcctggacagcccccacaagagcctgaagtgcctggccgctgagaccatcgccaacgtggccaagttcaagagggccaggagagtggtgcggcagcacggcggcatcaccaagctggtggccctgctggactgtgcccatgacagcaccaagccagcccagagcagcctgtatgaggccagagatgtggaggtggcccgctgtggggccctggccctgtggagctgcagcaagagccacaccaacaaggaggccatcaggaaggccggcggcatccccctgctggcccggctgctgaagaccagccatgagaacatgctgatccctgtggtgggcaccctgcaggagtgtgccagcgaggagaactacagagctgccatcaaggccgagcgcatcatcgagaacctggtgaagaacctgaacagtgaaaatgagcagctgcaggagcactgtgccatggccatctaccagtgtgccgaggacaaggagacccgggacctggtgcggctgcatggaggcctgaagcccctggccagcctgctgaacaacacagacaacaaggagcggctggccgctgtgactggagccatctggaagtgcagcatcagcaaagaaaatgtgaccaagttccgggagtacaaggccatcgagaccctggtgggcctgctgacagaccagcctgaggaggtgctggtgaatgtggtgggcgccctgggggagtgctgccaggagcgggagaacagagtcatcgtgaggaaatgtggcggcatccagcccctggtgaacctgctggtgggcatcaaccaggccctgctggtgaatgtgaccaaggctgtgggcgcctgtgctgtggagcctgagagcatgatgatcatcgaccggctggatggagtgcggctgctgtggagcctgctgaagaacccccacccagatgtgaaggccagcgctgcctgggccctgtgcccctgcatcaagaatgccaaggatgctggggagatggtgcgcagctttgtgggcggcctggagctgattgtgaacctgctgaagagtgacaacaaggaggtgctggcctctgtgtgtgccgccatcaccaacatcgccaaggaccaggagaacctggccgtcatcacagaccatggagtggtgcccctgctgagcaagctggccaacaccaacaacaacaagctgcggcaccacctggccgaggccatcagccgctgctgcatgtggggcaggaacagagtggcctttggagagcacaaggctgtggcccccctggtgcgctacctgaagagcaatgacaccaacgtgcaccgggccacagcccaggccctgtaccagctgtctgaagatgctgacaactgcatcaccatgcatgaaaatggagctgtgaagctgctgctggacatggtgggcagcccagaccaggacctgcaggaggccgctgctggctgcatcagcaacatccggcggctggccctggccacagagaaggcccgctacacctag

SEQ ID NO: 35610 - DNA, 1170 bp, Artificial Sequence
  Description of Artificial Sequence: Synthetic coding sequence
ctgagccggctgctgctgattgccaagacaggcaagctgaaggaggcccaggcctgtgtggaggccaacagagaccccatcgtgaagatcctgggcagtgactacaacaccatgaaggagaacagcatcgccctgaacatcctgggcaagatcaccagagatgatgatcctgagagcgagatcaagatgaagatcgccatgctgctgaagcagctggacctgcacctgctgaaccacagcctgaagcacatcagcctggagatcagcctgagccccatgacagtgaagaaggacatcgagctgctgaagcgcttcagcggcaagggcaaccagacagtgctggagagcattgagtacaccagtgactatgagttcagcaatggctgccgggccccaccctggaggcagatccggggggagatctgctacgtgctggtgaagccccatgatggagagaccctgtgcatcacctgcagcgctgggggcgtcttcctgaatggaggcaagacagatgatgaaggagatgtgaactatgaaaggaagggcagcatctacaagaacctggtgaccttcctgcgggagaagagccccaagttcagcgagaacatgagcaagctgggcatctccttcagcgaggaccagcagaaggagaaggaccagctgggcaaggcccccaagaaggaggaggccgccgccctgaggaaggacatcagcggcagtgacaagaggagcctggagaagaaccagatcaacttctggaggaaccagatgaccaagcgctgggagcccagcctgaactggaagaccaccgtgaactacaagggcaagggcagcgccaaggagatccaggaggacaagcacacaggcaagctggagaagccccggcccagcgtgagccacggccgggcccagctgctgaggaagtctgctgagaagattgaggagaccgtgtctgacagcagcagcgagagcgaggaggatgaggagcccccagaccaccggcaggaggccagcgctgacctgcccagcgagtactggcagatccagaagctggtgaagtacctgaagcagaaggagaccagccagaatggaagaaacaagcgctggatcaggaagcagaacaccagggtcatccgctccatgatctttgatgtgggcaagaccagctag

SEQ ID NO: 35611 - DNA, 621 bp, Artificial Sequence
  Description of Artificial Sequence: Synthetic coding sequence
atgagcaagctgggcatctccttcagcgaggaccagcagaaggagaaggaccagctgggcaaggcccccaagaaggaggaggccgccgccctgaggaaggacatcagcggcagtgacaagaggagcctggagaagaaccagatcaacttctggaggaaccagatgaccaagcgctgggagcccagcctgaactggaagaccaccgtgaactacaagggcaagggcagcgccaaggagatccaggaggacaagcacacaggcaagctggagaagccccggcccagcgtgagccacggccgggcccagctgctgaggaagtctgctgagaagattgaggagaccgtgtctgacagcagcagcgagagcgaggaggatgaggagcccccagaccaccggcaggaggccagcgctgacctgcccagcgagtactggcagatccagaagctggtgaagtacctgaagggcggcaaccagacagccaccgtgattgccctgtgcagcatgagggacttcagcctggcccaggagacctgccagctggccatcagagatgtgggcggcctggaggtgctgatcatctgcctgaagcccatgaagagcaatgtgcggctggtgcactag

SEQ ID NO: 35612 - DNA, 2118 bp, Artificial Sequence
  Description of Artificial Sequence: Synthetic coding sequence
atgagcaagctgggcatctccttcagcgaggaccagcagaaggagaaggaccagctgggcaaggcccccaagaaggaggaggccgccgccctgaggaaggacatcagcggcagtgacaagaggagcctggagaagaaccagatcaacttctggaggaaccagatgaccaagcgctgggagcccagcctgaactggaagaccaccgtgaactacaagggcaagggcagcgccaaggagatccaggaggacaagcacacaggcaagctggagaagccccggcccagcgtgagccacggccgggcccagctgctgaggaagtctgctgagaagattgaggagaccgtgtctgacagcagcagcgagagcgaggaggatgaggagcccccagaccaccggcaggaggccagcgctgacctgcccagcgagtactggcagatccagaagctggtgaagtacctgaagggcggcaaccagacagccaccgtgattgccctgtgcagcatgagggacttcagcctggcccaggagacctgccagctggccatcagagatgtgggcggcctggaggtgctgatcaacctgctggagacagatgaggtgaagtgcaagattggcagcctgaagatcctgaaggagatcagccacaacccccagatccggcagaacatcgtggacctgggcggcctgcccatcatggtgaacatcctggacagcccccacaagagcctgaagtgcctggccgctgagaccatcgccaacgtggccaagttcaagagggccaggagagtggtgcggcagcacggcggcatcaccaagctggtggccctgctggactgtgcccatgacagcaccaagccagcccagagcagcctgtatgaggccagagatgtggaggtggcccgctgtggggccctggccctgtggagctgcagcaagagccacaccaacaaggaggccatcaggaaggccggcggcatccccctgctggcccggctgctgaagaccagccatgagaacatgctgatccctgtggtgggcaccctgcaggagtgtgccagcgaggagaactacagagctgccatcaaggccgagcgcatcatcgagaacctggtgaagaacctgaacagtgaaaatgagcagctgcaggagcactgtgccatggccatctaccagtgtgccgaggacaaggagacccgggacctggtgcggctgcatggaggcctgaagcccctggccagcctgctgaacaacacagacaacaaggagcggctggccgctgtgactggagccatctggaagtgcagcatcagcaaagaaaatgtgaccaagttccgggagtacaaggccatcgagaccctggtgggcctgctgacagaccagcctgaggaggtgctggtgaatgtggtgggcgccctgggggagtgctgccaggagcgggagaacagagtcatcgtgaggaaatgtggcggcatccagcccctggtgaacctgctggtgggcatcaaccaggccctgctggtgaatgtgaccaaggctgtgggcgcctgtgctgtggagcctgagagcatgatgatcatcgaccggctggatggagtgcggctgctgtggagcctgctgaagaacccccacccagatgtgaaggccagcgctgcctgggccctgtgcccctgcatcaagaatgccaaggatgctggggagatggtgcgcagctttgtgggcggcctggagctgattgtgaacctgctgaagagtgacaacaaggaggtgctggcctctgtgtgtgccgccatcaccaacatcgccaaggaccaggagaacctggccgtcatcacagaccatggagtggtgcccctgctgagcaagctggccaacaccaacaacaacaagctgcggcaccacctggccgaggccatcagccgctgctgcatgtggggcaggaacagagtggcctttggagagcacaaggctgtggcccccctggtgcgctacctgaagagcaatgacaccaacgtgcaccgggccacagcccaggccctgtaccagctgtctgaagatgctgacaactgcatcaccatgcatgaaaatggagctgtgaagaagaacatcttcatctcctag

SEQ ID NO: 35613 - DNA, 1839 bp, Artificial Sequence
  Description of Artificial Sequence: Synthetic coding sequence
atgagggacttcagcctggcccaggagacctgccagctggccatcagagatgtgggcggcctggaggtgctgatcaacctgctggagacagatgaggtgaagtgcaagattggcagcctgaagatcctgaaggagatcagccacaacccccagatccggcagaacatcgtggacctgggcggcctgcccatcatggtgaacatcctggacagcccccacaagagcctgaagtgcctggccgctgagaccatcgccaacgtggccaagttcaagagggcccggcgggtggtgcggcagcacggcggcatcaccaagctggtggccctgctggactgtgcccatgacagcaccaagccagcccagagcagcctgtatgaggccagagatgtggaggtggcccgctgtggggccctggccctgtggagctgcagcaagagccacaccaacaaggaggccatcaggaaggccggcggcatccccctgctggcccggctgctgaagaccagccatgagaacatgctgatccctgtggtgggcaccctgcaggagtgtgccagcgaggagaactaccgggccgccatcaaggccgagcgcatcatcgagaacctggtgaagaacctgaacagtgaaaatgagcagctgcaggagcactgtgccatggccatctaccagtgtgccgaggacaaggagacccgggacctggtgcggctgcacggcggcctgaagcccctggccagcctgctgaacaacacagacaacaaggagcggctggccgctgtgactggagccatctggaagtgcagcatcagcaaagaaaatgtgaccaagttccgggagtacaaggccatcgagaccctggtgggcctgctgacagaccagcctgaggaggtgctggtgaatgtggtgggcgccctgggggagtgctgccaggagagagaaaatagagtgattgtgaggaaatgtggcggcatccagcccctggtgaacctgctggtgggcatcaaccaggccctgctggtgaatgtgaccaaggctgtgggcgcctgtgctgtggagcctgagagcatgatgatcatcgaccggctggatggagtgcggctgctgtggagcctgctgaagaacccccacccagatgtgaaggccagcgctgcctgggccctgtgcccctgcatcaagaatgccaaggatgctggggagatggtgcgcagctttgtgggcggcctggagctgattgtgaacctgctgaagagtgacaacaaggaggtgctggcctctgtgtgtgccgccatcaccaacatcgccaaggaccaggagaacctggccgtcatcacagaccacggcgtggtgcccctgctgagcaagctggccaacaccaacaacaacaagctgcggcaccacctggccgaggccatcagccgctgctgcatgtggggcaggaacagagtggccttcggggagcacaaggctgtggcccccctggtgcgctacctgaagagcaatgacaccaacgtgcaccgggccacagcccaggccctgtaccagctgtctgaagatgctgacaactgcatcaccatgcatgaaaatggagctgtgaagacagagagcagacatgtggcccggctggagtgcagcgacaatgacctgggcagcctgcagcccccacctcctggcttcaagcgcttcagctgcctgagcctgctgagctcctgggactacagcttctactggatctggctgggccccctgacccgcatcagcaggaagctgcagctggtggtgtaccccatctctgctggctggctgctgctgcagaggcggcaggacaccctggagatctag

SEQ ID NO: 35614 - DNA, 2808 bp, Artificial Sequence
  Description of Artificial Sequence: Synthetic coding sequence
atggctgctgccaagcccaccctgacagacagcctgtccttctgcctggcccagctggccgctgctgctggggaggccctgggcggggagaaggaccctgccaccaatgagacccccctgagccgggccctgctggccctgcggaccaggcacatcaaggctgctgggggcatcgagcgcttccgggcccggggcggcctgcggcccctgctggccctgctgcggcgggctgctgctgctggcagcgcccccagccaggccggccctggcagcgcccccagcagcgctgccagcggggccagcagccctgccccagccagcggccctgcccccagcgctgtgagcagcagcagccccaccccacctgtgcggctgaggaagaccctggacctggccctgagcatcctggccgactgctgcacagaaggagcctgcaggacagaggtgcggcggctgggcggcatcctgcccctggtgaccatcctgcagtgcatgaagacagacagcatccagaacagaacagcccgggccctgggcaacctggccatggagcctgagagctgtggggacatccactgtgccggggctgtgcccctgctggtggagagcctgacagcctgccaggacagccagtgcctgcagagcgtggtgcgggccctgaggaacctggccgacagcccccagcaccggctggccctggcccagcagggcgctgtgcggcccctggccgagctgctggccacagccccagatgctgccctgaccctggccctggtgcgggccctgctggagctgagccggggctgcagccgggcctgtgccgagcagctgagcctgggcggcggcctgggccccctggtgtccctggccagccaccccaagagagctgtgcgggagggcaccatcctgatcctggccaacctgtgtgcccagggcctcatccggcctgccctgggcaatgctgggggcgtggaggtgctggtggatgagctgcggcagaggcgggaccccaacggggccagccccaccagccagcagcccctggtgcgggctgtgtgcctgctgtgccgggaggccatcaacagagcccggctgagagatgctgggggcctggacctgctgatgggcctgctgcgggacccccgggccagcgcctggcacccccgcatcgtggccgccctggtgggcttcctgtatgacacaggagccctgggccgcctgcaggccctgggcctggtgcccctgctggccggccagctgtgtggggaggccggggaggaggaggaggagggccgggaggccgcctcctgggacttccctgaggagaggaccccagagcgggcccagggcggcagcttccgcagcctgcgctcctggctgatcagcgagggctacgccactggaccagatgacatcagcccagactggagccctgagcagtgccccccagagcccatggagcccgccagccctgcccccacccccaccagcctgcgggcccccaggacccagaggaccccaggccgcagccctgctgctgccatcgaggagccctggggccgggagggccctgccctgctgctgctgagccgcttcagccaggccccagaccccagcggggccctggtgacaggccctgccctgtatggcctgctgacctacgtgactggagcccctggcccccccagcccccgggccctgcgcatcctgagccggctgacctgcaacccagcctgcctggaggcctttgtgcgctcctatggagctgccctgctgcgggcctggctggtgctgggcgtggccccagatgactggccagccccccgggcccggcccaccctgcacagccgccaccgggagctgggggagcggctgctgcagaacctgactgtgcaggccgagagcccctttggagtgggcgccctgacccacctgctgctgagcggcagccctgaggacagagtggcctgtgccctgaccctgcccttcatctgcaggaagcccagcctgtggaggcggctgctgctggagcagggcggcctgcggctgctgctggccgccctgaccaggcctgccccccaccccctcttcctgttctttgctgctgacagcctgagctgcctgcaggacctggtgagccccaccgtgtccccagctgtgccccaggccgtgcccatggacctggacagccccagcccctgcctgtatgagcccctgctgggccctgcccctgtgcctgccccagacctgcacttcctgctggacagcggcctgcagctgcctgcccagagagctgccagcgccacagccagccccttcttccgggccctgctgagcggcagctttgctgaggcccagatggacctggtgcccctgcggggcctgagccctggagctgcctggcctgtgctgcaccacctgcacggctgccggggctgtggggccgccctgggccctgtgcccccacctggccagcccctgctgggcagcgaggccgaggaggccctggaggccgccggccgcttcctgctgcccggcctggaggaggagctggaggaggccgtgggccgcatccacctgggcccccagggcggccctgagagcgtgggggaggtgttccggctgggccggccccggctggccgcccactgtgcccgctggaccctgggcagcgagcagtgccccaggaagaggggcctggccctggtgggcctggtggaggccgccggggaggaggccggccccctgacagaggccctgctggccgtggtgatgggcatcgagctgggcgcccgggtgcctgcctag

SEQ ID NO: 35615 - DNA, 3093 bp, Artificial Sequence
  Description of Artificial Sequence: Synthetic coding sequence
atggtgaccctgggcgctggggtgcggctcttcaccggggtgtaccctgtggtgctgaaccagatccgggccaccagcgaggccagcgccatcaccaggaccaccatgcctgcccctgagctgaccagcaccagcagagctgaggacacccgggacacaggagtgcagctgaggaagaggaagatcccccaggcccggcacagcaggaagaggcagaggaccttctccttccgcagcctgggcagcgctgcccggagcggggctgagagcgaggcccgggccaagatggccgccgccaagcccaccctgacagacagcctgtccttctgcctggcccagctggccgctgctgctggggaggccctgggcggggagaaggaccctgccaccaatgagacccccctgagccgggccctgctggccctgcggaccaggcacatcaaggccgccggcggcatcgagcgcttccgggcccggggcggcctgcggcccctgctggccctgctgcggcgggctgctgctgctggcagcgcccccagccaggccggccctggcagcgcccccagcagcgctgccagcggggccagcagccctgccccagccagcggccctgcccccagcgctgtgagcagcagcagccccaccccacctgtgcggctgaggaagaccctggacctggccctgagcatcctggccgactgctgcacagagggcgcctgcaggacagaggtgcggcggctgggcggcatcctgcccctggtgaccatcctgcagtgcatgaagacagacagcatccagaacagaacagcccgggccctgggcaacctggccatggagcctgagagctgtggggacatccactgtgccggggctgtgcccctgctggtggagagcctgacagcctgccaggacagccagtgcctgcagagcgtggtgcgggccctgaggaacctggccgacagcccccagcaccggctggccctggcccagcagggcgctgtgcggcccctggccgagctgctggccacagccccagatgctgccctgaccctggccctggtgcgggccctgctggagctgagccggggctgcagccgggcctgtgccgagcagctgagcctgggcggcggcctgggccccctggtgtccctggccagccaccccaagagagctgtgcgggagggcaccatcctgatcctggccaacctgtgtgcccagggcctcatccggcctgccctgggcaatgctgggggcgtggaggtgctggtggatgagctgcggcagaggcgggaccccaatggagccagccccaccagccagcagcccctggtgcgggctgtgtgcctgctgtgccgggaggccatcaacagagcccggctgagagatgctgggggcctggacctgctgatgggcctgctgcgggacccccgggccagcgcctggcaccccagaattgtggccgccctggtgggcttcctgtatgacaccggggccctgggccgcctgcaggccctgggcctggtgcccctgctggccggccagctgtgtggggaggccggggaggaggaggaggagggccgggaggccgcctcctgggacttccctgaggagaggaccccagagcgggcccagggcggcagcttccgcagcctgcgctcctggctgatcagcgagggctacgccaccggcccagatgacatcagcccagactggagccctgagcagtgccccccagagcccatggagcccgccagccctgcccccacccccaccagcctgcgggcccccaggacccagaggaccccaggccgcagccctgctgctgccatcgaggagccctggggccgggagggccctgccctgctgctgctgagccgcttcagccaggccccagaccccagcggggccctggtgactggacctgccctgtatggcctgctgacctacgtgactggagcccctggcccccccagcccccgggccctgcgcatcctgagccggctgacctgcaacccagcctgcctggaggcctttgtgcgctcctatggagctgccctgctgcgggcctggctggtgctgggcgtggccccagatgactggccagccccccgggcccggcccaccctgcacagccgccaccgggagctgggggagcggctgctgcagaacctgactgtgcaggccgagagccccttcggcgtgggcgccctgacccacctgctgctgagcggcagcccagaagatagagtggcctgtgccctgaccctgcccttcatctgcaggaagcccagcctgtggaggcggctgctgctggagcagggcggcctgcggctgctgctggccgccctgaccaggcctgccccccaccccctcttcctgttctttgctgctgacagcctgagctgcctgcaggacctggtgagccccaccgtgtccccagctgtgccccaggccgtgcccatggacctggacagccccagcccctgcctgtatgagcccctgctgggccctgcccctgtgcctgccccagacctgcacttcctgctggacagcggcctgcagctgcctgcccagagagctgccagcgccacagccagccccttcttccgggccctgctgagcggcagctttgctgaggcccagatggacctggtgcccctgcggggcctgagccctggggccgcctggcctgtgctgcaccacctgcacggctgccggggctgtggggccgccctgggccctgtgcccccacctggccagcccctgctgggcagcgaggccgaggaggccctggaggccgccggccgcttcctgctgcccggcctggaggaggagctggaggaggccgtgggccgcatccacctgggcccccagggcggccctgagagcgtgggggaggtgttccggctgggccggccccggctggccgcccactgtgcccgctggaccctgggcagcgagcagtgccccaggaagaggggcctggccctggtgggcctggtggaggccgccggggaggaggccggccccctgacagaggccctgctggccgtggtgatgggcatcgagctgggcgcccgggtgcctgcctag

SEQ ID NO: 35616 - DNA, 1740 bp, Artificial Sequence
  Description of Artificial Sequence: Synthetic coding sequence
atgaagacagacagcatccagaacagaacagcccgggccctgggcaacctggccatggagcctgagagctgtggggacatccactgtgccggggctgtgcccctgctggtggagagcctgacagcctgccaggacagccagtgcctgcagagcgtggccctgggcctggtgcccctgctggccggccagctgtgtggggaggccggggaggaggaggaggagggccgggaggccgcctcctgggacttccctgaggagaggaccccagagcgggcccagggcggcagcttccgcagcctgcgctcctggctgatcagcgagggctacgccactggaccagatgacatcagcccagactggagccctgagcagtgccccccagagcccatggagcccgccagccctgcccccacccccaccagcctgcgggcccccaggacccagaggaccccaggccgcagccctgctgctgccatcgaggagccctggggccgggagggccctgccctgctgctgctgagccgcttcagccaggccccagaccccagcggggccctggtgacaggccctgccctgtatggcctgctgacctacgtgactggagcccctggcccccccagcccccgggccctgcgcatcctgagccggctgacctgcaacccagcctgcctggaggcctttgtgcgctcctatggagctgccctgctgcgggcctggctggtgctgggcgtggccccagatgactggccagccccccgggcccggcccaccctgcacagccgccaccgggagctgggggagcggctgctgcagaacctgactgtgcaggccgagagcccctttggagtgggcgccctgacccacctgctgctgagcggcagccctgaggacagagtggcctgtgccctgaccctgcccttcatctgcaggaagcccagcctgtggaggcggctgctgctggagcagggcggcctgcggctgctgctggccgccctgaccaggcctgccccccaccccctcttcctgttctttgctgctgacagcctgagctgcctgcaggacctggtgagccccaccgtgtccccagctgtgccccaggccgtgcccatggacctggacagccccagcccctgcctgtatgagcccctgctgggccctgcccctgtgcctgccccagacctgcacttcctgctggacagcggcctgcagctgcctgcccagagagctgccagcgccacagccagccccttcttccgggccctgctgagcggcagctttgctgaggcccagatggacctggtgcccctgcggggcctgagccctggagctgcctggcctgtgctgcaccacctgcacggctgccggggctgtggggccgccctgggccctgtgcccccacctggccagcccctgctgggcagcgaggccgaggaggccctggaggccgccggccgcttcctgctgcccggcctggaggaggagctggaggaggccgtgggccgcatccacctgggcccccagggcggccctgagagcgtgggggaggtgttccggctgggccggccccggctggccgcccactgtgcccgctggaccctgggcagcgagcagtgccccaggaagaggggcctggccctggtgggcctggtggaggccgccggggaggaggccggccccctgacagaggccctgctggccgtggtgatgggcatcgagctgggcgcccgggtgcctgcctag

SEQ ID NO: 35617 - DNA, 2178 bp, Artificial Sequence
  Description of Artificial Sequence: Synthetic coding sequence
atggctgctgccaagcccaccctgacagacagcctgtccttctgcctggcccagctggccgctgctgctggggaggccctgggcggggagaaggaccctgccaccaatgagacccccctgagccgggccctgctggccctgcggaccaggcacatcaaggctgctgggggcatcgagcgcttccgggcccggggcggcctgcggcccctgctggccctgctgcggcgggctgctgctgctggcagcgcccccagccaggccggccctggcagcgcccccagcagcgctgccagcggggccagcagccctgccccagccagcggccctgcccccagcgctgtgagcagcagcagccccaccccacctgtgcggctgaggaagaccctggacctggccctgagcatcctggccgactgctgcacagaaggagcctgcaggacagaggtgcggcggctgggcggcatcctgcccctggtgaccatcctgcagtgcatgaagacagacagcatccagaacagaacagcccgggccctgggcaacctggccatggagcctgagagctgtggggacatccactgtgccggggctgtgcccctgctggtggagagcctgacagcctgccaggacagccagtgcctgcagagcgtggtgcgggccctgaggaacctggccgacagcccccagcaccggctggccctggcccagcagggcgctgtgcggcccctggccgagctgctggccacagccccagatgctgccctgaccctggccctggtgcgggccctgctggagctgagccggggctgcagccgggcctgtgccgagcagctgagcctgggcggcggcctgggccccctggtgtccctggccagccaccccaagagagctgtgcgggagggcaccatcctgatcctggccaacctgtgtgcccagggcctcatccggcctgccctgggcaatgctgggggcgtggaggtgctggtggatgagctgcggcagaggcgggaccccaacggggccagccccaccagccagcagcccctggtgcgggctgtgtgcctgctgtgccgggaggccatcaacagagcccggctgagagatgctgggggcctggacctgctgatgggcctgctgcgggacccccgggccagcgcctggcacccccgcatcgtggccgccctggtgggcttcctgtatgacacaggagccctgggccgcctgcaggccctgggcctggtgcccctgctggccggccagctgtgtggggaggccggggaggaggaggaggagggccgggaggccgcctcctgggacttccctgaggagaggaccccagagcgggcccagggcggcagcttccgcagcctgcgctcctggctgatcagcgagggctacgccactggaccagatgacatcagcccagactggagccctgagcagtgccccccagagcccatggagcccgccagccctgcccccacccccaccagcctgcgggcccccaggacccagaggaccccaggccgcagccctgctgctgccatcgaggagccctggggccgggagggccctgccctgctgctgctgagccgcttcagccaggccccagaccccagcggggccctggtgacaggccctgccctgtatggcctgctgacctacgtgactggagcccctggcccccccagcccccgggccctgcgcatcctgagccggctgacctgcaacccagcctgcctggaggcctttgtgcgctcctatggagctgccctgctgcgggcctggctggtgctgggcgtggccccagatgactggccagccccccgggcccggcccaccctgcacagccgccaccgggagctgggggagttcccctacccacctgtgtccctgcccccctgtgagagccccagcagccccatggcctccatgggccctgagccccacctgcccacccacctgagcagccctgcccggcccccagacaacctgagccctgagtggggcggggagcagggcgtgcctgtgcccccctgggcccaccggcagagcagcgctgtgtcctctgccctggccctgggcccccgctaccccaacagccgctgcagccctgccccccgcatctgggccggcctgtgcttcttccctggcagcgccatcggcagcgccctgtcctag

SEQ ID NO: 35618 - DNA, 2904 bp, Artificial Sequence
  Description of Artificial Sequence: Synthetic coding sequence
atgcaccggccccacgtgcccggctgtgccgccatcaagttccgcagcctgggcagcgctgcccggtctggagctgagagcgaggcccgggccaagatggctgctgccaagcccaccctgacagacagcctgtccttctgcctggcccagctggccgctgctgctggggaggccctgggcggggagaaggaccctgccaccaatgagacccccctgagccgggccctgctggccctgcggaccaggcacatcaaggctgctgggggcatcgagcgcttccgggcccggggcggcctgcggcccctgctggccctgctgcggcgggctgctgctgctggcagcgcccccagccaggccggccctggcagcgcccccagcagcgctgccagcggggccagcagccctgccccagccagcggccctgcccccagcgctgtgagcagcagcagccccaccccacctgtgcggctgaggaagaccctggacctggccctgagcatcctggccgactgctgcacagaaggagcctgcaggacagaggtgcggcggctgggcggcatcctgcccctggtgaccatcctgcagtgcatgaagacagacagcatccagaacagaacagcccgggccctgggcaacctggccatggagcctgagagctgtggggacatccactgtgccggggctgtgcccctgctggtggagagcctgacagcctgccaggacagccagtgcctgcagagcgtggtgcgggccctgaggaacctggccgacagcccccagcaccggctggccctggcccagcagggcgctgtgcggcccctggccgagctgctggccacagccccagatgctgccctgaccctggccctggtgcgggccctgctggagctgagccggggctgcagccgggcctgtgccgagcagctgagcctgggcggcggcctgggccccctggtgtccctggccagccaccccaagagagctgtgcgggagggcaccatcctgatcctggccaacctgtgtgcccagggcctcatccggcctgccctgggcaatgctgggggcgtggaggtgctggtggatgagctgcggcagaggcgggaccccaacggggccagccccaccagccagcagcccctggtgcgggctgtgtgcctgctgtgccgggaggccatcaacagagcccggctgagagatgctgggggcctggacctgctgatgggcctgctgcgggacccccgggccagcgcctggcacccccgcatcgtggccgccctggtgggcttcctgtatgacacaggagccctgggccgcctgcaggccctgggcctggtgcccctgctggccggccagctgtgtggggaggccggggaggaggaggaggagggccgggaggccgcctcctgggacttccctgaggagaggaccccagagcgggcccagggcggcagcttccgcagcctgcgctcctggctgatcagcgagggctacgccactggaccagatgacatcagcccagactggagccctgagcagtgccccccagagcccatggagcccgccagccctgcccccacccccaccagcctgcgggcccccaggacccagaggaccccaggccgcagccctgctgctgccatcgaggagccctggggccgggagggccctgccctgctgctgctgagccgcttcagccaggccccagaccccagcggggccctggtgacaggccctgccctgtatggcctgctgacctacgtgactggagcccctggcccccccagcccccgggccctgcgcatcctgagccggctgacctgcaacccagcctgcctggaggcctttgtgcgctcctatggagctgccctgctgcgggcctggctggtgctgggcgtggccccagatgactggccagccccccgggcccggcccaccctgcacagccgccaccgggagctgggggagcggctgctgcagaacctgactgtgcaggccgagagcccctttggagtgggcgccctgacccacctgctgctgagcggcagccctgaggacagagtggcctgtgccctgaccctgcccttcatctgcaggaagcccagcctgtggaggcggctgctgctggagcagggcggcctgcggctgctgctggccgccctgaccaggcctgccccccaccccctcttcctgttctttgctgctgacagcctgagctgcctgcaggacctggtgagccccaccgtgtccccagctgtgccccaggccgtgcccatggacctggacagccccagcccctgcctgtatgagcccctgctgggccctgcccctgtgcctgccccagacctgcacttcctgctggacagcggcctgcagctgcctgcccagagagctgccagcgccacagccagccccttcttccgggccctgctgagcggcagctttgctgaggcccagatggacctggtgcccctgcggggcctgagccctggagctgcctggcctgtgctgcaccacctgcacggctgccggggctgtggggccgccctgggccctgtgcccccacctggccagcccctgctgggcagcgaggccgaggaggccctggaggccgccggccgcttcctgctgcccggcctggaggaggagctggaggaggccgtgggccgcatccacctgggcccccagggcggccctgagagcgtgggggaggtgttccggctgggccggccccggctggccgcccactgtgcccgctggaccctgggcagcgagcagtgccccaggaagaggggcctggccctggtgggcctggtggaggccgccggggaggaggccggccccctgacagaggccctgctggccgtggtgatgggcatcgagctgggcgcccgggtgcctgcctag

SEQ ID NO: 35619 - DNA, 1431 bp, Artificial Sequence
  Description of Artificial Sequence: Synthetic coding sequence
atggtgtccaagagaattgcccaggagacctttgatgctgctgtgagagaaaatattgaggagtttgccatgggccctgaggaggccgtgaaggaggccgtggagcagtttgagagccagggcgtggacctgagcaacatcgtgaagacagcccccaaggtgtctgcagatggcagccaggagcccacccatgacatcctgcagatgctgagtgacctgcaggagagcgtggccagcagccggccccaggaggtgtctgcctacctgacccgcttctgtgaccagtgcaagcaggacaaggcctgccgcttcctggccgcccagaagggggcctaccccatcatcttcaccgcctggaagctggccacagctggggaccagggcctgctgctgcagagcctgaatgccctgtctgtgctgacagatggccagcctgacctgctggatgcccagggcctgcagctgctggtggccaccctgacccagaatgctgatgaagctgacctgacctgcagcggcatccgctgtgtgagacatgcctgcctgaagcatgagcagaaccggcaggacctggtgaaggccggcgtgctgcccctgctgactggagccatcacccaccacggccaccacacagatgtggtgcgggaggcctgctgggccctgcgggtgatgacctttgatgatgacatccgggtgcccttcggccacgcccacaaccacgccaagatgattgtgcaggagaacaagggcctgaaggtgctgattgaggccaccaaggccttcctggacaaccctggcatcctgtctgagctgtgtggcaccctgagccggctggccatcagaaatgagttctgccaggaggtggtggacctgggcggcctgagcatcctggtgtccctgctggccgactgcaatgaccaccagatgagggaccagagcggcgtgcaggagctggtgaagcaggtgctgagcaccctgcgggccatcgctggaaatgatgatgtgaaggatgccatcgtgcgggccggcggcacagagagcatcgtggccgccatgacccagcacctgaccagcccccaggtgtgtgagcagagctgtgccgccctgtgcttcctggccctgaggaagccagacaacagccgcatcatcgtggagggcggcggcgctgtggccgccctgcaggccatgaaggcccacccccagaaggccggcgtgcagaagcaggcctgcatgctgatccggaacctggtggcccacggccaggccttcagcaagcccatcctggacctgggcgctgaggccctgatcatgcaggcccggagcgcccaccgggactgtgaagatgtggccaaggccgccctgcgggacctgggctgccacgtggagctgcgggagctgtggacaggccagaggggcaacctggccccctag

SEQ ID NO: 35620 - DNA, 1395 bp, Artificial Sequence
  Description of Artificial Sequence: Synthetic coding sequence
atgaccagctgccgctgcagcgtgaccagccgcagcctgtggccagccctggccccccggcgctgccagcacaccagccctgccagcgcccagtgcaagcaggacaaggcctgccgcttcctggccgcccagaagggggcctaccccatcatcttcaccgcctggaagctggccacagctggggaccagggcctgctgctgcagagcctgaatgccctgtctgtgctgacagatggccagcctgacctgctggatgcccagggcctgcagctgctggtggccaccctgacccagaatgctgatgaagctgacctgacctgcagcggcatccgctgtgtgagacatgcctgcctgaagcatgagcagaaccggcaggacctggtgaaggccggcgtgctgcccctgctgactggagccatcacccaccacggccaccacacagatgtggtgcgggaggcctgctgggccctgcgggtgatgacctttgatgatgacatccgggtgcccttcggccacgcccacaaccacgccaagatgattgtgcaggagaacaagggcctgaaggtgctgattgaggccaccaaggccttcctggacaaccctggcatcctgtctgagctgtgtggcaccctgagccggctggccatcagaaatgagttctgccaggaggtggtggacctgggcggcctgagcatcctggtgtccctgctggccgactgcaatgaccaccagatgagggaccagagcggcgtgcaggagctggtgaagcaggtgctgagcaccctgcgggccatcgctggaaatgatgatgtgaaggatgccatcgtgcgggccggcggcacagagagcatcgtggccgccatgacccagcacctgaccagcccccaggtgtgtgagcagagctgtgccgccctgtgcttcctggccctgaggaagccagacaacagccgcatcatcgtggagggcggcggcgctgtggccgccctgcaggccatgaaggcccacccccagaaggccggcgtgcagaagcaggcctgcatgctgatccggaacctggtggcccaccggcccagccgcagccccagctggacctggggcctgcggcacagcagctgcaggccagacctgcccaccgtgacagtgaggacctggcccaggcctccctgtggcacctgggtggtgatgagcagcagcgagagctgtggccaggcccggggggccacctggaggcatgacccccggcccagcctggtgaccctgggggagagctgtgacagcggcatgggcgtggacccctgcccccccctgagccccatcagctctgtgcccttcaccatgaggagcgtcttctggcaggccctgggcaagggcagcggggagggcggggccctgtag

SEQ ID NO: 35621 - DNA, 1431 bp, Artificial Sequence; identical to SEQ ID NO: 35619
  Description of Artificial Sequence: Synthetic coding sequence

SEQ ID NO: 35622 - DNA, 1506 bp, Artificial Sequence
  Description of Artificial Sequence: Synthetic coding sequence
atgtctgagcgctgctgcagccgctacagcagcggggccagcatcggctgcacccccaccagcacccaggccaagatggtgtccaagagaattgcccaggagacctttgatgctgctgtgcgggagaacatcgaggagtttgccatgggccctgaggaggccgtgaaggaggccgtggagcagtttgagagccagggcgtggacctgagcaacatcgtgaagacagcccccaaggtgtctgcagatggcagccaggagcccacccatgacatcctgcagatgctgagtgacctgcaggagagcgtggccagcagccggccccaggaggtgtctgcctacctgacccgcttctgtgaccagtgcaagcaggacaaggcctgccgcttcctggccgcccagaagggggcctaccccatcatcttcaccgcctggaagctggccacagctggggaccagggcctgctgctgcagagcctgaatgccctgtctgtgctgacagatggccagcctgacctgctggatgcccagggcctgcagctgctggtggccaccctgacccagaatgctgatgaggccgacctgacctgcagcggcatccgctgtgtgagacatgcctgcctgaagcatgagcagaaccggcaggacctggtgaaggccggcgtgctgcccctgctgaccggggccatcacccaccacggccaccacacagatgtggtgcgggaggcctgctgggccctgcgggtgatgacctttgatgatgacatccgggtgccctttggacatgcccacaaccacgccaagatgattgtgcaggagaacaagggcctgaaggtgctgattgaggccaccaaggccttcctggacaaccctggcatcctgtctgagctgtgtggcaccctgagccggctggccatcagaaatgagttctgccaggaggtggtggacctgggcggcctgagcatcctggtgtccctgctggccgactgcaatgaccaccagatgagggaccagagcggcgtgcaggagctggtgaagcaggtgctgagcaccctgcgggccatcgctggaaatgatgatgtgaaggatgccatcgtgcgggccggcggcacagagagcatcgtggccgccatgacccagcacctgaccagcccccaggtgtgtgagcagagctgtgccgccctgtgcttcctggccctgaggaagccagacaacagccgcatcatcgtggagggcggcggcgctgtggccgccctgcaggccatgaaggcccacccccagaaggccggcgtgcagaagcaggcctgcatgctgatccggaacctggtggcccacggccaggccttcagcaagcccatcctggacctgggcgctgaggccctgatcatgcaggcccggagcgcccaccgggactgtgaagatgtggccaaggccgccctgcgggacctgggctgccacgtggagctgcgggagctgtggacaggccagaggggcaacctggccccctag

SEQ ID NO: 35623 - DNA, 1506 bp, Artificial Sequence; identical to SEQ ID NO: 35622
  Description of Artificial Sequence: Synthetic coding sequence

SEQ ID NO: 35624 - DNA, 213 bp, Artificial Sequence
  Description of Artificial Sequence: Synthetic coding sequence
atggtgtccaagagaattgcccaggagacctttgatgctgctgtgagagaaaatattgaggagtttgccatgggccctgaggaggccgtgaaggaggccgtggagcagtttgagagccagggcgtggacctgagcaacatcgtgaagacagcccccaaggtgtctgcagatggcagccaggagcccacccatgacatcctgcagatgctgtag

SEQ ID NO: 35625 - DNA, 774 bp, Artificial Sequence
  Description of Artificial Sequence: Synthetic coding sequence
atggtgtccaagagaattgcccaggagacctttgatgctgctgtgagagaaaatattgaggagtttgccatgggccctgaggaggccgtgaaggaggccgtggagcagtttgagagccagggcgtggacctgagcaacatcgtgaagacagcccccaaggtgtctgcagatggcagccaggagcccacccatgacatcctgcagatgctgagtgacctgcaggagagcgtggccagcagccggccccaggaggtgtctgcctacctgacccgcttctgtgaccagtgcaagcaggacaaggcctgccgcttcctggccgcccagaagggggcctaccccatcatcttcaccgcctggaagctggccacagctggggaccagggcctgctgctgcagagcctgaatgccctgtctgtgctgacagatggccagcctgacctgctggatgcccagggcctgcagctgctggtggccaccctgacccagaatgctgatgaagctgacctgacctgcagcggcatccgctgtgtgagacatgcctgcctgaagcatgagcagaaccggcaggacctggtgaaggccggcgtgctgcccctgctgactggagccatcacccaccacggccaccacacagatgtggtgcgggaggcctgctgggccctgcgggtgatgacctttgatgatgacatccgggtgcccttcggccacgcccacaaccacgccaagatgattgtgcaggagaacaagggcctgaaggtgctgattgaggcctag

SEQ ID NO: 35626 - DNA, 312 bp, Artificial Sequence
  Description of Artificial Sequence: Synthetic coding sequence
atggtgtccaagagaattgcccaggagacctttgatgctgctgtgagagaaaatattgaggagtttgccatgggccctgaggaggccgtgaaggaggccgtggagcagtttgagagccagggcgtggacctgagcaacatcgtgaagacagcccccaaggtgtctgcagatggcagccaggagcccacccatgacatcctgcagatgctgagtgacctgcaggagagcgtggccagcagccggccccaggaggtgtctgcctacctgacccgcttctgtgaccagtgcaagcaggacaaggcctgcaggtag

SEQ ID NO: 35627 - DNA, 246 bp, Artificial Sequence
  Description of Artificial Sequence: Synthetic coding sequence
tgaaaagcccacccccagaaggccggcgtgcagaagcaggcctgcatgctgatccggaacctggtggcccacggccaggccttcagcaagcccatcctggacctgggcgctgaggccctgatcatgcaggcccggagcgcccaccgggactgtgaagatgtggccaaggccgccctgcgggacctgggctgccacgtggagctgcgggagctgtggacaggccagaggggcaacctggccccctag

SEQ ID NO: 35628 - DNA, 93 bp, Artificial Sequence
  Description of Artificial Sequence: Synthetic coding sequence
atggtgtccaagagaattgcccaggagacctttgatgctgctgtgagagaaaatattgaggagtttgccatgggccctgaggaggccgtgtag

SEQ ID NO: 35629 - DNA, 486 bp, Artificial Sequence
  Description of Artificial Sequence: Synthetic coding sequence
atggtgtccaagagaattgcccaggagacctttgatgctgctgtgagagaaaatattgaggagtttgccatgggccctgaggaggccgtgaaggaggccgtggagcagtttgagagccagggcgtggacctgagcaacatcgtgaagacagcccccaaggtgtctgcagatggcagccaggagcccacccatgacatcctgcagatgctgagtgacctgcaggagagcgtggccagcagccggccccaggaggtgtctgcctacctgacccgcttctgtgaccagtgcaagcaggacaaggcctgccgcttcctggccgcccagaagggggcctaccccatcatcttcaccgcctggaagctggccacagctggggaccagggcctgctgctgcagagcctgaatgccctgtctgtgctgacagatggccagcctgacctgctggatgcccagggcctgcagctgctggtggccaccctgacctag

SEQ ID NO: 35630 - DNA, 492 bp, Artificial Sequence
  Description of Artificial Sequence: Synthetic coding sequence
atgtctgagcgctgctgcagccgctacagcagcggggccagcatcggctgcacccccaccagcacccaggccaagatggtgtccaagagaattgcccaggagacctttgatgctgctgtgcgggagaacatcgaggagtttgccatgggccctgaggaggccgtgaaggaggccgtggagcagtttgagagccagggcgtggacctgagcaacatcgtgaagacagcccccaaggtgtctgcagatggcagccaggagcccacccatgacatcctgcagatgctgagtgacctgcaggagagcgtggccagcagccggccccaggaggtgtctgcctacctgacccgcttctgtgaccagtgcaagcaggacaaggcctgccgcttcctggccgcccagaagggggcctaccccatcatcttcaccgcctggaagctggccacagctggggaccagggcctgctgctgcagagcctgaatgccctgtcctag

SEQ ID NO: 35631 - DNA, 780 bp, Artificial Sequence
  Description of Artificial Sequence: Synthetic coding sequence
atggtgtccaagagaattgcccaggagacctttgatgctgctgtgagagaaaatattgaggagtttgccatgggccctgaggaggccgtgaaggaggccgtggagcagtttgagagccagggcgtggacctgagcaacatcgtgaagacagcccccaaggtgtctgcagatggcagccaggagcccacccatgacatcctgcagatgctgagtgacctgcaggagagcgtggccagcagccggccccaggaggtgtctgcctacctgacccgcttctgtgaccagtgcaagcaggacaaggcctgccgcttcctggccgcccagaagggggcctaccccatcatcttcaccgcctggaagctggccacagctggggaccagggcctgctgctgcagagcctgaatgccctgtctgtgctgacagatggccagcctgacctgctggatgcccagggcctgcagctgctggtggccaccctgacccagaatgctgatgaagctgacctgacctgcagcggcatccgctgtgtgagacatgcctgcctgaagcatgagcagaaccggcaggacctggtgaaggccggcgtgctgcccctgctgactggagccatcacccaccacggccaccacacagatgtggtgcgggaggcctgctgggccctgcgggtgatgacctttgatgatgacatccgggtgcccttcggccacgcccacaaccacgccaagatgattgtgcaggagaacaagggcctgaaggtgctgattgaggccaccaagtag

SEQ ID NO: 35632 - DNA, 597 bp, Artificial Sequence
  Description of Artificial Sequence: Synthetic coding sequence
atggcccagaagcccaaggtggacccccacgtgggccgcctgggctacctgcaggccctggtgacagagttccaggagacccagagccaggatgccaaggagcaggtgctggccaacctggccaactttgcctatgaccccagcaactatgagtacctgcggcagctgcaggtgctggacctcttcctggacagcctgtctgaagaaaatgagaccctggtggagtttgccatcggcggcctgtgcaacctgtgcccagaccgggccaacaaggagcacatcctgcatgctggaggagtgcccctcatcatcaactgcctgagcagccccaatgaggagaccgtgctgagcgccatcaccaccctgatgcacctgagccccccaggccgctccttcctgcctgagctgacagccacccctgtggtgcagtgcatgctgcgcttcagcctgagcgccagcgcccggctgaggaacctggcccagatcttcctggaggacttctgcagcccccggcaggtggccgaggcccggagccggcaggcccacagcgccctgggcatccccctgcccaggtctgtggccccccggcagaggtag

SEQ ID NO: 35633 - DNA, 1158 bp, Artificial Sequence
  Description of Artificial Sequence: Synthetic coding sequence
atggaggtgacagccagcagccgccactacgtggaccggctgtttgatcctgacccccagaaggtgctgcagggcgtgattgacatgaagaatgctgtgattggcaacaacaagcagaaggccaacctgattgtgctgggcgctgtgccccggctgctgtacctgctgcagcaggagaccagcagcacagagctgaagacagaatgtgctgtggtgctgggcagcctggccatgggcacagaaaataatgtgaagagcctgctggactgccacatcatcccagccctgctgcagggcctgctgagcccagacctgaagttcatcgaggcctgcctgcgctgcctgcggaccatcttcaccagccctgtgaccccagaggagctgctgtacacagatgccaccgtcatcccccacctgatggccctgctgagccgcagccgctacacccaggagtacatctgccagatcttcagccactgctgcaagggccctgaccaccagaccatcctcttcaaccacggggctgtgcagaacatcgcccacctgctgaccagcctgagctacaaggtgaggatgcaggccctgaagtgcttctctgtgctggcctttgagaacccccaggtgtccatgaccctggtgaatgtgctggtggatggagagctgctgccccagatctttgtgaagatgctgcagagggacaagcccatcgagatgcagctgaccagcgccaagtgcctgacctacatgtgccgggccggggccatcagaacagatgacaactgcatcgtgctgaagaccctgccctgcctggtgaggatgtgcagcaaggagcggctgctggaggagcgggtggagggcgctgagaccctggcctacctgattgaaccagatgtggagctgcagagaattgccagcatcacagaccacctgattgccatgctggccgactacttcaagtaccccagctctgtgtctgccatcacagacatcaagaggctggaccatgacctgaagcacgcccacgagctgcggcaggccgccttcaagctgtatgccagcctgggcgccaatgatgaggacatcaggaagaaggtgtccctgggggagggccggccccctgtgctgacagccagccggcagggcgtgaccagcacctag

SEQ ID NO: 35634 - DNA, 1992 bp, Artificial Sequence
  Description of Artificial Sequence: Synthetic coding sequence
atgtctgtgctgtctgaggtgacagccagcagccgccactacgtggaccggctgtttgatcctgacccccagaaggtgctgcagggcgtgattgacatgaagaatgctgtgattggcaacaacaagcagaaggccaacctgattgtgctgggcgctgtgccccggctgctgtacctgctgcagcaggagaccagcagcacagagctgaagacagaatgtgctgtggtgctgggcagcctggccatgggcacagaaaataatgtgaagagcctgctggactgccacatcatcccagccctgctgcagggcctgctgagcccagacctgaagttcatcgaggcctgcctgcgctgcctgcggaccatcttcaccagccctgtgaccccagaggagctgctgtacacagatgccaccgtcatcccccacctgatggccctgctgagccgcagccgctacacccaggagtacatctgccagatcttcagccactgctgcaagggccctgaccaccagaccatcctcttcaaccacggggctgtgcagaacatcgcccacctgctgaccagcctgagctacaaggtgaggatgcaggccctgaagtgcttctctgtgctggcctttgagaacccccaggtgtccatgaccctggtgaatgtgctggtggatggagagctgctgccccagatctttgtgaagatgctgcagagggacaagcccatcgagatgcagctgaccagcgccaagtgcctgacctacatgtgccgggccggggccatcagaacagatgacaactgcatcgtgctgaagaccctgccctgcctggtgaggatgtgcagcaaggagcggctgctggaggagcgggtggagggcgctgagaccctggcctacctgattgaaccagatgtggagctgcagagaattgccagcatcacagaccacctgattgccatgctggccgactacttcaagtaccccagctctgtgtctgccatcacagacatcaagaggctggaccatgacctgaagcacgcccacgagctgcggcaggccgccttcaagctgtatgccagcctgggcgccaatgatgaggacatcaggaagaagatcatcgagacagagaacatgatggacagaattgtgacaggcctgtctgagagctctgtgaaggtgcggctggccgctgtgcgctgcctgcacagcctgagccgctctgtgcagcagctgcggaccagcttccaggaccatgctgtgtggaagcccctgatgaaggtgctgcagaatgccccagatgagatcctggtggtggccagctccatgctgtgcaacctgctgctggagttcagccccagcaaggagcccatcctggagagcggggctgtggagctgctgtgtggcctgacccagagcgagaacccagccctgcgggtgaatggcatctgggccctgatgaacatggccttccaggccgagcagaagatcaaggctgacatcctgcggagcctgagcacagagcagctgttccggctgctgagtgacagcgacctgaatgtgctgatgaagaccctgggcctgctgaggaacctgctgagcacccggccccacatcgacaagatcatgagcacccacggcaagcagatcatgcaggccgtgaccctcatcctggagggggagcacaacatcgaggtgaaggagcagaccctgtgcatcctggccaacattgctgatggcaccacagccaaggacctgatcatgaccaatgatgacatcctgcagaagatcaagtactacatgggccacagccacgtgaagctgcagctggccgccatgttctgcatcagcaacctgatctggaatgaggaggagggcagccaggagcggcaggacaagctgcgggacatgggcatcgtggacatcctgcacaagctgagccagagcccagacagcaacctgtgtgacaaggccaagatggccctgcagcagtacctggcctag

SEQ ID NO: 35635 - DNA, 597 bp, Artificial Sequence
  Description of Artificial Sequence: Synthetic coding sequence
atggcctgcctgctggagacccccatccgcatgtctgtgctgtctgaggtgacagccagcagccgccactacgtggaccggctgtttgatcctgacccccagaaggtgctgcagggcgtgattgacatgaagaatgctgtgattggcaacaacaagcagaaggccaacctgattgtgctgggcgctgtgccccggctgctgtacctgctgcagcaggagaccagcagcacagagctgaagacagaatgtgctgtggtgctgggcagcctggccatgggcacagaaaataatgtgaagagcctgctggactgccacatcatcccagccctgctgcagggcctgctgagcccagacctgaagttcatcgaggcctgcctgcgctgcctgcggaccatcttcaccagccctgtgaccccagaggagctgctgtacacagatgccaccgtcatcccccacctgatggccctgctgagccgcagccgctacacccaggagtacatctgccagatcttcagccactgctgcaagggccctgaccaccagaccatcctcttcaaccacggggctgtgcagaacatcgcccacctgctgacctag

SEQ ID NO: 35636 - DNA, 393 bp, Artificial Sequence
  Description of Artificial Sequence: Synthetic coding sequence
atgaagaatgctgtgattggcaacaacaagcagaaggccaacctgattgtgctgggcgctgtgccccggctgctgtacctgctgcagcaggagaccagcagcacagagctgaagacagaatgtgctgtggtgctgggcagcctggccatgggcacagaaaataatgtgaagagcctgctggactgccacatcatcccagccctgctgcagggcctgctgagcccagacctgaagttcatcgaggcctgcctgcgctgcctgcggaccatcttcaccagccctgtgaccccagaggagctgctgtacacagatgccaccgtcatcccccacctgatggccctgctgagccgcagccgctacacccaggagtacatctgccagatcttctcctag

SEQ ID NO: 35637 - DNA, 81 bp, Artificial Sequence
  Description of Artificial Sequence: Synthetic coding sequence
atggaggtgacagccagcagccgccactacgtggaccggctgtttgatcctgacccccagaaggtgctgcagggcgtgtag

SEQ ID NO: 35638 - DNA, 2022 bp, Artificial Sequence
  Description of Artificial Sequence: Synthetic coding sequence
atggcctgcctgctggagacccccatccgcatgtctgtgctgtctgaggtgacagccagcagccgccactacgtggaccggctgtttgatcctgacccccagaaggtgctgcagggcgtgattgacatgaagaatgctgtgattggcaacaacaagcagaaggccaacctgattgtgctgggcgctgtgccccggctgctgtacctgctgcagcaggagaccagcagcacagagctgaagacagaatgtgctgtggtgctgggcagcctggccatgggcacagaaaataatgtgaagagcctgctggactgccacatcatcccagccctgctgcagggcctgctgagcccagacctgaagttcatcgaggcctgcctgcgctgcctgcggaccatcttcaccagccctgtgaccccagaggagctgctgtacacagatgccaccgtcatcccccacctgatggccctgctgagccgcagccgctacacccaggagtacatctgccagatcttcagccactgctgcaagggccctgaccaccagaccatcctcttcaaccacggggctgtgcagaacatcgcccacctgctgaccagcctgagctacaaggtgaggatgcaggccctgaagtgcttctctgtgctggcctttgagaacccccaggtgtccatgaccctggtgaatgtgctggtggatggagagctgctgccccagatctttgtgaagatgctgcagagggacaagcccatcgagatgcagctgaccagcgccaagtgcctgacctacatgtgccgggccggggccatcagaacagatgacaactgcatcgtgctgaagaccctgccctgcctggtgaggatgtgcagcaaggagcggctgctggaggagcgggtggagggcgctgagaccctggcctacctgattgaaccagatgtggagctgcagagaattgccagcatcacagaccacctgattgccatgctggccgactacttcaagtaccccagctctgtgtctgccatcacagacatcaagaggctggaccatgacctgaagcacgcccacgagctgcggcaggccgccttcaagctgtatgccagcctgggcgccaatgatgaggacatcaggaagaagatcatcgagacagagaacatgatggacagaattgtgacaggcctgtctgagagctctgtgaaggtgcggctggccgctgtgcgctgcctgcacagcctgagccgctctgtgcagcagctgcggaccagcttccaggaccatgctgtgtggaagcccctgatgaaggtgctgcagaatgccccagatgagatcctggtggtggccagctccatgctgtgcaacctgctgctggagttcagccccagcaaggagcccatcctggagagcggggctgtggagctgctgtgtggcctgacccagagcgagaacccagccctgcgggtgaatggcatctgggccctgatgaacatggccttccaggccgagcagaagatcaaggctgacatcctgcggagcctgagcacagagcagctgttccggctgctgagtgacagcgacctgaatgtgctgatgaagaccctgggcctgctgaggaacctgctgagcacccggccccacatcgacaagatcatgagcacccacggcaagcagatcatgcaggccgtgaccctcatcctggagggggagcacaacatcgaggtgaaggagcagaccctgtgcatcctggccaacattgctgatggcaccacagccaaggacctgatcatgaccaatgatgacatcctgcagaagatcaagtactacatgggccacagccacgtgaagctgcagctggccgccatgttctgcatcagcaacctgatctggaatgaggaggagggcagccaggagcggcaggacaagctgcgggacatgggcatcgtggacatcctgcacaagctgagccagagcccagacagcaacctgtgtgacaaggccaagatggccctgcagcagtacctggcctag

SEQ ID NO: 35639 - DNA, 1158 bp, Artificial Sequence; identical to SEQ ID NO: 35633
  Description of Artificial Sequence: Synthetic coding sequence

SEQ ID NO: 35640 - DNA, 1980 bp, Artificial Sequence
  Description of Artificial Sequence: Synthetic coding sequence
atggaggtgacagccagcagccgccactacgtggaccggctgtttgatcctgacccccagaaggtgctgcagggcgtgattgacatgaagaatgctgtgattggcaacaacaagcagaaggccaacctgattgtgctgggcgctgtgccccggctgctgtacctgctgcagcaggagaccagcagcacagagctgaagacagaatgtgctgtggtgctgggcagcctggccatgggcacagaaaataatgtgaagagcctgctggactgccacatcatcccagccctgctgcagggcctgctgagcccagacctgaagttcatcgaggcctgcctgcgctgcctgcggaccatcttcaccagccctgtgaccccagaggagctgctgtacacagatgccaccgtcatcccccacctgatggccctgctgagccgcagccgctacacccaggagtacatctgccagatcttcagccactgctgcaagggccctgaccaccagaccatcctcttcaaccacggggctgtgcagaacatcgcccacctgctgaccagcctgagctacaaggtgaggatgcaggccctgaagtgcttctctgtgctggcctttgagaacccccaggtgtccatgaccctggtgaatgtgctggtggatggagagctgctgccccagatctttgtgaagatgctgcagagggacaagcccatcgagatgcagctgaccagcgccaagtgcctgacctacatgtgccgggccggggccatcagaacagatgacaactgcatcgtgctgaagaccctgccctgcctggtgaggatgtgcagcaaggagcggctgctggaggagcgggtggagggcgctgagaccctggcctacctgattgaaccagatgtggagctgcagagaattgccagcatcacagaccacctgattgccatgctggccgactacttcaagtaccccagctctgtgtctgccatcacagacatcaagaggctggaccatgacctgaagcacgcccacgagctgcggcaggccgccttcaagctgtatgccagcctgggcgccaatgatgaggacatcaggaagaagatcatcgagacagagaacatgatggacagaattgtgacaggcctgtctgagagctctgtgaaggtgcggctggccgctgtgcgctgcctgcacagcctgagccgctctgtgcagcagctgcggaccagcttccaggaccatgctgtgtggaagcccctgatgaaggtgctgcagaatgccccagatgagatcctggtggtggccagctccatgctgtgcaacctgctgctggagttcagccccagcaaggagcccatcctggagagcggggctgtggagctgctgtgtggcctgacccagagcgagaacccagccctgcgggtgaatggcatctgggccctgatgaacatggccttccaggccgagcagaagatcaaggctgacatcctgcggagcctgagcacagagcagctgttccggctgctgagtgacagcgacctgaatgtgctgatgaagaccctgggcctgctgaggaacctgctgagcacccggccccacatcgacaagatcatgagcacccacggcaagcagatcatgcaggccgtgaccctcatcctggagggggagcacaacatcgaggtgaaggagcagaccctgtgcatcctggccaacattgctgatggcaccacagccaaggacctgatcatgaccaatgatgacatcctgcagaagatcaagtactacatgggccacagccacgtgaagctgcagctggccgccatgttctgcatcagcaacctgatctggaatgaggaggagggcagccaggagcggcaggacaagctgcgggacatgggcatcgtggacatcctgcacaagctgagccagagcccagacagcaacctgtgtgacaaggccaagatggccctgcagcagtacctggcctag

SEQ ID NO: 35641 - DNA, 1896 bp, Artificial Sequence
  Description of Artificial Sequence: Synthetic coding sequence
atgaagaatgctgtgattggcaacaacaagcagaaggccaacctgattgtgctgggcgctgtgccccggctgctgtacctgctgcagcaggagaccagcagcacagagctgaagacagaatgtgctgtggtgctgggcagcctggccatgggcacagaaaataatgtgaagagcctgctggactgccacatcatcccagccctgctgcagggcctgctgagcccagacctgaagttcatcgaggcctgcctgcgctgcctgcggaccatcttcaccagccctgtgaccccagaggagctgctgtacacagatgccaccgtcatcccccacctgatggccctgctgagccgcagccgctacacccaggagtacatctgccagatcttcagccactgctgcaagggccctgaccaccagaccatcctcttcaaccacggggctgtgcagaacatcgcccacctgctgaccagcctgagctacaaggtgaggatgcaggccctgaagtgcttctctgtgctggcctttgagaacccccaggtgtccatgaccctggtgaatgtgctggtggatggagagctgctgccccagatctttgtgaagatgctgcagagggacaagcccatcgagatgcagctgaccagcgccaagtgcctgacctacatgtgccgggccggggccatcagaacagatgacaactgcatcgtgctgaagaccctgccctgcctggtgaggatgtgcagcaaggagcggctgctggaggagcgggtggagggcgctgagaccctggcctacctgattgaaccagatgtggagctgcagagaattgccagcatcacagaccacctgattgccatgctggccgactacttcaagtaccccagctctgtgtctgccatcacagacatcaagaggctggaccatgacctgaagcacgcccacgagctgcggcaggccgccttcaagctgtatgccagcctgggcgccaatgatgaggacatcaggaagaagatcatcgagacagagaacatgatggacagaattgtgacaggcctgtctgagagctctgtgaaggtgcggctggccgctgtgcgctgcctgcacagcctgagccgctctgtgcagcagctgcggaccagcttccaggaccatgctgtgtggaagcccctgatgaaggtgctgcagaatgccccagatgagatcctggtggtggccagctccatgctgtgcaacctgctgctggagttcagccccagcaaggagcccatcctggagagcggggctgtggagctgctgtgtggcctgacccagagcgagaacccagccctgcgggtgaatggcatctgggccctgatgaacatggccttccaggccgagcagaagatcaaggctgacatcctgcggagcctgagcacagagcagctgttccggctgctgagtgacagcgacctgaatgtgctgatgaagaccctgggcctgctgaggaacctgctgagcacccggccccacatcgacaagatcatgagcacccacggcaagcagatcatgcaggccgtgaccctcatcctggagggggagcacaacatcgaggtgaaggagcagaccctgtgcatcctggccaacattgctgatggcaccacagccaaggacctgatcatgaccaatgatgacatcctgcagaagatcaagtactacatgggccacagccacgtgaagctgcagctggccgccatgttctgcatcagcaacctgatctggaatgaggaggagggcagccaggagcggcaggacaagctgcgggacatgggcatcgtggacatcctgcacaagctgagccagagcccagacagcaacctgtgtgacaaggccaagatggccctgcagcagtacctggcctag

SEQ ID NO: 35642 - DNA, 1929 bp, Artificial Sequence
  Description of Artificial Sequence: Synthetic coding sequence
atggcctgcctgctggagacccccatccgcatgtctgtgctgtctgaggtgacagccagcagccgccactacgtggaccggctgtttgatcctgacccccagaaggtgctgcagggcgtgattgacatgaagaatgctgtgattggcaacaacaagcagaaggccaacctgattgtgctgggcgctgtgccccggctgctgtacctgctgcagcaggagaccagcagcacagagctgaagacagaatgtgctgtggtgctgggcagcctggccatgggcacagaaaataatgtgaagagcctgctggactgccacatcatcccagccctgctgcagggcctgctgagcccagacctgaagttcatcgaggcctgcctgcgctgcctgcggaccatcttcaccagccctgtgaccccagaggagctgctgtacacaggccctgaccaccagaccatcctcttcaaccacggggctgtgcagaacatcgcccacctgctgaccagcctgagctacaaggtgaggatgcaggccctgaagtgcttctctgtgctggcctttgagaacccccaggtgtccatgaccctggtgaatgtgctggtggatggagagctgctgccccagatctttgtgaagatgctgcagagggacaagcccatcgagatgcagctgaccagcgccaagtgcctgacctacatgtgcagagctggggccatcagaacagatgacaactgcatcgtgctgaagaccctgccctgcctggtgaggatgtgcagcaaggagcggctgctggaggagcgggtggagggcgctgagaccctggcctacctgattgaaccagatgtggagctgcagagaattgccagcatcacagaccacctgattgccatgctggccgactacttcaagtaccccagctctgtgtctgccatcacagacatcaagaggctggaccatgacctgaagcacgcccacgagctgcggcaggccgccttcaagctgtatgccagcctgggcgccaatgatgaggacatcaggaagaagatcattgaaacagagaacatgatggaccgcatcgtgacaggcctgtctgagagctctgtgaaggtgcggctggccgctgtgcgctgcctgcacagcctgagccgctctgtgcagcagctgcggaccagcttccaggaccatgctgtgtggaagcccctgatgaaggtgctgcagaatgccccagatgagatcctggtggtggccagctccatgctgtgcaacctgctgctggagttcagccccagcaaggagcccatcctggagagcggggctgtggagctgctgtgtggcctgacccagagtgaaaatcctgccctgcgggtgaatggcatctgggccctgatgaacatggccttccaggccgagcagaagatcaaggctgacatcctgcggagcctgagcacagagcagctgttccggctgctgagtgacagcgacctgaatgtgctgatgaagaccctgggcctgctgaggaacctgctgagcacccggccccacatcgacaagatcatgagcacccacggcaagcagatcatgcaggccgtgaccctcatcctggagggggagcacaacatcgaggtgaaggagcagaccctgtgcatcctggccaacattgctgatggcaccacagccaaggacctgatcatgaccaatgatgacatcctgcagaagatcaagtactacatgggccacagccacgtgaagctgcagctggccgccatgttctgcatcagcaacctgatctggaatgaggaggagggcagccaggagcggcaggacaagctgcgggacatgggcatcgtggacatcctgcacaagctgagccagagcccagacagcaacctgtgtgacaaggccaagatggccctgcagcagtacctggcctag

SEQ ID NO: 35643 - DNA, 1593 bp, Artificial Sequence
  Description of Artificial Sequence: Synthetic coding sequence
taccaggatgccaccgtcatcccccacctgatggccctgctgagccgcagccgctacacccaggagtacatctgccagatcttcagccactgctgcaagggccctgaccaccagaccatcctcttcaaccacggggctgtgcagaacatcgcccacctgctgaccagcctgagctacaaggtgaggatgcaggccctgaagtgcttctctgtgctggcctttgagaacccccaggtgtccatgaccctggtgaatgtgctggtggatggagagctgctgccccagatctttgtgaagatgctgcagagggacaagcccatcgagatgcagctgaccagcgccaagtgcctgacctacatgtgcagagctggggccatcagaacagatgacaactgcatcgtgctgaagaccctgccctgcctggtgaggatgtgcagcaaggagcggctgctggaggagcgggtggagggcgctgagaccctggcctacctgattgaaccagatgtggagctgcagagaattgccagcatcacagaccacctgattgccatgctggccgactacttcaagtaccccagctctgtgtctgccatcacagacatcaagaggctggaccatgacctgaagcacgcccacgagctgcggcaggccgccttcaagctgtatgccagcctgggcgccaatgatgaggacatcaggaagaagatcattgaaacagagaacatgatggaccgcatcgtgacaggcctgtctgagagctctgtgaaggtgcggctggccgctgtgcgctgcctgcacagcctgagccgctctgtgcagcagctgcggaccagcttccaggaccatgctgtgtggaagcccctgatgaaggtgctgcagaatgccccagatgagatcctggtggtggccagctccatgctgtgcaacctgctgctggagttcagccccagcaaggagcccatcctggagagcggggctgtggagctgctgtgtggcctgacccagagtgaaaatcctgccctgcgggtgaatggcatctgggccctgatgaacatggccttccaggccgagcagaagatcaaggctgacatcctgcggagcctgagcacagagcagctgttccggctgctgagtgacagcgacctgaatgtgctgatgaagaccctgggcctgctgaggaacctgctgagcacccggccccacatcgacaagatcatgagcacccacggcaagcagatcatgcaggccgtgaccctcatcctggagggggagcacaacatcgaggtgaaggagcagaccctgtgcatcctggccaacattgctgatggcaccacagccaaggacctgatcatgaccaatgatgacatcctgcagaagatcaagtactacatgggccacagccacgtgaagctgcagctggccgccatgttctgcatcagcaacctgatctggaatgaggaggagggcagccaggagcggcaggacaagctgcgggacatgggcatcgtggacatcctgcacaagctgagccagagcccagacagcaacctgtgtgacaaggccaagatggccctgcagcagtacctggcctag

SEQ ID NO: 35644 - DNA, 1998 bp, Artificial Sequence
  Description of Artificial Sequence: Synthetic coding sequence
atgggagacatcctggcccatgaaagtgagctgctgggcctggtgaaggagtacctggactttgctgagtttgaggacaccctgaagaccttcagcaaggagtgcaagatcaagggcaagcccctgtgcaagacagtgggcggcagcttccgggacagcaagagcctgaccatccagaaggacctggtggccgcctttgacaacggggaccagaaggtgttctttgacctgtgggaggagcacatcagcagcagcatcagagatggagacagctttgcccagaagctggagttctacctgcacatccactttgccatctacctgctgaagtacagcgtgggccgcccagacaaggaggagctggatgagaagatctcctacttcaagacctacctggagaccaagggagctgccctgagccagaccacagagttcctgcccttctacgccctgccctttgtgcccaaccccatggtgcaccccagcttcaaggagctgttccaggacagctggaccccagagctgaagctgaagctgatcaagttcctggccctgatcagcaaggccagcaacacccccaagctgctgaccatctacaaggaaaatggccagagcaacaaggagatcctgcagcagctgcaccagcagctggtggaggccgagcggcgctctgtgacctacctgaagcgctacaacaagatccaggccgactaccacaacctgattggagtgacagctgagctggtggacagcctggaggccaccgtgtctgggaagatgatcaccccagagtacctgcagagcgtgtgtgtgcggctcttcagcaaccagatgaggcagagcctggcccacagcgtggacttcaccaggcctggaacagccagcaccatgctgcgggccagcctggcccctgtgaagctgaaggatgtgcccctgctgcccagcctggactatgagaagctgaagaaggacctgatcctgggcagtgaccggctgaaggccttcctgctgcaggccctgcgctggaggctgaccaccagccaccctggagagcagcgggagaccgtgctgcaggcctacatcagcaatgacctgctggactgctacagccacaaccagaggtctgtgctgcagctgctgcacagcaccagtgatgtggtgcggcagtacatggcccggctcatcaatgcctttgccagcctggccgagggccgcctgtacctggcccagaacaccaaggtgctgcagatgctggagggccgcctgaaggaggaggacaaggacatcatcaccagagaaaatgtgctgggcgccctgcagaagttcagcctgcggcggcccctgcagacagccatgatccaggacggcctcatcttctggctggtggatgtgctgaaggaccctgactgcctgagtgactacaccctggagtacagcgtggccctgctgatgaacctgtgcctgcggagcacaggcaagaacatgtgtgccaaggtggccggcctggtgctgaaggtgctgagtgacctgctgggccacgagaaccacgagatccagccctacgtgaatggagccctgtacagcatcctgtctgtgcccagcatccgggaggaggcccgggccatgggcatggaggacatcctgcgctgcttcatcaaggagggcaatgctgagatgatccggcagatcgagttcatcatcaagcagctgaacagcgaggagctgcctgatggagtgctggagagtgatgatgatgaagatgaagatgatgaggaggaccatgacatcatggaggccgacctggacaaggatgagctgatccagccccagctgggggagctgtctggagagaagctgctgaccacagagtacctgggcatcatgaccaacacaggcaagaccaggaggaagggcctggccaacgtgcagtggagcggagatgagcccctgcagaggcctgtgacccctgggggccacagaaatggctaccctgtgtag

SEQ ID NO: 35645 - DNA, 2451 bp, Artificial Sequence
  Description of Artificial Sequence: Synthetic coding sequence
atgggagacatcctggcccatgaaagtgagctgctgggcctggtgaaggagtacctggactttgctgagtttgaggacaccctgaagaccttcagcaaggagtgcaagatcaagggcaagcccctgtgcaagacagtgggcggcagcttccgggacagcaagagcctgaccatccagaaggacctggtggccgcctttgacaacggggaccagaaggtgttctttgacctgtgggaggagcacatcagcagcagcatcagagatggagacagctttgcccagaagctggagttctacctgcacatccactttgccatctacctgctgaagtacagcgtgggccgcccagacaaggaggagctggatgagaagatctcctacttcaagacctacctggagaccaagggagctgccctgagccagaccacagagttcctgcccttctacgccctgccctttgtgcccaaccccatggtgcaccccagcttcaaggagctgttccaggacagctggaccccagagctgaagctgaagctgatcaagttcctggccctgatcagcaaggccagcaacacccccaagctgctgaccatctacaaggaaaatggccagagcaacaaggagatcctgcagcagctgcaccagcagctggtggaggccgagcggcgctctgtgacctacctgaagcgctacaacaagatccaggccgactaccacaacctgattggagtgacagctgagctggtggacagcctggaggccaccgtgtctgggaagatgatcaccccagagtacctgcagagcgtgtgtgtgcggctcttcagcaaccagatgaggcagagcctggcccacagcgtggacttcaccaggcctggaacagccagcaccatgctgcgggccagcctggcccctgtgaagctgaaggatgtgcccctgctgcccagcctggactatgagaagctgaagaaggacctgatcctgggcagtgaccggctgaaggccttcctgctgcaggccctgcgctggaggctgaccaccagccaccctggagagcagcgggagaccgtgctgcaggcctacatcagcaatgacctgctggactgctacagccacaaccagaggtctgtgctgcagctgctgcacagcaccagtgatgtggtgcggcagtacatggcccggctcatcaatgcctttgccagcctggccgagggccgcctgtacctggcccagaacaccaaggtgctgcagatgctggagggccgcctgaaggaggaggacaaggacatcatcaccagagaaaatgtgctgggcgccctgcagaagttcagcctgcggcggcccctgcagacagccatgatccaggacggcctcatcttctggctggtggatgtgctgaaggaccctgactgcctgagtgactacaccctggagtacagcgtggccctgctgatgaacctgtgcctgcggagcacaggcaagaacatgtgtgccaaggtggccggcctggtgctgaaggtgctgagtgacctgctgggccacgagaaccacgagatccagccctacgtgaatggagccctgtacagcatcctgtctgtgcccagcatccgggaggaggcccgggccatgggcatggaggacatcctgcgctgcttcatcaaggagggcaatgctgagatgatccggcagatcgagttcatcatcaagcagctgaacagcgaggagctgcctgatggagtgctggagagtgatgatgatgaagatgaagatgatgaggaggaccatgacatcatggaggccgacctggacaaggatgagctgatccagccccagctgggggagctgtctggagagaagctgctgaccacagagtacctgggcatcatgaccaacacaggcaagaccaggaggaagggcctggccaacgtgcagtggagcggagatgagcccctgcagaggcctgtgacccctgggggccacagaaatggctaccctgtggtggaggaccagcacaccccaccccagacagcccagcacgccagaaatggccacccccaggccctgcctgctgcccatgaagctgtgtaccgggagggcaagcccagcaccccagagagctgtgtgagcagcagcagcgccatcatcgccaagccaggagagtggctgccccggggccggcaggaggagcccaggcctgcccccaccccccggcagccccgggaggccccccaggaccctggaaatggagtgaccaccagagaatgtgccagcgccttcacctgcaagccccgggccccctgcaccccagagatgctggactggaacccccccaaggccaaggcctctgtgctggcccccctcttcagcagctgtggcccccagcaggccagccggcccggcagcacagccagcagcacccggggcctgcccagcaaggagacccaccccaagtag

SEQ ID NO: 35646 - DNA, 501 bp, Artificial Sequence
  Description of Artificial Sequence: Synthetic coding sequence
atgggagacatcctggcccatgaaagtgagctgctgggcctggtgaaggagtacctggactttgctgagtttgaggacaccctgaagaccttcagcaaggagtgcaagatcaagggcaagcccctgtgcaagacagtgggcggcagcttccgggacagcaagagcctgaccatccagaaggacctggtggccgcctttgacaacggggaccagaaggtgttctttgacctgtgggaggagcacatcagcagcagcatcagagatggagacagctttgcccagaagctggagttctacctgcacatccactttgccatctacctgctgaagtacagcgtgggccgcccagacaaggaggagctggatgagaagatctcctacttcaagacctacctggagaccaagggagctgccctgagccagaccacagagttcctgcccttctacgccctgccctttgtgcccaaccccatggtgcaccccagcttcaaggagctgtag

SEQ ID NO: 35647 - DNA, 1140 bp, Artificial Sequence
  Description of Artificial Sequence: Synthetic coding sequence
atgggctacgccaggaaggtgggctgggtgacagctggcctggtgattggagctggggcctgctactgcatctaccgcctgacccggggcaggaagcagaacaaggagaagatggccgagggcggcagcggagatgtggatgatgctggggactgcagcggggcccgctacaatgactggagcgatgatgatgatgacagcaatgaaagcaagagcatcgtgtggtacccaccctgggcccgcatcggcacagaggccggcacccgggcccgggcccgggcccgggcccgggccacccgggcccggcgggctgtgcagaagagggccagccccaacagtgatgacacagtgctgagcccccaggagctgcagaaggtgctgtgcctggtggagatgtctgagaagccctacatcctggaggccgccctgattgccctgggcaacaatgctgcctatgccttcaacagagacatcatccgggacctgggcggcctgcccatcgtggccaagatcctgaacacccgggaccccatcgtgaaggagaaggccctgattgtgctgaacaacctgtctgtgaatgctgagaaccagaggcggctgaaggtgtacatgaaccaggtgtgtgatgacaccatcaccagccggctgaacagctctgtgcagctggccggcctgcggctgctgaccaacatgacagtgaccaatgagtaccagcacatgctggccaacagcatcagtgacttcttccgcctcttctctgctggaaatgaggagaccaagctgcaggtgctgaagctgctgctgaacctggccgagaacccagccatgacccgggagctgctgcgggcccaggtgcccagcagcctgggcagcctcttcaacaagaaggagaacaaggaggtgatcctgaagctgctggtgatctttgagaacatcaatgacaacttcaagtgggaggagaatgagcccacccagaaccagtttggagagggcagcctcttcttcttcctgaaggagttccaggtgtgtgccgacaaggtgctgggcatcgagagccaccacgacttcctggtgaaggtgaaggtgggcaagttcatggccaagctggccgagcacatgttccccaagagccaggagtag

SEQ ID NO: 35648 - DNA, 1140 bp, Artificial Sequence; identical to SEQ ID NO: 35647
  Description of Artificial Sequence: Synthetic coding sequence

SEQ ID NO: 35649 - DNA, 6873 bp, Artificial Sequence
  Description of Artificial Sequence: Synthetic coding sequence
atgggccgcatccaggaggtgggctgggtgacagctggcctggtgatctgggccggcacctgctactacatctacaagttcaccaagggccgggcccagagcgtgaggaccctggccagaaatggcagcacagtgaagatggagaccgtggtgggcgtgcagagccagaccctggccatcaatgaagctgagatcaagaccaagccccaggtggagattggagctgagactggagcccggagcggccccagggctgaggtggagaccaaggccacagccatcgccatccaccgggccaacagccaggccaaggccatggtgggcgctgagcctgagacccagagcgagagcaaggtggtggccggcaccctggtgatgacagaagctgtgaccctgacagaggtgaaggccaaggcccgggaggtggccatgaaggaggccgtgacccagacagatgctgaggccggcaagatcgtgaagaaggaggccgtgacccagaccaaggccaaggcctgggccctggtggccaagacagaggccaagcgggaggccatgacccagaccaaggccgagacccacatcctggccgagaaggagacagagatcaacagagtgatggtgacccagagcgagaccctggccgtgccccgggaggtggccaagatgggcgccaccaacaagacaggcatcgtggatgagaccaagacccgggccctggaggagaccgtgtctgtggccaagacccagagcgaggcccggcctggggccaccgtggatgcccggggcaaccccaacggcatgagccgggaggtggccggcgtggacatgaagagctgtgcccagagccaggccgtgaccaagatccagggagatgacatgcctggcaccggggtggaggacatgggcaactgcaagaccatgagcagagctgagagcggggctgacacccgggccagcgcccagccccagatctttgccaagacccagacagaggccatccctggggccaagattgatgctgggggcaacaccaatgccatgtgcaaggtgggcgctggagcagatgtgcgggcctgcatccagccccagacagtggccaagaagcaggccgaggtgaccagcggggcccgggtggatggccggggcaacaccaacgtcatcagcaaggccatcaccggggctgacatgagagctgctgcccagccccaggccgtggccagcacccacgccgaggccatgtctgatgccaaggtgaagaacagaggcaaccccaatgccatgaccaaggccggggccaaggccaacctgcgggccaacagccaggtggaggccctgcctgatgcccgggacaagagccggggcaaccccaacgtgatggccaaggtgggagatggaacagacatgctgagctgcacccagccccagctggtggcctctgtgcaggccgacaccctgagtgatggcaagatcaaggtgagaggaaatgtgaacaccatgcccaaggagggcgctggggtggacatgaaggcccagggcatggcccagagccagggcgaggccctgcccaacacccggggcaaggcccggggcaaggccaaggccaagtgcaagacaggccctggcatggacatgaagacctgcacccagccccaggccggcgtgaagaccccagctgaggccctgctggacagccgggtggatggccggggcaaccccaatgccaccagcaaggccggcaccaaggctgaccagagggtgtgtggccagcccctggtggtggccaacccccagggcgaggccctgcccggggccaagaacaaggtgaagggcaacccccacacagtgctgaaggtgggcgctggggagggcaccacagattctgcccagcctgaggccgtggtgtccttccagggcgaggccctgctgggcaccaagaacaaggtgaagggcaaccccaacgtggtgctgaaggccgaggtgggggagggcgccatgggcacagcccagctgcagatcatggccagcagcaaaggagaggccctgctggacagcaagaacaaggtgaagggcaacagcaatgctgtgtccaaggccggggccggcacagacaccactggatctgtgcagccccagatcgtggccaacagccagggcgaggtgctgcccggggccaagaacaagatccggggcaaccccaccaccgtgcccaacagcggcgtgggcccctacaccacagattctgcccggctgcaggccgtggccaacagccagggcgaggtgctgcccggggccaagaacaaggtgaaggccaacctgaatgctgtgtccaaggccgaggccggcatgggcgccactggatctgtgcagccccaggccgtggccaacagccactgtgagaccctgcccggggccaagaacaaggtgcggggcaactggaatgctgtgtccaaggccggggccggcatggacacccggggcagcgcccagccccaggccgtggccaacagccagggcgaggtgctgcccggggccaagaacaaggtgaagggcaaccccaacgtggtgtccaaggccggggcccgggaggacacagtgggcagcacccagccccaggtgctggccagcagccagcgggagaccctgcccggggccaggaacaaggtgaagggcaacagcaatgtggtgtccaaggccggggcccgggaggacaccatgggcagcgcccagccccaggtggtggccaacagccagcgggagaccctgcccggggccaggaacaaggtgaagggcaacagcaatgccatcagcaaggccgaggccggggccggcatcatgggctctgtgcaggtgcaggtggtggccagcttccagggcgaggtgctgcccggggccaagaacaaggtgcggggcaacagcaatgctgtgcccaaggccgaggccggggctgacacagtgggcagcgcccagccccaggccgtggccaacagccagagcgagaccctgctgggcgccaggaacaaggtgaagggcaacaccatcgctgtgcccaaggccggcaccggggccggcaccaggcacagcgcccagccccagatcgtggccggcagccagggcgagaccctgcccggggcccgggacaagtccatgagcaccagcgaggccgaggccacagcagaagatgaggcctatgccaagccagaggccgaggccatgcccaccagcgagagcgagggcggcagcggcacccaggcctgcaggaagacccagcccaacatccatgactactactggaatggcatcggcgtggaggactggattgctgctgagcgctggatcaagttccgcttccagaccatggatggagactgggagaacagcgtgtcctgggcagatgatgaaaatgaggccagcatcggctcctggagcggggccagtgacaaggccggcatcatccgctcctgggccgtggcctgtgatgagacctctgtgaagtcctgggccggggcccgggcagaaaatgtggtgggcatcggcacctgggcccgggccggggagcaggccagcggcggcctgtgggccggcggccagaccagcgagggcacctgggccggggacaaggccagcggcggggcctggacaggagctgagaaccaggccagcggcggctcctgggccctggccggcaaccaggccatcggggagctgtgggccgccggccaggccagtgatggctcctggccaggcggccaggccagcggcgtgtcctgggtgggggaggaggccatcggcggctcctggacaggagctgagaaccaggccagcgagggctcctgggccggggccggggccggcaacatgagctctgtgtcctactgggccggcgtggtggaccaggccggcggcggctcctgggccggcaccagtgaccagagcggcggcggcagcaagcccaggtttgaggaccaggccagcggggagggctcctgggccggggccggcggccaggccagcggcggctccatgctgggccctgaggaccagagcagcggccgctcctgggccgacacagctgaccaggccagcggcggcagccggctgggccacgtggaccagagcagtggaggagcctgggccggcaccctggaccagagcggcggcggcagcaagcccaggtttgagaaccagaccacagaggagggctcctgggccggggccggcggccaggccggcggcggcagcaaggtgggccctgaggaccagagcagcggccgctcctgggccaacagcggggaccagatcagcggcggcttcctggtgggcatcgtggaccaggccaacggcggctcctggacaggagctggccacccagcctctgtgggccccaagcccatctttgaggaccaggtgtctggccggggctcctgggcagatgcccgggagcaggtggtgggggacagccggctgggcctgcgggaccagagcagcggggacagctgggccgacaccggggaccaggccagcggctggttctgtgtgtgccccggcagccagaccaatggaggctcctggggcggggccagcggccaggatgtgggcggcagccggcccggccccaccaaccagagcagcgctggctcctgggacagccctggcagccaggtgtctggcagctgctggacaggagctggagctgtggaccaggccggcggctgcagcaagccaggctttgaggaccaggccatcggcggcggcttctggccaggagctggggaccagacaggaggcggcagcaggcctggcagcgaggaccagagcagcggcatcggctcctggggcgtggccggcggccaggtgctgggcggggcccggcccggccctgctgaccagagcagcggcggctcctgggccggcaccggcaaccagagcagcggccgctcctggattggccctggggaccaggccgtggactgcagcaagccagagtttgaggaccaggcctgtggcggcggctcctgggccggggccggcagccaggccagcggggagagctgggccggcagcaggcctggaaatgaggccatcggcggcagcaggatgggcagcgaggaccaggccaccggcggctcctgggcccggtctgaggaccaggccagcggccgcttccaggtgtcctttgaggtggaggccaatgaaggcttctggtttggacctggagctgaggccgtgattggctcctggtgctggacagaggagaaggctgacatcgtgtccaggccagatgacaaggatgaggccaccacagccagccgctctggagctggggaggaggccatgatctgcagcagaattgaagctgagaacaaggccagcagcggctcctggatccgctctgaggaggtggcctacatgggcagctgtgtgggcgctgaggccggggccggggctgaggccggggccggggctgaggccggggccggggccggggctgaggccggggctgaggccggggccggggccggggccggccctggaacagaaagtggagctggcatctggagctgggatggagatgccaccaccgtggagagccggctgggcgctggggaggaggccggcgtggagagctggaccctggccagaaatgtgggggaggatgagctgagccgggagagcagcccagacatcgaggagatcagcctgcggagcctcttctgggccgagagcgagaacagcaacaccttccgcagcaagagcggcaaggatgccagctttgagagcggggccggggacaacaccagcatcaaggacaagtttgaggccgccggcggcgtggacatcggctcctggttctgtgctggaaatgaaaacaccagcgaggacaagagcgcccccaaggccaaggccaagaagagcagcgagagccggggcatctacccctacatggtgcctggagctggcatgggctcctgggatggagccatgatctggagcgagaccaagtttgcccaccagagcgaggccagcttccctgtggaggatgagagcaggaagcagaccaggactggagagaagacccggccctggagctgccgctgcaagcatgaggccaacatggacccccgggacctggagaagctgatctgcatgattgagatgacagaggaccccagcgtgcatgaaattgccaacaatgccctgtacaacagcgctgactacagctacagccatgaggtggtgagaaatgtgggcggcatcagcgtcatcgagagcctgctgaacaacccctaccccagcgtgcggcagaaggccctgaatgccctgaacaacatctctgtggccgctgagaaccacaggaaggtgaagacctacctgaaccaggtgtgtgaagatactgtgacctaccccctgaacagcaatgtgcagctggccggcctgcggctcatccgccacctgaccatcaccagcgagtaccagcacatggtgaccaactacatcagcgagttcctgcggctgctgactgtgggcagcggggagaccaaggaccacgtgctgggcatgctgctgaacttcagcaagaaccccagcatgaccaaggacctgctgattgccaatgcccccaccagcctcatcaacatcttcagcaagaaggagaccaaggagaacatcctgaatgccctgagcctgtttgagaacatcaactaccacttcaagaggcgggccaaggccttcacccaggacaagttcagcaagaacagcctgtacttcctgttccagaggcccaaggcctgtgccaagaagctgcgggccctggccgcagaatgtaatgaccctgaggtgaaggagcgggtggagctgctgatcagcaagctgtag

SEQ ID NO: 35650 - DNA, 903 bp, Artificial Sequence
  Description of Artificial Sequence: Synthetic coding sequence
atgggccgggcccgggaggtgggctggatggccgccggcctgatgattggagctggggcctgctactgtgtgtacaagctgaccatcggcagagatgacagcgagaagctggaggaggagggggaggaggagtgggatgatgaccaggagctggatgaggaggagccagacatctggtttgattttgagaccatggcccggccctggacagaagatggagactggacagagcccggggcccctgggggcacagaagatcggcccagcggcggcggcaaggccaacagagcccaccccatcaagcagaggcccttcccctatgagcacaagaacacctggagcgcccagaactgcaagaatggcagctgtgtgctggacctgagcaaatgtctcttcatccagggcaagctgctgtttgctgagcccaaggatgctggcttccccttcagccaggacatcaacagccacctggccagcctgtccatggccaggaacaccagccccaccccagaccccaccgtgcgggaggccctgtgtgccccagacaacctgaatgccagcattgagagccagggccagatcaagatgtacatcaatgaggtgtgccgggagaccgtgagccgctgctgcaacagcttcctgcagcaggccggcctgaacctgctgatctccatgaccgtcatcaacaacatgctggccaagagcgccagtgacctgaagttccccctcatcagcgagggcagcggctgtgccaaggtgcaggtgctgaagcccctgatgggcctgtctgagaagcctgtgctggccggggagctggtgggcgcccagatgctgttctccttcatgagcctcttcatcagaaatggaaaccgggagatcctgctggagaccccagccccctag

SEQ ID NO: 35651 - DNA, 903 bp, Artificial Sequence; identical to SEQ ID NO: 35650
  Description of Artificial Sequence: Synthetic coding sequence

SEQ ID NO: 35652 - DNA, 903 bp, Artificial Sequence; identical to SEQ ID NO: 35650
  Description of Artificial Sequence: Synthetic coding sequence

SEQ ID NO: 35653 - DNA, 1677 bp, Artificial Sequence
  Description of Artificial Sequence: Synthetic coding sequence
atggtggacagcggcacagaggcccgggcccggggcaaggccgaggccggcctgcaggacggcatcagcggccctgccacagcccgggtgaatggcaagacccaggccgaggccgtggccgaggccgagctgaagacagagagcgtgacccaggccaaggctggagatggagccatgaccaggacccacacagtgacctaccgggaggccatggctgtgacccgggaggtgatcaaggtggaggacaccaccaagaccagggtgatggtggagaccaagaccaagcccctggccgagaggagcatcgtgccccagaccaagagcaaggccatgcccatgagccgggtgtccacagtgaccaagtctgaggtgaaggtggtggccgtcatcgaggccaacatccgctcctatgccaagagccatgacaaggccaacacaggcagcaggccagaccggcgggaggagaccagcatcggcatgaagagcagtgatgaagatgaggagaacatctgctcctggttctggacaggagaggagcccagcgtgggctcctggttctggccagaggaggagaccagcctgcaggtgtacaagcccctgcccaagatccaggagaagcccaagcccacccacaagcccaccctgaccatcaagcagaaggtgattgcctggagccgggcccgctacatcgtgctggtgcctgtggagggcggggagcagagcctgcccccagagggcaactggaccctggtggagaccctgattgagacccccctgggcatccggcccctgaccaagatccccccctaccacggcccctactaccagaccctggccgagatcaagaagcagatccggcagcgggagaagtatggccccaaccccaaggcctgccactgcaagagccggggcttcagcctggagcccaaggagtttgacaagctggtggccctgctgaagctgaccaaggaccccttcatccacgagatcgccaccatgatcatgggcatcagccctgcctaccccttcacccaggacatcatccatgatgtgggcatcaccgtgatgattgagaacctggtgaacaaccccaacgtgaaggagcaccctggggccctgtccatggtggatgacagcagcgagagcagcgaggagcccaagagcggggagagctacatccaccaggtgtgcaagggcatcatcagctgccccctgaacagccctgtgcagctggccggcctgaagctgctgggccacctgagcatcaagtttgaggaccactacgtgatcaccagctacatcccagacttcctgaccctgctgaacaagggctctgtgaagaccaagttctacgtgctgaaggtgttcagctgcctgagcaagaaccacgccaacacccgggagctgatcagcgccaaggtgctgagcagcctggtggcccccttcaacaagaatgaaagcaaggccaacatcctgaacatcatcgagatctttgagaacatcaacttccagttcaagaccaaggccaagctgttcaccaaggagaagttcaccaagtctgagctgatcagcatcttccaggaggccaagcagtttggccagaagctgcaggacctggccgagcacagcgaccctgaggtgcgggacaaggtgatccgcctcatcctgaagctgtag

SEQ ID NO: 35654 - DNA, 1677 bp, Artificial Sequence; identical to SEQ ID NO: 35653
  Description of Artificial Sequence: Synthetic coding sequence

SEQ ID NO: 35655 - DNA, 1677 bp, Artificial Sequence; identical to SEQ ID NO: 35653
  Description of Artificial Sequence: Synthetic coding sequence

SEQ ID NO: 35656 - DNA, 1677 bp, Artificial Sequence; identical to SEQ ID NO: 35653
  Description of Artificial Sequence: Synthetic coding sequence

SEQ ID NO: 35657 - DNA, 1677 bp, Artificial Sequence; identical to SEQ ID NO: 35653
  Description of Artificial Sequence: Synthetic coding sequence

SEQ ID NO: 35658 - DNA, 633 bp, Artificial Sequence
  Description of Artificial Sequence: Synthetic coding sequence
atgtttgagagcttcaacgtgcccggcctgtacatcgctgtgcaggccgtgctggccctggccgcctcctggaccagccggcaggtgggggagaggaccctgactggaattgtgattgattctggagatggagtgacccacgtgattcctgtggccgagggctacgtgattggcagctgcatcaagcacatccccatcgccggccgggacatcacctacttcatccagcagctgctgcgggagcgggaggtgggcatccccccagagcagagcctggagacagccaaggccatcaaggagaagtactgctacatctgcccagacatcgtgaaggagtttgccaagtatgatgtggacccccagaagtggatcaagcagtacacaggcatcaatgccatcaaccagaagaagtttgtgattgatgtgggctatgagcgcttcctgggccctgagatcttcttccaccctgagtttgccaacccagacagcatggagagcatcagtgatgtggtggatgaggtgatccagaactgccccattgatgtgagaagacccctgtacaagatggagcagatccccctgagctacccccagggccacggcttccaccccctgagcccccccttccactag

SEQ ID NO: 35659 - DNA, 156 bp, Artificial Sequence
  Description of Artificial Sequence: Synthetic coding sequence
atgtttgagagcttcaacgtgcccggcctgtacatcgctgtgcaggccgtgctggccctggccgcctcctggaccagccggcaggtgggggagaggaccctgactggaattgtgattgattctggagatggagtgacccacgtgattcctgtgtag

SEQ ID NO: 35660 - DNA, 633 bp, Artificial Sequence; identical to SEQ ID NO: 35658
  Description of Artificial Sequence: Synthetic coding sequence

SEQ ID NO: 35661 - DNA, 1878 bp, Artificial Sequence
  Description of Artificial Sequence: Synthetic coding sequence
atgacagccaccctgcggccctacctgtctgctgtgcgggccaccctgcaggccgccctgtgcctggagaacttcagcagccaggtggtggagcggcacaacaagccagaggtggaggtgcgcagcagcaaggagctgctgctgcagcctgtgaccatcagcagaaatgagaaggagaaggtgctgattgagggcagcatcaacagcgtgcgggtgtccattgctgtgaagcaggctgatgaaattgagaagatcctgtgccacaagttcatgaggttcatgatgatgagagctgagaacttcttcatcctgcggaggaagcctgtggagcagaagaagatcttcaccatccagggctgctaccctgtgatccgctgcctgctgcggcggcggggctgggtggagaagaagatggtgcacaggagcggccccaccctgctgcccccccagaaggacctggacagcagcgccatgggagacagcgacaccacagaagatgaagatgaagatgaagatgaggagttccagcccagccagctgtttgattttgatgacctgctgaagtttgatgacctggatggcacccacgccctgatggtgggcctgtgcctgaacctgaggaacctgccctggtttgatgaggtggatgccaacagcttcttcccccgctgctactgcctgggcgcagaagatgacaagaaggccttcatcggggacaagcagcccaagaagcaggagaagaaccctgtgctggtgtccccagagtttgtggatgaggccctgtgtgcctgtgaggagtacctgagcaacctggcccacatggacatcgacaaggacctggaggcccccctgtacctgaccccagagggctggagcctcttcctgcagcgctactaccaggtggtgcatgaaggagctgagctgcggcacctggacacccaggtgcagagatgtgaggacatcctgcagcagctgcaggccgtggtgccccagattgacatggagggggacaggaacatctggatcgtgaagccaggggccaagagccggggccggggcatcatgtgcatggaccacctggaggagatgctgaagctggtgaatggaaatcctgtggtgatgaaggatggcaagtgggtggtgcagaagtacatcgagcggcccctgctgatcttcggcaccaagtttgacctgcggcagtggttcctggtgacagactggaaccccctgactgtgtggttctacagagacagctacatccgcttcagcacccagcccttcagcctgaagaacctggacaacagcgtgcacctgtgcaacaacagcatccagaagcacctggagaacagctgccaccgccaccccctgctgcccccagacaacatgtggagcagccagcgcttccaggcccacctgcaggagatgggcgccccaaatgcctggagcaccatcatcgtgcccggcatgaaggatgctgtgattcatgccctgcagaccagccaggacacagtgcagtgcaggaaggccagctttgagctgtatggagctgactttgtgtttggagaggacttccagccctggctgattgagatcaatgccagccccaccatggcccccagcacagctgtgacagcccggctgtgtgccggcgtgcaggccgacaccctgcgggtggtgattgacaggatgctggacaggaactgtgacaccggggcctttgagctgatctacaagcagcctgtgaccaccagccctgccagcaccccccggcccagctgcctgctgcccatgtacagcgacacccgggcccggagcagtgatgacagcacagcctcctggtgggccctgcggccctgccggccccaggcccggccctag

SEQ ID NO: 35662 - DNA, 1683 bp, Artificial Sequence
  Description of Artificial Sequence: Synthetic coding sequence
gctggccccagggctgcctgcagcgagcccaacccctgcacccaggtggtgatgaacagccacagctacaacggctctgtgggccggcccctgggcagcggccctggggccctgggccgggaccccccagaccctgaggccggccaccccccccagcccccccacagccctggcctgcaggtggtggtggccaagtctgagcccgcccggcccagccctggcagcccccggggccagccccaggaccaggatgatgatgaagatgatgaagaagatgaggccggccggcagagggccagcggcaagcccagcaatgtgggccaccggctgggccacagaagagccctgtttgagaagaggaagaggctgagtgactatgccctgatcttcggcatgtttggaattgtggtgatggtgacagaaacagagctgtcctggggcgtgtacaccaaggagagcctgtacagctttgccctgaagtgcctgatcagcctgagcacagccatcctgctgggcctggtggtgctgtaccacgcccgggagatccagctgttcatggtggacaatggagcagatgactggagaattgccatgacctgtgagagggtcttcctgatcagcctggagctggccgtgtgtgccatccaccctgtgcccggccactaccgcttcacctggacagcccggctggccttcacctacgcccccagcgtggccgaggctgatgtggatgtgctgctgagcatccccatgttcctgcggctgtacctgctgggccgggtgatgctgctgcacagcaagatcttcacagatgccagcagccgcagcattggagccctgaacaagatcaccttcaacaccaggtttgtgatgaagaccctgatgaccatctgccccggcaccgtgctgctggtgttcagcatcagctcctggatcatcgccgcctggacagtgcgggtgtgtgagcgctaccatgacaagcaggaggtgaccagcaacttcctgggcgccatgtggctgatcagcatcaccttcctgagcatcggctacggggacatggtgccccacacctactgtgggaaaggagtgtgcctgctgaccggcatcatgggcgccggctgcacagccctggtggtggccgtggtggccaggaagctggagctgaccaaggccgagaagcacgtgcacaacttcatgatggacacccagctgaccaagagggtgaagaatgctgctgccaacgtgctgcgggagacctggctgatctacaagcacacccggctggtgaagaagccagaccaggcccgggtgaggaagcaccagaggaagttcctgcaggccatccaccacggccgcatgctgcggtctgtgaagattgagcagggcaagctgaatgaccaggccaacaccctgacagacctggccaagacccagacagtgatgtatgacctggtgtctgagctgcacgcccagcacgaggagctggaggcccggctggccaccctggagagccggctggatgccctgggcgccagcctgcaggccctgcccggcctcatcgcccaggccatccggcccccacctccacccctgccccccaggcctggccctggcccccaggaccaggccgcccggagcagcccctgccgctggacccctgtggcccccagcgactgtggctag

SEQ ID NO: 35663 - DNA, 1209 bp, Artificial Sequence
  Description of Artificial Sequence: Synthetic coding sequence
atgaggtctggaggagtgcgcagctttgccctggagctggcccggggccctggaggagcctacagaggaggagagcggctgtgtggccgggtgctgctggaggccgccgcccccctgcgggtgcgggccctggaggtgaaggcccggggcggggccgccacccactggctggagggccgctctgtgggcgtgaatgctgtgtccagtgactatgctgctgctgagacctacctgcggcggcggcagctgctgctgcgggacaccggggagaccaccaccctgcccccaggaagacatgagttcctgttctccttccagctgccccccaccctggtgaccagctttgagggcaagcacggctctgtgcgctactgcatcaaggccaccctgcaccggccctgggtgcctgcccggcgggccaggaaggtgttcaccgtgattgagcctgtggacatcaacaccccagccctgctggccccccaggccggggcccgggagaaggtggcccgctcctggtactgcaacagaggcctggtgtccctgagcgccaagattgacaggaagggctacaccccaggagaggtgattcctgtgtttgctgagattgacaatggcagcaccaggcctgtgctgcccagggctgctgtggtgcagacccagaccttcatggcccggggggccaggaagcagaagagagctgtggtggccagcctggccggggagcctgtgggccctggccagagggccctgtggcagggccgggccctgcgcatcccccctgtgggccccagcatcctgcactgccgggtgctgcacgtggactatgccctgaaggtgtgtgtggacatccctggcaccagcaagctgctgctggagctgcccctggtgattggcaccatccccctgcaccccttcggcagccgcagcagctctgtgggcagccacgccagcttcctgctggactggaggctgggcgccctgcctgagaggcctgaggcccctcctgagtacagcgaggtggtggccgacacagaggaggccgccctgggccagagccccttccccctgccccaggaccctgacatgagcctggagggccccttctttgcctacatccaggagttccgctacagacctccacccctgtacagcgaggaggaccccaaccccctgctgggggacatgaggccccgctgcatgacctgctag

SEQ ID NO: 35664 - DNA, 1257 bp, Artificial Sequence
  Description of Artificial Sequence: Synthetic coding sequence
atgggcggggaggccggctgtgccgctgctgtgggcgctgagggccgggtgaagagcctgggcctggtgtttgaagatgagaggaagggctgctacagcagcggggagaccgtggccggccacgtgctgctggaggccagcgagcctgtggccctgcgggccctgcggctggaggcccagggccgggccacagctgcctggggccccagcacctgcccccgggccagcgccagcacagctgccctggccgtgttcagcgaggtggagtacctgaatgtgcggctgagcctgcgggagcccccagctggggagggcatcatcctgctgcagcccgggaagcatgagttccccttccgcttccagctgcccagcgagcccctggtgaccagcttcaccgggaagtatggcagcatccagtactgtgtgcgggctgtgctggagcggcccaaggtgcctgaccagagcgtgaagcgggagctgcaggtggtgagccacgtggatgtgaacaccccagccctgctgacccctgtgctgaagacccaggagaagatggtgggctgctggttcttcaccagcggccctgtgtccctgagcgccaagattgaaaggaagggctactgcaatggagaggccatccccatctatgcagaaattgagaactgcagcagccgcctcatcgtgcccaaggccgccatcttccagacccagacctacctggccagcggcaagaccaagaccatccgccacatggtggccaacgtgcggggcaaccacatcgccagcggcagcacagacacctggaatggcaagaccctgaagatcccccctgtgacccccagcatcctggactgctgcatcatccgggtggactacagcctggccgtgtacatccacatccctggggccaagaagctgatgctggagctgcccctggtgattggcaccatcccctacaatggatttggcagcaggaacagcagcatcgccagccagttctccatggacatgtcctggctgaccctgaccctgcctgagcagcctgaggccccacccaactatgcagatgtggtgtctgaggaggagttcagccgccacatccccccctacccccagccccccaactgtgagggggaggtgtgctgccctgtgtttgcctgcatccaggagttccgcttccagcccccacccctgtacagcgaggtggacccccaccccagtgatgtggaggagagccagcctgtgtccttcatcctgtag

SEQ ID NO: 35665 - DNA, 996 bp, Artificial Sequence
  Description of Artificial Sequence: Synthetic coding sequence
atgcagggcgaggctgatgccaggacaggctgtgccgagtggcagggcgagggcatcatcctgctgcagcccgggaagcatgagttccccttccgcttccagctgcccagcgagcccctggtgaccagcttcaccgggaagtatggcagcatccagtactgtgtgcgggctgtgctggagcggcccaaggtgcctgaccagagcgtgaagcgggagctgcaggtggtgagccacgtggatgtgaacaccccagccctgctgacccctgtgctgaagacccaggagaagatggtgggctgctggttcttcaccagcggccctgtgtccctgagcgccaagattgaaaggaagggctactgcaatggagaggccatccccatctatgcagaaattgagaactgcagcagccggctgattgtgcccaaggccgccatcttccagacccagacctacctggccagcggcaagaccaagaccatccgccacatggtggccaacgtgcggggcaaccacatcgccagcggcagcacagacacctggaatggcaagaccctgaagatcccccctgtgacccccagcatcctggactgctgcatcatccgggtggactacagcctggccgtgtacatccacatccctggggccaagaagctgatgctggagctgcccctggtgattggcaccatcccctacaacggcttcggcagcaggaacagcagcatcgccagccagttctccatggacatgtcctggctgaccctgaccctgcctgagcagcctgaggccccacccaactatgcagatgtggtgtctgaggaggagttcagccgccacatccccccctacccccagccccccaactgtgagggggaggtgtgctgccctgtgtttgcctgcatccaggagttccgcttccagcccccacccctgtacagcgaggtggacccccaccccagtgatgtggaggagagccagcctgtgtccttcatcctgtag

SEQ ID NO: 35666 - DNA, 1029 bp, Artificial Sequence
  Description of Artificial Sequence: Synthetic coding sequence
atgggagaccgggaggagtgcctgagcaccccccagccccccatgtctgtggtgaagagcattgagctggtgctgcctgaagatcgcatctacctggccggcagcagcatcaagggccaggtgatcctgaccctgaacagcaccctggtggaccccatcgtgaaggtggagctggtgggccggggctacgtggagtggagcgaggaggccggggccagctgtgactacagcagaaatgtcatctgcaacaacaaggctgactatgtgcacaagaccaagaccttccctgtggaggacaactggctgtctgctggcagccacacctttgacttccacttcaacctgcccccccggctgcccagcaccttcaccagcaagtttggacatgtgttctactttgtgcaggccagctgcatgggccgggagcacatcctggccaagaagaggatgtacctgctggtgcagggcaccagcaccttccacaaggagacccccttccagaaccccctgtttgtggaggccgaggagaaggtgtcctacaactgctgccggcagggcaccgtgtgcctgcagatccagatggagaggaacaccttcaccccaggagagaaggtggtgttcaccacagagatcaacaaccagaccagcaagtgcatcaagacagtggtgtttgccctgtatgcccacatccagtatgagggcttcacccccagcgctgagaggaggagccggctggacagcagcgagctgctgcggcaggaggccaacacccctgtgacccgcttcaacaccaccaaggtggtgtccaccttcaacctgcccctgctgctgtctgtgagcagcagcacccaggatggagagatcatgcacaccaggtatgagctggtgaccaccgtgcacctgccctggagcctgaccagcctgaaggccaaggtgcccatcatcatcaccagcgcctctgtggacagcgccatctgccagctgtctgaagatggagtgctgcctgtgaacccagaccaccagaactag

SEQ ID NO: 35667 - DNA, 843 bp, Artificial Sequence
  Description of Artificial Sequence: Synthetic coding sequence
atggagacccaccacggcatctgcagccggctgtgcaaggagagtgacagcgtggtgctggccgtgggctacaggaagctgcccaagcacaagtttcctgtgcctgtgcgggactgcctggtggccaccatccacttcctgaagagcctggatgcctatggagtggaccctgcccgggtggtggtgtgtggggacagctttggaggagccatcgctgctgtggtgtgccagcagctggtggacagaccagacctgccccgcatccgggcccagatcctgatctatgccatcctgcaggccctggacctgcagacccccagcttccagcagaggaagaacatccccctgctgacctggagcttcatctgctactgcttcttccagaacctggacttcagcagctcctggcaggaggtgatcatgaagggggcccacctgcctgctgaggtgtgggagaagtacaggaagtggctgggccctgagaacatccctgagcgcttcaaggagcggggctaccagctgaagccccatgagcccatgaatgaagctgcctacctggaggtgtctgtggtgctggatgtgatgtgcagccccctgattgctgaagatgacatcgtgtcccagctgcctgagacctgcatcgtgtcctgtgaatatgatgccctgcgggacaacagcctgctgtacaagaagaggctggaggacctgggcgtgcctgtgacctggcaccacatggaggatggcttccacggcgtgctgcggaccatcgacatgtccttcctgcacttcccctgcagcatgaggatcctgagcgccctggtgcagtttgtgaagggcctgtag

SEQ ID NO: 35668 - DNA, 1053 bp, Artificial Sequence
  Description of Artificial Sequence: Synthetic coding sequence
atgatctttgagaagctgcgcatctgcagcatgccccagttcttctgcttcatgcaggacctgccccccctgaagtatgaccctgatgtggtggtgacagacttccgcttcggcaccatccctgtgaagctgtaccagagcaaggccagcacctgcaccctgaagccaggcatcgtgtactaccacggcggcggcggcgtgatgggcagcctgaagacccaccacggcatctgcagccggctgtgcaaggagagtgacagcgtggtgctggccgtgggctacaggaagctgcccaagcacaagtttcctgtgcctgtgcgggactgcctggtggccaccatccacttcctgaagagcctggatgcctatggagtggaccctgcccgggtggtggtgtgtggggacagctttggaggagccatcgctgctgtggtgtgccagcagctggtggacagaccagacctgccccgcatccgggcccagatcctgatctatgccatcctgcaggccctggacctgcagacccccagcttccagcagaggaagaacatccccctgctgacctggagcttcatctgctactgcttcttccagaacctggacttcagcagctcctggcaggaggtgatcatgaagggggcccacctgcctgctgaggtgtgggagaagtacaggaagtggctgggccctgagaacatccctgagcgcttcaaggagcggggctaccagctgaagccccatgagcccatgaatgaagctgcctacctggaggtgtctgtggtgctggatgtgatgtgcagccccctgattgctgaagatgacatcgtgtcccagctgcctgagacctgcatcgtgtcctgtgaatatgatgccctgcgggacaacagcctgctgtacaagaagaggctggaggacctgggcgtgcctgtgacctggcaccacatggaggatggcttccacggcgtgctgcggaccatcgacatgtccttcctgcacttcccctgcagcatgaggatcctgagcgccctggtgcagtttgtgaagggcctgtag

SEQ ID NO: 35669 - DNA, 1578 bp, Artificial Sequence
  Description of Artificial Sequence: Synthetic coding sequence
atgggctggctgttcctgaaggtgctgctggccggcgtgtccttcagcggcttcctgtaccccctggtggacttctgcatcagcggcaagacccggggccagaagcccaacttcgtcatcatcctggctgatgacatgggctggggagacctgggcgccaactgggccgagaccaaggacacagccaacctggacaagatggccagcgagggcatgagatttgtggacttccacgccgccgccagcacctgcagccccagccgggccagcctgctgaccggccgcctgggcctgagaaatggagtgaccaggaactttgctgtgacctctgtgggcggcctgcccctgaatgagaccaccctggccgaggtgctgcagcaggccggctacgtgacaggcatcatcggcaagtggcacctgggccaccacggcagctaccaccccaacttccggggctttgactactacttcggcatcccctacagccatgacatgggctgcacagacaccccaggctacaaccaccccccctgcccagcctgcccccagggagatggccccagcaggaacctgcagagggactgctacacagatgtggccctgcccctgtatgagaacctgaacatcgtggagcagcctgtgaacctgagcagcctggcccagaagtatgcagagaaggccacccagttcatccagagggccagcaccagcggccggcccttcctgctgtatgtggccctggcccacatgcacgtgcccctgcctgtgacccagctgcctgctgccccccggggccgcagcctgtatggagctggcctgtgggagatggacagcctggtgggccagatcaaggacaaggtggaccacacagtgaaggagaacaccttcctgtggttcaccggggacaatggcccctgggcccagaagtgtgagctggccggctctgtgggccccttcaccggcttctggcagacccggcagggcggcagccctgccaagcagaccacctgggagggcggccaccgggtgcctgccctggcctactggccaggccgggtgcctgtgaatgtgaccagcacagccctgctgtctgtgctggacatcttccccaccgtggtggccctggcccaggccagcctgccccagggccgccgctttgatggagtggatgtgtctgaggtgctgtttggccgcagccagcccggccaccgggtgctcttccaccccaacagcggggccgccggggagtttggagccctgcagacagtgcggctggagcgctacaaggccttctacatcaccggcggggcccgggcctgtgatggcagcacaggccctgagctgcagcacaagttccccctcatcttcaacctggaggatgacacagctgaggccgtgcccctggagcggggcggcgctgagtaccaggccgtgctgcctgaggtgaggaaggtgctggctgatgtgctgcaggacatcgccaatgacaacatcagcagcgctgactacacccaggaccccagcgtgaccccctgctgcaacccctaccagatcgcctgccgctgccaggccgcctag

SEQ ID NO: 35670 - DNA, 1932 bp, Artificial Sequence
  Description of Artificial Sequence: Synthetic coding sequence
atgtgtggcatctgctgcagcgtgaacttctctgctgagcacttcagccaggacctgaaggaggacctgctgtacaacctgaagcagaggggccccaacagcagcaagcagctgctgaagagtgatgtgaactaccagtgcctcttcagcgcccacgtgctgcacctgcggggcgtgctgaccacccagcctgtggaggatgaaagaggaaatgtgttcctgtggaatggagagatcttcagcggcatcaaggtggaggccgaggagaatgacacccagatcctcttcaactacctgagcagctgcaagaatgaaagtgagatcctgagcctcttcagcgaggtgcagggcccctggagcttcatctactaccaggccagcagccactacctgtggtttggccgggacttcttcggccgccgcagcctgctgtggcacttcagcaacctgggcaagagcttctgcctgagctctgtgggcacccagaccagcggcctggccaaccagtggcaggaggtgcctgccagcggcctcttcagaattgacctgaagagcaccgtcatcagcggctgcatcatcctgcagctgtacccctggaagtacatcagccgggagaacatcatcgaggagaatgtgaacagcctgagccagatctctgctgacctgcctgcctttgtgtctgtggtggccaatgaggccaagctgtacctggagaagcctgtggtgcccctgaacatgatgctgccccaggccgccctggagacccactgcagcaacatcagcaatgtgccccccacccgggagatcctgcaggtgttcctgacagatgtgcacatgaaggaggtgatccagcagttcattgatgtgctgtctgtggccgtgaagaagagggtgctgtgcctgcccagagatgagaacctgacagccaatgaggtgctgaagacctgtgacaggaaggccaacgtggccatcctcttcagcggcggcatcgacagcatggtgattgccaccctggccgacagacacatccccctggatgagcccatcgacctgctgaatgtggccttcatcgccgaggagaagaccatgcccaccaccttcaaccgggagggcaacaagcagaagaacaagtgtgagatccccagcgaggagttcagcaaggatgtggccgctgctgctgctgacagccccaacaagcacgtgtctgtgcctgaccgcatcaccggccgggccggcctgaaggagctgcaggccgtgagccccagccgcatctggaactttgtggagatcaacgtgtccatggaggagctgcagaagctgcggaggacccgcatctgccacctgatccggcccctggacacagtgctggatgacagcatcggctgtgctgtgtggtttgccagccggggcatcggctggctggtggcccaggagggcgtgaagagctaccagagcaatgccaaggtggtgctgaccggcatcggggctgatgagcagctggccggctacagccgccaccgggtgcgcttccagagccacggcctggagggcctgaacaaggagatcatgatggagctgggccgcatcagcagcaggaacctgggcagagatgacagagtgattggagaccacggcaaggaggcccgcttccccttcctggatgaaaatgtggtgtccttcctgaacagcctgcccatctgggagaaggccaacctgaccctgccccggggcatcggggagaagctgctgctgcggctggccgctgtggagctgggcctgacagccagcgccctgctgcccaagagggccatgcagtttggcagccgcatcgccaagatggagaagatcaatgagaaggccagtgacaagtgtggccgcctgcagatcatgagcctggagaacctgagcattgagaaggagaccaagctgtag

SEQ ID NO: 35671 - DNA, 1857 bp, Artificial Sequence
  Description of Artificial Sequence: Synthetic coding sequence
atgtgtggcatctgctgcagcgtgaacttctctgctgagcacttcagccaggacctgaaggaggacctgctgtacaacctgaagcagaggggccccaacagcagcaagcagctgctgaagagtgatgtgaactaccagtgcctcttcagcgcccacgtgctgcacctgcggggcgtgctgaccacccagcctgtggaggatgaaagaggaaatgtgttcctgtggaatggagagatcttcagcggcatcaaggtggaggccgaggagaatgacacccagatcctcttcaactacctgagcagctgcaagaatgaaagtgagatcctgagcctcttcagcgaggtgcagggcccctggagcttcatctactaccaggccagcagccactacctgtggtttggccgggacttcttcggccgccgcagcctgctgtggcacttcagcaacctgggcaagagcttctgcctgagctctgtgggcacccagaccagcggcctggccaaccagtggcaggaggtgcctgccagcggcctcttcagaattgacctgaagagcaccgtcatcagcggctgcatcatcctgcagctgtacccctggaagtacatcagccgggagaacatcatcgaggagaatgtgaacagcctgagccagatctctgctgacctgcctgcctttgtgtctgtggtggccaatgaggccaagctgtacctggagaagcctgtggtgcccctgaacatgatgctgccccaggccgccctggagacccactgcagcaacatcagcaatgtgccccccacccgggagatcctgcaggtgttcctgacagatgtgcacatgaaggaggtgatccagcagttcattgatgtgctgtctgtggccgtgaagaagagggtgctgtgcctgcccagagatgagaacctgacagccaatgaggtgctgaagacctgtgacaggaaggccaacgtggccatcctcttcagcggcggcatcgacagcatggtgattgccaccctggccgacagacacatccccctggatgagcccatcgacctgctgaatgtggccttcatcgccgaggagaagaccatgcccaccaccttcaaccgggagggcaacaagcagaagaacaagtgtgagatccccagcgaggagttcagcaaggatgtggccgctgctgctgctgacagccccaacaagcacgtgtctgtgcctgaccgcatcaccggccgggccggcctgaaggagctgcaggccgtgagccccagccgcatctggaactttgtggagatcaacgtgtccatggaggagctgcagaagctgcggaggacccgcatctgccacctgatccggcccctggacacagtgctggatgacagcatcggctgtgctgtgtggtttgccagccggggcatcggctggctggtggcccaggagggcgtgaagagctaccagagcaatgccaaggtggtgctgaccggcatcggggctgatgagcagctggccggctacagccgccaccgggtgcgcttccagagccacggcctggagggcctgaacaaggagatcatgatggagctgggccgcatcagcagcaggaacctgggcagagatgacagagtgattggagaccacggcaaggaggcccgcttccccttcctggatgaaaatgtggtgtccttcctgaacagcctgcccatctgggagaaggccaacctgaccctgccccggggcatcggggagaagctgctgctgcggctggccgctgtggagctgggcctgacagccagcgccctgctgcccaagagggccatgcagtttggcagccgcatcgccaagatggagaagatcaatgaatag

SEQ ID NO: 35672 - DNA, 222 bp, Artificial Sequence
  Description of Artificial Sequence: Synthetic coding sequence
atgtgtggcatctgctgcagcgtgaacttctctgctgagcacttcagccaggacctgaaggaggacctgctgtacaacctgaagcagaggggccccaacagcagcaagcagctgctgaagagtgatgtgaactaccagtgcctcttcagcgcccacgtgctgcacctgcggggcgtgctgaccacccagcctgtggaggatgaaagaggaaatgtgttctag

SEQ ID NO: 35673 - DNA, 564 bp, Artificial Sequence
  Description of Artificial Sequence: Synthetic coding sequence
atggagaggtctgccttcatggagctggatgctggcagccggctggtgatgcacctgcgggagtggccagccctgctggtgagcagcacaggctggacagaatttgagcagctgaccctggatggccacaacctgcccagcctggtgtgtgtgatcactggatctgtggacctgggcgtgtgcctgcacatgagcagcagcggcctggacctgcccatgaaggtggtggacatgtttggctgctgcctgcctgtgtgtgctgtgaacttcaagtgcctgcacgagctggtgaagcatgaagaaaatggcctggtgtttgaagattctgaggagctggccgccctgcagatgctgttcagcaacttcccagaccctgctgggaagctgaaccagttctggaagaacctgcgggagagccagcagctgcgctgggatgagagctgggtgcagacagtgctgcccctggtgatggacatccagctgctgggccagaggctgaagccccgggacccctgctgccccagccgctccttcttcagcgagagccagggcaagcccttctag

SEQ ID NO: 35674 - DNA, 537 bp, Artificial Sequence
  Description of Artificial Sequence: Synthetic coding sequence
atgggagacagagtgaagggcagcaagagcagaagaccagacctggtggtggaggtggcccaccccaagatcatccacgagagcggggcccagatcctgcggcatgccaacctgctgagcctgcgggtgaccatggccacccacccagatggcttccggctggagggccccctggccgccgcccacagccctggcccctgcaccgtgctgtatgagggccctgtgcggggcctgtgcccctttgcccccaggaacagcaacaccatggctgctgctgccctggccgcccccagcctgggctttgatggagtgattggagtgctggtggccgacaccagcctgacagacatgcacgtggtggatgtggagctgagcggcccccggggccccaccggccgcagctttgctgtgcacacccggcgggagaacccagctgagcctggagctgtgactggaagtgccaccgtgacagccttctggcagagcctgctggcctgctgccagctgcccagcaggcctggcatccacctgtgctag

SEQ ID NO: 35675 - DNA, 852 bp, Artificial Sequence
  Description of Artificial Sequence: Synthetic coding sequence
atggctgaccggggcccctggagggtgggcgtggtgggctacggccgcctgggccagagcctggtgtcccggctgctggcccagggccctgagctgggcctggagctggtgtttgtgtggaacagagaccccggccgcatggccggctctgtgccccccagcctgcagctgcagaacctggccgccctgggggagcggcggccagacctggtggtggaggtggcccaccccaagatcatccatgaaagtggggcccagatcctgcggcatgccaacctgctggtgggcagccccagcgccctgagtgaccagaccacagagcggcagctgctggaggccagccagcactgggaccatgctgtgtttgtggcccggggggccctgtggggcgctgaggacatccggcggctggatgctgctgggggcctgcggagcctgcgggtgaccatggccacccacccagatggcttccggctggagggccccctggccgccgcccacagccctggcccctgcaccgtgctgtatgagggccctgtgcggggcctgtgcccctttgcccccaggaacagcaacaccatggctgctgctgccctggccgcccccagcctgggctttgatggagtcatcggcgtgctggtggccgacaccagcctgacagacatgcacgtggtggatgtggagctgagcggcccccggggccccaccggccgcagctttgctgtgcacaccaggagagaaaatcctgctgagcccggggctgtgacaggcagcgccaccgtgacagccttctggcagagcctgctggcctgctgccagctgcccagccggcccggcatccacctgtgctag

SEQ ID NO: 35676 - DNA, 1458 bp, Artificial Sequence
  Description of Artificial Sequence: Synthetic coding sequence
atgagcggccacagccccaccaggggggccatgcaggtggccatgaatggcaaggccaggaaggaggccgtgcagacagctgccaaggagctgctgaagtttgtgaacagaagccccagccccttccacgctgtggctgaatgtagaaaccggctgctgcaggccggcttcagcgagctgaaggagacagagaagtggaacatcaagccagagagcaagtacttcatgaccaggaacagcagcaccatcatcgcctttgctgtgggcggccagtatgtgcctggaaatggcttcagcctgattggagcccacacagacagcccctgcctgcgggtgaagaggaggagcagaagaagccaggtgggcttccagcaggtgggcgtggagacctatggaggcggcatctggagcacctggtttgaccgggacctgaccctggccggccgggtgattgtgaagtgccccaccagcggccgcctggagcagcagctggtgcacgtggagcggcccatcctgcgcatcccccacctggccatccacctgcagaggaacatcaatgaaaattttggccccaacacagagatgcacctggtgcccatcctggccacagccatccaggaggagctggagaagggcaccccagagcccggccccctgaatgctgtggatgagcggcaccacagcgtgctgatgagcctgctgtgtgcccacctgggcctgagccccaaggacatcgtggagatggagctgtgcctggccgacacccagcctgtggtgctgggcggggcctatgatgagttcatctttgccccccggctggacaacctgcacagctgcttctgtgccctgcaggccctgattgacagctgtgccggccctggcagcctggccacagagccccacgtgaggatggtgaccctgtatgacaatgaggaggtgggcagcgagagcgcccagggcgcccagagcctgctgacagagctggtgctgcggcgcatcagcgccagctgccagcaccccacagcctttgaggaggccatccccaagagcttcatgatctctgctgacatggcccatgctgtgcaccccaactacctggacaagcatgaggagaaccaccggcccctcttccacaagggccctgtgatcaaggtgaacagcaagcagagatatgccagcaatgctgtgtctgaggccctgatccgggaggtggccaacaaggtgaaggtgcccctgcaggacctgatggtgagaaatgacaccccctgtggcaccaccatcggccccatcctggccagccggctgggcctgcgggtgctggacctgggcagcccccagctggccatgcacagcatccgggagatggcctgcaccactggagtgctgcagaccctgaccctcttcaagggcttctttgagctgttccccagcctgagccacaacctgctggtggactag

SEQ ID NO: 35677 - DNA, 1326 bp, Artificial Sequence
  Description of Artificial Sequence: Synthetic coding sequence
atgagcggccacagccccaccaggggggccatgcaggtggccatgaatggcaaggccaggaaggaggccgtgcagacagctgccaaggagctgctgaagtttgtgaacagaagccccagccccttccacgctgtggctgaatgtagaaaccggctgctgcaggccggcttcagcgagctgaaggagacagagaagtggaacatcaagccagagagcaagtacttcatgaccaggaacagcagcaccatcatcgcctttgctgtgggcggccagtatgtgcctggaaatggcttcagcctgattggagcccacacagacagcccctgcctgcgggtgaagaggaggagcagaagaagccaggtgggcttccagcaggtgggcgtggagacctatggaggcggcatctggagcacctggtttgaccgggacctgaccctggccggccgggtgattgtgaagtgccccaccagcggccgcctggagcagcagctggtgcacgtggagcggcccatcctgcgcatcccccacctggccatccacctgcagaggaacatcaatgaaaattttggccccaacacagagatgcacctggtgcccatcctggccacagccatccaggaggagctggagaagggcaccccagagcccggccccctgaatgctgtggatgagcggcaccacagcgtgctgatgagcctgctgtgtgcccacctgggcctgagccccaaggacatcgtggagatggagctgtgcctggccgacacccagcctgtggtgctgggcggggcctatgatgagttcatctttgccccccggctggacaacctgcacagctgcttctgtgccctgcaggccctgattgacagctgtgccggccctggcagcctggccacagagccccacgtgaggatggtgaccctgtatgacaatgaggaggtgggcagcgagagcgcccagggcgcccagagcctgctgacagagctggtgctgcggcgcatcagcgccagctgccagcaccccacagcctttgaggaggccatccccaagagcttcatgatctctgctgacatggcccatgctgtgcaccccaactacctggacaagcatgaggagaaccaccggcccctcttccacaagggccctgtgatcaaggtgaacagcaagcagagatatgccagcaatgctgtgtctgaggccctgatccgggaggtggccaacaagagccgcagcccctgccgcatctcctggagcggcatgaccccacctgtggagccccccctggacctgtcctggctgctgggctggggctgcggctgctggatctag

SEQ ID NO: 35678 - DNA, 1137 bp, Artificial Sequence
  Description of Artificial Sequence: Synthetic coding sequence
ctgagcctgagcctgagcctgagcctcttcctggatgtgtccctgagcctgtctgtgtccctgtccttcagcctgagccaccctggcagcacctggtttgaccgggacctgaccctggccggccgggtcatcgtgaagtgccccaccagcggccgcctggagcagcagctggtgcacgtggagcggcccatcctgcgcatcccccacctggccatccacctgcagaggaacatcaatgaaaattttggccccaacacagagatgcacctggtgcccatcctggccacagccatccaggaggagctggagaagggcaccccagagcccggccccctgaatgctgtggatgagcggcaccacagcgtgctgatgagcctgctgtgtgcccacctgggcctgagccccaaggacatcgtggagatggagctgtgcctggccgacacccagcctgtggtgctgggcggggcctatgatgagttcatctttgccccccggctggacaacctgcacagctgcttctgtgccctgcaggccctgattgacagctgtgccggccctggcagcctggccacagagccccacgtgaggatggtgaccctgtatgacaatgaggaggtgggcagcgagagcgcccagggcgcccagagcctgctgacagagctggtgctgcggcgcatcagcgccagctgccagcaccccacagcctttgaggaggccatccccaagagcttcatgatctctgctgacatggcccatgctgtgcaccccaactacctggacaagcatgaggagaaccaccggcccctcttccacaagggccctgtgatcaaggtgaacagcaagcagagatatgccagcaatgctgtgtctgaggccctgatccgggaggtggccaacaaggtgaaggtgcccctgcaggacctgatggtgagaaatgacaccccctgtggcaccaccatcggccccatcctggccagccggctgggcctgcgggtgctggacctgggcagcccccagctggccatgcacagcatccgggagatggcctgcaccaccggggtgctgcagaccctgaccctcttcaagggcttctttgagctgttccccagcctgagccacaacctgctggtggactag

SEQ ID NO: 35679 - DNA, 1296 bp, Artificial Sequence
  Description of Artificial Sequence: Synthetic coding sequence
atggagggcgtgggcggcctgtggccctgggtgctgggcctgctgagcctgcccggggtcatcctgggcgcccccctggccagcagctgtgccggggcctgtggcaccagcttcccagatggcctgaccccagagggcacccaggccagcggggacaaggacatcccagccatcaaccagggcctcatcctggaggagaccccagagagcagcttcctgattgaaggagacatcatccggcccagccccttccggctgctgagcgccaccagcaacaagtggcccatgggcggcagcggcgtggtggaggtgcccttcctgctgagcagcaaatatgatgagcccagccggcaggtgatcctggaggccctggccgagtttgagaggagcacctgcatccgctttgtgacctaccaggaccagagggacttcatcagcatcatccccatgtatggctgcttcagctctgtgggccgcagcggcggcatgcaggtggtgtccctggcccccacctgcctgcagaagggccggggcatcgtgctgcacgagctgatgcacgtgctgggcttctggcatgagcacaccagggctgaccgggaccgctacatccgggtgaactggaatgagatcctgcccggctttgagatcaacttcatcaagagccagagcagcaacatgctgaccccctatgactacagctctgtgatgcactacggccgcctggccttcagcagaagaggcctgcccaccatcacccccctgtgggcccccagcgtgcacatcggccagcgctggaacctgagcgccagtgacatcaccagggtgctgaagctgtatggctgcagccccagcggcccccggccccggggccggggcagccacgcccacagcacaggccgcagccctgccccagccagcctgagcctgcagaggctgctggaggccctgtctgctgagagccgcagcccagaccccagcggcagcagcgctgggggccagcctgtgcctgctggccctggagagagcccccacggctgggagagccctgccctgaagaagctgtctgctgaggccagcgcccggcagccccagaccctggccagcagccccaggagcaggcctggggccggggcccctggggtggcccaggagcagagctggctggccggcgtgtccaccaagcccaccgtgcccagcagcgaggccggcatccagcctgtgcctgtgcagggcagccctgccctgcccggcggctgtgtgcccaggaaccacttcaagggcatgtctgaggactag

SEQ ID NO: 35680 - DNA, 2040 bp, Artificial Sequence
  Description of Artificial Sequence: Synthetic coding sequence
atgggcatccggggcctgatgagctttgtggaggaccacagcaatgagttcttcacagacctgaagctgcgggacaccaagatcgtgattgatggctacgccctcttccaccggctgtgcttcagcagcaacctggacctgcgctatggaggagactatgacagctttgctgatgtggtgcagaagttctttgagagcctgtttgcctgcaacatctgcccctacgtggtgctggatggcggctgtgacatcagtgacaagaagctgaccaccctgaaggaccgggcccgggagaagatccagatggcccacagcctgtctgtgggcggcagcggctacgtgtgccccctgctgatccgggaggtgttcatccaggtgctgatcaagctgcgggtgtgctttgtgcagtgcttcagcgaggccgaccgggacatcatgaccctggccaaccactggaactgccctgtgctgagcagtgacagcgacttctgcatctttgacctgaagacaggcttctgccccctgaacagcttccagtggaggaacatgaacaccatcaagggcacccagaactacatcccagccaagtgcttcagcctggatgccttctgccaccacttcagcaacatgaacaaggccctgctgcccctgtttgctgtgctgtgtggaaatgaccacgtgaacctgcccatcatggagaccttcctgagcaaggcccggctgcccctgggcgccaccagcagcaaaggaagaagacaccaccgcatcctgggcctgctgaactggctgagccactttgccaaccccacagaggccctggacaacgtgctgaagtacctgcccaagaaggaccgggagaatgtgaaggagctgctgtgctgcagcatggaggagtaccagcagagccaggtgaagctgcaggacttcttccagtgtggcacctacgtgtgcccagatgccctgaacctgggcctgcctgagtgggtgctggtggccctggccaagggccagctgagccccttcatcagtgatgccctggtgctgcggaggaccatcctgcccacccaggtggagaacatgcagcagcccaatgcccaccgcatcagccagcccatccggcagatcatctacggcctgctgctgaatgccagcccccacctggacaagacctcctggaatgccctgcccccccagcccctggccttcagcgaggtggagcgcatcaacaagaacatccgcaccagcatcattgatgctgtggagctggccaaggaccacagcgacctgagccggctgacagagctgagcctgcggcggcggcagatgctgctgctggagaccctgaaggtgaagcagaccatcctggagcccatccccaccagcctgaagctgcccatcgctgtgtcctgctactggctgcagcacacagagaccaaggccaagctgcaccacctgcagagcctgctgctgaccatgctggtgggccccctcatcgccatcatcaacagccctgggaaggaggagctgcaggaggatggagccaagatgctgtatgcagagttccagagggtgaaggcccagacccggctgggcacccggctggacctggacacagcccacatcttctgccagtggcagagctgcctgcagatgggcatgtacctgaaccagctgctgagcacccccctgcctgagccagacctgacccggctgtacagcggcagcctggtgcacggcctgtgccagcagctgctggccagcacctctgtggagagcctgctgagcatctgcccagaggccaagcagctgtatgagtacctgttcaatgccaccaggagctatgccccagctgagatcttcctgcccaagggccgcagcaacagcaagaagaagaggcagaagaagcagaacaccagctgcagcaagaacagaggccgcaccacagcccacaccaagtgctggtatgagggcaacaacagatttggcctgctgatggtggagaacctggaggagcacagcgaggccagcaacatcgagtag

SEQ ID NO: 35681 - DNA, 1194 bp, Artificial Sequence
  Description of Artificial Sequence: Synthetic coding sequence
atgggcatccggggcctgatgagctttgtggaggaccacagcaatgagttcttcacagacctgaagctgcgggacaccaagatcgtgattgatggctacgccctcttccaccggctgtgcttcagcagcaacctggacctgcgctatggaggagactatgacagctttgctgatgtggtgcagaagttctttgagagcctgtttgcctgcaacatctgcccctacgtggtgctggatggcggctgtgacatcagtgacaagaagctgaccaccctgaaggaccgggcccgggagaagatccagatggcccacagcctgtctgtgggcggcagcggctacgtgtgccccctgctgatccgggaggtgttcatccaggtgctgatcaagctgcgggtgtgctttgtgcagtgcttcagcgaggccgaccgggacatcatgaccctggccaaccactggaactgccctgtgctgagcagtgacagcgacttctgcatctttgacctgaagacaggcttctgccccctgaacagcttccagtggaggaacatgaacaccatcaagggcacccagaactacatcccagccaagtgcttcagcctggatgccttctgccaccacttcagcaacatgaacaaggccctgctgcccctgtttgctgtgctgtgtggaaatgaccacgtgaacctgcccatcatggagaccttcctgagcaaggcccggctgcccctgggcgccaccagcagcaaaggaagaagacaccaccgcatcctgggcctgctgaactggctgagccactttgccaaccccacagaggccctggacaacgtgctgaagtacctgcccaagaaggaccgggagaatgtgaaggagctgctgtgctgcagcatggaggagtaccagcagagccaggtgaagctgcaggacttcttccagtgtggcacctacgtgtgcccagatgccctgaacctgggcctgcctgagtgggtgctggtggccctggccaagggccagctgagccccttcatcagtgatgccctggtgctgcggaggaccatcctgcccacccaggtggagaacatgcagcccctggccttcagcgaggtggagcgcatcaacaagaacatccgcaccagcatcctgacagcccacaatgccagcggggccctggactgccacaaccagcagccctggtag

SEQ ID NO: 35682 - DNA, 147 bp, Artificial Sequence
  Description of Artificial Sequence: Synthetic coding sequence
atgggcatccggggcctgatgagctttgtggaggaccacagcaatgagttcttcacagacctgaagctgcgggacaccaagatcgtgattgatggctacgccctcttccaccggctgtgcttcagcagcaacctggacctgaggtag

SEQ ID NO: 35683 - DNA, 153 bp, Artificial Sequence
  Description of Artificial Sequence: Synthetic coding sequence
atgggcatccggggcctgatgagctttgtggaggaccacagcaatgagttcttcacagacctgaagctgcgggacaccaagatcgtgattgatggctacgccctcttccaccggctgtgcttcagcagcaacctggacctgcgctatggatag

SEQ ID NO: 35684 - DNA, 24 bp, Artificial Sequence
  Description of Artificial Sequence: Synthetic coding sequence
atgggcatccggggcctgatgtag

SEQ ID NO: 35685 - DNA, 255 bp, Artificial Sequence
  Description of Artificial Sequence: Synthetic coding sequence
atggagaggaagaatgaccccctgcccatcagcacagtgggcacccggggcaagggccccaagagagatgagcagtaccgcatcatgtggaatgagctggagaccctggtgcgggcccacatcaacaacagcgagaagcaccagagggtgctggagtgcctgatggcctgccgcagcaagcccccagaggaggaggagaggaagaaggaggaggagcggggcaagaccaagaggaccagccagaggaagcagtag

SEQ ID NO: 35686 - DNA, 2121 bp, Artificial Sequence
  Description of Artificial Sequence: Synthetic coding sequence
atgaagatcttcagcgagagccacaagacagtgtttgtggtggaccactgcccctacatggccgagagctgccggcagcacgtggagtttgacatgctggtgaagaacagaacccagggcatcatccccctggcccccatcagcaagagcctgtggacctgcagcgtggagagctccatggagtactgccgcatcatgtatgacatcttccccttcaagaagctggtgaacttcatcgtgtctgattctggggcccacgtgctgaacagctggacccaggaggaccagaacctgcaggagctgatggccgccctggccgctgtgggcccccccaaccccagggctgaccctgagtgctgcagcatcctgcacggcctggtggccgctgtggagaccctgtgcaagatcacagagtaccagcacgaggcccggaccctgctgatggagaatgctgagcgggtgggcaacagaggccgcatcatctgcatcaccaatgccaagagtgacagccacgtgaggatgctggaggactgtgtgcaggagaccatccacgagcacaacaagctggccgccaacagcgaccacctgatgcagatccagaagtgtgagctggtgctgatccacacctaccctgtgggggaggacagcctggtgtctgacaggagcaagaaggagctgagccctgtgctgaccagcgaggtgcacagcgtgcgggccggccgccacctggccaccaagctgaacatcctggtgcagcagcactttgacctggccagcaccaccatcaccaacatccccatgaaggaggagcagcacgccaacaccagcgccaactatgatgtggagctgctgcaccacaaggatgcccacgtggacttcctgaagagcggggacagccacctgggcggcggcagccgggagggcagcttcaaggagaccatcaccctgaagtggtgcacccccaggaccaacaacatcgagctgcactactgcaccggggcctaccgcatcagccctgtggatgtgaacagccggcccagcagctgcctgaccaacttcctgctgaatggccgctctgtgctgctggagcagcccaggaagagcggcagcaaggtgatcagccacatgctgagcagccacggcggggagatcttcctgcacgtgctgagcagcagccgcagcatcctggaggaccccccatccatcagcgagggctgcggcggccgggtgacagactaccgcatcacagactttggagagttcatgagggagaaccggctgacccccttcctggacccccgctacaagattgatggcagcctggaggtgcccctggagcgggccaaggaccagctggagaagcacacccgctactggcccatgatcatcagccagaccaccatcttcaacatgcaggccgtggtgcccctggcctctgtgattgtgaaggagagcctgacagaagaagatgtgctgaactgccagaagaccatctacaacctggtggacatggagaggaagaatgaccccctgcccatcagcacagtgggcacccggggcaagggccccaagagagatgagcagtaccgcatcatgtggaatgagctggagaccctggtgcgggcccacatcaacaacagcgagaagcaccagagggtgctggagtgcctgatggcctgccgcagcaagcccccagaggaggaggagaggaagaagaggggcaggaagcgggaggacaaggaggacaagtctgagaaggctgtgaaggactatgagcaggagaagtcctggcaggacagcgagcggctgaagggcatcctggagcggggcaaggaggagctggccgaggccgagatcatcaaggacagcccagacagccctgagccccccaacaagaagcccctggtggagatggatgagaccccccaggtggagaagagcaagggccctgtgtccctgctgagcctgtggagcaaccgcatcaacacagccaacagcaggaagcaccaggagtttgctggccgcctgaacagcgtgaacaacagagctgagctgtaccagcacctgaaggaggagaatggcatggagaccacagaaaatggcaaggccagccggcagtag

SEQ ID NO: 35687 - DNA, 882 bp, Artificial Sequence
  Description of Artificial Sequence: Synthetic coding sequence
atggtggtgctcttctactggaacaaccacgagagccaggtgctgaagagcctggtgatctgcctggtggccatggaggagcgcttcctgcacgtgctgagcagcagccgcagcatcctggaggaccccccatccatcagcgagggctgcggcggccgggtgacagactaccgcatcaccgtggtgcccctggccagcgtcatcgtgaaggagagcctgacagaggaggatgtgctgaactgccagaagaccatctacaacctggtggacatggagaggaagaatgaccccctgcccatcagcacagtgggcacccggggcaagggccccaagagagatgagcagtaccgcatcatgtggaatgagctggagaccctggtgcgggcccacatcaacaacagcgagaagcaccagagggtgctggagtgcctgatggcctgccgcagcaagcccccagaggaggaggagaggaagaagaggggcaggaagcgggaggacaaggaggacaagtctgagaaggctgtgaaggactatgagcaggagaagtcctggcaggacagcgagcggctgaagggcatcctggagcggggcaaggaggagctggccgaggccgagatcatcaaggacagcccagacagccctgagccccccaacaagaagcccctggtggagatggatgagaccccccaggtggagaagagcaaaggacctgtgtccctgctgagcctgtggagcaaccgcatcaacacagccaacagcaggaagcaccaggagtttgctggccgcctgaacagcgtgaacaacagagctgagctgtaccagcacctgaaggaggagaatggcatggagaccacagaaaatggcaaggccagccggcagtag

SEQ ID NO: 35688 - DNA, 492 bp, Artificial Sequence
  Description of Artificial Sequence: Synthetic coding sequence
atgaagatcttcagcgagagccacaagacagtgtttgtggtggaccactgcccctacatggccgagagctgccggcagcacgtggagtttgacatgctggtgaagaacagaacccagggcatcatccccctggcccccatcagcaagagcctgtggacctgcagcgtggagagctccatggagtactgccgcatcatgtatgacatcttccccttcaagaagctggtgaacttcatcgtgtctgattctggggcccacgtgctgaacagctggacccaggaggaccagaacctgcaggagctgatggccgccctggccgctgtgggcccccccaaccccagggctgaccctgagtgctgcagcatcctgcacggcctggtggccgctgtggagaccctgtgcaagatcacagagtaccagcacgaggcccggaccctgctgatggagaatgctgagcgggtgggcaacagaggccgcatcatctgcatctag

SEQ ID NO: 35689 - DNA, 375 bp, Artificial Sequence
  Description of Artificial Sequence: Synthetic coding sequence
atggccgccctggccgctgtgggcccccccaaccccagggctgaccctgagtgctgcagcatcctgcacggcctggtggccgctgtggagaccctgtgcaagatcacagagtaccagcacgaggcccggaccctgctgatggagaatgctgagcgggtgggcaacagaggccgcatcatctgcatcaccaatgccaagagtgacagccacgtgaggatgctggaggactgtgtgcaggagaccatccacgagcacaacaagctggccgccaacagcgaccacctgatgcagatccagaagtgtgagctggtgctgatccacacctaccctgtgggggaggacagcctggtgtctgacaggagcaagaaggagtag

SEQ ID NO: 35690 - DNA, 1818 bp, Artificial Sequence
  Description of Artificial Sequence: Synthetic coding sequence
atggccgccctggccgctgtgggcccccccaaccccagggctgaccctgagtgctgcagcatcctgcacggcctggtggccgctgtggagaccctgtgcaagatcacagagtaccagcacgaggcccggaccctgctgatggagaatgctgagcgggtgggcaacagaggccgcatcatctgcatcaccaatgccaagagtgacagccacgtgaggatgctggaggactgtgtgcaggagaccatccacgagcacaacaagctggccgccaacagcgaccacctgatgcagatccagaagtgtgagctggtgctgatccacacctaccctgtgggggaggacagcctggtgtctgacaggagcaagaaggagctgagccctgtgctgaccagcgaggtgcacagcgtgcgggccggccgccacctggccaccaagctgaacatcctggtgcagcagcactttgacctggccagcaccaccatcaccaacatccccatgaaggaggagcagcacgccaacaccagcgccaactatgatgtggagctgctgcaccacaaggatgcccacgtggacttcctgaagagcggggacagccacctgggcggcggcagccgggagggcagcttcaaggagaccatcaccctgaagtggtgcacccccaggaccaacaacatcgagctgcactactgcacaggagcctaccgcatcagccctgtggatgtgaacagccggcccagcagctgcctgaccaacttcctgctgaatggccgctctgtgctgctggagcagcccaggaagagcggcagcaaggtgatcagccacatgctgagcagccatggaggagagatcttcctgcacgtgctgagcagcagccgcagcatcctggaggacccccccagcatcagcgagggctgcggcggccgggtgacagactaccgcatcacagactttggagagttcatgagagaaaatcggctgacccccttcctggacccccgctacaagattgatggcagcctggaggtgcccctggagcgggccaaggaccagctggagaagcacacccgctactggcccatgatcatcagccagaccaccatcttcaacatgcaggccgtggtgcccctggccagcgtcatcgtgaaggagagcctgacagaggaggatgtgctgaactgccagaagaccatctacaacctggtggacatggagaggaagaatgaccccctgcccatcagcacagtgggcacccggggcaagggccccaagagagatgagcagtaccgcatcatgtggaatgagctggagaccctggtgcgggcccacatcaacaacagcgagaagcaccagagggtgctggagtgcctgatggcctgccgcagcaagcccccagaggaggaggagaggaagaagaggggcaggaagcgggaggacaaggaggacaagtctgagaaggctgtgaaggactatgagcaggagaagtcctggcaggacagcgagcggctgaagggcatcctggagcggggcaaggaggagctggccgaggccgagatcatcaaggacagcccagacagccctgagccccccaacaagaagcccctggtggagatggatgagaccccccaggtggagaagagcaaaggacctgtgtccctgctgagcctgtggagcaaccgcatcaacacagccaacagcaggaagcaccaggagtttgctggccgcctgaacagcgtgaacaacagagctgagctgtaccagcacctgaaggaggagaatggcatggagaccacagaaaatggcaaggccagccggcagtag

SEQ ID NO: 35691 - DNA, 678 bp, Artificial Sequence
  Description of Artificial Sequence: Synthetic coding sequence
atgaagatcttcagcgagagccacaagacagtgtttgtggtggaccactgcccctacatggccgagagctgccggcagcacgtggagtttgacatgctggtgaagaacagaacccagggcatcatccccctggcccccatcagcaagagcctgtggacctgcagcgtggagagctccatggagtactgccgcatcatgtatgacatcttccccttcaagaagctggtgaacttcatcgtgtctgattctggggcccacgtgctgaacagctggacccaggaggaccagaacctgcaggagctgatggccgccctggccgctgtgggcccccccaaccccagggctgaccctgagtgctgcagcatcctgcacggcctggtggccgctgtggagaccctgtgcaagatcacagagtaccagcacgaggcccggaccctgctgatggagaatgctgagcgggtgggcaacagaggccgcatcatctgcatcaccaatgccaagagtgacagccacgtgaggatgctggaggactgtgtgcaggagaccatccacgagcacaacaagctggccgccaacagcgaccacctgatgcagatccagaagtgtgagctggtgctgatccacacctaccctgtgggggaggacagcctggtgtctgacaggagcaagaaggagtag

SEQ ID NO: 35692 - DNA, 4812 bp, Artificial Sequence
  Description of Artificial Sequence: Synthetic coding sequence
atgagggtgaagccccagggcctggtggtgaccagcagcgctgtgtgcagcagcccagactacctgcgggagcccaagtactacccaggcggcccccccaccccccggcccctgctgcccacccggcccccagccagccccccagacaaggccttcagcacccacgccttcagcgagaacccccggcccccaccccggcgggaccccagcacccggcggccccctgtgctggccaagggagatgaccccctgcccccccgggccgcccggcctgtgtcccaggcccgctgccccacccctgtgggagatggcagcagcagccgccgctgctgggacaatggccgggtgaacctgcggcctgtggtgcagctgattgacatcatgaaggacctgacccggctgagccaggacctgcagcacagcggcgtgcacctggactgtggcggcctgcggctgagccggcccccagcccctcctcctggggacctgcagtacagcttcttcagcagccccagcctggccaacagcatccgcagccctgaggagcgggccacccctcatgccaagtctgagcggcccagccaccccctgtatgagcctgagcctgagccccgggacagcccccagcccggccagggccacagccctggggccacagctgctgccaccggcctgcccccagagcctgagccagacagcacagactacagcgagctggctgatgctgacatcctgtctgagctggccagcctgacctgcccagaggcccagctgctggaggcccaggccctggagccccccagccctgagcctgagccccagctgctggacccccagccccgcttcctggacccccaggccctggagcccctgggggaggccctggagctgccccccctgcagcccctggccgaccccctgggcctgcccggcctggccctgcaggccctggacaccctgcctgacagcctggagagccagctgctggacccccaggccctggaccccctgcccaagctgctggatgtgcccggccggcggctggagccccagcagcccctgggccactgccccctggccgagcccctgcggctggacctgtgcagcccccacggccccccaggccctgagggccaccccaagtatgccctgcggaggacagaccggcccaagatcctgtgcagaagaaggaaggccggccggggcaggaaggcagatgctggccctgagggccgcctgctgcccctgcccatgcccaccggcctggtggccgccctggccgagcccccacctcctcctcctcctcctcctccagccctgcccggccctggccctgtgtctgtgcctgagctgaagccagagagcagccagacccctgtggtgtccaccaggaaaggaaaatgtcggggcgtgcggaggatggtggtgaagatggccaagatccctgtgtccctgggcagaagaaacaagaccacctacaaggtgagcagcctgagcagcagcctgtctgtggagggcaaggagctgggcctgcgggtgtctgctgagcccacccccctgctgaagatgaagaacaacggcagaaatgtggtggtggtgtttcctcctggagagatgcccatcatcctgaagaggaagaggggccggccccccaagaacctgctgctgggccctgggaagcccaaggagcctgctgtggtggccgctgaggccgccaccgtggccgccgccaccatggccatgcctgaggtgaagaagagaagaagaaggaagcagaagctggccagcccccagcccagctatgctgctgatgccaatgacagcaaggccgagtacagtgatgtgctggccaagctggccttcctgaaccggcagagccagtgtgccggccgctgcagccccccacgctgctggaccccatctgagcctgagagcgtgcaccaggccccagacacccagagcatcagccacttcctgcaccgggtgcagggcttcagaagaagaggaggcaaggccggcggctttggaggccggggcggcggccatgctgccaagagcgcccgctgcagcttcagtgacttctttgagggcatcggcaagaagaagaaggtggtggccgtggccgccgccggcgtgggcggccctggcctgacagagctgggccaccccaggaagaggggccgcggggaggtggatgctgtgacaggcaagcccaagaggaagaggaggagcaggaagaatggcaccctcttccctgagcaggtgcccagcggccctggctttggagaggccggggctgagtgggccggggacaagggcggcggctgggccccccaccacggccaccctgggggccaggccggcaggaactgtggcttccagggcacagaggcccgggcctttgccagcacaggcctggagagcggggccagcggccggggcagctactacagcactggagcccccagcggccagacagagctgagccaggagcggcagaacctcttcaccggctacttccgcagcctgctggacagtgatgacagcagtgacctgctggactttgccctgagcgccagcaggcctgagagcaggaaggccagcggcacctacgccggcccccccaccagcgccctgcctgcccagaggggcctggccaccttccccagcagaggagccaaggccagccctgtggccgtgggcagcagtggagctggagctgaccccagcttccagcctgtgctgagcgcccggcagaccttccccccaggccgggccgccagctatggcctgaccccagctgccagtgactgcagagctgctgagaccttccccaagctggtgcccccacccagcgccatggcccggagccccaccacccaccccccagccaacacctacctgccccagtatggaggctacggggccggccagagcgtgtttgcccccaccaagcccttcaccggccaggactgtgccaacagcaaggactgcagctttgcctacggcagcggcaacagcctgcctgccagccccagcagcgcccacagcgctggctacgcccctcctccaactggaggcccctgcctgccccccagcaaggccagcttcttcagcagcagcgagggcgcccccttcagcggcagcgcccccacccccctgcgctgtgacagccgggccagcacagtgtccccaggcggctacatggtgcccaagggcaccacagccagcgccaccagcgctgccagcgctgccagcagcagcagcagcagcttccagcccagccctgagaactgccggcagtttgctggggccagccagtggcccttccggcagggctacggcggcctggactgggccagcgaggccttcagccagctgtacaaccccagctttgactgccacgtgtctgagcccaacgtcatcctggacatcagcaactacaccccccagaaggtgaagcagcagacagctgtgtctgagaccttcagcgagagcagcagtgacagcacccagttcaaccagcctgtgggcggcggcggcttcagaagagccaacagcgaggccagcagcagcgagggccagagcagcctgagcagcctggagaagctgatgatggactggaatgaggccagcagcgcccctggctacaactggaaccagagcgtgctcttccagagcagcagcaagccaggccggggccgcaggaagaaggtggacctgtttgaggccagccacctgggcttccccaccagcgccagcgctgctgccagcggctaccccagcaagaggagcacaggcccccggcagccccggggcggccggggcggcggggcctgcagcgccaagaaggagcggggcggggccgccgccaaggccaagttcatccccaagccccagcctgtgaaccccctcttccaggacagcccagacctgggcctggactactacagcggggacagctccatgagccccctgcccagccagagccgggcctttggagtgggggagcgggacccctgtgacttcatcggcccctacagcatgaaccccagcacccccagtgatggcaccttcggccagggcttccactgtgacagccccagcctgggcgcccctgagctggatggcaagcacttcccccccctggcccacccccccaccgtgtttgatgctggcctgcagaaggcctacagccccacctgcagccccaccctgggcttcaaggaggagctgcggcccccacccaccaagctggccgcctgtgagcccctgaagcacggcctgcagggcgccagcctgggccatgctgctgctgcccaggcccacctgagctgccgggacctgcccctgggccagccccactatgacagccccagctgcaagggcacagcctactggtacccacctggcagcgctgcccggagccccccctatgagggcaaggtgggcaccggcctgctggccgacttcctgggccgcacagaagctgcctgcctgagcgccccccacctggccagccccccagccacccccaaggctgacaaggagcccctggagatggcccggcccccaggccccccccggggccctgctgctgctgctgctggctacggctgccccctgctgagtgacctgaccctgagccctgtgccccgggacagcctgctgcccctgcaggacacagcctaccgctacccaggcttcatgccccaggcccaccctggcctgggcggcggccccaagagcggcttcctgggccccatggccgagccccaccctgaggacaccttcaccgtgaccagcctgtag

SEQ ID NO: 35693 - DNA, 4812 bp, Artificial Sequence; identical to SEQ ID NO: 35692
  Description of Artificial Sequence: Synthetic coding sequence

SEQ ID NO: 35694 - DNA, 450 bp, Artificial Sequence
  Description of Artificial Sequence: Synthetic coding sequence
atgagggtgaagccccagggcctggtggtgaccagcagcgctgtgtgcagcagcccagactacctgcgggagcccaagtactacccaggcggcccccccaccccccggcccctgctgcccacccggcccccagccagccccccagacaaggccttcagcacccacgccttcagcgagaacccccggcccccaccccggcgggaccccagcacccggcggccccctgtgctggccaagggagatgaccccctgcccccccgggccgcccggcctgtgtcccaggcccgctgccccacccctgtgggagatggcagcagcagccgccgctgctgggacaatggccgggtgaacctgcggcctgtggtgcagctgattgacatcatgaaggacctgacccggctgagccaggacctgcagcacagcggcgtgcacctggactgtggcggctag

SEQ ID NO: 35695 - DNA, 1239 bp, Artificial Sequence
  Description of Artificial Sequence: Synthetic coding sequence
atggaggccctgcagaagcagcaggccgcccggctggcccagggcgtgggccccctggccccagcctgccccctgctgcccccccagccccccctgcctgaccacaggaccctgcaggcccctgagggcgccctgggcaatgtgggcgctgaggaggaggaggatgctgaggaggatgaggagaagcgggaggaggccggggctgaggaggaggccgctgaggagagcaggcctggggcccagggccccagcagccccagcagccagcccccaggcctgcacccccatgagtggacctatgaggagcagttcaagcagctgtatgagctggatgctgaccccaagaggaaggagttcctggatgacctcttctccttcatgcagaagaggggcacccctgtgaacagagtgcccatcatggccaagcaggtgctggacctgtatgccctcttccggctggtgacagccaagggcggcctggtggaggtgatcaacaggaaggtgtggagggaggtgacccggggcctgagcctgcccaccaccatcaccagcgctgccttcaccctgcggacccagtacatgaagtacctgtacccctatgaatgtgagacccgggccctgagcagccctggagagctgcaggccgccatcgacagcaacagaagagagggccggcggcaggcctacacagccacccccctgtttggcctggccggccccccacccaggggggcccaggaccctgccctgggccctggccctgcccccccagccacccagagcagccctggccctgcccagggcagcaccagcggcctgcctgcccacgcctgtgcccagctgagccccagccccatcaagaaggaggagagcggcatccccaacccctgcctggccctgcctgtgggcctggccctgggccccacccgggagaagctggcccctgaggagcccccagagaagagagctgtgctgatgggccccatggaccccccccggccctgcatgcctccttccttcctgccccggggcaaggtgcccctgcgggaggagcggctggatggccccctgaacctggccggcagcggcatcagcagcatcaacatggccctggagatcaacggggtggtgtacacaggagtgctgtttgcccggcggcagcctgtgcctgccagccagggccccaccaacccagcccccccacccagcacaggcccccccagcagcatcctgccctag

SEQ ID NO: 35696 - DNA, 441 bp, Artificial Sequence
  Description of Artificial Sequence: Synthetic coding sequence
atgaccagcgagaggagccgcatcccctgcctgtctgctgctgctgctgagggcaccgggaagaagcagcaggagggccgggccatggccaccctggacaggaaggtgcccagccctgaggccttcctgggcaagccctggagctcctggattgatgctgccaagctgcactgcagcgacaacgtggacctggaggaggccggcaaggagggcggcaagagccgggaggtgatgaggctgaacaaggaggacatgcacctgtttggccactacccagcccatgatgacttctacctggtggtgtgcagcgcctgcaaccaggtggtgaagccccaggtgttccagagccactgcggcaggaagcaggacaacagaagaaatgaaggcatcagccgcagcggccctgagagcagccaggccatcgagaagcaccaggtgtag

SEQ ID NO: 35697 - DNA, 1602 bp, Artificial Sequence
  Description of Artificial Sequence: Synthetic coding sequence
atggatggagcagatgaaagtgagaagctggactgccagttcagcacccaccacccccggcccctggccttctgcagctttggcagccggctgatgggccggggctactacgtgtttgaccggcgctgggaccgcttccgctttgccctgaacagcatggtggagaagcacctgaacagccagatgtggaagcacaggaaccccagccaccgggccagcggccccagccccctcttccgcacctgcctgaccaacctgctgagcctgagcaacatcggggccgcctgggtgtccaccctggagagcgtggccccccgctaccccctgaacctggccgcccagaccccaggccctgggggccctgagcccggcggcatggccgcagatggaggagtggaggacatcaggaagaagagaaatggccaggacagcttcttcttcaacaagcacctgaccctgcaccaggagccccccacccagtacagcctgagcgccaggaagatccccccagctgctgacagccccctgcccagccctgctgcccacatcaccacccctgtgcctgcctctgtgctgcagcccttcagcaaccccagcgctgtgtacctgcccagcgcccccatcagcagccggctgaccagcagctacatcatgaccagcgccatgctgagcaatgctgcctttgtgaccagcccagaccccagcgccctgatgagccacaccacagccttcccccacgtggccgccaccctgagcatcatggacagcaccttcaaggcccccagcgctgtgagccccatcccagctgtgatccccagccccagccacaagcccagcaagaccaagaccagcaagagcagcaaggtgaaggacctgagcaccaggagtgatgagagccccagcaacaagaagaggaagccccagagcagcaccagcagcagcagcagcagcagcagcagcagcctgcagaccagcctgagcagccccctgagcggcccccacaagaagaactgtgtgctgaatgccagcagcgccctgaacagctaccaggccgccccaccctacaacagcctgtctgtgcacaacagcaacaatggagtgagccccctgagcgccaagctggagcccagcggccgcaccagcctgcccggcggccctgctgacatcgtgcggcaggtgggcgctgtgggcggcagcagtgacagctgccccctgtctgtgcccagcctggccctgcacgccggggacctgagcctggccagccacaatgctgtgagcagcctgcccctgagctttgacaagtctgagggcaagaagaggaagaacagcagcagcagcagcaaggcctgcaagatcaccaagatgcctggcatgaacagcgtgcacaagaagaacccccccagcctgctggcccctgtgcctgaccctgtgaacagcaccagcagccggcaggtgcgggacctgctggccccacccagccctgccctgggcggccggggctcctgggccgcccccctgctgagccgggccgcccccactggaaacaccagcctcatccctgtgctggtgtttcctgagggcagcttccaccccctgctgtag

SEQ ID NO: 35698 - DNA, 2586 bp, Artificial Sequence
  Description of Artificial Sequence: Synthetic coding sequence
atgaccagcgagaggagccgcatcccctgcctgtctgctgctgctgctgagggcaccgggaagaagcagcaggagggccgggccatggccaccctggacaggaaggtgcccagccctgaggccttcctgggcaagccctggagctcctggattgatgctgccaagctgcactgcagcgacaacgtggacctggaggaggccggcaaggagggcggcaagagccgggaggtgatgaggctgaacaaggaggacatgcacctgtttggccactacccagcccatgatgacttctacctggtggtgtgcagcgcctgcaaccaggtggtgaagccccaggtgttccagagccactgtgagcggcggcacggctccatgtgccggcccagccccagccctgtgtccccagccagcaaccccaggaccagcctggtgcaggtgaagaccaaggcctgcctgagcggccaccacagcgccagcagcaccagcaagcccttcaagacccccaaggacaacctgctgaccagcagcagcaagcagcacacagtgtttcctgccaagggcagccgggacaagccctgtgtgcctgtgcctgtggtgtccctggagaagatccccaacctggtgaaggcagatggagccaacgtgaagatgaacagcaccaccaccacagctgtgtctgccagcagcaccagcagcagcgctgtgtccaccccacccctcatcaagcctgtgctgatgagcaagtctgtgccccccagccctgagaagatcctgaatggcaagggcatcctgcccaccaccatcgacaagaagcaccagaatggcaccaagaacagcaacaagccctaccgccgcctgtctgagcgggagtttgaccccaacaagcactgcggcgtgctggaccctgagaccaagaagccctgcaccaggagcctgacctgcaagacccacagcctgagccaccggcgggctgtgcccggcaggaagaagcagtttgacctgctgctggccgagcacaaggccaagagccgggagaaggaggtgaaggacaaggagcacctgctgaccagcacccgggagatcctgcccagccagagcggccctgcccaggacagcctgctgggcagcagcggcagcagcggccctgagcccaaggtggccagccctgccaagagccggccccccaacagcgtgctgccccggcccagcagcgccaacagcatcagcagcagcaccagcagcaaccacagcggccacaccccagagccccccctgccccctgtgggcggggacctggccagccggctgagcagtgatgaaggagagatggatggagcagatgaaagtgagaagctggactgccagttcagcacccaccacccccggcccctggccttctgcagctttggcagccggctgatgggccggggctactacgtgtttgaccggcgctgggaccgcttccgctttgccctgaacagcatggtggagaagcacctgaacagccagatgtggaagaagatccccccagctgctgacagccccctgcccagccctgctgcccacatcaccacccctgtgcctgcctctgtgctgcagcccttcagcaaccccagcgctgtgtacctgcccagcgcccccatcagcagccggctgaccagcagctacatcatgaccagcgccatgctgagcaatgctgcctttgtgaccagcccagaccccagcgccctgatgagccacaccacagccttcccccacgtggccgccaccctgagcatcatggacagcaccttcaaggcccccagcgctgtgagccccatcccagctgtgatccccagccccagccacaagcccagcaagaccaagaccagcaagagcagcaaggtgaaggacctgagcaccaggagtgatgagagccccagcaacaagaagaggaagccccagagcagcaccagcagcagcagcagcagcagcagcagcagcctgcagaccagcctgagcagccccctgagcggcccccacaagaagaactgtgtgctgaatgccagcagcgccctgaacagctaccaggccgccccaccctacaacagcctgtctgtgcacaacagcaacaatggagtgagccccctgagcgccaagctggagcccagcggccgcaccagcctgcccggcggccctgctgacatcgtgcggcaggtgggcgctgtgggcggcagcagtgacagctgccccctgtctgtgcccagcctggccctgcacgccggggacctgagcctggccagccacaatgctgtgagcagcctgcccctgagctttgacaagtctgagggcaagaagaggaagaacagcagcagcagcagcaaggcctgcaagatcaccaagatgcctggcatgaacagcgtgcacaagaagaacccccccagcctgctggcccctgtgcctgaccctgtgaacagcaccagcagccggcaggtgggcaagaacagcagcctggccctgagccagagcagccccagcagcatcagcagccctggccacagccggcagaacaccaacagaacaggccgcatccgcaccctgccctag

SEQ ID NO: 35699 - DNA, 2217 bp, Artificial Sequence
  Description of Artificial Sequence: Synthetic coding sequence
atgtgccggcccagccccagccctgtgtccccagccagcaaccccaggaccagcctggtgcaggtgaagaccaaggcctgcctgagcggccaccacagcgccagcagcaccagcaagcccttcaagacccccaaggacaacctgctgaccagcagcagcaagcagcacacagtgtttcctgccaagggcagccgggacaagccctgtgtgcctgtgcctgtggtgtccctggagaagatccccaacctggtgaaggcagatggagccaacgtgaagatgaacagcaccaccaccacagctgtgtctgccagcagcaccagcagcagcgctgtgtccaccccacccctcatcaagcctgtgctgatgagcaagtctgtgccccccagccctgagaagatcctgaatggcaagggcatcctgcccaccaccatcgacaagaagcaccagaatggcaccaagaacagcaacaagccctaccgccgcctgtctgagcgggagtttgaccccaacaagcactgcggcgtgctggaccctgagaccaagaagccctgcaccaggagcctgacctgcaagacccacagcctgagccaccggcgggctgtgcccggcaggaagaagcagtttgacctgctgctggccgagcacaaggccaagagccgggagaaggaggtgaaggacaaggagcacctgctgaccagcacccgggagatcctgcccagccagagcggccctgcccaggacagcctgctgggcagcagcggcagcagcggccctgagcccaaggtggccagccctgccaagagccggccccccaacagcgtgctgccccggcccagcagcgccaacagcatcagcagcagcaccagcagcaaccacagcggccacaccccagagccccccctgccccctgtgggcggggacctggccagccggctgagcagtgatgaaggagagatggatggagcagatgaaagtgagaagctggactgccagttcagcacccaccacccccggcccctggccttctgcagctttggcagccggctgatgggccggggctactacgtgtttgaccggcgctgggaccgcttccgctttgccctgaacagcatggtggagaagcacctgaacagccagatgtggaagaagatccccccagctgctgacagccccctgcccagccctgctgcccacatcaccacccctgtgcctgcctctgtgctgcagcccttcagcaaccccagcgctgtgtacctgcccagcgcccccatcagcagccggctgaccagcagctacatcatgaccagcgccatgctgagcaatgctgcctttgtgaccagcccagaccccagcgccctgatgagccacaccacagccttcccccacgtggccgccaccctgagcatcatggacagcaccttcaaggcccccagcgctgtgagccccatcccagctgtgatccccagccccagccacaagcccagcaagaccaagaccagcaagagcagcaaggtgaaggacctgagcaccaggagtgatgagagccccagcaacaagaagaggaagccccagagcagcaccagcagcagcagcagcagcagcagcagcagcctgcagaccagcctgagcagccccctgagcggcccccacaagaagaactgtgtgctgaatgccagcagcgccctgaacagctaccaggccgccccaccctacaacagcctgtctgtgcacaacagcaacaatggagtgagccccctgagcgccaagctggagcccagcggccgcaccagcctgcccggcggccctgctgacatcgtgcggcaggtgggcgctgtgggcggcagcagtgacagctgccccctgtctgtgcccagcctggccctgcacgccggggacctgagcctggccagccacaatgctgtgagcagcctgcccctgagctttgacaagtctgagggcaagaagaggaagaacagcagcagcagcagcaaggcctgcaagatcaccaagatgcctggcatgaacagcgtgcacaagaagaacccccccagcctgctggcccctgtgcctgaccctgtgaacagcaccagcagccggcaggtgggcaagaacagcagcctggccctgagccagagcagccccagcagcatcagcagccctggccacagccggcagaagaacaccaacagaacaggccgcatccgcaccctgccctag

SEQ ID NO: 35700 - DNA, 1050 bp, Artificial Sequence
  Description of Artificial Sequence: Synthetic coding sequence
atgccccggggcggcacccaggccagcagcgaggagagcgaggaggagggcaccagtgatgacctgcaccccccaccagactgccactacgccacccggcccccccggccccaggccttctgcaccttcggcagccggctggtgtccccaggctgctacgtgttcagccggcggctggaccgcttctgcagcgccctgagctccatgctggagcggcacctgagcacccacatgtggaagaagatccccccagctgctgagcccccagcccacctggtgaacagccccctgagcgcccccctgagccccagcagcacaggcacctgcccccggctgcccggccccaccctgcggcctgcctgcccagcctccatgccacccaccaaggacaacctggtgcccagctacccagctggcagccccagcgtggccgccgcctgcagccaggccgagtgcatgggcggcagccaggccatcaccagccccctgcctgccaacacccccagccccagcttcagcaagctgccccccagcaaggccagcaagagcagcaagggcaaggatggagtggaggtggaggcccccagcaggaagaggaagctgagccctggccccaccaccctgaagaggacctgcatcctggagcccaccgggaagggcaagcccagcggctgccggggcctgagcgccaagaccaagacagccctgtccatgggcctgaatggcaccatgggcccccgggtgaagagagctggccccctggactgccggggcagcccccaccagctgcccacccctgtgaaggccagccagctggagaacagaggagctgctggccacccagccaaggccctgcccaccaactgcctgtctgaggaggaggtggccaagaagaggaagaacctggccacctactgcaggcctgtgaaggccaagcactgccaggccggggccccagcagatgtggcctgcagcgtgcggaggaagaagccaggccctgccctggcctttgaggagaagtgcagcaccctgaagagcaaggcccactag

SEQ ID NO: 35701 - DNA, 2169 bp, Artificial Sequence
  Description of Artificial Sequence: Synthetic coding sequence
atggctgtgcgggagagagctgctgctgccatggccgccctggagcggcgggtgcccagcctggatgactttgctggccagagctggagctcctgggtggagagagctgacctgcctgctgctgatggagctgagctggaggagagcagcaagaacaccaagaagctggatgccatgaccctcatcaaggaggacatgagcatcttcggccactgcccagcccatgatgacttctacctggtggtgtgcaaccactgcagccaggtggtgaagccccaggccttccagaagcactgtgaaagaagacatggccccctgagcaagctgtatggccgggcccctcctcctcctccagccccagccagcagccagaagtgccacgtggtgaatggccagggccctgcctgccgggcccctggcagcaccaagaccagcagccgggagaagggccagggcagccgcagccggggccaccagcccccagagaagacccagaaggacaacctgtgccagcccggcggcctgaccaaggacagccctgggaagccacccatggccccacccagcaaggagcccccaggccgggagaacatcgagatcatccccagcgagggcagcagccactgggccgagggcagccccccagagaaggagcccagcggcacccggctgccccccaagacccacaggaagatggccaggaaagaatgtgacctgaaccggcagtgtggggtcatcaaccctgagaccaagaagatctgcacccggctgctgacctgcaagatccacagcgtgcaccagaggcgggaggtgcagggccgggccaaggactttgatgtgctggtggccgagctgaaggccaacagcaggaaaggagagagccccaaggagaagagccctggcaggaaggagcaggtgctggagcggcccagccaggagctgcccagctctgtgcaggtggtggccgctgtggccgcccccagcagcaccttctctgtgcgggccaagcagacctacccctactgtgccctgcccaggagccgggccagcagcgagagcgagctggatgatgagggcccctgtggaggagatggagaccccggcctcttccccttccccatgccccggggcggcacccaggccagcagcgaggagagcgaggaggagggcaccagtgatgacctgcaccccccaccagactgccactacgccaccaggcctccccggccccaggccttctgcaccttcggcagccggctggtgtccccaggctgctacgtgttcagccggcggctggaccgcttctgcagcgccctgagctccatgctggagcggcacctgagcacccacatgtggaagaagatccccccagctgctgagcccccagcccacctggtgaacagccccctgagcgcccccctgagccccagcagcacaggcacctgcccccggctgcccggccccaccctgcggcctgcctgcccagcctccatgccacccaccaaggacaacctggtgcccagctacccagctggcagccccagcgtggccgccgcctgcagccaggccgagtgcatgggcggcagccaggccatcaccagccccctgcctgccaacacccccagccccagcttcagcaagctgccccccagcaaggccagcaagagcagcaagggcaaggatggagtggaggtggaggcccccagcaggaagaggaagctgagccctggccccaccaccctgaagaggacctgcatcctggagcccaccgggaagggcaagcccagcggctgccggggcctgagcgccaagaccaagacagccctgtccatgggcctgaatggcaccatgggcccccgggtgaagagagctggccccctggactgccggggcagcccccaccagctgcccacccctgtgaaggccagccagctggagaacagaggagctgctggccacccagccaaggccctgcccaccaactgcctgtctgaggaggaggtggccaagaagaggaagaacctggccacctactgcaggcctgtgaaggccaagcactgccaggccggggccccagcagatgtggcctgcagcgtgcggaggaagaagccaggccctgccctggcctttgaggagaagtgcagcaccctgaagagcaaggcccactag

SEQ ID NO: 35702 - DNA, 1743 bp, Artificial Sequence
  Description of Artificial Sequence: Synthetic coding sequence
atggctgtgcgggagagagctgctgctgccatggccgccctggagcggcgggtgcccagcctggatgactttgctggccagagctggagctcctgggtggagagagctgacctgcctgctgctgatggagctgagctggaggagagcagcaagaacaccaagaagctggatgccatgaccctcatcaaggaggacatgagcatcttcggccactgcccagcccatgatgacttctacctggtggtgtgcaaccactgcagccaggtggtgaagccccaggccttccagaagcactgtgaaagaagacatggccccctgagcaagctgtatggccgggcccctcctcctcctccagccccagccagcagccagaagtgccacgtggtgaatggccagggccctgcctgccgggcccctggcagcaccaagaccagcagccgggagaagggccagggcagccgcagccggggccaccagcccccagagaagacccagaaggacaacctgtgccagcccggcggcctgaccaaggacagccctgggaagccacccatggccccacccagcaaggagcccccaggccgggagaacatcgagatcatccccagcgagggcagcagccactgggccgagggcagccccccagagaaggagcccagcggcacccggctgccccccaagacccacaggaagatggccaggaaagaatgtgacctgaaccggcagtgtggggtcatcaaccctgagaccaagaagatctgcacccggctgctgacctgcaagatccacagcgtgcaccagaggcgggaggtgcagggccgggccaaggactttgatgtgctggtggccgagctgaaggccaacagcaggaaaggagagagccccaaggagaagagccctggcaggaaggagcaggtgctggagcggcccagccaggagctgcccagctctgtgcaggtggtggccgctgtggccgcccccagcagcaccttctctgtgcgggccaagcagacctacccctactgtgccctgcccaggagccgggccagcagcgagagcgagctggatgatgagggcccctgtggaggagatggagaccccggcctcttccccttccccatgccccggggcggcacccaggccagcagcgaggagagcgaggaggagggcaccagtgatgacctgcaccccccaccagactgccactacgccaccaggcctccccggccccaggccttctgcaccttcggcagccggctggtgtccccaggctgctacgtgttcagccggcggctggaccgcttctgcagcgccctgagctccatgctggagcggcacctgagcacccacatgtggaagaagatccccccagctgctgagcccccagcccacctggtgaacagccccctgagcgcccccctgagccccagcagcacaggcacctgcccccggctgcccggccccaccctgcggcctgcctgcccagcctccatgccacccaccaaggacaacctggtgcccagctacccagctggcagccccagcgtggccgccgcctgcagccaggccgagtgcatgggagagcccggctaccacctgaccacagcctgccagcacgccatccctgtgctgcagcaggccgccgccttccagggccagcaggtgatccagaggcagggccggggcggcggcggcggccccttcagcaaggccgaggtgatcccctggccctaccacagctag

SEQ ID NO: 35703 - DNA, 294 bp, Artificial Sequence
  Description of Artificial Sequence: Synthetic coding sequence
atggaggagatcagcctggccaacctggacaccaacaagctggaggccatcgcccaggagatctacgtggacctgattgaggacagctgcctgggcttctgctttgaggtgcacagagctgtgaagtgtggctacttctacctggagtttgctgagactggatctgtgaaggactttggcatccagcctgtggaggacaagggggcctgccgcctgcccctgtgcagcctgcccggggagcctggaaatggaccagaccagcagctgcagaggagccccccagagttccagtag

SEQ ID NO: 35704 - DNA, 1860 bp, Artificial Sequence
  Description of Artificial Sequence: Synthetic coding sequence
atgctgctggccagcgctgtggtggtgtgggagtggctgaatgagcacggccgctggaggccctacagccctgctgtgagccaccacatcgaggccgtggtgcgggccggcccccgggccggcggctctgtggtgctgggccaggtggacagccggctggccccctacatcatcgacctgcagagcatgaaccagttccggcaggacaccggcaccctgcggcctgtgagaagaaactactatgaccccagcagcgcccctggaaaaggagtggtgtgggagtgggagaatgacaatggctcctggaccccctatgacatggaggtgggcatcaccatccagcacgcctatgagaagcagcacccctggattgacctgaccagcatcggcttctcctatgtgattgacttcaacaccatgggccagatcaaccggcagacccagaggcagaggagagtgagaagaaggctggacctgatctaccccatggtgacaggcaccctgcccaaggcccagagctggcctgtgtccccaggccctgccaccagcccccccatgagcccctgcagctgcccccagtgtgtgctggtgatgtctgtgaaggctgctgtggtgaatggcagcacaggccccctgcagctgcctgtgaccaggaagaacatgcctcctcctggggtggtgaagctgccccccctgcccggcagcggggccaagcccctggacagcacaggcaccatccggggccccctgaagacagcccccagccaggtgatccggcggcaggccagctccatgcccaccggcaccaccatgggcagccctgccagccccccaggccccaacagcaagacaggccgggtggccctggccaccctgaacagaaccaacctgcagaggctggccatcgcccagagccgggtgctgattgccagcggcgtgcccaccgtgcctgtgaagaacctgaatggcagcagccctgtgaacccagccctggccggcatcaccggcatcctgatgtctgctgctggcctgcctgtgtgcctgaccaggcctcccaagctggtgctgcaccccccacctgtgtccaagtctgagatcaagagcatccctggggtgagcaacaccagcaggaagaccaccaagaagcaggccaagaagggcaagaccccagaggaggtgctgaagaagtacctgcagaaggtgcgccaccccccagatgaggactgcaccatctgcatggagcggctgacagcccccagcggctacaagggcccccagcccaccgtgaagccagacctggtgggcaagctgagccgctgtggccacgtgtaccacatctactgcctggtggccatgtacaacaatggaaacaaggatggcagcctgcagtgccccacctgcaagaccatctatggagtgaagacaggcacccagcccccaggcaagatggagtaccacctgatcccccacagcctgcccggccacccagactgcaagaccatccgcatcatctacagcatccccccaggcatccagggccctgagcaccccaaccctgggaagagcttcagcgcccggggcttccccaggcactgctacctgcctgattctgagaagggcaggaaggtgctgaagctgctgctggtggcctgggacagaagactcatctttgccatcggcaccagcagcaccactggagagagtgacaccgtcatctggaatgaggtgcaccacaagacagaatttggcagcaacctgactggacatggctacccagatgccaactacctggacaacgtgctggccgagctggccgcccagggcatcagcgaggacagcacagcccaggagaaggactag

SEQ ID NO: 35705 - DNA, 996 bp, Artificial Sequence
  Description of Artificial Sequence: Synthetic coding sequence
atggctgtggccatggtgaagctgtgtgagcgggccggcctgcccctgctggccgcccccctgctgcggagcctgctgccccgggccccccagcccggccctgcccagcccaggtctgtgcagggccagcgctgcccagcccggcaccccccaggcaacctggtgtgtgagcggggggccggcgtgaatggagtgacagctggagctgggggccgcctgcggggcctgcacagaggaggccgggccctgggctgcagcgcccaccggcccctgcacagcgcccgggtgcggcccccagcccacctggccgcccctcctggcagcagcgcccggggctgccgcctgacagagctgggctacgccctgaatgagtggctgcaggacatcaggaagaaccagctgcccggcctgctgggcggcgtgggccccatgcacagcgtggtgcagctgttccagggcttccgggacctgctgtggctgcccatcgagcagtacaggaaggatggccgcctgatgaggggcctgcagagaggagctgccagctttggcagcagcacagccagcgctgccctggagctgagcaaccggctggtgcaggccatccaggccacagctgagaccgtgtatgacatcctgagccctgctgcccctgtgagccgcagcctgcaggacaagaggtctgcccggcggctgcggcggggccagcagcctgctgacctgcgggagggcgtggccaaggcctatgacacagtgcgggagggcatcctggacacagcccagaccatctgtgatgtggccagccggggccacgagcagaagggcctgaccggggctgtgggcggcgtcatccggcagctgcccccaacagtggtgaagcccctcatcctggccacagaggccaccagcagcctgctgggcggcatgaggaaccagatcgtgcctgatgcccacaaggaccacgccctgaagtggaggagtgacagcgcccaggactag

SEQ ID NO: 35706 - DNA, 5817 bp, Artificial Sequence
  Description of Artificial Sequence: Synthetic coding sequence
atgagccgctggctgtggccctggagcaactgtgtgaaggagcgggtgtgccgctacctgctgcaccactacctgggccacttcttccaggagcacctgagcctggaccagctgagcctggacctgtacaagggctctgtggccctgcgggacatccacctggagatctggagcgtgaatgaggtgctggagagcatggagagccccctggagctggtggagggctttgtgggcagcattgaggtggccgtgccctgggccgccctgctgacagaccactgcaccgtgcgggtgtctggcctgcagctgaccctgcagccccggcggggccctgcccctggagctgctgacagccagagctgggccagctgcatgaccaccagcctgcagctggcccaggagtgcctgagagatggcctgcctgagcccagcgagcccccccagcccctggagggcctggagatgtttgcccagaccatcgagaccgtgctgcggcgcatcaaggtgaccttcctggacacagtggtgcgggtggagcacagccctggagatggagagcggggcgtggccgtggaggtgcgggtgcagaggctggagtactgtgatgaggccgtgcgggaccccagccaggcccctcctgtggatgtgcaccagcccccagccttcctgcacaagctgctgcagctggccggcgtgcggctgcactatgaggagctgcctgcccaggaggagcccccagagccccccctgcagatcggcagctgcagcggctacatggagctgatggtgaagctgaagcagaatgaggccttccctggccccaagctggaggtggccggccagctgggcagcctgcacctgctgctgaccccccggcagctgcagcagctgcaggagctgctgtctgctgtgtccctgacagaccacgagggcctggccgacaagctgaacaagagccggcccctgggcgctgaggacctgtggctgattgagcaggacctgaaccagcagctgcaggccggggctgtggccgagcccctgagcccagaccccctgaccaaccccctgctgaacctggacaacacagacctcttcttctccatggccggcctgaccagctctgtggccagcgccctgtctgagctgagcctgagtgatgtggacctggccagctctgtgcggagtgacatggccagccggcggctgagcgcccaggcccaccctgctgggaagatggcccccaaccccctgctggacaccatgaggccagacagcctgctgaagatgaccctgggcggcgtgaccctgaccctgctgcagaccagcgcccccagcagcggccccccagacctggccacccacttcttcacagaatttgatgccaccaaggatggccccttcggcagccgggacttccaccacctgcggccccgcttccagagggcctgcccctgcagccacgtgcggctgactggaacagctgtgcagctgtcctgggagctgaggacaggcagccggggccgccgcaccacctccatggaggtgcacttcggccagctggaggtgctggagtgcctgtggccccggggcaccagcgagcctgagtacacagagatcctgaccttccctggcaccctgggcagccaggccagcgcccggccctgtgcccacctgcggcacacccagatcctgcggcgggtgcccaagagccggcccaggagatctgtggcctgccactgccacagcgagctggccctggacctggccaacttccaggctgatgtggagctgggcgccctggaccggctggccgccctgctgcggctggccaccgtgcctgctgagcccccagctggcctgctgacagagcccctgcctgccatggagcagcagaccgtcttccggctgagcgccccccgggccaccctgcggctgcgcttccccatcgctgacctgcggcctgagccagacccctgggccggccaggccgtgcgggcagagcagctgcggctggagctgtctgagccccagttccgctctgagctgagcagcggccctggcccccctgtgcccacccacctggagctgacctgcagcgacctgcacggcatctatgaagatggcggcaagccccctgtgccctgcctgcgggtgtccaaggccctggaccccaagagcactggaaggaagtacttcctgccccaggtggtggtgacagtgaacccccagagcagcagcacccagtgggaggtggcccctgagaagggggaggagctggagctgtctgtggagagcccctgtgagctgcgggagcctgagcccagccccttcagcagcaagaggaccatgtatgaaacagaggagatggtgattcctggggaccctgaggagatgaggaccttccagagcaggaccctggccctgagccgctgcagcctggaggtgatcctgcccagcgtgcacatcttcctgcccagcaaggaggtgtatgagagcatctacaaccgcatcaacaatgacctgctgatgtgggagcctgctgacctgctgcccaccccagaccctgctgcccagcccagcggcttccctggccccagcggcttctggcatgacagcttcaagatgtgcaagagcgccttcaagctggccaactgctttgacctgaccccagacagcgacagtgatgatgaagatgcccacttcttctctgtgggcgccagcggcggcccccaggccgccgcccctgaggcccccagcctgcacctgcagagcaccttcagcaccctggtgacagtgctgaagggccgcatcacagccctgtgtgagaccaaggatgaaggaggcaagaggctggaggccgtgcatggagagctggtgctggacatggagcacggcaccctcttctctgtgtcccagtactgcggccagcccggcctgggctacttctgcctggaggccgagaaggccaccctgtaccacagagctgctgtggatgactaccccctgcccagccacctggacctgcccagctttgcccccccagcccagctggcccccaccatctaccccagcgaggagggcgtgacagagcggggggccagcggcaggaagggccagggccggggcccccacatgctgagcacagctgtgcgcatccacctggacccccacaagaatgtgaaggagttcctggtgaccctgcggctgcacaaggccaccctgcggcactacatggccctgcctgagcagagctggcacagccagctgctggagttcctggatgtgctggatgatcctgtgctgggctacctgcccccaacagtcatcaccatcctgcacacccacctgttcagctgcagcgtggactaccggcccctgtacctgcctgtgcgggtgctgatcacagctgagaccttcaccctgagcagcaacatcatcatggacaccagcaccttcctgctgcgcttcatcctggatgattctgccctgtacctgagtgacaagtgtgaggtggagaccctggacctgcggcgggactatgtgtgtgtgctggatgtggacctgctggagctggtgatcaagacctggaagggcagcacagagggcaagctgagccagcccctgtttgagctgcgctgcagcaacaacgtggtgcacgtgcacagctgtgccgacagctgtgccctgctggtgaacctgctgcagtatgtgatgagcactggagacctgcaccccccacccaggcctcccagccccacagaaattgctggccagaagctgtctgagagccctgccagcctgcccagctgcccccctgtggagacagccctgatcaaccagagggacctggctgatgccctgctggacacagagaggagcctgcgggagctggcccagcccagcggcggccacctgccccaggccagccccatctctgtgtacctgtttcctggagagaggtctggggcccccccacccagcccccctgtgggcggccctgctggcagcctgggcagctgcagcgaggagaaggaggatgagcgggaggaggagggagatggagacaccctggacagtgatgagttctgcatcctggatgcccctggcctgggcatccccccaagagatggagagcctgtggtgacccagctgcaccctggccccatcgtggtgagagatggctacttcagccggcccatcggcagcacagacctgctgcgggccccagcccacttccctgtgcccagcaccagggtggtgctgcgggaggtgtccctggtgtggcacctgtatggaggccgggactttggcccccaccctggccaccgggccaggacaggcctgagcggccccaggagcagccccagccgctgcagcggccccaaccggccccagaacagctggaggacccagggcggcagcggccggcagcaccacgtgctgatggagatccagctgagcaaggtgtccttccagcacgaggtgtacccagctgagcccgccaccggccctgctgcccccagccaggagctggaggagcggcccctgagccggcaggtgttcatcgtgcaggagctggaggtgcgggaccggctggccagcagccagatcaacaagttcctgtacctgcacaccagcgagaggatgccccggcgggcccacagcaacatgctgaccatcaaggccctgcacgtggcccccaccaccaacctgggcggccctgagtgctgcctgcgggtgtccctgatgcccctgcggctgaatgtggaccaggatgccctcttcttcctgaaggacttcttcaccagcctggtggccggcatcaaccctgtggtgcctggagagaccagcgctgaggcccggcctgagacccgggcccagcccagcagccccctggagggccaggccgagggcgtggagaccaccggcagccaggaggcccctgggggcggccacagccccagccccccagaccagcagcccatctacttccgggagttccgcttcaccagcgaggtgcccatctggctggactaccacggcaagcacgtgaccatggaccaggtgggcacctttgctggcctgctgattggcctggcccagctgaactgcagcgagctgaagctgaagaggctgtgctgccgccacggcctgctgggcgtggacaaggtgctgggctacgccctgaatgagtggctgcaggacatcaggaagaaccagctgcccggcctgctgggcggcgtgggccccatgcacagcgtggtgcagctgttccagggcttccgggacctgctgtggctgcccatcgagcagtacaggaaggatggccgcctgatgaggggcctgcagagaggagctgccagctttggcagcagcacagccagcgctgccctggagctgagcaaccggctggtgcaggccatccaggccacagctgagaccgtgtatgacatcctgagccctgctgcccctgtgagccgcagcctgcaggacaagaggtctgcccggcggctgcggcggggccagcagcctgctgacctgcgggagggcgtggccaaggcctatgacacagtgcgggagggcatcctggacacagcccagaccatctgtgatgtggccagccggggccacgagcagaagggcctgactggagctgtgggcggcgtcatccggcagctgccccccaccgtggtgaagcccctcatcctggccacagaggccaccagcagcctgctgggcggcatgaggaaccagatcgtgcctgatgcccacaaggaccacgccctgaagtggaggagtgacagcgcccaggactag

SEQ ID NO: 35707 - DNA, 5823 bp, Artificial Sequence
  Description of Artificial Sequence: Synthetic coding sequence
atgagccgctggctgtggccctggagcaactgtgtgaaggagcgggtgtgccgctacctgctgcaccactacctgggccacttcttccaggagcacctgagcctggaccagctgagcctggacctgtacaagggctctgtggccctgcgggacatccacctggagatctggagcgtgaatgaggtgctggagagcatggagagccccctggagctggtggagggctttgtgggcagcattgaggtggccgtgccctgggccgccctgctgacagaccactgcaccgtgcgggtgtctggcctgcagctgaccctgcagccccggcggggccctgcccctggagctgctgacagccagagctgggccagctgcatgaccaccagcctgcagctggcccaggagtgcctgagagatggcctgcctgagcccagcgagcccccccagcccctggagggcctggagatgtttgcccagaccatcgagaccgtgctgcggcgcatcaaggtgaccttcctggacacagtggtgcgggtggagcacagccctggagatggagagcggggcgtggccgtggaggtgcgggtgcagaggctggagtactgtgatgaggccgtgcgggaccccagccaggcccctcctgtggatgtgcaccagcccccagccttcctgcacaagctgctgcagctggccggcgtgcggctgcactatgaggagctgcctgcccaggaggagcccccagagccccccctgcagatcggcagctgcagcggctacatggagctgatggtgaagctgaagcagaatgaggccttccctggccccaagctggaggtggccggccagctgggcagcctgcacctgctgctgaccccccggcagctgcagcagctgcaggagctgctgtctgctgtgtccctgacagaccacgagggcctggccgacaagctgaacaagagccggcccctgggcgctgaggacctgtggctgattgagcaggacctgaaccagcagctgcaggccggggctgtggccgagcccctgagcccagaccccctgaccaaccccctgctgaacctggacaacacagacctcttcttctccatggccggcctgaccagctctgtggccagcgccctgtctgagctgagcctgagtgatgtggacctggccagctctgtgcggagtgacatggccagccggcggctgagcgcccaggcccaccctgctgggaagatggcccccaaccccctgctggacaccatgaggccagacagcctgctgaagatgaccctgggcggcgtgaccctgaccctgctgcagaccagcgcccccagcagcggccccccagacctggccacccacttcttcacagaatttgatgccaccaaggatggccccttcggcagccgggacttccaccacctgcggccccgcttccagagggcctgcccctgcagccacgtgcggctgactggaacagctgtgcagctgtcctgggagctgaggacaggcagccggggccgccgcaccacctccatggaggtgcacttcggccagctggaggtgctggagtgcctgtggccccggggcaccagcgagcctgagtacacagagatcctgaccttccctggcaccctgggcagccaggccagcgcccggccctgtgcccacctgcggcacacccagatcctgcggcgggtgcccaagagccggcccaggagatctgtggcctgccactgccacagcgagctggccctggacctggccaacttccaggctgatgtggagctgggcgccctggaccggctggccgccctgctgcggctggccaccgtgcctgctgagcccccagctggcctgctgacagagcccctgcctgccatggagcagcagaccgtcttccggctgagcgccccccgggccaccctgcggctgcgcttccccatcgctgacctgcggcctgagccagacccctgggccggccaggccgtgcgggcagagcagctgcggctggagctgtctgagccccagttccgctctgagctgagcagcggccctggcccccctgtgcccacccacctggagctgacctgcagcgacctgcacggcatctatgaagatggcggcaagccccctgtgccctgcctgcgggtgtccaaggccctggaccccaagagcactggaaggaagtacttcctgccccaggtggtggtgacagtgaacccccagagcagcagcacccagtgggaggtggcccctgagaagggggaggagctggagctgtctgtggagagcccctgtgagctgcgggagcctgagcccagccccttcagcagcaagaggaccatgtatgaaacagaggagatggtgattcctggggaccctgaggagatgaggaccttccagagcaggaccctggccctgagccgctgcagcctggaggtgatcctgcccagcgtgcacatcttcctgcccagcaaggaggtgtatgagagcatctacaaccgcatcaacaatgacctgctgatgtgggagcctgctgacctgctgcccaccccagaccctgctgcccagcccagcggcttccctggccccagcggcttctggcatgacagcttcaagatgtgcaagagcgccttcaagctggccaactgctttgacctgaccccagacagcgacagtgatgatgaagatgcccacttcttctctgtgggcgccagcggcggcccccaggccgccgcccctgaggcccccagcctgcacctgcagagcaccttcagcaccctggtgacagtgctgaagggccgcatcacagccctgtgtgagaccaaggatgaaggaggcaagaggctggaggccgtgcatggagagctggtgctggacatggagcacggcaccctcttctctgtgtcccagtactgcggccagcccggcctgggctacttctgcctggaggccgagaaggccaccctgtaccacagagctgctgtggatgactaccccctgcccagccacctggacctgcccagctttgcccccccagcccagctggcccccaccatctaccccagcgaggagggcgtgacagagcggggggccagcggcaggaagggccagggccggggcccccacatgctgagcacagctgtgcgcatccacctggacccccacaagaatgtgaaggagttcctggtgaccctgcggctgcacaaggccaccctgcggcactacatggccctgcctgagcagagctggcacagccagctgctggagttcctggatgtgctggatgatcctgtgctgggctacctgcccccaacagtcatcaccatcctgcacacccacctgttcagctgcagcgtggactaccggcccctgtacctgcctgtgcgggtgctgatcacagctgagaccttcaccctgagcagcaacatcatcatggacaccagcaccttcctgctgcgcttcatcctggatgattctgccctgtacctgagtgacaagtgtgaggtggagaccctggacctgcggcgggactatgtgtgtgtgctggatgtggacctgctggagctggtgatcaagacctggaagggcagcacagagggcaagctgagccagcccctgtttgagctgcgctgcagcaacaacgtggtgcacgtgcacagctgtgccgacagctgtgccctgctggtgaacctgctgcagtatgtgatgagcactggagacctgcaccccccacccaggcctcccagccccacagaaattgctggccagaaggtgcagctgtctgagagccctgccagcctgcccagctgcccccctgtggagacagccctgatcaaccagagggacctggctgatgccctgctggacacagagaggagcctgcgggagctggcccagcccagcggcggccacctgccccaggccagccccatctctgtgtacctgtttcctggagagaggtctggggcccccccacccagcccccctgtgggcggccctgctggcagcctgggcagctgcagcgaggagaaggaggatgagcgggaggaggagggagatggagacaccctggacagtgatgagttctgcatcctggatgcccctggcctgggcatccccccaagagatggagagcctgtggtgacccagctgcaccctggccccatcgtggtgagagatggctacttcagccggcccatcggcagcacagacctgctgcgggccccagcccacttccctgtgcccagcaccagggtggtgctgcgggaggtgtccctggtgtggcacctgtatggaggccgggactttggcccccaccctggccaccgggccaggacaggcctgagcggccccaggagcagccccagccgctgcagcggccccaaccggccccagaacagctggaggacccagggcggcagcggccggcagcaccacgtgctgatggagatccagctgagcaaggtgtccttccagcacgaggtgtacccagctgagcccgccaccggccctgctgcccccagccaggagctggaggagcggcccctgagccggcaggtgttcatcgtgcaggagctggaggtgcgggaccggctggccagcagccagatcaacaagttcctgtacctgcacaccagcgagaggatgccccggcgggcccacagcaacatgctgaccatcaaggccctgcacgtggcccccaccaccaacctgggcggccctgagtgctgcctgcgggtgtccctgatgcccctgcggctgaatgtggaccaggatgccctcttcttcctgaaggacttcttcaccagcctggtggccggcatcaaccctgtggtgcctggagagaccagcgctgaggcccggcctgagacccgggcccagcccagcagccccctggagggccaggccgagggcgtggagaccaccggcagccaggaggcccctgggggcggccacagccccagccccccagaccagcagcccatctacttccgggagttccgcttcaccagcgaggtgcccatctggctggactaccacggcaagcacgtgaccatggaccaggtgggcacctttgctggcctgctgattggcctggcccagctgaactgcagcgagctgaagctgaagaggctgtgctgccgccacggcctgctgggcgtggacaaggtgctgggctacgccctgaatgagtggctgcaggacatcaggaagaaccagctgcccggcctgctgggcggcgtgggccccatgcacagcgtggtgcagctgttccagggcttccgggacctgctgtggctgcccatcgagcagtacaggaaggatggccgcctgatgaggggcctgcagagaggagctgccagctttggcagcagcacagccagcgctgccctggagctgagcaaccggctggtgcaggccatccaggccacagctgagaccgtgtatgacatcctgagccctgctgcccctgtgagccgcagcctgcaggacaagaggtctgcccggcggctgcggcggggccagcagcctgctgacctgcgggagggcgtggccaaggcctatgacacagtgcgggagggcatcctggacacagcccagaccatctgtgatgtggccagccggggccacgagcagaagggcctgactggagctgtgggcggcgtcatccggcagctgccccccaccgtggtgaagcccctcatcctggccacagaggccaccagcagcctgctgggcggcatgaggaaccagatcgtgcctgatgcccacaaggaccacgccctgaagtggaggagtgacagcgcccaggactag

SEQ ID NO: 35708 - DNA, 6237 bp, Artificial Sequence
  Description of Artificial Sequence: Synthetic coding sequence
atgccctggcccttcagcgagagcatcaagaagagggcctgccgctacctgctgcagcgctacctgggccacttcctgcaggagaagctgagcctggagcagctgagcctggacctgtaccagggcaccggcagcctggcccaggtgcccctggacaagtggtgcctgaatgagatcctggagagcgcagatgcccccctggaggtgacagagggcttcatccagagcatcagcctgtctgtgccctggggcagcctgctgcaggacaactgtgccctggaggtgcggggcctggagatggtgttccggccccggcccaggcctgccaccggcagcgagcccatgtactggagcagcttcatgaccagctccatgcagctggccaaggagtgcctgagccagaagctgacagatgagcagggcgagggcagccagccctttgagggcctggagaagtttgctgagaccattgaaacagtgctgcggcgggtgaaggtgaccttcatcgacacagtgctgagaattgaacatgtgcctgagaacagcaagacaggaacagccctggagatccgcatcgagaggacagtgtactgtgatgaaacagcagatgagagcagcggcatcaacgtgcaccagcccacagcctttgcccacaagctgctgcagctgagcggcgtgtccctcttctgggatgagttcagcgccagcgccaagagcagccctgtgtgcagcacagcccctgtggagacagagcccaagctgagccccagctggaaccccaagatcatctatgagccccacccccagctgaccaggaacctgcctgagatcgcccccagcgaccctgtgcagatcggccgcctgattggccgcctggagctgagcctgaccctgaagcagaatgaggtgctgcccggggccaagctggatgtggatggccagattgacagcatccacctgctgctgagcccccggcaggtgcacctgctgctggacatgctggccgccatcgccggccctgagaacagcagcaagattggcctggccaacaaggacaggaagaaccggcccatgcagcaggaggatgagtaccgcatccagatggagctgaaccgctactacctgaggaaggacagcctgtctgtgggcgtgagcagcgagcagagcttctatgaaacagaaacagcccggacccccagcagccgggaggaggaggtgttcttctccatggctgacatggacatgagccacagcctgagcagcctgccccccctgggggacccccccaacatggacctggagctgagcctgaccagcacctacaccaacaccccagctggcagccccctgagcgccaccgtgctgcagcccacctggggcgagttcctggaccaccacaaggagcagcctgtgcggggcagcaccttccccagcaacctggtgcaccccacccccctgcagaagaccagcctgcccagccgctctgtgtctgtggatgagagcaggcctgagctgatcttccggctggccgtgggcaccttcagcatctctgtgctgcacatcgaccccctgagccccccagagaccagccagaacctgaaccccctgacccccatggctgtggccttcttcacctgcatcgagaagattgatcctgcccgcttcagcacagaggacttcaagagcttccgggctgtgtttgctgaggcctgcagccatgaccacctgcgcttcatcggcaccggcatcaaggtgtcctatgagcagaggcagaggtctgccagccgctacttcagcacagacatgagcatcggccagatggagttcctggagtgcctcttccccacagacttccacagcgtgcccccccactacacagagctgctgaccttccacagcaaggaggagaccggcagccacagccctgtgtgcctgcagctgcactacaagcacagtgaaaatagaggcccccagggcaaccaggcccggctgagctctgtgccccacaaggccgagctgcagatcaagctgaaccctgtgtgctgtgagctggacatcagcatcgtggaccggctgaacagcctgctgcagccccagaagctggccaccgtggagatgatggccagccacatgtacaccagctacaacaagcacatcagcctgcacaaggccttcacagaggtgttcctggatgacagccacagccctgccaactgccgcatctctgtgcaggtggccaccccagccctgaacctgtctgtgcgcttccccatcccagacctgcggagtgaccaggagcggggcccctggttcaagaagagcctgcagaaggagatcctgtacctggccttcacagacctggagttcaagacagagttcatcggcggcagcaccccagagcagatcaagctggagctgaccttccgggagctgattggcagcttccaggaggagaagggggaccccagcatcaagttcttccacgtgtcctctggagtggatggagacaccaccagcagtgatgactttgactggccccgcatcgtgctgaagatcaaccccccagccatgcacagcatcctggagagaattgctgctgaggaggaggaggagaatgatggccactaccaggaggaggaggagggcggggcccacagcctgaaggatgtgtgtgacctgcggcggcctgcccccagccccttcagcagccggcgggtgatgtttgaaaatgagcagatggtgatgcctggggaccctgtggagatgacagagttccaggacaaggccatcagcaacagccactacgtgctggagctgaccctgcccaacatctacgtgaccctgcccaacaagagcttctatgagaagctgtacaaccgcatcttcaatgacctgctgctgtgggagcccacagcccccagccctgtggagacctttgagaacatctcctatggcatcggcctgtctgtggccagccagctgatcaacaccttcaacaaggacagcttcagcgccttcaagtctgctgtgcactatgatgaggagagcggcagcgaggaggagaccctgcagtacttcagcacagtggaccccaactaccgcagcaggaggaagaagaagctggacagccagaacaagaacagccagagcttcctgtctgtgctgctgaacatcaaccacggcctgattgctgtgttcacagatgtgaagcaggacaatggagacctgctggagaacaagcatggagagttctggctggagttcaacagcggcagcctcttctgtgtgaccaagtatgagggctttgatgacaagcactacatctgcctgcacagcagcagcttcagcctgtaccacaagggcatcgtgaatggagtcatcctgcccacagagacccggctgcccagcagcacccggccccactggctggagcccaccatctacagcagcgaggaggatggcctgagcaagaccagcagtgatggagtgggcggggacagcctgaacatgctgtctgtggccgtgaagatcctgagtgacaagtctgagagcaacaccaaggagttcctgattgctgtgggcctgaagggggccaccctgcagcacaggatgctgcccagcggcctgtcctggcatgagcagatcctgtacttcctgaacattgctgatgagcctgtgctgggctacaacccccccaccagcttcaccaccttccacgtgcacctgtggagctgtgccctggactaccggcccctgtacctgcccatccgcagcctgctgactgtggagaccttctctgtgagcagctctgtggccctggacaagagcagcagcaccctgcgcatcatcctggatgaagctgccctgcacctgagtgacaagtgcaacacagtgaccatcaacctgagccgggactatgtgcgggtgatggacatgggcctgctggagctgaccatcacagctgtgaagagtgacagtgatggagagcagacagagcccaggtttgagctgcactgcagcagtgatgtggtgcacatccgcacctgcagcgacagctgtgccgccctgatgaacctgatccagtacatcgccagctatggagacctgcagacccccaacaaggctgacatgaagccaggggccttccagaggaggagcaaggtggacagcagcggccgcagcagcagccggggccctgtgctgcctgaggccgaccagcagatgctgcgggacctgatgtctgatgccatggaggagattgacatgcagcagggcaccagctctgtgaagccccaggccaacggggtgctggatgagaagagccagatccaggagccctgctgcagcgacctcttcctgttcccagatgagagcggaaatgtgtcccaggagagcggccccacctacgccagcttcagccaccacttcatcagtgatgccatgactggagtgcccacagaaaatgatgacttctgcatcctgtttgcccccaaggccgccatgcaggagaaggaggaggagcccgtcatcaagatcatggtggatgatgccatcgtcatccgggacaactacttcagcctgcctgtgaacaagacagacaccagcaaggcccccctgcacttccccatccctgtgatccgctacgtggtgaaggaggtgtccctggtgtggcacctgtatggaggcaaggactttggaattgtgccccccaccagccctgccaagagctacatcagcccccacagcagccccagccacacccccaccaggcatggaagaaacacagtgtgtggcggcaagggcaggaaccacgacttcctgatggagatccagctgagcaaggtgaagttccagcacgaggtgtacccaccctgcaagccagactgtgacagcagcctgtctgagcaccctgtgtcccggcaggtgttcatcgtgcaggacctggagatccgggaccggctggccaccagccagatgaacaagttcctgtacctgtactgcagcaaggagatgcccaggaaggcccacagcaacatgctgactgtgaaggccctgcacgtgtgcccagagagcggccgcagcccccaggagtgctgcctgcgggtgtccctgatgcccctgcggctgaacatcgaccaggatgccctcttcttcctgaaggacttcttcaccagcctgtctgctgaggtggagctgcagatgaccccagaccctgaggtgaagaagagccctggagcagatgtgacctgcagcctgcccaggcacctgagcaccagcaaggagcccaacctggtgatctccttcagcggccccaagcagcccagccagaatgattctgccaacagcgtggaggtggtgaatggcatggaggagaagaacttctctgctgaggaggccagcttccgggaccagcctgtgttcttccgggagttccgcttcaccagcgaggtgcccatccggctggactaccacggcaagcacgtgtccatggaccagggcaccctggccggcatcctgattggcctggcccagctgaactgcagcgagctgaagctgaagaggctgagctacagacatggcctgctgggcgtggacaagctgttctcctatgccatcacagagtggctgaatgacatcaagaagaaccagctgcccggcatcctgggcggcgtgggccccatgcacagcctggtgcagctggtgcagggcctgaaggacctggtgtggctgcccatcgagcagtacaggaaggatggaagaattgtgcggggcttccagagaggagctgccagctttggcaccagcacagccatggccgccctggagctgaccaacaggatggtgcagaccatccaggccgctgctgagacagcctatgacatggtgtccccaggcaccctgagcattgagcccaagaagaccaagcgcttcccccaccaccggctggcccaccagcctgtggacctgcgggagggcgtggccaaggcctacagcgtggtgaaggagggcatcacagacacagcccagaccatctatgaaacagctgcccgggagcacgagagcagaggagtgactggagctgtgggggaggtgctgcggcagatccccccagctgtggtgaagcccctcatcgtggccacagaggccaccagcaatgtgctgggcggcatgaggaaccagatccggccagatgtgcggcaggatgagagccagaagtggaggcatggagatgactag

SEQ ID NO: 35709 - DNA, 2214 bp, Artificial Sequence
  Description of Artificial Sequence: Synthetic coding sequence
atggaggatgctggggaggaccccaccacctttgctgcccacagcctgcccagcgacccccggctgctggccaccgtgaccaatgcctacctgggcaccagggtcttccatgacaccctgcacgtgtctggagtgtacaatggagctggaggagacacccaccgggccatgctgcccagccccctgaatgtgcggctggaggccccagctggcatgggagagcagctgacagagacctttgccctggacaccaacacaggcagcttcctgcacaccctggagggcccccgcttccgggccagccagtgcatctatgcccacaggaccctgccccacgtgctggccttccgggtgtccatcgcccggctggcccctggcagcggccccatcaccctgctgctgcggagcgccttcagccctgagagcccagacctggacctgcaccagggccctgacttccagggcgcccgctacctgtatggccacaccctgaccccagagcagcccggcggcccccagcaggaggtgcacatgctgtggaccccagcccccccagacctgaccctgggggagggggaggaggcccggacctgggacttcctgacagctgtgggcggcagccaggccgaggcccaggcctgcctgacagaggccctgcagctgcaggcccggggggccctgtacacagcccacgcccaggcctgggcccagctgtgggtggagtgtggcctggatgtggtgggccccctgcagctgcggcaggccctgcggggcagcctgtactacctgctgagcgccctgccccagcccaaggcccctggctacatctgccacggcctgagccctgggggcctgagcaatggcagccgggaggagtgctactggggccacgtgttctgggaccaggacctgtggatgttccccagcatcctgatgttccaccctgaggccgcccgggccatcctggagtaccgcatccgcaccctggatggagccctggagaatgcccagaacctgggctaccagggcgccaagtttgcctgggagagcgctgacagcggcctggaggtgtgcccagaggacatctatggagtgcaggaggtgcacgtgaatggagctgtggtgctggcctttgagctgtactaccacaccacccaggacctgcagctgttccgggaggccggcggctgggatgtggtgcgggctgtggccgagttctggtgcagccgggtggagtggagcccccgggaggagaagtaccacctgcggggcgtgatgagcccagatgagtaccacagcggcgtgaacaacagcgtgtacaccaacgtgctggtgcagaacagcctgcgctttgctgctgccctggcccaggacctgggcctgcccatccccagccagtggctggccgtggccgacaagatcaaggtgccctttgatgtggagcagaacttccaccctgagtttgatggctatgagcctggagaggtggtgaagcaggctgatgtggtgctgctgggctaccctgtgcccttcagcctgagcccagatgtgcggaggaagaacctggagatctatgaagctgtgaccagcccccagggccctgccatgacctggagcatgtttgctgtgggctggatggagctgaaggatgctgtgcgggcccggggcctgctggacaggagctttgccaacatggccgagcccttcaaggtgtggacagaaaatgctgatggcagcggggctgtgaacttcctgaccggcatgggcggcttcctgcaggccgtggtgtttggctgcaccggcttccgggtgaccagggctggggtgacctttgatcctgtgtgcctgagcggcatcagccgggtgtctgtgtctggcatcttctaccagggcaacaagctgaacttctccttcagcgaggacagcgtgacagtggaggtgacagcccgggccggcccctgggccccccacctggaggccgagctgtggcccagccagagccggctgagcctgctgcccggccacaaggtgtccttccccaggtctgctggccgcatccagatgagcccccccaagctgcccggcagcagcagcagcgagttccctggccgcaccttcagtgatgtgcgggaccccctgcagagccccctgtgggtgaccctgggcagcagcagccccacagagagcctgactgtggaccctgccagcgagtag

SEQ ID NO: 35710 - DNA, 804 bp, Artificial Sequence
  Description of Artificial Sequence: Synthetic coding sequence
atgagggtggccgccctgatcagcggcggcaaggacagctgctacaacatgatgcagtgcatcgctgctggccaccagatcgtggccctggccaacctgcggcctgctgagaaccaggtgggcagtgatgagctggacagctacatgtaccagacagtgggccaccacgccatcgacctgtatgcagaggccatggccctgcccctgtacagaaggaccatccggggccgcagcctggacacccggcaggtgtacaccaagtgtgaaggagatgaggtggaggacctgtatgagctgctgaagctggtgaaggagaaggaggaggtggagggcatctctgtgggcgccatcctgagtgactaccagaggatccgggtggagaatgtgtgcaagaggctgaacctgcagcccctggcctacctgtggcagaggaaccaggaggacctgctgcgggagatgatcagcagcaacatccaggccatgatcatcaaggtggccgccctgggcctggaccctgacaagcacctgggcaagaccctggaccagatggagccctacctgattgagctgagcaagaagtatggagtgcacgtgtgtggggagggcggggagtatgagaccttcaccctggactgccccctcttcaagaagaagatcatcgtggacagcagcgaggtggtgatccacagcgcagatgcctttgcccctgtggcctacctgcgcttcctggagctgcacctggaggacaaggtgtcctctgtgcctgacaactaccgcaccagcaactacatctacaacttctag

SEQ ID NO: 35711 - DNA, 498 bp, Artificial Sequence
  Description of Artificial Sequence: Synthetic coding sequence
atgagggtggccgccctgatcagcggcggcaaggacagctgctacaacatgatgcagtgcatcgctgctggccaccagatcgtggccctggccaacctgcggcctgctgagaaccaggtgggcagtgatgagctggacagctacatgtaccagacagtgggccaccacgccatcgacctgtatgcagaggccatggccctgcccctgtacagaaggaccatccggggccgcagcctggacacccggcaggtgtacaccaagtgtgaaggagatgaggtggaggacctgtatgagctgctgaagctggtgaagggcatcaccaggatgaccctgctggccgagtatgatgccctgaacctgcaggacttccacatgcacctgaaggtgggcagccaggccatcgtgtaccgcaccccaaatgagctgtgcacccacagcaagtttgacaagcacaccttcccccccttcatcagcgagatcgccaagtgtgaggtgtag

SEQ ID NO: 35712 - DNA, 3306 bp, Artificial Sequence
  Description of Artificial Sequence: Synthetic coding sequence
atgtctgccaaggccatcagcgagcagacaggcaaggagctgctgtacaagttcatctgcaccaccagcgccatccagaaccgcttcaagtatgcccgggtgaccccagacacagactgggcccggctgctgcaggaccacccctggctgctgagccagaacctggtggtgaagccagaccagctgatcaagagaagaggcaagctgggcctggtgggcgtgaacctgaccctggatggagtgaagtcctggctgaagccccggctgggccaggaggccaccgtgggcaaggccaccggcttcctgaagaacttcctgattgagccctttgtgccccacagccaggccgaggagttctacgtgtgcatctatgccacccgggagggggactatgtgctcttccaccacgagggcggcgtggatgtgggagatgtggatgccaaggcccagaagctgctggtgggcgtggatgagaagctgaaccctgaggacatcaagaagcacctgctggtgcacgcccctgaggacaagaaggagatcctggccagcttcatcagcggcctcttcaacttctatgaagatctctacttcacctacctggagatcaaccccctggtggtgaccaaggatggagtgtatgtgctggacctggccgccaaggtggatgccacagctgactacatctgcaaggtgaagtggggagacatcgagttccccccacccttcggccgggaggcctacccagaggaggcctacatcgctgacctggatgccaagagcggggccagcctgaagctgaccctgctgaaccccaagggccgcatctggaccatggtggccggcggcggggcctctgtggtgtacagcgacaccatctgtgacctgggcggcgtgaatgagctggccaactacggggagtacagcggggcccccagcgagcagcagacctatgactatgccaagaccatcctgagcctgatgacccgggagaagcacccagatggcaagatcctgatcatcggcggcagcatcgccaacttcaccaacgtggccgccaccttcaagggcatcgtgcgggccatccgggactaccagggccccctgaaggagcacgaggtgaccatctttgtgcggcggggcggccccaactaccaggagggcctgcgggtgatgggagaggtgggcaagaccaccggcatccccatccacgtgtttggaacagagacccacatgacagccatcgtgggcatggccctgggccaccggcccatccccaaccagcccccaacagctgcccacacagccaacttcctgctgaatgccagcggcagcaccagcaccccagcccccagcaggacagccagcttcagcgagagcagagcagatgaggtggccccagccaagaaggccaagccagccatgccccaggacagcgtgcccagccccaggagcctgcagggcaagagcaccaccctcttcagccgccacaccaaggccatcgtgtggggcatgcagaccagggctgtgcagggcatgctggactttgattatgtgtgcagcagagatgagcccagcgtggccgccatggtgtaccccttcaccggggaccacaagcagaagttctactggggccacaaggagatcctgatccctgtgttcaagaacatggctgatgccatgaggaagcaccctgaggtggatgtgctgatcaactttgccagcctgcggagcgcctatgacagcaccatggagaccatgaactatgcccagatccgcaccatcgccatcatcgccgagggcatccctgaggccctgaccaggaagctgatcaagaaggctgaccagaagggcgtgaccatcatcggccctgccaccgtgggcggcatcaagccaggctgcttcaagattggcaacacaggaggcatgctggacaacatcctggccagcaagctgtaccggcccggctctgtggcctacgtgagccgcagcggcggcatgagcaatgagctgaacaacatcatcagcaggaccacagatggagtgtatgagggcgtggccatcggcggggaccgctacccaggcagcaccttcatggaccacgtgctgcgctaccaggacaccccaggagtgaagatgattgtggtgctgggggagattggaggaacagaggagtacaagatctgccggggcatcaaggagggccgcctgaccaagcccatcgtgtgctggtgcatcggcacctgtgccaccatgttcagcagcgaggtgcagtttggacatgctggggcctgtgccaaccaggccagcgagacagctgtggccaagaaccaggccctgaaggaggccggcgtgtttgtgcccaggagctttgatgagctgggggagatcatccagagcgtgtatgaggacctggtggccaatggagtcatcgtgcctgcccaggaggtgcccccacccaccgtgcccatggactacagctgggcccgggagctgggcctcatcaggaagccagccagcttcatgaccagcatctgtgatgagcggggccaggagctgatctatgccggcatgcccatcacagaggtgttcaaggaggagatgggcattggaggagtgctgggcctgctgtggttccagaagaggctgcccaagtacagctgccagttcatcgagatgtgcctgatggtgacagctgaccacggccctgctgtgtctggggcccacaacaccatcatctgtgcccgggccggcaaggacctggtgagcagcctgaccagcggcctgctgaccatcggggacagatttggaggagccctggatgctgctgccaagatgttcagcaaggcctttgacagcggcatcatccccatggagtttgtgaacaagatgaagaaggagggcaagctgatcatgggcatcggccaccgggtgaagagcatcaacaacccagacatgagggtgcagatcctgaaggactatgtgcggcagcacttccctgccacccccctgctggactatgccctggaggtggagaagatcaccaccagcaagaagcccaacctgatcctgaatgtggatggcctgattggagtggcctttgtggacatgctgaggaactgtggcagcttcacccgggaggaggctgatgagtacatcgacatcggggccctgaatggcatctttgtgctgggccgctccatgggcttcatcggccactacctggaccagaagaggctgaagcagggcctgtaccgccacccctgggatgacatctcctatgtgctgcctgagcacatgtccatgtag

SEQ ID NO: 35713 - DNA, 288 bp, Artificial Sequence
  Description of Artificial Sequence: Synthetic coding sequence
atggcccacttcaaggatgacctgcagaccaacgtggagatcatccctggagagagcgcccccaggaaggagagcccccggcccccagccccacccagcagcgctgctggggtgggcggctgcagcaaccacagccccagcgtgcaggagagccccctgagccccccagccctggcccagctgggcagcgcccagcagcccagcatgaggacagagctgtccttcagcgagaagaaggacaccatgatcatctggcagatcaccatcaccgtgtggtgccagaggtag

SEQ ID NO: 35714 - DNA, 288 bp, Artificial Sequence; identical to SEQ ID NO: 35713
  Description of Artificial Sequence: Synthetic coding sequence

SEQ ID NO: 35715 - DNA, 1173 bp, Artificial Sequence
  Description of Artificial Sequence: Synthetic coding sequence
atgccacccagcggcctgcggctgctgcccctgctgctgcccctgctgtggctgctggtgctgaccccaggccggcctgctgctggcctgagcacctgcaagaccatcgacatggagctggtgaagaggaagagaattgaggccatccggggccagatcctgagcaagctgcggctggccagcccccccagccagggcgaggtgcccccaggccccctgcctgaggccgtgctggccctgtacaacagcacccgggacagagtggccggggagagcgctgagcctgagcctgagcctgaggccgactactatgccaaggaggtgaccagggtgctgatggtggagacccacaatgagatctatgacaagttcaagcagagcacccacagcatctacatgttcttcaacaccagcgagctgcgggaggccgtgcctgagcctgtgctgctgagcagagctgagctgcggctgctgcggctgaagctgaaggtggagcagcacgtggagctgtaccagaagtacagcaacaacagctggagatacctgagcaaccggctgctggcccccagcgacagccctgagtggctgagctttgatgtgactggagtggtgcggcagtggctgagcagaggaggagaaattgagggcttccggctgagcgcccactgcagctgtgacagccgggacaacaccctgcaggtggacatcaatggcttcaccactggaagaagaggagacctggccaccatccacggcatgaaccggcccttcctgctgctgatggccacccccctggagcgggcccagcacctgcagagcagccgccacagaagagccctggacaccaactactgcttcagcagcacagagaagaactgctgcgtgcggcagctgtacatcgacttcaggaaggacctgggctggaagtggatccacgagcccaagggctaccacgccaacttctgcctgggcccctgcccctacatctggagcctggacacccagtacagcaaggtgctggccctgtacaaccagcacaaccctggggccagcgctgccccctgctgcgtgccccaggccctggagcccctgcccatcgtgtactacgtgggcaggaagcccaaggtggagcagctgagcaacatgattgtgcgcagctgcaagtgcagctag

SEQ ID NO: 35716 - DNA, 576 bp, Artificial Sequence
  Description of Artificial Sequence: Synthetic coding sequence
atgtgggacctggtgctggaggacaggaggatgaacagcctgcggctggtggcccccatgtggaatggccgcatccggggcatccaccggctgggcgctgctgtggcccctgagggcaaccagaagaagaagaggaccatcctgcagttcctgaccaactacttctatgatgtggaggccctgcgggactacctgctgcagcgggagatgtacaaggtgcatgagaagaacagaagctacacctggctggagaagcagcacggcccctacggggccggggccttcttcatcctgaagcagggcggcgctgtgaagttccgggacaaggagtggatccggccagacaagtatggccacttcagccaggagttctggaacttctgtgaggtgcctgtggaggccgtggatgctggggactgtgacatcaactatgagggcctggacaacctgcggaccagcgctggctggaccagcaggaccagcctgccctgccccaccctggccagcctgcgctactggtggaggcgctgctgccccatcgcccggctgtgggagagcacaggcctgcgggcctag

SEQ ID NO: 35717 - DNA, 792 bp, Artificial Sequence
  Description of Artificial Sequence: Synthetic coding sequence
atgtgggacctggtgctggaggacaggaggatgaacagcctgcggctggtggcccccatgtggaatggccgcatccggggcatccaccggctgggcgctgctgtggcccctgagggcaaccagaagaagaagaggaccatcctgcagttcctgaccaactacttctatgatgtggaggccctgcgggactacctgctgcagcgggagatgtacaaggtgcatgagaagaacagaagctacacctggctggagaagcagcacggcccctacggggccggggccttcttcatcctgaagcagggcggcgctgtgaagttccgggacaaggagtggatccggccagacaagtatggccacttcagccaggagttctggaacttctgtgaggtgcctgtggaggccgtggatgctggggactgtgacatcaactatgagggcctggacaacctgctgcggctgaaggagctgcagagcctgagcctgcagcgctgctgccacgtggatgactggtgcctgagccggctgtaccccctggccgacagcctgcaggagctgagcctggccggctgcccccgcatcagcgagcggggcctggcctgcctgcaccacctgcagaacctgcggcggctggacatcagtgacctgcctgctgtgagcaaccctggcctgacccagatcctggtggaggagatgctgcccaactgtgaggtggtgggcgtggactgggccgagggcctgaagagcggccctgaggagcagccccgggacacagccagccctgtgcctgcctag

SEQ ID NO: 35718 - DNA, 693 bp, Artificial Sequence
  Description of Artificial Sequence: Synthetic coding sequence
atggccgccccctgggccagcctgcggctggtggcccccatgtggaatggccgcatccggggcatccaccggctgggcgctgctgtggcccctgagggcaaccagaagaagaagaggaccatcctgcagttcctgaccaactacttctatgatgtggaggccctgcgggactacctgctgcagcgggagatgtacaaggtgcatgagaagaaccgcttccgggacaaggagtggatccggccagacaagtatggccacttcagccaggagttctggaacttctgtgaggtgcctgtggaggccgtggatgctggggactgtgacatcaactatgagggcctggacaacctgctgcggctgaaggagctgcagagcctgagcctgcagcgctgctgccacgtggatgactggtgcctgagccggctgtaccccctggccgacagcctgcaggagctgagcctggccggctgcccccgcatcagcgagcggggcctggcctgcctgcaccacctgcagaacctgcggcggctggacatcagtgacctgcctgctgtgagcaaccctggcctgacccagatcctggtggaggagatgctgcccaactgtgaggtggtgggcgtggactgggccgagggcctgaagagcggccctgaggagcagccccgggacacagccagccctgtgcctgcctag

SEQ ID NO: 35719 - DNA, 1002 bp, Artificial Sequence
  Description of Artificial Sequence: Synthetic coding sequence
atggagctggacatccacagcgcccaggtgcccctgcctgtgggccggggccgccacagagatgccaccccagagagcaagggcagcctgcaggacctgggctggagcgctgtggcccagagccagctgacagccaccagcaccagccctgcccaggtgattcctccaccccagccccgctggagcaggaccccaggcttcaagcgctgcttccggctgggcctgcacaaggtgctgggcagccagagcctgcggctggtggcccccatgtggaatggccgcatccggggcatccaccggctgggcgctgctgtggcccctgagggcaaccagaagaagaagaggaccatcctgcagttcctgaccaactacttctatgatgtggaggccctgcgggactacctgctgcagcgggagatgtacaaggtgcatgagaagaacagaagctacacctggctggagaagcagcacggcccctacggggccggggccttcttcatcctgaagcagggcggcgctgtgaagttccgggacaaggagtggatccggccagacaagtatggccacttcagccaggagttctggaacttctgtgaggtgcctgtggaggccgtggatgctggggactgtgacatcaactatgagggcctggacaacctgctgcggctgaaggagctgcagagcctgagcctgcagcgctgctgccacgtggatgactggtgcctgagccggctgtaccccctggccgacagcctgcaggagctgagcctggccggctgcccccgcatcagcgagcggggcctggcctgcctgcaccacctgcagaacctgcggcggctggacatcagtgacctgcctgctgtgagcaaccctggcctgacccagatcctggtggaggagatgctgcccaactgtgaggtggtgggcgtggactgggccgagggcctgaagagcggccctgaggagcagccccgggacacagccagccctgtgcctgcctag

SEQ ID NO: 35720 - DNA, 693 bp, Artificial Sequence; identical to SEQ ID NO: 35718
  Description of Artificial Sequence: Synthetic coding sequence

SEQ ID NO: 35721 - DNA, 3663 bp, Artificial Sequence
  Description of Artificial Sequence: Synthetic coding sequence
atgggagacatggccaacagcagcattgagttccaccccaagccccagcagcagagagatgtgccccaggccggcggcttcggctgcaccctggccgagctgcggaccctgatggagctgcggggagctgaggccctgcagaagattgaggaggcctatggagatgtgtctggcctgtgccggcggctgaagaccagccccacagagggcctggccgacaacaccaatgacctggagaagaggcggcagatctacggccagaacttcatcccccccaagcagcccaagaccttcctgcagctggtgtgggaggccctgcaggatgtgaccctcatcatcctggaggtggccgccatcgtgtccctgggcctgtccttctacgcccctcctggagaggagagcgaggcctgtggaaatgtgtctggaggagcagaagatgaaggagaggccgaggccggctggattgaaggagctgccatcctgctgagcgtcatctgtgtggtgctggtgacagccttcaatgactggagcaaggagaagcagttccggggcctgcagagcagaattgagcaggagcagaagttcaccgtcatcagaaatggccagctgctgcaggtgcctgtggccgccctggtggtgggggacatcgcccaggtgaagtatggagacctgctgcctgcagatggagtgctgatccaggccaatgacctgaagattgatgagagcagcctgactggagagagtgaccacgtgaggaagtctgctgacaaggaccccatgctgctgagcggcacccacgtgatggagggcagcggccgcatggtggtgacagctgtgggcgtgaacagccagacaggcatcatcttcaccctgctgggcgctggaggagaggaggaggagaagaaggacaagaagggcaagcagcaggatggagccatggagagcagccagaccaaggccaagaagcaggatggagctgtggccatggagatgcagcccctgaagtctgctgagggcggggagatggaggagcgggagaagaagaaggccaatgcccccaagaaggagaagtctgtgctgcagggcaagctgaccaagctggccgtgcagatcggcaaggccggcctggtgatgtctgccatcaccgtcatcatcctggtgctgtacttcgtcatcgagacctttgtggtggagggccgcacctggctggctgaatgtacccctgtgtatgtgcagtactttgtgaagttcttcatcatcggcgtgacagtgctggtggtggccgtgcctgagggcctgcccctggccgtgaccatcagcctggcctacagcgtgaagaagatgatgaaggacaacaacctggtgcgccacctggatgcctgtgagaccatgggaaatgccacagccatctgcagcgacaagacaggcaccctgaccaccaacaggatgacagtggtgcagagctacctgggggacacccactacaaggagatcccagcccccagcgccctgacccccaagatcctggacctgctggtgcacgccatcagcatcaacagcgcctacaccaccaagatcctgcccccagagaaggagggcgccctgccccggcaggtgggcaacaagacagaatgtgccctgctgggctttgtgctggacctgaagagggacttccagcctgtgcgggagcagatccctgaggacaagctgtacaaggtgtacaccttcaacagcgtgaggaagtccatgagcaccgtcatccgcatgccagatggcggcttccgcctcttcagcaaaggagccagcgagatcctgctgaagaagtgcaccaacatcctgaacagcaatggagagctgcggggcttccggccccgggacagagatgacatggtgaggaagatcatcgagcccatggcctgtgatggcctgcggaccatctgcatcgcctacagagacttctctgctggccaggagccagactgggacaatgaaaatgaggtggtgggggacctgacctgcatcgctgtggtgggcatcgaggaccctgtgcggcctgaggtgcctgaggccatcaggaagtgccagagagctggcatcaccgtgaggatggtgactggagacaacatcaacacagcccgggccatcgccgccaagtgtggcatcatccagcccggggaggacttcctgtgcctggagggcaaggagttcaacagacgcatcagaaatgagaagggggagattgagcaggagcggctggacaaggtgtggcccaagctgcgggtgctggcccggagcagccccacagacaagcacaccctggtgaagggcatcatcgacagcaccaccggggagcagaggcaggtggtggccgtgactggagatggcaccaatgatggccctgccctgaagaaggcagatgtgggctttgccatgggcattgctggaacagatgtggccaaggaggccagtgacatcatcctgacagatgacaacttcaccagcatcgtgaaggctgtgatgtggggcagaaatgtgtatgacagcatcagcaagttcctgcagttccagctgactgtgaatgtggtggccgtgattgtggccttcaccggggcctgcatcacccaggacagccccctgaaggctgtgcagatgctgtgggtgaacctgatcatggacacctttgccagcctggccctggccacagagcccccaacagagagcctgctgctgaggaagccctacggccgggacaagcccctcatcagcaggaccatgatgaagaacatcctgggccatgctgtgtaccagctggccatcatcttcaccctgctgtttgtgggggagctgttctttgatattgattctggaagaaatgcccccctgcacagcccccccagcgagcactacaccatcatcttcaacacctttgtgatgatgcagctgttcaatgagatcaatgccaggaagatccatggagagagaaatgtgtttgatggcatcttcagcaaccccatcttctgcaccatcgtgctgggcaccttcggcatccagatcgtcatcgtgcagtttggaggcaagcccttcagctgcagccccctgagcacagagcagtggctgtggtgcctgtttgtgggcgtgggggagctggtgtggggccaggtgattgccaccatccccaccagccagctgaagtgcctgaaggaggccggccacggccctgggaaggatgagatgacagatgaggagctggccgagggggaggaggagattgaccatgctgagcgggagctgcggcggggccagatcctgtggttccggggcctgaaccgcatccagacccagatccgggtggtgaaggccttccgcagcagcctgtatgagggcctggagaagccagagagcaagaccagcatccacaacttcatggccaccccagagttcctgatcaatgactacacccacaacatccccctgattgatgacacagatgtggatgaaaatgaggagcggctgcgggcccctcctccacccagccccaaccagaacaacaatgccatcgacagcggcatctacctgaccacccacgtgaccaagagcgccaccagctctgtgttcagcagcagccctggcagccccctgcacagcgtggagaccagcctgtag

SEQ ID NO: 35722 - DNA, 4377 bp, Artificial Sequence
  Description of Artificial Sequence: Synthetic coding sequence
atggtgaacaccaggaagagcagcctgcggctgctgggcagcaagagccctggccctggccctggccctggagctggagctgagcccggggccaccggcggcagcagccacttcatcagcagcaggaccaggagcagcaagacccgggccgccagctgcccagctgccaaggccggcggcagcggcggggccggcgtgaccctggatgaggccaggaaggtggaggtggatggcagcctgagtgacagccacgtgtccccaccagccaagaggaccctgaagcagcctgacagcgtgtgcaaggacaagagcaagagccgcagcacaggccagcgggaggagtggaacctgagcacaggccaggcccggctgaccagccagcccggggccaccctgcccaacggccacagcggcctgagcctgcggagccaccccctgcggggggagaagaagggagatggagacctgagctgcatcaacggggacatggaggtgaggaagagctgccgcagcaggaagaacagatttgagagcgtgaaccagagcctgctgtttgaccagctggtgaacagcacagctgaggccgtgctgcaggagatggacaacatcaacatccggcagaacagaagaagtggagaggtggagcggctgaggatgtggacagacacagaatttgagaacatggacatgtacagccgggtgaagagaagaaggaagagcctgcggagaaattcctatggcatccagaaccaccacgaggtgtccacagaaggagaggaggaggagagccaggaggaggatggagacatcgaggtggaggaggccgagggggaggagaatgaccggccctacaacctgcggcagaggaagacagtggaccgctaccaggccccacccatcgtgcctgcccaccagaagaagcgggagaacaccctgtttgacatccacaggagccctgcccggcgcagccacatccggaggaagaagcacgccatccacagcagtgacaccaccagcagtgatgaggagagatttgaaagaaggaagagcaagtccatggcccgggccaggaaccgctgcctgcccatgaacttccgggcagaggacctggccagcggcatcctgcgggagcgggtgaaggtgggcgccagcctggctgatgtggaccccatgaacatcgacaagtctgtgcgctttgacagcatcggcggcctgagccaccacatccacgccctgaaggagatggtggtgttccccctgctgtacccagagatctttgagaagttcaagatccagcccccccggggctgcctcttctacggccccccaggcaccgggaagaccctggtggcccgggccctggccaatgaatgttcccagggcgacaagaaggtggccttcttcatgaggaaaggagctgactgcctgagcaagtgggtgggggagagcgagcggcagctgcggctgctgtttgaccaggcctacctgatgaggcccagcatcatcttctttgatgaaattgatggcctggcccctgtgcgcagcagccggcaggaccagatccacagcagcatcgtgtccaccctgctggccctgatggatggcctggacaacagaggagagatcgtggtgattggagccaccaaccggctggacagcattgatcctgccctgcggcggcccggccgctttgaccgggagttcctgttcaacctgcctgaccagaaggccaggaagcacatcctgcagatccacacccgggactggaaccccaagctgagtgatgccttcctgggggagctggccgagaagtgtgtgggctactgtggggctgacatcaaggccctgtgcacagaggccgccctgattgccctgcggcggcgctacccccagatctatgccagcagccacaagctgcagctggatgtgagcagcatcgtgctgagcgcccaggacttctaccacgccatgcagaacatcgtgcctgccagccagagagctgtgatgagcagcggccacgccctgagccccatcatccggcccctgctggagaggagcttcaacaacatcctggccgtgctgcagaaggtgttcccccatgctgagatcagccagagcgacaagaaggaggacatcgagaccctcatcctggaggacagtgaagatgaaaatgccctgagcatctttgagaccaactgccacagcggcagccccaagaagcagagcagcagcgctgccatccacaagccctacctgcacttcaccatgagcccctaccaccagcccaccagctaccggccccggctgctgctgagcggggagcggggcagcggccagaccagccacctggccccagccctgctgcacaccctggagcgcttctctgtgcaccggctggacctgcctgccctgtacagcgtgtctgccaagaccccagaggagagctgtgcccagatcttccgggaggcccggaggacagtgcccagcatcgtgtacatgccccacatcggggactggtgggaggccgtgtctgagaccgtgcgggccaccttcctgaccctgctgcaggacatccccagcttcagccccatcttcctgctgagcaccagcgagaccatgtacagcgagctgcctgaggaggtgaagtgcatcttccgcatccagtatgaggaggtgctgtacatccagaggcccattgaagaagatagaaggaagttcttccaggagctgatcctgaaccaggcctccatggccccacccaggaggaagcatgctgccctgtgtgccatggaggtgctgcccctggccctgcccagccccccccggcagctgtctgagagcgagaagagcaggatggaggaccaggaggagaacaccctgcgggagctgcggctcttcctgagagatgtgaccaagaggctggccacagacaagcgcttcaacatcttcagcaagcctgtggacatcgaggaggtgtctgactacctggaggtgatcaaggagcccatggacctgagcaccgtcatcaccaagattgacaagcacaactacctgacagccaaggacttcctgaaggacatcgacctgatctgcagcaatgccctggagtacaacccagacaaggaccccggggacaagatcatccgccaccgggcctgcaccctgaaggacacagcccacgccatcatcgctgctgagctggaccctgagttcaacaagctgtgtgaggagatcaaggaggcccgcatcaagaggggcctgtctgtgaccagcgagcagatcaacccccacagcactggagccaggaagacagagaccagggtggaggaggccttccgccacaagcagaggaaccccatggatgtgtggcacaacagcgccaacaagtgtgccttccgggtgcggaggaagagcagaagaagaagccagtggggcaagggcatcatcaagaagaggaaggtgaacaacctgaagaaggatgaggaggacaccaagtttgctgactatgagaaccacacagaggacaggaagctgctggagaatggagaatttgaggtgtccacagactgccatgaagaaaatggagaggagaccggggacctgtccatgaccaatgatgagagcagctgtgacatcatggacctggaccagggccagaggctgaacaatggagctggcaccaaggaaaattttgccagcacagaggaggagagcagcaatgaaagcctgctggtgaacagcagcagcagcctgaaccctgagcagaccagcaggaaggagaccttcctgaagggcaactgcctgaatggagaggccagcacagacagctttgagggcatccctgtgctggagtgccagaatggcaagctggaggtggtgtccttctgtgacagcggggacaagtgcagcagcgagcagaagatcctgctggaggaccagagcaaggagaagccagagaccagcacagaaaatcatggagatgacctggagaagctggaggccctggagtgcagcaacaatgagaagctggagcccggcagtgatgtggaggtgaaggatgctgagctggacaaggagggcgccagcaaggtgaagaagtacaggaagctgatcctggagcaggccaagaccaccagcctggagctggtgcctgaggagcccagcgagcctgtgccccccctgattgtggaccgggagcggctgaagaagctgctggacctgctggtggacaagagcaacaacctggccgtggaccagctggagcggctgtacagcctgctgagccagtgcatctaccgccacaggaaggactatgacaagagccagctggtggaggagatggagaggacagtgcacatgtttgagaccttcctgtag

SEQ ID NO: 35723 - DNA, 639 bp, Artificial Sequence
  Description of Artificial Sequence: Synthetic coding sequence
atggaggtgaggaagagctgccgcagcaggaagaacagatttgagagcgtgaaccagagcctgctgtttgaccagctggtgaacagcacagctgaggccgtgctgcaggagatggacaacatcaacatccggcagaacagaagaagtggagaggtggagcggctgaggatgtggacagacacagaatttgagaacatggacatgtacagccgggtgaagagaagaaggaagagcctgcggagaaattcctatggcatccagaaccaccacgaggtgtccacagaaggagaggaggaggcccggaccagcaagctgctgcccctggagaagatcagcattgagagccaggaggaggatggagacatcgaggtggaggaggccgagggggaggagaatgaccggccctacaacctgcggcagaggaagacagtggaccgctaccaggccccacccatcgtgcctgcccaccagaagaagcgggagaacaccctgtttgacatccacaggagccctgcccggcgcagccacatccggaggaagaagcacgccatccacagcagtgacaccaccagcagtgatgaggagagatttgaaagaaggaagagcaagtccatggcccgggccaggaacaggaagtag

SEQ ID NO: 35724 - DNA, 1881 bp, Artificial Sequence
  Description of Artificial Sequence: Synthetic coding sequence
atgccccacatcggggactggtgggaggccgtgtctgagaccgtgcgggccaccttcctgaccctgctgcaggacatccccagcttcagccccatcttcctgctgagcaccagcgagaccatgtacagcgagctgcctgaggaggtgaagtgcatcttccgcatccagtatgaggaggtgctgtacatccagaggcccattgaagaagatagaaggaagttcttccaggagctgatcctgaaccaggcctccatggccccacccaggaggaagcatgctgccctgtgtgccatggaggtgctgcccctggccctgcccagccccccccggcagctgtctgagagcgagaagagcaggatggaggaccaggaggagaacaccctgcgggagctgcggctcttcctgagagatgtgaccaagaggctggccacagacaagcgcttcaacatcttcagcaagcctgtggacatcgaggaggtgtctgactacctggaggtgatcaaggagcccatggacctgagcaccgtcatcaccaagattgacaagcacaactacctgacagccaaggacttcctgaaggacatcgacctgatctgcagcaatgccctggagtacaacccagacaaggaccccggggacaagatcatccgccaccgggcctgcaccctgaaggacacagcccacgccatcatcgctgctgagctggaccctgagttcaacaagctgtgtgaggagatcaaggaggcccgcatcaagaggggcctgtctgtgaccagcgagcagatcaacccccacagcactggagccaggaagacagagaccagggtggaggaggccttccgccacaagcagaggaaccccatggatgtgtggcacaacagcgccaacaagtgtgccttccgggtgcggaggaagagcagaagaagaagccagtggggcaagggcatcatcaagaagaggaaggtgaacaacctgaagaaggatgaggaggacaccaagtttgctgactatgagaaccacacagaggacaggaagctgctggagaatggagaatttgaggtgtccacagactgccatgaagaaaatggagaggagaccggggacctgtccatgaccaatgatgagagcagctgtgacatcatggacctggaccagggccagaggctgaacaatggagctggcaccaaggaaaattttgccagcacagaggaggagagcagcaatgaaagcctgctggtgaacagcagcagcagcctgaaccctgagcagaccagcaggaaggagaccttcctgaagggcaactgcctgaatggagaggccagcacagacagctttgagggcatccctgtgctggagtgccagaatggcaagctggaggtggtgtccttctgtgacagcggggacaagtgcagcagcgagcagaagatcctgctggaggaccagagcaaggagaagccagagaccagcacagaaaatcatggagatgacctggagaagctggaggccctggagtgcagcaacaatgagaagctggagcccggcagtgatgtggaggtgaaggatgctgagctggacaaggagggcgccagcaaggtgaagaagtacaggaagctgatcctggagcaggccaagaccaccagcctggagctggtgcctgaggagcccagcgagcctgtgccccccctgattgtggaccgggagcggctgaagaagctgctggacctgctggtggacaagagcaacaacctggccgtggaccagctggagcggctgtacagcctgctgagccagtgcatctaccgccacaggaaggactatgacaagagccagctggtggaggagatggagaggacagtgcacatgtttgagaccttcctgtag

SEQ ID NO: 35725 - DNA, 1236 bp, Artificial Sequence
  Description of Artificial Sequence: Synthetic coding sequence
atgagcaaggatgccctgaacctggcccagatgcaggagcagaccctgcagctggagcagcagagcaagctgaagcagctggtgaatgaagacctgaggaagcaggaggagagcgtgcagaagcaccaccagaccttcctggagagcatccgggctgctggcaccctgtttggagagggcttccgggcctttgtgacagaccgggacaaggtgacagccaccgtggccggcctgaccctgctggccgtgggcgtgtacagcgccaagaatgccacagctgtgacaggccgctacatcgaggcccggctgggcaagcccagcctggtgcgggagaccagccgcatcaccgtgctggaggccctgcggcaccccatccagcaggtgtcccggcggctgctgagccggccccaggatgtgctggagggcgtggtgctgagccccagcctggaggcccgggtgcgggacatcgccatcatgaccaggaacatcaagaagaacagaggcctgtaccgccacatcctgctgtatggccccccaggcaccgggaagaccctgtttgccaagaagctggccctgcacagcggcatggactatgccatcatgactggaggagatgtggcccccatgggccgggagggcgtgacagccatgcacaagctgtttgactgggccaacaccagccggcggggcctgctgctgtttgtggatgaagcagatgccttcctgaggaagagggccacagagaagatcagcgaggacctgcgggccaccctgaatgccttcctgtacagaacaggccagcacagcaacaagttcatgctgatcctggccagctgccaccctgagcagtttgactgggccatcaatgcctgcattgatgtgatggtgcactttgacctgcccggccaggaggagcgggcccggctggtgaggatgtacctgaatgaatatgtgctgaagccagccacagagggcaagaggcggctgaagctggcccagtttgattatggcaggaagtgcctggagatcgcccggctgacagagggcatgagctgcaggaagatcgcccagctggccgtgtcctggcaggccacagcctatgccagcaaggatggagtgctgacagaggccatgatggatgcctgtgtgcaggactttgtgcagcagcaccagcagatgatgcgctggctgaagggggagcggcccggcccagaagatgagcagcccagcagctag

SEQ ID NO: 35726 - DNA, 2112 bp, Artificial Sequence
  Description of Artificial Sequence: Synthetic coding sequence
atggccacctgtgccgagatcctgcggtctgagttccctgagattgatggccaggtgtttgattatgtgactggagtgctgcacagcggcagcgctgactttgagagcgtggatgacctggtggaggccgtgggggagctgctgcaggaggtgtctggggacagcaaggatgatgctggcatccgggctgtgtgccagaggatggccgagccccagagccagggcaacagccaggtgctgctggatgcccccatccagctgagcaagatcacagagaactatgactgtggcaccaagctgcccggcctgctgaagcgggagcagagcagcacagtgaatgccaagaagctggagaaggccgaggcccggctgaaggccaagcaggagaagaggtctgagaaggacaccctgaagaccagcaaccccctggtgctggaggaggccagcgccagccaggccggcagcaggaaggagagccggctggagagcagcggcaagaacaagagctatgatgtgagaattgaaaattttgatgtgtcctttggagacagagtgctgctggccggggctgatgtgaacctggcctggggccgccgctatggcctggtgggcagaaatggcctgggcaagaccaccctgctgaagatgctggccaccaggagcctgcgggtgcctgcccacatcagcctgctgcacgtggagcaggaggtggccggagatgacaccccagccctgcagagcgtgctggagagtgacagcgtgcgggaggacctgctgcggcgggagcgggagctgacagcccagattgctgctggccgggcagagggcagcgaggccgctgagctggccgagatctatgccaagctggaggagattgaggccgacaaggccccagcccgggccagcgtcatcctggccggcctgggcttcacccccaagatgcagcagcagcccacccgggagttcagcggcggctggaggatgaggctggccctggcccgggccctgtttgcccggccagacctgctgctgctggatgagcccaccaacatgctggatgtgcgggccatcctgtggctggagaactacctgcagacctggcccagcaccatcctggtggtgtcccatgacaggaacttcctgaatgccatcgccacagacatcatccacctgcacagccagaggctggatggctacagaggagactttgagaccttcatcaagagcaagcaggagcggctgctgaaccagcagcgggagtatgaggcccagcagcagtaccggcagcacatccaggtgttcatcgaccgcttccgctacaatgccaacagagccagccaggtgcagagcaagctgaagatgctggagaagctgcctgagctgaagcctgtggacaaggagagcgaggtggtgatgaagttcccagatggctttgagaagttcagcccccccatcctgcagctggatgaggtggacttctactatgaccccaagcacgtgatcttcagccggctgtctgtgtctgctgacctggagagccgcatctgtgtggtgggggagaatggagctgggaagagcaccatgctgaagctgctgctgggggacctggcccctgtgcggggcatcagacatgcccacaggaacctgaagattggctacttcagccagcaccacgtggagcagctggacctgaatgtgtctgctgtggagctgctggccaggaagtttcctggccggcctgaggaggagtaccgccaccagctgggccgctatggcatcagcggggagctggccatgaggcccctggccagcctgagcggcggccagaagagccgggtggcctttgcccagatgaccatgccctgccccaacttctacatcctggatgagcccaccaaccacctggacatggagaccatcgaggccctgggccgggccctgaacaacttccggggcggcgtcatcctggtgtcccatgatgagcgcttcatccggctggtgtgccgggagctgtgggtgtgtgagggcggcggcgtgaccagggtggagggcggctttgaccagtaccgggccctgctgcaggagcagttccggcgggagggcttcctgtag

SEQ ID NO: 35727 - DNA, 2130 bp, Artificial Sequence
  Description of Artificial Sequence: Synthetic coding sequence
atggccacctgtgccgagatcctgcggtctgagttccctgagattgatggccaggtgtttgattatgtgactggagtgctgcacagcggcagcgctgactttgagagcgtggatgacctggtggaggccgtgggggagctgctgcaggaggtgtctggggacagcaaggatgatgctggcatccgggctgtgtgccagaggatgtacaacaccctgcggctggccgagccccagagccagggcaacagccaggtgctgctggatgcccccatccagctgagcaagatcacagagaactatgactgtggcaccaagctgcccggcctgctgaagcgggagcagagcagcacagtgaatgccaagaagctggagaaggccgaggcccggctgaaggccaagcaggagaagaggtctgagaaggacaccctgaagaccagcaaccccctggtgctggaggaggccagcgccagccaggccggcagcaggaaggagagccggctggagagcagcggcaagaacaagagctatgatgtgagaattgaaaattttgatgtgtcctttggagacagagtgctgctggccggggctgatgtgaacctggcctggggccgccgctatggcctggtgggcagaaatggcctgggcaagaccaccctgctgaagatgctggccaccaggagcctgcgggtgcctgcccacatcagcctgctgcacgtggagcaggaggtggccggagatgacaccccagccctgcagagcgtgctggagagtgacagcgtgcgggaggacctgctgcggcgggagcgggagctgacagcccagattgctgctggccgggcagagggcagcgaggccgctgagctggccgagatctatgccaagctggaggagattgaggccgacaaggccccagcccgggccagcgtcatcctggccggcctgggcttcacccccaagatgcagcagcagcccacccgggagttcagcggcggctggaggatgaggctggccctggcccgggccctgtttgcccggccagacctgctgctgctggatgagcccaccaacatgctggatgtgcgggccatcctgtggctggagaactacctgcagacctggcccagcaccatcctggtggtgtcccatgacaggaacttcctgaatgccatcgccacagacatcatccacctgcacagccagaggctggatggctacagaggagactttgagaccttcatcaagagcaagcaggagcggctgctgaaccagcagcgggagtatgaggcccagcagcagtaccggcagcacatccaggtgttcatcgaccgcttccgctacaatgccaacagagccagccaggtgcagagcaagctgaagatgctggagaagctgcctgagctgaagcctgtggacaaggagagcgaggtggtgatgaagttcccagatggctttgagaagttcagcccccccatcctgcagctggatgaggtggacttctactatgaccccaagcacgtgatcttcagccggctgtctgtgtctgctgacctggagagccgcatctgtgtggtgggggagaatggagctgggaagagcaccatgctgaagctgctgctgggggacctggcccctgtgcggggcatcagacatgcccacaggaacctgaagattggctacttcagccagcaccacgtggagcagctggacctgaatgtgtctgctgtggagctgctggccaggaagtttcctggccggcctgaggaggagtaccgccaccagctgggccgctatggcatcagcggggagctggccatgaggcccctggccagcctgagcggcggccagaagagccgggtggcctttgcccagatgaccatgccctgccccaacttctacatcctggatgagcccaccaaccacctggacatggagaccatcgaggccctgggccgggccctgaacaacttccggggcggcgtcatcctggtgtcccatgatgagcgcttcatccggctggtgtgccgggagctgtgggtgtgtgagggcggcggcgtgaccagggtggagggcggctttgaccagtaccgggccctgctgcaggagcagttccggcgggagggcttcctgtag

SEQ ID NO: 35728 - DNA, 3573 bp, Artificial Sequence
  Description of Artificial Sequence: Synthetic coding sequence
atgaagacccggcagaacaaggacagcatgtccatgaggagcggcaggaagaaggaggcccctggcccccgggaggagctgcggagccggggccgggccagccctggaggagtgtccaccagcagcagtgatggcaaggccgagaagagccggcagacagccaagaaggcccgggtggaggaggccagcacccccaaggtgaacaagcagggccgctctgaggagatcagcgagagcgagagcgaggagaccaatgcccccaagaagaccaagacagagcaggagctgccccggccccagagccccagcgacctggacagcctggatggccgcagcctgaatgatgatggcagcagtgacccccgggacatcgaccaggacaacagaagcaccagccccagcatctacagccctggctctgtggagaatgacagcgacagcagcagcggcctgagccagggccctgcccggccctaccaccccccacccctcttcccccccagcccccagcccccagacagcaccccccggcagcctgaggccagctttgagccccaccccagcgtgacccccaccggctaccacgcccccatggagccccccaccagcaggatgttccaggcccctcctggggcccccccaccccacccccagctgtacccaggcggcaccggcggcgtgctgagcggcccccccatgggccccaagggcggcggggccgccagctctgtgggcggccccaacggcggcaagcagcaccccccacccaccacccccatctctgtgagcagcagcggggccagcggggccccacccaccaagccacccaccacccctgtgggcggcggcaacctgcccagcgcccctcctccagccaacttcccccacgtgacccccaacctgcccccacctccagccctgcggcccctgaacaatgccagcgccagccccccaggcctgggcgcccagcccctgcccggccacctgcccagcccccacgccatgggccagggcatgggcggcctgcccccaggccctgagaagggccccaccctggcccccagcccccacagcctgcccccagccagcagcagcgccccagccccacccatgaggttcccctacagcagcagcagcagcagcagcgctgctgccagcagcagcagcagcagcagcagcagcagcgccagccccttccctgccagccaggccctgcccagctacccccacagcttccccccacccaccagcctgtctgtgagcaaccagccccccaagtacacccagcccagcctgcccagccaggccgtgtggagccagggccccccacctcctccaccctacggccgcctgctggccaacagcaatgcccaccctggccccttcccccccagcactggagcccagagcacagcccacccccctgtgtccacccaccaccaccaccaccagcagcagcagcagcagcagcagcagcagcagcagcagcagcagcagcagcagcagcaccacggcaacagcggccccccacctcctggggccttcccccaccccctggagggcggcagcagccaccacgcccacccctatgccatgagccccagcctgggcagcctgcggccctacccacctggccctgcccacctgcccccaccccacagccaggtgtcctacagccaggccggccccaacggcccccctgtgagcagcagcagcaacagcagcagcagcaccagccagggcagctacccctgcagccaccccagccccagccagggcccccagggcgccccctaccccttcccccctgtgcccaccgtgaccaccagcagcgccaccctgagcaccgtcatcgccaccgtggccagcagccctgctggctacaagacagccagccccccaggccccccaccctacggcaagagggcccccagccctggggcctacaagacagccaccccacctggctacaagccaggcagcccccccagcttcagaacaggcaccccacctggctaccggggcaccagccccccagctggccctggcaccttcaagccaggcagccccaccgtgggccctggccccctgcccccagctggccccagcggcctgcccagcctgcccccacctcctgctgccccagccagcggcccccccctgagcgccacccagatcaagcaggagcctgctgaggagtatgagaccccagagagccctgtgcccccagcccggagccccagccccccacccaaggtggtggatgtgcccagccacgccagccagagcgcccgcttcaacaagcacctggaccggggcttcaacagctgtgcccggagtgacctgtactttgtgcccctggagggcagcaagctggccaagaagagagctgacctggtggagaaggtgcggcgggaggccgagcagagggcccgggaggagaaggagcgggagcgggagcgggagcgggagaaggagcgggagcgggagaaggagcgggagctggagaggtctgtgaagctggcccaggagggccgggcccctgtggagtgccccagcctgggccctgtgccccaccggcccccatttgagcccggcagcgctgtggccaccgtgcccccctacctgggccctgacaccccagccctgcggaccctgtctgaatatgcccggccccacgtgatgagccctggcaacagaaaccaccccttctacgtgcccctgggcgctgtggaccccggcctgctgggctacaacgtgcctgccctgtacagcagtgaccctgctgcccgggagcgggagcgggaggcccgggagcgggacctgcgggaccggctgaagccaggctttgaggtgaagcccagcgagctggagcccctgcatggagtgcccggccctggcctggaccccttccccaggcatggaggcctggccctgcagcccggccccccaggcctgcaccccttccccttccaccccagcctgggccccctggagcgggagcggctggccctggccgccggccctgccctgcggccagacatgtcctatgcagagcggctggccgctgagcggcagcacgccgagcgggtggccgccctgggcaatgaccccctggcccggctgcagatgctgaatgtgaccccccaccaccaccagcacagccacatccacagccacctgcacctgcaccagcaggatgccatccatgctgccagcgcctctgtgcaccccctgattgaccccctggccagcggcagccacctgacccgcatcccctacccagctggcaccctgcccaaccccctgctgccccaccccctgcatgaaaatgaggtgctgcggcaccagctgtttgctgccccctacagagacctgcctgccagcctgagcgcccccatgtctgctgcccaccagctgcaggccatgcacgcccagagcgctgagctgcagaggctggccctggagcagcagcagtggctgcacgcccaccaccccctgcacagcgtgcccctgcctgcccaggaggactactacagccacctgaagaaggagagtgacaagcccctgtag

SEQ ID NO: 35729 - DNA, 3573 bp, Artificial Sequence; identical to SEQ ID NO: 35728
  Description of Artificial Sequence: Synthetic coding sequence

SEQ ID NO: 35730 - DNA, 3780 bp, Artificial Sequence
  Description of Artificial Sequence: Synthetic coding sequence
atggatggccccacccggggccacggcctgaggaagaagaggaggagccgcagccagagggaccgggagcggcgcagccggggcggcctgggcgctggagctgctgggggcggcggggccggccgcacccgggccctgagcctggccagcagcagcggcagtgacaaggaggacaatggcaagccacccagcagcgcccccagccggccccggccccccaggaggaagagaagagagagcaccagcgctgaggaggacatcattgatggctttgccatgaccagctttgtgacctttgaggccctggagaaggatgtggccctgaagccccaggagcgggtggagaagaggcagacccccctgaccaagaagaagcgggaggccctgaccaacggcctgtccttccacagcaagaagagccggctgagccacccccaccactacagcagtgacagagaaaatgacaggaacctgtgccagcacctgggcaagaggaagaagatgcccaaggccctgcggcagctgaagccaggccagaacagctgccgggacagcgacagcgagagcgccagcggggagagcaagggcttccacaggagcagcagccgggagcggctgagtgacagcagcgcccccagcagcctgggcaccggctacttctgtgacagcgacagcgaccaggaggagaaggccagtgatgccagcagcgagaagctgttcaacacagtcatcgtgaacaaggaccctgagctgggcgtgggcaccctgcctgagcatgacagccaggatgctggccccatcgtgcccaagatcagcggcctggagaggagccaggagaagagccaggactgctgcaaggagcccatctttgagcctgtggtgctgaaggacccctgcccccaggtggcccagcccatcccccagccccagacagagccccagctgcgggcccccagcccagaccctgacctggtgcagaggacagaggccccaccccagcccccacccctgagcacccagcccccccagggccccccagaggcccagctgcagcctgccccccagccccaggtgcagaggcctccccggccccagagccccacccagctgctgcaccagaacctgccccctgtgcaggcccaccccagcgcccagagcctgagccagcccctgagcgcctacaacagcagcagcctgagcctgaacagcctgagcagcagccgcagcagcaccccagccaagacccagcctgccccaccccacatcagccaccaccccagcgccagccccttccccctgagcctgcccaaccacagccccctgcacagcttcacccccaccctgcagcccccagcccacagccaccaccccaacatgtttgccccacccacagccctgcccccacctccacccctgaccagcggcagcctgcaggtggccggccaccctgctggcagcacctacagcgagcaggacatcctgcggcaggagctgaacacccgcttcctggccagccagagcgctgacagaggagccagcctgggccccccaccctacctgaggacagagttccaccagcaccagcaccagcaccagcacacccaccagcacacccaccagcacaccttcacccccttcccccacgccatccccccaacagccatcatgcccaccccagccccacccatgtttgacaagtaccccaccaaggtggaccccttctaccgccacagcctcttccacagctaccccccagctgtgtctggcatcccccccatgatccccccaacaggccccttcggcagcctgcagggcgccttccagcccaagaccagcaaccccattgatgtggccgcccggcccggcaccgtgccccacaccctgctgcagaaggacccccggctgacagaccccttccggcccatgctgaggaagccaggcaagtggtgtgccatgcacgtgcacatcgcctggcagatctaccaccaccagcagaaggtgaagaagcagatgcagagcgacccccacaagctggactttggcctgaagccagagttcctgagccggcccccaggccccagcctgtttggagccatccaccacccccatgacctggcccggcccagcaccctcttctctgctgctggagctgcccaccccaccggcaccccatttggacctccaccccaccacagcaacttcctgaacccagctgcccacctggagcccttcaaccggcccagcaccttcaccggcctggccgctgtgggcggcaatgcctttggaggcctgggcaaccccagcgtgacccccaacagcatgtttggccacaaggatggccccagcgtgcagaacttcagcaacccccatgagccctggaaccggctgcacaggaccccacccagcttccccaccccaccaccctggctgaagccaggagagctggagaggtctgccagcgctgctgcccatgaccgggacagagatgtggacaagagggacagctctgtgtccaaggatgacaaggagcgggagagcgtggagaagaggcacagcagccaccccagccctgcccctgtgctgcctgtgaatgccctgggccacaccaggagcagcacagagcagatccgggcccacctgaacacagaggcccgggagaaggacaagcccaaggagcgggagcgggaccacagcgagagcaggaaggacctggccgcagatgagcacaaggccaaggagggccacctgcctgagaaggatggccacggccacgagggccgggctgctggggaggaggccaagcagctggcccgggtgcccagcccctacgtgaggacccctgtggtggagagcgcccggcccaacagcaccagcagccgggaggccgagcccaggaagggggagcccgcctatgagaaccccaagaagagcagcgaggtgaaggtgaaggaggagaggaaggaggaccatgacctgcccccagaggccccccagacccaccgggccagcgagcccccaccacccaacagcagcagctctgtgcaccctggccccctggcctccatgcccatgacagtgggcgtgacaggcatccaccccatgaacagcatcagcagcctggacaggaccaggatgatgacccccttcatgggcatcagccccctgcccggcggggagcgcttcccctaccccagcttccactgggaccccatccgggaccccctgcgggacccctaccgggagctggacatccaccggcgggaccccctgggccgggacttcctgctgagaaatgaccccctgcaccggctgagcaccccccggctgtatgaggccgaccgctccttccgggaccgggagccccatgactacagccaccaccaccaccaccaccaccaccccctgtctgtggacccccggcgggagcacgagcggggcggccacctggatgagcgggagcggctgcacatgctgcgggaggactatgagcacacccggctgcacagcgtgcacccagccagcctggatggccacctgccccaccccagcctcatcaccccaggcctgcccagcatgcactacccccgcatcagccccacagctggcaaccagaatggcctgctgaacaagaccccacccacagctgccctgagcgcccctcctcctctcatcagcaccctgggcggccggcctgtgagccccaggaggaccacccccctgtctgctgagatccgggagcggccccccagccacaccctgaaggacatcgaggccaggtag

SEQ ID NO: 35731 - DNA, 801 bp, Artificial Sequence
  Description of Artificial Sequence: Synthetic coding sequence
atggatggccccacccggggccacggcctgaggaagaagaggaggagccgcagccagagggaccgggagcggcgcagccggggcggcctgggcgctggagctgctgggggcggcggggccggccgcacccgggccctgagcctggccagcagcagcggcagtgacaaggaggacaatggcaagccacccagcagcgcccccagccggccccggccccccaggaggaagagaagagagagcaccagcgctgaggaggacatcattgatggctttgccatgaccagctttgtgacctttgaggccctggagaaggatgtggccctgaagccccaggagcgggtggagaagaggcagacccccctgaccaagaagaagcgggaggccctgaccaacggcctgtccttccacagcaagaagagccggctgagccacccccaccactacagcagtgacagagaaaatgacaggaacctgtgccagcacctgggcaagaggaagaagatgcccaaggccctgcggcagctgaagccaggccagaacagctgccgggacagcgacagcgagagcgccagcggggagagcaagggcttccacaggagcagcagccgggagcggctgagtgacagcagcgcccccagcagcctgggcaccggctacttccgcagcggcaagatgtgcctgggggaggaggcctgcctgaagtctggaaatgacatgaagagagatgtgagcaacaccagctcctgggccagcaaccgggagagcttcttcagcctggtgaagctgctgaagggcttctag

SEQ ID NO: 35732 - DNA, 3708 bp, Artificial Sequence
  Description of Artificial Sequence: Synthetic coding sequence
atggatggccccacccggggccacggcctgaggaagaagaggaggagccgcagccagagggaccgggagcggcgcagccggggcggcctgggcgctggagctgctgggggcggcggggccggccgcacccgggccctgagcctggccagcagcagcggcagtgacaaggaggacaatggcaagccacccagcagcgcccccagccggccccggccccccaggaggaagagaagagagagcaccagcgctgaggaggacatcattgatggctttgccatgaccagctttgtgacctttgaggccctggagaaggatgtggccctgaagccccaggagcgggtggagaagaggcagacccccctgaccaagaagaagcgggaggccctgaccaacggcctgtccttccacagcaagaagagccggctgagccacccccaccactacagcagtgacagagaaaatgacaggaacctgtgccagcacctgggcaagaggaagaagatgcccaaggccctgcggcagctgaagccaggccagaacagctgccgggacagcgacagcgagagcgccagcggggagagcaagggcttccacaggagcagcagccgggagcggctgagtgacagcagcgcccccagcagcctgggcaccggctacttctgtgacagcgacagcgaccaggaggagaaggccagtgatgccagcagcgagaagctgttcaacacagtcatcgtgaacaaggaccctgagctgggcgtgggcaccctgcctgagcatgacagccaggatgctggccccatcgtgcccaagatcagcggcctggagaggagccaggagaagagccaggactgctgcaaggagcccatctttgagcctgtggtgctgaaggacccctgcccccaggtggcccagcccatcccccagccccagacagagccccagctgcgggcccccagcccagaccctgacctggtgcagaggacagaggccccaccccagcccccacccctgagcacccagcccccccagggccccccagaggcccagctgcagcctgccccccagccccaggtgcagaggcctccccggccccagagccccacccagctgctgcaccagaacctgccccctgtgcaggcccaccccagcgcccagagcctgagccagcccctgagcgcctacaacagcagcagcctgagcctgaacagcctgagcagcagccgcagcagcaccccagccaagacccagcctgccccaccccacatcagccaccaccccagcgccagccccttccccctgagcctgcccaaccacagccccctgcacagcttcacccccaccctgcagcccccagcccacagccaccaccccaacatgtttgccccacccacagccctgcccccacctccacccctgaccagcggcagcctgcaggtggccggccaccctgctggcagcacctacagcgagcaggacatcctgcggcaggagctgaacacccgcttcctggccagccagagcgctgacagaggagccagcctgggccccccaccctacctgaggacagagttccaccagcaccagcaccagcaccagcacacccaccagcacacccaccagcacaccttcacccccttcccccacgccatccccccaacagccatcatgcccaccccagccccacccatgtttgacaagtaccccaccaaggtggaccccttctaccgccacagcctcttccacagctaccccccagctgtgtctggcatcccccccatgatccccccaacaggccccttcggcagcctgcagggcgccttccagcccaagctgacagaccccttccggcccatgctgaggaagccaggcaagtggtgtgccatgcacgtgcacatcgcctggcagatctaccaccaccagcagaaggtgaagaagcagatgcagagcgacccccacaagctggactttggcctgaagccagagttcctgagccggcccccaggccccagcctgtttggagccatccaccacccccatgacctggcccggcccagcaccctcttctctgctgctggagctgcccaccccaccggcaccccatttggacctccaccccaccacagcaacttcctgaacccagctgcccacctggagcccttcaaccggcccagcaccttcaccggcctggccgctgtgggcggcaatgcctttggaggcctgggcaaccccagcgtgacccccaacagcatgtttggccacaaggatggccccagcgtgcagaacttcagcaacccccatgagccctggaaccggctgcacaggaccccacccagcttccccaccccaccaccctggctgaagccaggagagctggagaggtctgccagcgctgctgcccatgaccgggacagagatgtggacaagagggacagctctgtgtccaaggatgacaaggagcgggagagcgtggagaagaggcacagcagccaccccagccctgcccctgtgctgcctgtgaatgccctgggccacaccaggagcagcacagagcagatccgggcccacctgaacacagaggcccgggagaaggacaagcccaaggagcgggagcgggaccacagcgagagcaggaaggacctggccgcagatgagcacaaggccaaggagggccacctgcctgagaaggatggccacggccacgagggccgggctgctggggaggaggccaagcagctggcccgggtgcccagcccctacgtgaggacccctgtggtggagagcgcccggcccaacagcaccagcagccgggaggccgagcccaggaagggggagcccgcctatgagaaccccaagaagagcagcgaggtgaaggtgaaggaggagaggaaggaggaccatgacctgcccccagaggccccccagacccaccgggccagcgagcccccaccacccaacagcagcagctctgtgcaccctggccccctggcctccatgcccatgacagtgggcgtgacaggcatccaccccatgaacagcatcagcagcctggacaggaccaggatgatgacccccttcatgggcatcagccccctgcccggcggggagcgcttcccctaccccagcttccactgggaccccatccgggaccccctgcgggacccctaccgggagctggacatccaccggcgggaccccctgggccgggacttcctgctgagaaatgaccccctgcaccggctgagcaccccccggctgtatgaggccgaccgctccttccgggaccgggagccccatgactacagccaccaccaccaccaccaccaccaccccctgtctgtggacccccggcgggagcacgagcggggcggccacctggatgagcgggagcggctgcacatgctgcgggaggactatgagcacacccggctgcacagcgtgcacccagccagcctggatggccacctgccccaccccagcctcatcaccccaggcctgcccagcatgcactacccccgcatcagccccacagctggcaaccagaatggcctgctgaacaagaccccacccacagctgccctgagcgcccctcctcctctcatcagcaccctgggcggccggcctgtgagccccaggaggaccacccccctgtctgctgagatccgggagcggccccccagccacaccctgaaggacatcgaggccaggtag

SEQ ID NO: 35733 - DNA, 423 bp, Artificial Sequence
  Description of Artificial Sequence: Synthetic coding sequence
atggtgacagccatggccctgagcaagagcaccaacagccacaagaatgccacagaggacctgtatgaggtggacaagctgaagaaggagtgctatgagtggatcaacacctgcagctgcctgctgagcaacatcaagggcaggaagatcaccctgctgacctatgaggagattgaaaggctgctggaggaggaggccgtgaaggagttcatcgagcctgagattgatgagagcttcaaggaggatgaggaggagagcaaggaggacaggaagctgcaggaggagaacaaggagcgggcagaggagcagcccagcaccagcacagagaaggagaagctgatccgcttcatcggagaagatgaaaatgtgcacagcaagcccctgtttgaaacagatgtgctgagctcctggaagaacatctag

SEQ ID NO: 35734 - DNA, 2691 bp, Artificial Sequence
  Description of Artificial Sequence: Synthetic coding sequence
atggtggacaggagcaagctgctgcccaccagcctgcagaatgagttcatccccaaggaggtgctgctgagcctgacctacgccgccaatgccggcccctgcccagagaacctgctgccccccaagaagatcaagacccccaagggcaccctgccccggctggtggaccacgtgtggcaccaccctgtgagaagaaacaagttcaagtacctgattgaccaccctgtgtccctgactggagctggccgggacatctccttcctgtatgatgtgacctacgccaagggccagacccgggagaaggctgtgtgccccccccacctggcccggagcctgcagagccatgatggagtgattgtgccccacaagcccaagaccctgacagacaccctcatccctgaggagttccacatcgtgagcagcactggagtgtctggcctggagtgctatgatgacaagtacaccaccctgctgacagattctgagaaccggctgctgctcttccccagcatgaagcccaacaagagggtggaggtggcccagctgaatgatgtgatggacaccatgctggagagagctggggtggagaaccaggagtacacaggccccaccaagatgcacaagctgctgcacatcctgaagaaggagcagaccatctacaacatgatcttccacgagctgatccggcaggtgtctgtggactgtgccgacagaggagagctgctgagcaaggtgcgggagagatatgtgcagatgctggaccagatcgcccggcagatgattgacttctacaaggacctggtgacccagagggtgatggaccagaggatcctggaggagctgtacaacttcaagcacgtgattgaggagctgacccgggagctgtgcctggtgcgggcccatgatgtgaagctgaccaaggagacagagaaggcccacaaggacctggcccaggccctgctgaatgctgagaagaatgccaagatcgtggaggagtaccatgacctgtacaccctgcagcgggagaggatggagaatgacatgaagaagctggtggccgagcgggacatctggagcagcgccacctatgagctggccctgaaggtgattgaaagaaacagagtcatcctggcccggcggctgtacctgaatgagaagggctggaacaagtacaccaagcacttcatcatcctgctgagcaacaaggacacagaggacctggccctgctgcagaagctgacccagaagtggaggaacctggtgaacaagctgaagcaggaggtggagcagatggaggagagcaccagcgagaccctgaagatcgtgaaggatggcctcatcaagtggcaggagttcttcaatgagaaggacatcctgagccccaacaagggcaacatcttcaacagcgtgctgctggacttcaagcagtggcagaagatcctgaatgagaagaaggaggagttcaccggagatgtgctgctgagcaaatatgacaccctgaagatcatcaagcacctgcaggagaactgggccgacatcggcctgggcatcttcaacagacacaagagcctggagggggagatgcccagcgagcggcagtacatggaggagatcatcaagaacatccagaagctgtacaaggagtatgagatccgcatcaacggggacaatggctacagcaagatcctgcccagcctcatcagcagcctggacttctgcagcttcaagctggagaacctggagttcccagacacccccctggaggagtggcaggagattgatgagaagatcaatgagatgaagagccacctggacatcctgctgaacctgactggaattgtgccccagcacattgatgtggacagcgtgtctgtgctgcaggcctacatcttcaacatgatccagcagtggctgctgaagattggaaatgagatcaacaatggaaacatcgagctgcagcaccacatggatgagctgcacatctccatgatccagtggatggtgaacctgctgatcctgatgatccccaacttcacagaccaggactgcctgctgaagctggaggaggagagcgctgagaagcatgacattggagtggcccggctggagctggatgccatcgagctgaccaggaagctgtaccagtacagcagctacctgagcagctgctgcaagggcatggtgacagccatggccctgagcaagagcaccaacagccacaagaatgccacagaggacctgtatgaggtggacaagctgaagcagcccagcaccagcacagagaaggagaagctgatccgcttcatcggagaagatgaaaatgtgcacagcaagcccctgtttgaaacagatgtgctgagctcctggagggagagcgccaagcagggcaccctggcccagaagtacctggaggccatggctgtgattgagcacatgcaggagaagctgctggaggtggagaacagagcccggcaggccgaggagaagtttgaagatgcctatgagaagctgcaccacaccctcatcaagaacaaggacctggaggagctggtgatgaccagcaggaaggagagcaaggaggagaaggagaaccaggatgagcgggaggtgaaggaggaggaggagcagcaggaggaggaggaggtgcgctctgctgagaacagcagcaagagccccaagaagggccactag

SEQ ID NO: 35735 - DNA, 3039 bp, Artificial Sequence
  Description of Artificial Sequence: Synthetic coding sequence
atgagcctgcccaagacccccagcacccccctgaacagcaccagcaccagcgagagcaagaagctgaaggtgtctgtggccaaggagggcacccggggcctgcctgagctgaaggagaagaagaacatggtggacaggagcaagctgctgcccaccagcctgcagaatgagttcatccccaaggaggtgctgctgagcctgacctacgccgccaatgccggcccctgcccagagaacctgctgccccccaagaagatcaagacccccaagggcaccctgccccggctggtggaccacgtgtggcaccaccctgtgagaagaaacaagttcaagtacctgattgaccaccctgtgtccctgactggagctggccgggacatctccttcctgtatgatgtgacctacgccaagggccagacccgggagaaggctgtgtgccccccccacctggcccggagcctgcagagccatgatggagtgattgtgccccacaagcccaagaccctgacagacaccctcatccctgaggagttccacatcgtgagcagcactggagtgtctggcctggagtgctatgatgacaagtacaccaccctgctgacagattctgagaaccggctgctgctcttccccagcatgaagcccaacaagagggtggaggtggcccagctgaatgatgtgatggacaccatgctggagagagctggggtggagaaccaggagtacacaggccccaccaagatgcacaagctgctgcacatcctgaagaaggagcagaccatctacaacatgatcttccacgagctgatccggcaggtgtctgtggactgtgccgacagaggagagctgctgagcaaggtgcgggagagatatgtgcagatgctggaccagatcgcccggcagatgattgacttctacaaggacctggtgacccagagggtgatggaccagaggatcctggaggagctgtacaacttcaagcacgtgattgaggagctgacccgggagctgtgcctggtgcgggcccatgatgtgaagctgaccaaggagacagagaaggcccacaaggacctggcccaggccctgctgaatgctgagaagaatgccaagatcgtggaggagtaccatgacctgtacaccctgcagcgggagaggatggagaatgacatgaagaagctggtggccgagcgggacatctggagcagcgccacctatgagctggccctgaaggtgattgaaagaaacagagtcatcctggcccggcggctgtacctgaatgagaagggctggaacaagtacaccaagcacttcatcatcctgctgagcaacaaggacacagaggacctggccctgctgcagaagctgacccagaagtggaggaacctggtgaacaagctgaagcaggaggtggagcagatggaggagagcaccagcgagaccctgaagatcgtgaaggatggcctcatcaagtggcaggagttcttcaatgagaaggacatcctgagccccaacaagggcaacatcttcaacagcgtgctgctggacttcaagcagtggcagaagatcctgaatgagaagaaggaggagttcaccggagatgtgctgctgagcaaatatgacaccctgaagatcatcaagcacctgcaggagaactgggccgacatcggcctgggcatcttcaacagacacaagagcctggagggggagatgcccagcgagcggcagtacatggaggagatcatcaagaacatccagaagctgtacaaggagtatgagatccgcatcaacggggacaatggctacagcaagatcctgcccagcctcatcagcagcctggacttctgcagcttcaagctggagaacctggagttcccagacacccccctggaggagtggcaggagattgatgagaagatcaatgagatgaagagccacctggacatcctgctgaacctgactggaattgtgccccagcacattgatgtggacagcgtgtctgtgctgcaggcctacatcttcaacatgatccagcagtggctgctgaagattggaaatgagatcaacaatggaaacatcgagctgcagcaccacatggatgagctgcacatctccatgatccagtggatggtgaacctgctgatcctgatgatccccaacttcacagaccaggactgcctgctgaagctggaggaggagagcgctgagaagcatgacattggagtggcccggctggagctggatgccatcgagctgaccaggaagctgtaccagtacagcagctacctgagcagctgctgcaagggcatggtgacagccatggccctgagcaagagcaccaacagccacaagaatgccacagaggacctgtatgaggtggacaagctgaagaaggagtgctatgagtggatcaacacctgcagctgcctgctgagcaacatcaagggcaggaagatcaccctgctgacctatgaggagattgaaaggctgctggaggaggaggccgtgaaggagttcatcgagcctgagattgatgagagcttcaaggaggatgaggaggagagcaaggaggacaggaagctgcaggaggagaacaaggagcgggcagaggagcagcccagcaccagcacagagaaggagaagctgatccgcttcatcggagaagatgaaaatgtgcacagcaagcccctgtttgaaacagatgtgctgagctcctggagggagagcgccaagcagggcaccctggcccagaagtacctggaggccatggctgtgattgagcacatgcaggagaagctgctggaggtggagaacagagcccggcaggccgaggagaagtttgaagatgcctatgagaagctgcaccacaccctcatcaagaacaaggacctggaggagctggtgatgaccagcaggaaggagagcaaggaggagaaggagaaccaggatgagcgggaggtgaaggaggaggaggagcagcaggaggaggaggaggtgcgctctgctgagaacagcagcaagagccccaagaagggccactag

SEQ ID NO: 35736 - DNA, 1968 bp, Artificial Sequence
  Description of Artificial Sequence: Synthetic coding sequence
atgagcctgcccaagacccccagcacccccctgaacagcaccagcaccagcgagagcaagaagctgaaggtgtctgtggccaaggagggcacccggggcctgcctgagctgaaggagaagaagaacatggtggacaggagcaagctgctgcccaccagcctgcagaatgagttcatccccaaggaggtgctgctgagcctgacctacgccgccaatgccggcccctgcccagagaacctgctgccccccaagaagatcaagacccccaagggcaccctgccccggctggtggaccacgtgtggcaccaccctgtgagaagaaacaagttcaagtacctgattgaccaccctgtgtccctgactggagctggccgggacatctccttcctgtatgatgtgacctacgccaagggccagacccgggagaaggctgtgtgccccccccacctggcccggagcctgcagagccatgatggagtgattgtgccccacaagcccaagaccctgacagacaccctcatccctgaggagttccacatcgtgagcagcactggagtgtctggcctggagtgctatgatgacaagtacaccaccctgctgacagattctgagaaccggctgctgctcttccccagcatgaagcccaacaagagggtggaggtggcccagctgaatgatgtgatggacaccatgctggagagagctggggtggagaaccaggagtacacaggccccaccaagatgcacaagctgctgcacatcctgaagaaggagcagaccatctacaacatgatcttccacgagctgatccggcaggtgtctgtggactgtgccgacagaggagagctgctgagcaaggtgcgggagagatatgtgcagatgctggaccagatcgcccggcagatgattgacttctacaaggacctggtgacccagagggtgatggaccagaggatcctggaggagctgtacaacttcaagcacgtgattgaggagctgacccgggagctgtgcctggtgcgggcccatgatgtgaagctgaccaaggagacagagaaggcccacaaggacctggcccaggccctgctgaatgctgagaagaatgccaagatcgtggaggagtaccatgacctgtacaccctgcagcgggagaggatggagaatgacatgaagaagctggtggccgagcgggacatctggagcagcgccacctatgagctggccctgaaggtgattgaaagaaacagagtcatcctggcccggcggctgtacctgaatgagaagggctggaacaagtacaccaagcacttcatcatcctgctgagcaacaaggacacagaggacctggccctgctgcagaagctgacccagaagtggaggaacctggtgaacaagctgaagcaggaggtggagcagatggaggagagcaccagcgagaccctgaagatcgtgaaggatggcctcatcaagtggcaggagttcttcaatgagaaggacatcctgagccccaacaagggcaacatcttcaacagcgtgctgctggacttcaagcagtggcagaagatcctgaatgagaagaaggaggagttcaccggagatgtgctgctgagcaaatatgacaccctgaagatcatcaagcacctgcaggagaactgggccgacatcggcctgggcatcttcaacagacacaagagcctggagggggagatgcccagcgagcggcagtacatggaggagatcatcaagaacatccagaagctgtacaaggagtatgagatccgcatcaacggggacaatgaaacaggcagccaccgggtggcccaggccggcctgaagctgctgggcagcagtgaccaccccaccagcgccccccagagcgctggcatccggggcatcatccacaggacctggccctgggtgaacttctacatcgtgtgtgaggtgacccccaagttcttccaggtgtag

SEQ ID NO: 35737 - DNA, 237 bp, Artificial Sequence
  Description of Artificial Sequence: Synthetic coding sequence
atgagcctgcccaagacccccagcacccccctgaacagcaccagcaccagcgagagcaagaagctgaaggtgtctgtggccaaggagggcacccggggcctgcctgagctgaaggagaagaagaacatggtggacaggagcaagctgctgcccaccagcctgcagaatgagttcatccccaaggaggtgctgctgagcctgacctacgccgccaatgccggcccctgcccagagtag

SEQ ID NO: 35738 - DNA, 378 bp, Artificial Sequence
  Description of Artificial Sequence: Synthetic coding sequence
atgagcctgcccaagacccccagcacccccctgaacagcaccagcaccagcgagagcaagaagctgaaggtgtctgtggccaaggagggcacccggggcctgcctgagctgaaggagaagaagaacatggtggacaggagcaagctgctgcccaccagcctgcagaatgagttcatccccaaggaggtgctgctgagcctgacctacgccgccaatgccggcccctgcccagagaacctgctgccccccaagaagatcaagacccccaagggcaccctgccccggctggtggaccacgtgtggcaccaccctgtgagaagaaacaagttcaagtacctgattgaccaccctgtgtccctgactggagctggaagatag

SEQ ID NO: 35739 - DNA, 120 bp, Artificial Sequence
  Description of Artificial Sequence: Synthetic coding sequence
atggctgctggagctgtgttcctggccctgagcgcccagctgctgcaggcccggctgatgaaggaggagagccctgtggtgtcctggaggctggagccagaagatggaacagccctgtag

SEQ ID NO: 35740 - DNA, 147 bp, Artificial Sequence
  Description of Artificial Sequence: Synthetic coding sequence
atggctgctggagctgtgttcctggccctgagcgcccagctgctgcaggcccggctgatgaaggaggtgtcccctgtggtgtcctggaggctggagccagaagatggaacagccctgagcggcgtgtccctgtgcaggcctggatag

SEQ ID NO: 35741 - DNA, 582 bp, Artificial Sequence
  Description of Artificial Sequence: Synthetic coding sequence
atgcccctgccctgggactacccagaggccccctggaggcggctgcacagcagccccccccggccctgcccccgggccctgcagggcggcggccggcggggccccaacccagacccccggggcagcaagggcctgaagcagacagtgggcgccctgaaccccaacctgcacctgtggggcatctgcagctgccagttcctgctgcggagcaagggccgggactttgtgcacagcgtgcaggagacccacagccagctgctgggctcctgggacccctgggaggagccagaagatgctgcccctgtggcccccagcgtgcctgccagcggctacccagagctgcccaccccccggcgggaggtgcagagcgagagcgcccaggagcccggggccagagatgtggaggcccagctgcggcggctgcaggaggagaggacctgcaaggtgtgcctggacagagctgtgtccatcgtgtttgtgccctgtggccacctggtgtgtgctgaatgtgcccctggcctgcagctgtgccccatctgccgggcccctgtgcgcagccgggtgaggaccttcctgtcctag

SEQ ID NO: 35742 - DNA, 7827 bp, Artificial Sequence
  Description of Artificial Sequence: Synthetic coding sequence
atggatggccgggactttgcccccccaccccacctgctgtctgagcggggcagcctgggccacaggtctgctgctgctgctgcccggctggccccagctggccctgctgcccagcccccagcccacttccagcccgggaagtacttccccagccccctgcccatggccagccacactggaagtgccaggaagatgggcagctgcccagcccccagcttcctgcccagcttcctggagcggcccctgtacccagcccccaccaagacagtgtctggccccagcctgcggcccccaacagctgccatccgcagccccaccccagactgtgcccagaagtggagccagaatgcccacgaggcccctggctacccccgcttcagcggcagcctggccagcaccttcctgcctgtgagccacctggaccaccacggcaacagcaatgtgctgtatggccagcaccgcttctacggcacccagaaggacaacttctacctgaggaacctgcccccccagcccaccctgctgcctgccaaccacaacttccccagcgtggcccgggccgccccagcccaccccatgggcagctgcagccgggaccgggacagaggagaggccggcagcctgcagaagggccccaaggactttgaccgcttcctggtgggcaaggagctgggccgggagaaggccggcaaggctgctgagggcaaggagaggcctgctgctgaagaagatggcggcaaggagcggcacaagctggtgctgcctgtgcctgcagatggccactgccgggagggcggccctgcccccaggggggcctgtgagggccggcccaagcacctgaccagctgcctgctgaacaccaaggtgctgaatggagagatgggccgggccgccctggccagctgtgccggcggcatgctgggccggcccggcaccggggtggtgaccagcggccgctgtgccaaggaggccgccggccccccagagcccggccctgccttcagcgagtgcctggagcggcggcagatgctgcaccacacagccagctatgccggccccccaccacccctgagcacagctgctggcagcttcccctgcctgcagctgcacggcggcccagatggcctgtgccccctgcaggacaaggccccccgggacctgaaggccagcggccccacctttgtgcccagcgtgggccacctggccgacaagggccggcccttccaggccgctgaggcctgtgctgtggccggggagggcaaggacagacacctggagggcaccatggccccagaccacgccgccccctatggagtgtcctatgcccacctgaaggccgagggcaaaggagagcggcggcctgggggctttgaagctgccctgaacccccggctgaagggcctggactacctgagcagcgctggccctgaggccagcttccctggcctgcccaagagcggcctggacaagagcggctactttgagctgcccaccagcagccaggactgtgcccggcccggccaccaggaccccctgggcggcaaggccccccaggcctgctgcaccctggacaagacagtgggcaaggaggccccagctggccccccaggggcccagaaggtggcccgcatccgccaccagcagcacctgatggctgctgaggtggagcagggcggcatcggggctgaggccaagaggaagagcctggagctggccagcctgggctacagcggcccccacctgcccccctggggcgtgcaggccggccagggcacagccatggccatcagcgaggagaggaaggccggggcctacctggacccctttggaagtggcctgcagcaggccgccctgctgccccaggagctgcctgcccccccagatgaggtgtctgccatgaagaacctgctgaagtacagcagccaggccctggtggtgggccagaaggcccccctggtgggcctgggcggcctgaaggccagctgcatccagcaggaggccaagttcctgagcagcaaaggacctggccagagcgagaggccagactgtgcccggagccgggagcatgacaccacccatggagatggagaggtgcggcagccccctgtgggcattgctgtggccctggcccggcagaaggacacagtgagccgctctgaggccgcctacggcaccaacacagcccggcagggccgggccgccccagccttcaagggcggcggcggccccaggagcacccacgccctggacctggaggccgaggaggagaggacccggctgtgtgatgaccggctgggcctggccagccgggagctgctgctgcaggacagcaaggacagagtggagtttgcccgcatccacccccccagcagctgccctggggacctggccccccacctgatgatgcagagcggccagctgggcggggaccctgccccccacacccacccccaccccccctggctgcccaggaccaggagccccagcctgtggatgggcggccacagctatggcctgggccacccagccctgcaccagaacctgcccccaggcttccctgcctctgtggccggccctgtgcccagcgtcttccccctgccccaggatgcccccacccagctggtgatcctgcccagcgagcccaccccccacagcgccccccacgccctggctgatgtgatggaccaggccagcctgtggccacccatgtatggaggccggggccctgccagccacatgcagcaccctggccagctgcctgtgtacagccggccccagctgctgcggcagcaggagctgtatgccctgcagcagcagagagctgcccagttccagaggaagccagaggaccagcacctggacctggaggagcccgcccaggagaaggcccccaagagcacccacaagcctgtggccctgacccccacagcccctggggcccccagccctgctgctggccccaccaagctgcccccctgctgccaccccccagaccccaagcccccagccagcagccccaccccaccaccccggcccagcgccccctgcaccctgaatgtgtgcccagccagcagccctggccctggcagccgggtgcgctctgctgaggagaagaatggagagggccagcagagcacagctgacatcatcaccagcgagccagacctgcccccaggctacctgcggcccatggccggcctgggcttcagcctgcccagtgatgtgcacagcagcaacctggaggaccctgagaccatgcagaccacagcccctggggcccagcctgagcccaccaggaccttcctgcctggagagcccccaccctgcagccccaggagcctggaggagcccggcctgctgagcggggcccgggaggccacccaggacctggccgccaccccctaccccacagagcggggcccccagggcaaggctgctgaccccagccccctggagggcctgcaggagctgcagtgtgccgccctgctggaggccggcggccctgaggccaccggccaggcccacagcacccagggcggggcccgggaggagaggagccgggaggagggggagcagggccccagcagcggggccagcagccaggtgctggagcagagagctggcagccctggggccctggaggatgaaggagagcagcctgcccctgaggaggatgagctggaggaggatgagctgggccagcagagcatggaggacagcgaggaggactgtggcggggccccagacaacagccaccccccccgggccctgcccggcctggatgccctggtggccgccaccatcaacctgggggacctgcccagcgacagccccccagacccccagcccccagctgccagcggcccccccagcacagtgcccctgccccacagcagcggcatccacggcatcgccctgctgtctgagctggccgacctggccatccagaggcagaggtctgagaggacagtgcctgaggaggaggaggatgtgctggccttcaacctgcagcacctggccaccctggccacagcctggagcctggtggaggccgccggcctggacagcagcacagccccagcccagcccccaacagccaacccctgcagcggcccccggctgacccccaggatgcagatcctgcagaggaaggacacctggacccccaagaccaagcctgtgtgccccctgaaggccgccatcgaccggctggacacccaggaggtgggcatgagggtgcggctggccgagctgcagaggcgctacaaggagaagcagcgggagctggcccggctgcagaggaagcatgaccacgagagagatgagagcagccgcagccctgcccggcggggccctggccggcccaggaagaggaagcacagcagcagcctgcctgccccccggcccaccggccccctgcccaggagtgatggcaagaaggtgaaggctgtgaggaccagcctgggcctgctgtgtgccgagctgcggggcggcagcggcggggagcccgccaagaagaggagcaagctggagaggtctgtgtatgccggcctgcagacagcctctgtggagaaggcccagtgcaagaagagcagctgccagggcggcctggcccccagcgtggcccaccgggtggcccagctgaagcccaaggtgaagagcaagggcctgcccaccggcctgagcagcttccagcagaaggaggccaccccaggcggccgcatccgggagaagctgagccgggccaagagcgccaaggtgtctggggccaccaggcacccccagcccaagggccacggcagccgggagaccccccgctgcccagcccagcccagcgtggccgccagccaggaggccggcagcggctatgattctgaggactgtgagggcctgctgggcacagaggccccaccccgggaggccggcctgctgctgcacactggagcctctgtggccgtgctgggccccagccccagctctgtggtgaagatggaggccaaccagaaggccaagaagaagaaggagcggcagggcctgctgggcgcctgccgcctgagcagccctgagagcgaggtgaagatcaagagaagatctgtgaaggccaaggtgggcaccaccctggagcgggcccctggccagaggcctcctggggccctgggcaagaagaaggccaagggcaaggccaagggcagcctgcgggcagagcccggggccacccccagcagagatgccctcttcaaccccagccgggcctttgcctgccgggaggagggcagccagctggccagcgagcggctgaagagggccaccaggaagggcaccgtgctgcagcctgtgctgcggaggaagaatggagccctgagcatcaccctggccaccagaaatgccaaggccatcctgggcaagggcaggaagctgagcaaggtgaagcacaaggccggcaagcagggcaagggccgggctgtgtcccggctgctggagagctttgctgtggaggaggactttgaatttgatgacaacagcagcttcagcgaggaggaggaggatgaggaggaggaggaggaggacagcggccccctgtctgctgagcagagcgctgccctggcccggagctgtgccatccacaaggaggacctgagagatggcctgcctgtgctgatccccaaggaggacagcctgctgtatgccggctctgtgaggaccctgcagcccccagacatctacagcatcgtcatcgagggggagcggggcaaccggcagaggatctacagcctggagcagctgctgcaggaggccgtgctggatgtgcggccccagagcagccgctacctgcccccaggcaccagggtgtgtgcctactggagccagaagagccgctgcctgtacccaggaaatgtggtgcggggggccagcggagatgaagatgaggacctggacagcgtggtggtggagtttgatgatggagacaccggccacatcgctgtgtccaatgtgcggctgctgcccccagacttcaagatccagtgcacagagcccagccctgccctgctggtgagcagcagctgcaggaggaccaagaaggtgagcagcgaggcccccccacccagcgaggccgccacccccagcctgagccccaaggcccaggacggccctgaggccctgaagaccccaggcaagaagagcatcagcaaggacaaggccggcaaggccgagctgctgaccagcggggccaagagccccactggagccagtgaccacttcctgggccggcggggcagccccctgctgtcctggagcgctgtggcccagaccaagaggaaggctgtggccgccgccagcaagggccctggggtgctgcagaacctcttccagctgaatggcagcagcaagaagctgcgggcccgggaggccctcttccctgtgcacagcgtggccacccccatctttggaaatggcttccgggctgacagcttcagcagcctggccagcagctatgccccctttgtgggcggcaccggccctggcctgcccaggggggcccacaagctgctgcgggccaagaaggccgagcgggtggaggccgagaagggcggcagaagaagagctggaggagagttcctggtgaagctggaccacgagggcgtgaccagccccaagaacaagacctgcaaggccctgctgatgggagacaaggacttcagccccaagctgggccggcccctgcccagccccagctatgtgcacccagccctggtgggcaaggacaagaagggccgggcccccatcccccccctgcccatgggcctggccctgaggaaatatgccggccaggccgagttccccctgccctatgacagcgactgccacagcagcttcagtgatgaagatgaagatggccctggcctggccgccggcgtgcccagccgcttcctggcccggctgtctgtgagcagcagcagcagcggcagcagcaccagcagcagcagcggctctgtgtccaccagcagcctgtgcagcagtgacaatgaagacagcagctacagcagtgatgatgaggaccctgccctgctgctgcagacctgcctgacccaccctgtgcccaccctgctggcccagcctgaggccctgcggagcaaaggaagtggcccccacgcccacgcccagcgctgcttcctgagccgggccaccgtggccggcaccggggccggcagcggccccagcagcagcagcaagagcaagctgaagaggaaggaggccctgtccttcagcaaggccaaggagctgagccggcggcagaggcctcccagcgtggagaaccggcccaagatcagcgccttcctgcctgcccggcagctgtggaagtggagcggcaaccccacccagaggcggggcatgaagggcaaggccaggaagctgttctacaaggccatcgtgcggggggaggagaccctgcgggtgggggactgtgctgtgttcctgtctgctggccggcccaacctgccctacatcggccgcatcgagagcatgtgggagagctggggcagcaacatggtggtgaaggtgaagtggttctaccaccctgaggagaccaagctgggcaagaggcagtgtgatggcaagaatgccctgtaccagagctgccatgaagatgaaaatgatgtgcagaccatcagccacaagtgccaggtggtggcccgggagcagtatgagcagatggcccggagcaggaagtgccaggaccggcaggacctgtactacctggccggcacctatgaccccaccaccggccgcctggtgacagcagatggagtgcccatcctgtgctag

SEQ ID NO: 35743 - DNA, 1260 bp, Artificial Sequence
  Description of Artificial Sequence: Synthetic coding sequence
atgaacaagcaccagaagcctgtgctgaccggccagcgcttcaagaccaggaagagagatgagaaggagaagtttgagcccaccgtcttccgggacaccctggtgcagggcctgaatgaagctggagatgacctggaggccgtggccaagttcctggacagcacaggcagccggctggactaccgccgctatgctgacaccctgtttgacatcctggtggccggctccatgctggcccctgggggcaccagaattgatgatggagacaagaccaagatgaccaaccactgtgtgttcagcgccaatgaagatcatgagaccatcagaaattatgcccaggtgttcaacaagctgatccgccgctacaagtacctggagaaggcctttgaagatgagatgaagaagctgctgctcttcctgaaggccttcagcgagacagagcagaccaagctggccatgctgagcggcatcctgctgggcaatggcaccctgcctgccaccatcctgaccagcctcttcacagacagcctggtgaaggagggcattgctgccagctttgctgtgaagctgttcaaggcctggatggccgagaaggatgccaacagcgtgaccagcagcctgaggaaggccaacctggacaagaggctgctggagctgtttcctgtgaaccggcagagcgtggaccactttgccaagtacttcacagatgctggcctgaaggagctgagtgacttcctgcgggtgcagcagagcctgggcaccaggaaggagctgcagaaggagctgcaggagcggctgagccaggagtgccccatcaaggaggtggtgctgtatgtgaaggaggagatgaagagaaatgacctgcctgagacagctgtgattggcctgctgtggacctgcatcatgaatgctgtggagtggaacaagaaggaggagctggtggccgagcaggccctgaagcacctgaagcagtatgcccccctgctggccgtgttcagcagccagggccagagcgagctgatcctgctgcagaaggtgcaggagtactgctatgacaacatccacttcatgaaggccttccagaagatcgtggtgctcttctacaaggcagatgtgctgtctgaggaggccatcctgaagtggtacaaggaggcccacgtggccaagggcaagagcgtcttcctggaccagatgaagaagtttgtggagtggctgcagaatgctgaggaggagagcgagagcgagggggaggagaactag

SEQ ID NO: 35744 - DNA, 1227 bp, Artificial Sequence
  Description of Artificial Sequence: Synthetic coding sequence
atgaacaagcaccagaagcctgtgctgaccggccagcgcttcaagaccaggaagagagatgagaaggagaagtttgagcccaccgtcttccgggacaccctggtgcagggcctgaatgaagctggagatgacctggaggccgtggccaagttcctggacagcacaggcagccggctggactaccgccgctatgctgacaccctgtttgacatcctggtggccggctccatgctggcccctgggggcaccagaattgatgatggagacaagaccaagatgaccaaccactgtgtgttcagcgccaatgaagatcatgagaccatcagaaattatgcccaggtgttcaacaagctgatccgccgctacaagtacctggagaaggcctttgaagatgagatgaagaagctgctgctcttcctgaaggccttcagcgagacagagcagaccaagctggccatgctgagcggcatcctgctgggcaatggcaccctgcctgccaccatcctgaccagcctcttcacagacagcctggtgaaggagggcattgctgccagctttgctgtgaagctgttcaaggcctggatggccgagaaggatgccaacagcgtgaccagcagcctgaggaaggccaacctggacaagaggctgctggagctgtttcctgtgaaccggcagagcgtggaccactttgccaagtacttcacagatgctggcctgaaggagctgagtgacttcctgcgggtgcagcagagcctgggcaccaggaaggagctgcagaaggagctgcaggagcggctgagccaggagtgccccatcaaggaggtggtgctgtatgtgaaggaggagatgaagagaaatgacctgcctgagacagctgtgattggcctgctgtggacctgcatcatgaatgctgtggagtggaacaagaaggaggagctggtggccgagcaggccctgaagcacctgaagcagtatgcccccctgctggccgtgttcagcagccagggccagagcgagctgatcctgctgcagaaggtgcaggagtactgctatgacaacatccacttcatgaaggccttccagaagatcgtggtgctcttctacaaggcagatgtgctgtctgaggaggccatcctgaagtggtacaaggaggcccacgtggccaagggcaagagcgtcttcctggaccagatgaagaagtttgtggagtggctgcagaatgcctag

SEQ ID NO: 35745 - DNA, 492 bp, Artificial Sequence
  Description of Artificial Sequence: Synthetic coding sequence
atgaacaagcaccagaagcctgtgctgaccggccagcgcttcaagaccaggaagagagatgagaaggagaagtttgagcccaccgtcttccgggacaccctggtgcagggcctgaatgaagctggagatgacctggaggccgtggccaagttcctggacagcacaggcagccggctggactaccgccgctatgctgacaccctgtttgacatcctggtggccggctccatgctggcccctgggggcaccagaattgatgatggagacaagaccaagatgaccaaccactgtgtgttcagcgccaatgaagatcatgagaccatcagaaattatgcccaggtgttcaacaagctgatccgccgctacaagtacctggagaaggcctttgaagatgagatgaagaagctgctgctcttcctgaaggccttcagcgagacagagcagaccaagctggccatgctgagcggcatcctgctgggcaatggcacctag

SEQ ID NO: 35746 - DNA, 1260 bp, Artificial Sequence; identical to SEQ ID NO: 35743
  Description of Artificial Sequence: Synthetic coding sequence

SEQ ID NO: 35747 - DNA, 627 bp, Artificial Sequence
  Description of Artificial Sequence: Synthetic coding sequence
atgaacaagcaccagaagcctgtgctgaccggccagcgcttcaagaccaggaagagagatgagaaggagaagtttgagcccaccgtcttccgggacaccctggtgcagggcctgaatgaagctggagatgacctggaggccgtggccaagttcctggacagcacaggcagccggctggactaccgccgctatgctgacaccctgtttgacatcctggtggccggctccatgctggcccctgggggcaccagaattgatgatggagacaagaccaagatgaccaaccactgtgtgttcagcgccaatgaagatcatgagaccatcagaaattatgcccaggtgttcaacaagctgatccgccgctacaagtacctggagaaggcctttgaagatgagatgaagaagctgctgctcttcctgaaggccttcagcgagacagagcagaccaagctggccatgctgagcggcatcctgctgggcaatggcaccctgcctgccaccatcctgaccagcctcttcacagacagcctggtgaaggagggcattgctgccagctttgctgtgaagctgttcaaggcctggatggccgagaaggatgccaacagcgtgaccagcagcctgaggtag

SEQ ID NO: 35748 - DNA, 825 bp, Artificial Sequence
  Description of Artificial Sequence: Synthetic coding sequence
atgaacaagcaccagaagcctgtgctgaccggccagcgcttcaagaccaggaagagagatgagaaggagaagtttgagcccaccgtcttccgggacaccctggtgcagggcctgaatgaagctggagatgacctggaggccgtggccaagttcctggacagcacaggcagccggctggactaccgccgctatgctgacaccctgtttgacatcctggtggccggctccatgctggcccctgggggcaccagaattgatgatggagacaagaccaagatgaccaaccactgtgtgttcagcgccaatgaagatcatgagaccatcagaaattatgcccaggtgttcaacaagctgatccgccgctacaagtacctggagaaggcctttgaagatgagatgaagaagctgctgctcttcctgaaggccttcagcgagacagagcagaccaagctggccatgctgagcggcatcctgctgggcaatggcaccctgcctgccaccatcctgaccagcctcttcacagacagcctggtgaaggagggcattgctgccagctttgctgtgaagctgttcaaggcctggatggccgagaaggatgccaacagcgtgaccagcagcctgaggaaggccaacctggacaagaggctgctggagctgtttcctgtgaaccggcagagcgtggaccactttgccaagtacttcacagatgctggcctgaaggagctgagtgacttcctgcgggtgcagcagagcctgggcaccaggaaggagctgcagaaggagctgcaggagcggctgagccaggagtgccccatcaaggagtag

SEQ ID NO: 35749 - DNA, 486 bp, Artificial Sequence
  Description of Artificial Sequence: Synthetic coding sequence
atgaacaagcaccagaagcctgtgctgaccggccagcgcttcaagaccaggaagagagatgagaaggagaagtttgagcccaccgtcttccgggacaccctggtgcagggcctgaatgaagctggagatgacctggaggccgtggccaagttcctggacagcacaggcagccggctggactaccgccgctatgctgacaccctgtttgacatcctggtggccggctccatgctggcccctgggggcaccagaattgatgatggagacaagaccaagatgaccaaccactgtgtgttcagcgccaatgaagatcatgagaccatcagaaattatgcccaggtgttcaacaagctgatccgccgctacaagtacctggagaaggcctttgaagatgagatgaagaaggccctgcggccccacctgctgagcagcttcagcaagcacggctggcagaagaagatgcccaccctgctgccccggctgtag

SEQ ID NO: 35750 - DNA, 477 bp, Artificial Sequence
  Description of Artificial Sequence: Synthetic coding sequence
atgaaccaggagaagctggccaagctgcaggcccaggtgagaattggaggcaagggcacagcccggaggaagaagaaggtggtgcacaggacagccacagcagatgacaagaagctgcagagcagcctgaagaagctggccgtgaacaacattgctggcatcgaggaggtgaacatgatcaaggatgatggcaccgtcatccacttcaacaaccccaaggtgcaggccagcctgagcgccaacacctttgccatcaccggccatgctgaggccaagcccatcacagagatgctgcccggcatcctgagccagctgggcgctgacagcctgaccagcctgaggaagctggccgagcagttcccccggcaggtgctggacagcaaggcccccaagccagaagatattgatgaggaggatgatgatgtgcctgacctggtggagaactttgatgaggccagcaagaatgaggccaactag

SEQ ID NO: 35751 - DNA, 303 bp, Artificial Sequence
  Description of Artificial Sequence: Synthetic coding sequence
atgatcaaggatgatggcaccgtcatccacttcaacaaccccaaggtgcaggccagcctgagcgccaacacctttgccatcaccggccatgctgaggccaagcccatcacagagatgctgcccggcatcctgagccagctgggcgctgacagcctgaccagcctgaggaagctggccgagcagttcccccggcaggtgctggacagcaaggcccccaagccagaagatattgatgaggaggatgatgatgtgcctgacctggtggagaactttgatgaggccagcaagaatgaggccaactag

SEQ ID NO: 35752 - DNA, 213 bp, Artificial Sequence
  Description of Artificial Sequence: Synthetic coding sequence
atggccgaggtgaagtccatgttccgggaggtgctgcccaagcagggccccctgtttgtggaggacatcatgaccatggtgctgtgcaagcccaagctgctgcccctgaagagcctgaccctggagaagctggagaagatgcaccaggccgcccagaacaccatccggcagcaggagatggccgagaaggaccagaggcagatcacccactag

SEQ ID NO: 35753 - DNA, 213 bp, Artificial Sequence; identical to SEQ ID NO: 35752
  Description of Artificial Sequence: Synthetic coding sequence

SEQ ID NO: 35754 - DNA, 279 bp, Artificial Sequence
  Description of Artificial Sequence: Synthetic coding sequence
atgctgaaggctgctgccaagaggcctgagctgagcggcaagaacaccatcagcaacaacagcgacatggccgaggtgaagtccatgttccgggaggtgctgcccaagcagggccccctgtttgtggaggacatcatgaccatggtgctgtgcaagcccaagctgctgcccctgaagagcctgaccctggagaagctggagaagatgcaccaggccgcccagaacaccatccggcagcaggagatggccgagaaggaccagaggcagatcacccactag

SEQ ID NO: 35755 - DNA, 204 bp, Artificial Sequence
  Description of Artificial Sequence: Synthetic coding sequence
atgctgaaggctgctgccaagaggcctgagctgagcggccccctgtttgtggaggacatcatgaccatggtgctgtgcaagcccaagctgctgcccctgaagagcctgaccctggagaagctggagaagatgcaccaggccgcccagaacaccatccggcagcaggagatggccgagaaggaccagaggcagatcacccactag

SEQ ID NO: 35756 - DNA, 312 bp, Artificial Sequence
  Description of Artificial Sequence: Synthetic coding sequence
atgctgaaggctgctgccaagaggcctgagctgagcggcctgctgaagttcaacaactacggcatcctgtctgagagccccctgaccagccagaggaccacctggctgctgtaccagagccccagcttcatccctggctttgcctaccccagccgctgcctgaagaccatcggcggcgtgtacaagcaggccaggaagaagcactacatccagcagctgcgctatggccgctctgaggtgaatgtgcccggcagcagcagcaaggcccgggccaccgtgtgtggccgctacaatgacaacggggctgtgtag

SEQ ID NO: 35757 - DNA, 879 bp, Artificial Sequence
  Description of Artificial Sequence: Synthetic coding sequence
atggctgtgcccacagagctggatggcggctctgtgaaggagacagctgctgaggaggagagccgggtgctggcccctggggccgccccctttggaaacttcccccactacagccgcttccaccccccagagcagaggctgcggctgctgcccccagagctgctgcggcagctgtttcctgagagcccagaaaatggccccatcctgggcctggatgtgggctgcaacagcggggacctgtctgtggccctgtacaagcacttcctgagcctgcctgatggagagacctgcagtgatgccagccgggagttccggctgctgtgctgtgacattgatcctgtgctggtgaagagagctgagaaggagtgccccttcccagatgccctgaccttcatcaccctggacttcatgaaccagaggaccaggaaggtgctgctgagcagcttcctgagccagtttggccgctctgtgtttgacatcggcttctgcatgagcatcaccatgtggatccacctgaaccacggggaccacggcctgtgggagttcctggcccacctgagcagcctgtgccactacctgctggtggagccccagccctggaagtgctacagagctgctgcccggcggctgaggaagctgggcctgcatgactttgaccacttccacagcctggccatccggggggacatgcccaaccagatcgtgcagatcctgacccaggaccacggcatggagctgatctgctgcttcggcaacacctcctgggacaggagcctgctgctcttccgggccaagcagaccatcgagacccaccccatccctgagagcctcatcgagaagggcaaggagaagaaccggctgtccttccagaagcagtag

SEQ ID NO: 35758 - DNA, 741 bp, Artificial Sequence
  Description of Artificial Sequence: Synthetic coding sequence
atgagcctgcagtggacagctgtggccaccttcctgtatgcagaggtgtttgtggtgctgctgctgtgcatccccttcatcagccccaagcgctggcagaagatcttcaagagccggctggtggagctgctggtgtcctatggcaacaccttctttgtggtgctgattgtcatcctggtgctgctggtgattgatgctgtgcgggagatcagaaaatatgatgatgtgacagagaaggtgaacctgcagaacaaccctggggccatggagcacttccacatgaagctgttccgggcccagaggaacctgtacatcgccggcttcagcctgctgctgtccttcctgctgcggcggctggtgaccctcatcagccagcaggccaccctgctggccagcaatgaggccttcaagaagcaggccgagagcgccagcgaggccgccaagaagtacatggaggagaatgaccagctgaagaagggagctgctgtggatggcggcaagctggatgtgggcaatgctgaggtgaagctggaggaggagaacagaagcctgaaggctgacctgcagaagctgaaggatgagctggccagcaccaagcagaagctggagaaggccgagaaccaggtgctggccatgaggaagcagagcgagggcctgaccaaggagtatgaccggctgctggaggagcacgccaagctgcaggccgctgtggatggccccatggacaagaaggaggagtag

SEQ ID NO: 35759 - DNA, 741 bp, Artificial Sequence; identical to SEQ ID NO: 35758
  Description of Artificial Sequence: Synthetic coding sequence

SEQ ID NO: 35760 - DNA, 636 bp, Artificial Sequence
  Description of Artificial Sequence: Synthetic coding sequence
atggcccaggccaagatcaatgccaaggccaatgaaggccgcttctgccgcagcagctccatggctgacaggagcagccggctgctggagagcctggaccagctggagctgcgggtggaggccctgcgggaggccgccacagctgtggagcaggagaaggagatcctgctggagatgatccacagcatccagaacagccaggacatgaggcagatcagtgatggagagcgggaggagctgaacctgacagccaaccggctgatgggccgcaccctgactgtggaggtgtctgtggagaccatccggaacccccagcagcaggagagcctgaagcacgccacccgcatcattgatgaggtggtgaacaagttcctggatgacctgggcaatgccaagagccacctgatgagcctgtacagcgcctgcagcagcgaggtgccccacggccctgtggaccagaagttccagagcatcgtcatcggctgtgccctggaggaccagaagaagatcaagaggcggctggagaccctgctgagaaatattgagaacagcgacaaggccatcaagctgctggagcacagcaaaggagctggcagcaagaccctgcagcagaatgctgagagccgcttcaactag

SEQ ID NO: 35761 - DNA, 327 bp, Artificial Sequence
  Description of Artificial Sequence: Synthetic coding sequence
atgccccacatgtgggtggaggccctgcgggaggccgccacagctgtggagcaggagaaggagatcctgctggagatgatccacagcatcctgacagccaaccggctgatgggccgcaccctgactgtggaggtgtctgtggagaccatccggaacccccagcagcaggagagcctgaagcacgccacccgcatcattgatgaggtggtgaacaagttcctggatgacctgggcaatgccaagagccacctgatgagcctgtacagcgcctgcagcagcgaggtgccccacggccctgtggaccagaagttccagagcatcgtgtag

SEQ ID NO: 35762 - DNA, 537 bp, Artificial Sequence
  Description of Artificial Sequence: Synthetic coding sequence
atgccccacatgtgggtggaggccctgcgggaggccgccacagctgtggagcaggagaaggagatcctgctggagatgatccacagcatccagaacagccaggacatgaggcagatcagtgatggagagcgggaggagctgaacctgacagccaaccggctgatgggccgcaccctgactgtggaggtgtctgtggagaccatccggaacccccagcagcaggagagcctgaagcacgccacccgcatcattgatgaggtggtgaacaagttcctggatgacctgggcaatgccaagagccacctgatgagcctgtacagcgcctgcagcagcgaggtgccccacggccctgtggaccagaagttccagagcatcgtgattggctgtgccctggaggaccagaagaagatcaagaggcggctggagaccctgctgaggaacattgaaaattctgacaaggccatcaagctgctggagcacagcaagggggccggcagcaagaccctgcagcagaatgctgagagccgcttcaactag

SEQ ID NO: 35763 - DNA, 1938 bp, Artificial Sequence
  Description of Artificial Sequence: Synthetic coding sequence
atgtctgagaggacccaggagcaggactttgtgatcatcaccgtggatgacagtgatgacaacaatgactgcagcattgagatggtggaggtgtctgaaacagctgacaacagcaccaatgacattgctgatgacagcacctacgtgacagctgacaaccccacagatgacacagccacccagcccaacttccctggaggaaatgatggccaccaccggcccctgcagatgtcctatggcagcggctctgtgacccaggccggcgtgcagtggcatgaccacagcagcctgcagccccagcccctgggcctgaagcagttcttccacctgagcctgcccagctcctgggatgacaggaggaccccaccctgccctgtggcccacggggaccagatcgtgtcccagatcaaccaccctgtgcacctgcggcgctacagctacaacagcgaggaggtggacttccccaagaggggccgcttctacaccccagaggtgcagagcagcatcagccccccagctgagcggcaggagacccacgcctgggccagccctgctgtgaccagcctggagagcgctgcctgccacgagctgcaggaggccgacctgtctgagagcctgagctaccccagaattgtgagcagcagcagcctgcagcagtatgtggcccagggcggcagcttcccctgcttcggcatgccctggaacttcatcagcggcggcgctgagagcaccaatgctgtgatcagctttgccaatgccaccacagctgtgcccatggctgtgctgagccggcgggagagcagcctggccaacaaccctggggtggtgaactacagcgccctgcctgaaaatgaaaatgtgggccctggccgggccctgagcagcttctgcttccaccccaacctggagagcggcccccagatgtcctatggcaccatgagctacagcacagagatgaagaacaactgtgaccaggatgatgccagcgccagcgcctgcctgaccccagactttgccctgctgcccctgaacatcctggtgaaggtggacaccaacacagagaacagcgtgaacaccatgaacagaagcaccctgctggacagcgacagcggccaggacagcagcagcagctctgtgtgcatcccccccaagtatggctacctgggggaccccaagagaaatgtgcgggtgctgaagatccacctgctggccgtgcagaacatggccaagcccaagcaggccgcctgctacctggtgcgcatcctcttcagcaaggagatcctgatcagcagctctgtggacatccacctgaaggacagccagagcctggaccccaacaagatggccgccctgcgggagtacctggccaccaccttccccacctgtgacctgcatgaacatggcaaggactggcaggactgcatcagcggcatcaacagcatgatctactgcctgtgcagcgagggcaagagcacccccaagacagtgaggaagaacaagaagaggaccaacagagtggccagcgccagcgctgacagaaatgaccagagaggaagagatggaggagagggctgctcctggatgttccagcccatgaacaacagcaagatgagggagaagaggaacctgcagcccaacagcaatgccatccctgagggcatgagggagcccagcacagacaaccctgaggagcctggagaggcctggagctacttcggccggccctggaggaacatccgcatgccctgcagcgtgctgaccctggccaagaccaagagctgtgccagcctgagcgcccgctacctgatccagaagctgttcaccaaggatgtgctggtgcagagcaatgtgtatggcaacctgaagcacggcctgtgtgccctggaccccaacaagatcagcgccctgcggggcctgctgcacatcgagtatgtgtag

SEQ ID NO: 35764 - DNA, 2400 bp, Artificial Sequence
  Description of Artificial Sequence: Synthetic coding sequence
atgtctgagaggacccaggagcaggactttgtgatcatcaccgtggatgacagtgatgacaacaatgactgcagcattgagatggtggaggtgtctgaaacagctgacaacagcaccaatgacattgctgatgacagcacctacgtgacagctgacaaccccacagatgacacagccacccagcccaacttccctggaggaaatgatggccaccaccggcccctgcagatgtcctatggcagcggctctgtgacccaggccggcgtgcagtggcatgaccacagcagcctgcagccccagcccctgggcctgaagcagttcttccacctgagcctgcccagctcctgggatgacaggaggaccccaccctgccctgtggcccacggggaccagatcgtgtcccagatcaaccaccctgtgcacctgcggcgctacagctacaacagcgaggaggtggacttccccaagaggggccgcttctacaccccagaggtgcagagcagcatcagccccccagctgagcggcaggagacccacgcctgggccagccctgctgtgaccagcctggagagcgctgcctgccacgagctgcaggaggccgacctgtctgagagcctgagctaccccagaattgtgagcagcagcagcctgcagcagtatgtggcccagggcggcagcttcccctgcttcggcatgccctggaacttcatcagcggcggcgctgagagcaccaatgctgtgatcagctttgccaatgccaccacagctgtgcccatggctgtgctgagccggcgggagagcagcctggccaacaaccctggggtggtgaactacagcgccctgcctgaaaatgaaaatgtgggccctggccgggccctgagcagcttctgcttccaccccaacctggagatgcctgagaggcctgccaacagcagcaagaacagcacagaaacagccaactaccccaccctgatgggcaactacaacggccagaacacagccagcctgtctgtgttcatccccccctactttgctgagaagatcatcctgacagagatgcctggcaccacagagaccaacgtggagaacaacagccagacagtgtactacccagccctgagcggcaacaccagcgccccctacccagccagcagctacctgcccatcaccagcaactttgaaagtggcccccagatgtcctatggcaccatgagctacagcacagagatgaagaacaactgtgaccaggatgatgccagcgccagcgcctgcctgaccccagactttgccctgctgcccctgaacatcctggtgaaggtggacaccaacacagaaaattctgtgaacaccatgaacagaagcaccctgctggacagcgacagcggccaggacagcagcagcagctctgtgtgcatcccccccaagtatggctacctgggggaccccaagagaaatgtgcgggtgctgaagatccacctgctggccgtgcagaacatggccaagcccaagcaggccgcctgctacctggtgcgcatcctcttcagcaaggagatcctgatcagcagctctgtggacatccacctgaaggacagccagagcctggaccccaacaagatggccgccctgcgggagtacctggccaccaccttccccacctgtgacctgcacgagcacggcaaggactggcaggactgcatcagcggcatcaacagcatgatctactgcctgtgcagcgagggcaagagcacccccaagacagtgaggaagaacaagaagaggaccaacagagtggccagcgccagcgctgacagaaatgaccagagaggaagagatggaggagagggctgctcctggatgttccagcccatgaacaacagcaagatgagggagaagaggaacctgcagcccaacagcaatgccatccctgagggcatgagggagcccagcacagacaaccctgaggagcccggggaggcctggagctacttcggccggccctggaggaacatccgcatgccctgcagcgtgctgaccctggccaagaccaagagctgtgccagcctgagcgcccgctacctgatccagaagctgttcaccaaggatgtgctggtgcagagcaatgtgtatggcaacctgaagcacggcctgtgtgccctggaccccaacaagatcagcgccctgcgggagttcctgcaggagaactaccccatctgtgacctgtctgaaaatggccgggactggaagagctgtgtgaccagcatcaacagcggcatccgcagcctgcggcatgatgtgcggcgggcagaggcccggagccagagcctgcctgctgtgaccccacctgagctggagcaggagagcaagccaggggaccctgatgccacagaccccagcacctag

SEQ ID NO: 35765 - DNA, 2487 bp, Artificial Sequence
  Description of Artificial Sequence: Synthetic coding sequence
atgaacagcacagagttcacagaagatgtggaggaggtgctgaagagcatcaccgtgaaggtggagacagaagcagaagatgctgccctggactgcagcgtgaacagcaggaccagcgagaagcacagcgtggacagcgtgctgacagccctgcaggacagcagcaagaggaagcagctggtgtctgatggcctgctggacagcgtgcctggggtgaagagaagaagactcatccctgaggccctgctggccggcatgaggaaccgggagaacagcagcccctgccagggcaatggagagcaggccggccggggccgcagcctgggcaatgtgtggccaggagaggaggagccctgcaatgatgccaccacccccagctacaagaagcccctgtatggcatcagccacaagatcatggagaagaagaacccccccagcggggacctgctgaatgtgtatgagctgtttgagaaggccaatgccagcaacagccccagcagcctgcggctgctgaatgagccccagaagagggactgtggcagcactggagctggaacagacaatgaccccaacatctacttcctgatccagaagatgttctacatgctgaacaccctgaccagcaacatgagccagctgcacagcaaggtggacctgctgagcctggaggtgagccgcatcaagaagcaggtgagccccacagagatggtggccaagttccagcccccacctgagtaccagctgacagctgctgagctgaagcagatcgtggaccagagcctgagcggcggggacctggcctgccgcctgctggtgcagctgtttcctgagctgttcagtgatgtggacttcagccggggctgcagcgcctgtggctttgctgccaagaggaagctggagagcctgcacctgcagctgatccggaactacgtggaggtgtactaccccagcgtgaaggacacagctgtgtggcaggctgaatgtctgccccagctgaatgacttcttcagccgcttctgggcccagcgggagatggaggacagccagcccagcggccaggtggccagcttctttgaggccgagcaggtggaccccggccacttcctggacaacaaggaccaggaggaggccctgagcctggacaggagcagcaccatcgccagtgaccacgtggtggacacccaggacctgacagagttcctggatgaggccagcagccctggagaatttgctgtgttcctgctgcacaggctcttccctgagctgtttgaccacaggaagctgggggagcagtacagctgctatggagatggcggcaagcaggagctggacccccagaggctgcagatcatccggaactacacagagatctacttcccagacatgcaggaggaggaggcctggctgcagcagtgtgcccagaggatcaatgatgagctggagggcctgggcctggatgctggcagcgagggggaccccccaagagatgactgctatgacagcagcagcctgcctgatgacatctctgtggtgaaggtggaggacagctttgaaggagagcggcccggccgccgcagcaagaagatctggctggtgcccatcgactttgacaagctggagatcccccagcctgactttgaggtgcctggagctgactgcctgctgagcaaggagcagctgcggagcatctatgagagcagcctgagcatcggcaactttgccagccggctgctggtgcacctgtttcctgagctgttcacccatgagaacctgaggaagcagtacaactgcagcggcagcctgggcaagaagcagctggaccccagccgcatcaagctgatccgccactacgtgcagctgctgtacccccgggccaagaatgacagagtgtggaccctggagtttgtgggcaagctggatgagcgctgcagaagaagagacacagagcagaggaggagctaccagcagcagaggaaggtgcacgtgcccggccctgagtgccgggacctgaccagctatgccatcaaccctgagcgcttccgggaggagtttgagggcccccccctgcccccagagaggagcagcaaggacttctgcaagatccccctggatgagctggtggtgcccagcccagacttccctgtgcccagcccctacctgctgagtgacaaggaggtgcgggagatcgtgcagcagagcctgtctgtgggcaactttgctgcccggctgctggtgcggctcttccctgagctgttcaccgctgagaacctgcggctgcagtacaaccacagcggggcctgcaacaagaagcagctggaccccacccggctgcggctcatccgccactacgtggaggccgtgtaccctgtggagaagatggaggaggtgtggcactatgagtgcatccccagcattgatgagcgctgccggcggcccaacaggaagaagtgtgacatcctgaagaaggccaagaaggtggagaagtag

SEQ ID NO: 35766 - DNA, 2487 bp, Artificial Sequence; identical to SEQ ID NO: 35765
  Description of Artificial Sequence: Synthetic coding sequence

SEQ ID NO: 35767 - DNA, 1218 bp, Artificial Sequence
  Description of Artificial Sequence: Synthetic coding sequence
atgcagcctgctgaggagggccccagcgtgcccaagatctacaagcagaggagcccctacagcgtgctgaagaccttccccagcctgaatgtggtgtctgagagcaggatgatcctggatgcctttgcccagcagtgcagccgggtgctgagcctgctgaactgtggcggcaagctgctggacagcaaccacagccagagcatgatcagctgtgtgaagcaggagggcagcagctacaatgaaaggcaggagcactgccacatcggcaagggcgtgcacagccagaccagtgacaacgtggacatcgagatgcagtacatgcagaggaagcagcagaccagcgccttcctgcgggtcttcacagacagcctgcagaactacctgctgagcggcagcttccccacccccaaccccagcagcgcctctgaatatggccacctggctgatgtggaccccctgagcaccagccctgtgcacaccctgggcggctggaccagccctgccaccagcgagagccacggccaccccagcagcagcaccctgcctgaggaggaggaggaggaggatgaggagggctactgcccccgctgccaggagctggagcaggaggtgatcagcctgcagcaggagaatgaggagctgcggaggaagctggagagcatccctgtgccctgccagacagtgctggactacctgaagatggtgctgcagcaccacaaccagctgctgatcccccagcctgctgaccagcccacagagggcagcaagcagctgctgaacaactaccctgtgtacatcaccagcaagcagtgggatgaggccgtgaacagcagcaagaaggatggaagaaggctgctgcgctacctgatccgctttgtgttcaccacagatgagctgaagtacagctgtggcctgggcaagaggaagaggtctgtgcagagcggggagactggacctgagcggcggcccctggaccctgtgaaggtgacctgcctgcgggagttcatccgcatgcactgcaccagcaacccagactggtggatgcccagcgaggagcagatcaacaaggtgttcagtgatgctgtgggccacgcccggcagggccgggctgtgggcaccttcctgcacaatggaggcagcttctatgagggcatcgaccaccaggccagccaggatgaggtgttcaacaagagcagccaggacggcagcggggactag

SEQ ID NO: 35768 - DNA, 1605 bp, Artificial Sequence
  Description of Artificial Sequence: Synthetic coding sequence
atggaggaggagatgcagcctgctgaggagggccccagcgtgcccaagatctacaagcagaggagcccctacagcgtgctgaagaccttccccagcaagaggcctgccctggccaagagatatgagcggcccaccctggtggagctgccccacgtgcgggcccctcctcctcctcctcctccatttgcccctcatgctgctgtgtccatcagcagcagcgagcccccaccccagcagttccaggcccagagcagctacccacctggccctggccgggctgctgctgctgccagcagcagcagccccagctgcaccccagccaccagccagggccacctgcggaccccagcccagcccccaccagccagccctgctgccagcagcagcagcagctttgctgctgtggtgcgctatggccctggagctgctgctgctgctggcaccggcggcactggaagtgacagcgccagcctggagctgtctgctgagagcaggatgatcctggatgcctttgcccagcagtgcagccgggtgctgagcctgctgaactgtggcggcaagctgctggacagcaaccacagccagagcatgatcagctgtgtgaagcaggagggcagcagctacaatgaaaggcaggagcactgccacatcggcaaaggagtgcacagccagaccagtgacaacgtggacatcgagatgcagtacatgcagaggaagcagcagaccagcgccttcctgcgggtcttcacagacagcctgcagaactacctgctgagcggcagcttccccacccccaaccccagcagcgcctctgaatatggccacctggctgatgtggaccccctgagcaccagccctgtgcacaccctgggcggctggaccagccctgccaccagcgagagccacggccaccccagcagcagcaccctgcctgaggaggaggaggaggaggatgaggagggctactgcccccgctgccaggagctggagcaggaggtgatcagcctgcagcaggagaatgaggagctgcggaggaagctggagagcatccctgtgccctgccagacagtgctggactacctgaagatggtgctgcagcaccacaaccagctgctgatcccccagcctgctgaccagcccacagagggcagcaagcagctgctgaacaactaccctgtgtacatcaccagcaagcagtgggatgaagctgtgaacagcagcaagaaggatggccggcggctgctgcgctacctgatccgctttgtgttcaccacagatgagctgaagtacagctgtggcctgggcaagaggaagaggtctgtgcagagcggggagaccggccctgagcggcggcccctggaccctgtgaaggtgacctgcctgcgggagttcatccgcatgcactgcaccagcaacccagactggtggatgcccagcgaggagcagatcaacaaggtgttcagtgatgctgtgggccacgcccggcagggccgggctgtgggcaccttcctgcacaacggcggcagcttctatgagggcatcgaccaccaggccagccaggatgaggtgttcaacaagagcagccaggacggcagcggggactag

SEQ ID NO: 35769 - DNA, 1314 bp, Artificial Sequence
  Description of Artificial Sequence: Synthetic coding sequence
atgcagcctgctgaggagggccccagcgtgcccaagatctacaagcagaggagcccctacagcgtgctgaagaccttccccagcaagaggcctgccctggccaagagatatgagcggcccaccctggtggagctgccccacgtgcgggcccctcctcctcctcctcctccatttgcccctcatgctgctgtgtccatcagcagcagcgagcccccaccccagcagttccaggcccagagcagctacccacctggccctggccgggctgctgctgctgccagcagcagcagccccagctgcaccccagccaccagccagggccacctgcggaccccagcccagcccccaccagccagccctgctgccagcagcagcagcagctttgctgctgtggtgcgctatggccctggagctgctgctgctgctggcaccggcggcactggaagtgacagcgccagcctggagctgtctgctgagagcaggatgatcctggatgcctttgcccagcagtgcagccgggtgctgagcctgctgaactgtggcggcaagctgctggacagcaaccacagccagagcatgatcagctgtgtgaagcaggagggcagcagctacaatgaaaggcaggagcactgccacatcggcaaaggagtgcacagccagaccagtgacaacgtggacatcgagatgcagtacatgcagaggaagcagcagaccagcgccttcctgcgggtcttcacagacagcctgcagaactacctgctgagcggcagcttccccacccccaaccccagcagcgcctctgaatatggccacctggctgatgtggaccccctgagcaccagccctgtgcacaccctgggcggctggaccagccctgccaccagcgagagccacggccaccccagcagcagcaccctgcctgaggaggaggaggaggaggatgaggagggctactgcccccgctgccaggagctggagcaggaggtgatcagcctgcagcaggagaatgaggagctgcggaggaagctggagagcatccctgtgccctgccagacagtgctggactacctgaagatggtgctgcagcaccacaaccagctgctgatcccccagcctgctgaccagcccacagagggcagcaagcagctgctgaacaactaccctgtgtacatcaccagcaagcagtgggatgaagctgtgaacagcagcaagaaggatggccggcggctgctgcgctacctgatccgctttgtgttcaccacagatgagctgaagtacagctgtggcctgggcaagaggaagaggatccactag

SEQ ID NO: 35770 - DNA, 570 bp, Artificial Sequence
  Description of Artificial Sequence: Synthetic coding sequence
atgcagaagatcgtgcagacagatgagatcaccaacacccaggccttcaggaagggcaagaggaagaggacagagaccatggattctgaaaatgccaacagcgacatggacaagggccagagggacccctacagcggaaatgccttcctgcctggagagagcagcagtgaagatgaggagcccctggccgagctgagcaaggaggagctgtgtgccaagatcaagagcctgaaggagaagctgaccaacaccaggaaagaaaacagccggctgcggcagagcctggtgatgctgcaggtgctgccccaggccgtgacccagtttgaggagctggtgggcatggccgaggccctgctgaagggcggcggcaccatgagcaccagcgccagcaccctgtggagggccaccaacaacagcagcccagacagctttgccagcacctgcagcaacagcaacagcaacagcagcagccctgtgtccctgaagccagaggaggagcaccagacagatgagaagcagttccagatcgagaagtggcagaaccccctgctgcagggcaccaagctgtag

SEQ ID NO: 35771 - DNA, 390 bp, Artificial Sequence
  Description of Artificial Sequence: Synthetic coding sequence
atgcagaagatcgtgcagacagatgagatcaccaacacccaggccttcaggaagggcaagaggaagaggacagagaccatggattctgaaaatgccaacagcgacatggacaagggccagagggacccctacagcggaaatgccttcctgcctggagagagcagcagtgaagatgaggagcccctggccgagctgagcaaggaggagctgtgtgccaagatcaagagcctgaaggagaagctgaccaacaccaggaaagaaaacagccggctgcggcagagcctggtgatgctgcagggcaacaagctggacatcaccacagagaagaccatcctgcatggaggcatgaagaccctgaatgtggtgaccaccagcagccaccctgtgtag

SEQ ID NO: 35772 - DNA, 840 bp, Artificial Sequence
  Description of Artificial Sequence: Synthetic coding sequence
atgcagaagatcgtgcagacagatgagatcaccaacacccaggccttcaggaagggcaagaggaagaggacagagaccatggattctgaaaatgccaacagcgacatggacaagggccagagggacccctacagcggaaatgccttcctgcctggagagagcagcagtgaagatgaggagcccctggccgagctgagcaaggaggagctgtgtgccaagatcaagagcctgaaggagaagctgaccaacaccaggaaagaaaacagccggctgcggcagagcctggtgatgctgcaggtgctgccccaggccgtgacccagtttgaggagctggtgggcatggccgaggccctgctgaagggcggcggcaccatgagcaccagcgccagcaccctgtggagggccaccaacaacagcagcccagacagctttgccagcacctgcagcaacagcaacagcaacagcagcagccctgtgtccctgaagccagaggaggagcaccagacagatgagaagcagttccagatcgagaagtggcagatcgcccgctgcaacaagagcaagccccagaagttcatcaatgacctgatgcaggtgctgtacaccaatgagtacatggccacccacagcctgaccggggccaagagcagcaccagccgggacaaggctgtgaagccagccatgaaccagaatgaggtgcaggagatcattggagtgaccaagcagctgttccccaacacagatgatgtgtccatccggaggatgattggccagaagctgaacaactgcaccaagaagcccaacctgagcaagaacctgaacagccaggacatcaagtag

SEQ ID NO: 35773 - DNA, 321 bp, Artificial Sequence
  Description of Artificial Sequence: Synthetic coding sequence
atgcagaagatcgtgcagacagatgagatcaccaacacccaggccttcaggaagggcaagaggaagaggacagagaccatggattctgaaaatgccaacagcgacatggacaagggccagagggacccctacagcggaaatgccttcctgcctggagagagcagcagtgaagatgaggagcccctggccgagctgagcaaggaggagctgtgtgccaagatcaagagcctgaaggagaagctgaccaacaccaggaaagaaaacagccggctgcggcagagcctggtgatgctgcaggcctggagccgggagctgccctag

SEQ ID NO: 35774 - DNA, 390 bp, Artificial Sequence; identical to SEQ ID NO: 35771
  Description of Artificial Sequence: Synthetic coding sequence

SEQ ID NO: 35775 - DNA, 546 bp, Artificial Sequence
  Description of Artificial Sequence: Synthetic coding sequence
atgctgctgccccaggccgtgacccagtttgaggagctggtgggcatggccgaggccctgctgaagggcggcggcaccatgagcaccagcgccagcaccctgtggagggccaccaacaacagcagcccagacagctttgccagcacctgcagcaacagcaacagcaacagcagcagccctgtgtccctgaagccagaggaggagcaccagacagatgagaagcagttccagatcgagaagtggcagatcgcccgctgcaacaagagcaagccccagaagttcatcaatgacctgatgcaggtgctgtacaccaatgagtacatggccacccacagcctgaccggggccaagagcagcaccagccgggacaaggctgtgaagccagccatgaaccagaatgaggtgcaggagatcattggagtgaccaagcagctgttccccaacacagatgatgtgtccatccggaggatgattggccagaagctgaacaactgcaccaagaagcccaacctgagcaagaacctgaacagccaggacatcaagtag

SEQ ID NO: 35776 - DNA, 1407 bp, Artificial Sequence
  Description of Artificial Sequence: Synthetic coding sequence
atggagatcaagaagcagatcaccggcatgaggcggctgctgaatgacagcacaggccgcatctaccagagggtgggcaaggagggggagaagctgaaggaggagccccaggacctggacctggtgtggccaccccggctgaacagcagcgctgaggccccccagagcctgcaccccagcagcagaggagtgtggaatgagctgcccccccagagcggccagttcagcggccagtatggcaccaggagcaggaccttccagagccagccccaccccaccaccagcagcaatggagagctgcctgtggtgaacagcagcgctggcagcaactgctgcacctgcaactgccagagcaccctgcaggccatcctgcaggagctgaagaccatgaggaagctgatgcagatccaggccgtgggcacccagaaccggcagcagccccccatcagcctcatctgcagccagaggacagctgtgtccaggaagaggaacaagaagaagaaggtgccccccaagacagtggagcccctgactgtgaagcagaagcccagcggcagcgagatggagaagaagtctgtggtggccagcgagctgagcgccctgcaggccgctgagcacaccagccctgaggagagccgggtgctgggctttggaattgtgctggagagccccagcagtgaccctgaggtgcagctggccgagggctttgatgtgttcatgcccaagagccagctggacagcatcctgagcaactacaccaggagcggcagcctgctcttcaggaagctggtgtgtgccttctttgatgacaagaccctggccaacagcctgcccaacgggaagaggaagaggggcctgaatgacaacaggaagggcctggaccagaacatcgtgggcgccatcaaggtgttcacagagaagtactgcacagccaaccacgtggacaagctgcccggcccccgggactgggtgcagatcctgcaggaccagatcaagctggcccggcggcggctgaagaggggcagcgctgagattgctgacagtgatgagcggctggatggcatcgccctgccccccaccggggcctgtggcggcccctgcaccgtgctgcccggcggcagcgctgctgtgaccctggtgctgcagagcagcccccagaccatgagccaggagaagggccagatggccgagccctgggaggagcagcacctggtgctgctgaacaacctgacccgggacagagctgagactggagccctgagccagaccagccaggacttcaagcaccacagcttcctgatcacccaggtgtctgccaccctgcaccaccagaggggcatccggaacttccccaccccaggcagcgccaagagcctgaccctgcacatcagctgcctgagcctgtag

SEQ ID NO: 35777 - DNA, 1125 bp, Artificial Sequence
  Description of Artificial Sequence: Synthetic coding sequence
atggagatcaagaagcagatcaccggcatgaggcggctgctgaatgacagcacaggccgcatctaccagagggtgggcaaggagggggagaagctgaaggaggagccccaggacctggacctggtgtggccaccccggctgaacagcagcgctgaggccccccagagcctgcaccccagcagcagaggagtgtggaatgagctgcccccccagagcggccagttcagcggccagtatggcaccaggagcaggaccttccagagccagccccaccccaccaccagcagcaatggcatggtggtgaacaagcacagcgagggcagccatggaggagagctgcctgtggtgaacagcagcgctggcagcaactgctgcacctgcaactgccagagcaccctgcaggccatcctgcaggagctgaagaccatgaggaagctgatgcagatccaggccgtgggcacccagaaccggcagcagccccccatcagcctcatctgcagccagaggacagctgtgtccaggaagaggaacaagaagaagaaggtgccccccaagacagtggagcccctgactgtgaagcagaagcccagcggcagcgagatggagaagaagtctgtggtggccagcgagctgagcgccctgcaggccgctgagcacaccagccctgaggagagccgggtgctgggcttcggcatcgtgctggagagccccagcagtgaccctgaggtgcagctggccgagggctttgatgtgttcatgcccaagagccagctggacagcatcctgagcaactacaccaggagcggcagcctgctcttcaggaagctggtgtgtgccttctttgatgacaagaccctggccaacagcctgcccaacgggaagaggaagaggggcctgaatgacaacaggaagggcctggaccagaacatcgtgggcgccatcaaggtgttcacagagaagtactgcacagccaaccacgtggacaagctgcccggcccccgggactgggtgcagatcctgcaggaccagatcaagctggcccggcggcggctgaagaggggcagcgagattgctgacagtgatgagcggctggatggcatcgccctgccccccaccgtggtgtag

SEQ ID NO: 35778 - DNA, 1281 bp, Artificial Sequence
  Description of Artificial Sequence: Synthetic coding sequence
atggagttcagcgagaggaagaggagcaggaagagccagagcttcaagctggtgtcccgggactaccaccacgaggtgtacaagatccctgagttcagcaatgatgtgaatggagaggccaaggagacccagcccatcttcctgggagatgagagcatggagatcaagaagcagatcaccggcatgaggcggctgctgaatgacagcacaggccgcatctaccagagggtgggcaaggagggggagaagctgaaggaggagccccaggacctggacctggtgtggccaccccggctgaacagcagcgctgaggccccccagagcctgcaccccagcagcagaggagtgtggaatgagctgcccccccagagcggccagttcagcggccagtatggcaccaggagcaggaccttccagagccagccccaccccaccaccagcagcaatggcatggtggtgaacaagcacagcgagggcagccatggaggagagctgcctgtggtgaacagcagcgctggcagcaactgctgcacctgcaactgccagagcaccctgcaggccatcctgcaggagctgaagaccatgaggaagctgatgcagatccaggccgtgggcacccagaaccggcagcagccccccatcagcctcatctgcagccagaggacagctgtgtccaggaagaggaacaagaagaagaaggtgccccccaagacagtggagcccctgactgtgaagcagaagcccagcggcagcgagatggagaagaagtctgtggtggccagcgagctgagcgccctgcaggccgctgagcacaccagccctgaggagagccgggtgctgggcttcggcatcgtgctggagagccccagcagtgaccctgaggtgcagctggccgagggctttgatgtgttcatgcccaagagccagctggacagcatcctgagcaactacaccaggagcggcagcctgctcttcaggaagctggtgtgtgccttctttgatgacaagaccctggccaacagcctgcccaacgggaagaggaagaggggcctgaatgacaacaggaagggcctggaccagaacatcgtgggcgccatcaaggtgttcacagagaagtactgcacagccaaccacgtggacaagctgcccggcccccgggactgggtgcagatcctgcaggaccagatcaagctggcccggcggcggctgaagaggggcagcgagattgctgacagtgatgagcggctggatggcatcgccctgccccccaccgtggtgtag

SEQ ID NO: 35779 - DNA, 1560 bp, Artificial Sequence
  Description of Artificial Sequence: Synthetic coding sequence
atggagttcagcgagaggaagaggagcaggaagagccagagcttcaagctggtgtcccgggactaccaccacgaggtgtacaagatccctgagttcagcaatgatgtgaatggagaggccaaggagacccagcccatcttcctgggagatgagagcatggagatcaagaagcagatcaccggcatgaggcggctgctgaatgacagcacaggccgcatctaccagagggtgggcaaggagggggagaagctgaaggaggagccccaggacctggacctggtgtggccaccccggctgaacagcagcgctgaggccccccagagcctgcaccccagcagcagaggagtgtggaatgagctgcccccccagagcggccagttcagcggccagtatggcaccaggagcaggaccttccagagccagccccaccccaccaccagcagcaatggagagctgcctgtggtgaacagcagcgctggcagcaactgctgcacctgcaactgccagagcaccctgcaggccatcctgcaggagctgaagaccatgaggaagctgatgcagatccaggccgtgggcacccagaaccggcagcagccccccatcagcctcatctgcagccagaggacagctgtgtccaggaagaggaacaagaagaagaaggtgccccccaagacagtggagcccctgactgtgaagcagaagcccagcggcagcgagatggagaagaagtctgtggtggccagcgagctgagcgccctgcaggccgctgagcacaccagccctgaggagagccgggtgctgggctttggaattgtgctggagagccccagcagtgaccctgaggtgcagctggccgagggctttgatgtgttcatgcccaagagccagctggacagcatcctgagcaactacaccaggagcggcagcctgctcttcaggaagctggtgtgtgccttctttgatgacaagaccctggccaacagcctgcccaacgggaagaggaagaggggcctgaatgacaacaggaagggcctggaccagaacatcgtgggcgccatcaaggtgttcacagagaagtactgcacagccaaccacgtggacaagctgcccggcccccgggactgggtgcagatcctgcaggaccagatcaagctggcccggcggcggctgaagaggggcagcgagattgctgacagtgatgagcggctggatggcatcgccctgcccccaactggagcctgtggcggcccctgcaccgtgctgcccggcggcagcgctgctgtgaccctggtgctgcagagcagcccccagaccatgagccaggagaagggccagatggccgagccctgggaggagcagcacctggtgctgctgaacaacctgacccgggacagagctgagaccggggccctgagccagaccagccaggacttcaagcaccacagcttcctgatcacccaggtgtctgccaccctgcaccaccagaggggcatccggaacttccccaccccaggcagcgccaagagcctgaccctgcacatcagctgcctgagcctgtag

SEQ ID NO: 35780 - DNA, 354 bp, Artificial Sequence
  Description of Artificial Sequence: Synthetic coding sequence
ctggacagcatcctgagcaactacaccaggagcggcagcctgctcttcaggaagctggtgtgtgccttctttgatgacaagaccctggccaacagcctgcccaacgggaagaggaagaggggcctgaatgacaacaggaagggcctggaccagaacatcgtgggcgccatcaaggtgttcacagagaagtactgcacagccaaccacgtggacaagctgcccggcccccgggactgggtgcagatcctgcaggaccagatcaagctggcccggcggcggctgaagaggggcagcgagattgctgacagtgatgagcggctggatggcatcgccctgcccccaacaggcaagtag

SEQ ID NO: 35781 - DNA, 3069 bp, Artificial Sequence
  Description of Artificial Sequence: Synthetic coding sequence
atgccagacttccagcccggggacaccaccgtgcggctggacaagaggatgagcctgacagccatctatgacaagaggcgggagacagactacagcgacaagggctacaacctggcctttgtgtcccaggatgagcaggagaacagcagcttcaccatcctgtatgaggagcccctgcaggaggaggacaagtatgccagcgctgaggcccggcagacccagagcgtgctcttccatgacaccagcgctgacagcatgcctgtgctggcctgtgagaggtctgagagcaggacagacctggtgcaccactttgagaagggcaccaagctgggggagacctttgacagcgacagcagcgagatgttcctgtctgtggaggccaagcgctacaagatctaccccctggccctgagccccatctatgaagatgacagcagccaggaggacatcctgagcagcgaggtgtccccaggccaccacggccccaggaagagccgggacagcgagaaccagagcagctctgtgctgagcctgctgcagagcgtgtctgagcggctgaagatgaactttgatgaagatgaccgggaggccgcagatgaggaggaggaggaggaggaggccgctgtgctgcacaagggggacctgcgggccggcagcggggagcgggtgaccttccagctgcctgaccccagcatcaccttctacccagatgaccaggagagcgtgggcatcagcaagaacagctatgtgatgcccaatgagcccaccaccagcaacctgcaggtgggcctgtggccagagaagaccagcttcctgcagaagagtgacctgaccagcaagctgcacagcagcctgaagagcgcctaccaccagtacctgcagaccagccagagccacagcagcgagaagggggccaggtttggaggcatcttccaggagcctgtgtccaagtacttccgggtgcaggacagccctggccgcctgagccccttcattgaaaatgtggacaagcagaccctgcgctgcaaccccaggcctgggaagatggtgatctatgacctgcacgagagcacctacaagcaggaggtgtactgcaacatcccagatgccacctcctggagcttccccaatggagtgctgatcaaggtggtgcggggctgctggatcctgtatgagaagccccacttccggggccagaagtgtgtgctggaggagggggagaaggtgctgaacagagactggatcctgcagaacagaagacacccccagaggaacttcatcctgggcagcctgaagagggtgctgaaggactgcagcatccctgagattgagctgttcccccagagcgaccctgcctgctgccctgtgtacatccagagagctgtgcccaacctggaggagctgaacatcagcaagtctgtgtccttcaccgtgaagagcggcgtgtggctggcctacccagacatcaacttcaagggccaggccaccgtgctggaggaggaccacggcctgtttgagatcagcacagctgagatgaagagcctgcaccccctgcagatgggcggcctgaaggtggagatgcccatgaacctgaaggtgatcatctatgagaagccccacttccacggccaggccaaggagttcagcgagcacatcgacagcgtgcccaacttcctgaagaacaacggggacttccaccgcatcggcagcatccgggtcatcggcggcgtgtgggtggcctatgagaaggagcacttcaagggccagcagttcctgctggaggagggggactttgaggacagcaatgcctgtggggccctgagcagccccatcctgtccttccgctacctgcaggccaacttcatcgagagctctgtgaccctgtttgaaagtgacctggagagcggcaagttcatcgacatcaccaaccaggagatcagtgacctggaggagatcggcttcggcagcaagaccaggagcatccacgtgaagtctggagtgtgggtggcctaccagcagaagttcttctgtggggagcagtacatcctggagaagggcaagtacaagtgcttctttgactggggcggcagcaacaacatcatcatgagcatccggcccatccagctggagcccctgggcatcaatgaaccaccccacctgctgaaggccttcagcaagccaggcttccagggcgagtgcatcgacttcacagaggagaccagtgacctgaccagcctgatgccctgcagcttcaaggtgctgcggggctgctggctgctgtactaccaggaggacatgtttgtgaaccactgtgtgctggaggagggcctgtatgctgacctgaccagctgtggctgcccagccagcaaggtgaagagcctgaagcccattgattatgtgtttgaggagcccagcatcagcctgtttgccctggagcactgtgagggccgggagctgcacctggaggaggccgtgaacagcgtgctgaacaaggacctgcacttctacacccagagcgtgtgggtgaagagcggcctgtggatcgcctatgagggcagcaacttcctgggccggcagatcctgctgcggcccaatgagatccccaactggacagccttcagccgctggaagaccatcggcagcctgcggcccatgaagcagcctgctgtgtacatccgcatcaagaacagagcccagggcgagtacctgactgtgacaggcagcctggccgacacccgggccacctctgtgtgcatcagcccctacagcggcaagaacacccagatctggtactactgccggggcctcttcaagagcaaggccagtgacacctgcctggatgtgattggaggccgggacacccctggggccaaggtggccctgtggacagaacatggccagttccggcagaagtggaggctgaacaagaatggcaccatcagcagctacctgagtgaccagctggtgctggatgtgaagggcggcaactactgtgacaagacccacgtgattgtgaaccagcccctggagggggaggagacccagaagtgggacatcgagatcctgtag

SEQ ID NO: 35782 - DNA, 690 bp, Artificial Sequence
  Description of Artificial Sequence: Synthetic coding sequence
atgaatgagaagaagaaggtgtttgaggagcccagcatcagcctgtttgccctggagcactgtgagggccgggagctgcacctggaggaggccgtgaacagcgtgctgaacaaggacctgcacttctacacccagagcgtgtgggtgaagagcggcctgtggatcgcctatgagggcagcaacttcctgggccggcagatcctgctgcggcccaatgagatccccaactggacagccttcagccgctggaagaccatcggcagcctgcggcccatgaagcagcctgctgtgtacatccgcatcaagaacagagcccagggcgagtacctgactgtgacaggcagcctggccgacacccgggccacctctgtgtgcatcagcccctacagcggcaagaacacccagatctggtactactgccggggcctcttcaagagcaaggccagtgacacctgcctggatgtgattggaggccgggacacccctggggccaaggtggccctgtggacagagcacggccagttccggcagaagtggaggctgaacaagaatggcaccatcagcagctacctgagtgaccagctggtgctggatgtgaagggcggcaactactgtgacaagacccacgtgattgtgaaccagcccctggagggggaggagacccagaagtgggacatcgagatcctgtag

SEQ ID NO: 35783 - DNA, 396 bp, Artificial Sequence
  Description of Artificial Sequence: Synthetic coding sequence
atgaacaagaagaaggtgtttgaggagcccagcatcagcctgtttgccctggagcactgtgagggccgggagctgcacctggaggaggccgtgaacagcgtgctgaacaaggacctgcacttctacacccagagcgtgtgggtgaagagcggcctgtggatcgcctatgagggcagcaacttcctgggccggcagatcctgctgcggcccaatgagatccccaactggacagccttcagccgctggaagaccatcggcagcctgcggcccatgaagcagcctgctgtgtacatccgcatcaagaacagagcccagggcgagtacctgactgtgacaggcagcctggccgacacccgggccacctctgtgtgcatcagcccctacagcggcaagtag

SEQ ID NO: 35784 - DNA, 9156 bp, Artificial Sequence
  Description of Artificial Sequence: Synthetic coding sequence
atggccaccaacccccagccccagcccccacctccagcccctcctcctcctccaccccagccccagccccagcccccacctcctcctcctggccctggggccggccctggggccggcggggccggcggggccggggccggggccggggacccccagctggtggccatgattgtgaaccacctgaagagccagggcctgtttgaccagttcagaagagactgcctggctgatgtggacaccaagccagcctaccagaacctgcggcagagggtggacaactttgtggccaaccacctggccacccacacctggagcccccacctgaacaagaaccagctgaggaacaacatccggcagcaggtgctgaagagcggcatgctggagagcggcatcgaccgcatcatcagccaggtggtggaccccaagatcaaccacaccttccggccccaggtggagaaggctgtgcatgagttcctggccaccctgaaccacaaggaggagggcagcggcaacacagccccagatgatgagaagccagacaccagcctcatcacccagggcgtgcccaccccaggccccagcgccaacgtggccaatgatgccatgagcatcctggagaccatcaccagcctgaaccaggaggccagcgctgcccgggccagcacagagaccagcaatgccaagaccagcgagcgggccagcaagaagctgcccagccagcccaccacagacaccagcacagacaaggagaggaccagcgaggacatggctgacaaggagaagagcacagctgacagcggcggggagggcctggagacagcccccaagtctgaggagttcagtgacctgccctgccctgtggaggagatcaagaactacaccaaggagcacaacaacctgatcctgctgaacaaggatgtgcagcaggagagcagcgagcagaagaacaagagcacagacaagggggagaagaagccagacagcaatgaaaaaggagagaggaagaaggagaagaaggagaagacagagaagaagtttgaccacagcaagaagtctgaggacacccagaaggtgaaggatgagaagcaggccaaggagaaggaggtggagagcctgaagctgcccagcgagaagaacagcaacaaggccaagacagtggagggcaccaaggaggacttcagcctgattgacagtgatgtggatggcctgacagacatcaccgtgtcctctgtgcacaccagtgacctgagcagctttgaggaggacacagaggaggaggtggtgaccagtgacagcatggaggagggggagatcaccagtgatgatgaggagaagaacaagcagaacaagaccaagacccagaccagtgacagcagcgagggcaagaccaagtctgtgagacatgcctacgtgcacaagccctacctgtacagcaagtactacagcgacagtgatgatgagctgactgtggagcagaggcggcagagcatcgccaaggagaaggaggagcggctgctgcggcggcagatcaaccgggagaagctggaggagaagaggaagcagaaggccgagaagaccaagagcagcaagaccaagggccagggccgcagctctgtggacctggaggagagcagcaccaagagcctggagcccaaggccgcccgcatcaaggaggtgctgaaggagaggaaggtgctggagaagaaggtggccctgagcaagaagaggaagaaggacagcagaaatgtggaggagaacagcaagaagaagcagcagtatgaggaggacagcaaggagaccctgaagaccagcgagcactgtgagaaggagaagatcagcagcagcaaggagctgaagcacgtgcacgccaagtctgagcccagcaagccagcccggcggctgtctgagagcctgcacgtggtggatgagaacaagaatgaaagcaagctggagcgggagcacaagaggaggaccagcacccctgtgatcatggagggcgtgcaggaggagacagacaccagagatgtgaagaggcaggtggagaggtctgagatctgcacagaggagccccagaagcagaagagcaccctgaagaatgagaagcacctgaagaaggatgacagcgagaccccccacctgaagagcctgctgaagaaggaggtgaagagcagcaaggagaagccagagcgggagaagaccccatctgaggacaagctgtctgtgaagcacaagtacaagggggactgcatgcacaagacaggagatgaaacagagctgcacagcagcgagaagggcctgaaggtggaggagaacatccagaagcagagccagcagaccaagctgagcagtgatgacaagacagagaggaagagcaagcacagaaatgaaaggaagctgtctgtgctgggcaaggatggcaagcctgtgtctgagtacatcatcaagacagatgaaaatgtgaggaaagaaaacaacaagaaggagcggcggctgtctgctgagaagaccaaggccgagcacaagagcagaagaagcagtgacagcaagatccagaaggacagcctgggcagcaagcagcacggcatcaccctgcagaggagaagtgagagctacagtgaagataaatgtgacatggacagcaccaacatggacagcaacctgaagccagaggaggtggtgcacaaggagaagaggaggaccaagagcctgctggaggagaagctggtgctgaagagcaagagcaagacccagggcaagcaggtgaaggtggtggagacagagctgcaggagggcgccaccaagcaggccaccacccccaagccagacaaggagaagaacacagaagaaaatgacagcgagaagcagaggaagagcaaggtggaggacaagccctttgaggagaccggggtggagcctgtgctggagacagccagcagcagcgcccacagcacccagaaggacagcagccaccgggccaagctgcccctggccaaggagaagtacaagagtgacaaggacagcaccagcacccggctggagaggaagctgagtgatggccacaagagccgcagcctgaagcacagcagcaaggacatcaagaagaaggatgagaacaagagtgatgacaaggatggcaaggaggtggacagcagccatgagaaggcccggggcaacagcagcctgatggagaagaagctgagccggcggctgtgtgagaacagaagaggcagcctgagccaggagatggccaagggggaggagaagctggccgccaacaccctgagcacccccagcggcagcagcctgcagaggcccaagaagagcggggacatgaccctcatccctgagcaggagcccatggagattgacagcgagcccggggtggagaatgtgtttgaggtgtccaagacccaggacaacagaaacaacaacagccagcaggacattgattctgagaacatgaagcagaagaccagcgccaccgtgcagaaggatgagctgcggacctgcacagctgacagcaaggccacagccccagcctacaagccaggccggggcactggagtgaacagcaacagcgagaagcatgctgaccacaggagcaccctgaccaagaagatgcacatccagagcgctgtgtccaagatgaaccctggagagaaggagcccatccaccggggcaccacagaggtgaacattgattctgaaacagtgcacaggatgctgctgagcgcccccagtgaaaatgacagagtgcagaagaacctgaagaacacagctgctgaggagcacgtggcccagggagatgccaccctggagcacagcaccaacctggacagcagccccagcctgagctctgtgacagtggtgcccctgcgggagagctatgaccctgatgtgatccccctgtttgacaagaggacagtgctggagggcagcacagccagcaccagccctgctgaccacagcgccctgcccaaccagagcctgactgtgcgggagagcgaggtgctgaagaccagtgacagcaaggagggcggggagggcttcaccgtggacaccccagccaaggccagcatcaccagcaagaggcacatccctgaggcccaccaggccaccctgctggatggcaagcagggcaaggtgatcatgcccctgggcagcaagctgactggagtcatcgtggagaatgaaaacatcaccaaggagggcggcctggtggacatggccaagaaggaaaatgacctgaatgctgagcccaacctgaagcagaccatcaaggccaccgtggagaatggcaagaaggatggcattgctgtggaccacgtggtgggcctgaacacagagaagtatgcagagaccgtgaagctgaagcacaagaggagccctgggaaggtgaaggacatcagcattgatgtggagaggagaaatgaaaacagcgaggtggacaccagcgctggcagcggcagcgcccccagcgtgctgcaccagagaaatggccagacagaagatgtggccaccggcccccggcgggcagagaagacctctgtggccaccagcacagagggcaaggacaaggatgtgaccctgagccctgtgaaggccggccctgccaccaccaccagcagcgagacccggcagagcgaggtggccctgccctgcaccagcattgaagcagatgagggcctcatcatcggcacccacagcaggaacaaccccctgcacgtgggcgctgaggccagcgagtgcaccgtgtttgctgctgctgaggagggcggcgctgtggtgacagagggctttgctgagagcgagaccttcctgaccagcaccaaggagggggagagcggagaatgtgctgtggccgagagcgaggacagagctgctgacctgctggccgtgcatgctgtgaagattgaggccaacgtgaacagcgtggtgacagaggagaaggatgatgctgtgaccagcgctggcagcgaggagaagtgtgatggcagcctgagccgggacagcgagatcgtggagggcaccatcaccttcatcagcgaggtggagagtgatggagctgtgaccagcgctggaacagagatccgggccggcagcatcagcagcgaggaggtggatggcagccagggcaacatgatgaggatgggccccaagaaggagacagagggcaccgtgacctgcaccggggctgagggccgcagtgacaactttgtgatctgcagcgtgactggagctggcccccgggaggagaggatggtgactggagctggggtggtgctgggggacaatgatgcccctcctggcaccagcgccagccaggagggagatggctctgtgaatgatggaacagaaggagagagcgctgtgaccagcacaggcatcacagaagatggagagggccctgccagctgcaccggcagcgaggacagcagcgagggctttgccatcagcagcgagagcgaggagaatggagagagcgccatggacagcacagtggccaaggagggcaccaacgtgcccctggtggccgccggcccctgtgatgatgagggcatcgtgaccagcactggagccaaggaggaggatgaggagggggaggatgtggtgaccagcactggaagaggaaatgagatcggccacgccagcacctgcaccggcctgggggaggagagcgagggcgtgctgatctgtgagagcgctgagggggacagccagatcggcaccgtggtggagcacgtggaggccgaggccggggccgccatcatgaatgccaatgaaaacaacgtggacagcatgtctggaacagagaagggcagcaaggacacagacatctgcagcagcgccaagggcatcgtggagagctctgtgaccagcgctgtgtctgggaaggatgaggtgacccctgtgcctgggggctgtgagggccccatgaccagcgctgccagtgaccagagcgacagccagctggagaaggtggaggacaccaccatcagcacaggcctggtgggcggcagctatgatgtgctggtgtctggagaggtgcctgaatgtgaggtggcccacaccagccccagcgagaaggaggatgaggacatcatcacctctgtggagaatgaggagtgtgatggcctgatggccaccacagccagcggggacatcaccaaccagaacagcctggccggcggcaagaaccagggcaaggtgctgatcatcagcaccagcaccaccaatgactacaccccccaggtgtctgccatcacagatgtggagggcggcctgagtgatgccctgaggacagaggagaacatggagggcaccagggtgaccacagaggagtttgaggcccccatgcccagcgctgtgtctggagatgacagccagctgacagccagccgctctgaggagaaggatgaatgtgccatgatcagcaccagcatcggggaggagtttgagctgcccatcagcagcgccaccaccatcaagtgtgccgagagcctgcagcctgtggccgctgctgtggaggagcgggccaccggccctgtgctgatcagcacagctgactttgagggccccatgcccagcgcccctcctgaggccgagagccccctggccagcaccagcaaggaggagaaggatgaatgtgccctgatcagcaccagcattgctgaggagtgtgaggcctctgtgtctggagtggtggtggagagtgaaaatgaaagagctggcaccgtgatggaggagaaggatggcagcggcatcatcagcaccagctctgtggaggactgtgagggccctgtgagcagcgctgtgccccaggaggagggggaccccagcgtgaccccagctgaggagatgggagacacagccatgatcagcaccagcaccagcgagggctgtgaggccgtgatgattggagctgtgctgcaggatgaagatcggctgaccatcaccagggtggaggacctgagtgatgctgccatcatcagcaccagcacagctgagtgcatgcccatcagcgccagcattgacagacatgaggagaaccagctgacagctgacaaccctgagggcaatggagacctgagcgccacagaggtgtccaagcacaaggtgcccatgcccagcctgattgctgagaacaactgccgctgccccggccctgtgcggggcggcaaggagcccggccctgtgctggccgtgtccacagaggagggccacaacggccccagcgtgcacaagcccagcgctggccagggccaccccagcgctgtgtgtgccgagaaggaggagaagcacggcaaggaatgtcctgagatcggcccctttgctggccggggccagaaggagagcaccctgcacctgatcaatgctgaggagaagaatgtgctgctgaacagcctgcagaaggaggacaagagccctgagaccggcacagctgggggcagcagcacagccagctacagcgctggccggggcctggagggcaatgccaacagccctgcccacctgcggggccctgagcagaccagcggccagacagccaaggaccccagcgtgtccatccgctacctggccgctgtgaacacaggagccatcaaggcagatgacatgcctcctgtgcagggcaccgtggccgagcacagcttcctgcctgctgagcagcagggcagcgaggacaacctgaagaccagcaccaccaagtgcatcaccggccaggagagcaagatcgcccccagccacaccatgatccccccagccacctacagcgtggccctgctggcccccaagtgtgagcaggacctgaccatcaagaatgactacagcggcaagtggacagaccaggccagcgctgagaagacaggagatgacaacagcaccaggaagagcttccctgaggagggggacatcatggtgacagtgagcagcgaggagaatgtgtgtgacattggaaatgaggagagccccctgaatgtgctgggcggcctgaagctgaaggccaacctgaagatggaggcctacgtgcccagcgaggaggagaagaatggagagatcctggcccctcctgagagcctgtgtggcggcaagcccagcggcattgctgagctgcagcgggagcccctgctggtgaatgaaagcctgaatgtggagaacagcggcttccgcaccaatgaggagatccacagcgagagctacaacaagggggagatcagcagcggcaggaaggacaatgctgaggccatcagcggccacagcgtggaggccgaccccaaggaggtggaggaggaggagcggcacatgcccaagaggaagaggaagcagcactacctgagcagtgaagatgagccagatgacaacccagatgtgctggacagcagaattgaaacagcccagaggcagtgcccagagacagagccccatgacaccaaggaggagaacagccgggacctggaggagctgcccaagaccagcagcgagaccaacagcaccaccagccgggtgatggaggagaaggatgagtacagcagcagcgagaccaccggggagaagccagagcagaatgatgatgacaccatcaagagccaggaggaggaccagcccatcatcatcaagaggaagaggggccggcccaggaagtaccctgtggagaccaccctgaagatgaaggatgacagcaagacagacacaggaattgtgacagtggagcagagccccagcagcagcaagctgaaggtgatgcagacagatgagagcaacaaggagacagccaacctgcaggagaggagcatcagcaatgatgatggagaggagaagatcgtgacctctgtgagaagaagaggaaggaagcccaagaggagcctgactgtgtctgatgatgctgagagcagcgagcctgagaggaagaggcagaagtctgtgtctgaccctgtggaggacaagaaggagcaggagagtgatgaggaggaggaggaggaggaggaggatgagcccagcggggccaccaccaggagcaccaccaggtctgaggcccagaggagcaagacccagctgagccccagcatcaagaggaagcgggaggtgagccccccaggggcccggacccggggccagcagagggtggaggaggcccctgtgaagaaggccaagaggtag

SEQ ID NO: 35785 - DNA, 519 bp, Artificial Sequence
  Description of Artificial Sequence: Synthetic coding sequence
atggctgatggcggcggcggcggcagcggcggggccggccctgccagcacccgggccagcggcggcggcggccccatcaacccagccagcctgcccccaggggacccccagctgattgccatcatcgtgggccagctgaagagccggggcctgtttgacagcttccggcgggactgcaaggcagatgtggacaccaagccagcctaccagaacctgagccagaaggctgacaactttgtgtccacccacctggacaagcaggagtggaaccccccagccaatgacaaccagctgcatgatggcctgcggcagagcgtggtgcagagcggccgctctgaggccggcgtggaccgcatcagcagccaggtggtggaccccaagctgaaccacatcttccggccccagatcgagcagatcatccacgagttcctggtggcccagaaggaggccgctgtgcctgccctgcccccagagcctgagggccaggaccccccagcccccagccaggacaccagctag

SEQ ID NO: 35786 - DNA, 414 bp, Artificial Sequence
  Description of Artificial Sequence: Synthetic coding sequence
atgctgagcggccgcctggtgctgggcctggtgtccatggccggccgggtgtgcctgtgccagggcagcgctggcagcggggccatcggccctgtggaggccgccatccgcaccaagctggaggaggccctgagccctgaggtgctggagctgagaaatgaaagtggcggccatgctgtgcccccaggcagcgagacccacttccgggtggccgtggtgagcagcagatttgagggcctgagccccctgcagaggcaccggctggtgcatgctgccctggccgaggagctgggcggccctgtgcacgccctggccatccaggcccggaccccagcccagtggagggagaacagccagctggacaccagccccccctgcctgggcggcaacaagaagaccctgggcaccccctag

SEQ ID NO: 35787 - DNA, 459 bp, Artificial Sequence
  Description of Artificial Sequence: Synthetic coding sequence
atggccagcgccaagagcctggaccgctggaaggcccggctgctggagggcggcagcacagccctgacctacgccctggtgcgggcagaggtgtccttccctgctgaggtggcccctgtgcggcagcagggctctgtggccggggcccgggccggcgtggtgtccctgctgggctgccgcagctcctggacagctgccatggagctgtctgctgagtacctgcgggagaagctgcagagggacctggaggccgagcacgtggaggtggaggacaccaccctgaaccgctgcagctgcagcttccgggtgctggtggtgtctgccaagtttgagggcaagcccctgctgcagaggcaccggctggtgaatgcctgcctggccgaggagctgccccacatccacgcctttgagcagaagaccctgaccccagaccagtgggcccgggagcggcagaagtag

SEQ ID NO: 35788 - DNA, 1593 bp, Artificial Sequence
  Description of Artificial Sequence: Synthetic coding sequence
atgaccagcagcctgcagaggccctggagggtgccctggctgccctggaccatcctgctggtgtccacagctgctgccagccagaaccaggagcggctgtgtgccttcaaggacccctaccagcaggacctgggcatcggggagagccgcatcagccatgaaaatggcaccatcctgtgcagcaagggcagcacctgctacggcctgtgggagaagagcaagggggacatcaacctggtgaagcagggctgctggagccacatcggggacccccaggagtgccactatgaggagtgtgtggtgaccaccaccccacccagcatccagaatggcacctaccgcttctgctgctgcagcacagacctgtgcaatgtgaacttcacagagaacttccccccaccagacaccacccccctgagccccccccacagcttcaacagagatgagaccatcatcatcgccctggcctctgtgtctgtgctggccgtgctgattgtggccctgtgcttcggctacaggatgctgaccggggacaggaagcagggcctgcacagcatgaacatgatggaggccgccgccagcgagcccagcctggacctggacaacctgaagctgctggagctgattggccggggccgctacggggctgtgtacaagggcagcctggatgagaggcctgtggccgtgaaggtgttctcctttgccaaccggcagaacttcatcaatgagaagaacatctacagagtgcccctgatggagcatgacaacatcgcccgcttcatcgtgggagatgagcgggtgacagcagatggccgcatggagtacctgctggtgatggagtactaccccaacggcagcctgtgcaagtacctgagcctgcacaccagtgactgggtgagcagctgccgcctggcccacagcgtgacccggggcctggcctacctgcacacagagctgcccaggggggaccactacaagccagccatcagccaccgggacctgaacagcagaaatgtgctggtgaagaatgatggcacctgtgtgatcagtgactttggcctgtccatgaggctgactggaaaccggctggtgcggcctggagaagaagataatgctgccatcagcgaggtgggcaccatccgctacatggcccctgaggtgctggagggcgctgtgaacctgcgggactgtgagagcgccctgaagcaggtggacatgtatgccctgggcctcatctactgggagatcttcatgcgctgcacagacctcttccctggagagagcgtgcctgagtaccagatggccttccagacagaggtgggcaaccaccccacctttgaggacatgcaggtgctggtgtcccgggagaagcagaggcccaagtttcctgaggcctggaaggagaacagcctggccgtgcgcagcctgaaggagaccatcgaggactgctgggaccaggatgctgaggcccggctgacagcccagtgtgccgaggagaggatggccgagctgatgatgatctgggagaggaacaagtctgtgagccccaccgtgaaccccatgagcacagccatgcagaatgaaagaagatag

SEQ ID NO: 35789 - DNA, 1470 bp, Artificial Sequence
  Description of Artificial Sequence: Synthetic coding sequence
atgaacaagctgagccctgtgctgctcttcctgaaccagcagaactaccagattgacaaggatgtggaggacaagaggcagaaggccatcgaggagttcttcaccaaggatgtgattgtgcccagcccctggacagaccacgagggcaagcagctgagccagtgccacagcagcaagtgcaccaacatcaacagcgacagccctgtgggcaagaagctgaccatccacagcgagaagagtgatgctgcctgccagaccctgctgagcctgcctgtggacttcaacctggagaacatcctgggggactacttccgggcagatgaatttgctgaccagagccctggcaacctgagcagcagcagcctgcggaggaagctgttcctggatggaaatggcagcatcagtgacagcctgcccagcgccagccctggcagcccccacagcggcgtgcagaccagcctggagatgttctacagcattgacctgagccctgtgaagtgccgcagccccctgcagacccccagcagcggccagttcagcagcagccccatccaggccagcgccaagaagtacagcctgggcagcatcaccagccccagccccatcagcagccccaccttcagccccatcgagttccagatcggggagacccccctgtctgagcagaggaagttcaccgtgcacagcccagatgccagcagcggcaccaacagcaatggcatcaccaacccctgcatccgcagcccctacattgatggctgcagccccatcaagaactggagccccatgaggctgcagatgtacagcggcggcacccagtaccgcaccagcgtcatccagatccccttcaccctggagacccagggagaagatgaggaggacaaggagaacatccccagcacagatgtgagcagccctgccatggatgctgctggcatccacctgcggcagttcagcaatgaggccagcacccacggcacccacctggtggtgacagccatgtctgtgacccagaaccagagcagcgccagcgagaaggagctggccctgctgcaggatgtggagcgggagaaggacaacaacacagtggacatggtggaccccattgaaattgctgatgagaccacctggatcaaggagcctgtggacaatggcagcctgcccatgacagactttgtgtctggcatcgccttcagcattgagaacagccacatgtgcatgagccccctggccgagagcagcgtcatcccctgtgagagcagcaacatccagatggattctggctacaacacccagaactgtggcagcaacatcatggacacagtgggcgctgagagctactgcaaggagagtgatgcccagacctgtgaggtggagagcaagagccaggccttcaacatgaagcaggaccacaccacccagcgctgctggatgaagacagccagccccttccagtgcagcagcccctag

SEQ ID NO: 35790 - DNA, 1680 bp, Artificial Sequence
  Description of Artificial Sequence: Synthetic coding sequence
atgggagatgtgaaggagagcaagatgcagatcaccccagagaccccaggccgcatccctgtgctgaacccctttgagagccccagcgactacagcaacctgcacgagcagaccctggccagccccagcgtcttcaagagcaccaagctgcccaccccaggcaagttccgctggagcattgaccagctggccgtcatcaaccctgtggagattgatcctgaggacatccaccggcaggccctgtacctgagccacagcagaattgacaaggatgtggaggacaagaggcagaaggccatcgaggagttcttcaccaaggatgtgattgtgcccagcccctggacagaccacgagggcaagcagctgagccagtgccacagcagcaagtgcaccaacatcaacagcgacagccctgtgggcaagaagctgaccatccacagcgagaagagtgatgctgcctgccagaccctgctgagcctgcctgtggacttcaacctggagaacatcctgggggactacttccgggcagatgaatttgctgaccagagccctggcaacctgagcagcagcagcctgcggaggaagctgttcctggatggaaatggcagcatcagtgacagcctgcccagcgccagccctggcagcccccacagcggcgtgcagaccagcctggagatgttctacagcattgacctgagccctgtgaagtgccgcagccccctgcagacccccagcagcggccagttcagcagcagccccatccaggccagcgccaagaagtacagcctgggcagcatcaccagccccagccccatcagcagccccaccttcagccccatcgagttccagatcggggagacccccctgtctgagcagaggaagttcaccgtgcacagcccagatgccagcagcggcaccaacagcaatggcatcaccaacccctgcatccgcagcccctacattgatggctgcagccccatcaagaactggagccccatgaggctgcagatgtacagcggcggcacccagtaccgcaccagcgtcatccagatccccttcaccctggagacccagggagaagatgaggaggacaaggagaacatccccagcacagatgtgagcagccctgccatggatgctgctggcatccacctgcggcagttcagcaatgaggccagcacccacggcacccacctggtggtgacagccatgtctgtgacccagaaccagagcagcgccagcgagaaggagctggccctgctgcaggatgtggagcgggagaaggacaacaacacagtggacatggtggaccccattgaaattgctgatgagaccacctggatcaaggagcctgtggacaatggcagcctgcccatgacagactttgtgtctggcatcgccttcagcattgagaacagccacatgtgcatgagccccctggccgagagcagcgtcatcccctgtgagagcagcaacatccagatggattctggctacaacacccagaactgtggcagcaacatcatggacacagtgggcgctgagagctactgcaaggagagtgatgcccagacctgtgaggtggagagcaagagccaggccttcaacatgaagcaggaccacaccacccagcgctgctggatgaagacagccagccccttccagtgcagcagcccctag

SEQ ID NO: 35791 - DNA, 2007 bp, Artificial Sequence
  Description of Artificial Sequence: Synthetic coding sequence
atgaccagcacaggcaaggatggaggagcccagcacgcccagtatgtgggcccctaccgcctggagaagaccctgggcaagggccagacaggcctggtgaagctgggcgtgcactgtgtgacctgccagaaggtggccatcaagatcgtgaaccgggagaagctgtctgagagcgtgctgatgaaggtggagcgggagatcgccatcctgaagctgattgagcacccccacgtgctgaagctgcatgatgtgtatgagaacaagaagtacctgtacctggtgctggagcacgtgtctggaggagagctgtttgactacctggtgaagaagggccgcctgacccccaaggaggccaggaagttcttccggcagatcatcagcgccctggacttctgccacagccacagcatctgccaccgggacctgaagccagagaacctgctgctggatgagaagaacaacatcagaattgctgactttggcatggccagcctgcaggtgggggacagcctgctggagaccagctgtggcagcccccactacgcctgcccagaggtgatccggggggagaagtatgatggcaggaaggcagatgtgtggagctgtggggtcatcctgtttgccctgctggtgggcgccctgccctttgatgatgacaacctgcggcagctgctggagaaggtgaagaggggcgtcttccacatgccccacttcatccccccagactgccagagcctgctgcggggcatgattgaggtggatgctgcccggcggctgaccctggagcacatccagaagcacatctggtacatcggcggcaagaatgaacctgagcctgagcagcccatccccaggaaggtgcagatccgcagcctgcccagcctggaggacatcgaccctgatgtgctggacagcatgcacagcctgggctgcttccgggacaggaacaagctgctgcaggacctgctgtctgaggaggagaaccaggagaagatgatctacttcctgctgctggacaggaaggagcgctaccccagccaggaggatgaggacctgcccccaagaaatgaaattgacccccccaggaagagggtggacagccccatgctgaacagacatggcaagaggaggcctgagaggaagtccatggaggtgctgtctgtgacagatggcggcagccctgtgcctgcccggcgggccatcgagatggcccagcacggccagaggagccgcagcatcagcggggccagcagcggcctgagcaccagccccctgagcagcccccgggtgaccccccaccccagcccccggggcagccccctgcccacccccaagggcacccctgtgcacacccccaaggagagccctgctggcacccccaaccccaccccacccagcagccccagcgtgggcggcgtgccctggagggcccggctgaacagcatcaagaacagcttcctgggcagcccccgcttccacaggaggaagctgcaggtgcccaccccagaggagatgagcaacctgaccccagagagcagccctgagctggccaagaagtcctggtttggaaacttcatcagcctggagaaggaggagcagatctttgtggtgatcaaggacaagcccctgagcagcatcaaggctgacatcgtgcacgccttcctgagcatccccagcctgagccacagcgtcatcagccagaccagcttccgggcagagtacaaggccactggaggccctgctgtgttccagaagcctgtgaagttccaggtggacatcacctacacagagggcggggaggcccagaaggaaaatggcatctacagcgtgaccttcaccctgctgagcggccccagccgccgcttcaagagggtggtggagaccatccaggcccagctgctgagcacccatgaccccccagctgcccagcacctgagtgacaccaccaactgcatggagatgatgacaggccgcctgagcaaatgtggcatcatccccaagagctag

SEQ ID NO: 35792 - DNA, 2091 bp, Artificial Sequence
  Description of Artificial Sequence: Synthetic coding sequence
atgaccagcacaggcaaggatggaggagcccagcacgcccagtatgtgggcccctaccgcctggagaagaccctgggcaagggccagacaggcctggtgaagctgggcgtgcactgtgtgacctgccagaaggtggccatcaagatcgtgaaccgggagaagctgtctgagagcgtgctgatgaaggtggagcgggagatcgccatcctgaagctgattgagcacccccacgtgctgaagctgcatgatgtgtatgagaacaagaagtacctgtacctggtgctggagcacgtgtctggaggagagctgtttgactacctggtgaagaagggccgcctgacccccaaggaggccaggaagttcttccggcagatcatcagcgccctggacttctgccacagccacagcatctgccaccgggacctgaagccagagaacctgctgctggatgagaagaacaacatcagaattgctgactttggcatggccagcctgcaggtgggggacagcctgctggagaccagctgtggcagcccccactacgcctgcccagaggtgatccggggggagaagtatgatggcaggaaggcagatgtgtggagctgtggggtcatcctgtttgccctgctggtgggcgccctgccctttgatgatgacaacctgcggcagctgctggagaaggtgaagaggggcgtcttccacatgccccacttcatccccccagactgccagagcctgctgcggggcatgattgaggtggatgctgcccggcggctgaccctggagcacatccagaagcacatctggtacatcggcggcaagaatgaacctgagcctgagcagcccatccccaggaaggtgcagatccgcagcctgcccagcctggaggacatcgaccctgatgtgctggacagcatgcacagcctgggctgcttccgggacaggaacaagctgctgcaggacctgctgtctgaggaggagaaccaggagaagatgatctacttcctgctgctggacaggaaggagcgctaccccagccaggaggatgaggacctgcccccaagaaatgaaattgacccccccaggaagagggtggacagccccatgctgaacagacatggcaagaggaggcctgagaggaagtccatggaggtgctgtctgtgacagatggcggcagccctgtgcctgcccggcgggccatcgagatggcccagcacggccagagcaaggccatgttcagcaagagcctggacattgctgaggcccacccccagttcagcaaagaagatagaagccgcagcatcagcggggccagcagcggcctgagcaccagccccctgagcagcccccgggtgaccccccaccccagcccccggggcagccccctgcccacccccaagggcacccctgtgcacacccccaaggagagccctgctggcacccccaaccccaccccacccagcagccccagcgtgggcggcgtgccctggagggcccggctgaacagcatcaagaacagcttcctgggcagcccccgcttccacaggaggaagctgcaggtgcccaccccagaggagatgagcaacctgaccccagagagcagccctgagctggccaagaagtcctggtttggaaacttcatcagcctggagaaggaggagcagatctttgtggtgatcaaggacaagcccctgagcagcatcaaggctgacatcgtgcacgccttcctgagcatccccagcctgagccacagcgtcatcagccagaccagcttccgggcagagtacaaggccactggaggccctgctgtgttccagaagcctgtgaagttccaggtggacatcacctacacagagggcggggaggcccagaaggaaaatggcatctacagcgtgaccttcaccctgctgagcggccccagccgccgcttcaagagggtggtggagaccatccaggcccagctgctgagcacccatgaccccccagctgcccagcacctgtctgagcccccacctccagcccctggcctgtcctggggcgccggcctgaagggccagaaggtggccaccagctatgagagcagcctgtag

SEQ ID NO: 35793 - DNA, 2301 bp, Artificial Sequence
  Description of Artificial Sequence: Synthetic coding sequence
atgagccctgagggccaccccagccgctgggcccggccccggcggccctgcatctgccccagcagcctgtgcagcccccgggagcccaggagcggccctgctgtgggccggggcggggccgcccaccaccgggtgcctgctggccacaccccaggcccccagctgctgcagccccacctgcacctgccccagggccagacctggctgtgcctgcagcccagccctgctggcctggtgaagctgggcgtgcactgtgtgacctgccagaaggtggccatcaagatcgtgaaccgggagaagctgtctgagagcgtgctgatgaaggtggagcgggagatcgccatcctgaagctgattgagcacccccacgtgctgaagctgcatgatgtgtatgagaacaagaagtacctgtacctggtgctggagcacgtgtctggaggagagctgtttgactacctggtgaagaagggccgcctgacccccaaggaggccaggaagttcttccggcagatcatcagcgccctggacttctgccacagccacagcatctgccaccgggacctgaagccagagaacctgctgctggatgagaagaacaacatcagaattgctgactttggcatggccagcctgcaggtgggggacagcctgctggagaccagctgtggcagcccccactacgcctgcccagaggtgatccggggggagaagtatgatggcaggaaggcagatgtgtggagctgtggggtcatcctgtttgccctgctggtgggcgccctgccctttgatgatgacaacctgcggcagctgctggagaaggtgaagaggggcgtcttccacatgccccacttcatccccccagactgccagagcctgctgcggggcatgattgaggtggatgctgcccggcggctgaccctggagcacatccagaagcacatctggtacatcggcggcaagaatgaacctgagcctgagcagcccatccccaggaaggtgcagatccgcagcctgcccagcctggaggacatcgaccctgatgtgctggacagcatgcacagcctgggctgcttccgggacaggaacaagctgctgcaggacctgctgtctgaggaggagaaccaggagaagatgatctacttcctgctgctggacaggaaggagcgctaccccagccaggaggatgaggacctgcccccaagaaatgaaattgacccccccaggaagagggtggacagccccatgctgaacagacatggcaagaggaggcctgagaggaagtccatggaggtgctgtctgtgacagatggcggcagccctgtgcctgcccggcgggccatcgagatggcccagcacggccagaggagccgcagcatcagcggggccagcagcggcctgagcaccagccccctgagcagcccccgggtgaccccccaccccagcccccggggcagccccctgcccacccccaagggcacccctgtgcacacccccaaggagagccctgctggcacccccaaccccaccccacccagcagccccagcgtgggcggcgtgccctggagggcccggctgaacagcatcaagaacagcttcctgggcagcccccgcttccacaggaggaagctgcaggtgcccaccccagaggagatgagcaacctgaccccagagagcagccctgagctggccaagaagtcctggtttggaaacttcatcagcctggagaaggaggagcagatctttgtggtgatcaaggacaagcccctgagcagcatcaaggctgacatcgtgcacgccttcctgagcatccccagcctgagccacagcgtcatcagccagaccagcttccgggcagagtacaaggccactggaggccctgctgtgttccagaagcctgtgaagttccaggtggacatcacctacacagagggcggggaggcccagaaggaaaatggcatctacagcgtgaccttcaccctgctgagcggccccagccgccgcttcaagagggtggtggagaccatccaggcccagctgctgagcacccatgaccccccagctgcccagcacctgagtgacaccaccaactgcatggagatgatgacaggccgcctgagcaaatgtgatgagaagaatggccaggccgcccaggcccccagcaccccagccaagaggtctgcccacggccccctgggggacagcgctgctgctggccctggccctggaggagatgctgagtaccccaccgggaaggacacagccaagatgggccccccaacagcccggcgggagcagccctag

SEQ ID NO: 35794 - DNA, 2091 bp, Artificial Sequence; identical to SEQ ID NO: 35792
  Description of Artificial Sequence: Synthetic coding sequence

SEQ ID NO: 35795 - DNA, 2211 bp, Artificial Sequence
  Description of Artificial Sequence: Synthetic coding sequence
atgaccagcacaggcaaggatggaggagcccagcacgcccagtatgtgggcccctaccgcctggagaagaccctgggcaagggccagacaggcctggtgaagctgggcgtgcactgtgtgacctgccagaaggtggccatcaagatcgtgaaccgggagaagctgtctgagagcgtgctgatgaaggtggagcgggagatcgccatcctgaagctgattgagcacccccacgtgctgaagctgcatgatgtgtatgagaacaagaagtacctgtacctggtgctggagcacgtgtctggaggagagctgtttgactacctggtgaagaagggccgcctgacccccaaggaggccaggaagttcttccggcagatcatcagcgccctggacttctgccacagccacagcatctgccaccgggacctgaagccagagaacctgctgctggatgagaagaacaacatcagaattgctgactttggcatggccagcctgcaggtgggggacagcctgctggagaccagctgtggcagcccccactacgcctgcccagaggtgatccggggggagaagtatgatggcaggaaggcagatgtgtggagctgtggggtcatcctgtttgccctgctggtgggcgccctgccctttgatgatgacaacctgcggcagctgctggagaaggtgaagaggggcgtcttccacatgccccacttcatccccccagactgccagagcctgctgcggggcatgattgaggtggatgctgcccggcggctgaccctggagcacatccagaagcacatctggtacatcggcggcaagaatgaacctgagcctgagcagcccatccccaggaaggtgcagatccgcagcctgcccagcctggaggacatcgaccctgatgtgctggacagcatgcacagcctgggctgcttccgggacaggaacaagctgctgcaggacctgctgtctgaggaggagaaccaggagaagatgatctacttcctgctgctggacaggaaggagcgctaccccagccaggaggatgaggacctgcccccaagaaatgaaattgacccccccaggaagagggtggacagccccatgctgaacagacatggcaagaggaggcctgagaggaagtccatggaggtgctgtctgtgacagatggcggcagccctgtgcctgcccggcgggccatcgagatggcccagcacggccagaggagccgcagcatcagcggggccagcagcggcctgagcaccagccccctgagcagcccccgggtgaccccccaccccagcccccggggcagccccctgcccacccccaagggcacccctgtgcacacccccaaggagagccctgctggcacccccaaccccaccccacccagcagccccagcgtgggcggcgtgccctggagggcccggctgaacagcatcaagaacagcttcctgggcagcccccgcttccacaggaggaagctgcaggtgcccaccccagaggagatgagcaacctgaccccagagagcagccctgagctggccaagaagtcctggtttggaaacttcatcagcctggagaaggaggagcagatctttgtggtgatcaaggacaagcccctgagcagcatcaaggctgacatcgtgcacgccttcctgagcatccccagcctgagccacagcgtcatcagccagaccagcttccgggcagagtacaaggccactggaggccctgctgtgttccagaagcctgtgaagttccaggtggacatcacctacacagagggcggggaggcccagaaggaaaatggcatctacagcgtgaccttcaccctgctgagcggccccagccgccgcttcaagagggtggtggagaccatccaggcccagctgctgagcacccatgaccccccagctgcccagcacctgagtgacaccaccaactgcatggagatgatgacaggccgcctgagcaaatgtggcagccccctgagcaacttctttgatgtgatcaagcagctgttcagtgatgagaagaatggccaggccgcccaggcccccagcaccccagccaagaggtctgcccacggccccctgggggacagcgctgctgctggccctggccctggaggagatgctgagtaccccaccgggaaggacacagccaagatgggccccccaacagcccggcgggagcagccctag

SEQ ID NO: 35796 - DNA, 2025 bp, Artificial Sequence
  Description of Artificial Sequence: Synthetic coding sequence
atgaccagcacaggcaaggatggaggagcccagcacgcccagtatgtgggcccctaccgcctggagaagaccctgggcaagggccagacaggcctggtgaagctgggcgtgcactgtgtgacctgccagaaggtggccatcaagatcgtgaaccgggagaagctgtctgagagcgtgctgatgaaggtggagcgggagatcgccatcctgaagctgattgagcacccccacgtgctgaagctgcatgatgtgtatgagaacaagaagtacctgtacctggtgctggagcacgtgtctggaggagagctgtttgactacctggtgaagaagggccgcctgacccccaaggaggccaggaagttcttccggcagatcatcagcgccctggacttctgccacagccacagcatctgccaccgggacctgaagccagagaacctgctgctggatgagaagaacaacatcagaattgctgactttggcatggccagcctgcaggtgggggacagcctgctggagaccagctgtggcagcccccactacgcctgcccagaggtgatccggggggagaagtatgatggcaggaaggcagatgtgtggagctgtggggtcatcctgtttgccctgctggtgggcgccctgccctttgatgatgacaacctgcggcagctgctggagaaggtgaagaggggcgtcttccacatgccccacttcatccccccagactgccagagcctgctgcggggcatgattgaggtggatgctgcccggcggctgaccctggagcacatccagaagcacatctggtacatcggcggcaagaatgaacctgagcctgagcagcccatccccaggaaggtgcagatccgcagcctgcccagcctggaggacatcgaccctgatgtgctggacagcatgcacagcctgggctgcttccgggacaggaacaagctgctgcaggacctgctgtctgaggaggagaaccaggagaagatgatctacttcctgctgctggacaggaaggagcgctaccccagccaggaggatgaggacctgcccccaagaaatgaaattgacccccccaggaagagggtggacagccccatgctgaacagacatggcaagaggaggcctgagaggaagtccatggaggtgctgtctgtgacagatggcggcagccctgtgcctgcccggcgggccatcgagatggcccagcacggccagaggagccgcagcatcagcggggccagcagcggcctgagcaccagccccctgagcagcccccgggtgaccccccaccccagcccccggggcagccccctgcccacccccaagggcacccctgtgcacacccccaaggagagccctgctggcacccccaaccccaccccacccagcagccccagcgtgggcggcgtgccctggagggcccggctgaacagcatcaagaacagcttcctgggcagcccccgcttccacaggaggaagctgcaggtgcccaccccagaggagatgagcaacctgaccccagagagcagccctgagctggccaagaagtcctggtttggaaacttcatcagcctggagaaggaggagcagatctttgtggtgatcaaggacaagcccctgagcagcatcaaggctgacatcgtgcacgccttcctgagcatccccagcctgagccacagcgtcatcagccagaccagcttccgggcagagtacaaggccactggaggccctgctgtgttccagaagcctgtgaagttccaggtggacatcacctacacagagggcggggaggcccagaaggaaaatggcatctacagcgtgaccttcaccctgctgagcggccccagccgccgcttcaagagggtggtggagaccatccaggcccagctgctgagcacccatgaccccccagctgcccagcacctgtctgagcccccacctccagcccctggcctgtcctggggcgccggcctgaagggccagaaggtggccaccagctatgagagcagcctgtag

SEQ ID NO: 35797 - DNA, 1110 bp, Artificial Sequence
  Description of Artificial Sequence: Synthetic coding sequence
atgcacagcctgggctgcttccgggacaggaacaagctgctgcaggacctgctgtctgaggaggagaaccaggagaagatgatctacttcctgctgctggacaggaaggagcgctaccccagccaggaggatgaggacctgcccccaagaaatgaaattgatcctcccaggaagagggtggacagccccatgctgaacagacatggcaagagaagacctgagaggaagtccatggaggtgctgtctgtgacagatggcggcagccctgtgcctgcccggcgggccatcgagatggcccagcacggccagaggagccgcagcatcagcggggccagcagcggcctgagcaccagccccctgagcagcccccgggtgaccccccaccccagcccccggggcagccccctgcccacccccaagggcacccctgtgcacacccccaaggagagccctgctggcacccccaaccccaccccacccagcagccccagcgtgggcggcgtgccctggagggcccggctgaacagcatcaagaacagcttcctgggcagcccccgcttccacaggaggaagctgcaggtgcccaccccagaggagatgagcaacctgaccccagagagcagccctgagctggccaagaagtcctggtttggaaacttcatcagcctggagaaggaggagcagatctttgtggtgatcaaggacaagcccctgagcagcatcaaggctgacatcgtgcacgccttcctgagcatccccagcctgagccacagcgtcatcagccagaccagcttccgggcagagtacaaggccaccggcggccctgctgtgttccagaagcctgtgaagttccaggtggacatcacctacacagaaggaggagaggcccagaaggaaaatggcatctacagcgtgaccttcaccctgctgagcggccccagccgccgcttcaagagggtggtggagaccatccaggcccagctgctgagcacccatgaccccccagctgcccagcacctgtctgagcccccacctccagcccctggcctgtcctggggcgccggcctgaagggccagaaggtggccaccagctatgagagcagcctgtag

SEQ ID NO: 35798 - DNA, 336 bp, Artificial Sequence
  Description of Artificial Sequence: Synthetic coding sequence
atggagaatgtgcccaaggagaacaaggtggtggagaaggcccctgtgcagaatgaggccccagccctgggcggcggggagtaccaggagcccggcggcaatgtgaagggcgtgtgggcccccccagcccctggctttggagaagatgtgcccaaccggctggtggacaacatcgacatgattgatggagatggagatgacatggagcgcttcatggaggagatgagggagctgcggaggaagatccgggagctgcagctgcgctacagcctgcgcatcctgattggagaccccccccaccacgaccaccatgatgagttctgcctgatgccctag

SEQ ID NO: 35799 - DNA, 336 bp, Artificial Sequence; identical to SEQ ID NO: 35798
  Description of Artificial Sequence: Synthetic coding sequence

SEQ ID NO: 35800 - DNA, 2478 bp, Artificial Sequence
  Description of Artificial Sequence: Synthetic coding sequence
atggctgctgggaagtttgccagcctgcccaggaacatgcctgtgaaccaccagttccccctggccagctccatggacctgctgagcagccgcagccccctggccgagcacaggccagatgcctaccaggatgtgtccatccacggcaccctgcccaggaagaagaagggccccccacccatccgcagctgtgatgacttcagccacatgggcaccctgccccacagcaagagcccccggcagaacagccctgtgacccaggacggcatccaggagagcccctggcaggacagacatggagagaccttcaccttccgggacccccacctgctggaccccaccgtggagtatgtgaagttcagcaaggagcggcacatcatggacaggaccccagagaagctgaagaaggagctggaggaggagctgctgctgagcagcgaggacctgcggagccacgcctggtaccacggccgcatcccccggcaggtgtctgagaacctggtgcagagagatggagacttcctggtgcgggacagcctgagcagccctggcaactttgtgctgacctgccagtggaagaacctggcccagcacttcaagatcaacagaacagtgctgcggctgtctgaggcctacagccgggtgcagtaccagtttgagatggagagctttgacagcatccctggcctggtgcgctgctacgtgggcaacagaagacccatcagccagcagagcggggccatcatcttccagcccatcaacagaacagtgcccctgcgctgcctggaggagcactacggcaccagccctggccaggcccgggagggcagcctgaccaagggccgcccagatgtggccaagaggctgagcctgaccatgggcggcgtgcaggcccgggagcagaacctgccccggggcaacctgctgaggaacaaggagaagagcggcagccagcctgcctgcctggaccacatgcaggaccggcgggccctgagcctgaaggcccaccagagcgagagctacctgcccatcggctgcaagctgcccccccagagcagtggagtggacaccagcccctgccccaacagccctgtgttcagaacaggcagcgagcccgccctgagccctgctgtggtgcggcgggtgtccagtgatgcccgggccggggaggccctgcggggcagtgacagccagctgtgccccaagcccccacccaagccctgcaaggtgcccttcctgaaggtgcccagcagccccagcgcctggctgaacagcgaggccaactactgtgagctgaacccagcctttgccaccggctgcggccgcggggccaagctgcccagctgtgcccagggcagccacacagagctgctgacagccaagcagaatgaggcccctggccccagaaattctggagtgaactacctgatcctggatgatgatgaccgggagcggccctgggagcctgctgctgcccagatggagaagggccagtgggacaagggggagtttgtgacccccctgctggagaccgtgagcagcttccggcccaatgaatttgagagcaagttcctgcccccagagaacaagcccctggagacagccatgctgaagagggccaaggagctgttcaccaacaatgaccccaaggtgattgcccagcacgtgctgtccatggactgccgggtggcccgcatcctgggcgtgtctgaggagatgagaagaaacatgggcgtgagcagcggcctggagctgatcaccctgccccacggccaccagctgcggctggacatcatcgagcggcacaacaccatggccatcggcattgctgtggacatcctgggctgcaccggcaccctggaggaccgggccgccaccctgagcaagatcatccaggtggccgtggagctgaaggacagcatgggagacctgtacagcttcagcgccctgatgaaggccctggagatgccccagatcacccggctggagaagacctggacagccctgcggcaccagtacacccagacagccatcctgtatgagaagcagctgaagcccttcagcaagctgctgcacgagggccgggagagcacctgtgtgccccccaacaacgtgtctgtgcccctgctgatgcccctggtgaccctgatggagcggcaggccgtgacctttgagggcacagacatgtgggagaagaatgaccagagctgtgagatcatgctgaaccacctggccacagcccgcttcatggccgaggccgctgacagctacaggatgaatgctgagcgcatcctggccggcttccagccagatgaggagatgaatgagatctgcaagacagagttccagatgaggctgctgtggggcagcaaaggagcccaggtgaaccagacagaaagatatgagaagttcaaccagatcctgacagccctgagcaggaagctggagcccccacctgtgaagcaggccgagctgtag

SEQ ID NO: 35801 - DNA, 2478 bp, Artificial Sequence; identical to SEQ ID NO: 35800
  Description of Artificial Sequence: Synthetic coding sequence

SEQ ID NO: 35802 - DNA, 2478 bp, Artificial Sequence; identical to SEQ ID NO: 35800
  Description of Artificial Sequence: Synthetic coding sequence

SEQ ID NO: 35803 - DNA, 2205 bp, Artificial Sequence
  Description of Artificial Sequence: Synthetic coding sequence
atgcccaaggagtgcagcgccttccacgccctgtctgctgccctgtgctgcttctaccacaggaagagcttcatcggcgtgaagttcagcaaggagcggcacatcatggacaggaccccagagaagctgaagaaggagctggaggaggagctgctgctgagcagcgaggacctgcggagccacgcctggtaccacggccgcatcccccggcaggtgtctgagaacctggtgcagagagatggagacttcctggtgcgggacagcctgagcagccctggcaactttgtgctgacctgccagtggaagaacctggcccagcacttcaagatcaacagaacagtgctgcggctgtctgaggcctacagccgggtgcagtaccagtttgagatggagagctttgacagcatccctggcctggtgcgctgctacgtgggcaacagaagacccatcagccagcagagcggggccatcatcttccagcccatcaacagaacagtgcccctgcgctgcctggaggagcactacggcaccagccctggccaggcccgggagggcagcctgaccaagggccgcccagatgtggccaagaggctgagcctgaccatgggcggcgtgcaggcccgggagcagaacctgccccggggcaacctgctgaggaacaaggagaagagcggcagccagcctgcctgcctggaccacatgcaggacagaagagccctgagcctgaaggcccaccagagcgagagctacctgcccatcggctgcaagctgcccccccagagcagcggcgtggacaccagcccctgccccaacagccctgtgttcagaactggaagtgagcccgccctgagccctgctgtggtgagaagagtgtccagtgatgcccgggccggggaggccctgcggggcagtgacagccagctgtgccccaagcccccacccaagccctgcaaggtgcccttcctgaaggtgcccagcagccccagcgcctggctgaacagcgaggccaactactgtgagctgaacccagcctttgccaccggctgcggccgcggggccaagctgcccagctgtgcccagggcagccacacagagctgctgacagccaagcagaatgaggcccctggccccaggaacagcggcgtgaactacctgatcctggatgatgatgaccgggagcggccctgggagcctgctgctgcccagatggagaagggccagtgggacaagggggagtttgtgacccccctgctggagaccgtgtcctccttccggcccaatgaatttgagagcaagttcctgcccccagagaacaagcccctggagacagccatgctgaagagggccaaggagctgttcaccaacaatgaccccaaggtgattgcccagcacgtgctgtccatggactgccgggtggcccgcatcctgggcgtgtctgaggagatgagaagaaacatgggcgtgagcagcggcctggagctgatcaccctgccccacggccaccagctgcggctggacatcatcgagcggcacaacaccatggccatcggcattgctgtggacatcctgggctgcaccggcaccctggaggacagagctgccaccctgagcaagatcatccaggtggccgtggagctgaaggacagcatgggagacctgtacagcttcagcgccctgatgaaggccctggagatgccccagatcacccggctggagaagacctggacagccctgcggcaccagtacacccagacagccatcctgtatgagaagcagctgaagcccttcagcaagctgctgcacgagggccgggagagcacctgtgtgccccccaacaacgtgtctgtgcccctgctgatgcccctggtgaccctgatggagcggcaggccgtgacctttgagggcacagacatgtgggagaagaatgaccagagctgtgagatcatgctgaaccacctggccacagcccgcttcatggccgaggccgctgacagctacaggatgaatgctgagcgcatcctggccggcttccagccagatgaggagatgaatgagatctgcaagacagagttccagatgaggctgctgtggggcagcaagggggcccaggtgaaccagacagaaagatatgagaagttcaaccagatcctgacagccctgagcaggaagctggagcccccacctgtgaagcaggccgagctgtag

SEQ ID NO: 35804 - DNA, 1506 bp, Artificial Sequence
  Description of Artificial Sequence: Synthetic coding sequence
atgcaggaccggcgggccctgagcctgaaggcccaccagagcgagagctacctgcccatcggctgcaagctgcccccccagagcagtggagtggacaccagcccctgccccaacagccctgtgttcagaacaggcagcgagcccgccctgagccctgctgtggtgcggcgggtgtccagtgatgcccgggccggggaggccctgcggggcagtgacagccagctgtgccccaagcccccacccaagccctgcaaggtgcccttcctgaaggtgcccagcagccccagcgcctggctgaacagcgaggccaactactgtgagctgaacccagcctttgccaccggctgcggccgcggggccaagctgcccagctgtgcccagggcagccacacagagctgctgacagccaagcagaatgaggcccctggccccagaaattctggagtgaactacctgatcctggatgatgatgaccgggagcggccctgggagcctgctgctgcccagatggagaagggccagtgggacaagggggagtttgtgacccccctgctggagaccgtgagcagcttccggcccaatgaatttgagagcaagttcctgcccccagagaacaagcccctggagacagccatgctgaagagggccaaggagctgttcaccaacaatgaccccaaggtgattgcccagcacgtgctgtccatggactgccgggtggcccgcatcctgggcgtgtctgaggagatgagaagaaacatgggcgtgagcagcggcctggagctgatcaccctgccccacggccaccagctgcggctggacatcatcgagcggcacaacaccatggccatcggcattgctgtggacatcctgggctgcaccggcaccctggaggaccgggccgccaccctgagcaagatcatccaggtggccgtggagctgaaggacagcatgggagacctgtacagcttcagcgccctgatgaaggccctggagatgccccagatcacccggctggagaagacctggacagccctgcggcaccagtacacccagacagccatcctgtatgagaagcagctgaagcccttcagcaagctgctgcacgagggccgggagagcacctgtgtgccccccaacaacgtgtctgtgcccctgctgatgcccctggtgaccctgatggagcggcaggccgtgacctttgagggcacagacatgtgggagaagaatgaccagagctgtgagatcatgctgaaccacctggccacagcccgcttcatggccgaggccgctgacagctacaggatgaatgctgagcgcatcctggccggcttccagccagatgaggagatgaatgagatctgcaagacagagttccagatgaggctgctgtggggcagcaaaggagcccaggtgaaccagacagaaagatatgagaagttcaaccagatcctgacagccctgagcaggaagctggagcccccacctgtgaagcaggccgagctgtag

SEQ ID NO: 35805 - DNA, 4452 bp, Artificial Sequence
  Description of Artificial Sequence: Synthetic coding sequence
atggcccccctgctgggcaggaagcccttccccctggtgaagcccctgcctggagaggagcccctcttcaccatcccccacacccaggaggccttccgcacccgggaggagtatgaggcccggctggagcgctacagcgagcgcatctggacctgcaagagcacaggcagcagccagctgacccacaaggaggcctgggaggaggagcaggaggtggccgagctgctgaaggaggagttccctgcctggtatgagaagctggtgctggagatggtgcaccacaacacagccagcctggagaagctggtggacacagcctggctggagatcatgaccaagtatgctgtgggggaggagtgtgactttgaggtgggcaaggagaagatgctgaaggtgaagatcgtgaagatccaccccctggagaaggtggatgaggaggccacagagaagaagagtgatggagcctgtgacagccccagcagtgacaaggagaacagcagccagatcgcccaggaccaccagaagaaggagaccgtggtgaaggaggatgagggccggcgggagagcatcaatgaccgggcccggcgcagccccaggaagctgcccaccagcctgaagaagggggagaggaagtgggccccacccaagttcctgccccacaagtatgatgtgaagctgcagaatgaagacaagatcatcagcaatgtgcctgctgacagcctcatcagaacagagaggcctcccaacaaggagatcgtgcgctacttcatccgccacaatgccctgcgggccggcaccggggagaatgccccctgggtggtggaggatgagctggtgaagaagtacagcctgcccagcaagttcagtgacttcctgctggacccctacaagtacatgaccctgaaccccagcaccaagaggaagaacacaggcagcccagacaggaagcccagcaagaagagcaagacagacaacagcagcctgagcagccccctgaaccccaagctgtggtgccacgtgcacctgaagaagagcctgagcggcagccccctgaaggtgaagaacagcaagaacagcaagagccctgaggagcacctggaggagatgatgaagatgatgagccccaacaagctgcacaccaacttccacatccccaagaagggccccccagccaagaagccaggcaagcacagcgacaagcccctgaaggccaagggccgcagcaagggcatcctgaatggccagaagagcacaggcaacagcaagagccccaagaagggcctgaagacccccaagaccaagatgaagcagatgaccctgctggacatggccaagggcacccagaagatgacccgggcccccagaaattctgggggcacccccaggaccagcagcaagccccacaagcacctgcccccagctgccctgcacctgattgcctactacaaggagaacaaggaccgggaggacaagaggtctgccctgagctgtgtgatcagcaagacagcccggctgctgagcagtgaagatcgggcccggctgcctgaggagctgcggagcctggtgcagaagagatatgagctgctggagcacaagaagcgctgggcctccatgtctgaggagcagaggaaggagtacctgaagaagaagcgggaggagctgaagaagaagctgaaggagaaggccaaggagcggcgggagaaggagatgctggagcggctggagaagcagaagagatatgaggaccaggagctgaccgggaagaacctgcctgccttccggctggtggacaccccagagggcctgcccaacaccctgtttggagatgtggccatggtggtggagttcctgagctgctacagcggcctgctgctgcctgatgcccagtaccccatcacagctgtgtccctgatggaggccctgtctgctgacaagggcggcttcctgtacctgaacagagtgctggtgatcctgctgcagaccctgctgcaggatgaaattgctgaagattatggagagctgggcatgaagctgtctgagatccccctgaccctgcacagcgtgtctgagctggtgcggctgtgcctgcggcggagtgatgtgcaggaggagagcgagggcagtgacacagatgacaacaaggacagcgctgcctttgaggacaatgaggtgcaggatgagttcctggagaagctggagaccagcgagttctttgagctgaccagcgaggagaagctgcagatcctgacagccctgtgccaccgcatcctgatgacctacagcgtgcaggaccacatggagacccggcagcagatgtctgctgagctgtggaaggagcggctggccgtgctgaaggaggagaatgacaagaagagagctgagaagcagaagaggaaggagatggaggccaagaacaaggaaaatggcaaggtggagaatggcctgggcaagacagacaggaagaaggagatcgtgaagtttgagccccaggtggacacagaagctgaggacatgatctctgctgtgaagagccggcggctgctggccatccaggccaagaaggagcgggagatccaggagcgggagatgaaggtgaagctggagcggcaggccgaggaggagcgcatcaggaagcacaaggctgctgctgagaaggccttccaggagggcatcgccaaggccaagctggtgatgaggaggacccccatcggcacagacaggaaccacaaccgctactggctgttcagtgatgaggtgcccggcctcttcatcgagaagggctgggtgcatgacagcattgactaccgcttcaaccaccactgcaaggaccacacagtgtctggagatgaggactactgccccaggagcaagaaggccaacctgggcaagaatgcctccatgaacacccagcacggcacagccacagaggtggccgtggagaccaccacccccaagcagggccagaacctgtggttcctgtgtgacagccagaaggagctggatgagctgctgaactgcctgcacccccagggcatccgggagagccagctgaaggagcggctggagaagcgctaccaggacatcatccacagcatccacctggccaggaagcccaacctgggcctgaagagctgtgatggcaaccaggagctgctgaacttcctgcggagtgacctgattgaggtggccacccggctgcagaagggcggcctgggctacgtggaggagaccagcgagtttgaggcccgggtcatcagcctggagaagctgaaggactttggagaatgtgtgattgccctgcaggccagcgtcatcaagaagttcctgcagggcttcatggcccccaagcagaagaggaggaagctgcagagtgaagattctgccaagacagaggaggtggatgaggagaagaagatggtggaggaggccaaggtggccagcgccctggagaagtggaagacagccatccgggaggcccagaccttcagcaggatgcacgtgctgctgggcatgctggatgcctgcatcaagtgggacatgtctgcagaaaatgcccgctgcaaggtgtgcaggaagaagggagaagatgacaagctgatcctgtgtgatgagtgcaacaaggccttccacctgttctgcctgcggcctgccctgtatgaggtgcctgatggagagtggcagtgcccagcctgccagcctgccacagcccggaggaacagccggggcaggaactacacagaggagagcgccagcgaggacagtgaagatgatgaaagtgatgaggaggaggaggaggaggaggaggaggaggaggaggaggactatgaggtggccggcctgcggctgcggcccaggaagaccatccggggcaagcacagcgtcatccccccagctgcccggtctggaagaagacctgggaagaagccccacagcaccaggaggagccagcccaaggcccctcctgtggatgatgctgaggtggatgagctggtgctgcagaccaagaggagcagccggcggcagagcctggagctgcagaagtgtgaggagatcctgcacaagatcgtgaagtaccgcttctcctggcccttccgggagcctgtgaccagagatgaagctgaggactactatgatgtgatcacccaccccatggacttccagacagtgcagaacaagtgcagctgtggcagctacagatctgtgcaggagttcctgacagacatgaagcaggtgttcaccaatgctgaggtgtacaactgccggggcagccacgtgctgagctgcatggtgaagacagagcagtgcctggtggccctgctgcacaagcacctgcccggccacccctacgtgcggaggaagaggaagaagttcccagaccggctggctgaagatgaaggagacagcgagcctgaggccgtgggccagagccggggccggcggcagaagaagtag

SEQ ID NO: 35806 - DNA, 1506 bp, Artificial Sequence
  Description of Artificial Sequence: Synthetic coding sequence
atgaagggctaccagagcctggtgttcaacttcttcttcctgaagctgtctgcagaaaatgaaagcacccccatccagcagctgctggagcacttcctgcggcagctgcagaggaaggacccccacggcttctttgccttccctgtgacagatgccatcgcccctggctacagcatgatcatcaagcaccccatggactttggcaccatgaaggacaagatcgtggccaatgagtacaagtctgtgacagagttcaaggctgacttcaagctgatgtgtgacaatgccatgacctacaacagaccagacacagtgtactacaagctggccaagaagatcctgcacgccggcttcaagatgatgagcaaggagcggctgctggccctgaagaggtccatgtccttcatgcaggacatggacttcagccagcaggccgccctgctgggcaatgaagacacagctgtggaggagcctgtgcctgaggtggtgcctgtgcaggtggagacagccaagaagagcaagaagcccagccgggaggtgatcagctgcatgtttgagcctgagggcaatgcctgcagcctgacagacagcacagctgaggagcacgtgctggccctggtggagcacgccgcagatgaggcccgggaccgcatcaaccgcttcctgcccggcggcaagatgggctacctgaagagaaatggagatggcagcctgctgtacagcgtggtgaacacagctgagccagatgctgatgaggaggagacccaccctgtggacctgagcagcctgagcagcaagctgctgcccggcttcaccaccctgggcttcaaggatgagaggaggaacaaggtgaccttcctgagcagcgccaccacagccctgtccatgcagaacaacagcgtgtttggagacctgaagagtgatgagatggagctgctgtacagcgcctatggagatgaaacaggagtgcagtgtgccctgagcctgcaggagtttgtgaaggatgctggcagctacagcaagaaggtggtggatgacctgctggaccagatcaccggcggggaccacagcaggaccctcttccagctgaagcagaggagaaatgtgcccatgaagcccccagatgaggccaaggtgggggacaccctgggggacagcagcagctctgtgctggagttcatgtccatgaagagctacccagatgtgtctgtggacatctccatgctgagcagcctgggcaaggtgaagaaggagctggaccctgatgacagccacctgaacctggatgagaccaccaagctgctgcaggacctgcacgaggcccaggccgagcggggcggcagccggcccagcagcaacctgagcagcctgagcaatgccagcgagcgggaccagcaccacctgggcagccccagccggctgtctgtgggggagcagccagatgtgacccatgacccctatgagttcctgcagagccctgagcctgctgccagcgccaagacctag

SEQ ID NO: 35807 - DNA, 561 bp, Artificial Sequence
  Description of Artificial Sequence: Synthetic coding sequence
gctgtgtgcagcctgcggctgcccagcagcccagacaagaggagccgggccatgcaggtgaccctcatcctggccgaggaggagacccaccctgtggacctgagcagcctgagcagcaagctgctgcccggcttcaccaccctgggcttcaaggatgagaggaggaacaaggtgaccttcctgagcagcgccaccacagccctgtccatgcagaacaacagcgtgtttggagacctgaagagtgatgagatggagctgctgtacagcgcctatggagatgaaacaggagtgcagtgtgccctgagcctgcaggagtttgtgaaggatgctggcagctacagcaagaaggtggtggatgacctgctggaccagatcaccggcggggaccacagcaggaccctcttccagctgaagcagaggagaaatgtgcccatgaagcccccagatgaggccaaggtgggggacaccctgggggacagcagcagctctgtgctggagttcatgtccatgaagagctacccagatgtgtctgtggacatctccatgctgagcagcctgtag

SEQ ID NO: 35808 - DNA, 1446 bp, Artificial Sequence
  Description of Artificial Sequence: Synthetic coding sequence
atgaagggctaccagagcctggtgttcaacttcttcttcctgaagctgtctgcagaaaatgaaagcacccccatccagcagctgctggagcacttcctgcggcagctgcagaggaaggacccccacggcttctttgccttccctgtgacagatgccatcgcccctggctacagcatgatcatcaagcaccccatggactttggcaccatgaaggacaagatcgtggccaatgagtacaagtctgtgacagagttcaaggctgacttcaagctgatgtgtgacaatgccatgacctacaacagaccagacacagtgtactacaagctggccaagaagatcctgcacgccggcttcaagatgatgagcaagcaggccgccctgctgggcaatgaagacacagctgtggaggagcctgtgcctgaggtggtgcctgtgcaggtggagacagccaagaagagcaagaagcccagccgggaggtgatcagctgcatgtttgagcctgagggcaatgcctgcagcctgacagacagcacagctgaggagcacgtgctggccctggtggagcacgccgcagatgaggcccgggaccgcatcaaccgcttcctgcccggcggcaagatgggctacctgaagagaaatggagatggcagcctgctgtacagcgtggtgaacacagctgagccagatgctgatgaggaggagacccaccctgtggacctgagcagcctgagcagcaagctgctgcccggcttcaccaccctgggcttcaaggatgagaggaggaacaaggtgaccttcctgagcagcgccaccacagccctgtccatgcagaacaacagcgtgtttggagacctgaagagtgatgagatggagctgctgtacagcgcctatggagatgaaacaggagtgcagtgtgccctgagcctgcaggagtttgtgaaggatgctggcagctacagcaagaaggtggtggatgacctgctggaccagatcaccggcggggaccacagcaggaccctcttccagctgaagcagaggagaaatgtgcccatgaagcccccagatgaggccaaggtgggggacaccctgggggacagcagcagctctgtgctggagttcatgtccatgaagagctacccagatgtgtctgtggacatctccatgctgagcagcctgggcaaggtgaagaaggagctggaccctgatgacagccacctgaacctggatgagaccaccaagctgctgcaggacctgcacgaggcccaggccgagcggggcggcagccggcccagcagcaacctgagcagcctgagcaatgccagcgagcgggaccagcaccacctgggcagccccagccggctgtctgtgggggagcagccagatgtgacccatgacccctatgagttcctgcagagccctgagcctgctgccagcgccaagacctag

SEQ ID NO: 35809 - DNA, 645 bp, Artificial Sequence
  Description of Artificial Sequence: Synthetic coding sequence
atgaagggctaccagagcctggtgttcaacttcttcttcctgaagctgtctgcagaaaatgaaagcacccccatccagcagctgctggagcacttcctgcggcagctgcagaggaaggacccccacggcttctttgccttccctgtgacagatgccatcgcccctggctacagcatgatcatcaagcaccccatggactttggcaccatgaaggacaagatcgtggccaatgagtacaagtctgtgacagagttcaaggctgacttcaagctgatgtgtgacaatgccatgacctacaacagaccagacacagtgtactacaagctggccaagaagatcctgcacgccggcttcaagatgatgagcaagcaggccgccctgctgggcaatgaagacacagctgtggaggagcctgtgcctgaggtggtgcctgtgcaggtggagacagccaagaagagcaagaagcccagccgggaggtgatcagctgcatgtttgagcctgagggcaatgcctgcagcctgacagacagcacagctgaggagcacgtgctggccctggtggagcacgccgcagatgaggcccgggaccgcatcaaccgcttcctgcccggcggcaagagaagaagacccacccgctggacctag

SEQ ID NO: 35810 - DNA, 1794 bp, Artificial Sequence
  Description of Artificial Sequence: Synthetic coding sequence
atgggcaagaagcacaagaagcacaaggccgagtggaggagcagctatgaagattatgctgacaagcccctggagaagcccctgaagctggtgctgaaggtgggcggcagcgaggtgacagagctgagcggcagcggccatgacagcagctactatgatgacagaagtgaccacgagcgggagcggcacaaggagaagaagaagaagaagaagaagaagtctgagaaggagaagcacctggatgatgaggagaggaggaagaggaaggaggagaagaagaggaagcgggagcgggagcactgtgacacagaaggagaggctgatgactttgaccccgggaagaaggtggaggtggagcccccaccagacaggcctgtgcgggcctgcaggacccagcctgcagaaaatgaaagcacccccatccagcagctgctggagcacttcctgcggcagctgcagaggaaggacccccacggcttctttgccttccctgtgacagatgccatcgcccctggctacagcatgatcatcaagcaccccatggactttggcaccatgaaggacaagatcgtggccaatgagtacaagtctgtgacagagttcaaggctgacttcaagctgatgtgtgacaatgccatgacctacaacagaccagacacagtgtactacaagctggccaagaagatcctgcacgccggcttcaagatgatgagcaagcaggccgccctgctgggcaatgaagacacagctgtggaggagcctgtgcctgaggtggtgcctgtgcaggtggagacagccaagaagagcaagaagcccagccgggaggtgatcagctgcatgtttgagcctgagggcaatgcctgcagcctgacagacagcacagctgaggagcacgtgctggccctggtggagcacgccgcagatgaggcccgggaccgcatcaaccgcttcctgcccggcggcaagatgggctacctgaagagaaatggagatggcagcctgctgtacagcgtggtgaacacagctgagccagatgctgatgaggaggagacccaccctgtggacctgagcagcctgagcagcaagctgctgcccggcttcaccaccctgggcttcaaggatgagaggaggaacaaggtgaccttcctgagcagcgccaccacagccctgtccatgcagaacaacagcgtgtttggagacctgaagagtgatgagatggagctgctgtacagcgcctatggagatgaaacaggagtgcagtgtgccctgagcctgcaggagtttgtgaaggatgctggcagctacagcaagaaggtggtggatgacctgctggaccagatcaccggcggggaccacagcaggaccctcttccagctgaagcagaggagaaatgtgcccatgaagcccccagatgaggccaaggtgggggacaccctgggggacagcagcagctctgtgctggagttcatgtccatgaagagctacccagatgtgtctgtggacatctccatgctgagcagcctgggcaaggtgaagaaggagctggaccctgatgacagccacctgaacctggatgagaccaccaagctgctgcaggacctgcacgaggcccaggccgagcggggcggcagccggcccagcagcaacctgagcagcctgagcaatgccagcgagcgggaccagcaccacctgggcagccccagccggctgtctgtgggggagcagccagatgtgacccatgacccctatgagttcctgcagagccctgagcctgctgccagcgccaagacctag

SEQ ID NO: 35811 - DNA, 1635 bp, Artificial Sequence
  Description of Artificial Sequence: Synthetic coding sequence
atgatgacaggccagaccatgtctgagcggggcaccaagaagaggaagagaagaagaagaagaagccccaggagaagaagcatctggaccatgaggaaggagggcagcgagaggaagaggaggagcggcagcgagcggggcagcacagtgacccggcgggagcggctgaccaccctcatcctgggccgccgctggcgctggagccggccccagatcggccagagcgagcgggccggccacagccagcccaagatgagggcccacctgttcagcaacagctggaacaccagcagcgccagcttccgggacccccacggcttctttgccttccctgtgacagatgccatcgcccctggctacagcatgatcatcaagcaccccatggactttggcaccatgaaggacaagatcgtggccaatgagtacaagtctgtgacagagttcaaggctgacttcaagctgatgtgtgacaatgccatgacctacaacagaccagacacagtgtactacaagctggccaagaagatcctgcatgctggcttcaagatgatgagcaagcaggccgccctgctgggcaatgaagacacagctgtggaggagcctgtgcctgaggtggtgcctgtgcaggtggagacagccaagaagagcaagaagcccagccgggaggtgatcagctgcatgtttgagcctgagggcaatgcctgcagcctgacagacagcacagctgaggagcacgtgctggccctggtggagcacgccgcagatgaggcccgggaccgcatcaaccgcttcctgcccggcggcaagatgggctacctgaagagaaatggagatggcagcctgctgtacagcgtggtgaacacagctgagccagatgctgatgaggaggagacccaccctgtggacctgagcagcctgagcagcaagctgctgcccggcttcaccaccctgggcttcaaggatgaaagaagaaacaaggtgaccttcctgagcagcgccaccacagccctgtccatgcagaacaacagcgtgtttggagacctgaagagtgatgagatggagctgctgtacagcgcctatggagatgagaccggggtgcagtgtgccctgagcctgcaggagtttgtgaaggatgctggcagctacagcaagaaggtggtggatgacctgctggaccagatcactggaggagaccacagcaggaccctcttccagctgaagcagaggagaaatgtgcccatgaagcccccagatgaggccaaggtgggggacaccctgggggacagcagcagctctgtgctggagttcatgtccatgaagagctacccagatgtgtctgtggacatctccatgctgagcagcctgggcaaggtgaagaaggagctggaccctgatgacagccacctgaacctggatgagaccaccaagctgctgcaggacctgcacgaggcccaggccgagcggggcggcagccggcccagcagcaacctgagcagcctgagcaatgccagcgagcgggaccagcaccacctgggcagccccagccggctgtctgtgggggagcagccagatgtgacccatgacccctatgagttcctgcagagccctgagcctgctgccagcgccaagacctag

SEQ ID NO: 35812 - DNA, 438 bp, Artificial Sequence
  Description of Artificial Sequence: Synthetic coding sequence
atgctgggctggatccagcccagccggcagccccagctgcgggccgccccacccaccaggaccccatctgccaagcgctgcatcctgtgcaacttcctgcccggctgctggctggtgggagatgtggccggcagccggcagcccagcgccccccagaccctgcggcagaggcagcacacccggcccccaccccaggagcggggcagcggcagaagaagccccctgcgggaggcccggcgggccaacccccacttcaagagcttccctgtgctggaggcccggggcctgccctgtggggccaggagaacaggcccccggcggcctgtgcgggagatgaccctgcccagcgaccctgagcgggccaccctgcccaacccccggctgggcgccccagctgtgccccggcggggccccaggagccatggaggaagaagatag

SEQ ID NO: 35813 - DNA, 522 bp, Artificial Sequence
  Description of Artificial Sequence: Synthetic coding sequence
atggccgagggagaagatgtgggctggtggaggtcctggctgcagcagagctaccaggccgtgaaggagaagagcagcgaggccctggagttcatgaagagggacctgacagagttcacccaggtggtgcagcacgacacagcctgcaccatcgccgccacagcctctgtggtgaaggagaagctggccacagagggcagcagcggggccacagagaagatgaagaagggcctgagtgacttcctgggcgtcatcagtgacacctttgcccccagcccagacaagaccatcgactgtgatgtgatcaccctgatgggcaccccatctggaacagctgagccctatgatggcaccaaggcccggctgtacagcctgcagagcgaccctgccacctactgcaatgaaccagatggccccccagagctgtttgatgcctgccagcctgagctgtgggcccagatcctggtggccccctgctggcccagctgggccagcgcccacacctgggagggcgccctgtag

SEQ ID NO: 35814 - DNA, 1425 bp, Artificial Sequence
  Description of Artificial Sequence: Synthetic coding sequence
atggccgagggagaagatgtgggctggtggaggtcctggctgcagcagagctaccaggccgtgaaggagaagagcagcgaggccctggagttcatgaagagggacctgacagagttcacccaggtggtgcagcacgacacagcctgcaccatcgccgccacagcctctgtggtgaaggagaagctggccatcgccgcctgcagcagaggagcctgcttcctgtgccccttcagcatccagacagagggcagcagcggggccacagagaagatgaagaagggcctgagtgacttcctgggcgtcatcagtgacacctttgcccccagcccagacaagaccatcgactgtgatgtgatcaccctgatgggcacccccagcggcacagctgagccctatgatggcaccaaggcccggctgtacagcctgcagagcgaccctgccacctactgcaatgaaccagatggccccccagagctgtttgatgcctggctgagccagttctgcctggaggagaagaagggggagatcagcgagctgctggtgggcagccccagcatccgggccctgtacaccaagatggtgcctgctgctgtgagccacagcgagttctggcaccgctacttctacaaggtgcaccagctggagcaggagcaggccaggagagatgccctgaagcagagagctgagcagagcatcagcgaggagcccggctgggaggaggaggaggaggagctgatgggcatcagccccatcagccccaaggaggccaaggtgcctgtggccaagatcagcaccttccctgagggggagcccggcccccagagcccctgtgaggagaacctggtgacctctgtggagcccccagctgaggtgacccccagcgagagcagcgagagcatcagcctggtgacccagatcgccaacccagccacagcccctgaggcccgggtgctgcccaaggacctgagccagaagctgctggaggccagcctggaggagcagggcctggccgtggatgtgggggagaccggccccagcccccccatccacagcaagcccctgaccccagctggccacactggaggccctgagccccggcccccagcccgggtggagaccctgcgggaggaggcccccacagacctgcgggtgtttgagctgaacagcgacagcggcaagagcacccccagcaacaacgggaagaagggcagcagcacagacatcagcgaggactgggagaaggactttgacctggacatgacagaggaggaggtgcagatggccctgagcaaggtggatgccagcggggaggtgtctggccctgggggcagcgagggcagcgagcccaacggccctggctgtgagagcagcccccagcctgcccagctgagcccccaggagggcccctgcagctgcctgaggtag

SEQ ID NO: 35815 - DNA, 1110 bp, Artificial Sequence
  Description of Artificial Sequence: Synthetic coding sequence
atggccgagggagaagatgtgggctggtggaggtcctggctgcagcagagctaccaggccgtgaaggagaagagcagcgaggccctggagttcatgaagagggacctgacagagttcacccaggtggtgcagcacgacacagcctgcaccatcgccgccacagcctctgtggtgaaggagaagctggccacagagggcagcagcggggccacagagaagatgaagaagggcctgagtgacttcctgggcgtcatcagtgacacctttgcccccagcccagacaagaccatcgactgtgatgtgatcaccctgatgggcaccccatctggaacagctgagccctatgatggcaccaaggcccggctgtacagcctgcagagcgaccctgccacctactgcaatgaaccagatggccccccagagctgtttgatgccctgaagcagagagctgagcagagcatcagcgaggagcccggctgggaggaggaggaggaggagctgatgggcatcagccccatcagccccaaggaggccaaggtgcctgtggccaagatcagcaccttccctgagggggagcccggcccccagagcccctgtgaggagaacctggtgacctctgtggagcccccagctgaggtgacccccagcgagagcagcgagagcatcagcctggtgacccagatcgccaacccagccacagcccctgaggcccgggtgctgcccaaggacctgagccagaagctgctggaggccagcctggaggagcagggcctggccgtggatgtgggggagaccggccccagcccccccatccacagcaagcccctgaccccagctggccacactggaggccctgagccccggcccccagcccgggtggagaccctgcgggaggaggcccccacagacctgcgggtgtttgagctgaacagcgacagcggcaagagcacccccagcaacaacgggaagaagggcagcagcacagacatcagcgaggactgggagaaggactttgacctggacatgacagaggaggaggtgcagatggccctgagcaaggtggatgccagcggggagctggaggatgtggagtgggaggactgggagtag

SEQ ID NO: 35816 - DNA, 1125 bp, Artificial Sequence
  Description of Artificial Sequence: Synthetic coding sequence
atggccgagggagaagatgtgggctggtggaggtcctggctgcagcagagctaccaggccgtgaaggagaagagcagcgaggccctggagttcatgaagagggacctgacagagttcacccaggtggtgcagcacgacacagcctgcaccatcgccgccacagcctctgtggtgaaggagaagctggccgcccggctgtacagcctgcagagcgaccctgccacctactgcaatgaaccagatggccccccagagctgtttgatgcctggctgagccagttctgcctggaggagaagaagggggagatcagcgagctgctggtgggcagccccagcatccgggccctgtacaccaagatggtgcctgctgctgtgagccacagcgagttctggcaccgctacttctacaaggtgcaccagctggagcaggagcaggccaggagagatgccctgaagcagagagctgagcagagcatcagcgaggagcccggctgggaggaggaggaggaggagctgatgggcatcagccccatcagccccaaggaggccaaggtgcctgtggccaagatcagcaccttccctgagggggagcccggcccccagagcccctgtgaggagaacctggtgacctctgtggagcccccagctgaggtgaccccatctgagagcagcgagagcatcagcctggtgacccagatcgccaacccagccacagcccctgaggcccgggtgctgcccaaggacctgagccagaagctgctggaggccagcctggaggagcagggcctggccgtggatgtgggggagaccggccccagcccccccatccacagcaagcccctgaccccagctggccacactggaggccctgagccccggcccccagcccgggtggagaccctgcgggaggaggcccccacagacctgcgggtgtttgagctgaacagcgacagcggcaagagcacccccagcaacaacgggaagaagggcagcagcacagacatcagcgaggactgggagaaggactttgacctggacatgacagaggaggaggtgcagatggccctgagcaaggtggatgccagcggggagctggaggatgtggagtgggaggactgggagtag

SEQ ID NO: 35817 - DNA, 1344 bp, Artificial Sequence
  Description of Artificial Sequence: Synthetic coding sequence
atggccgagggagaagatgtgggctggtggaggtcctggctgcagcagagctaccaggccgtgaaggagaagagcagcgaggccctggagttcatgaagagggacctgacagagttcacccaggtggtgcagcacgacacagcctgcaccatcgccgccacagcctctgtggtgaaggagaagctggccatcgccgcctgcagcagaggagcctgcttcctgtgccccttcagcatccagacagagggcagcagcggggccacagagaagatgaagaagggcctgagtgacttcctgggcgtcatcagtgacacctttgcccccagcccagacaagaccatcgactgtgatgtgatcaccctgatgggcacccccagcggcacagctgagccctatgatggcaccaaggcccggctgtacagcctgcagagcgaccctgccacctactgcaatgaaccagatggccccccagagctgtttgatgcctggctgagccagttctgcctggaggagaagaagggggagatcagcgagctgctggtgggcagccccagcatccgggccctgtacaccaagatggtgcctgctgctgtgagccacagcgagttctggcaccgctacttctacaaggtgcaccagctggagcaggagcaggccaggagagatgccctgaagcagagagctgagcagagcatcagcgaggagcccggctgggaggaggaggaggaggagctgatgggcatcagccccatcagccccaaggaggccaaggtgcctgtggccaagatcagcaccttccctgagggggagcccggcccccagagcccctgtgaggagaacctggtgacctctgtggagcccccagctgaggtgacccccagcgagagcagcgagagcatcagcctggtgacccagatcgccaacccagccacagcccctgaggcccgggtgctgcccaaggacctgagccagaagctgctggaggccagcctggaggagcagggcctggccgtggatgtgggggagaccggccccagcccccccatccacagcaagcccctgaccccagctggccacactggaggccctgagccccggcccccagcccgggtggagaccctgcgggaggaggcccccacagacctgcgggtgtttgagctgaacagcgacagcggcaagagcacccccagcaacaacgggaagaagggcagcagcacagacatcagcgaggactgggagaaggactttgacctggacatgacagaggaggaggtgcagatggccctgagcaaggtggatgccagcggggagctggaggatgtggagtgggaggactgggagtag

SEQ ID NO: 35818 - DNA, 1269 bp, Artificial Sequence
  Description of Artificial Sequence: Synthetic coding sequence
atggccgagggagaagatgtgggctggtggaggtcctggctgcagcagagctaccaggccgtgaaggagaagagcagcgaggccctggagttcatgaagagggacctgacagagttcacccaggtggtgcagcacgacacagcctgcaccatcgccgccacagcctctgtggtgaaggagaagctggccacagagggcagcagcggggccacagagaagatgaagaagggcctgagtgacttcctgggcgtcatcagtgacacctttgcccccagcccagacaagaccatcgactgtgatgtgatcaccctgatgggcaccccatctggaacagctgagccctatgatggcaccaaggcccggctgtacagcctgcagagcgaccctgccacctactgcaatgaaccagatggccccccagagctgtttgatgcctggctgagccagttctgcctggaggagaagaagggggagatcagcgagctgctggtgggcagccccagcatccgggccctgtacaccaagatggtgcctgctgctgtgagccacagcgagttctggcaccgctacttctacaaggtgcaccagctggagcaggagcaggccaggagagatgccctgaagcagagagctgagcagagcatcagcgaggagcccggctgggaggaggaggaggaggagctgatgggcatcagccccatcagccccaaggaggccaaggtgcctgtggccaagatcagcaccttccctgagggggagcccggcccccagagcccctgtgaggagaacctggtgacctctgtggagcccccagctgaggtgaccccatctgagagcagcgagagcatcagcctggtgacccagatcgccaacccagccacagcccctgaggcccgggtgctgcccaaggacctgagccagaagctgctggaggccagcctggaggagcagggcctggccgtggatgtgggggagaccggccccagcccccccatccacagcaagcccctgaccccagctggccacactggaggccctgagccccggcccccagcccgggtggagaccctgcgggaggaggcccccacagacctgcgggtgtttgagctgaacagcgacagcggcaagagcacccccagcaacaacgggaagaaggagaccaggagccagttcaccgtggacttcctgtggaagatctctgtgaccctgctggagcccctgggccagagcgccagccccctcttcagcaacctgcccttccccaggtag

SEQ ID NO: 35819 - DNA, 1293 bp, Artificial Sequence
  Description of Artificial Sequence: Synthetic coding sequence
atggccgagggagaagatgtgggctggtggaggtcctggctgcagcagagctaccaggccgtgaaggagaagagcagcgaggccctggagttcatgaagagggacctgacagagttcacccaggtggtgcagcacgacacagcctgcaccatcgccgccacagcctctgtggtgaaggagaagctggccacagagggcagcagcggggccacagagaagatgaagaagggcctgagtgacttcctgggcgtcatcagtgacacctttgcccccagcccagacaagaccatcgactgtgatgtgatcaccctgatgggcaccccatctggaacagctgagccctatgatggcaccaaggcccggctgtacagcctgcagagcgaccctgccacctactgcaatgaaccagatggccccccagagctgtttgatgcctggctgagccagttctgcctggaggagaagaagggggagatcagcgagctgctggtgggcagccccagcatccgggccctgtacaccaagatggtgcctgctgctgtgagccacagcgagttctggcaccgctacttctacaaggtgcaccagctggagcaggagcaggccaggagagatgccctgaagcagagagctgagcagagcatcagcgaggagcccggctgggaggaggaggaggaggagctgatgggcatcagccccatcagccccaaggaggccaaggtgcctgtggccaagatcagcaccttccctgagggggagcccggcccccagagcccctgtgaggagaacctggtgacctctgtggagcccccagctgaggtgaccccatctgagagcagcgagagcatcagcctggtgacccagatcgccaacccagccacagcccctgaggcccgggtgctgcccaaggacctgagccagaagctgctggaggccagcctggaggagcagggcctggccgtggatgtgggggagaccggccccagcccccccatccacagcaagcccctgaccccagctggccacactggaggccctgagccccggcccccagcccgggtggagaccctgcgggaggaggcccccacagacctgcgggtgtttgagctgaacagcgacagcggcaagagcacccccagcaacaacgggaagaagggcagcagcacagacatcagcgaggactgggagaaggactttgacctggacatgacagaggaggaggtgcagatggccctgagcaaggtggatgccagcggggagctggaggatgtggagtgggaggactgggagtag

SEQ ID NO: 35820 - DNA, 1008 bp, Artificial Sequence
  Description of Artificial Sequence: Synthetic coding sequence
atggccgagggagaagatgtgggctggtggaggtcctggctgcagcagagctaccaggccgtgaaggagaaggcccggctgtacagcctgcagagcgaccctgccacctactgcaatgaaccagatggccccccagagctgtttgatgcctggctgagccagttctgcctggaggagaagaagggggagatcagcgagctgctggtgggcagccccagcatccgggccctgtacaccaagatggtgcctgctgctgtgagccacagcgagttctggcaccgctacttctacaaggtgcaccagctggagcaggagcaggccaggagagatgccctgaagcagagagctgagcagagcatcagcgaggagcccggctgggaggaggaggaggaggagctgatgggcatcagccccatcagccccaaggaggccaaggtgcctgtggccaagatcagcaccttccctgagggggagcccggcccccagagcccctgtgaggagaacctggtgacctctgtggagcccccagctgaggtgacccccagcgagagcagcgagagcatcagcctggtgacccagatcgccaacccagccacagcccctgaggcccgggtgctgcccaaggacctgagccagaagctgctggaggccagcctggaggagcagggcctggccgtggatgtgggggagaccggccccagcccccccatccacagcaagcccctgaccccagctggccacactggaggccctgagccccggcccccagcccgggtggagaccctgcgggaggaggcccccacagacctgcgggtgtttgagctgaacagcgacagcggcaagagcacccccagcaacaacgggaagaagggcagcagcacagacatcagcgaggactgggagaaggactttgacctggacatgacagaggaggaggtgcagatggccctgagcaaggtggatgccagcggggagctggaggatgtggagtgggaggactgggagtag

SEQ ID NO: 35821 - DNA, 1158 bp, Artificial Sequence
  Description of Artificial Sequence: Synthetic coding sequence
atggccagcctgggccctgctgctgctggggagcaggccagcggggctgaggccgagcccggccctgctggccccccacctccacccagccccagcagcctgggccccctgctgcccctgcagcgggagcccctgtacaactggcaggccaccaaggccagcctgaaggagagatttgccttcctgttcaacagcgagctgctgagtgatgtgcgctttgtgctgggcaagggcagaggagctgctgctgctgggggcccccagaggatcccagcccacagatttgtgctggccgccggcagcgctgtgtttgatgccatgtttaatggaggcatggccaccaccagcgctgagattgagctgcctgatgtggagcctgctgccttcctggccctgctgcgcttcctgtacagtgatgaggtgcagatcggccctgagaccgtgatgaccaccctgtacacagccaagaagtatgctgtgcctgccctggaggcccactgtgtggagttcctgaccaagcacctgcgggctgacaatgccttcatgctgctgacccaggcccggctgtttgatgagccccagctggccagcctgtgcctggacaccatcgacaagagcaccatggatgccatctctgctgagggcttcacagacattgatattgacaccctgtgtgctgtgctggagcgggacaccctgagcatccgggagagccggctgtttggagctgtggtgcgctgggccgaggccgagtgccagaggcagcagctgcctgtgacctttggaaacaagcagaaggtgctgggcaaggccctgagcctcatccgcttccccctgatgaccatcgaggagtttgctgctggccctgcccagagcggcatcctgagtgaccgggaggtggtgaacctcttcctgcacttcaccgtgaaccccaagccccgggtggagtacatcgaccggccccgctgctgcctgcggggcaaggagtgctgcatcaaccgcttccagcaggtggagagccgctggggctacagcggcaccagtgaccgcatccgcagcctgaacatgaggaagagcaagccctgggacaggatgatcccagccctggtggtgatgggccagctgacccacagcggcagctgcagcaggaacccctag

SEQ ID NO: 35822 - DNA, 1521 bp, Artificial Sequence
  Description of Artificial Sequence: Synthetic coding sequence
atgatcatgagcaacacccacaaggcccggctggagaggagagtgacaggcagcaccaaccgctggaggctgcccaagcagcccttcagcggggacctgctgagcctgagccagatgtgcaaggccctgagcattgactttgaggaggccctgaggaacccagaccggctgtgcatcagccagatccagaagttcttctttgagaacttcaagaacaaggacatccagagcggggaggctgatgtgatcctggagtgcctgggcttcaagtgggagctgcaccagccccagctgttccagagcgagaccctggccaagctgtacctgaaggccctggcccagggcaccacccaccccctgcgggagctggaggagctgctgcgggcccagagccccaagaagaccaaggagaagagccctgccaagaggatcatcatcagcctgaagatcaatgaccccctggtgaccaaggtggcctttgccacagccctgaagaacctgtacatgtctgaggtggagatcaacctggaggacctgctgggcgtgctggccagcgcccacatcctgcagttcagcggcctcttccagagatgtgtggatgtgatgattgcccggctgaagcccagcaccatcaagaagttctatgaagctggctgcaagtacaaggaggagcagctgaccaccggctgtgagaagtggctggagatgaacctggtgcccctgggcggcacccagatccacctgcacaagatcccccaggacctgctgcacaaggtgctgaagagccccaggctcttcaccttcagcgagttccacctgctgaagaccatgctgctgtgggtgttcctgcagctgaactacaagatccaggccatccccacctatgaaacagtgatgaccttcttcaagagcttccctgagaactgctgcttcctggaccgggacatcggccgcagcctgcggcccctcttcctgtgcctgcggctgcacggcatcaccaagggcaaggacctggaggtgctgcggcacctgaacttcttccctgagagctggctggaccaggtgacagtgaaccactaccacgccctggagaatggaggagacatggtgcacctgaaggacctgaacacccaggccgtgcgcttcggcctgctcttcaaccaggagaacaccacctacagcaagaccatcgccctgtatggcttcttcttcaagatcaagggcctgaagcatgacaccaccagctacagcttctacatgcagaggatcaagcacacagacctggagagccccagcgctgtgtatgagcacaaccacgtgtccctgcgggccgcccggctggtgaagtatgagatccgggcagaggccctggtggatggcaagtggcaggagttccgcaccaaccagatcaagcagaagtttggcctgaccaccagcagctgcaagagccacaccctgaagatccagacagtgggcatccccatctacgtgtcctttgccttcatcttccctgccagctag

SEQ ID NO: 35823 - DNA, 1524 bp, Artificial Sequence
  Description of Artificial Sequence: Synthetic coding sequence
atgatcatgagcaacacccagcacaaggcccggctggagcggcgggtgacaggcagcaccaaccgctggaggctgcccaagcagcccttcagcggggacctgctgagcctgagccagatgtgcaaggccctgagcattgactttgaggaggccctgagaaatccagaccggctgtgcatcagccagatccagaagttcttctttgagaacttcaagaacaaggacatccagagcggggaggctgatgtgatcctggagtgcctgggcttcaagtgggagctgcaccagccccagctgttccagagcgagaccctggccaagctgtacctgaaggccctggcccagggcaccacccaccccctgcgggagctggaggagctgctgcgggcccagagccccaagaagaccaaggagaagagccctgccaagaggatcatcatcagcctgaagatcaatgaccccctggtgaccaaggtggcctttgccacagccctgaagaacctgtacatgtctgaggtggagatcaacctggaggacctgctgggcgtgctggccagcgcccacatcctgcagttcagcggcctcttccagagatgtgtggatgtgatgattgcccggctgaagcccagcaccatcaagaagttctatgaggccggctgcaagtacaaggaggagcagctgaccaccggctgtgagaagtggctggagatgaacctggtgcccctgggcggcacccagatccacctgcacaagatcccccaggacctgctgcacaaggtgctgaagagccccaggctcttcaccttcagcgagttccacctgctgaagaccatgctgctgtgggtgttcctgcagctgaactacaagatccaggccatccccacctatgagaccgtgatgaccttcttcaagagcttccctgagaactgctgcttcctggaccgggacatcggccgcagcctgcggcccctcttcctgtgcctgcggctgcacggcatcaccaagggcaaggacctggaggtgctgcggcacctgaacttcttccctgagagctggctggaccaggtgacagtgaaccactaccacgccctggagaatggaggagacatggtgcacctgaaggacctgaacacccaggccgtgcgcttcggcctgctcttcaaccaggagaacaccacctacagcaagaccatcgccctgtatggcttcttcttcaagatcaagggcctgaagcatgacaccaccagctacagcttctacatgcagaggatcaagcacacagacctggagagccccagcgctgtgtatgagcacaaccacgtgtccctgcgggccgcccggctggtgaagtatgagatccgggcagaggccctggtggatggcaagtggcaggagttccgcaccaaccagatcaagcagaagtttggcctgaccaccagcagctgcaagagccacaccctgaagatccagacagtgggcatccccatctacgtgtcctttgccttcatcttccctgccagctag

SEQ ID NO: 35824 - DNA, 2139 bp, Artificial Sequence
  Description of Artificial Sequence: Synthetic coding sequence
atgtgcagccctgccagccccaagatcctgtacagaaacccccgcttcctgcggctggccttcctgcagctgcaccaccagcagcagagtgatgtgttctgtgatgtgctgctgcaggccgagggggaggccgtgcctgcccactgctgcatcctgagcgcctgcagccccttcttcacagagcggctggagcgggagaggcctgcccagggcggcaaggtggtgctggagctgggcggcctgaagatcagcaccctgaggaagctggtggacttcctgtacaccagcgagatggaggtgtcccaggaggaggcccaggatgtgctgtctgctgcccggcagctgcgggtgtctgagctggagagcctgcagctggagggcggcaagctggtgaaggccccccagggccgccgcctgaaccgggagtgcctgcagcccaccagcgctgcccccatcagcgcccgggtggtgacccccagccaccacccccacacccccctgcccaccaaccagaccccctgccccctgggcgccatccggctgaagagcctgggcaaggaggagggcccccaggagaacaaccggcagaatgctgacaacctgagcggcaccctgctgctgaagaggaaggcccgggcctgccccaccccccaggagaagaacagcagccccagcagccacagccaggagccccgggagaacaagaatgacacagccctggaccccaccgtgctgagcccccccagcctgtaccccagcgtggacaagcacctgctgcccaggaagatccggctgagccgcagcaagcccagccctggcatctgcaccagcaagcccagcagcatcctgagcggcagcagctctgtgcctgccaccccaggaagaaggctgtggaggcagaggtctgtgaacaaggagaccccagaggacaagcccaagccaggccgggccagccccctgcagagcacccccaaccccagcggcctgggcaagacaggaggcagcaggaagaggagccctgaggtgcgggcccccaacagcgacagcgctgaggagggccaggtgggccgggtgaagctgaggaagatcgtgaatggcacctgctgggaggtggtgcaggagacccccctgaagaacacccaggacagcccccagatcccagaccctggaggagacttccaggagcccagcggcacccagcccttcagcagcaatgagcaggagatgagccccaccaggacagagctgtgccaggacagccccatgtgcaccaagctgcaggacatcctggtgtctgccagccacagcccagaccaccctgtggtgaagtcagaatttgagagcagccctgagctggtggagaaggagcccatgctggccatcgactgccgggagccctatgcctttgacacagccctgctggagcagccctgtgaggccgaggagtaccgcatcaccagcgctgctgccaccagcgagctggaggagatcctggacttcatgctgtgtggcagtgacatcgagccccccatcggcagcctggagagccctggagctgagggctgcaggacccccacctaccacctgacagagaccgggaagaactggattgaaggagaggagtggtgcctgcctgacatggagctgtggccccgggagctgacagagctggagaaggagcctgctggggagaacagaggccccacagagctgctgagccccctggtgatgcccagcgaggtgtctgaggtgctgtctgtgggcggccgctggaccccagacctggagatcaccagcagccagcccctggatggccaggaggacaagctgctgcacgtgagcagcctggacaccccccagaggagctatggagacctgagccccccctgcagcaactgggtggagaccggcctggaggtgtccctgaccacagatgagctgctgtaccccagccccaaggccggcaaggaggtgtctggccacagcgagctgctgggcagcctgcctgccagcagcgaggaggaggagattgatgtggtggactggacagctgagggccgcctggtgcccaccaccgtgcccagcgtgtggccagaccccagcagcgagagcgagacagaggtggacatcctgacctag

SEQ ID NO: 35825 - DNA, 2139 bp, Artificial Sequence; identical to SEQ ID NO: 35824
  Description of Artificial Sequence: Synthetic coding sequence

SEQ ID NO: 35826 - DNA, 270 bp, Artificial Sequence
  Description of Artificial Sequence: Synthetic coding sequence
atgtgcagccctgccagccccaagatcctgtacagaaacccccgcttcctgcggctggccttcctgcagctgcaccaccagcagcagagtgatgtgttctgtgatgtgctgctgcaggccgagggggaggccgtgcctgcccactgctgcatcctgagcgcctgcagccccttcttcacagagcggctggagcgggagaggcctgcccagggcggcaaggtggtgctggagctgggcggcctgaagatcagcaccctgaggaagctgtag

SEQ ID NO: 35827 - DNA, 876 bp, Artificial Sequence
  Description of Artificial Sequence: Synthetic coding sequence
atggagcccctgggcctggtggtgcacggcaaggccgagcccttctctgctgccctgcggagcctggtgaacaacccccgctacagtgatgtgtgctttgtggtgggccaggagcggcaggaggtgtttgcccaccgctgcctgctggcctgccgctgcaacttcttccagaggctgctgggcacagagcccggccctggggtgcccagccctgtggtgctgagcacagtgcccacagaggccttcctggccgtgctggagttcctgtacaccaacagcgtgaagctgtaccgccacagcgtgctggaggtgctgacagctgctgtggagtatggcctggaggagctgcgggagctgtgcctgcagtttgtggtgaaggtgctggatgtggacctggtgtgtgaggccctgcaggtggccgtgaccttcggcctgggccagctgcaggagcgctgtgtggccttcatcgaggcccacagccaggaggccctgcggacccggggcttcctggagctgtctgctgctgccctgctgcccctgctgcggagtgacaagctgtgtgtggatgaagctgagctggtgcgggccgcccgctcctgggcccgggtgggcgctgctgtgctggagaggcctgtggccgaggtggccgcccctgtggtgaaggagctgcggctggccctgctggccccagctgagctgagcgccctggaggagcagaaccggcaggagcccctcatccctgtggagcagatcgtggaggcctggaagtgccacgccctgcggagaggagatgaggcccggggggccccctgcagaagaagaagaggcaccctgccccgggagcaccaccgcttcctggacctgtccttcaagtag

SEQ ID NO: 35828 - DNA, 489 bp, Artificial Sequence
  Description of Artificial Sequence: Synthetic coding sequence
atggagcccctgggcctggtggtgcacggcaaggccgagcccttctctgctgccctgcggagcctggtgaacaacccccgctacagtgatgtgtgctttgtggtgggccaggagcggcaggaggtgtttgcccaccgctgcctgctggcctgccgctgcaacttcttccagaggctgctgggcacagagcccggccctggggtgcccagccctgtggtgctgagcacagtgcccacagaggccttcctggccgtgctggagttcctgtacaccaacagcgtgaagctgtaccgccacagcgtgctggaggtgctgacagctgctgtggagtatggcctggaggagctgcgggagctgtgcctgcagtttgtggtgaaggtgctggatgtggacctggtgtgtgaggccctgcagcacttctggaggccccggcgggctgaccaggaggtgagaagaagccggcccagctggctgacccgctggccctag

SEQ ID NO: 35829 - DNA, 1386 bp, Artificial Sequence
  Description of Artificial Sequence: Synthetic coding sequence
atggctgctgacatcttccccaggaagaagccagccaacagcagcagcacctctgtgcagcagtaccaccagcagaacctgagcaacaacaacctgatcccagcccccaactggcagggcctgtaccccaccatccgggagagaaatgccatgatgttcaacaatgacctgatggctgatgtgcactttgtggtgggccccccaggcggcacccagaggctgcccggccacaagtatgtgctggccgtgggcagcagcgtcttccacgccatgttttatggagagctggccgaggacaaggatgagatccgcatcccagatgtggagcctgctgccttcctggccatgctgaagtacatctactgtgatgaaattgacctggccgctgacacagtgctggccaccctgtatgctgccaagaagtacatcgtgccccacctggcccgggcctgtgtgaacttcctggagaccagcctgagcgccaagaatgcctgtgtgctgctgagccagagctgcctgtttgaggagccagacctgacccagcgctgctgggaggtgattgatgcccaggccgagctggccctgaagtctgagggcttctgtgacatcgacttccagaccctggagagcatcctgcggcgggagaccctgaatgccaaggagatcgtggtgtttgaagctgccctgaactgggccgaggtggagtgccagaggcaggacctggccctgagcattgagaacaagaggaaggtgctgggcaaggccctgtacctgatccgcatccccaccatggccctggatgactttgccaatggagctgcccagagcggcgtgctgaccctgaatgagaccaatgacatcttcctgtggtacacagctgccaagaagccagagctgcagtttgtgtccaaggccaggaagggcctggtgccccagcgctgccaccgcttccagagctgtgcctaccgcagcaaccagtggagataccggggccgctgtgacagcatccagtttgctgtggacaagagggtcttcatcgccggcttcggcctgtatggcagcagctgtggcagcgctgagtacagcgccaagattgagctgaagaggcagggcgtggtgctgggccagaacctgagcaagtacttcagtgatggcagcagcaacaccttccctgtgtggtttgagtaccctgtgcagatcgagccagacaccttctacacagccagcgtcatcctggatggaaatgagctgagctacttcggccaggagggcatgacagaggtgcagtgtgggaaggtgacagtgcagttccagtgcagcagtgacagcaccaatggaactggagtgcagggcggccagatccctgagctgatcttctacgcctag

SEQ ID NO: 35830 - DNA, 1569 bp, Artificial Sequence
  Description of Artificial Sequence: Synthetic coding sequence
atggtggatgacaaggagaagaacatgaagtgcctgaccttcttcctgatgctgcctgagaccgtgaagaacagaagcaagaagagcagcaagaaggccaacaccagcagcagcagcagcaacagcagcaagctgccccctgtgtgctatgagatcatcaccctgaagaccaagaagaagaagatggctgctgacatcttccccaggaagaagccagccaacagcagcagcacctctgtgcagcagtaccaccagcagaacctgagcaacaacaacctgatcccagcccccaactggcagggcctgtaccccaccatccgggagagaaatgccatgatgttcaacaatgacctgatggctgatgtgcactttgtggtgggccccccaggcggcacccagaggctgcccggccacaagtatgtgctggccgtgggcagctctgtgttccacgccatgttctacggggagctggccgaggacaaggatgagatccgcatcccagatgtggagcctgctgccttcctggccatgctgaagtacatctactgtgatgaaattgacctggccgctgacacagtgctggccaccctgtatgctgccaagaagtacatcgtgccccacctggcccgggcctgtgtgaacttcctggagaccagcctgagcgccaagaatgcctgtgtgctgctgagccagagctgcctgtttgaggagccagacctgacccagcgctgctgggaggtgattgatgcccaggccgagctggccctgaagtctgagggcttctgtgacatcgacttccagaccctggagagcatcctgcggcgggagaccctgaatgccaaggagatcgtggtgtttgaggccgccctgaactgggccgaggtggagtgccagaggcaggacctggccctgagcattgagaacaagaggaaggtgctgggcaaggccctgtacctgatccgcatccccaccatggccctggatgactttgccaacggggccgcccagagcggcgtgctgaccctgaatgagaccaatgacatcttcctgtggtacacagctgccaagaagccagagctgcagtttgtgtccaaggccaggaagggcctggtgccccagcgctgccaccgcttccagagctgtgcctaccgcagcaaccagtggagataccggggccgctgtgacagcatccagtttgctgtggacaagagggtcttcatcgccggcttcggcctgtatggcagcagctgtggcagcgctgagtacagcgccaagattgagctgaagaggcagggcgtggtgctgggccagaacctgagcaagtacttcagtgatggcagcagcaacaccttccctgtgtggtttgagtaccctgtgcagattgaaccagacaccttctacacagccagcgtcatcctggatggaaatgagctgagctacttcggccaggagggcatgacagaggtgcagtgtgggaaggtgacagtgcagttccagtgcagcagtgacagcaccaacggcaccggggtgcagggcggccagatccctgagctgatcttctacgcctag

SEQ ID NO: 35831 - DNA, 1386 bp, Artificial Sequence; identical to SEQ ID NO: 35829
  Description of Artificial Sequence: Synthetic coding sequence

SEQ ID NO: 35832 - DNA, 1569 bp, Artificial Sequence; identical to SEQ ID NO: 35830
  Description of Artificial Sequence: Synthetic coding sequence

SEQ ID NO: 35833 - DNA, 411 bp, Artificial Sequence
  Description of Artificial Sequence: Synthetic coding sequence
atggctgctgacatcttccccaggaagaagccagccaacagcagcagcacctctgtgcagcagtaccaccagcagaacctgagcaacaacaacctgatcccagcccccaactggcagggcctgtaccccaccatccgggagagaaatgccatgatgttcaacaatgacctgatggctgatgtgcactttgtggtgggccccccaggcggcacccagaggctgcccggccacaagtatgtgctggccgtgggcagcagcgtcttccacgccatgttttatggagagctggccgaggacaaggatgagatccgcatcccagatgtggagcctgctgccttcctggccatgctgaagtacatctactgtgatgaaattgacctggccgctgacacagtgctggccaccctgtag

SEQ ID NO: 35834 - DNA, 9 bp, Artificial Sequence
  Description of Artificial Sequence: Synthetic coding sequence
atggcctag

SEQ ID NO: 35835 - DNA, 1860 bp, Artificial Sequence
  Description of Artificial Sequence: Synthetic coding sequence
atggctgctgccccacccctgagcaaggccgagtacctgaagcgctacctgagcggggctgatgctggggtggaccggggcagcgagagcggcaggaagaggaggaagaagaggcccaagccaggaggagctgggggcaagggcatgagaattgtggatgatgatgtgtcctggacagccatcagcaccaccaagctggagaaggaggaggaggaggatgatggagacctgcctgtggtggccgagtttgtggatgagaggcctgaggaggtgaagcagatggaggccttccgcagcagcgccaagtggaagctgctgggcggccacaatgaagacctgcccagcaacagacacttcagacatgacaccccagacagcagccccaggagagtgagacatggcaccccagaccccagccccaggaaggacagacatgacaccccagaccccagcccccggcgggcccggcatgacaccccagaccccagccccctgcggggggcccggcatgacagcgacaccagccccccccggcgcatcagacatgacagcagtgacaccagccccccaagaagagcccggcatgacagcccagaccccagccccccccggcggccccagcacaacagcagcggggccagcccccggcgggtgagacatgacagcccagaccccagccccccaagaagagcccggcacggcagcagtgacatcagcagcccccggcgggtgcacaacaacagcccagacaccagcaggaggaccctgggcagcagtgacacccagcagctgcggcgggcccggcatgacagcccagacctggccccaaatgtgacctacagcctgcccaggaccaagagcggcaaggcccctgagcgggccagcagcaagaccagcccccactggaaggagagcggggccagccacctgtccttccccaagaacagcaaatatgaatatgaccctgacatcagcccccccaggaagaagcaggccaagagccactttggagacaagaagcagctggacagcaaaggagactgccagaaggccacagacagcgacctgagcagccccaggcacaagcagagccctggccaccaggacagcgacagcgacctgagcccccccaggaaccggcccaggcacaggagcagtgacagcgacctgagccccccccggcggcggcagaggaccaagagcagtgacagcgacctgagccccccccggcgcagccagcccccaggcaagaaggccgcccacatgtacagcggggccaagacaggcctggtgctgacagacatccagcgggagcagcaggagctgaaggagcaggaccaggagaccatggcctttgaggccgagttccagtatgcagagaccgtcttccgggacaagagcggcaggaagaggaacctgaagctggagcggctggagcagaggaggaaggccgagaaggacagcgagagagatgagctgtatgcccagtggggcaagggcctggcccagagccggcagcagcagcagaatgtggaggatgccatgaaggagatgcagaagcccctggcccgctacattgatgatgaggacctggacaggatgctgcgggagcaggagcgggagggggaccccatggccaacttcatcaagaagaacaaggccaaggagaacaagaacaagaaggtgcggccccgctacagcggccctgcccccccacccaaccgcttcaacatctggccaggctaccgctgggatggagtggacaggagcaatggatttgagcagaagagatttgcccggctggccagcaagaaggctgtggaggagctggcctacaagtggagcgtggaggacatgtag

SEQ ID NO: 35836 - DNA, 1458 bp, Artificial Sequence
  Description of Artificial Sequence: Synthetic coding sequence
atggctgctgccccacccctgagcaaggccgagtacctgaagcgctacctgagcggggctgatgctggggtggaccggggcagcgagagcggcaggaagaggaggaagaagaggcccaagccaggaggagctgggggcaagggcatgagaattgtggatgatgatgtgtcctggacagccatcagcaccaccaagctggagaaggaggaggaggaggatgatggagacctgcctgtggtggccgagtttgtggatgagaggcctgaggaggtgaagcagatggaggccttccgcagcagcgccaagtggaagctgctgggcggccacaatgaagacctgcccagcaacagacacttcagacatgacaccccagacagcagccccaggagagtgagacatggcaccccagaccccagccccaggaaggacagacatgacaccccagaccccagcccccggcgggcccggcatgacaccccagaccccagccccctgcggggggcccggcatgacagcgacaccagccccccccggcgcatcagacatgacagcagtgacaccagccccccaagaagagcccggcatgacagcccagaccccagccccccccggcggccccagcacaacagcagcggggactgccagaaggccacagacagcgacctgagcagccccaggcacaagcagagccctggccaccaggacagcgacagcgacctgagcccccccaggaaccggcccaggcacaggagcagtgacagcgacctgagccccccccggcggcggcagaggaccaagagcagtgacagcgacctgagccccccccggcgcagccagcccccaggcaagaaggccgcccacatgtacagcggggccaagacaggcctggtgctgacagacatccagcgggagcagcaggagctgaaggagcaggaccaggagaccatggcctttgaggccgagttccagtatgcagagaccgtcttccgggacaagagcggcaggaagaggaacctgaagctggagcggctggagcagaggaggaaggccgagaaggacagcgagagagatgagctgtatgcccagtggggcaagggcctggcccagagccggcagcagcagcagaatgtggaggatgccatgaaggagatgcagaagcccctggcccgctacattgatgatgaggacctggacaggatgctgcgggagcaggagcgggagggggaccccatggccaacttcatcaagaagaacaaggccaaggagaacaagaacaagaaggtgcggccccgctacagcggccctgcccccccacccaaccgcttcaacatctggccaggctaccgctgggatggagtggacaggagcaatggatttgagcagaagagatttgcccggctggccagcaagaaggctgtggaggagctggcctacaagtggagcgtggaggacatgtag

SEQ ID NO: 35837 - DNA, 600 bp, Artificial Sequence
  Description of Artificial Sequence: Synthetic coding sequence
gcccctggccgcctggccagcaggcctcctcctcctccagcccggcgctggaggctggccgccccccgctacagcagcgccagcggccccagcggccctgctgcccggctgtgtgccgagacccagggcgaggccccccggggccccagggctgtgggcggcagcggcggggccggggagccccgctggagccggggccctgcccagcgggagcggctgctgggctgcagctgctgcttccccagcttcttcaccggcacctgcagcttccgcacctcctggagcgccttcaccctggagctgaccagcagcatcccagcccccctgcccccacctcctgctgccctgagcctgagccagcagcagggcaagagcaggaggaaggaggccagcacccccctgaccccagctgaggccccagcctacagccgggcccggccccggcggcagggcagccccagcgctggccctgaggcccccctggccacagatgagcccccaccccagaggaggagcggcatccggggcggcagcgccaacatccgcagcctgcagcccagcagcctgcggcccagcgcccaccggggcagcgccctgtag

SEQ ID NO: 35838 - DNA, 1185 bp, Artificial Sequence
  Description of Artificial Sequence: Synthetic coding sequence
atgagccgcatctaccatgatggagccctgaggaacaaggctgtgcagagcgtgcggctgcccggggcctgggaccctgctgcccaccagggcggcaatggagtgctgctggagggggagctgattgatgtgagccgccacagcatcctggacacccacggcaggaaggagcgctactacgtgctgtacatccggcccagccacatccacaggaggaagtttgatgccaagggaaatgaaattgagcccaacttcagcgccaccaggaaggtgaacacaggcttcctgatgagcagctacaaggtggaggccaagggggacacagaccggctgaccccagaggccctgaagggcctggtgaacaagccagagctgctggccctgacagagagcctgaccccagaccacacagtggccttctggatgcctgagagcgagatggaggtgatggagctggagctgggcgctggggtgcggctgaagaccagaggagatggccccttcctggacagcctggccaagctggaggccggcaccgtgaccaagtgcaacttcaccggagatggcaagacaggagcctcctggacagacaacatcatggcccagaagtgcagcaaaggagctgctgctgagatccgggagcagggagatggagcagaagatgaggagtggccagaggagatccagcagcagatcgtgcgggagaccttccacctggtgctgaagagagatgacaacatctgcaacttcctggagggcggcagcctgattggaggcagtgactacaagctgatctaccgccactacgccaccctgtactttgtgttctgtgtggacagcagcgagagcgagctgggcatcctggacctgatccaggtgtttgtggagaccctggacaagtgctttgaaaatgtgtgtgagctggacctgatcttccacatggacaaggtgcactacatcctgcaggaggtggtgatgggcggcatggtgctggagaccaacatgaatgagatcgtggcccagatcgaggcccagaaccggctggagaagtctgagggcggcctgtctgctgccccagcccgggctgtgtctgctgtgaagaacatcaacctgcctgagatccccaggaacatcaacatcggggacctgaacatcaaggtgcccaacctgagccagtttgtgtag

SEQ ID NO: 35839 - DNA, 1176 bp, Artificial Sequence
  Description of Artificial Sequence: Synthetic coding sequence
atggccggctccatggtgacccccctgctgtacagaaggaagctgcggcctggagagaggaagatgaggcctgaggtgggccgggagcctgctgccctgcagccccggcagaggcccaggagtgaccaccagctgcacaggagccccttcaccgtgccccccaggaccccagcctgccgcagccctggccccagcccccccatcgctgtggccctggaggtgaagccccagctggaggatgctgtgggcaagctggccgctgaggccgtggccgtgcgggtcttccccctggccgtggatgacctggagagtgatgtgctggtgggccggccccgggtggaggcccaggatggagagatcctggtggtgggcgccggcctgcaggaggtgctgggccgcggggccctggtggatgaggtgggcgtggaggatgtggagctggtgtccctgcatgacctgggccgctgggtggtgaaggtggtggtgcggctggtggtgctggtgcccctggaggcccgggtgcatgctgtggaggaggcccggctggcctggcctgtgctggtgggcccccaggtgggcctggccggggagtggcacctgcacgccgagctgcggctggtgctggcccacgccctgctgggccccccagaggaggatgtgctgggcgccctggccggcgtgtcccgggacctggagctgctggcccgggagctgcaggccctgcaggtgctgatccgcttccagcacgtgcgggtgcagtggcagctggtgcggcgggagcagcccagggctgtgcctgctggggtggtggtggtgcaggccctgctggaccaggtgctgctgcacgagcaccggctggccctggccctggccctgactgtgcctgtggccgtggccctgtgccggggccgggctgtgcacctgggcctgcggggagctgccctgcggggcggccctggccggggcggccggcgggtgctgcggctgcaggccgctgctgggggcctgggcctgctgctggaggatggagagcagaggctggccctgcacgccctgctgctgctgcagtttgtgcagctgctgccccagcacgtgctggtggccctgacccagcccagcgcccaccgggcccgggccatgtgggcccggagctgctgccggcggctgagccagtag

SEQ ID NO: 35840 - DNA, 1062 bp, Artificial Sequence
  Description of Artificial Sequence: Synthetic coding sequence
atgtggctgctggagaaggccggctacaaggtgggcgctgctgagcctgctgcccgctgggcccccagcggcctcttcagcaagagaagagcccctggcccccccaccagcgcctgccccaacgtgctgaccccagaccgcatcccccagttcttcatccccccccggctgcctgaccccggcggcgctgtgcctgctgcccggcggcacgtggccggccggggcctgcctgccacctgcagcctgccccacctggccggccgggagggctgggccttcctgcctgagagcccccacacccggcggcgggagagcctcttccacggccccccaccagccccagctgggggcctgcctgctgcccagagccggctgcacgtgtctgccccagacctgcggctgtgccgggccccagacagcgacacagccagcagcccagacagcagccccttcggcagcccccggcccggcctgggcagaagaagagtgtcccggccccacagcctgagccctgagaaggccagcagcgctgacaccagcccccacagccccaggagagctggcccccccaccccacccctcttccacctggacttcctgtgctgccagctgcggcccacccgggagagcgtgctgcggctgggcccccggggcggccagctgcggctgagcacagagtaccaggccggccctggccgcctgcggctgcggctggtgtctgctgagggcctgccccggcccaggagcaggcctggcagcggcggcggcggctgctgcgtggtgctgcggctgcggccccgggtgcggccccgggagcagcagagccgggtggtgaagtgcagcgccaaccccatcttcaatgaagacttcttctttgatggcctgggccccccagacctggccgcccggagcctgcgggccaaggtgctggacagaggagctggcctgcggagagatgtgctgctgggggagtgtgagacccccctcatcgccctgctgccccccctgggcggcggcctgggccctggcagcagcctggcccccacccacctgagcctgtag

SEQ ID NO: 35841 - DNA, 2124 bp, Artificial Sequence
  Description of Artificial Sequence: Synthetic coding sequence
atggaccccggctggggccagagagatgtgggctgggccgccctgctgatcctgtttgctgccagcctgctgactgtgtttgcctggctgctgcagtatgcccggggcctgtggctggcccgggcccggggggaccggggccctggccctgccctggccggggagcctgctggcagcctgcgggagctgggcgtgtggaggagcctgctgcggctgcgggccaccagggctggagctgctgaggagcccggggtgcggggcctgctggccagcctgtttgccttcaagagcttccgggagaactggcagagggcctgggtgcgggccctgaatgagcaggcctgcagaaatggcagcagcatccagatcgcctttgaggaggtgccccagctgcccccccgggccagcatcagccacgtgacctgtgtggaccagagcgagcacaccatggtgctgcgctgccagctgtctgctgaggaggtgcgcttccctgtgtctgtgacccagcagagccctgctgctgtgtccatggagacctaccacgtgaccctgaccctgccccccacccagctggaggtgaacctggaggagatccctggagagggcctgctgatctcctgggccttcacagacagaccagacctgagcctgactgtgctgcccaagctgcaggcccgggagcggggggaggagcaggtggagctgagcaccatcgaggagctgatcaaggatgccatcgtgtccacccagcctgccatgatggtgaacctgcgggcctgcagcgcccctgggggcctggtgcccagcgagaagccacccatgatgccccaggcccagcctgccatcccccggcccaacagactcttcctgcggcagctgcgggccagccacctgggcaatgagctggagggcacagaggagctgtgctgcgtggccgagctggacaaccccatgcagcagaagtggaccaagccagcccgggccggcagcgaggtggagtggacagaggacctggccctggacctgggcccccagagccgggagctgaccctgaaggtgctgcggagcagcagctgtggggacacagagctgctgggccaggccaccctgcctgtgggcagccccagccggcccctgagccggcggcagctgtgccccctgaccccaggccctgggaaggccctgggccctgctgccaccatggctgtggagctgcactatgaggagggcagccccaggaacctgggcacccccaccagcagcaccccccggcccagcatcacccccaccaagaagattgagctggacaggaccatcatgccagatggcaccatcgtgaccaccgtgaccaccgtgcagagccggcccagaattgatggcaagctggacagccccagccgcagccccagcaaggtggaggtgacagagaagaccaccaccgtgctgtctgagagcagcggccccagcaacaccagccacagcagcagccctggggacagccacctgagcaatggcctggaccctgtggccgagacagccatccggcagctgacagagcccagcggccgggtggccaagaagacccccaccaagaggagcaccctcatcatcagcggcgtgtccaaggtgcccatcgcccaggatgagctggccctgagcctgggctatgctgccagcctggaggcctctgtgcaggatgatgctggcaccagcggcggccccagcagccccccaagtgaccccccagccatgagccctggccccctggatgccctgagcagccccacctctgtgcaggaggctgatgagaccaccaggagtgacatcagcgagcggcccagcgtggatgacatcgagagcgagaccggcagcactggagccctggagaccaggagcctgaaggaccacaaggtgtccttcctgcggagcggcaccaagctgatcttcagaagaagaccccggcagaaggaggccggcctgagccagagccatgatgacctgagcaatgccacagccaccccatctgtgaggaagaaggccggcagcttcagcagaagactcatcaagcgcttctccttcaagagcaagcccaaggccaacggcaaccccagcccccagctgtag

SEQ ID NO: 35842 - DNA, 840 bp, Artificial Sequence
  Description of Artificial Sequence: Synthetic coding sequence
atgatcaaccagctgaccggcaccatccaggtggcccagagaattgacagagatgctggggagctgcggcagaaccccaccatcagcctggaggtgctggtgaaggaccggccctatggaggccaggagaaccgcatccagatcaccttcatcgtggaggatgtgaatgacaacccagccacctgccagaagttcaccttcagcatcatggtgcctgagaggacagccaagggcaccctgctgctggacctgaacaagttctgctttgatgatgattctgaggcccccaacaaccgcttcaacttcaccatgcccagcggcgtgggcagcggcagccgcttcctgcaggaccctgctggcagcggcaagatcgtgctgattggagacctggactatgagaaccccagcaacctggccgccggcaacaagtacaccgtcatcatccaggtgcaggatgtggccccaccctactacaagagcaagtacaacgtgtatgtgtacatcctgaccagcccagaaaatgagttccccctcatctttgaccggcccagctatgtgtttgatgtgtctgagcggcggcctgcccagggccacctgagcggccctgaggagaagaggctgctgagcatctgcatggtgcgggctgtgtgccaccacttcggcctgcacatcgccagcggcagcccccgggtgcccggccggcccatcggccagagccacccccagaccctgcccctgcaggactgggaggagcagggcacctctgtgcgggagatccccaatgaagactgccgggagcggcggcggggcggcaactacccagatgagcactacctgtag

SEQ ID NO: 35843 - DNA, 957 bp, Artificial Sequence
  Description of Artificial Sequence: Synthetic coding sequence
tacacagtgctggaggagctgagccctggcaccatcgtggccaacatcacagcagaagatcctgatgatgagggcttccccagccacctgctgtacagcatcaccaccgtgtccaagtacttcatgatcaaccagctgaccggcaccatccaggtggcccagagaattgacagagatgctggggagctgcggcagaaccccaccatcagcctggaggtgctggtgaaggaccggccctacggcggccaggagaaccgcatccagatcaccttcatcgtggaggatgtgaatgacaacccagccacctgccagaagttcaccttcagcatcatggtgcctgagaggacagccaagggcaccctgctgctggacctgaacaagttctgctttgatgatgacagcgaggcccccaacaaccgcttcaacttcaccatgcccagcggcgtgggcagcggcagccgcttcctgcaggaccctgctggcagcggcaagatcgtgctgattggagacctggactatgagaaccccagcaacctggccgccggcaacaagtacaccgtcatcatccaggtgcaggatgtggccccaccctactacaagaacaacgtgtatgtgtacatcctgaccagcccagaaaatgagttccccctcatctttgaccggcccagctatgtgtttgatgtgtctgaaagaagacctgcccagggccacctgagcggccctgaggagaagaggctgctgagcatctgcatggtgcgggctgtgtgccaccacttcggcctgcacatcgccagcggcagcccccgggtgcccggccggcccatcggccagagccacccccagaccctgcccctgcaggactgggaggagcagggcaccagtgacaaggagaggagaaatgaagactgccgggagaggagaagaggaggcaactacccagatgagcactacctgtag

SEQ ID NO: 35844 - DNA, 450 bp, Artificial Sequence
  Description of Artificial Sequence: Synthetic coding sequence
atgcaggaggccatcatcctgctggccctgctgggcgccatgtctggaggagaggccctgcacctgatcctgctgcctgccactggaaatgtggccgagaacagccccccaggcacctctgtgcacaagttctctgtgaagctgagcgccagcctgagccctgtgattcctggcttcccccagatcgtgaacagcaaccccctgacagaggccttccgggtgaactggctgagcggcacctactttgaggtggtgaccaccggcatggagcagctggactttgagaccggccccaacatctttgacctgcagatctacgtgaaggatgaggtgggcgtgacagacctgcaggtgctgactgtgcaggtgacagatgtgaatgaaccaccccagttccagggcaacctggccgaggcccggcatgagtgcacccagagctggaggaactag

SEQ ID NO: 35845 - DNA, 2658 bp, Artificial Sequence
  Description of Artificial Sequence: Synthetic coding sequence
atgcaggaggccatcatcctgctggccctgctgggcgccatgtctggaggagaggccctgcacctgatcctgctgcctgccactggaaatgtggccgagaacagccccccaggcacctctgtgcacaagttctctgtgaagctgagcgccagcctgagccctgtgattcctggcttcccccagatcgtgaacagcaaccccctgacagaggccttccgggtgaactggctgagcggcacctactttgaggtggtgaccaccggcatggagcagctggactttgagaccggccccaacatctttgacctgcagatctacgtgaaggatgaggtgggcgtgacagacctgcaggtgctgactgtgcaggtgacagatgtgaatgaaccaccccagttccagggcaacctggccgagggcctgcacctgtacatcgtggagcgggccaaccctggcttcatctaccaggtggaggcctttgatcctgaggacaccagcaggaacatccccctgagctacttcctgatcagcccccccaagagcttcaggatgtctgccaacggcaccctcttcagcaccacagagctggactttgaagctggccaccgctccttccacctgattgtggaggtgcgggacagcggcggcctgaaggccagcacagagctgcaggtgaacatcgtgaacctgaatgatgaggtgccccgcttcaccagccccaccagggtgtacacagtgctggaggagctgagccctggcaccatcgtggccaacatcacagcagaagatcctgatgatgagggcttccccagccacctgctgtacagcatcaccaccgtgtccaagtacttcatgatcaaccagctgaccggcaccatccaggtggcccagagaattgacagagatgctggggagctgcggcagaaccccaccatcagcctggaggtgctggtgaaggaccggccctacggcggccaggagaaccgcatccagatcaccttcatcgtggaggatgtgaatgacaacccagccacctgccagaagttcaccttcagcatcatggtgcctgagaggacagccaagggcaccctgctgctggacctgaacaagttctgctttgatgatgacagcgaggcccccaacaaccgcttcaacttcaccatgcccagcggcgtgggcagcggcagccgcttcctgcaggaccctgctggcagcggcaagatcgtgctgattggagacctggactatgagaaccccagcaacctggccgccggcaacaagtacaccgtcatcatccaggtgcaggatgtggccccaccctactacaagaacaacgtgtatgtgtacatcctgaccagcccagaaaatgagttccccctcatctttgaccggcccagctatgtgtttgatgtgtctgaaagaagacctgcccggaccagggtgggccaggtgcgggccacagacaaggacctgccccagagcagcctgctgtacagcatcagcactggaggagccagcctgcagtaccccaacgtgttctggatcaaccccaagacaggagagctgcagctggtgaccaaggtggactgtgagaccacccccatctacatcctgcgcatccaggccaccaacaatgaagacaccagctctgtgacagtgacagtgaacatcctggaggagaatgatgagaagcccatctgcacccccaacagctacttcctggccctgcctgtggacctgaaggtgggcaccaacatccagaacttcaagctgacctgcacagacctggacagcagccccaggagcttccgctacagcatcggccctggaaatgtgaacaaccacttcaccttcagccccaatgccggcagcaatgtgacccggctgctgctgaccagcagatttgattatgccggcggctttgacaagatctgggactacaagctgctggtgtatgtgacagatgacaacctgatgtctgacaggaagaaggccgaggccctggtggagaccggcaccgtgaccctgagcatcaaggtgatcccccaccccaccaccatcatcaccaccaccccccggccccgggtgacctaccaggtgctgaggaagaatgtgtacagccccagcgcctggtacgtgcccttcgtcatcaccctgggcagcatcctgctgctgggcctgctggtgtacctggtggtgctgctggccaaggccatccaccgccactgcccctgcaagacaggcaagaacaaggagcccctgaagaagaagacagagaccaagacagctgagagagatgtggtggtggagaccatccagatgaacaccatctttgatggagaggccatcgaccctgtgactggagagacctatgagttcaacagcaagacaggagccaggaagtggaaggaccccctgacccagatgcccaagtggaaggagagcagccaccagggcgccgccccccggcgggtgacagctggggagggcatgggcagcctgcggagcgccaactgggaggaggatgagctgagcggcaaggcctgggccgaggatgctggcctgggcagcagaaatgaaggaggcaagctgggcaaccccaagaacagaaatcctgccttcatgaacagagcctaccccaagccccaccctgggaagtag

SEQ ID NO: 35846 - DNA, 945 bp, Artificial Sequence
  Description of Artificial Sequence: Synthetic coding sequence
atgtctgctgctgaggccggcggcgtcttccaccgggcccggggccgcaccctggccgccttccctgctgagaaggagagcgagtggaagggccccttctacttcatcctgggcgctgacccccagtttggcctcatcaaggcctggagcactggagactgtgacaatggaggagatgagtgggagcaggagatccggctgacagagcaggccgtgcaggccatcaacaagctgaaccccaagcccaagttctttgtgctgtgtggggacctgattcatgccatgcctgggaagccctggaggacagagcagacagaggacctgaagagggtgctgcgggctgtggaccgggccatccccctggtgctggtgtctggcaaccacgacatcggcaacacccccacagctgagaccgtggaggagttctgcaggacctggggagatgactacttctccttctgggtgggcggcgtgctcttcctggtgctgaacagccagttctatgagaaccccagcaaatgtcccagcctgaagcaggcccaggaccagtggctggatgagcagctgagcatcgcccggcagaggcactgccagcacgccatcgtgttccagcacatccccctcttcctggagagcattgatgaagatgatgactactacttcaacctgagcaagagcaccaggaagaagctggccgacaagttcatccacgccggcgtgaaggtggtgttttctggccactaccacagaaatgctgggggcacctaccagaacctggacatggtggtgtcctctgccatcggctgccagctgggccgggacccccacggcctgcgggtggtggtggtgacagctgagaagatcgtgcaccgctactacagcctggatgagctgtctgagaagggcattgaagatgacctgatggacctgatcaagaagaagtag

SEQ ID NO: 35847 - DNA, 519 bp, Artificial Sequence
  Description of Artificial Sequence: Synthetic coding sequence
atgtctgctgctgaggccggcggcgtcttccaccgggcccggggccgcaccctggccgccttccctgctgagaaggagagcgagtggaagggccccttctacttcatcctgggcgctgacccccagtttggcctcatcaaggcctggagcactggagactgtgacaatggaggagatgagtgggagcaggagatccggctgacagagcaggccgtgcaggccatcaacaagctgaaccccaagcccaagttctttgtgctgtgtggggacctgattcatgccatgcctggggtgaaggtggtgttttctggccactaccacagaaatgctgggggcacctaccagaacctggacatggtggtgtcctctgccatcggctgccagctgggccgggacccccacggcctgcgggtggtggtggtgacagctgagaagatcgtgcaccgctactacagcctggatgagctgtctgagaagggcattgaagatgacctgatggacctgatcaagaagaagtag

SEQ ID NO: 35848 - DNA, 426 bp, Artificial Sequence
  Description of Artificial Sequence: Synthetic coding sequence
atgggcttccagaagttcagccccttcctggccctgagcatcctggtgctgctgcaggccggcagcctgcatgctgcccccttccgcagcgccctggagagcagccctgctgaccctgccaccctgtctgaagatgaggcccggctgctgctggccgccctggtgcaggactatgtgcagatgaaggccagcgagctggagcaggagcaggagcgggagggcagcagcctggacagccccaggagcaagagatgtggcaacctgagcacctgcatgctgggcacctacacccaggacttcaacaagttccacaccttcccccagacagccatcggcgtgggcgcccctgggaagaagagggacatgagcagtgacctggagcgggaccaccggccccacgtgtccatgccccagaatgccaactag

SEQ ID NO: 35849 - DNA, 564 bp, Artificial Sequence
  Description of Artificial Sequence: Synthetic coding sequence
atgggcaacaagcagaccatcttcacagaggagcagctggacaactaccaggactgcaccttcttcaacaagaaggacatcctgaagctgcacagccgcttctatgagctggcccccaacctggtgcccatggactacaggaagagccccatcgtgcacgtgcccatgagcctcatcatccagatgcctgagctgcgggagaaccccttcaaggagcgcatcgtggccgccttctctgaagatggagagggcaacctgaccttcaatgactttgtggacatgttttctgtgctgtgtgagagcgccccccgggagctgaaggccaactatgccttcaagatctatgacttcaacacagacaacttcatctgcaaggaggacctggagctgaccctggcccggctgaccaagtctgagctggatgaggaggaggtggtgctggtgtgtgacaaggtgattgaggaggccgacctggatggagatggcaagctgggctttgctgactttgaggacatgattgccaaggccccagacttcctgagcaccttccacatccgcatctag

SEQ ID NO: 35850 - DNA, 564 bp, Artificial Sequence
  Description of Artificial Sequence: Synthetic coding sequence
atgggcaacaagcagaccgtcttcacccatgagcagctggaggcctaccaggactgcaccttcttcaccaggaaggagatcatgaggctcttctaccgctaccaggacctggccccccagctggtgcccctggactacaccacctgcccagatgtgaaggtgccctatgagctgattggctccatgcctgagctgaaggacaaccccttccggcagagaattgcccaggtgttttctgaagatggagatggccacatgaccctggacaacttcctggacatgttttctgtgatgtctgagatggccccccgggacctgaaggcctactatgccttcaagatctatgacttcaacaatgatgactacatctgtgcctgggacctggagcagacagtgaccaagctgacccggggcggcctgtctgctgaggaggtgtccctggtgtgtgagaaggtgctggatgaagcagatggagaccatgatggccgcctgagcctggaggacttccagaacatgatcctgcgggccccagacttcctgagcaccttccacatccgcatctag

SEQ ID NO: 35851 - DNA, 417 bp, Artificial Sequence
  Description of Artificial Sequence: Synthetic coding sequence
atgggcaacaagcagaccgtcttcacccatgagcagctggaggcctaccaggacaaccccttccggcagagaattgcccaggtgttttctgaagatggagatggccacatgaccctggacaacttcctggacatgttttctgtgatgtctgagatggccccccgggacctgaaggcctactatgccttcaagatctatgacttcaacaatgatgactacatctgtgcctgggacctggagcagacagtgaccaagctgacccggggcggcctgtctgctgaggaggtgtccctggtgtgtgagaaggtgctggatgaagcagatggagaccatgatggccgcctgagcctggaggacttccagaacatgatcctgcgggccccagacttcctgagcaccttccacatccgcatctag

SEQ ID NO: 35852 - DNA, 93 bp, Artificial Sequence
  Description of Artificial Sequence: Synthetic coding sequence
atgggcaacaagcagaccgtcttcacccatgagcagctggaggcctaccaggactgcaccttcttcaccaggaaggagatcatgaggttctag

SEQ ID NO: 35853 - DNA, 558 bp, Artificial Sequence
  Description of Artificial Sequence: Synthetic coding sequence
atgggccagtgcctgcgctaccagatgcactgggaggacctggaggagtaccaggccctgaccttcctgaccagaaatgagatcctgtgcatccatgacaccttcctgaagctgtgccccccaggcaagtactacaaggaggccaccctgaccatggaccaggtgagcagcctgcctgccctgcgggtgaaccccttccgggaccgcatctgcagggtcttcagccacaagggcatgttctcctttgaagatgtgctgggcatggccagcgtcttcagcgagcaggcctgccccagcctgaagattgaatatgccttccgcatctatgacttcaatgaaaatggcttcattgatgaggaggacctgcagaggatcatcctgcggctgctgaacagtgatgacatgtctgaggacctgctgatggacctgaccaaccacgtgctgtctgagagtgacctggacaatgacaacatgctgtccttcagcgagtttgagcacgccatggccaagagcccagacttcatgaacagcttccgcatccacttctggggctgctag

SEQ ID NO: 35854 - DNA, 450 bp, Artificial Sequence
  Description of Artificial Sequence: Synthetic coding sequence
atggctgctgagcacctgctgcccggccccccacccagcctggccgacttccggctggaggccggcggcaagggcacagagcggggcagcggcagcagcaagcccaccggcagcagccggggccccaggatggccaagttcctgagccaggaccagatcaatgatggaaatggagagctggacttcagcaccttcctgaccatcatgcacatgcagatcaagcaggaggaccccaagaaggagatcctgctggccatgctgatggtggacaaggagaagaagggctacgtgatggccagtgacctgcggagcaagctgaccagcctgggggagaagctgacccacaaggaggtggatgacctcttccgggaggccgacatcgagcccaacgggaaggtgaagtatgatgagttcatccacaagatcaccctgcccggccgggactactag

SEQ ID NO: 35855 - DNA, 591 bp, Artificial Sequence
  Description of Artificial Sequence: Synthetic coding sequence
atggctgctgagcacctgctgcccggccccccacccagcctggccgacttccggctggaggccggcggcaagggcacagagcggggcagcggcagcagcaagcccaccggcagcagccggggccccaggatggccaagttcctgagccaggaccagatcaatgagtacaaggagtgcttcagcctgtatgacaagcagcagaggggcaagatcaaggccacagacctgatggtggccatgcgctgcctgggcgccagccccaccccaggagaggtgcagaggcacctgcagacccatggaattgatggaaatggagagctggacttcagcaccttcctgaccatcatgcacatgcagatcaagcaggaggaccccaagaaggagatcctgctggccatgctgatggtggacaaggagaagaagggctacgtgatggccagtgacctgcggagcaagctgaccagcctgggggagaagctgacccacaaggaggtggatgacctcttccgggaggccgacatcgagcccaacgggaaggtgaagtatgatgagttcatccacaagatcaccctgcccggccgggactactag

SEQ ID NO: 35856 - DNA, 363 bp, Artificial Sequence
  Description of Artificial Sequence: Synthetic coding sequence
atggtggccatgcgctgcctgggcgccagccccaccccaggagaggtgcagaggcacctgcagacccatggaattgatggaaatggagagctggacttcagcaccttcctgaccatcatgcacatgcagatcaagcaggaggaccccaagaaggagatcctgctggccatgctgatggtggacaaggagaagaagggctacgtgatggccagtgacctgcggagcaagctgaccagcctgggggagaagctgacccacaaggaggtggatgacctcttccgggaggccgacatcgagcccaacgggaaggtgaagtatgatgagttcatccacaagatcaccctgcccggccgggactactag

SEQ ID NO: 35857 - DNA, 441 bp, Artificial Sequence
  Description of Artificial Sequence: Synthetic coding sequence
atggccggggagctgaccccagaggaggaggcccagtacaagaaggccttctctgctgtggacacagatggaaatggcaccatcaatgcccaggagctgggcgccgccctgaaggccaccgggaagaacctgtctgaggcccagctgaggaagctgatcagcgaggtggacagtgatggagatggagagatctccttccaggagttcctgacagctgccaagaaggcccgggccggcctggaggacctgcaggtggccttccgggcctttgaccaggatggagatggccacatcaccgtggatgagctgcggcgggccatggccggcctgggccagcccctgccccaggaggagctggatgccatgatccgggaggctgatgtggaccaggacggccgggtgaactatgaggagtttgccaggatgctggcccaggagtag

SEQ ID NO: 35858 - DNA, 2010 bp, Artificial Sequence
  Description of Artificial Sequence: Synthetic coding sequence
atggcctactaccaggagcccagcgtggagaccagcatcatcaagttcaaggaccaggacttcaccaccctgcgggaccactgcctgtccatgggccgcaccttcaaggatgagaccttccctgctgctgacagcagcatcggccagaagctgctgcaggagaagaggctgagcaatgtcatctggaagaggccccaggacctgcccggcggccccccccacttcatcctggatgacatcagcagatttgacatccagcagggcggcgctgctgactgctggttcctggccgccctgggcagcctgacccagaacccccagtaccggcagaagatcctgatggtgcagagcttcagccaccagtatgccggcatcttccgcttccgcttctggcagtgtggccagtgggtggaggtggtgattgatgaccggctgcctgtgcagggcgacaagtgcctgtttgtgcggcccaggcaccagaaccaggagttctggccctgcctgctggagaaggcctatgccaagctgctgggcagctacagcgacctgcactacggcttcctggaggatgccctggtggacctgaccggcggcgtcatcaccaacatccacctgcacagcagccctgtggacctggtgaaggctgtgaagacagccaccaaggccggcagcctcatcacctgtgccacccccagcggccccacagacacagcccaggccatggagaatggcctggtgtccctgcacgcctacacagtgactggagctgagcagatccagtaccgccggggctgggaggagatcatcagcctgtggaacccctggggctggggcgaggccgagtggaggggccgctggagcgatggcagccaggagtgggaggagacctgtgaccccaggaagagccagctgcacaagaagagagaagatggagagttctggatgagctgccaggacttccagcagaagttcatcgccatgttcatctgcagcgagatccccatcaccctggaccacggcaacaccctgcacgagggctggagccagatcatgttcaggaagcaggtgatcctgggcaacacagctgggggccccagaaatgatgcccagttcaacttctctgtgcaggagcccatggagggcaccaacgtggtggtgtgtgtgacagtggccgtgacccccagcaacctgaaggccgaggatgccaagttccccctggacttccaggtgatcctggccggcagccagcgcttccgggagaagtttcctcctgtgttcttcagcagcttcaggaacacagtgcagagcagcaacaacaagttcagaagaaacttcaccatgacctaccacctgagccctggcaactacgtggtggtggcccagaccaggaggaagtctgctgagttcctgctgcgcatcttcctgaagatgccagacagcgacagacacctgagcagccacttcaacctgaggatgaagggcagccccagcgagcacggcagccagcagagcatcttcaacagatatgcccagcagaggctggacattgatgccacccagctgcagggcctgctgaaccaggagctgctgactggacctcctggggacatgttcagcctggatgagtgccgcagcctggtggccctgatggagctgaaggtgaatggccgcctggaccaggaggagtttgcccggctgtggaagaggctggtgcactaccagcacgtgttccagaaggtgcagaccagccctggggtgctgctgagcagtgacctgtggaaggccattgaaaatacagacttcctgcggggcatcttcatcagccgggagctgctgcacctggtgaccctgcgctacagcgacagcgtgggccgggtgtccttccccagcctggtgtgcttcctgatgaggctggaggccatggccaagaccttcaggaacctgagcaaggatggcaagggcctgtacctgacagagatggagtggatgagcctggtgatgtacaactag

SEQ ID NO: 35859 - DNA, 2010 bp, Artificial Sequence
  Description of Artificial Sequence: Synthetic coding sequence
atggcctactaccaggagcccagcgtggagaccagcatcatcaagttcaaggaccaggacttcaccaccctgcgggaccactgcctgtccatgggccgcaccttcaaggatgagaccttccctgctgctgacagcagcatcggccagaagctgctgcaggagaagaggctgagcaatgtcatctggaagaggccccaggacctgcccggcggccccccccacttcatcctggatgacatcagcagatttgacatccagcagggcggcgctgctgactgctggttcctggccgccctgggcagcctgacccagaacccccagtaccggcagaagatcctgatggtgcagagcttcagccaccagtatgccggcatcttccgcttccgcttctggcagtgtggccagtgggtggaggtggtgattgatgaccggctgcctgtgcagggcgacaagtgcctgtttgtgcggcccaggcaccagaaccaggagttctggccctgcctgctggagaaggcctatgccaagctgctgggcagctacagcgacctgcactacggcttcctggaggatgccctggtggacctgaccggcggcgtcatcaccaacatccacctgcacagcagccctgtggacctggtgaaggctgtgaagacagccaccaaggccggcagcctcatcacctgtgccacccccagcggccccacagacacagcccaggccatggagaatggcctggtgtccctgcacgcctacacagtgactggagctgagcagatccagtaccgccggggctgggaggagatcatcagcctgtggaacccctggggctggggcgaggccgagtggaggggccgctggagcgatggcagccaggagtgggaggagacctgtgaccccaggaagagccagctgcacaagaagagagaagatggagagttctggatgagctgccaggacttccagcagaagttcatcgccatgttcatctgcagcgagatccccatcaccctggaccacggcaacaccctgcacgagggctggagccagatcatgttcaggaagcaggtgatcctgggcaacacagctgggggccccagaaatgatgcccagttcaacttctctgtgcaggagcccatggagggcaccaacgtggtggtgtgtgtgacagtggccgtgacccccagcaacctgaaggccgaggatgccaagttccccctggacttccaggtgatcctgacctctgtgcagcgcttccgggagaagtttcctcctgtgttcttcagcagcttcaggaacacagtgcagagcagcaacaacaagttcagaagaaacttcaccatgacctaccacctgagccctggcaactacgtggtggtggcccagaccaggaggaagtctgctgagttcctgctgcgcatcttcctgaagatgccagacagcgacagacacctgagcagccacttcaacctgaggatgaagggcagccccagcgagcacggcagccagcagagcatcttcaacagatatgcccagcagaggctggacattgatgccacccagctgcagggcctgctgaaccaggagctgctgactggacctcctggggacatgttcagcctggatgagtgccgcagcctggtggccctgatggagctgaaggtgaatggccgcctggaccaggaggagtttgcccggctgtggaagaggctggtgcactaccagcacgtgttccagaaggtgcagaccagccctggggtgctgctgagcagtgacctgtggaaggccattgaaaatacagacttcctgcggggcatcttcatcagccgggagctgctgcacctggtgaccctgcgctacagcgacagcgtgggccgggtgtccttccccagcctggtgtgcttcctgatgaggctggaggccatggccaagaccttcaggaacctgagcaaggatggcaagggcctgtacctgacagagatggagtggatgagcctggtgatgtacaactag

SEQ ID NO: 35860 - DNA, 2055 bp, Artificial Sequence
  Description of Artificial Sequence: Synthetic coding sequence
atgagcctgtggccacccttccgctgccgctggaagctggccccccgctacagcagaagagccagcccccagcagccccagcaggactttgaggccctgctggccgagtgcctgagaaatggctgcctgtttgaggacaccagcttccctgccaccctgagcagcatcggcagcggcagcctgctgcagaagctgcccccccggctgcagtggaagaggcctcctgagctgcacagcaacccccagttctactttgccaaggccaagaggctggacctgtgccagggcatcgtgggggactgctggttcctggccgccctgcaggccctggccctgcaccaggacatcctgagccgggtggtgcccctgaaccagagcttcacagagaagtatgccggcatcttccgcttctggttctggcactacggcaactgggtgcctgtggtgattgatgaccggctgcctgtgaatgaagctggccagctggtgtttgtgagcagcacctacaagaacctcttctggggcgccctgctggagaaggcctatgccaagctgagcggcagctatgaggacctgcagagcggccaggtgtctgaggccctggtggacttcaccggaggagtgaccatgaccatcaacctggccgaggcccacggcaacctgtgggacatcctgattgaggccacctacaacagaaccctgattggctgccagacccacagcggggagaagatcctggagaatggcctggtggagggccacgcctacaccctgaccggcatcaggaaggtgacctgcaagcacaggcctgagtacctggtgaagctgaggaacccctggggcaaggtggagtggaagggggactggagcgacagcagcagcaagtgggagctgctgagccccaaggagaagatcctgctgctgaggaaggacaatgatggagagttctggatgaccctgcaggacttcaagacccactttgtgctgctggtgatctgcaagctgaccccaggcctgctgagccaggaggccgcccagaagtggacctacaccatgagggagggccgctgggagaagaggagcacagctgggggccagaggcagctgctgcaggacaccttctggaagaacccccagttcctgctgtctgtgtggaggcctgaggagggcagaagaagcctgcggccctgcagcgtgctggtgtccctgctgcagaagcccaggcaccgctgcaggaagaggaagcccctgctggccatcggcttctacctgtacaggatgaacaagtaccatgatgaccagaggcggctgcccccagagttcttccagaggaacacccccctgagccagcctgaccgcttcctgaaggagaaggaggtgtcccaggagctgtgcctggagcccggcacctacctgattgtgccctgcatcctggaggcccaccagaagtcagaatttgtgctgcgggtcttcagcaggaagcacatcttctatgagatcggcagcaacagcggcgtggtgttcagcaaggagattgaggaccagaatgaaaggcaggatgagttcttcaccaagttctttgagaagcaccctgagatcaatgctgtgcagctgcagaacctgctgaaccagatgacctggagcagcctgggcagccggcagcccttcttcagcctggaggcctgccagggcatcctggccctgctggacctgaatgccagcggcaccatgagcatccaggagttccgggacctgtggaagcagctgaagctgagccagaaggtgttccacaagcaggaccggggcagcggctacctgaactgggagcagctgcatgctgccatgagggaggccggcatcatgctgagtgatgatgtgtgccagctgatgctgatccgctatggaggcccccggctgcagatggactttgtgtccttcatccacctgatgctgcgggtggagaacatggaggatgtgttccagaacctgacccaggacggcaagggcatctacctgcagaagccagagtggatgatgatggccctgtacagctag

SEQ ID NO: 35861 - DNA, 2055 bp, Artificial Sequence
  Description of Artificial Sequence: Synthetic coding sequence
atgagcctgtggccacccttccgctgccgctggaagctggccccccgctacagcagaagagccagcccccagcagccccagcaggactttgaggccctgctggccgagtgcctgagaaatggctgcctgtttgaggacaccagcttccctgccaccctgagcagcatcggcagcggcagcctgctgcagaagctgcccccccggctgcagtggaagaggcctcctgagctgcacagcaacccccagttctactttgccaaggccaagaggctggacctgtgccagggcatcgtgggggactgctggttcctggccgccctgcaggccctggccctgcaccaggacatcctgagccgggtggtgcccctgaaccagagcttcacagagaagtatgccggcatcttccgcttctggttctggcactacggcaactgggtgcctgtggtgattgatgaccggctgcctgtgaatgaagctggccagctggtgtttgtgagcagcacctacaagaacctcttctggggcgccctgctggagaaggcctatgccaagctgagcggcagctatgaggacctgcagagcggccaggtgtctgaggccctggtggacttcaccggaggagtgaccatgaccatcaacctggccgaggcccacggcaacctgtgggacatcctgattgaggccacctacaacagaaccctgattggctgccagacccacagcggggagaagatcctggagaatggcctggtggagggccacgcctacaccctgaccggcatcaggaaggtgacctgcaagcacaggcctgagtacctggtgaagctgaggaacccctggggcaaggtggagtggaagggggactggagcgacagcagcagcaagtgggagctgctgagccccaaggagaagatcctgctgctgaggaaggacaatgatggagagttctggatgaccctgcaggacttcaagacccactttgtgctgctggtgatctgcaagctgaccccaggcctgctgagccaggaggccgcccagaagtggacctacaccatgagggagggccgctgggagaagaggagcacagctgggggccagaggcagctgctgcaggacaccttctggaagaacccccagttcctgctgtctgtgtggaggcctgaggagggcagaagaagcctgcggccctgcagcgtgctggtgtccctgctgcagaagcccaggcaccgctgcaggaagaggaagcccctgctggccatcggcttctacctgtacagagtggccaagtaccatgatgaccagaggcggctgcccccagagttcttccagaggaacacccccctgagccagcctgaccgcttcctgaaggagaaggaggtgtcccaggagctgtgcctggagcccggcacctacctgattgtgccctgcatcctggaggcccaccagaagtcagaatttgtgctgcgggtcttcagcaggaagcacatcttctatgagatcggcagcaacagcggcgtggtgttcagcaaggagattgaggaccagaatgaaaggcaggatgagttcttcaccaagttctttgagaagcaccctgagatcaatgctgtgcagctgcagaacctgctgaaccagatgacctggagcagcctgggcagccggcagcccttcttcagcctggaggcctgccagggcatcctggccctgctggacctgaatgccagcggcaccatgagcatccaggagttccgggacctgtggaagcagctgaagctgagccagaaggtgttccacaagcaggaccggggcagcggctacctgaactgggagcagctgcatgctgccatgagggaggccggcatcatgctgagtgatgatgtgtgccagctgatgctgatccgctatggaggcccccggctgcagatggactttgtgtccttcatccacctgatgctgcgggtggagaacatggaggatgtgttccagaacctgacccaggacggcaagggcatctacctgcagaagccagagtggatgatgatggccctgtacagctag

SEQ ID NO: 35862 - DNA, 2046 bp, Artificial Sequence
  Description of Artificial Sequence: Synthetic coding sequence
atggccgcccaggccgccggcgtgtcccggcagagagctgccacccagggcctgggcagcaaccagaatgccctgaagtacctgggccaggacttcaagaccctgcggcagcagtgcctggacagcggcgtgctcttcaaggaccctgagttccctgcctgccccagcgccctgggctacaaggacctgggccctggcagcccccagacccagggcatcatctggaagaggcccacagagctgtgccccagcccccagttcatcgtgggcggggccaccaggacagacatctgccagggcggcctgggggactgctggctgctggccgccatcgccagcctgaccctgaatgaggagctgctgtacagagtggtgccccgggaccaggacttccaggagaactatgccggcatcttccacttccagttctggcagtacggggagtgggtggaggtggtgattgatgaccggctgcccaccaagaatggccagctgctcttcctgcacagcgagcagggcaatgagttctggagcgccctgctggagaaggcctatgccaagctgaatggctgctatgaggccctggccggcggcagcacagtggagggctttgaggacttcaccggcggcatcagcgagttctatgacctgaagaagcccccagccaacctgtaccagatcatcaggaaggccctgtgtgccggcagcctgctgggctgcagcattgatgtgagcagcgctgctgaggccgaggccatcaccagccagaagctggtgaagagccacgcctacagcgtgactggagtggaggaggtgaacttccagggccaccctgagaagctgatccggctgaggaacccctggggcgaggtggagtggagcggggcctggagcgatgatgccagccctgtgatcagccccagcgctgagggctgccgggtgaagcacaccaccatgaggtccatgagccagatgagcctgagtgactttgtgcggcagttcagccggctggagatctgcaacctgagcccagacagcctgagcagcgaggaggtgcacaagtggaacctggtgctcttcaacggccactggacccggggcagcacagctgggggctgccagaactacccagccacctactggaccaacccccagttcaagatccggctggatgaggtggatgaggaccaggaggagagcattggagagccctgctgcaccgtgctgctgggcctgatgcagaagaacagacgctggaggaagagaattggccagggcatgctgagcatcggctatgctgtgtaccaggtgctgctgtgctggtacaccctggatgtgctgggcctgaacatcctggccagccactgcagcaccagcttcctgctgctggaggaggccagcctgctgctgtacatccccctgcctgtggccctgctgcgcttccgggacagcttcctgtggctgaacacccggcggctgcggcgcatctgcccccaggcctgccatgatgccctgcccttctggcagaggcccagctctgtgccccacccctggatggtgtccctggaggtgttctaccggggcggcagcttcccccacctgcagatgatccgcttccccctgcccttcagcaggacagacatcaagtttgatggcttcaacatcaacacctgccgggagatgatcagcctgctggacagcaatggcaccggcaccctgggcgctgtggagttcaagaccctgtggctgaagatccagaagtacctggagatctactgggagacagactacaaccacagcggcaccattgatgcccacgagatgaggacagccctgaggaaggccggcttcaccctgaacagccaggtgcagcagaccatcgccctgcgctatgcctgcagcaagctgggcatcaactttgacagctttgtggcctgcatgatccggctggagaccctcttcaagctgttcagcctgctggatgaggacaaggatggcatggtgcagctgagcctggccgagtggctgtgctgcgtgctggtgtag

SEQ ID NO: 35863 - DNA, 1146 bp, Artificial Sequence
  Description of Artificial Sequence: Synthetic coding sequence
atggccgcccaggccgccggcgtgtcccggcagagagctgccacccagggcctgggcagcaaccagaatgccctgaagtacctgggccaggacttcaagaccctgcggcagcagtgcctggacagcggcgtgctcttcaaggaccctgagttccctgcctgccccagcgccctgggctacaaggacctgggccctggcagcccccagacccagggcatcatctggaagaggcccacagagctgtgccccagcccccagttcatcgtgggcggggccaccaggacagacatctgccagggcggcctgggggactgctggctgctggccgccatcgccagcctgaccctgaatgaggagctgctgtacagagtggtgccccgggaccaggacttccaggagaactatgccggcatcttccacttccagttctggcagtacggggagtgggtggaggtggtgattgatgaccggctgcccaccaagaatggccagctgctcttcctgcacagcgagcagggcaatgagttctggagcgccctgctggagaaggcctatgccaagctgaatggctgctatgaggccctggccggcggcagcacagtggagggctttgaggacttcaccggcggcatcagcgagttctatgacctgaagaagcccccagccaacctgtaccagatcatcaggaaggccctgtgtgccggcagcctgctgggctgcagcattgatgtgagcagcgctgctgaggccgaggccatcaccagccagaagctggtgaagagccacgcctacagcgtgactggagtggaggaggtgaacttccagggccaccctgagaagctgatccggctgaggaacccctggggcgaggtggagtggagcggggcctggagcgatgatgcccctgagtggaaccacatcgaccccaggaggaaggaggagctggacaagaaggtggaggatggagagttctggatgagcctgagtgactttgtgcggcagttcagccggctggagatctgcaacctgagcccagacagcctgagcagcgaggaggtgcacaagtggaacctggtgctcttcaacggccactggacccggggcagcacagctgggggctgccagaactacccaggcagcagctag

SEQ ID NO: 35864 - DNA, 1314 bp, Artificial Sequence
  Description of Artificial Sequence: Synthetic coding sequence
atggccgcccaggccgccggcgtgtcccggcagagagctgccacccagggcctgggcagcaaccagaatgccctgaagtacctgggccaggacttcaagaccctgcggcagcagtgcctggacagcggcgtgctcttcaaggaccctgagttccctgcctgccccagcgccctgggctacaaggacctgggccctggcagcccccagacccagggcatcatctggaagaggcccacagagctgtgccccagcccccagttcatcgtgggcggggccaccaggacagacatctgccagggcggcctgggggactgctggctgctggccgccatcgccagcctgaccctgaatgaggagctgctgtacagagtggtgccccgggaccaggacttccaggagaactatgccggcatcttccacttccagttctggcagtacggggagtgggtggaggtggtgattgatgaccggctgcccaccaagaatggccagctgctcttcctgcacagcgagcagggcaatgagttctggagcgccctgctggagaaggcctatgccaagctgaatggctgctatgaggccctggccggcggcagcacagtggagggctttgaggacttcaccggcggcatcagcgagttctatgacctgaagaagcccccagccaacctgtaccagatcatcaggaaggccctgtgtgccggcagcctgctgggctgcagcattgatgtgagcagcgctgctgaggccgaggccatcaccagccagaagctggtgaagagccacgcctacagcgtgactggagtggaggaggtgaacttccagggccaccctgagaagctgatccggctgaggaacccctggggcgaggtggagtggagcggggcctggagcgatgatgcccctgagtggaaccacatcgaccccaggaggaaggaggagctggacaagaaggtggaggatggagagttctggatgagcctgagtgactttgtgcggcagttcagccggctggagatctgcaacctgagcccagacagcctgagcagcgaggaggtgcacaagtggaacctggtgctcttcaacggccactggacccggggcagcacagctgggggctgccagaactacccagccacctactggaccaacccccagttcaagatccggctggatgaggtggatgaggaccaggaggagagcatcggggagccctgctgcaccgtgctgctgggcctgatgcagaagaacagacgctggaggaagagaattggccagggcatgctgagcatcggctatgctgtgtaccagtag

SEQ ID NO: 35865 - DNA, 2151 bp, Artificial Sequence
  Description of Artificial Sequence: Synthetic coding sequence
atgagcggcagcaagaagaagaaggtgaccaaggccgagcggctgaagctgctgcaggaggaggaggagcggcggctgaaggaggaggaggaggcccggctgaagtatgagaaggaggagatggagcggctggagatccagagaattgagaaggagaagtggcaccggctggaggccaaggacctggagaggagaaatgaggagctggaggagctgtacctgctggagcgctgcttccctgaggccgagaagctgaagcaggagaccaagctgctgagccagtggaagcactacatccagtgtgatggcagcccagaccccagcgtggcccaggagatgaacaccttcatcagcctgtggaaggagaagaccaatgagacctttgaggaggtgattgagaagagcaaggtggtgctgaacctgattgagaagctgaagttcatcctgctggagaccccaccctgtgacctgcaggacaagaacatcatccagtaccaggagagcatcctgcagctgcaggagctgctgcacctgaagtttggagtggccacagagatcctgctgaagcaggccagcaccctggccgacctggacagcggcaacatggagaaggtgatcaaggatgaaaatgtgaccctgtatgtgtgggccaacctgaagaagaaccccaggcacaggtctgtgcgcttcagcgagacccagattggatttgagatcccccgcatcctggccaccagtgacattgctgtgcggctgctgcacacccactatgaccacgtgtctgccctgcaccctgtgtccacccccagcaaggagtacaccagcgctgtgacagagctggtgaaggatgatgtgaagaatgtggagaaggccatcagcaaggaggtggaggaggagagcaagcagcaggagcggggcagccacctgatccaggaggaggagatcaaggtggaggaggagcagggcgacatcgaggtgaagatgagcagcgctgaggaggagagcgaggccatcaagtgtgagcgggagatgaaggtgctgtctgagaccgtgtctgctgcccagctgctgctggtggagaacagcagcgagaagccagacttctttgaggacaacgtggtggacctgtgccagttcaccaccctgggcggcgtgtaccacctggacatcctggagctgcccccccagtgcaagcctgtgaagggctggatgattgtggagatcctgaaggagggcctgcagaagtacacctacccacctgagaccacagaggagtttgaaacagaaaatgccttcccccccatcgaggtgaccctggaggtgcatgaaaatgtcatcttctttgaagatcctgtggtggtgcgctgggatgctgagggcaagcactggaggacagatggcatcagcaatgtgtcctacaagcccaaggagcggctggtgaccttcagcctggacacctttggacctgtgaccctcatccaggatgcccacatcaacatgccctaccagagctgggagctgcggcccctggatgtgaacaaggtgctgctgactgtgaccaccgtcttcacagagatccagatccagatcaaggagaacctgtgcatgctgagcagcatcaagctgaaggacaagaagcacatcagcatcctggagggcacctggatgacccccatccccttcatcatcgccctgaaggaggccggcctgaacatcttccccaccaggcacagccacttctacgtgatcatcaacaacaaggtgcccctggtggaggtgaaggcctaccggcagatggccctgctgagcagcgcctttgccttcggctggagcaagtggaacctgctgtgcaacagcaccaaggtggtgttcaaggtgcgggagcacctgacagaggcctgcacagagaaccccaactgggccctgctgatgttcagcggggaccgggcccagaggctgaagatcaaggaggagagcgaggccttcagcgaggccctgaaggaggagacagagttccacagcaccctgtaccacatggtgaaggactttgccagcgaggaggccatggagaaggtgcgcagcagcaactgccagtttgtgaacagcgtgtgccacatgctgctgagcacccggctgctgagctacagctag

SEQ ID NO: 35866 - DNA, 2073 bp, Artificial Sequence
  Description of Artificial Sequence: Synthetic coding sequence
atgaggcagacaggaggaggagccaccacagacagcgccagccctgtgctgaacaacgtcatcaagagccagagctacttcaccgccaagagggtgggcctgggcaacaacagctacctgggcgtgggccggcccagcagccagcagtggctgagcctgcccggccctgggggccagggccccaaggccaagaagagcggcagcaagaagaagaaggtgaccaaggccgagcggctgaagctgctgcaggaggaggaggagcggcggctgaaggaggaggaggaggcccggctgaagtatgagaaggaggagatggagcggctggagatccagagaattgagaaggagaagtggcaccggctggaggccaaggacctggagaggagaaatgaggagctggaggagctgtacctgctggagcgctgcttccctgaggccgagaagctgaagcaggagaccaagctgctgagccagtggaagcactacatccagtgtgatggcagcccagaccccagcgtggcccaggagatgaacaccttcatcagcctgtggaaggagaagaccaatgagacctttgaggaggtgattgagaagagcaaggtggtgctgaacctgattgagaagctgaagttcatcctgctggagaccccaccctgtgacctgcaggacaagaacatcatccagtaccaggagagcatcctgcagctgcaggagctgctgcacctgaagtttggagtggccacagagatcctgctgaagcaggccagcaccctggccgacctggacagcggcaacatggagaaggtgatcaaggatgaaaatgtgaccctgtatgtgtgggccaacctgaagaagaaccccaggcacaggtctgtgcgcttcagcgagacccagattggatttgagatcccccgcatcctggccaccagtgacattgctgtgcggctgctgcacacccactatgaccacgtgtctgccctgcaccctgtgtccacccccagcaaggagtacaccagcgctgtgacagagctggtgaaggatgatgtgaagaatgtggagaaggccatcagcaaggaggtggaggaggagagcaagcagcaggagcggggcagccacctgatccaggaggaggagatcaaggtggaggaggagcagggcgacatcgaggtgaagatgagcagcgctgaggaggagagcgaggccatcaagtgtgagcgggagatgaaggtgctgtctgagaccgtgtctgctgcccagctgctgctggtggagaacagcagcgagaagccagacttctttgaggacaacgtggtggacctgtgccagttcaccaccctgggcggcgtgtaccacctggacatcctggagctgcccccccagtgcaagcctgtgaagggctggatgattgtggagatcctgaaggagggcctgcagaagtacacctacccacctgagaccacagaggagtttgaaacagaaaatgccttcccccccatcgaggtgaccctggaggtgcatgaaaatgtcatcttctttgaagatcctgtggtggtgcgctgggatgctgagggcaagcactggaggacagatggcatcagcaatgtgtcctacaagcccaaggagcggctggtgaccttcagcctggacacctttggacctgtgaccctcatccaggatgcccacatcaacatgccctaccagagctgggagctgcggcccctggatgtgaacaaggtgctgctgactgtgaccaccgtcttcacagagatccagatccagatcaaggagaacctgtgcatgctgagcagcatcaagctgaaggacaagaagcacatcagcatcctggagggcacctggatgacccccatccccttcatcatcgccctgaaggaggccggcctgaacatcttccccaccaggcacagccacttctacgtgatcatcaacaacaaggtgcccctggtggaggtgaaggcctaccggcagatggccctgctgagcagcgcctttgccttcggctggagcaagtggaacctgctgtgcaacagcaccaaggtggtgttcaagtggtag

SEQ ID NO: 35867 - DNA, 1311 bp, Artificial Sequence
  Description of Artificial Sequence: Synthetic coding sequence
atggagcggctggagatccagagaattgagaaggagaagtggcaccggctggaggccaaggacctggagaggagaaatgaggagctggaggagctgtacctgctggagcgctgcttccctgaggccgagaagctgaagcaggagaccaagctgctgagccagtggaagcactacatccagtgtgatggcagcccagaccccagcgtggcccaggagatgaacaccttcatcagcctgtggaaggagtacaccagcgctgtgacagagctggtgaaggatgatgtgaagaatgtggagaaggccatcagcaaggaggtggaggaggagagcaagcagcaggagcggggcagccacctgatccaggaggaggagatcaaggtggaggaggagcagggcgacatcgaggtgaagatgagcagcgctgaggaggagagcgaggccatcaagtgtgagcgggagatgaaggtgctgtctgagaccgtgtctgctgcccagctgctgctggtggagaacagcagcgagaagccagacttctttgaggacaacgtggtggacctgtgccagttcaccaccctgggcggcgtgtaccacctggacatcctggagctgcccccccagtgcaagcctgtgaagggctggatgattgtggagatcctgaaggagggcctgcagaagtacacctacccacctgagaccacagaggagtttgaaacagaaaatgccttcccccccatcgaggtgaccctggaggtgcatgaaaatgtcatcttctttgaagatcctgtggtggtgcgctgggatgctgagggcaagcactggaggacagatggcatcagcaatgtgtcctacaagcccaaggagcggctggtgaccttcagcctggacacctttggacctgtgaccctcatccaggatgcccacatcaacatgccctaccagagctgggagctgcggcccctggatgtgaacaaggtgctgctgactgtgaccaccgtcttcacagagatccagatccagatcaaggagaacctgtgcatgctgagcagcatcaagctgaaggacaagaagcacatcagcatcctggagggcacctggatgacccccatccccttcatcatcgccctgaaggaggccggcctgaacatcttccccaccaggcacagccacttctacgtgatcatcaacaacaaggtgcccctggtggaggtgaaggcctaccggcagatggccctgctgagcagcgcctttgccttcggctggagcaagtggaacctgctgtgcaacagcaccaaggtggtgttcaagtggtag

SEQ ID NO: 35868 - DNA, 2169 bp, Artificial Sequence
  Description of Artificial Sequence: Synthetic coding sequence
atgggccccaaggccaagaagagcggcagcaagaagaagaaggtgaccaaggccgagcggctgaagctgctgcaggaggaggaggagcggcggctgaaggaggaggaggaggcccggctgaagtatgagaaggaggagatggagcggctggagatccagagaattgagaaggagaagtggcaccggctggaggccaaggacctggagaggagaaatgaggagctggaggagctgtacctgctggagcgctgcttccctgaggccgagaagctgaagcaggagaccaagctgctgagccagtggaagcactacatccagtgtgatggcagcccagaccccagcgtggcccaggagatgaacaccttcatcagcctgtggaaggagaagaccaatgagacctttgaggaggtgattgagaagagcaaggtggtgctgaacctgattgagaagctgaagttcatcctgctggagaccccaccctgtgacctgcaggacaagaacatcatccagtaccaggagagcatcctgcagctgcaggagctgctgcacctgaagtttggagtggccacagagatcctgctgaagcaggccagcaccctggccgacctggacagcggcaacatggagaaggtgatcaaggatgaaaatgtgaccctgtatgtgtgggccaacctgaagaagaaccccaggcacaggtctgtgcgcttcagcgagacccagattggatttgagatcccccgcatcctggccaccagtgacattgctgtgcggctgctgcacacccactatgaccacgtgtctgccctgcaccctgtgtccacccccagcaaggagtacaccagcgctgtgacagagctggtgaaggatgatgtgaagaatgtggagaaggccatcagcaaggaggtggaggaggagagcaagcagcaggagcggggcagccacctgatccaggaggaggagatcaaggtggaggaggagcagggcgacatcgaggtgaagatgagcagcgctgaggaggagagcgaggccatcaagtgtgagcgggagatgaaggtgctgtctgagaccgtgtctgctgcccagctgctgctggtggagaacagcagcgagaagccagacttctttgaggacaacgtggtggacctgtgccagttcaccaccctgggcggcgtgtaccacctggacatcctggagctgcccccccagtgcaagcctgtgaagggctggatgattgtggagatcctgaaggagggcctgcagaagtacacctacccacctgagaccacagaggagtttgaaacagaaaatgccttcccccccatcgaggtgaccctggaggtgcatgaaaatgtcatcttctttgaagatcctgtggtggtgcgctgggatgctgagggcaagcactggaggacagatggcatcagcaatgtgtcctacaagcccaaggagcggctggtgaccttcagcctggacacctttggacctgtgaccctcatccaggatgcccacatcaacatgccctaccagagctgggagctgcggcccctggatgtgaacaaggtgctgctgactgtgaccaccgtcttcacagagatccagatccagatcaaggagaacctgtgcatgctgagcagcatcaagctgaaggacaagaagcacatcagcatcctggagggcacctggatgacccccatccccttcatcatcgccctgaaggaggccggcctgaacatcttccccaccaggcacagccacttctacgtgatcatcaacaacaaggtgcccctggtggaggtgaaggcctaccggcagatggccctgctgagcagcgcctttgccttcggctggagcaagtggaacctgctgtgcaacagcaccaaggtggtgttcaaggtgcgggagcacctgacagaggcctgcacagagaaccccaactgggccctgctgatgttcagcggggaccgggcccagaggctgaagatcaaggaggagagcgaggccttcagcgaggccctgaaggaggagacagagttccacagcaccctgtaccacatggtgaaggactttgccagcgaggaggccatggagaaggtgcgcagcagcaactgccagtttgtgaacagcgtgtgccacatgctgctgagcacccggctgctgagctacagctag

SEQ ID NO: 35869 - DNA, 2031 bp, Artificial Sequence
  Description of Artificial Sequence: Synthetic coding sequence
atggagcggctggagatccagagaattgagaaggagaagtggcaccggctggaggccaaggacctggagaggagaaatgaggagctggaggagctgtacctgctggagcgctgcttccctgaggccgagaagctgaagcaggagaccaagctgctgagccagtggaagcactacatccagtgtgatggcagcccagaccccagcgtggcccaggagatgaacaccttcatcagcctgtggaaggagaagaccaatgagacctttgaggaggtgattgagaagagcaaggtggtgctgaacctgattgagaagctgaagttcatcctgctggagaccccaccctgtgacctgcaggacaagaacatcatccagtaccaggagagcatcctgcagctgcaggagctgctgcacctgaagtttggagtggccacagagatcctgctgaagcaggccagcaccctggccgacctggacagcggcaacatggagaaggtgatcaaggatgaaaatgtgaccctgtatgtgtgggccaacctgaagaagaaccccaggcacaggtctgtgcgcttcagcgagacccagattggatttgagatcccccgcatcctggccaccagtgacattgctgtgcggctgctgcacacccactatgaccacgtgtctgccctgcaccctgtgtccacccccagcaaggagtacaccagcgctgtgacagagctggtgaaggatgatgtgaagaatgtggagaaggccatcagcaaggaggtggaggaggagagcaagcagcaggagcggggcagccacctgatccaggaggaggagatcaaggtggaggaggagcagggcgacatcgaggtgaagatgagcagcgctgaggaggagagcgaggccatcaagtgtgagcgggagatgaaggtgctgtctgagaccgtgtctgctgcccagctgctgctggtggagaacagcagcgagaagccagacttctttgaggacaacgtggtggacctgtgccagttcaccaccctgggcggcgtgtaccacctggacatcctggagctgcccccccagtgcaagcctgtgaagggctggatgattgtggagatcctgaaggagggcctgcagaagtacacctacccacctgagaccacagaggagtttgaaacagaaaatgccttcccccccatcgaggtgaccctggaggtgcatgaaaatgtcatcttctttgaagatcctgtggtggtgcgctgggatgctgagggcaagcactggaggacagatggcatcagcaatgtgtcctacaagcccaaggagcggctggtgaccttcagcctggacacctttggacctgtgaccctcatccaggatgcccacatcaacatgccctaccagagctgggagctgcggcccctggatgtgaacaaggtgctgctgactgtgaccaccgtcttcacagagatccagatccagatcaaggagaacctgtgcatgctgagcagcatcaagctgaaggacaagaagcacatcagcatcctggagggcacctggatgacccccatccccttcatcatcgccctgaaggaggccggcctgaacatcttccccaccaggcacagccacttctacgtgatcatcaacaacaaggtgcccctggtggaggtgaaggcctaccggcagatggccctgctgagcagcgcctttgccttcggctggagcaagtggaacctgctgtgcaacagcaccaaggtggtgttcaaggtgcgggagcacctgacagaggcctgcacagagaaccccaactgggccctgctgatgttcagcggggaccgggcccagaggctgaagatcaaggaggagagcgaggccttcagcgaggccctgaaggaggagacagagttccacagcaccctgtaccacatggtgaaggactttgccagcgaggaggccatggagaaggtgcgcagcagcaactgccagtttgtgaacagcgtgtgccacatgctgctgagcacccggctgctgagctacagctag

SEQ ID NO: 35870 - DNA, 1458 bp, Artificial Sequence
  Description of Artificial Sequence: Synthetic coding sequence
atgggccccaaggccaagaagagcggcagcaagaagaagaaggtgaccaaggccgagcggctgaagctgctgcaggaggaggaggagcggcggctgaaggaggaggaggaggcccggctgaagtatgagaaggaggagatggagcggctggagatccagagaattgagaaggagaagtggcaccggctggaggccaaggacctggagaggagaaatgaggagctggaggagctgtacctgctggagcgctgcttccctgaggccgagaagctgaagcaggagaccaagctgctgagccagtggaagcactacatccagtgtgatggcagcccagaccccagcgtggcccaggagatgaacaccttcatcagcctgtggaaggagaagaccaatgagacctttgaggaggtgattgagaagagcaaggtggtgctgaacctgattgagaagctgaagttcatcctgctggagaccccaccctgtgacctgcaggacaagaacatcatccagtaccaggagagcatcctgcagctgcaggagctgctgcacctgaagtttggagtggccacagagatcctgctgaagcaggccagcaccctggccgacctggacagcggcaacatggagaaggtgatcaaggatgaaaatgtgaccctgtatgtgtgggccaacctgaagaagaaccccaggcacaggtctgtgcgcttcagcgagacccagattggatttgagatcccccgcatcctggccaccagtgacattgctgtgcggctgctgcacacccactatgaccacgtgtctgccctgcaccctgtgtccacccccagcaaggagtacaccagcgctgtgacagagctggtgaaggatgatgtgaagaatgtggagaaggccatcagcaaggaggtggaggaggagagcaagcagcaggagcggggcagccacctgatccaggaggaggagatcaaggtggaggaggagcagggcgacatcgaggtgaagatgagcagcgctgaggaggagagcgaggccatcaagtgtgagcgggagatgaaggtgctgtctgagaccgtgtctgctgcccagctgctgctggtggagaacagcagcgagaagccagacttctttgaggacaacgtggtggacctgtgccagttcaccaccctgggcggcgtgtaccacctggacatcctggagctgcccccccagtgcaagcctgtgaagggctggatgattgtggagatcctgaaggagggcctgcagaagtacacctacccacctgagaccacagaggagtttgaaacagaaaatgccttcccccccatcgaggtgaccctggaggtgcatgaaaatgtcatcttctttgaagatcctgtggtggtgcgctggatgctgaaggtgaacatcggggagctgatggccagcgccatgtaccccaccaaccagaagaaggacctgtag

SEQ ID NO: 35871 - DNA, 1545 bp, Artificial Sequence
  Description of Artificial Sequence: Synthetic coding sequence
atgaacaccttcatcagcctgtggaaggagaagaccaatgagacctttgaggaggtgattgagaagagcaaggtggtgctgaacctgattgagaagctgaagttcatcctgctggagaccccaccctgtgacctgcaggacaagaacatcatccagtaccaggagagcatcctgcagctgcaggagctgctgcacctgaagtttggagtggccacagagatcctgctgaagcaggccagcaccctggccgacctggacagcggcaacatggagaaggtgatcaaggatgaaaatgtgaccctgtatgtgtgggccaacctgaagaagaaccccaggcacaggtctgtgcgcttcagcgagacccagattggatttgagatcccccgcatcctggccaccagtgacattgctgtgcggctgctgcacacccactatgaccacgtgtctgccctgcaccctgtgtccacccccagcaaggagtacaccagcgctgtgacagagctggtgaaggatgatgtgaagaatgtggagaaggccatcagcaaggaggtggaggaggagagcaagcagcaggagcggggcagccacctgatccaggaggaggagatcaaggtggaggaggagcagggcgacatcgaggtgaagatgagcagcgctgaggaggagagcgaggccatcaagtgtgagcgggagatgaaggtgctgtctgagaccgtgtctgctgcccagctgctgctggtggagaacagcagcgagaagccagacttctttgaggacaacgtggtggacctgtgccagttcaccaccctgggcggcgtgtaccacctggacatcctggagctgcccccccagtgcaagcctgtgaagggctggatgattgtggagatcctgaaggagggcctgcagaagtacacctacccacctgagaccacagaggagtttgaaacagaaaatgccttcccccccatcgaggtgaccctggaggtgcatgaaaatgtcatcttctttgaagatcctgtggtggtgcgctgggatgctgagggcaagcactggaggacagatggcatcagcaatgtgtcctacaagcccaaggagcggctggtgaccttcagcctggacacctttggacctgtgaccctcatccaggatgcccacatcaacatgccctaccagagctgggagctgcggcccctggatgtgaacaaggtgctgctgactgtgaccaccgtcttcacagagatccagatccagatcaaggagaacctgtgcatgctgagcagcatcaagctgaaggacaagaagcacatcagcatcctggagggcacctggatgacccccatccccttcatcatcgccctgaaggaggccggcctgaacatcttccccaccaggcacagccacttctacgtgatcatcaacaacaaggtgcccctggtggaggtgaaggcctaccggcagatggccctgctgagcagcgcctttgccttcggctggagcaagtggaacctgctgtgcaacagcaccaaggtggtgttcaagtggtag

SEQ ID NO: 35872 - DNA, 279 bp, Artificial Sequence
  Description of Artificial Sequence: Synthetic coding sequence
atggagcggctggagatccagagaattgagaaggagaagtggcaccggctggaggccaaggacctggagaggagaaatgaggagctggaggagctgtacctgctggagcgctgcttccctgaggccgagaagctgaagcaggagaccaagctgctgagccagtggaagcactacatccagtgtgatggcagcccagaccccagcgtggcccaggagatgaacaccttcatcagcctgtggaaggagaagaccaatgagacctttgaggaggtgatctag

SEQ ID NO: 35873 - DNA, 1974 bp, Artificial Sequence
  Description of Artificial Sequence: Synthetic coding sequence
atggacctggagaggagaaatgaggagctggaggagctgtacctgctggagcgctgcttccctgaggccgagaagctgaagcaggagaccaagctgctgagccagtggaagcactacatccagtgtgatggcagcccagaccccagcgtggcccaggagatgaacaccttcatcagcctgtggaaggagaagaccaatgagacctttgaggaggtgattgagaagagcaaggtggtgctgaacctgattgagaagctgaagttcatcctgctggagaccccaccctgtgacctgcaggacaagaacatcatccagtaccaggagagcatcctgcagctgcaggagctgctgcacctgaagtttggagtggccacagagatcctgctgaagcaggccagcaccctggccgacctggacagcggcaacatggagaaggtgatcaaggatgaaaatgtgaccctgtatgtgtgggccaacctgaagaagaaccccaggcacaggtctgtgcgcttcagcgagacccagatcggctttgagatcccccgcatcctggccaccagtgacattgctgtgcggctgctgcacacccactatgaccacgtgtctgccctgcaccctgtgtccacccccagcaaggagtacaccagcgctgtgacagagctggtgaaggatgatgtgaagaatgtggagaaggccatcagcaaggaggtggaggaggagagcaagcagcaggagcggggcagccacctgatccaggaggaggagatcaaggtggaggaggagcagggcgacatcgaggtgaagatgagcagcgctgaggaggagagcgaggccatcaagtgtgagcgggagatgaaggtgctgtctgaaacagtgtctgctgcccagctgctgctggtggagaacagcagcgagaagccagacttctttgaagataatgtggtggacctgtgccagttcaccaccctgggcggcgtgtaccacctggacatcctggagctgcccccccagtgcaagcctgtgaagggctggatgattgtggagatcctgaaggagggcctgcagaagtacacctacccacctgagaccacagaggagtttgaaacagaaaatgccttcccccccatcgaggtgaccctggaggtgcatgaaaatgtcatcttctttgaggaccctgtggtggtgcgctgggatgctgagggcaagcactggaggacagatggcatcagcaatgtgtcctacaagcccaaggagcggctggtgaccttcagcctggacaccttcggccctgtgaccctcatccaggatgcccacatcaacatgccctaccagagctgggagctgcggcccctggatgtgaacaaggtgctgctgactgtgaccaccgtcttcacagagatccagatccagatcaaggagaacctgtgcatgctgagcagcatcaagctgaaggacaagaagcacatcagcatcctggagggcacctggatgacccccatccccttcatcatcgccctgaaggaggccggcctgaacatcttccccaccaggcacagccacttctacgtgatcatcaacaacaaggtgcccctggtggaggtgaaggcctaccggcagatggccctgctgagcagcgcctttgccttcggctggagcaagtggaacctgctgtgcaacagcaccaaggtggtgttcaaggtgcgggagcacctgacagaggcctgcacagagaaccccaactgggccctgctgatgttttctggggaccgggcccagaggctgaagatcaaggaggagagcgaggccttcagcgaggccctgaaggaggagacagagttccacagcaccctgtaccacatggtgaaggactttgccagcgaggaggccatggagaaggtgcgcagcagcaactgccagtttgtgaacagcgtgtgccacatgctgctgagcacccggctgctgagctacagctag

SEQ ID NO: 35874 - DNA, 411 bp, Artificial Sequence
  Description of Artificial Sequence: Synthetic coding sequence
atgatgcacaccaccagctaccgccgcctgagccccccccacctgacagaccagcccagcgcctacagccacacccacaggaccttcagccacttcagctgtggcagccagcctgctgcccagaggctgcacgtggagctgtggaatgctgacctgcagagcgagttcctgtgcccctgcctgggcctgaccctgtacctgacctgcaacccccagctgggcaagaggaagttctgcagccacagcagcgaggacatgagcaagatggtgtccagaagaaatgtgaaggacagccatgaggtgtctggcagcctgcaggccaccctgcaggtgatctccttctccttccccttcctgctgcacacctgcagccaccccctgagccaccccaccagcggccagaggaggtag

SEQ ID NO: 35875 - DNA, 570 bp, Artificial Sequence
  Description of Artificial Sequence: Synthetic coding sequence
atgacagacaagacagagaaggtggccgtggaccctgagaccgtcttcaagaggcccagagaatgtgacagccccagctaccagaagaggcagaggatggccctgctggccaggaagcagggcgctggggacagcctgattgctggcagcgccatgagcaaggagaagaagctgatgacaggccacgccatcccccccagccagctggacagccagattgatgacttcaccggcttcagcaaggacaggatgatgcagaagccaggcagcaatgcccctgtgggcggcaatgtgaccagcagcttctctggagatgacctggagtgccgggagacagccagcagccccaagagccagcgggagatcaatgctgacatcaagaggaagctggtgaaggagctgcgctgtgtgggccagaagtatgagaagatctttgagatgctggagggcgtgcagggccccacagctgtgaggaagcgcttctttgagagcatcatcaaggaggccgcccgctgcatgaggcgggactttgtgaagcacctgaagaagaagctgaagaggatgatctag

SEQ ID NO: 35876 - DNA, 867 bp, Artificial Sequence
  Description of Artificial Sequence: Synthetic coding sequence
atgtctgccaccggggacagacaccccacccagggcgaccaggaggcccctgtgtcccaggagggcgcccaggccgaggccgccggggccggcaaccaggagggcggggacagcggccctgacagcagtgatgtggtgcctgctgctgaggtggtgggcgtggccggccctgtggagggcctgggggaggaggagggggagcaggccgccggcctggccgctgtgccccggggcggcagcgcagaagaagattctgacatcggccctgccacagaggaggaggaggaggaggagggcaatgaggccgccaactttgacctggccgtggtggcccggcgctacccagccagcggcatccactttgtgctgctggacatggtgcacagcctgctgcaccggctgagccacaatgaccacatcctgattgaaaatcggcagctgagccggctgatggtgggcccccacgccgccgccaggaacctgtggggcaacctgccccccctgctgctgccccagaggctgggcgctggagctgctgcccgggccggggagggcctgggcctcatccaggaggccgcctctgtgcctgagcctgctgtgcctgctgacctggccgagatggcccgggagcctgctgaggaggccgctgaggagaagctgtctgaggaggccacagaggagccagatgctgaggagcccgccacagaggagcccacagcccaggaggccacagcccctgaggaggtgaccaagagccagcctgagaagtgggatgaggaggcccaggatgctgctggggaggaggagaaggagcaggagaaggagaaggatgctgagaacaaggtgaagaacagcaagggcacctag

SEQ ID NO: 35877 - DNA, 867 bp, Artificial Sequence; identical to SEQ ID NO: 35876
  Description of Artificial Sequence: Synthetic coding sequence

SEQ ID NO: 35878 - DNA, 495 bp, Artificial Sequence
  Description of Artificial Sequence: Synthetic coding sequence
atgggagacctgcccggcctggtgcggctgagcatcgccctgcgcatccagcccaatgatggccctgtgttctacaaggtggatggccagcgcttcggccagaacagaaccatcaagctgctgaccggcagcagctacaaggtggaggtgaagatcaagcccagcaccctgcaggtggagaacatcagcatcggcggcgtgctggtgcccctggagctgaagagcaaggagccagatggagacagagtggtgtacacaggcacctatgacacagaaggagtgacccccaccaagtctggagagcggcagcccatccagatcaccatgcccttcacagacatcggcacctttgaaacagtgtggcaggtgaagttctacaactaccacaagagggaccactgccagtggggcagccccttctctgtgattgaatatgagtgcaagcccaatgagaccaggagcctgatgtgggtgaacaaggagagcttcctgtag

SEQ ID NO: 35879 - DNA, 387 bp, Artificial Sequence
  Description of Artificial Sequence: Synthetic coding sequence
atgggagacctgcccggcctggtgcggctgagcatcgccctgcgcatccagcccaatgatggccctgtgttctacaaggtggatggccagcgcttcggccagaacagaaccatcaagctgctgaccggcagcagctacaaggtggaggtgaagatcaagcccagcaccctgcaggtggagaacatcagcatcggcggcgtgctggtgcccctggagctgaagagcaaggagccagatggagacagagtggtgtacacaggcacctatgacacagaaggagtgacccccaccaagtctggagagcggcagcccatccagatcaccatgccagaatgtctggagcagaggccccaggagatcagcctgacctatgaatgtgaggagtag

SEQ ID NO: 35880 - DNA, 279 bp, Artificial Sequence
  Description of Artificial Sequence: Synthetic coding sequence
atgaatgactacaagctggaggaggaccctgtgaccaaggagaggaccttcaagagatttgcccccaggaagggggacaagatctaccaggagttcaagaagctgtacttctacagtgatgcctaccggcccctgaagtttgcctgtgagaccatcatcgaggagtatgaagatgagatcagcagcctcatcgcccaggagacccactacctggccgacaagctgtgcagcgagaagagtgacctgtgtgagaccagcgccaaccacacagagctgtag

SEQ ID NO: 35881 - DNA, 3141 bp, Artificial Sequence
  Description of Artificial Sequence: Synthetic coding sequence
atgcagaagcccagcggcctgaagcccccaggccggggcggcaagcacagcagccccatgggccgcaccagcactggaagtgccagcagcagcgctgctgtggccgccagcagcaaggagggcagccccctgcacaagcagagcagcggccccagcagcagccctgctgctgctgctgcccctgagaagccaggccccaaggctgctgaggtgggagatgacttcctgggggactttgtggtgggggagcgggtgtgggtgaatggagtgaagccaggagtggtgcagtacctgggggagacccagtttgcccctggccagtgggccggcgtggtgctggatgatcctgtgggcaagaatgatggagctgtgggcggcgtgcgctactttgaatgtcctgccctgcagggcatcttcacccggcccagcaagctgacccggcagcccacagctgagggcagcggcagtgatgcccacagcgtggagagcctgacagcccagaacctgagcctgcacagcggcacagccaccccacccctgaccagcagggtcatccccctgcgggagagcgtgctgaacagctctgtgaagacaggaaatgaaagtggcagcaacctgagtgacagcggctctgtgaagagaggagagaaggacctgcggctgggggacagagtgctggtgggcggcaccaagacaggagtggtgcgctacgtgggggagacagactttgccaagggggagtggtgtggggtggagctggatgagcccctgggcaagaatgatggagctgtggccggcacccgctacttccagtgcccccccaagtttggcctgtttgcccccatccacaaggtgatccgcatcggcttccccagcaccagccctgccaaggccaagaagaccaagaggatggccatgggcgtgtctgccctgacccacagccccagcagcagcagcatcagctctgtgtcctctgtggccagctctgtgggcggccggcccagccgcagcggcctgctgacagagaccagcagccgctatgccaggaagatcagcggcaccacagccctgcaggaggccctgaaggagaagcagcagcacatcgagcagctgctggccgagcgggacctggagcgggcagaggtggccaaggccaccagccacatctgtgaggtggagaaggagatcgccctgctgaaggcccagcacgagcagtatgtggccgaggccgaggagaagctgcagagggcccggctgctggtggagagcgtgaggaaggagaaggtggacctgagcaaccagctggaggaggagaggaggaaggtggaggacctgcagttccgggtggaggaggagagcatcaccaagggggacctggagacccagacccagctggagcacgcccgcatcggggagctggagcagagcctgctgctggagaaggcccaggccgagcggctgctgcgggagctggccgacaaccggctgaccaccgtggccgagaagagccgggtgctgcagctggaggaggagctgaccctgcggcggggggagattgaggagctgcagcagtgcctgctgcacagcggccccccacctccagaccacccagatgctgctgagatcctgcggctgcgggagcggctgctgagcgccagcaaggagcaccagcgggagagcggcgtgctgcgggacaagtatgagaaggccctgaaggcctaccaggccgaggtggacaagctgcgggccgccaatgagaagtatgcccaggaggtggccggcctgaaggacaaggtgcagcaggccaccagcgagaacatgggcctgatggacaactggaagagcaagctggacagcctggccagtgaccaccagaagagcctggaggacctgaaggccaccctgaacagcggccctggggcccagcagaaggagatcggggagctgaaggctgtgatggagggcatcaagatggagcaccagctggagctgggcaacctgcaggccaagcatgacctggagacagccatgcacgtgaaggagaaggaggccctgcgggagaagctgcaggaggcccaggaggagctggccggcctgcagaggcactggagggcccagctggaggtgcaggccagccagcaccggctggagctgcaggaggcccaggaccagaggagagatgctgagctgcgggtgcatgagctggagaagctggatgtggagtaccggggccaggcccaggccatcgagttcctgaaggagcagatcagcctggccgagaagaagatgctggactatgaaaggctgcagagagctgaggcccagggcaagcaggaggtggagagcctgcgggagaagctgctggtggctgaaaatcggctgcaggccgtggaggccctgtgcagcagccagcacacccacatgattgagagcaatgacatcagcgaggagaccatccgcaccaaggagaccgtggagggcctgcaggacaagctgaacaagagggacaaggaggtgacagccctgaccagccagacagagatgctgcgggcccaggtgtctgccctggagagcaagtgcaagagcggggagaagaaggtggatgccctgctgaaggagaagaggcggctggaggccgagctggagaccgtgtccaggaagacccatgatgccagcggccagctggtgctgatcagccaggagctgctgaggaaggagaggagcctgaatgagctgcgggtgctgctgctggaggccaacagacacagccctggccctgagcgggacctgagccgggaggtgcacaaggccgagtggaggatcaaggagcagaagctgaaggatgacatccggggcctgcgggagaagctgaccggcctggacaaggagaagagcctgagtgaccagaggcgctacagcctgattgacaggagcagcgcccctgagctgctgcggctgcagcaccagctgatgagcacagaagatgccctgagagatgccctggaccaggcccagcaggtggagaagctgatggaggccatgaggagctgcccagacaaggcccagaccatcggcaacagcggcagcgccaacggcatccaccagcaggacaaggcccagaagcaggaggacaagcactag

SEQ ID NO: 35882 - DNA, 2118 bp, Artificial Sequence
  Description of Artificial Sequence: Synthetic coding sequence
atgaccatcgaggacctgcctgacttccccctggagggcaaccccctgtttggccgctaccccttcatcttcagcgccagtgacacccctgtgatcttcagcatctctgctgcccccatgcccagcgactgtgagttctccttctttgaccccaatgatgccagctgccaggagatcctgtttgaccccaagacctctgtgtctgagctgtttgccatcctgcggcagtgggtgccccaggtgcagcagaacatcgacatcattggaaatgagatcctgaagaggggctgcaatgtgaatgacagagatggcctgacagacatgaccctgctgcactacacctgcaagagcggggcccacggcattggagatgtggagacagctgtgaagtttgccacccagctgattgacctgggcgctgacatcagcctgcggagccgctggaccaacatgaatgccctgcactatgctgcctactttgatgtgcctgagctgatccgggtcatcctgaagaccagcaagcccaaggatgtggatgccacctgcagcgacttcaactttggaacagccctgcacatcgccgcctacaacctgtgtgccggggctgtgaagtgcctgctggagcagggcgccaacccagccttcagaaatgacaagggccagatcccagcagatgtggtgcctgaccctgtggacatgcccctggagatggctgatgctgctgccacagccaaggagatcaagcagatgctgctggatgctgtgcccctgagctgcaacatcagcaaggccatgctgcccaactatgaccacgtgacaggcaaggccatgctgaccagcctgggcctgaagctgggggacagagtggtgattgctggccagaaggtgggcaccctgcgcttctgtggcaccacagaatttgccagcggccagtgggccggcatcgagctggatgagcctgagggcaagaacaatggatctgtgggcaaggtgcagtacttcaagtgtgcccccaagtatggcatctttgcccccctgagcaagatcagcaaggccaagggccgcaggaagaacatcacccacacccccagcaccaaggctgctgtgcccctcatccgcagccagaagattgatgtggcccacgtgaccagcaaggtgaacacaggcctgatgaccagcaagaaggacagcgccagcgagagcaccctgagcctgcccccaggagaggagctgaagacagtgacagagaaggatgtggccctgctgggctctgtgagcagctgcagcagcaccagcagcctggagcaccggcagagctaccccaagaagcagaatgccatcagcagcaacaagaagaccatgagcaagagccccagcctgagcagccgggccagcgctggcctgaacagcagcgccaccagcacagccaacaacagccgctgtgagggggagctgcggctgggggagcgggtgctggtggtgggccagaggctgggcaccatccgcttcttcggcaccaccaactttgcccctggctactggtatggaattgagctggagaagccccacggcaagaatgatggctctgtgggcggcgtgcagtacttcagctgcagccccaggtatggcatctttgccccacccagccgggtgcagagggtgacagacagcctggacaccctgtctgagatcagcagcaacaagcagaaccacagctacccaggcttcagaagaagcttcagcaccaccagcgccagcagccagaaggagatcaacagaagaaatgccttcagcaagagcaaggccgccctgcggcgctcctggagcagcacccccacagctgggggcatcgagggctctgtgaagctgcacgagggcagccaggtgctgctgaccagcagcaatgagatgggcaccgtgcgctacgtgggccccacagactttgccagcggcatctggctgggcctggagctgcggagcgccaagggcaagaatgatggctctgtgggggacaagcgctacttcacctgcaagcccaaccacggcgtgctggtgcggcccagccgggtgacctaccggggcatcaatggcagcaagctggtggatgagaactgctag

SEQ ID NO: 35883 - DNA, 2172 bp, Artificial Sequence
  Description of Artificial Sequence: Synthetic coding sequence
aagatgaccatcgaggacctgcctgacttccccctggagggcaaccccctgtttggccgctaccccttcatcttcagcgccagtgacacccctgtgatcttcagcatctctgctgcccccatgcccagcgactgtgagttctccttctttgaccccaatgatgccagctgccaggagatcctgtttgaccccaagacctctgtgtctgagctgtttgccatcctgcggcagtgggtgccccaggtgcagcagaacatcgacatcattggaaatgagatcctgaagaggggctgcaatgtgaatgacagagatggcctgacagacatgaccctgctgcactacacctgcaagagcggggcccatggaattggagatgtggagacagctgtgaagtttgccacccagctgattgacctgggcgctgacatcagcctgcggagccgctggaccaacatgaatgccctgcactacgccgcctactttgatgtgcctgagctgatccgggtcatcctgaagaccagcaagcccaaggatgtggatgccacctgcagcgacttcaactttggaacagccctgcacatcgccgcctacaacctgtgtgccggggctgtgaagtgcctgctggagcagggcgccaacccagccttcagaaatgacaagggccagatcccagcagatgtggtgcctgaccctgtggacatgcccctggagatggctgatgctgctgccacagccaaggagatcaagcagatgctgctggatgctgtgcccctgagctgcaacatcagcaaggccatgctgcccaactatgaccacgtgacaggcaaggccatgctgaccagcctgggcctgaagctgggggacagagtggtgattgctggccagaaggtgggcaccctgcgcttctgtggcaccacagaatttgccagcggccagtgggccggcatcgagctggatgagcctgagggcaagaacaacggctctgtgggcaaggtgcagtacttcaagtgtgcccccaagtatggcatctttgcccccctgagcaagatcagcaaggccaagggccgcaggaagaacatcacccacacccccagcaccaaggctgctgtgcccctcatccgcagccagaagattgatgtggcccacgtgaccagcaaggtgaacacaggcctgatgaccagcaagaaggacagcgccagcgagagcaccctgagcctgcccccaggagaggagctgaagacagtgacagagaaggatgtggccctgctgggctctgtgagcagctgcagcagcaccagcagcctggagcaccggcagagctaccccaagaagcagaatgccatcagcagcaacaagaagaccatgagcaagagccccagcctgagcagccgggccagcgctggcatctacggcttcttcaaccaggccttcctggtgttcttcatcctggtgtgcctgtttgagttcctgagcaacatctacagcaacagccgctgtgagggggagctgcggctgggggagcgggtgctggtggtgggccagaggctgggcaccatccgcttcttcggcaccaccaactttgcccctggctactggtatggaattgagctggagaagccccacggcaagaatgatggctctgtgggcggcgtgcagtacttcagctgcagccccaggtatggcatctttgccccacccagccgggtgcagagggtgacagacagcctggacaccctgtctgagatcagcagcaacaagcagaaccacagctacccaggcttcagaagaagcttcagcaccaccagcgccagcagccagaaggagatcaacagaagaaatgccttcagcaagagcaaggccgccctgcggcgctcctggagcagcacccccacagctgggggcatcgagggctctgtgaagctgcacgagggcagccaggtgctgctgaccagcagcaatgagatgggcaccgtgcgctacgtgggccccacagactttgccagcggcatctggctgggcctggagctgcggagcgccaagggcaagaatgatggctctgtgggggacaagcgctacttcacctgcaagcccaaccacggcgtgctggtgcggcccagccgggtgacctaccggggcatcaatggcagcaagctggtggatgagaactgctag

SEQ ID NO: 35884 - DNA, 2124 bp, Artificial Sequence
  Description of Artificial Sequence: Synthetic coding sequence
atgaccatcgaggacctgcctgacttccccctggagggcaaccccctgtttggccgctaccccttcatcttcagcgccagtgacacccctgtgatcttcagcatctctgctgcccccatgcccagcgactgtgagttctccttctttgaccccaatgatgccagctgccaggagatcctgtttgaccccaagacctctgtgtctgagctgtttgccatcctgcggcagtgggtgccccaggtgcagcagaacatcgacatcattggaaatgagatcctgaagaggggctgcaatgtgaatgacagagatggcctgacagacatgaccctgctgcactacacctgcaagagcggggcccacggcattggagatgtggagacagctgtgaagtttgccacccagctgattgacctgggcgctgacatcagcctgcggagccgctggaccaacatgaatgccctgcactatgctgcctactttgatgtgcctgagctgatccgggtcatcctgaagaccagcaagcccaaggatgtggatgccacctgcagcgacttcaactttggaacagccctgcacatcgccgcctacaacctgtgtgccggggctgtgaagtgcctgctggagcagggcgccaacccagccttcagaaatgacaagggccagatcccagcagatgtggtgcctgaccctgtggacatgcccctggagatggctgatgctgctgccacagccaaggagatcaagcagatgctgctggatgctgtgcccctgagctgcaacatcagcaaggccatgctgcccaactatgaccacgtgacaggcaaggccatgctgaccagcctgggcctgaagctgggggacagagtggtgattgctggccagaaggtgggcaccctgcgcttctgtggcaccacagaatttgccagcggccagtgggccggcatcgagctggatgagcctgagggcaagaacaatggatctgtgggcaaggtgcagtacttcaagtgtgcccccaagtatggcatctttgcccccctgagcaagatcagcaaggccaagggccgcaggaagaacatcacccacacccccagcaccaaggctgctgtgcccctcatccgcagccagaagattgatgtggcccacgtgaccagcaaggtgaacacaggcctgatgaccagcaagaaggacagcgccagcgagagcaccctgagcctgcccccaggagaggagctgaagacagtgacagagaaggatgtggccctgctgggctctgtgagcagctgcagcagcaccagcagcctggagcaccggcagagctaccccaagaagcagaatgccatcagcagcaacaagaagaccatgagcaagagccccagcctgagcagccgggccagcgctggcctgaacagcagcgccaccagcacagccaacaacagccgctgtgagggggagctgcggctgggggagcgggtgctggtggtgggccagaggctgggcaccatccgcttcttcggcaccaccaactttgcccctgtgctgggctactggtatggaattgagctggagaagccccacggcaagaatgatggctctgtgggcggcgtgcagtacttcagctgcagccccaggtatggcatctttgccccacccagccgggtgcagagggtgacagacagcctggacaccctgtctgagatcagcagcaacaagcagaaccacagctacccaggcttcagaagaagcttcagcaccaccagcgccagcagccagaaggagatcaacagaagaaatgccttcagcaagagcaaggccgccctgcggcgctcctggagcagcacccccacagctgggggcatcgagggctctgtgaagctgcacgagggcagccaggtgctgctgaccagcagcaatgagatgggcaccgtgcgctacgtgggccccacagactttgccagcggcatctggctgggcctggagctgcggagcgccaagggcaagaatgatggctctgtgggggacaagcgctacttcacctgcaagcccaaccacggcgtgctggtgcggcccagccgggtgacctaccggggcatcaatggcagcaagctggtggatgagaactgctag

SEQ ID NO: 35885 - DNA, 2118 bp, Artificial Sequence; identical to SEQ ID NO: 35882
  Description of Artificial Sequence: Synthetic coding sequence

SEQ ID NO: 35886 - DNA, 645 bp, Artificial Sequence
  Description of Artificial Sequence: Synthetic coding sequence
atgaccatcgaggacctgcctgacttccccctggagggcaaccccctgtttggccgctaccccttcatcttcagcgccagtgacacccctgtgatcttcagcatctctgctgcccccatgcccagcgactgtgagttctccttctttgaccccaatgatgccagctgccaggagatcctgtttgaccccaagacctctgtgtctgagctgtttgccatcctgcggcagtgggtgccccaggtgcagcagaacatcgacatcattggaaatgagatcctgaagaggggctgcaatgtgaatgacagagatggcctgacagacatgaccctgctgcactacacctgcaagagcggggcccacggcattggagatgtggagacagctgtgaagtttgccacccagctgattgacctgggcgctgacatcagcctgcggagccgctggaccaacatgaatgccctgcactatgctgcctactttgatgtgcctgagctgatccgggtcatcctgaagaccagcaagcccaaggatgtggatgccacctgcagcgacttcaactttggaacagccctgcacatcgccgcctacaacctgtgtgccggggctgtgaagtgcctgctggagcagggcgccaacccagcctag

SEQ ID NO: 35887 - DNA, 1998 bp, Artificial Sequence
  Description of Artificial Sequence: Synthetic coding sequence
atgcagaggaggaagcagaagcagaagaacctgaatgaaagccactacctgtgcatgctgctgcagagcgagctgtctgagttctccttctttgaccccaatgatgccagctgccaggagatcctgtttgaccccaagacctctgtgtctgagctgtttgccatcctgcggcagtgggtgccccaggtgcagcagaacatcgacatcattggaaatgagatcctgaagaggggctgcaatgtgaatgacagagatggcctgacagacatgaccctgctgcactacacctgcaagagcggggcccacggcattggagatgtggagacagctgtgaagtttgccacccagctgattgacctgggcgctgacatcagcctgcggagccgctggaccaacatgaatgccctgcactatgctgcctactttgatgtgcctgagctgatccgggtcatcctgaagaccagcaagcccaaggatgtggatgccacctgcagcgacttcaactttggaacagccctgcacatcgccgcctacaacctgtgtgccggggctgtgaagtgcctgctggagcagggcgccaacccagccttcagaaatgacaagggccagatcccagcagatgtggtgcctgaccctgtggacatgcccctggagatggctgatgctgctgccacagccaaggagatcaagcagatgctgctggatgctgtgcccctgagctgcaacatcagcaaggccatgctgcccaactatgaccacgtgacaggcaaggccatgctgaccagcctgggcctgaagctgggggacagagtggtgattgctggccagaaggtgggcaccctgcgcttctgtggcaccacagaatttgccagcggccagtgggccggcatcgagctggatgagcctgagggcaagaacaatggatctgtgggcaaggtgcagtacttcaagtgtgcccccaagtatggcatctttgcccccctgagcaagatcagcaaggccaagggccgcaggaagaacatcacccacacccccagcaccaaggctgctgtgcccctcatccgcagccagaagattgatgtggcccacgtgaccagcaaggtgaacacaggcctgatgaccagcaagaaggacagcgccagcgagagcaccctgagcctgcccccaggagaggagctgaagacagtgacagagaaggatgtggccctgctgggctctgtgagcagcaacaagaagaccatgagcaagagccccagcctgagcagccgggccagcgctggcctgaacagcagcgccaccagcacagccaacaacagccgctgtgagggggagctgcggctgggggagcgggtgctggtggtgggccagaggctgggcaccatccgcttcttcggcaccaccaactttgcccctggctactggtatggaattgagctggagaagccccacggcaagaatgatggctctgtgggcggcgtgcagtacttcagctgcagccccaggtatggcatctttgccccacccagccgggtgcagagggtgacagacagcctggacaccctgtctgagatcagcagcaacaagcagaaccacagctacccaggcttcagaagaagcttcagcaccaccagcgccagcagccagaaggagatcaacagaagaaatgccttcagcaagagcaaggccgccctgcggcgctcctggagcagcacccccacagctgggggcatcgagggctctgtgaagctgcacgagggcagccaggtgctgctgaccagcagcaatgagatgggcaccgtgcgctacgtgggccccacagactttgccagcggcatctggctgggcctggagctgcggagcgccaagggcaagaatgatggctctgtgggggacaagcgctacttcacctgcaagcccaaccacggcgtgctggtgcggcccagccgggtgacctaccggggcatcaatggcagcaagctggtggatgagaactgctag

SEQ ID NO: 35888 - DNA, 1173 bp, Artificial Sequence
  Description of Artificial Sequence: Synthetic coding sequence
atggtgaccagggctggagctggaacagctgtggccggggctgtggtggtggccctgctgtctgctgccctggccctgtatggcccccccctggatgctgtgctggagcgggccttcagcctgaggaaggcccacagcatcaaggacatggagaacaccctgcagctggtgaggaacatcatcccccccctgagcagcaccaagcacaagggccaggacggccgcatcggcgtggtgggcggctgccaggagtacaccggggccccctactttgctgccatcagcgccctgaaggtgggcgctgacctgagccacgtgttctgtgccagcgctgctgcccctgtgatcaaggcctacagccctgagctgattgtgcaccctgtgctggacagccccaatgctgtgcatgaggtggagaagtggctgccccggctgcacgccctggtggtgggccctggcctgggcagagatgatgccctgctgagaaatgtgcagggcatcctggaggtgtccaaggcccgggacatccctgtggtgattgatgctgatggcctgtggctggtggcccagcagcctgccctgatccacggctacaggaaggctgtgctgacccccaaccacgtggagttcagccggctgtatgatgctgtgctgcggggccccatggacagtgatgacagccacggctctgtgctgcggctgagccaggccctgggcaatgtgacagtggtgcagaagggggagcgggacatcctgagcaatggccagcaggtgctggtgtgcagccaggagggcagcagccgccgctgtggcggccagggcgacctgctgagcggcagcctgggcgtgctggtgcactgggccctgctggccggcccccagaagaccaatggaggcatcagtgacctgaagctgaccatctggggccctgagattgagaccggggtgaagacccgggcccagggcagctgtggccccaggaccaccacccccaccagcccccacctgctgctgagccccagcccccaggtgcagcccagccctgggggccgggtgtggaggctgctgagccaccaggccgtgcagccccccagcctgcctgaggcccggagcctgcaccaccacctgcggcatgaccggcggggcggcggccgcctgcagcaggccctgtag

SEQ ID NO: 35889 - DNA, 366 bp, Artificial Sequence
  Description of Artificial Sequence: Synthetic coding sequence
atggccctgggcccccgctgtggggccatccgggcctgccggcgggtgctggagcgggccttcagcctgaggaaggcccacagcatcaaggacatggagaacaccctgcagctggtgaggaacatcatcccccccctgagcagcaccaagcacaagggccaggacggccgcatcggcgtggtgggcggctgccaggatgacagccccaatgctgtgcatgaggtggagaagtggctgccccggctgcacgccctggtggtgggccctggcctgggcagagatgatgccctgctgagaaatgtgcagggcatcctggaggtgtccaaggcccgggacatccctgtggtgattgatgctgtgtcctag

SEQ ID NO: 35890 - DNA, 714 bp, Artificial Sequence
  Description of Artificial Sequence: Synthetic coding sequence
atgctgcctgatggccctggcagcagcctgtggggcaaccctggcctgcagaccagtgacagccccaatgctgtgcatgaggtggagaagtggctgccccggctgcacgccctggtggtgggccctggcctgggcagagatgatgccctgctgagaaatgtgcagggcatcctggaggtgtccaaggcccgggacatccctgtggtgattgatgctgatggcctgtggctggtggcccagcagcctgccctgatccacggctacaggaaggctgtgctgacccccaaccacgtggagttcagccggctgtatgatgctgtgctgcggggccccatggacagtgatgacagccacggctctgtgctgcggctgagccaggccctgggcaatgtgacagtggtgcagaagggggagcgggacatcctgagcaatggccagcaggtgctggtgtgcagccaggagggcagcagccgccgctgtggcggccagggcgacctgctgagcggcagcctgggcgtgctggtgcactgggccctgctggccggcccccagaagaccaacggcagcagccccctgctggtggccgcctttggagcctgcagcctgacccggcagtgcaaccaccaggccttccagaagcacggccgcagcaccaccaccagtgacatgattgctgaggtgggcgccgccttcagcaagctgtttgagacctag

SEQ ID NO: 35891 - DNA, 972 bp, Artificial Sequence
  Description of Artificial Sequence: Synthetic coding sequence
atggccctgggcccccgctgtggggccatccgggcctgccggcgggtgctggagcgggccttcagcctgaggaaggcccacagcatcaaggacatggagaacaccctgcagctggtgaggaacatcatcccccccctgagcagcaccaagcacaagggccaggacggccgcatcggcgtggtgggcggctgccaggagtacaccggggccccctactttgctgccatcagcgccctgaaggtgggcgctgacctgagccacgtgttctgtgccagcgctgctgcccctgtgatcaaggcctacagccctgagctgattgtgcaccctgtgctggacagccccaatgctgtgcatgaggtggagaagtggctgccccggctgcacgccctggtggtgggccctggcctgggcagagatgatgccctgctgagaaatgtgcagggcatcctggaggtgtccaaggcccgggacatccctgtggtgattgatgctgatggcctgtggctggtggcccagcagcctgccctgatccacggctacaggaaggctgtgctgacccccaaccacgtggagttcagccggctgtatgatgctgtgctgcggggccccatggacagtgatgacagccacggctctgtgctgcggctgagccaggccctgggcaatgtgacagtggtgcagaagggggagcgggacatcctgagcaatggccagcaggtgctggtgtgcagccaggagggcagcagccgccgctgtggcggccagggcgacctgctgagcggcagcctgggcgtgctggtgcactgggccctgctggccggcccccagaagaccaacggcagcagccccctgctggtggccgcctttggagcctgcagcctgacccggcagtgcaaccaccaggccttccagaagcacggggcctgccagatcttcaacctgagcatcaactggctgcccctgcgcatctag

SEQ ID NO: 35892 - DNA, 651 bp, Artificial Sequence
  Description of Artificial Sequence: Synthetic coding sequence
atggctgtgtttcctgccacagcccggggccagctgggcatcagaaatgctgcccgctggccctgggtgctggccgtgggccagagcggcctggctgatgagggcatcctggaggtgtccaaggcccgggacatccctgtggtgattgatgctgatggcctgtggctggtggcccagcagcctgccctgattcatggctacaggaaggctgtgctgacccccaaccacgtggagttcagccggctgtatgatgctgtgctgcggggccccatggacagtgatgacagccacggctctgtgctgcggctgagccaggccctgggcaatgtgacagtggtgcagaagggggagcgggacatcctgagcaatggccagcaggtgctggtgtgcagccaggagggcagcagcagaagatgtggcggccagggcgacctgctgagcggcagcctgggcgtgctggtgcactgggccctgctggccggcccccagaagaccaacggcagcagccccctgctggtggccgccttcggggcctgcagcctgacccggcagtgcaaccaccaggccttccagaagcacggccgcagcaccaccaccagtgacatgattgctgaggtgggcgccgccttcagcaagctgtttgagacctag

SEQ ID NO: 35893 - DNA, 789 bp, Artificial Sequence
  Description of Artificial Sequence: Synthetic coding sequence
atgagccggctgtcctggggctaccgggagcacaacggccccatccactggaaggagttcttccccatcgcagatggagaccagcagagccccatcgagatcaagaccaaggaggtgaagtatgacagcagcctgcggcccctgagcatcaagtatgaccccagcagcgccaagatcatcagcaacagcggccacagcttcaacgtggactttgatgacacagagaacaagtctgtgctgcggggcggccccctgaccggcagctaccgcctgcggcaggtgcacctgcactggggcagcgcagatgaccacggcagcgagcacatcgtggatggagtgtcctatgctgctgagctgcacgtggtgcactggaacagcgacaagtaccccagctttgtggaggccgcccacgagccagatggcctggccgtgctgggcgtcttcctgcagattggagagcccaacagccagctgcagaagatcacagacaccctggacagcatcaaggagaagggcaagcagacccgcttcaccaactttgacctgctgagcctgctgcccccatcctgggactactggacctacccaggcagcctgactgtgccccccctgctggagagcgtgacctggatcgtgctgaagcagcccatcaacatcagcagccagcagctggccaagttccgcagcctgctgtgcacagctgagggggaggccgccgccttcctggtgagcaaccaccggcccccccagcccctgaagggcaggaaggtgcgggccagcttccactag

SEQ ID NO: 35894 - DNA, 1311 bp, Artificial Sequence
  Description of Artificial Sequence: Synthetic coding sequence
atgcagggcaccccaggcggcggcaccaggcctggccccagccctgtggacaggaggaccctgctggtgttctccttcatcctggccgccgccctgggccagatgaacttcaccggggaccaggtgctgcgggtgctggccaaggatgagaagcagctgagcctgctgggggacctggagggcctgaagccccagaaggtggacttctggaggggccctgcccggcccagcctgcctgtggacatgagggtgcccttcagcgagctgaaggacatcaaggcctacctggagagccacggcctggcctacagcatcatgatcaaggacatccaggtgctgctggatgaggagcggcaggccatggccaagagccggcggctggagaggagcaccaacagcttctcctacagcagctaccacaccctggaggagatctacagctggattgacaactttgtgatggagcacagcgacatcgtgtccaagatccagatcggcaacagctttgagaaccagagcatcctggtgctgaagttcagcactggaggcagccgccacccagccatctggattgacaccggcatccacagccgggagtggatcacccacgccaccggcatctggacagccaacaagatcgtgtctgactatggcaaggacagagtgctgacagacatcctgaatgccatggacatcttcatcgagctggtgaccaacccagatggctttgccttcacccacagcatgaaccggctgtggaggaagaacaagagcatccggcccggcatcttctgcatcggcgtggacctgaacagaaactggaagagcggctttggaggaaatggcagcaacagcaacccctgcagcgagacctaccacggccccagcccccagagcgagcctgaggtggccgccatcgtgaacttcatcacagcccacggcaacttcaaggccctgatcagcatccacagctacagccagatgctgatgtacccctacggccgcctgctggagcctgtgagcaaccagcgggagctgtatgacctggccaaggatgctgtggaggccctgtacaaggtgcatggaattgagtacatcttcggcagcatcagcaccaccctgtatgtggccagcggcatcaccgtggactgggcctatgacagcggcatcaagtatgccttctcctttgagctgcgggacaccggccagtatggcttcctgctgcctgccacccagatcatccccacagcccaggagacctggatggccctgcggaccatcatggagcacaccctgaaccacccctactag

SEQ ID NO: 35895 - DNA, 1311 bp, Artificial Sequence; identical to SEQ ID NO: 35894
  Description of Artificial Sequence: Synthetic coding sequence

SEQ ID NO: 35896 - DNA, 2196 bp, Artificial Sequence
  Description of Artificial Sequence: Synthetic coding sequence
atgagccggcccggcacagccaccccagccctggccctggtgctgctggccgtgaccctggccggcgtgggcgcccagggcgccgccctggaggaccctgactactacggccaggagatctggagccgggagccctactatgcccggcctgagcctgagctggagaccttcagcccccccctgcctgctggccctggagaggagtgggagcggcggccccaggagccccggccccccaagagggccaccaagcccaagaaggcccccaagcgggagaagagcgcccctgagcccccacctcctgggaagcacagcaacaagaaggtgatgaggaccaagagcagcgagaaggccgccaatgatgaccacagcgtgcgggtggcccgggaggatgtgcgggagagctgcccccccctgggcctggagaccctgaagatcacagacttccagctgcacgccagcacagtgaagagatatggcctgggcgcccaccggggccgcctgaacatccaggccggcatcaatgaaaatgacttctatgatggagcctggtgtgccggcagaaatgacctgcagcagtggattgaggtggatgcccggcggctgacccgcttcaccggggtcatcacccagggcaggaacagcctgtggctgagtgactgggtgaccagctacaaggtgatggtgtccaatgacagccacacctgggtgacagtgaagaatggaagtggggacatgatctttgagggcaacagcgagaaggagatccctgtgctgaatgagctgcctgtgcccatggtggcccgctacatccgcatcaacccccagagctggtttgacaatggcagcatctgcatgaggatggagatcctgggctgccccctgcctgaccccaacaactactaccacagaagaaatgagatgaccaccacagatgacctggacttcaagcaccacaactacaaggagatgaggcagctgatgaaggtggtgaatgagatgtgccccaacatcacccgcatctacaacatcggcaagagccaccagggcctgaagctgtatgctgtggagatcagtgaccaccctggagaacatgaggtgggggagcctgagttccactacatcgccggggcccatggaaatgaggtgctgggccgggagctgctgctgctgctggtgcagtttgtgtgccaggagtacctggccagaaatgccagaattgtgcacctggtggaggagacccgcatccacgtgctgcccagcctgaacccagatggctatgagaaggcctatgaaggaggcagcgagctgggcggctggagcctgggccgctggacccatgatggcatcgacatcaacaacaacttcccagacctgaacaccctgctgtctgaaaatgccaccgtggccgctgagaccagggctgtgattgcctggatggagaagatcccctttgtgctgggcggcaacctgcagggcggggagctggtggtggcctacccctatgacctggtgcgcagcccctggaagacccaggagcacacccccaccccagatgaccacgtgttccgctggctggcctacagctatgccagcacccaccggctgatgacagatgcccggcggcgggtgtgccacacagaggacttccagaaggaggagggcaccgtgaatggagcctcctggcacacagtggccggcagcctgaatgacttctcctacctgcacaccaactgctttgagctgagcatctacgtgggctgtgacaagtacccccatgagagccagctgcctgaggagtgggagaacaaccgggagagcctgattgtgttcatggagcaggtgcaccggggcatcaagggcctggtgcgggacagccacggcaagggcatccccaatgccatcatctctgtggagggcatcaaccacgacatcagaacagccaatgatggagactactggaggctgctgaaccctggagaatatgtggtgacagccaaggccgagggcttcaccgccagcaccaagaactgcatggtgggctatgacatgggcgccacccgctgtgacttcaccctgagcaagaccaacatggcccgcatccgggagatcatggagaagtttgggaagcagcctgtgtccctgcctgcccggcggctgaagctgcggggccagaagaggcggcagaggggctag

SEQ ID NO: 35897 - DNA, 1770 bp, Artificial Sequence
  Description of Artificial Sequence: Synthetic coding sequence
ctggagatccaggccggcatcaatgaaaatgacttctatgatggagcctggtgtgccggcagaaatgacctgcagcagtggattgaggtggatgcccggcggctgacccgcttcaccggggtcatcacccagggcaggaacagcctgtggctgagtgactgggtgaccagctacaaggtgatggtgtccaatgacagccacacctgggtgacagtgaagaatggcagcggggacatgatctttgagggcaacagcgagaaggagatccctgtgctgaatgagctgcctgtgcccatggtggcccgctacatccgcatcaacccccagagctggtttgacaatggcagcatctgcatgaggatggagatcctgggctgccccctgcctgaccccaacaactactaccacagaagaaatgagatgaccaccacagatgacctggacttcaagcaccacaactacaaggagatgaggcagctgatgaaggtggtgaatgagatgtgccccaacatcacccgcatctacaacatcggcaagagccaccagggcctgaagctgtatgctgtggagatcagtgaccaccctggagagcacgaggtgggggagcctgagttccactacatcgccggggcccacggcaatgaggtgctgggccgggagctgctgctgctgctggtgcagtttgtgtgccaggagtacctggccagaaatgcccgcatcgtgcacctggtggaggagacccgcatccacgtgctgcccagcctgaacccagatggctatgagaaggcctatgagggcggcagcgagctgggcggctggagcctgggccgctggacccatgatggcatcgacatcaacaacaacttcccagacctgaacaccctgctgtgggaggccgaggaccggcagaatgtgcccaggaaggtgcccaaccactacatcgccatccctgagtggttcctgtctgaaaatgccaccgtggccgctgagaccagggctgtgattgcctggatggagaagatcccctttgtgctgggcggcaacctgcagggcggggagctggtggtggcctacccctatgacctggtgcgcagcccctggaagacccaggagcacacccccaccccagatgaccacgtgttccgctggctggcctacagctatgccagcacccaccggctgatgacagatgcccggcggcgggtgtgccacacagaggacttccagaaggaggagggcaccgtgaatggagcctcctggcacacagtggccggcagcctgaatgacttctcctacctgcacaccaactgctttgagctgagcatctacgtgggctgtgacaagtacccccatgagagccagctgcctgaggagtgggagaacaaccgggagagcctgattgtgttcatggagcaggtgcaccggggcatcaagggcctggtgcgggacagccacggcaagggcatccccaatgccatcatctctgtggagggcatcaaccacgacatcagaacagccaatgatggagactactggaggctgctgaaccctggagaatatgtggtgacagccaaggccgagggcttcaccgccagcaccaagaactgcatggtgggctatgacatgggcgccacccgctgtgacttcaccctgagcaagaccaacatggcccgcatccgggagatcatggagaagtttgggaagcagcctgtgtccctgcctgcccggcggctgaagctgcggggccagaagaggcggcagaggggctag

SEQ ID NO: 35898 - DNA, 1464 bp, Artificial Sequence
  Description of Artificial Sequence: Synthetic coding sequence
atgtctgacctgctgagcatctacagcgcccctgtggtggtgtccacagtgctgcacatcaccatcgtgttccccatcctgcagatcaggaagctgcggctgggccgggtgcacaagctgccccgggtgctggaggtgggcaacagcggcaccatgagccgggcctacaccttcttcttcctgcgctggaacagcatggccctgaccggctacagctggctgctgctgagcgccaccttcctgaatgtgggcgctgagatcagcatcaccctggagcccgcccagcccagcgagggggacaacgtgaccctggtggtgcacggcctgagcggggagctgctggcctacagctggtacgccggccccaccctgtctgtgtcctacctggtggccagctacatcgtgtccactggagatgagaccccaggccctgcccacacaggccgggaggccgtgcggccagatggcagcctggacatccagggcatcctgcccaggcacagcggcacctacatcctgcagaccttcaaccggcagctgcagacagaggtgggctacggccacgtgcaggtgcatgagatcctggcccagcccaccgtgctggccaacagcacagccctggtggagcggcgggacaccctgcggctgatgtgcagcagccccagccccacagctgaggtgcgctggttcttcaacggcggggccctgcctgtggccctgcggctgggcctgagcccagatggccgggtgctggcccggcacggcatcagaagagaggaggccggggcctaccagtgtgaggtgtggaaccctgtgtctgtgagccgctctgagcccatcaacctgactgtgtacttcggccctgagcgggtggccatcctgcaggacagcaccaccaggacaggctgcaccatcaaggtggacttcaacaccagcctgaccctgtggtgtgtgagccgcagctgcccagagccagaatatgtgtggaccttcaacggccaggccctgaagaatggccaggaccacctgaacatcagctccatgacagctgcccaggagggcacctacacctgcatcgccaagaacaccaagaccctgctgagcggcagcgcctctgtggtggtgaagctgtctgctgctgctgtggccaccatgattgtgcctgtgcccaccaagcccacagagggccaggatgtgaccctgactgtgcagggctaccccaaggacctgctggtgtatgcctggtaccggggccctgccagcgagcccaaccggctgctgagccagctgcccagcggcacctggattgctggccctgcccacacaggccgggaggtgggcttccccaactgcagcctgctggtgcagaagctgaacctgacagacaccggccgctacaccctgaagacagtgacagtgcagggcaagacagagaccctggaggtggagctgcaggtggcctag

SEQ ID NO: 35899 - DNA, 1278 bp, Artificial Sequence
  Description of Artificial Sequence: Synthetic coding sequence
atggccctgaccggctacagctggctgctgctgagcgccaccttcctgaatgtgggcgctgagatcagcatcaccctggagcccgcccagcccagcgagggggacaacgtgaccctggtggtgcacggcctgtctggagagctgctggcctacagctggtacgccggccccaccctgtctgtgtcctacctggtggccagctacatcgtgtccactggagatgagaccccaggccctgcccacacaggccgggaggccgtgcggccagatggcagcctggacatccagggcatcctgcccaggcacagcggcacctacatcctgcagaccttcaaccggcagctgcagacagaggtgggctacggccacgtgcaggtgcatgagatcctggcccagcccaccgtgctggccaacagcacagccctggtggagcggcgggacaccctgcggctgatgtgcagcagccccagccccacagctgaggtgcgctggttcttcaatggaggagccctgcctgtggccctgcggctgggcctgagcccagatggccgggtgctggcccggcacggcatccggcgggaggaggccggggcctaccagtgtgaggtgtggaaccctgtgtctgtgagccgctctgagcccatcaacctgactgtgtactttggacctgagcgggtggccatcctgcaggacagcaccaccaggacaggctgcaccatcaaggtggacttcaacaccagcctgaccctgtggtgtgtgagccgcagctgcccagagccagaatatgtgtggaccttcaacggccaggccctgaagaatggccaggaccacctgaacatcagctccatgacagctgcccaggagggcacctacacctgcatcgccaagaacaccaagaccctgctgagcggcagcgcctctgtggtggtgaagctgtctgctgctgctgtggccaccatgattgtgcctgtgcccaccaagcccacagagggccaggatgtgaccctgactgtgcagggctaccccaaggacctgctggtgtatgcctggtaccggggccctgccagcgagcccaaccggctgctgagccagctgcccagcggcacctggattgctggccctgcccacacaggccgggaggtgggcttccccaactgcagcctgctggtgcagaagctgaacctgacagacaccggccgctacaccctgaagacagtgacagtgcagggcaagacagagaccctggaggtggagctgcaggtggcccccctgggctag

SEQ ID NO: 35900 - DNA, 1092 bp, Artificial Sequence
  Description of Artificial Sequence: Synthetic coding sequence
atggacctgagccggccccgctggagcctgtggaggagggtcttcctgatggccagcctgctggcctgtggcatctgccaggccagcggccagatcttcatcacccagaccctgggcatcaagggctacagaacagtggtggccctggacaaggtgcctgaagatgtgcaggagtacagctggtactggggcgccaatgacagcgctggcaacatgatcatcagccacaagccacccagcgcccagcagcccggccccatgtacacaggccgggagcgggtgaaccgggagggcagcctgctgatccggcccacagccctgaatgacaccggcaactacacagtgcgggtggtggccggaaatgagacccagagggccaccggctggctggaggtgctggagctgggcagcaacctgggcatctctgtgaatgccagcagcctggtggagaacatggacagcgtggccgctgactgcctgaccaacgtgaccaacatcacctggtacgtgaatgatgtgcccaccagcagcagtgacaggatgaccatcagcccagatggcaagaccctggtgatcctgcgggtgagccgctatgacaggaccatccagtgcatgattgagagcttccctgagatcttccagaggtctgagcgcatcagcctgactgtggcctacggccctgactatgtgctgctgcggagcaacccagatgacttcaacggcatcgtgacagctgagatcggcagccaggtggagatggagtgcatctgctacagcttcctggacctgaagtaccactggatccacaacggcagcctgctgaacttcagtgatgccaagatgaacctgagcagcctggcctgggagcagatgggccgctaccgctgcaccgtggagaaccctgtgacccagctgatcatgtacatggatgtgcgcatccaggcccctcatgagtgccccctgcccagcggcatcctgcctgtggtgcaccgggacttcagcatcagcggctccatggtgatgttcctgatcatgctgactgtgctgggcggcgtgtacatctgtggggtgctgatccacgccctgatctag

SEQ ID NO: 35901 - DNA, 1197 bp, Artificial Sequence
  Description of Artificial Sequence: Synthetic coding sequence
atggaggtgtctggctgccccaccccagctggccagagcgccccctggggcggcaaggccgccctgaaggccggccggcgggaccggcagcccctgtgccaggagacccaggtgctggagggcgctgaggaggtggccgtgtccctggagggccccctgctgctggaggacccccggcagctgatggacctgagccggccccgctggagcctgtggaggagggtcttcctgatggccagcctgctggcctgtggcatctgccaggccagcggccagatcttcatcacccagaccctgggcatcaagggctacagaacagtggtggccctggacaaggtgcctgaagatgtgcaggagtacagctggtactggggcgccaatgattctgctggcaacatgatcatcagccacaagcccccatctgcccagcagcccggccccatgtacacaggccgggagcgggtgaaccgggagggcagcctgctgatccggcccacagccctgaatgacaccggcaactacacagtgcgggtggtggccggaaatgagacccagagggccaccggctggctggaggtgctggagctgggcagcaacctgggcatctctgtgaatgccagcagcctggtggagaacatggattctgtggccgctgactgcctgaccaacgtgaccaacatcacctggtacgtgaatgatgtgcccaccagcagcagtgacaggatgaccatcagcccagatggcaagaccctggtgatcctgcgggtgagccgctatgacaggaccatccagtgcatgattgagagcttccctgagatcttccagaggtctgagcgcatcagcctgactgtggcctacggccctgactatgtgctgctgcggagcaacccagatgacttcaatggaattgtgacagctgagatcggcagccaggtggagatggagtgcatctgctacagcttcctggacctgaagtaccactggatccacaacggcagcctgctgaacttcagtgatgccaagatgaacctgagcagcctggcctgggagcagatgggccgctaccgctgcaccgtggagaaccctgtgacccagctgatcatgtacatggatgtgcgcatccaggcccctcatgaatgtagcagcagccccccaggcagctgctttgcccacctgcctgcctccatgccctgctag

SEQ ID NO: 35902 - DNA, 705 bp, Artificial Sequence
  Description of Artificial Sequence: Synthetic coding sequence
atggagaagtgcaagggcaccagcaggatggccggcaccaccagcgcagatgtgaagatgagcagcagcgaggaggtgtcctggatctcctggttctgtggcctgcggggaaatgagttcttctgtgaggtggatgaggactacatccaggacaagttcaacctgaccggcctgaatgagcaggtgccccactaccggcaggccctggacatgatcctggacctggagccagatgaggagctggaggacaaccccaaccagagcgacctgattgagcaggccgctgagatgctgtatggcctcatccacgcccgctacatcctgaccaacagaggaattgcccagatgctggagaagtaccagcagggcgactttggctactgcccccgggtgtactgtgagaaccagcccatgctgcccatcggcctgagtgacatccctggagaggccatggtgaagctgtactgccccaagtgcatggatgtgtacacccccaagagcagccgccaccaccacacagatggagcctacttcggcaccggcttcccccacatgctgttcatggtgcaccctgagtaccggcccaagaggcctgccaaccagtttgtgccccggctgtatggcttcaagatccaccccatggcctaccagctgcagctgcaggccgccagcaacttcaagagccctgtgaagaccatcagatag

SEQ ID NO: 35903 - DNA, 294 bp, Artificial Sequence
  Description of Artificial Sequence: Synthetic coding sequence
atggctgacaaggtgctgaaggagaagaggaagctgttcatccacagcatgggagagggcaccatcaatggcctgctggatgagctgctgcagaccagggtgctgaaccaggaggagatggagaaggtgaagcgggagaatgccaccgtgatggacaagacccgggccctgattgacagcgtcatccccaagggggcccaggcctgccagatctgcatcacctacatctgtgaagaagattcctacctggccgagaccctgggcctgtctgctggccccatccctggcaactag

SEQ ID NO: 35904 - DNA, 594 bp, Artificial Sequence
  Description of Artificial Sequence: Synthetic coding sequence
atggctgacaaggtgctgaaggagaagaggaagctgttcatccacagcatgggagagggcaccatcaatggcctgctggatgagctgctgcagaccagggtgctgaaccaggaggagatggagaaggtgaagcgggagaatgccaccgtgatggacaagacccgggccctgattgacagcgtcatccccaagggggcccaggcctgccagatctgcatcacctacatctgtgaagaagattcctacctggccgagaccctgggcctgtctgctgccctgcaggccgtgcaggacaacccagccatgcccacctgcagcagccctgagggccgcatcaagctgtgcttcctggaggatgcccagaggatctggaagcagaagctgcagcgctgccacgtgcagaacaccatcatcaagtggagcgagcgctacaccagcggcagctttgagatgcagtggctgttcctgcggaccaacttcatcgagcgcttctggaggaacatcctgctgctgcccctgcacaagggcagcctgtacccccgcatccctggcctgggcaaggagctgcagacaggcacccacaagctgtcctag

SEQ ID NO: 35905 - DNA, 294 bp, Artificial Sequence; identical to SEQ ID NO: 35903
  Description of Artificial Sequence: Synthetic coding sequence

SEQ ID NO: 35906 - DNA, 273 bp, Artificial Sequence
  Description of Artificial Sequence: Synthetic coding sequence
atggctgaccagctgctgaggaagaagaggcgcatcttcatccacagcgtgggcgccggcaccatcaatgccctgctggactgcctgctggaggatgaggtgatcagccaggaggacatgaacaaggtgagagatgaaaatgacacagtgatggacaaggcccgggtgctgattgacctggtgacaggcaagggccccaagagctgctgcaagttcatcaagcacctgtgtgaggaggacccccagctggccagcaagatgggcctgcactag

SEQ ID NO: 35907 - DNA, 672 bp, Artificial Sequence
  Description of Artificial Sequence: Synthetic coding sequence
atggccctgtctgtgcccctgctgtacagcctggtgcgggccatcagcgaggccggggcccctcctggcagcgctggccccctgctgctgcagccccagaggcacagagctgctggctgcttcctgggcacctgcctggacctgctggacagcttcaccctggtggagctgatgctggagggccgggtgcccctgcctgcccacctgcgctacctgctgattgctgtgtacttcctgaccctggccagccctgtgctgtggctgtatgagctgaatgctgctgctgctgctgctgcctcctggggccaggccagcggccctggcagctgcagccggctgctgcggctgctgggcggctgcctggtggatgtgcccctgctggccctgcgctgcctgctggtggtgtcctaccagcagcccctgagcatcttcatgctgaagaacctcttcttcctgggctgccggggcctggaggccctggagggctgctgggaccggggcaacagagccagccccagccgggcccggggcggctatggagccccacccagcgcccctcctcctcctcctcctccaccccagggcggcagccagctgggccactgcatcagtgaaaatgaaggaggagcccacggctacgtgaacaccctggccgtggccagccagaactag

SEQ ID NO: 35908 - DNA, 1737 bp, Artificial Sequence
  Description of Artificial Sequence: Synthetic coding sequence
atgaggcctgccctgggccaccccaggtctgtgtcctctgccagcggcagcttccccccacctcctgctgctgcccggctgcagcccctcttcctgcggggcggcagcttccggggccggcggggcagcggggacagcagcaccagcaccagcaccagcagaggaggcggcggcggccggcggggcggcggcggcggcagccccagcagcagcactggagctgagagagaagatgatgatgagagcctgtctgtgtccaagcccctggtgcccaatgctgccctgctgggccccccagcccaggtgggcgccccagctggccctgcccctgtggccttcagcagcagcgctgccaccagcagcagcaccagcacccccaccagcagctgcagcatgacagctgctgactttggaggaggagctgctgctggagctgtgggcggccctggcagccgctctgctgggggcgccggcggcaccggcaccggcagcggggccagctgctgcccctgctgctgctgctgcggctgcccagacaggcctggaagaagaggaagaagaagaggctgtgcccccagcccccgctgccgctggggctaccaggccctgtctgtggtgctgctgctggcccagggcggcctgctggacctgtacctgattgctgtgacagacctgtactggtgctcctggatcgccacagacctggtggtggtggtgggctgggccatcttctttgccaagaacagccggggccggcggggcggggccgccagcggggcccacaaccaccacctgcaccaccaccacgccgccccacccctgcacctgcctgcccccagcgctgccacagctggggccaaggcccggggggcccggggcggggccggcggggccggcggcggcctgggcgctgctgctgctgctggggagtttgcctttgcctacctggcctggctgatctacagcatcgccttcacccccaaggtggtgctgatcctgggcaccagcatcctggacctgattgagctgcgggcccccttcggcaccaccggcttccggctgaccatggccctgtctgtgcccctgctgtacagcctggtgcgggccatcagcgaggccggggcccctcctggcagcgctggccccctgctgctgcagccccagaggcacagagctgctggctgcttcctgggcacctgcctggacctgctggacagcttcaccctggtggagctgatgctggagggccgggtgcccctgcctgcccacctgcgctacctgctgattgctgtgtacttcctgaccctggccagccctgtgctgtggctgtatgagctgaatgctgctgctgctgctgctgcctcctggggccaggccagcggccctggcagctgcagccggctgctgcggctgctgggcggctgcctggtggatgtgcccctgctggccctgcgctgcctgctggtggtgtcctaccagcagcccctgagcatcttcatgctgaagaacctcttcttcctgggctgccggggcctggaggccctggagggctgctgggaccggggcaacagagccagccccagccgggcccggggcggctacggggcccctccttctgcccctcctcctcctcctcctccaccccagggcggcagccagctgggccactgcatcagtgaaaatgaaggaggagcccacggctacgtgaacaccctggccgtggccagccagaactag

SEQ ID NO: 35909 - DNA, 2262 bp, Artificial Sequence
  Description of Artificial Sequence: Synthetic coding sequence
atggctgacaagaggaagctgcagggcgagattgaccgctgcctgaagaaggtgtctgaaggagtggagcagtttgaggacatctggcagaagctgcacaatgctgccaatgccaaccagaaggagaagtatgaggccgacctgaagaaggagatcaagaagctgcagaggctgcgggaccagatcaagacctgggtggccagcaatgagatcaaggacaagaggcagctgattgacaacaggaagctgattgagacccagatggagcgcttcaaggtggtggagcgggagaccaagaccaaggcctacagcaaggagggcctgggcctggcccagaaggtggaccctgcccagaaggagaaggaggaggtgggccagtggctgaccaacaccatcgacaccctgaacatgcaggtggaccagtttgagagcgaggtggagagcctgtctgtgcagaccaggaagaagaagggggacaaggacaagcaggaccgcatcgagggcctgaagaggcacatcgagaagcaccgctaccacgtgaggatgctggagaccatcctgaggatgctggacaatgacagcatcctggtggatgccatcaggaagatcaaggatgatgtggagtactacgtggacagcagccaggaccctgactttgaagaaaatgagttcctgtatgatgacctggacctggaggacatcccccaggccctggtggccaccagcccccccagccacagccacatggaggatgagatcttcaaccagagcagcagcacccccaccagcaccaccagcagcagccccatcccccccagccctgccaactgcaccacagagaacagtgaagatgacaagaagaggggccgcagcacagacagcgaggtgtcccagagccctgccaagaatggcagcaagcctgtgcacagcaaccagcacccccagagccctgctgtgccccccacctaccccagcggccccccacctgctgccagcgccctgagcaccaccccaggcaacaatggagtgcctgccccagctgcccctccttctgccctgggccccaaggccagccctgcccccagccacaacagcggcaccccagccccctatgcccaggccgtggcccccccagcccccagcggccccagcaccacccagccccggccccccagcgtgcagcccagcggcggcggcggcggcggcagcggcggcggcggcagcagcagcagcagcaacagcagcgctgggggcggggccggcaagcagaatggagccaccagctacagctctgtggtggccgacagccctgctgaggtggccctgagcagcagcggcggcaacaatgccagcagccaggccctgggccccccatctggcccccacaaccccccacccagcaccagcaaggagcccagcgctgctgcccccaccggggccggcggcgtggcccctggcagcggcaacaacagcggcggccccagcctgctggtgcccctgcctgtgaacccccccagcagccccacccccagcttcagtgatgccaaggccgccggggccctgctgaatggaccaccccagttcagcacagcccctgagatcaaggcccctgagcccctgagcagcctgaagtccatggccgagcgggccgccatcagcagcggcattgaagatcctgtgcccaccctgcacctgacagagcgggacatcatcctgagcagcaccagcgcccccccagccagcgcccagccccccctgcagctgtctgaggtgaacatccccctgagcctgggcgtgtgccccctgggccctgtgcccctgaccaaggagcagctgtaccagcaggccatggaggaggccgcctggcaccacatgccccaccccagcgacagcgagcgcatccggcagtacctgcccaggaacccctgccccaccccaccctaccaccaccagatgcccccaccccacagcgacacagtggagttctaccagaggctgagcacagagaccctcttcttcatcttctactacctggagggcaccaaggcccagtacctggccgccaaggccctgaagaagcagagctggaggttccacaccaagtacatgatgtggttccagagacatgaggagcccaagaccatcacagatgaatttgagcagggcacctacatctactttgattatgagaagtggggccagaggaagaaggagggcttcacctttgagtaccgctacctggaggaccgggacctgcagtag

SEQ ID NO: 35910 - DNA, 2262 bp, Artificial Sequence; identical to SEQ ID NO: 35909
  Description of Artificial Sequence: Synthetic coding sequence

SEQ ID NO: 35911 - DNA, 2262 bp, Artificial Sequence; identical to SEQ ID NO: 35909
  Description of Artificial Sequence: Synthetic coding sequence

SEQ ID NO: 35912 - DNA, 2262 bp, Artificial Sequence; identical to SEQ ID NO: 35909
  Description of Artificial Sequence: Synthetic coding sequence

SEQ ID NO: 35913 - DNA, 2262 bp, Artificial Sequence; identical to SEQ ID NO: 35909
  Description of Artificial Sequence: Synthetic coding sequence

SEQ ID NO: 35914 - DNA, 2262 bp, Artificial Sequence; identical to SEQ ID NO: 35909
  Description of Artificial Sequence: Synthetic coding sequence

SEQ ID NO: 35915 - DNA, 2262 bp, Artificial Sequence; identical to SEQ ID NO: 35909
  Description of Artificial Sequence: Synthetic coding sequence

SEQ ID NO: 35916 - DNA, 810 bp, Artificial Sequence
  Description of Artificial Sequence: Synthetic coding sequence
atggagcggctggtgatccgcatgcccttcagccacctgagcacctacagcctggtgtgggtgatggctgctgtggtgctgtgcacagcccaggtgcaggtggtgacccaggatgagcgggagcagctgtacaccccagccagcctgaagtgcagcctgcagaatgcccaggaggccctgattgtgacctggcagaagaagaaggctgtgtccccagagaacatggtgaccttcagcgagaaccacggcgtggtgatccagcctgcctacaaggacaagatcaacatcacccagctgggcctgcagaacagcaccatcaccttctggaacatcaccctggaggatgagggctgctacatgtgcctcttcaacaccttcggctttgggaagatcagcggcacagcctgcctgactgtgtatgtgcagcccatcgtgtccctgcactacaagttcagcgaggaccacctgaacatcacctgcagcgccacagcccggcctgcccccatggtgttctggaaggtgcccaggtctggaattgagaacagcacagtgaccctgagccaccccaacggcaccacctctgtgaccagcatcctgcacatcaaggaccccaagaaccaggtgggcaaggaggtgatctgccaggtgctgcacctgggcaccgtgacagacttcaagcagacagtgaacaagggctactggttctctgtgcccctgctgctgagcatcgtgtccctggtgatcctgctggtgctgatcagcatcctgctgtactggaagaggcacaggaaccaggaccgggagccctag

SEQ ID NO: 35917 - DNA, 885 bp, Artificial Sequence
  Description of Artificial Sequence: Synthetic coding sequence
atggagcggctgaccctgaccaggaccatcggcggccccctgctgacagccaccctgctgggcaagaccaccatcaatgactaccaggtgatccgcatgcccttcagccacctgagcacctacagcctggtgtgggtgatggctgctgtggtgctgtgcacagcccaggtgcaggtggtgacccaggatgagcgggagcagctgtacaccccagccagcctgaagtgcagcctgcagaatgcccaggaggccctgattgtgacctggcagaagaagaaggctgtgtccccagagaacatggtgaccttctctgaaaatcatggagtggtgatccagcctgcctacaaggacaagatcaacatcacccagctgggcctgcagaacagcaccatcaccttctggaacatcaccctggaggatgagggctgctacatgtgcctcttcaacacctttggatttgggaagatctctggaacagcctgcctgactgtgtatgtgcagcccatcgtgtccctgcactacaagttcagcgaggaccacctgaacatcacctgcagcgccacagcccggcctgcccccatggtgttctggaaggtgcccaggagcggcatcgagaacagcacagtgaccctgagccaccccaacggcaccacctctgtgaccagcatcctgcacatcaaggaccccaagaaccaggtgggcaaggaggtgatctgccaggtgctgcacctgggcaccgtgacagacttcaagcagacagtgaacaagggctactggttctctgtgcccctgctgctgagcatcgtgtccctggtgatcctgctggtgctgatcagcatcctgctgtactggaagaggcacaggaaccaggaccgggagccctag

SEQ ID NO: 35918 - DNA, 1377 bp, Artificial Sequence
  Description of Artificial Sequence: Synthetic coding sequence
atgaacagaggagtgcccttccgccacctgctgctggtgctgcagctggccctgctgcctgctgccacccagggcaagaaggtggtgctgggcaagaagggggacacagtggagctgacctgcacagccagccagaagaagagcatccagttccactggaagaacagcaaccagatcaagatcctgggcaaccagggcagcttcctgaccaagggccccagcaagctgaatgacagagctgacagcagaagaagcctgtgggaccagggcaacttccccctcatcatcaagaacctgaagattgaggacagcgacacctacatctgtgaggtggaggaccagaaggaggaggtgcagctgctggtgtttggcctgacagccaacagcgacacccacctgctgcagggccagagcctgaccctgaccctggagagccccccaggcagcagccccagcgtgcagtgccgcagcccccggggcaagaacatccagggcggcaagaccctgtctgtgtcccagctggagctgcaggacagcggcacctggacctgcaccgtgctgcagaaccagaagaaggtggagttcaagattgatattgtggtgctggccttccagaaggccagcagcatcgtgtacaagaaggagggggagcaggtggagttctccttccccctggccttcaccgtggagaagctgactggaagtggagagctgtggtggcaggccgagcgggccagcagcagcaagtcctggatcacctttgacctgaagaacaaggaggtgtctgtgaagagggtgacccaggaccccaagctgcagatgggcaagaagctgcccctgcacctgaccctgccccaggccctgccccagtatgccggcagcggcaacctgaccctggccctggaggccaagacaggcaagctgcaccaggaggtgaacctggtggtgatgagggccacccagctgcagaagaacctgacctgtgaggtgtggggccccaccagccccaagctgatgctgagcctgaagctggagaacaaggaggccaaggtgtccaagcgggagaaggctgtgtgggtgctgaaccctgaggccggcatgtggcagtgcctgctgagtgacagcggccaggtgctgctggagagcaacatcaaggtgctgcccacctggagcacccctgtgcagcccatggccctgattgtgctgggcggcgtggccggcctgctgctcttcatcggcctgggcatcttcttctgtgtgcgctgccgccacagaagacggcaggccgagaggatgagccagatcaagaggctgctgtctgagaagaagacctgccagtgcccccaccgcttccagaagacctgcagccccatctag

SEQ ID NO: 35919 - DNA, 789 bp, Artificial Sequence
  Description of Artificial Sequence: Synthetic coding sequence
atggtggcctggaggtctgccttcctggtgtgcctggccttcagcctggccaccctggtgcagaggggcagcggggactttgatgacttcaacctggaggatgctgtgaaggagaccagctctgtgaagcagccctgggaccacaccaccaccaccaccaccaacagacctggcaccacccgggccccagccaagcccccaggcagcggcctggacctggctgatgccctggatgaccaggatgatggccgcaggaagccaggcattggaggccgggagcgctggaaccacgtgaccaccaccaccaagaggcctgtgaccacccgggccccagccaacaccctgggcaatgactttgacctggctgatgccctggatgacagaaatgacagagatgatggaagaaggaagcccatcgccggcggcggcggcttcagtgacaaggacctggaggacatcgtgggcggcggggagtacaagccagacaagggcaaaggagatggccgctatggcagcaatgatgaccccggcagcggcatggtggccgagcccggcaccatcgccggcgtggccagcgccctggccatggccctgattggagctgtgagcagctacatctcctaccagcagaagaagttctgcttcagcatccagcagggcctgaatgctgactatgtgaagggggagaacctggaggccgtggtgtgtgaggagccccaggtgaagtacagcaccctgcacacccagagcgctgagcccccacctcctcctgagcccgcccgcatctag

SEQ ID NO: 35920 - DNA, 1437 bp, Artificial Sequence
  Description of Artificial Sequence: Synthetic coding sequence
atggctgctgctgctgctgggggcgcccctggccctgcccctggccctgctggccccccacctcctgctgcccccaccagcgctgcccgggccccaccccaggccctgcggcggcggggggacagcagaagacggcaggccgccctcttcttcctgaacaacatcagcctggatggccggccccccagcctgggccctggaggagagaagcccccacctcctcctgctgaggcccgggagcccccagcccctcctcctcctgagcccccaacaggcctgcctgcccggaccccagccccccagggcctgctgagccccacccaggtgcccaccggcctgggcctggatggccagaggcagaggaagagggtgaccagccagcgctgcagcctggagttcctggaggatgctgtgggctgtgccccagcccagaggaccaagcacaccagcggcagccccaggcacaagggcctgaagaagacccacttcatcaagaacatgaggcagtatgacaccaggaacagcagaattgtgctgatctgtgccaagaggagcctgtgtgccgccttctctgtgctgccctatggagagggcctgcgcatcagtgacctgcgggtggacagccagaagcagaggcaccccagcggaggagtgtctgtgagcagcgagatggtgtttgagctggagggcgtggagctgggcgcagatggcaaggtggtgtcctatgccaagttcctgtaccccaccaatgccctggtgacccacaagagtgacagccacggcctgctgcccaccccccggcccagcgtgcccaggaccctgcccggcagccgccacaagccagcccccaccaagagcgccccagccagcacagagctgggcagtgatgtgggggacaccctggagtacaaccccaacctgctggatgacccccagtggccctgtgggaagcacaagagggtgctgatctttgccagctacatgaccaccgtcatcgagtatgtgaagcccagcgacctgaagaaggacatgaatgagaccttccgggagaagttcccccacgtgaagctgaccctgagcaagatccgcagcctgaagcgggagatgaggagcctgtctgaagaatgttccctggagcctgtgacagtggccatggcctacgtgtactttgagaagctggtgctgcagggcaagctgagcaagcagaacaggaagctgtgtgccggggcctgtgtgctgctggccgccaagatcagcagtgacctgaggaagtctggagtgacccagctgattgacaagctggaggagcgcttccgcttcaacagaagagacctgattggatttgagttcaccgtgctggtggccctggagctggccctgtacctgcctgagaaccaggtgctgccccactaccgccgcctgacccagcagttctag

SEQ ID NO: 35921 - DNA, 801 bp, Artificial Sequence
  Description of Artificial Sequence: Synthetic coding sequence
gaccgggcccacctgtgccaggccgtgcctgtgcggggcctgctgggccctgccctgtggggccggcctgctgaccaggtggtgtcctatgccaagttcctgtaccccaccaatgccctggtgacccacaagagtgacagccacggcctgctgcccaccccccggcccagcgtgcccaggaccctgcccggcagccgccacaagccagcccccaccaagagcgccccagccagcacagagctgggcagtgatgtgggggacaccctggagtacaaccccaacctgctggatgacccccagtggccctgtgggaagcacaagagggtgctgatctttgccagctacatgaccaccgtcatcgagtatgtgaagcccagcgacctgaagaaggacatgaatgagaccttccgggagaagttcccccacgtgaagctgaccctgagcaagatccgcagcctgaagcgggagatgaggagcctgtctgaagaatgttccctggagcctgtgacagtggccatggcctacgtgtactttgagaagctggtgctgcagggcaagctgagcaagcagaacaggaagctgtgtgccggggcctgtgtgctgctggccgccaagatcagcagtgacctgaggaagtctggagtgacccagctgattgacaagctggaggagcgcttccgcttcaacagaagagacctgattggatttgagttcaccgtgctggtggccctggagctggccctgtacctgcctgagaaccaggtgctgccccactaccgccgcctgacccagcagttctag

SEQ ID NO: 35922 - DNA, 777 bp, Artificial Sequence
  Description of Artificial Sequence: Synthetic coding sequence
tgacaccaggagcagcaggaccgggcccacctgtgccaggccgtgcctgtgcggggcctgctgggccctgccctgtggggccggcctgctgaccaggtggtgtcctatgccaagttcctgtaccccaccaatgccctggtgacccacaagagtgacagccacggcctgctgcccaccccccggcccagcgtgcccaggaccctgcccggcagccgccacaagccagcccccaccaagagcgccccagccagcacagagctgggcagtgatgtgggggacaccctggagtacaaccccaacctgctggatgacccccagtggccctgtgggaagcacaagagggtgctgatctttgccagctacatgaccaccgtcatcgagtatgtgaagcccagcgacctgaagaaggacatgaatgagaccttccgggagaagttcccccacgtgaagctgaccctgagcaagatccgcagcctgaagcgggagatgaggagcctgtctgaagaatgttccctggagcctgtgacagtggccatggcctacgtgtactttgagaagctggtgctgcagggcaagctgagcaagcagaacaggaagctgtgtgccggggcctgtgtgctgctggccgccaagatcagcagtgacctgaggaagtctggagtgacccagctgattgacaagctggaggagcgcttccgcttcaacagaagagacctgattggatttgagttcaccgtgctggtggccctggagctggccctgtacctgcctgagtag

SEQ ID NO: 35923 - DNA, 258 bp, Artificial Sequence
  Description of Artificial Sequence: Synthetic coding sequence
atggtgggcggggaggccgctgctgctgtggaggagctggtgtctggagtgcggcaggccgctgactttgctgagcagttccgcagctacagcgagagcgagaagcagtggaaggccaggatggagttcatcctgcggcacctgcctgactacagagaccccccagatggcagcggccgcctggaccagctgctgagcctgtccatggtgtgggccaaccacctgttcctgggctgcagcccccggggccccaagtag

SEQ ID NO: 35924 - DNA, 351 bp, Artificial Sequence
  Description of Artificial Sequence: Synthetic coding sequence
atggtgggcggggaggccgctgctgctgtggaggagctggtgtctggagtgcggcaggccgctgactttgctgagcagttccgcagctacagcgagagcgagaagcagtggaaggccaggatggagttcatcctgcggcacctgcctgactacagagaccccccagatggcagcggccgcctggaccagctgctgagcctgtccatggtgtgggccaaccacctgttcctgggctgcagctacaacaaggacctgctggacaaggtgatggagatggctgatggcatcgaggtggaggacctgccccagttcaccaccaggtctgagctgatgaagaagcaccagagctag

SEQ ID NO: 35925 - DNA, 372 bp, Artificial Sequence
  Description of Artificial Sequence: Synthetic coding sequence
atgagcagcggcggcagccctggctgcctgcggctggccgagggctgccccaaccaccgggcctgggtgcgctggaacagacggcagccccacagcgccttcctgattgccagccacctgttcctgtctgtgctggtgtggttcaacagcttccagggcctggagctggagagcgagaaccccaggcacctgctgtggaatgtgtgcctggtggtgctggtgtgccccagcagcagcctggcctgccgcttccaggtgtaccagaggaccttctgcagcgtggagagccacaggaccaagaggaagatcctgcagctgtttgccaacatcctgccctacctgtacaagcagccctacaccaagaagcactag

SEQ ID NO: 35926 - DNA, 396 bp, Artificial Sequence
  Description of Artificial Sequence: Synthetic coding sequence
atgggccctgctgcccggcccaggagatttgtgcccggccccccaggagatgccaccaccctggagctgtacaccaaggtgtgcctgcccaggaagcgctggaggctgcccctgggccgcctggcccggagcccccggctgcaggccccccgggtgcgggccggcagcagccacagctgcaaggaggccgccaagtatgtgttccagaccttccacggcagcaagctgagcgccagcatcaagaggtctggagtgcggggcaagagcatcctgggcatctccatgcagatgaatggacctggcttccagctgcggagcggcttcccccccctgcgggcagagctggcccccagccacgcccggcctgaggccagcggccgctgccctgggggctag

SEQ ID NO: 35927 - DNA, 438 bp, Artificial Sequence
  Description of Artificial Sequence: Synthetic coding sequence
atgggcctgaagagccacgtgctgcctgcccccaacagccagggccagggcagcctgtgcatctttgtgtatgtgaccagctacatggactacatccagctgcagggcaaggagaacctggactgcagcggcctgaacaagcagaagatcgtgttcccccacagcatggacagcggagatggctggctgatggtgctggtgcagcagctgcacgagggccggggccacgtgctggacccctttgccctgatctctgtgctggtgacctcctggagccaggacggctgctgcatccccaagaaccacgtgtgtgtgcagggccggcggggcggcggccggggccgggccaagctggccggccctgtgaccttctaccagaaggtgaagccccggcagaagtctgtgtcctgcagcctgcccctgcacatcttcacctag

SEQ ID NO: 35928 - DNA, 387 bp, Artificial Sequence
  Description of Artificial Sequence: Synthetic coding sequence
atgctgcaggaggccctgacagaggccagcttcctgaagctggtgatcttcttcttcttcttctccttcctgcggcgcagcctggccctgagcccccggctggagtgcagcggggccatcagcgcccactgcaacctgcggctgctgggcagcagctacagcctggccagcgccagccgggtgtctggcatcaccggcagccgccaccacgcccagctgttctttgtgttcctggtggagaccggcttccaccacatcggccaggccggcctggagctgctgaccagcggggacccccccaccagcgccagccagagcgtgggcatcaccggggtgagccaccgggcccagcagatgaggatcatcttcatcttcatcaagctgtag

SEQ ID NO: 35929 - DNA, 597 bp, Artificial Sequence
  Description of Artificial Sequence: Synthetic coding sequence
atgaccctgaaggagcacgccgccttcaagcacctgttcaacaaggcccacctggccccacccctcatccacctgaccctgagcggccacagcacctgcttccgggagcaccgggtgggcggcaaggtgattgaccagcagcaccccaaggccgaggagagcttcctggtgcagaacaagatggagagccccatgagcaccttcttctacagcagacatggcaacaacctgatcagcctgtccttcccccacatcagccccttcagcatcccccagaacagacactgccaccacggcctcttctccatgagctgctgggtgcggctgcctgatggagtggccgccggccagaggggcagcagcctgccccggcggggcggccgggcagaggccccacccaccagcaggactggaagaagacctgggggcggggccccccacttcccagacagagtggccgccggccggcggggcagcagcctgctgcggcggggcggctgctgggccgagggcctgctgaccagccagacaggccggcccggcagagatgccccccacctgcctgatggagtggccgccggccagcgctgcagctag

SEQ ID NO: 35930 - DNA, 450 bp, Artificial Sequence
  Description of Artificial Sequence: Synthetic coding sequence
atgcaggagatccacgagaaggtgctgaatgaggtggtgggcgccatgatgtaccacaccttcagcctgacccgggaggacctggagaacttcaaggccctgcgggtgattgtgcaggtgggcagcggctatgacaacgtggccatcaaggccgccggggagctggagattgctgtgtgcagcatccccagcgctgctgtggaggagacagctgacagcaccaccggccacatcctgaacctgtactggggcaacagaagcctgtaccaggccctgcgggagggcaccagggtgcagagcgtggagcagatcggggaggtggcctctgtgaaggcccgcatccggggggagatcctgggcctcatcggcttcggccgcacccagcaggaggtggccgtgcgggccaaggcctttgctggctgggacagagctgtgcccggctgtgcctag

SEQ ID NO: 35931 - DNA, 381 bp, Artificial Sequence
  Description of Artificial Sequence: Synthetic coding sequence
atgggcctgcctgcccccagcctgcacgccaccagcaccctgcggccagaccagttcagcccccacaccaaccccagcctgagcctgccctgcctgaagagcttccctgtgtccctgtggccctggggccgggccagcctgctgtgccacctgagccggctgtttgtgtgccaccggcccctgacccccaccagccaggcccccaacatgttcagctgtgtgagcagcagcctgaccctggccgccagcagcgcctggccagccagccacctgcccatcagccacagccccttcctgcccccccacctgctgcggagccagctgtctgtgaccagcagccgggagccccggctgagcctgcccctgcagctgggccagtag

SEQ ID NO: 35932 - DNA, 1548 bp, Artificial Sequence
  Description of Artificial Sequence: Synthetic coding sequence
atggagtggaagctggagaggacagcccccaggagagtgaggacagaggaggagatgctgtgggagagcatcatgagggtgctgagcaaggacctgaagcagaagaggagccaggacagcgccaacgtgctggacagcgtgaatgccacctacagcgacttcaagagcaactttgccaagaggctgtctgctgaggtgcctgtggccagcagccccatcaccacccgctggcagcagagccagacccgggccctgagcagtgacagctttggagaggagcagagcaccacctacctgcctgaggccagcggctctgtgctgaagaccccacctgagaaggagaccctgaccctgggcagcaggaaggagcagctgaagacccccagcaagggcatcagcgagaccagcaacagcgccctgcacttctgcaaggcccctcatgccatggaccgggactggaaggagagcgtggccagcaagggccagaagtgcctgaagcagctgtttgtgacccagaatgtggtgcagcaggccaacgggaagatgcagctgtgtgagcagagtgaatgtgtgtggaagggctgcaaggatggagtgagagatgagagcttccacctgaagagcagcggggacatcaatgacagcatcctgcagcctgaggtgaagatccacatcaccggcctgagaaatgactactacctgaacatcctggactggagcttccagaacctggtggccatcgccctgggcagcgctgtgtacatctggaatggagagaaccacaacggcattgaaaatattgacctgagcctgacctgcaactacatcagctctgtgtcctggatcaaggagggcacctgcctggccgtgggcaccagcgagggggaggtgcagctgtgggatgtggtgaccaagaagaggctgaggaacatgctgggccacctgtctgtggtgggcgccctgtcctggaaccacttcatcctgagcagcggcagccggctgggccgggtgtaccaccatgatgtgcgggtggcccagcaccacgtgggcaccctgcggcacaagcaggccgtgtgtgccctgaagtggagcccagatggccgcctgctgagcagcggctgcagtgatggcctgctgaccatctggccccatgaccccggggccagcgcccagggccagcccctgaaggtgatcacccagagcacagctgtgaaggccatggactggtgcccctggcagagcggcgtgctggccatcggcggcggcatgaaggatggccgcctgcacatcctggacatcaatgccggcaagagcatccagacccccagcaccaacagccagatctgcagcctcatctggctgcccaagaccaaggagatcgccaccggccagggcacccccaagaatgatgtgacagtgtggacctgccccaccgtgagccgcagcggccaccggggccgggtgctgcacctgagcctgagcccagaccagaccagggtcttctctgctgctgctgatggaacagcctctgtgtggaactgctactag

SEQ ID NO: 35933 - DNA, 1434 bp, Artificial Sequence
  Description of Artificial Sequence: Synthetic coding sequence
atggagtggaagctggagaggacagcccccaggagagtgaggacagaggaggagatgctgtgggagagcatcatgagggtgctgagcaaggacctgaagcagaagaggagccaggacagcgccaacgtgctggacagcgtgaatgccacctacagcgacttcaagagcaactttgccaagaggctgtctgctgaggtgcctgtggccagcagccccatcaccacccgctggcagcagagccagacccgggccctgagcagtgacagctttggagaggagcagagcaccacctacctgcctgaggccagcggctctgtgctgaagaccccacctgagaaggagaccctgaccctgggcagcaggaaggagcagctgaagacccccagcaagggcatcagcgagaccagcaacagcgccctgcacttctgcaaggcccctcatgccatggaccgggactggaaggagagcgtggccagcaagggccagaagtgcctgaagcagctgtttgtgacccagaatgtggtgcagcaggccaacgggaagatgcagctgtgtgagcagagtgaatgtgtgtggaagggctgcaaggatggagtgagagatgagagcttccacctgaagagcagcggggacatcaatgacagcatcctgcagcctgaggtgaagatccacatcaccggcctgagaaatgactactacctgaacatcctggactggagcttccagaacctggtggccatcgccctgggcagcgctgtgtacatctggaatggagagaaccacaacggcattgaaaatattgacctgagcctgacctgcaactacatcagctctgtgtcctggatcaaggagggcacctgcctggccgtgggcaccagcgagggggaggtgcagctgtgggatgtggtgaccaagaagaggctgaggaacatgctgggccacctgtctgtggtgggcgccctgtcctggaaccacttcatcctgagcagcggcagccggctgggccgggtgtaccaccatgatgtgcgggtggcccagcaccacgtgggcaccctgcggcacaagcaggccgtgtgtgccctgaagtggagcccagatggccgcctgctgagcagcggctgcagtgatggcctgctgaccatctggccccatgaccccggggccagcgcccagggccagcccctgaaggtgatcacccagagcacagctgtgaagatctgcagcctcatctggctgcccaagaccaaggagatcgccaccggccagggcacccccaagaatgatgtgacagtgtggacctgccccaccgtgagccgcagcggcggcttcttcggccaccggggccgggtgctgcacctgagcctgagcccagaccagaccagggtcttctctgctgctgctgatggaacagcctctgtgtggaactgctactag

SEQ ID NO: 35934 - DNA, 579 bp, Artificial Sequence
  Description of Artificial Sequence: Synthetic coding sequence
atggagtggaagctggagaggacagcccccaggagagtgaggacagaggaggagatgctgtgggtgctggacagcgtgaatgccacctacagcgacttcaagagcaactttgccaagaggctgtctgctgaggtgcctgtggccagcagccccatcaccacccgctggcagcagagccagacccgggccctgagcagtgacagctttggagaggagcagagcaccacctacctgcctgaggccagcggctctgtgctgaagaccccacctgagaaggagaccctgaccctgggcagcaggaaggagcagctgaagacccccagcaagggcatcagcgagaccagcaacagcgccctgcacttctgcaaggccccccacgccatggaccgggactggaaggagagcgtggccagcaagggccagaagtgcctgaagcagctgtttgtgacccagaatgtggtgcagcaggccaacgggaagatgcagctgtgtgagcagagtgaatgtgtgtggaaggaccacttcagcggctccatgaagaagagatttgagcaggaggatgtgggcggcaaggactag

SEQ ID NO: 35935 - DNA, 1119 bp, Artificial Sequence
  Description of Artificial Sequence: Synthetic coding sequence
atggagtggaagctggagaggacagcccccaggagagtgaggacagaggaggagatgctgtgggagagcatcatgagggtgctgagcaaggacctgaagcagaagaggagccaggacagcgccaacgtgctggacagcgtgaatgccacctacagcgacttcaagagcaactttgccaagaggctgtctgctgaggtgcctgtggccagcagccccatcaccacccgctggcagcagagccagacccgggccctgagcagtgacagctttggagaggagcagagcaccacctacctgcctgaggccagcggctctgtgctgaagaccccacctgagaaggagaccctgaccctgggcagcaggaaggagcagctgaagacccccagcaagggcatcagcgagaccagcaacagcgccctgcacttctgcaaggcccctcatgccatggaccgggactggaaggagagcgtggccagcaagggccagaagtgcctgaagcagctgtttgtgacccagaatgtggtgcagcaggccaacgggaagatgcagctgtgtgagcagagtgaatgtgtgtggaagggctgcaaggatggagtgagagatgagagcttccacctgaagagcagcggggacatcaatgacagcatcctgcagcctgaggtgaagatccacatcaccggcctgagaaatgactactacctgaacatcctggactggagcttccagaacctggtggccatcgccctgggcagcgctgtgtacatctggaatggagagaaccacaacggcattgaaaatattgacctgagcctgacctgcaactacatcagctctgtgtcctggatcaaggagggcacctgcctggccgtgggcaccagcgagggggaggtgcagctgtgggatgtggtgaccaagaagaggctgaggaacatgctgggccacctgtctgtggtgggcgccctgtcctggaaccacttcatcctgagccggctggagttcagcggggtcatcagcgcccactgcaacctgcacctgcccagctcctgggactaccgccggcccccaccctgcctggtgggccaggactggggcgtcttcatcatcaccatgtttggatag

SEQ ID NO: 35936 - DNA, 1560 bp, Artificial Sequence
  Description of Artificial Sequence: Synthetic coding sequence
atggagtggaagctggagaggacagcccccaggagagtgaggacagaggaggagatgctgtgggagagcatcatgagggtgctgagcaaggacctgaagcagaagaggagccaggacagcgccaacgtgctggacagcgtgaatgccacctacagcgacttcaagagcaactttgccaagaggctgtctgctgaggtgcctgtggccagcagccccatcaccacccgctggcagcagagccagacccgggccctgagcagtgacagctttggagaggagcagagcaccacctacctgcctgaggccagcggctctgtgctgaagaccccacctgagaaggagaccctgaccctgggcagcaggaaggagcagctgaagacccccagcaagggcatcagcgagaccagcaacagcgccctgcacttctgcaaggcccctcatgccatggaccgggactggaaggagagcgtggccagcaagggccagaagtgcctgaagcagctgtttgtgacccagaatgtggtgcagcaggccaacgggaagatgcagctgtgtgagcagagtgaatgtgtgtggaagggctgcaaggatggagtgagagatgagagcttccacctgaagagcagcggggacatcaatgacagcatcctgcagcctgaggtgaagatccacatcaccggcctgagaaatgactactacctgaacatcctggactggagcttccagaacctggtggccatcgccctgggcagcgctgtgtacatctggaatggagagaaccacaacggcattgaaaatattgacctgagcctgacctgcaactacatcagctctgtgtcctggatcaaggagggcacctgcctggccgtgggcaccagcgagggggaggtgcagctgtgggatgtggtgaccaagaagaggctgaggaacatgctgggccacctgtctgtggtgggcgccctgtcctggaaccacttcatcctgagcagcggcagccggctgggccgggtgtaccaccatgatgtgcgggtggcccagcaccacgtgggcaccctgcggcacaagcaggccgtgtgtgccctgaagtggagcccagatggccgcctgctgagcagcggctgcagtgatggcctgctgaccatctggccccatgaccccggggccagcgcccagggccagcccctgaaggtgatcacccagagcacagctgtgaaggccatggactggtgcccctggcagagcggcgtgctggccatcggcggcggcatgaaggatggccgcctgcacatcctggacatcaatgccggcaagagcatccagacccccagcaccaacagccagatctgcagcctcatctggctgcccaagaccaaggagatcgccaccggccagggcacccccaagaatgatgtgacagtgtggacctgccccaccgtgagccgcagcggcggcttcttcggccaccggggccgggtgctgcacctgagcctgagcccagaccagaccagggtcttctctgctgctgctgatggaacagcctctgtgtggaactgctactag

SEQ ID NO: 35937 - DNA, 807 bp, Artificial Sequence
  Description of Artificial Sequence: Synthetic coding sequence
atgggcagcgccaagtctgtgcctgtgaccccagcccggcccccaccccacaacaagcacctggcccgggtggccgaccccaggagccccagcgctggcatcctgcggacccccatccaggtggagagcagcccccagcccggcctgcctgctggggagcagctggagggcctgaagcacgcccaggacagcgaccccaggagccccaccctgggcatcgcccggacccccatgaagaccagcagcggggacccccccagccccctggtgaagcagctgtctgaggtgtttgaaacagaggacagcaagagcaacctgcccccagagcctgtgctgcccccagaggcccccctgagcagcgagctggacctgcccctgggcacccagctgtctgtggaggagcagatgccaccctggaaccagacagagttccccagcaagcaggtgttcagcaaggaggaggcccggcagcccacagagacccctgtggccagccagagcagtgacaagcccagccgggaccctgagacccccaggagcagcggctccatgaggaaccgctggaagcccaacagcagcaaggtgctgggccgcagccccctgaccatcctgcaggatgacaacagccctggcaccctgaccctgcggcagggcaagaggcccagccccctgtctgaaaatgtgtctgagctgaaggagggcgccatcctgggcaccggccgcctgctgaagacaggaggccgggcctgggagcagggccaggaccatgacaaggagaaccagcacttccccctggtggagagctag

SEQ ID NO: 35938 - DNA, 435 bp, Artificial Sequence
  Description of Artificial Sequence: Synthetic coding sequence
atggccttcacctttgctgccttctgctacatgctggccctgctgctgacagctgccctgatcttctttgccatctggcacatcatcgcctttgatgagctgaagacagactacaagaaccccatcgaccagtgcaacaccctgaaccccctggtgctgcctgagtacctgattcatgccttcttctgtgtgatgttcctgtgtgccgctgagtggctgaccctgggcctgaacatgcccctgctggcctaccacatctggagatacatgagcaggcctgtgatgagcggccctggcctgtatgaccccaccaccatcatgaatgctgacatcctggcctactgccagaaggagggctggtgcaagctggccttctacctgctggccttcttctactacctgtatggcatgatctacgtgctggtgagcagctag

SEQ ID NO: 35939 - DNA, 225 bp, Artificial Sequence
  Description of Artificial Sequence: Synthetic coding sequence
atgaagttccaggagtgccacagcgaggtgatgagacatggccagaagatctaccccagccaccaccgcatcgagatggctgtggagatcgccagcctgaagtgccagcacagcagcatcaaccagagccccaccaggaagaacagcaacagcaccaccggctggctgctgtgggacctgctgatgggcatcggcaacagcggcagcaatgtggtgctgacctag

SEQ ID NO: 35940 - DNA, 750 bp, Artificial Sequence
  Description of Artificial Sequence: Synthetic coding sequence
atgaccacagctgtggagaggaagtacatcaacatcaggaagaggctggaccagctgggctaccggcagaccctgactgtggagtgcctgcccctggtggagaagctgttcagtgacctggtgcacaccacagagagcctgcggcagagcaagctgtctgctgtgaaggccgagaaggagagcgccaactttgattttgtgctggagccctacaagctggagaatgcccggctgagcagagaaaataatgagctgtacctggagctgatgaagctgcgggagcacagcgaccagcacgtgaaggagctgaagaccagcctgaagaagtgtgcccgggagacagctgacctgaagttcctgaacaaccagtatgcccacaagctgaagctgctggagaaggagagcaaggccaagaatgaaagaatccagcagctgcaggagaagaacctgcatgctgtggtgcagaccccaggcggcaagaagaggagcatcgccttccggcggcagaggatgcagattgatgagcctgtgccccccagcgaggtgagcagctaccctgtgccccagccagatgacccctacatcgctgacctgctgcaggtggccgacaaccgcatccaggagctgcagcaggaggtgcaccagctgcaggagaagctggccatgatggagagcggcgtgcgggactacagcaagcaggtgggcttcctgttcacctgcatcgtgggcatcgagatcggcatgctgtag

SEQ ID NO: 35941 - DNA, 165 bp, Artificial Sequence
  Description of Artificial Sequence: Synthetic coding sequence
atgagcctgcggcggcacatcggcaaccctgagtacctgatgaagaggatcccccagaacccccgctaccagcacatcaagagccggctggacaccggggcctgtgtgtacctgaccagcagccctgccctgcctgactgtgccatgaatggcctgtgcttctag

SEQ ID NO: 35942 - DNA, 411 bp, Artificial Sequence
  Description of Artificial Sequence: Synthetic coding sequence
atgctgagcagcttcaatgagtggttctggcaggaccgcttctggctgcccccaaatgtgacctggacagagctggaggacagagatggccgggtgtacccccacccccaggacctgctggccgccctgcccctggccctggtgctgctggccatgaggctggcctttgagcgcttcatcggcctgcccctgagccgctggctgggcgtgcgggaccagacccggcggcaggtgaagcccaatgccaccctggagaagcacttcctgacagagggccaccggcccaaggagccccagctgagcctgctggccgcccagtgtggcctgaccctgcagcagacccagcgctggttcagaagaagaagaaaccaggaccggccccagctgaccaagaagttctgtgaggcctag

SEQ ID NO: 35943 - DNA, 1398 bp, Artificial Sequence
  Description of Artificial Sequence: Synthetic coding sequence
atgagaagagctgctggcatggaggacttctctgctgaggaggaggagagctggtatgaccagcaggacctggagcaggacctgcacctggccgctgagctgggcaagaccctgctggagaggaacaaggagctggagggcagcctgcagcagatgtacagcaccaatgaggagcaggtgcaggagattgagtacctgaccaagcagctggacaccctgcggcacgtgaatgagcagcacgccaaggtgtatgagcagctggacctgacagcccgggacctggagctgaccaaccaccggctggtgctggagagcaaggccgcccagcagaagatccacggcctgacagagaccatcgagcggctgcaggcccaggtggaggagctgcaggcccaggtggagcagctgcggggcctggagcagctgcgggtgctgcgggagaagcgggagaggaggaggaccatccacaccttcccctgcctgaaggagctgtgcaccagcccccgctgcaaggatgccttccggctgcacagcagcagcctggagctgggcccccggcccctggagcaggagaatgaaaggctgcagaccctggtgggcgccctgcggagccaggtgtcccaggagcggcagaggaaggagcgggcagagcgggagtacacagctgtgctgcaggagtacagcgagctggagcggcagctgtgtgagatggaggcctgccgcctgcgggtgcaggagctggaggccgagctgctggagctgcagcagatgaagcaggccaagacctacctgctgggcccagatgaccacctggccgaggccctgctggcccccctgacccaggcccctgaggctgatgacccccagcccggcagaggagatgacctgggcgcccaggatggagtgagcagccctgctgccagccctggccacgtggtgaggaagagctgcagcgacacagccctgaatgccatcgtggccaaggaccctgccagcagacatgctggcaacctgaccctgcacgccaacagcgtgaggaagaggggcatgagcatcctgcgggaggtggatgagcagtaccacgccctgctggagaagtatgaggagctgctgagcaaatgtcggcagcacggggccggcgtgagacatgctggggtgcagaccagccggcccatcagccgggacagctcctggagggacctgcggggcggggaggagggccagggcgaggtgaaggccggggagaagagcctgagccagcacgtggaggccgtggacaagaggctggagcagagccagcctgagtacaaggccctcttcaaggagatcttcagccgcatccagaagaccaaggctgacatcaatgccaccaaggtgaagacccacagcagcaagtag

SEQ ID NO: 35944 - DNA, 555 bp, Artificial Sequence
  Description of Artificial Sequence: Synthetic coding sequence
atgtgggtgtttggctacggcagcctcatctggaaggtggacttcccctaccaggacaagctggtgggctacatcaccaactacagccgccgcttctggcagggcagcacagaccacagaggagtgcctgggaagccaggccgggtggtgaccctggtggaggaccctgctggctgtgtgtggggcgtggcctaccgcctgcctgtgggcaaggaggaggaggtgaaggcctacctggacttccgggagaagggcggctaccgcaccaccaccgtcatcttctaccccaaggaccccaccaccaagcccttctctgtgctgctgtacatcggcacctgtgacaacccagactacctgggccctgcccccctggaggacattgctgagcagatcttcaatgctgctggccccagcggcaggaacacagagtacctgtttgagctggccaacagcatccggaacctggtgcctgaggaggctgatgagcacctgtttgccctggagaagctggtgaaggagcggctggagggcaagcagaacctgaactgcatctag

SEQ ID NO: 35945 - DNA, 285 bp, Artificial Sequence
  Description of Artificial Sequence: Synthetic coding sequence
atgatgggcctgagcctggccagcgctgtgctgctggccagcctgctgagcctgcacctgggcacagccacccggggcagtgacatcagcaagacctgctgcttccagtacagccacaagcccctgccctggacctgggtgcgctcctatgagttcaccagcaacagctgcagccagagagctgtgatcttcaccaccaagaggggcaagaaggtgtgcacccaccccaggaagaagtgggtgcagaagtacatcagcctgctgaagacccccaagcagctgtag

SEQ ID NO: 35946 - DNA, 729 bp, Artificial Sequence
  Description of Artificial Sequence: Synthetic coding sequence
atgtgggccagccgggaccacctgcctgagccagacctgggagatgctgcccctcctggcagccccagcagcttctggaccagcggcctgccccggcaggagaggagcaccagccggcagaggagccggggcagccccagcagcacctgtgtgccctacaaggtgcacgccctggccacctttgagtgcagcgccaccagccacgccagccggctgtggcagaccctgcagcagttctgggccgaccacatcagccggcccttcagccccaggaggcctcccctgcggaggatgcccagcctgagcaccttctacctgctggaccacaacacccggcaggccgagctgggcctggcctacggggccccctgcatgaggctgagcaaccaggcctttgtgttccggggcggccgctggaccacagagagccagctggcccggaccaggagccccctgctgagcaggacagcctggggctggaaggcccaggtgcagaggagcaagagccaggtgctgctggaggagaacaactacctgaagctgcagcaggagctgctgattgacatgctgacagagaccatggccaggatgcacctgctggagaagcagaggaaccctgaggtgatccccacagctgctgcccgggccggccagaggaagatgaggaagagagctggggccagcgctggggtgctgatgatccagccctgtgccctggacagccagtag

SEQ ID NO: 35947 - DNA, 237 bp, Artificial Sequence
  Description of Artificial Sequence: Synthetic coding sequence
atgtctgccaccacagcctgctggccagccttcaccgtgctgggggaggcccggggggaccaggtggactggagccggctgtacagagacaccggcctggtgaagatgagcaggaagccccgggccagcagccccttcagcaacaaccaccccagcacccccaagcgcttcccccggcagcccaagcgggagaagggccctgtgaaggaggtgcccggcaccaagggcagcccctag

SEQ ID NO: 35948 - DNA, 222 bp, Artificial Sequence
  Description of Artificial Sequence: Synthetic coding sequence
atgtctgccaccacagcctgctggccagccttcaccgtgctgggggaggcccggggggaccaggtggactggagccggctgtacagagacaccggcctggtgaagatgagcaggaagccccgggccagcagccccttcagcaacaaccaccccagcacccccaagaggcggggccggggcaagcaccccctcatccctggccctgaggccctgagcaagtag

SEQ ID NO: 35949 - DNA, 237 bp, Artificial Sequence; identical to SEQ ID NO: 35947
  Description of Artificial Sequence: Synthetic coding sequence

SEQ ID NO: 35950 - DNA, 333 bp, Artificial Sequence
  Description of Artificial Sequence: Synthetic coding sequence
atgtggatgggcctcatccagctggtggagggcgtgaagaggaaggaccagggcttcctggagaaggagttctaccacaagaccaacatcaagatgagatgtgagttcctggcctgctggccagccttcaccgtgctgggggaggcctggagggaccaggtggactggagccggctgctgagagatgctggcctggtgaagatgagcaggaagccccgggccagcagccccctgagcaacaaccacccccccacccccaagcgcttcccccggcagcccggccgggagaagggccccatcaaggaggtgcccggcaccaagggcagcccctag

SEQ ID NO: 35951 - DNA, 492 bp, Artificial Sequence
  Description of Artificial Sequence: Synthetic coding sequence
atgagcaagggcctgctgctgctgctgctgctgtccatgggcggcacctgggccagcaaggagcccctgcggccccgctgccggcccatcaatgccaccctggccgtggagaaggagggctgccctgtgtgcatcaccgtgaacaccaccatctgtgccggctactgccccaccatgaccagggtgctgcagggcgtgctgcctgccctgccccaggtggtgtgcaactacagagatgtgcgctttgagagcatccggctgcccggctgcccccggggcgtgaaccctgtggtgtcctatgctgtggccctgagctgccagtgtgccctgtgccgccgcagcaccacagactgtggcggccccaaggaccaccccctgacctgtgatgacccccgcttccaggccagcagcagcagcaaggcccccccacccagcctgcccagccccagccggctgcccggccccagcgacacccccatcctgccccagtag

SEQ ID NO: 35952 - DNA, 417 bp, Artificial Sequence
  Description of Artificial Sequence: Synthetic coding sequence
atgagcaagggcctgctgctgctgctgctgctgtccatgggcggcacctgggccagcaaggagcccctgcggccccgctgccggcccatcaatgccaccctggccgtggagaaggagggctgccctgtgtgcatcaccgtgaacaccaccatctgtgccggctactgccccaccatgaccagggtgctgcagggcgtgctgcctgccctgccccaggtggtgtgcaactacagagatgtgcgctttgagagcatccggctgcccggctgcccccggggcgtgaaccctgtggtgtcctatgctgtggccctgagctgccagtgtgccctgtgccgccgcagcaccacagactgtggcggccccaaggaccaccccctgacctgtgacccccccctgcccggcctgctcttcctgtag

SEQ ID NO: 35953 - DNA, 492 bp, Artificial Sequence
  Description of Artificial Sequence: Synthetic coding sequence
atgttccagggcctgctgctgctgctgctgctgtccatgggcggcacctgggccagccgggagatgctgcggccccgctgccggcccatcaatgccaccctggccgtggagaaggagggctgccctgtgtgcatcaccgtgaacaccaccatctgtgccggctactgccccaccatgaccagggtgctgcagggcgtgctgcctgccctgccccaggtggtgtgcaactacagagatgtgcgctttgagagcatccggctgcccggctgcccccggggcgtgaaccctgtggtgtcctatgctgtggccctgagctgccagtgtgccctgtgccgccgcagcaccacagactgtggcggccccaaggaccaccccctgacctgtgatgacccccgcttccaggccagcagcagcagcaaggcccccccacccagcctgcccagccccagccggctgcccggccccagcgacacccccatcctgccccagtag

SEQ ID NO: 35954 - DNA, 498 bp, Artificial Sequence
  Description of Artificial Sequence: Synthetic coding sequence
atggagatgttccagggcctgctgctgctgctgctgctgtccatgggcggcacctgggccagccgggagatgctgcggccccgctgccggcccatcaatgccaccctggccgtggagaaggagggctgccctgtgtgcatcaccgtgaacaccaccatctgtgccggctactgccccaccatgaccagggtgctgcagggcgtgctgcctgccctgccccaggtggtgtgcaactacagagatgtgcgctttgagagcatccggctgcccggctgcccccggggcgtgaaccctgtggtgtcctatgctgtggccctgagctgccagtgtgccctgtgccgccgcagcaccacagactgtggcggccccaaggaccaccccctgacctgtgatgacccccgcttccaggccagcagcagcagcaaggcccccccacccagcctgcccagccccagccggctgcccggccccagcgacacccccatcctgccccagtag

SEQ ID NO: 35955 - DNA, 189 bp, Artificial Sequence
  Description of Artificial Sequence: Synthetic coding sequence
atggccagcaacaagaccaccctgcagaagatgggcaagaagcagaatggcaagagcaagaaggtggaggaggccgagcctgaggagtttgtggtggagaaggtgctggaccggcgggtggtgaatggcaaggtggagtacttcctgaagtggaagggcttcacagatgctgacaacacctgggagtag

SEQ ID NO: 35956 - DNA, 2082 bp, Artificial Sequence
  Description of Artificial Sequence: Synthetic coding sequence
atggagcgggccggggccaccagccggggcggccaggcccctggcttcctgctgcggctgcacacagagggccgggcagaggccgcccgggtgcaggagcaggacctgcggcagtggggcctgacagccagcgagctgcacaagctgctgcagcccttcctgctgcggcgggtgaaggccgaggtggccacagagctgcccaagaagacagaggtggtgatctaccacggcatgtctgccctgcagaagaagtactacaaggccatcctgatgaaggacctggatgcctttgaaaatgaaacagccaagaaggtgaagctgcagaacatcctgagccagctgaggaaatgtgtggaccacccctacctgtttgatggagtggagcctgagccctttgaggtgggggaccacctgacagaggccagcggcaagctgcacctgctggacaagctgctggccttcctgtacagcggcggccaccgggtgctgctcttcagccagatgacccagatgctggacatcctgcaggactacatggactaccggggctacagctatgaaagagtggatggctctgtgcggggggaggagcggcacctggccatcaagaactttggccagcagcccatctttgtgttcctgctgagcaccagggctggaggagtgggcatgaacctgacagctgctgacaccgtcatctttgtggacagcgacttcaacccccagaatgacctgcaggccgccgcccgggcccaccgcatcggccagaacaagtctgtgaaggtgatccgcctcatcggccgggacacagtggaggagatcgtgtacaggaaggccgccagcaagctgcagctgaccaacatgatcatcgagggcggccacttcaccctgggcgcccagaagccagctgctgatgctgacctgcagctgtctgagatcctgaagtttggcctggacaagctgctggccagcgagggcagcaccatggatgaaattgacctggagagcatcctgggggagaccaaggatggccagtgggtgtctgatgccctgcctgctgctgagggcggcagccgggaccaggaggagggcaagaaccacatgtacctgtttgagggcaaggactacagcaaggagcccagcaaagaagacaggaagagctttgagcagctggtgaacctgcagaagaccctgctggagaaggccagccaggagggccgcagcctgaggaacaagggctctgtgctgatccctggcctggtggagggcagcaccaagaggaagagggtgctgagccctgaggagctggaggaccggcagaagaagaggcaggaggccgccgccaagagaagaagactcatcgaggagaagaagaggcagaaggaggaggccgagcacaagaagaagatggcctggtgggagagcaacaactaccagagcttctgcctgcccagcgaggagagcgagcctgaggacctggagaatggagaggagagcagcgctgagctggactaccaggaccctgatgccaccagcctgaagtatgtgtctggagatgtgacccacccccaggccggggctgaagatgccctgattgtgcactgtgtggatgattctggccactggggccggggcggcctcttcaccgccctggagaagaggtctgctgagcccaggaagatctatgagctggccggcaagatgaaggacctgagcctgggcggcgtgctgctcttccctgtggatgacaaggagagcagaaataaaggccaggacctgctggccctgattgtggcccagcaccgggacaggagcaatgtgctgagcggcatcaagatggccgccctggaggagggcctgaagaagatcttcctggccgccaagaagaagaaggcctctgtgcacctgcccagaattggacatgccaccaagggcttcaactggtatggaacagagcggctcatcaggaagcacctggccgcccggggcatccccacctacatctactacttccccaggagcaagtctgctgtgctgcacagccagagcagcagcagcagcagccggcagctggtgccctag

SEQ ID NO: 35957 - DNA, 1851 bp, Artificial Sequence
  Description of Artificial Sequence: Synthetic coding sequence
atgtctgccctgcagaagaagtactacaaggccatcctgatgaaggacctggatgcctttgaaaatgaaacagccaagaaggtgaagctgcagaacatcctgagccagctgaggaaatgtgtggaccacccctacctgtttgatggagtggagcctgagccctttgaggtgggggaccacctgacagaggccagcggcaagctgcacctgctggacaagctgctggccttcctgtacagcggcggccaccgggtgctgctcttcagccagatgacccagatgctggacatcctgcaggactacatggactaccggggctacagctatgagcgggtggatggctctgtgcggggggaggagcggcacctggccatcaagaactttggccagcagcccatctttgtgttcctgctgagcacccgggccggcggcgtgggcatgaacctgacagctgctgacaccgtcatctttgtggacagcgacttcaacccccagaatgacctgcaggccgccgcccgggcccacagaattggccagaacaagtctgtgaaggtgatccggctgattggccgggacacagtggaggagatcgtgtacaggaaggccgccagcaagctgcagctgaccaacatgatcattgaaggaggccacttcaccctgggcgcccagaagccagctgctgatgctgacctgcagctgtctgagatcctgaagtttggcctggacaagctgctggccagcgagggcagcaccatggatgaaattgacctggagagcatcctgggggagaccaaggatggccagtgggtgtctgatgccctgcctgctgctgagggcggcagccgggaccaggaggagggcaagaaccacatgtacctgtttgagggcaaggactacagcaaggagcccagcaaggaggacaggaagagctttgagcagctggtgaacctgcagaagaccctgctggagaaggccagccaggagggccgcagcctgagaaataaaggatctgtgctgatccctggcctggtggagggcagcaccaagaggaagagggtgctgagccctgaggagctggaggaccggcagaagaagaggcaggaggccgccgccaagagaagaaggctgattgaggagaagaagaggcagaaggaggaggccgagcacaagaagaagatggcctggtgggagagcaacaactaccagagcttctgcctgcccagcgaggagagcgagcctgaggacctggagaatggagaggagagcagcgctgagctggactaccaggaccctgatgccaccagcctgaagtatgtgtctggagatgtgacccacccccaggccggggctgaagatgccctgattgtgcactgtgtggatgacagcggccactggggccggggcggcctcttcaccgccctggagaagaggtctgctgagcccaggaagatctatgagctggccggcaagatgaaggacctgagcctgggcggcgtgctgctcttccctgtggatgacaaggagagcaggaacaagggccaggacctgctggccctgattgtggcccagcaccgggacaggagcaatgtgctgagcggcatcaagatggccgccctggaggagggcctgaagaagatcttcctggccgccaagaagaagaaggcctctgtgcacctgccccgcatcggccacgccaccaagggcttcaactggtacggcacagagcggctcatcaggaagcacctggccgcccggggcatccccacctacatctactacttccccaggagcaagtctgctgtgctgcacagccagagcagcagcagcagcagccggcagctggtgccctag

SEQ ID NO: 35958 - DNA, 2694 bp, Artificial Sequence
  Description of Artificial Sequence: Synthetic coding sequence
atggagcgggccggggccaccagccggggcggccaggcccctggcttcctgctgcggctgcacacagagggccgggcagaggccgcccgggtgcaggagcaggacctgcggcagtggggcctgaccggcatccacctgcggagctaccagctggagggcgtgaactggctggcccagcgcttccactgccagaatggctgcatcctgggagatgagatgggcctgggcaagacctgccagaccatcgccctcttcatctacctggccggccgcctgaatgatgagggccccttcctgatcctgtgccccctgtctgtgctgagcaactggaaggaggagatgcagagatttgcccctggcctgagctgtgtgacctacgccggggacaaggaggagcgggcctgcctgcagcaggacctgaagcaggagagccgcttccacgtgctgctgaccacctatgagatctgcctgaaggatgccagcttcctgaagagcttcccctggagcgtgctggtggtggatgaggcccaccggctgaagaaccagagcagcctgctgcacaagaccctgtctgagttctctgtggtgttcagcctgctgctgaccggcacccccatccagaacagcctgcaggagctgtacagcctgctgagctttgtggagccagacctcttcagcaaggaggaggtgggggacttcatccagcgctaccaggacatcgagaaggagagcgagagcgccagcgagctgcacaagctgctgcagcccttcctgctgcggcgggtgaaggccgaggtggccacagagctgcccaagaagacagaggtggtgatctaccacggcatgtctgccctgcagaagaagtactacaaggccatcctgatgaaggacctggatgcctttgaaaatgaaacagccaagaaggtgaagctgcagaacatcctgagccagctgaggaaatgtgtggaccacccctacctgtttgatggagtggagcctgagccctttgaggtgggggaccacctgacagaggccagcggcaagctgcacctgctggacaagctgctggccttcctgtacagcggcggccaccgggtgctgctcttcagccagatgacccagatgctggacatcctgcaggactacatggactaccggggctacagctatgaaagagtggatggctctgtgcggggggaggagcggcacctggccatcaagaactttggccagcagcccatctttgtgttcctgctgagcaccagggctggaggagtgggcatgaacctgacagctgctgacaccgtcatctttgtggacagcgacttcaacccccagaatgacctgcaggccgccgcccgggcccaccgcatcggccagaacaagtctgtgaaggtgatccgcctcatcggccgggacacagtggaggagatcgtgtacaggaaggccgccagcaagctgcagctgaccaacatgatcatcgagggcggccacttcaccctgggcgcccagaagccagctgctgatgctgacctgcagctgtctgagatcctgaagtttggcctggacaagctgctggccagcgagggcagcaccatggatgaaattgacctggagagcatcctgggggagaccaaggatggccagtgggtgtctgatgccctgcctgctgctgagggcggcagccgggaccaggaggagggcaagaaccacatgtacctgtttgagggcaaggactacagcaaggagcccagcaaagaagacaggaagagctttgagcagctggtgaacctgcagaagaccctgctggagaaggccagccaggagggccgcagcctgaggaacaagggctctgtgctgatccctggcctggtggagggcagcaccaagaggaagagggtgctgagccctgaggagctggaggaccggcagaagaagaggcaggaggccgccgccaagagaagaagactcatcgaggagaagaagaggcagaaggaggaggccgagcacaagaagaagatggcctggtgggagagcaacaactaccagagcttctgcctgcccagcgaggagagcgagcctgaggacctggagaatggagaggagagcagcgctgagctggactaccaggaccctgatgccaccagcctgaagtatgtgtctggagatgtgacccacccccaggccggggctgaagatgccctgattgtgcactgtgtggatgattctggccactggggccggggcggcctcttcaccgccctggagaagaggtctgctgagcccaggaagatctatgagctggccggcaagatgaaggacctgagcctgggcggcgtgctgctcttccctgtggatgacaaggagagcagaaataaaggccaggacctgctggccctgattgtggcccagcaccgggacaggagcaatgtgctgagcggcatcaagatggccgccctggaggagggcctgaagaagatcttcctggccgccaagaagaagaaggcctctgtgcacctgcccagaattggacatgccaccaagggcttcaactggtatggaacagagcggctcatcaggaagcacctggccgcccggggcatccccacctacatctactacttccccaggagcaagtctgctgtgctgcacagccagagcagcagcagcagcagccggcagctggtgccctag

SEQ ID NO: 35959 - DNA, 1983 bp, Artificial Sequence
  Description of Artificial Sequence: Synthetic coding sequence
atggaggccctgatggcccggggggccctgaccggccccctgcgggccctgtgcctgctgggctgcctgctgagccatgctgctgctgcccccagccccatcatcaagtttcctggagatgtggcccccaagacagacaaggagctggccgtgcagtacctgaacaccttctacggctgccccaaggagagctgcaacctgtttgtgctgaaggacaccctgaagaagatgcagaagttcttcggcctgccccagacaggagacctggaccagaacaccatcgagaccatgaggaagccccgctgtggcaacccagatgtggccaactacaacttcttccccaggaagcccaagtgggacaagaaccagatcacctaccgcatcatcggctacaccccagacctggaccctgagaccgtggatgatgcctttgcccgggccttccaggtgtggagcgatgtgacccccctgcgcttcagccgcatccatgatggagaggccgacatcatgatcaactttggccgctgggagcacggagatggctacccctttgatggcaaggatggcctgctggcccacgcctttgcccctggcactggagtgggcggggacagccactttgatgatgatgagctgtggaccctgggggagggccaggtggtgcgggtgaagtatggaaatgctgatggagagtactgcaagttccccttcctgttcaacgggaaggagtacaacagctgcacagacaccggccgcagtgatggcttcctgtggtgcagcaccacctacaactttgagaaggatggcaagtatggcttctgcccccatgaggccctcttcaccatgggcggcaatgctgagggccagccctgcaagttccccttccgcttccagggcaccagctatgacagctgcaccacagagggccgcacagatggctaccgctggtgtggcaccacagaagattatgaccgggacaagaagtatggcttctgcccagagacagccatgagcacagtgggcggcaacagcgagggcgccccctgtgtgttccccttcaccttcctgggcaacaagtatgagagctgcaccagcgctggccgcagtgatggcaagatgtggtgtgccaccacagccaactatgatgatgacaggaagtggggcttctgcccagaccagggctacagcctcttcctggtggccgcccatgaatttggacatgccatgggcctggagcacagccaggaccccggggccctgatggcccccatctacacctacaccaagaacttccggctgagccaggatgacatcaagggcatccaggagctgtatggagccagcccagacatcgacctgggcaccggccccacccccaccctgggccctgtgaccccagagatctgcaagcaggacatcgtgtttgatggcatcgcccagatccggggggagatcttcttcttcaaggaccgcttcatctggaggacagtgaccccccgggacaagcccatgggccccctgctggtggccaccttctggccagagctgcctgagaagattgatgctgtgtatgaggccccccaggaggagaaggctgtgttctttgctggaaatgagtactggatctacagcgccagcaccctggagcggggctaccccaagcccctgaccagcctgggcctgcccccagatgtgcagagggtggatgctgccttcaactggagcaagaacaagaagacctacatctttgctggggacaagttctggagatacaatgaggtgaagaagaagatggaccccggcttccccaagctgattgctgatgcctggaatgccatcccagacaacctggatgctgtggtggacctgcagggcggcggccacagctacttcttcaagggggcctactacctgaagctggagaaccagagcctgaagtctgtgaagtttggcagcatcaagagtgactggctgggctgctag

SEQ ID NO: 35960 - DNA, 8646 bp, Artificial Sequence
  Description of Artificial Sequence: Synthetic coding sequence
atgacagaccccatgatggacttctttgatgatgccaacctgtttggagagaccctggagggcctgagtgatgatgcctttgtgcagcccggccctgtgtccctggtggatgagctgaacctgggcgctgagtttgagcccctgcacatcgacagcctgaaccacgtgcagggcacccccacccaccagaagatgacagactttgagcagctgaaccagtttgacagcatcaagttccaccacgtgaaccagagctttggcagccctgctgagcacgtgctgagcccccacagccagttcaactgcagccccatccacccccagaaccagcccaacggcctcttcccagatgtgtctgatggcagccccatgtggggccaccagacagccaccaccatcagcaaccagaatggcagccccttccaccagcagggccacagccacagcatgcaccagaacaagagctttgtggcccaccacgactttgccctcttccaggccaatgagcagcagacccagtgcaccagcctgcggagccagcagaacagaaacaacctgaaccctggccagaacagcctgagccagagcaagaacttcatgaatgtgtctggcccccaccgggtgaatgtgaaccaccccccccagatgaccaatgccagcaacagccagcagagcatctccatgcagcagttcagccagaccagcaaccccagcgcccacttccacaagtgcagcagccaccaggagggcaacttcaacggccccagccccaacatgaccagctgcagcgtgagcaacagccagcagttcagcagccactacagcttcagcagcaaccacatcagccccaacagcctgctgcagagcagcgctgtgctggccagcaaccacaccaaccagaccctgagtgacttcaccggcagcaacagcttcagcccccaccggggcatcaagcaggagagcacccagcacatcctgaaccccaacaccagcctgaacagcaacaacttccagatcctgcacagcagccacccccagggcaactacagcaacagcaagctgagccctgtgcacatgaacttcccagaccctgtggacagcggcacccagatgggccacttcaatgaccacgtggagaccaacggcttcagcagcctggaggagaacctgctgcaccaggtggagagccagacagagcccttcaccggcctggaccctgaggacctgctgcaggagggcctgctgccccactttgatgagagcaccttcggccaggacaacagcagccacatcctggaccatgacctggaccggcagttcaccagccacctggtgacccggcccagcgacatggcccagacccagctgcagagccaggcccgctcctggcacagcagcttcagcaaccaccagcacctgcatgacaggaaccacctgtgcctgcagaggcagccccccagcagcaagaagagtgatggcagcggcacctacaccaagctgcagaacacccaggtgcgggtgatgtctgagaagaagcagaggaagaaggtggagagcgagagcaagcaggagaaggccaaccgcatcatcagcgaggccatcgccaaggccaaggagcggggggagaggaacatcccccgggtgatgagccctgagaacttccccacagcctctgtggagggcaaggaggagaagaagggccgcaggatgaagagcaagcccaaggacaaggacagcaagaagaccaagacctgcagcaagctgaaggagaagaccaagattggcaagctgatcatcaccctgggcaagaagcagaagaggaagaatgaaagcagtgatgagatcagtgatgctgagcagatgccccagcacaccctgaaggaccaggacagccagaagaggaggagcaaccggcagatcaagaggaagaagtatgcagaagatattgagggcaagcagagcgaggaggaggtgaagggctccatgaagatcaagaagaacagcgcccccctgcccggggagcagcccctgcagctgtttgtggagaaccccagtgaagaagatgctgccatcgtggacaagatcctgagcagcaggacagtgaagaaggagatcagccctggggtgatgattgacacagaggagttctttgtgaagtacaagaactacagctacctgcactgtgagtgggccacagaggagcagctgctgaaggacaagaggatccagcagaagatcaagcgcttcaagctgcggcaggcccagagggcccacttctttgctgacatggaggaggagcccttcaacccagactatgtggaggtggacagagtgctggaggtgtccttctgtgaggacaaggacacaggagagcccgtcatctactacctggtgaagtggtgcagcctgccctatgaggacagcacctgggagctgaaggaggatgtggacctggccaagattgaggagtttgagcagctgcaggccagcaggccagacacccggcggctggaccggccccccagcaacatctggaagaagattgaccagagccgggactacaagaatggaaaccagctgcgggagtaccagctggagggcctgaactggctgctcttcaactggtacaacagaagaaactgcatcctggctgatgagatgggcctgggcaagaccatccagagcatcaccttcctgtatgagatcctgctgaccggcatccggggccccttcctgatcatcgcccccctgagcaccatcgccaactgggagcgggagttccgcacctggacagacatcaacgtggtggtgtaccacggcagcctcatcagccggcagatgatccagcagtatgagatgtacttccgggacagccagggccgcatcatccggggggcctaccgcttccaggccatcatcaccacctttgagatgatcctgggcggctgtggggagctgaatgccatcgagtggaggtgtgtgatcattgatgaggcccaccggctgaagaacaagaactgcaagctgctggagggcctgaagctgatgaacctggagcacaaggtgctgctgaccggcacccccctgcagaacacagtggaggagctgttcagcctgctgcacttcctggagcccctgcgcttccccagcgagagcaccttcatgcaggagtttggagacctgaagacagaggagcaggtgcagaagctgcaggccatcctgaagcccatgatgctgcggcggctgaaggaggatgtggagaagaagctggcccccaaggaggagaccatcatcgaggtggagctgaccaacatccagaagaagtactaccgggccatcctggagaagaacttctccttcctgagcaaaggagctggccagaccaacgtgcccaacctggtgaacaccatgatggagctgaggaagtgctgcaaccacccctacctgatcaagggagctgaggagaagatcctgggggagttccgggacacctacaacccagctgccagtgacttccacctgcaggccatgatccagagcgctgggaagctggtgctgattgacaagctgctgcccaagatgaaggccggcggccacaaggtgctgatcttcagccagatggtgcgctgcctggacatcctggaggactacctgatccacaagcgctacctgtatgaaagaattgatggccgggtgcggggcaacctgcggcaggccgccatcgaccgcttcagcaagccagacagcgacagatttgtgttcctgctgtgcacccgggccggcggcctgggcatcaacctgacagctgctgacacctgcatcatctttgacagcgactggaacccccagaatgacctgcaggcccaggcccgctgccacagaattggccagaacaaggctgtgaaggtgtaccgcctggtgaccagaaattcctatgaaagagagatgtttgaccgggccagcctgaagctgggcctggacaaggctgtgctgcagagcatgagcggccgggagagcaatgtgggcggcatccagcagctgagcaagaaggagattgaggacctgctgcggcggggggcctatggagccatcatggaggaggaggatgagggcagcaagttctgtgaagaagatattgaccagatcctgctgcggaggaccaagaccatcaccatcgagagcgagggccggggcagcacctttgccaaggccagctttgtggccagcggcaacagaacagacatcagcctggatgaccccaacttctggcagaagtgggccaagaaggccgagattgacatcgaggccatcagcggcaggaacagcctggtgattgacaccccccgcatcaggaagcagacccggcccttcagcgccaccaaggatgagctggccgagctgtctgaggccgagagtgaaggagatgagaagcccaagctgcggcggccctgtgacaggagcaatggctacggccgcacagagtgcttccgggtggagaagaacctgctggtgtatggctggggccgctggagggagatcctgagccacggccgcttcaagaggcagctgaatgaacatgatgtggagatcatctgccgggccctgctggcctactgcctggtgcactacagaggagatgagaagatcaagggcttcatctgggacctgatcacccccacagaagatggccagacccgggagctgcagaaccacctgggcctgagcgcccctgtgccccggggcaggaagggcaagaaggtgaagacccagaccagcagctttgacatccagaaggccgagtggctgaggaagtacaaccctgagcagctgctgcaggatgagggctacaagaagcacatcaagcaccactgcaacaaggtgctgctgcgggtgaggatgctgtactacctgaagcaggaggtgattggaaatgaatgccagaaggtgtttgatggagtggatgccagtgacattgatgtgtgggtgcctgagccagaccacagcgaggtgcctgctgagtggtgggactttgatgctgacaagagcctgctgattggagtcttcaagcacggctatgagaagtacaacaccatccgggctgaccctgccctgtgcttcctggagcgggtgggcaagccagatgagaaggctgtggccgctgagcagagggccaatgactacatggatggagatgtggaggaccctgagtacaagccagccccagccatcttcaaggatgacattgaagatgatgtgagcagccctggggacctggtgattgctgatggagatggccagctgatggagggggacaaggtgtactggcccacccagagcgccctgaccacccggctgcggcggctcatcacagcctaccagaggaccaacaagaaccggcagatccagcagatccagcccaccttctctgtgcccacctctgtgatgcagcccatctatgaggaggccaccctgaaccccaagatggccgccaagattgaaaggcagcagcgctggacccggcgggaggaggccgacttctacagagtggtgtccacctttggagtggtgtttgatcctgaccggggccagtttgactggaccaagttccgggccatggcccggctgcacaagaagacagatgacagcctggagaagtacctgtatgccttcatgtccatgtgcagaagagtgtgccgcctgcccagcaaggaggagctggtggaccccaacatcttcatccagcccatcacagaggagcgggccagcaggaccctgtaccgcatcgagctgctgaggaaggtgcgggagcaggccctgcggcacccccagctgtttgagcggctgaagctgtgccaccccaacccagacctgcctgtgtggtgggagtgtggcccccatgaccgggacctgctgattggagctgccaagcatggagtgtccaggacagactaccacatcctgcgggaccctgagctgtccttcatggccgcccagaggaactacagccagagcaagatggcccacagcaggaccagcacccccctgctgcagcagtaccaggtggccctgagcgccagccccctgaccagcctgccccggctgctggatgccaagggcatcatcctggaggagatgaaggtgaagtctgagaacctgaaggaggagccccagagcagcgaggaggagagcatgagctctgtggagaccaggaccctcatcaagtctgagcctgtgagccccaagaatggagtgctgccccaggccactggagaccagaagagcggcggcaaatgtgaaacagacaggaggatggtggccgccaggacagagcccctgacccccaacccagccagcaagaagccccgggtgcacaagaggggcagcgagagcagcagtgacagcgacagcgacagcgagaggagcagctgcagcagccgcagcagcagcagcagcagcagcagcagctgcagccacagccgcagcggcagcagcagcagcagcagcagcagctgcagcagcgccagcagcagcagcagcagcagcaccagcagcagcagcagcagcagcagcagcagcagcgaggagagtgacagtgatgaggaggaggcccagaagcgggagagcaccacccacatgaaggcctatgatgaggagagcgtggccagcctgagcaccacccaggatgagacccaggacagcttccagatgaacaacggcaccccagagagcgcctacatcctgcagggcggctacatgctggccgccagctactggcccaaggacagagtgatgatcaaccggctggacagcatctgccagacagtgctgaagggcaagtggcccagcgcccggcgctcctatgatgccaacacagtggccagcttctacaccaccaagctgctggacagccctggggccgccacagagtacagcgaccccagcgtgcccaccccacctggagctggggtgaaggaggagcatgaccagagcacccagatgagcaaggagggcggcctgaagctgaccttccagaagcagggcctggcccagaagaggccctttgatggagaagatggagccctgggccagcagcagtacctgacccggctgcgggagctgcagagcgccagcgagaccagcctggtgaacttccccaagagcatccctgtgtctggcaccagcatccagcccaccctgggcgccaacggggtcatcctggacaaccagcccatcgtgaagaagagaagaggccgcaggaagaatgtggagggcgtggacatcttcttcttcaacagaaacaagccacccaaccacgtgtccctgggcctgaccagcagccagatcagcacaggcatcaacccagccctgagctacacccagccccagggcatcccagacacagagagccctgtgcctgtgatcaacctgaaggatggcacccggctggccggagatgatgcccccaagaggaaggacctggagaagtggctgaaggagcaccctggctacgtggaggacctgggcgccttcatccccaggatgcagctgcacgagggccggcccaagcagaagaggcaccgctgcaggaaccccaacaagctggatgtgaacagcctgaccggggaggagcgggtgcagctgatcaacagaagaaatgccaggaaggtgggcggggcctttgccccacccctgaaggacctgtgccgcttcctgaaggaaaattctgaatatggagtggcccctgagtggggagatgtggtgaagcagagcggcttcctgcctgagagcatgtatgaaagaatcctgactggacctgtggtgcgggaggaggtgtccagaagaggccggcggcccaagagcggcatcgccaaggccacagctgctgctgctgctgccagcgccacctctgtgtctggcaaccccctgctggccaacggcctgctgcccggggtggacctgaccaccctgcaggccctgcagcagaacctgcagaacctgcagagcctgcaggtgacagctggcctgatgggcatgcccaccggcctgcccagcggcggggaggccaagaacatggccgccatgttccccatgctgctgagcggcatggccggcctgcccaacctgctgggcatgggcggcctgctgaccaagcccacagaaagtggcacagaggacaagaagggcagtgacagcaaggagagcgagggcaagacagagaggacagagagccagagcagtgaaaatggaggagaaaattctgtgagcagcagccccagcaccagcagcacagctgccctgaacacagctgctgctgccaaccccctggccctgaaccccctgctgctgagcaacatcctgtacccaggcatgctgctgaccccaggcctgaacctgcacatccccaccctgagccagagcaacacctttgatgtgcagaacaagaacagcgacctgggcagcagcaagtctgtggaggtgaaggaggaggacagccgcatcaaggaccaggaggacaagggcggcacagagcccagccccctgaatgaaaacagcacagatgagggcagcgagaaggcagatgccagcagcggcagtgacagcaccagcagcagcagtgaagattctgacagcagcaatgaagattag

SEQ ID NO: 35961 - DNA, 8649 bp, Artificial Sequence
  Description of Artificial Sequence: Synthetic coding sequence
atgacagaccccatgatggacttctttgatgatgccaacctgtttggagagaccctggagggcctgagtgatgatgcctttgtgcagcccggccctgtgtccctggtggatgagctgaacctgggcgctgagtttgagcccctgcacatcgacagcctgaaccacgtgcagggcacccccacccaccagaagatgacagactttgagcagctgaaccagtttgacagcatcaagttccaccacgtgaaccagagctttggcagccctgctgagcacgtgctgagcccccacagccagttcaactgcagccccatccacccccagaaccagcccaacggcctcttcccagatgtgtctgatggcagccccatgtggggccaccagacagccaccaccatcagcaaccagaatggcagccccttccaccagcagggccacagccacagcatgcaccagaacaagagctttgtggcccaccacgactttgccctcttccaggccaatgagcagcagacccagtgcaccagcctgcggagccagcagaacagaaacaacctgaaccctggccagaacagcctgagccagagcaagaacttcatgaatgtgtctggcccccaccgggtgaatgtgaaccaccccccccagatgaccaatgccagcaacagccagcagagcatctccatgcagcagttcagccagaccagcaaccccagcgcccacttccacaagtgcagcagccaccaggagggcaacttcaacggccccagccccaacatgaccagctgcagcgtgagcaacagccagcagttcagcagccactacagcttcagcagcaaccacatcagccccaacagcctgctgcagagcagcgctgtgctggccagcaaccacaccaaccagaccctgagtgacttcaccggcagcaacagcttcagcccccaccggggcatcaagcaggagagcacccagcacatcctgaaccccaacaccagcctgaacagcaacaacttccagatcctgcacagcagccacccccagggcaactacagcaacagcaagctgagccctgtgcacatgaacttcccagaccctgtggacagcggcacccagatgggccacttcaatgaccacgtggagaccaacggcttcagcagcctggaggagaacctgctgcaccaggtggagagccagacagagcccttcaccggcctggaccctgaggacctgctgcaggagggcctgctgccccactttgatgagagcaccttcggccaggacaacagcagccacatcctggaccatgacctggaccggcagttcaccagccacctggtgacccggcccagcgacatggcccagacccagctgcagagccaggcccgctcctggcacagcagcttcagcaaccaccagcacctgcatgacaggaaccacctgtgcctgcagaggcagccccccagcagcaagaagagtgatggcagcggcacctacaccaagctgcagaacacccaggtgcgggtgatgtctgagaagaagcagaggaagaaggtggagagcgagagcaagcaggagaaggccaaccgcatcatcagcgaggccatcgccaaggccaaggagcggggggagaggaacatcccccgggtgatgagccctgagaacttccccacagcctctgtggagggcaaggaggagaagaagggccgcaggatgaagagcaagcccaaggacaaggacagcaagaagaccaagacctgcagcaagctgaaggagaagaccaagattggcaagctgatcatcaccctgggcaagaagcagaagaggaagaatgaaagcagtgatgagatcagtgatgctgagcagatgccccagcacaccctgaaggaccaggacagccagaagaggaggagcaaccggcagatcaagaggaagaagtatgcagaagatattgagggcaagcagagcgaggaggaggtgaagggctccatgaagatcaagaagaacagcgcccccctgcccggggagcagcccctgcagctgtttgtggagaaccccagtgaagaagatgctgccatcgtggacaagatcctgagcagcaggacagtgaagaaggagatcagccctggggtgatgattgacacagaggagttctttgtgaagtacaagaactacagctacctgcactgtgagtgggccacagaggagcagctgctgaaggacaagaggatccagcagaagatcaagcgcttcaagctgcggcaggcccagagggcccacttctttgctgacatggaggaggagcccttcaacccagactatgtggaggtggacagagtgctggaggtgtccttctgtgaggacaaggacacaggagagcccgtcatctactacctggtgaagtggtgcagcctgccctatgaggacagcacctgggagctgaaggaggatgtggacctggccaagattgaggagtttgagcagctgcaggccagcaggccagacacccggcggctggaccggccccccagcaacatctggaagaagattgaccagagccgggactacaagaatggaaaccagctgcgggagtaccagctggagggcctgaactggctgctcttcaactggtacaacagaagaaactgcatcctggctgatgagatgggcctgggcaagaccatccagagcatcaccttcctgtatgagatcctgctgaccggcatccggggccccttcctgatcatcgcccccctgagcaccatcgccaactgggagcgggagttccgcacctggacagacatcaacgtggtggtgtaccacggcagcctcatcagccggcagatgatccagcagtatgagatgtacttccgggacagccagggccgcatcatccggggggcctaccgcttccaggccatcatcaccacctttgagatgatcctgggcggctgtggggagctgaatgccatcgagtggaggtgtgtgatcattgatgaggcccaccggctgaagaacaagaactgcaagctgctggagggcctgaagctgatgaacctggagcacaaggtgctgctgaccggcacccccctgcagaacacagtggaggagctgttcagcctgctgcacttcctggagcccctgcgcttccccagcgagagcaccttcatgcaggagtttggagacctgaagacagaggagcaggtgcagaagctgcaggccatcctgaagcccatgatgctgcggcggctgaaggaggatgtggagaagaagctggcccccaaggaggagaccatcatcgaggtggagctgaccaacatccagaagaagtactaccgggccatcctggagaagaacttctccttcctgagcaaaggagctggccagaccaacgtgcccaacctggtgaacaccatgatggagctgaggaagtgctgcaaccacccctacctgatcaagggagctgaggagaagatcctgggggagttccgggacacctacaacccagctgccagtgacttccacctgcaggccatgatccagagcgctgggaagctggtgctgattgacaagctgctgcccaagatgaaggccggcggccacaaggtgctgatcttcagccagatggtgcgctgcctggacatcctggaggactacctgatccacaagcgctacctgtatgaaagaattgatggccgggtgcggggcaacctgcggcaggccgccatcgaccgcttcagcaagccagacagcgacagatttgtgttcctgctgtgcacccgggccggcggcctgggcatcaacctgacagctgctgacacctgcatcatctttgacagcgactggaacccccagaatgacctgcaggcccaggcccgctgccacagaattggccagaacaaggctgtgaaggtgtaccgcctggtgaccagaaattcctatgaaagagagatgtttgaccgggccagcctgaagctgggcctggacaaggctgtgctgcagagcatgagcggccgggagagcaatgtgggcggcatccagcagctgagcaagaaggagattgaggacctgctgcggcggggggcctatggagccatcatggaggaggaggatgagggcagcaagttctgtgaagaagatattgaccagatcctgctgcggaggaccaagaccatcaccatcgagagcgagggccggggcagcacctttgccaaggccagctttgtggccagcggcaacagaacagacatcagcctggatgaccccaacttctggcagaagtgggccaagaaggccgagattgacatcgaggccatcagcggcaggaacagcctggtgattgacaccccccgcatcaggaagcagacccggcccttcagcgccaccaaggatgagctggccgagctgtctgaggccgagagtgaaggagatgagaagcccaagctgcggcggccctgtgacaggagcaatggctacggccgcacagagtgcttccgggtggagaagaacctgctggtgtatggctggggccgctggagggagatcctgagccacggccgcttcaagaggcagctgaatgaacatgatgtggagatcatctgccgggccctgctggcctactgcctggtgcactacagaggagatgagaagatcaagggcttcatctgggacctgatcacccccacagaagatggccagacccgggagctgcagaaccacctgggcctgagcgcccctgtgccccggggcaggaagggcaagaaggtgaagacccagaccagcagctttgacatccagaaggccgagtggctgaggaagtacaaccctgagcagctgctgcaggatgagggctacaagaagcacatcaagcaccactgcaacaaggtgctgctgcgggtgaggatgctgtactacctgaagcaggaggtgattggaaatgaatgccagaaggtgtttgatggagtggatgccagtgacattgatgtgtgggtgcctgagccagaccacagcgaggtgcctgctgagtggtgggactttgatgctgacaagagcctgctgattggagtcttcaagcacggctatgagaagtacaacaccatccgggctgaccctgccctgtgcttcctggagcgggtgggcaagccagatgagaaggctgtggccgctgagcagagggccaatgactacatggatggagatgtggaggaccctgagtacaagccagccccagccatcttcaaggatgacattgaagatgatgtgagcagccctggggacctggtgattgctgatggagatggccagctgatggagggggacaaggtgtactggcccacccagagcgccctgaccacccggctgcggcggctcatcacagcctaccagaggaccaacaagaaccggcagatccagcagatccagcccaccttctctgtgcccacctctgtgatgcagcccatctatgaggaggccaccctgaaccccaagatggccgccaagattgaaaggcagcagcgctggacccggcgggaggaggccgacttctacagagtggtgtccacctttggagtggtgtttgatcctgaccggggccagtttgactggaccaagttccgggccatggcccggctgcacaagaagacagatgacagcctggagaagtacctgtatgccttcatgtccatgtgcagaagagtgtgccgcctgcccagcaaggaggagctggtggaccccaacatcttcatccagcccatcacagaggagcgggccagcaggaccctgtaccgcatcgagctgctgaggaaggtgcgggagcaggccctgcggcacccccagctgtttgagcggctgaagctgtgccaccccaacccagacctgcctgtgtggtgggagtgtggcccccatgaccgggacctgctgattggagctgccaagcatggagtgtccaggacagactaccacatcctgcgggaccctgagctgtccttcatggccgcccagaggaactacagccagagcaagatggcccacagcaggaccagcacccccctgctgcagcagtaccaggtggccctgagcgccagccccctgaccagcctgccccggctgctggatgccaagggcatcatcctggaggagatgaaggtgaagtctgagaacctgaaggaggagccccagagcagcgaggaggagagcatgagctctgtggagaccaggaccctcatcaagtctgagcctgtgagccccaagaatggagtgctgccccaggccactggagaccagaagagcggcggcaaatgtgaaacagacaggaggatggtggccgccaggacagagcccctgacccccaacccagccagcaagaagccccgggtgcacaagaggggcagcgagagcagcagtgacagcgacagcgacagcgagaggagcagctgcagcagccgcagcagcagcagcagcagcagcagcagctgcagccacagccgcagcggcagcagcagcagcagcagcagcagctgcagcagcgccagcagcagcagcagcagcagcaccagcagcagcagcagcagcagcagcagcagcagcgaggagagtgacagtgatgaggaggaggcccagaagagagctgagagcaccacccacatgaaggcctatgatgaggagagcgtggccagcctgagcaccacccaggatgagacccaggacagcttccagatgaacaacggcaccccagagagcgcctacatcctgcagggcggctacatgctggccgccagctactggcccaaggacagagtgatgatcaaccggctggacagcatctgccagacagtgctgaagggcaagtggcccagcgcccggcgctcctatgatgccaacacagtggccagcttctacaccaccaagctgctggacagccctggagctgccacagagtacagcgaccccagcgtgcccaccccacctggggccggcgtgaaggaggagcatgaccagagcacccagatgagcaaggagggcggcctgaagctgaccttccagaagcagggcctggcccagaagaggccctttgatggagaagatggagccctgggccagcagcagtacctgacccggctgcgggagctgcagagcgccagcgagaccagcctggtgaacttccccaagagcatccctgtgtctggcaccagcatccagcccaccctgggcgccaatggagtcatcctggacaaccagcccatcgtgaagaagaggcggggccgcaggaagaatgtggagggcgtggacatcttcttcttcaacagaaacaagccacccaaccacgtgtccctgggcctgaccagcagccagatcagcacaggcatcaacccagccctgagctacacccagccccagggcatcccagacacagagagccctgtgcctgtgatcaacctgaaggatggcacccggctggccggagatgatgcccccaagaggaaggacctggagaagtggctgaaggagcaccctggctacgtggaggacctgggcgccttcatccccaggatgcagctgcacgagggccggcccaagcagaagaggcaccgctgcaggaaccccaacaagctggatgtgaacagcctgactggagaggagcgggtgcagctgatcaacagaagaaatgccaggaaggtgggcggggcctttgccccacccctgaaggacctgtgccgcttcctgaaggagaacagtgaatatggagtggcccctgagtggggagatgtggtgaagcagagcggcttcctgcctgagagcatgtatgagcgcatcctgaccggccctgtggtgcgggaggaggtgtcccggcggggcagaagacccaagtctggaattgccaaggccacagctgctgctgctgctgccagcgccacctctgtgtctggcaaccccctgctggccaacggcctgctgcccggggtggacctgaccaccctgcaggccctgcagcagaacctgcagaacctgcagagcctgcaggtgacagctggcctgatgggcatgcccaccggcctgcccagcggcggggaggccaagaacatggccgccatgttccccatgctgctgagcggcatggccggcctgcccaacctgctgggcatgggcggcctgctgaccaagcccacagagagcggcacagaggacaagaagggcagtgacagcaaggagagcgagggcaagacagagaggacagagagccagagcagtgaaaatggaggagagaacagcgtgagcagcagccccagcaccagcagcacagctgccctgaacacagctgctgctgccaaccccctggccctgaaccccctgctgctgagcaacatcctgtacccaggcatgctgctgaccccaggcctgaacctgcacatccccaccctgagccagagcaacacctttgatgtgcagaacaagaacagcgacctgggcagcagcaagtctgtggaggtgaaggaggaggacagccgcatcaaggaccaggaggacaagggcggcacagagcccagccccctgaatgaaaacagcacagatgagggcagcgagaaggcagatgccagcagcggcagtgacagcaccagcagcagcagcgaggacagcgacagcagcaatgaagattag

SEQ ID NO: 35962 - DNA, 2892 bp, Artificial Sequence
  Description of Artificial Sequence: Synthetic coding sequence
atgctgtactacctgaagcaggaggtgattggaaatgaatgccagaaggtgtttgatggagtggatgccagtgacattgatgtgtgggtgcctgagccagaccacagcgaggtgcctgctgagtggtgggactttgatgctgacaagagcctgctgattggagtcttcaagcacggctatgagaagtacaacaccatccgggctgaccctgccctgtgcttcctggagcgggtgggcaagccagatgagaaggctgtggccgctgagcagagggccaatgactacatggatggagatgtggaggaccctgagtacaagccagccccagccatcttcaaggatgacattgaagatgatgtgagcagccctggggacctggtgattgctgatggagatggccagctgatggagggggacaaggtgtactggcccacccagagcgccctgaccacccggctgcggcggctcatcacagcctaccagaggaccaacaagaaccggcagatccagcagatccagcccaccttctctgtgcccacctctgtgatgcagcccatctatgaggaggccaccctgaaccccaagatggccgccaagattgaaaggcagcagcgctggacccggcgggaggaggccgacttctacagagtggtgtccacctttggagtggtgtttgatcctgaccggggccagtttgactggaccaagttccgggccatggcccggctgcacaagaagacagatgacagcctggagaagtacctgtatgccttcatgtccatgtgcagaagagtgtgccgcctgcccagcaaggaggagagcaccacccacatgaaggcctatgatgaggagagcgtggccagcctgagcaccacccaggatgagacccaggacagcttccagatgaacaacggcaccccagagagcgcctacatcctgcagggcggctacatgctggccgccagctactggcccaaggacagagtgatgatcaaccggctggacagcatctgccagacagtgctgaagggcaagtggcccagcgcccggcgctcctatgatgccaacacagtggccagcttctacaccaccaagctgctggacagccctggggccgccacagagtacagcgaccccagcgtgcccaccccacctggagctggggtgaaggaggagcatgaccagagcacccagatgagcaaggtgaagaagcacgtgcgggagaaggagttcaccgtgaagatcaaggatgaaggaggcctgaagctgaccttccagaagcagggcctggcccagaagaggccctttgatggagaagatggagccctgggccagcagcagtacctgacccggctgcgggagctgcagagcgccagcgagaccagcctggtgaacttccccaagagcatccctgtgtctggcaccagcatccagcccaccctgggcgccaacggggtcatcctggacaaccagcccatcgtgaagaagagaagaggccgcaggaagaatgtggagggcgtggacatcttcttcttcaacagaaacaagccacccaaccacgtgtccctgggcctgaccagcagccagatcagcacaggcatcaacccagccctgagctacacccagccccagggcatcccagacacagagagccctgtgcctgtgatcaacctgaaggatggcacccggctggccggagatgatgcccccaagaggaaggacctggagaagtggctgaaggagcaccctggctacgtggaggacctgggcgccttcatccccaggatgcagctgcacgagggccggcccaagcagaagaggcaccgctgcaggaaccccaacaagctggatgtgaacagcctgaccggggaggagcgggtgcagctgatcaacagaagaaatgccaggaaggtgggcggggcctttgccccacccctgaaggacctgtgccgcttcctgaaggaaaattctgaatatggagtggcccctgagtggggagatgtggtgaagcagagcggcttcctgcctgagagcatgtatgaaagaatcctgactggacctgtggtgcgggaggaggtgtccagaagaggccggcggcccaagagcggcatcgccaaggccacagctgctgctgctgctgccagcgccacctctgtgtctggcaaccccctgctggccaacggcctgctgcccggggtggacctgaccaccctgcaggccctgcagcagaacctgcagaacctgcagagcctgcaggtgacagctggcctgatgggcatgcccaccggcctgcccagcggcggggaggccaagaacatggccgccatgttccccatgctgctgagcggcatggccggcctgcccaacctgctgggcatgggcggcctgctgaccaagcccacagaaagtggcacagaggacaagaagggcagtgacagcaaggagagcgagggcaagacagagaggacagagagccagagcagtgaaaatggaggagaaaattctgtgagcagcagccccagcaccagcagcacagctgccctgaacacagctgctgctgccaaccccctggccctgaaccccctgctgctgagcaacatcctgtacccaggcatgctgctgaccccaggcctgaacctgcacatccccaccctgagccagagcaacacctttgatgtgcagaacaagaacagcgacctgggcagcagcaagtctgtggaggtgaaggaggaggacagccgcatcaaggaccaggaggacaagggcggcacagagcccagccccctgaatgaaaacagcacagatgagggcagcgagaaggcagatgccagcagcggcagtgacagcaccagcagcagcagtgaagattctgacagcagcaatgaagattag

SEQ ID NO: 35963 - DNA, 8646 bp, Artificial Sequence; identical to SEQ ID NO: 35960
  Description of Artificial Sequence: Synthetic coding sequence

SEQ ID NO: 35964 - DNA, 444 bp, Artificial Sequence
  Description of Artificial Sequence: Synthetic coding sequence
atgacagccatccggctgcgggagttcatcgagcggcggcctgtgattcctccttccatcttcatcgcccaccagggcagagatgtgcagggctactacccaggccagctggcccggctgcactttgaccacagcgccaagagggccccccggcccctgattgacctgaccatcccccccaagaccaagtaccactaccagccccagctggaccagcagaccctcatccgctacatctgcctgcggcggcacagcaagccagctgagccctggtacaaggagaccacctaccgccgggactacagcctgcccttctatgaaattgactggaaccagaagctggccaccgtgtccctgaacccccggcccctgaacagcctgcctgagctgtactgctgtgaggagaggagcagctttgaaagaaatgccttcaagctgaagtag

SEQ ID NO: 35965 - DNA, 348 bp, Artificial Sequence
  Description of Artificial Sequence: Synthetic coding sequence
atgacagccatccggctgcgggagttcatcgagcggcggcctgtgattcctccttccatcttcatcgcccaccagggcagagatgtgcagggctactacccaggccagctggcccggctgcactttgaccacagcgccaagagggcccccaggcacagcaagccagctgagccctggtacaaggagaccacctaccgccgggactacagcctgcccttctatgaaattgactggaaccagaagctggccaccgtgtccctgaacccccggcccctgaacagcctgcctgagctgtactgctgtgaggagaggagcagctttgaaagaaatgccttcaagctgaagtag

SEQ ID NO: 35966 - DNA, 552 bp, Artificial Sequence
  Description of Artificial Sequence: Synthetic coding sequence
atggagaagcgggagctgaaggcctctgtgcccaagtttgacaagatcccctggctgtctgaggccagcctggtgaacaagcccctggtgctgagcctgccccggcgctacccccacaccagcgccaccttcctgaccagcagcaagaagaacatgaacctgcccatcctcttccaggtgcctgatgtgctgagcaaggcccggaggaaccagtgtgacagcatgctgctgaggaaccagcagctgtgcagcacctgccaggagatgaagatggtgcagcccaggaccatgaagatcccagatgaccccaaggccagctttgagaactgcatgagctacaggatgagcctgcaccagcccaagttccagaccaccccagagcccttccatgatgacatccccacagagagcatccactaccgcctgcccatcctgggccccaggacagctgtgttccacggcctgctgacagaggcctacaagaccctgaaggagcggcagaggagcagcctgcccaggaaggagcccatcggcaagaccacccggcagtag

SEQ ID NO: 35967 - DNA, 1992 bp, Artificial Sequence
  Description of Artificial Sequence: Synthetic coding sequence
atgctgcagatgcccaagctgaatgagatccccccaggccgggccggcagaagagaggcccggggggagggccgctggccaggccagacaggccctgaggccgcccggctggagtggagggcccagggccaggccggcggggcccgggccccctgggacagctggggcagcagccggctgcccacccagcccggccctggctggagccgctgcccccccagcctgctgtgtgccctgtccttccagaagagcaccatggagagcaaggatgaggtgtctgacacagattctggcatcatcctgcagagcggccctgacagccctgtgagccccatgaaggagctgacccatgctgtgcacaagcagcagagggccctggaggcccggctggaggcctgcctggaggagctgcggcggctgtgcctgcgggaggccgagctgaccggcaccctgcctgctgagtaccccctgaagccaggagagaaggcccccaaggtgagaagacgcatcggggccgcctacaagctggatgactgggccctgcaccgggaggaccccctgagcagcctggagcggcagctggccctgcagctgcagatcacagaagctgcccggcggctgtgcctggaggagaacctgagccggcaggcccggcggcagaggaagcacagcatgctgcaggaggagaagaagctgcaggagctgcagcgctgcctggtggagaggagaagaaacagcgagcccccacctgctgctgccctgcccctgggccgggagctgagcgccagtgatgacagcagcctgagtgatggcctgctgctggaggaggaggagagccaggtgcccaagcccccacctgagagccctgccccacccagccggcccctgcccccccagaccctggagggcctgcagcccactggacctgaggccggcagccctgagcgggcccctgtgcagaacagcccctggaaggagaccagcctggaccacccctatgagaagcccaggaagagcagcgagccctggagcgagagcagcagccctgccaccaccccccaggacggccccagcgccagcagcctgtggctgctggagcccgccagctaccacgtggtgcccatccggggcgtgcccggccagtggcagggccgcaccagcgccccagccaccccagagatccagggcagaagaggccagagccagagcctgcgggtggacagcttccgggccggccctgagggccggggccgcagcgccttcccccggcggcggcccacccactacacagtgacagtgcctgacagctgcttccctgccaccaagccacccctgccccacgccgcctgccacagctgcagtgaagattctggcagtgatgtgagcagcatcagccaccccaccagccctggcagcagcagcccagacatctccttcctgcagcccctgagcccccccaagacccaccgccacagaggagcctgggtgcctgctggcagccgggagctggtggcccaccaccccaagctgctgctgcccccaggctacttccctgctggccgctacgtggtggtggccgagagccccctgcccccaggagagtgggagctgcggcgggccgcccctggccctgcctatgaggaggagggcacccccctgcgctaccagaggctggtgcccagccgcagcagaattgtgaggacccccagcctgaaggacagccctgctggccggggcctgagcaaggctgctgtgtctgaggagctgaagtggtggcatgagcgggcccggctgcggagcacccggccccacagcctggaccggcagggcgccttccgggtgcgcagcctgcccctgggccgggagggcttcggccgggccctgggcccccgggcccaggtgcccaccgtgtgtgtgctgcggcgcagcccagatggagcccctgtgcaggtgtttgtgcctgagaagggggagatcatcagccaggtgtag

SEQ ID NO: 35968 - DNA, 1737 bp, Artificial Sequence
  Description of Artificial Sequence: Synthetic coding sequence
atggagagcaaggatgaggtgtctgacacagacagcggcatcatcctgcagagcggccctgacagccctgtgagccccatgaaggagctgacccatgctgtgcacaagcagcagagggccctggaggcccggctggaggcctgcctggaggagctgcggcggctgtgcctgcgggaggccgagctgaccggcaccctgcctgctgagtaccccctgaagccaggagagaaggcccccaaggtgagaagaagaattggagctgcctacaagctggatgactgggccctgcaccgggaggaccccctgagcagcctggagcggcagctggccctgcagctgcagatcacagaggccgcccggcggctgtgcctggaggagaacctgagccggcaggcccggcggcagaggaagcacagcatgctgcaggaggagaagaagctgcaggagctgcagcgctgcctggtggagaggagaagaaattctgagcccccacctgctgctgccctgcccctgggccgggagctgagcgccagtgatgacagcagcctgagtgatggcctgctgctggaggaggaggagagccaggtgcccaagcccccacctgagagccctgccccacccagccggcccctgcccccccagaccctggagggcctgcagcccaccggccctgaggccggcagccctgagcgggcccctgtgcagaacagcccctggaaggagaccagcctggaccacccctatgagaagcccaggaagagcagcgagccctggagcgagagcagcagccctgccaccaccccccaggacggccccagcgccagcagcctgtggctgctggagcccgccagctaccacgtggtgcccatccggggcgtgcccggccagtggcagggccgcaccagcgccccagccaccccagagatccagggccggcggggccagagccagagcctgcgggtggacagcttccgggccggccctgagggccggggccgcagcgccttccccaggagaagacccacccactacacagtgacagtgcctgacagctgcttccctgccaccaagccacccctgccccatgctgcctgccacagctgcagcgaggacagcggcagtgatgtgagcagcatcagccaccccaccagccctggcagcagcagcccagacatctccttcctgcagcccctgagcccccccaagacccaccgccacagaggagcctgggtgcctgctggcagccgggagctggtggcccaccaccccaagctgctgctgcccccaggctacttccctgctggccgctacgtggtggtggccgagagccccctgcccccaggagagtgggagctgcggcgggccgcccctggccctgcctatgaggaggagggcacccccctgcgctaccagaggctggtgcccagccgcagccgcatcgtgaggacccccagcctgaaggacagccctgctggccggggcctgagcaaggctgctgtgtctgaggagctgaagtggtggcatgagcgggcccggctgcggagcacccggccccacagcctggaccggcagggcgccttccgggtgcgcagcctgcccctgggccgggagggcttcggccgggccctgggcccccgggcccaggtgcccaccgtgtgtgtgctgcggcgcagcccagatggagcccctgtgcaggtgtttgtgcctgagaagggggagatcatcagccaggtgtag

SEQ ID NO: 35969 - DNA, 372 bp, Artificial Sequence
  Description of Artificial Sequence: Synthetic coding sequence
atggagagcaaggatgaggtgtctgacacagacagcggcatcatcctgcagagcggccctgacagccctgtgagccccatgaaggagctgacccatgctgtgcacaagcagcagagggccctggaggcccggctggaggcctgcctggaggagctgcggcggctgtgcctgcgggaggccgagctgaccggcaccctgcctgctgagtaccccctgaagccaggagagaaggcccccaaggtgagaagaagaattggagctgcctacaagctggatgactgggccctgcaccgggaggaccccctgagcagcctggagcggcagctggccctgcagctgcagatcacagaggccgcccggcggctgtgctag

SEQ ID NO: 35970 - DNA, 123 bp, Artificial Sequence
  Description of Artificial Sequence: Synthetic coding sequence
atggagagcaaggatgaggtgtctgacacagacagcggcatcatcctgcagagcggccctgacagccctgtgagccccatgaaggagctgacccatgctgtgcacaagcagcagagggcctag

SEQ ID NO: 35971 - DNA, 612 bp, Artificial Sequence
  Description of Artificial Sequence: Synthetic coding sequence
atgacccaggaccggcccctgctggccgtgcaggaggccctgaagaagtgcttccctgtggtggaggagcagcagggcctgtggcagagcgccctgcgggactgccagcccctgctgagcagcctgagcaacctggccgagcagctgcaggccgcccagaacctgcgctttgaagatgtgcctgccctgcgggccttcccagacctgaaggagcggctgcggaggaagcagctggtggccggggacatcgtgctggacaagctgggggagcggctggccatcctgctgaaggtgcgggacatggtgagcagccacgtggagagggtcttccagatctatgagcagcacgccgacacagtgggcattgatgctgtgctgcagcccagcgctgtgagccccagcgtggccgacatgctggagtggctgcaggacatcgagcggcactacaggaagagctacctgaagaggaagtacctgctgagcagcatccagtggggagacctggccaacatccaggccctgcccaaggcctgggaccgcatcagcaaggatgagcaccaggacctggtgcaggacatcctgctgaatgtgtccttcttcctggaggagtag

SEQ ID NO: 35972 - DNA, 909 bp, Artificial Sequence
  Description of Artificial Sequence: Synthetic coding sequence
atggagcggcacatggtgcggggccagctgtacaagcactttgacctggagaggaagaatgccaagcaggccgaggcccggctggaccagaggctgcagaggctgaaggtgatctgcctgtaccacgtgaagctgctgacctgggagcagaggcagctgcagaaggagctgcagaggctgcagcaggccgagaccatgaagaagaagttcagcagctacctgggcaatggcttccagaagaggccagaagatgtgctggtgttcagcccccagggccggcagaagcaccgggccccccaggccaagaagatgagggccctggccaccaggatggcccaggacacctgcaagagcaagagccaggtgccccccagccatgatgctggcctgaaggaccccatgaagagcaagaagcagcccctgagccagaacaacagaacagcctgcttcatcaaggagcagccccaggcccaggagaaggacagcgtgaaccccagcaaggatgtggaccccagcaagggcatctctgtgccctgccagaaccaggaggtgtccaccaacaccatcgagcagggccccagcagcagccctgccagtgacagcggcatggcctgtgctgatgagaccaggagcaaggatgtggccctgaagccagatggcaacacaggcaagcagatcccccccaagcacatggagtgtgccggcagctttgaaggagagttcaccaagcccaccttcctggagctgctgagcaaggccagaaatgcccactacctgcggcaccgggtgcccccagagagcgagcggctgctgagcattggagagatctttggacatggagagagcagcagcagcagagctgggaaggaatgtgagaacagagtgcccagcaagttcctgcccctgtag

SEQ ID NO: 35973 - DNA, 708 bp, Artificial Sequence
  Description of Artificial Sequence: Synthetic coding sequence
atggtgcggggccagctgtacaagcactttgacctggagaggaagaatgccaagcaggccgaggcccggctggaccagaggctgcagaggctgaaggtgatctgcctgtaccacgtgaagctgctgacctgggagcagaggcagctgcagaaggagctgcagaggctgcagcaggagaccatgaagaagaagttcagcagctacctgggcaatggcttccagaagaggccagaagatgtgctggtgttcagcccccagggccggcagaagcaccgggccccccaggccaagaagatgagggccctggccaccaggatggcccaggacacctgcaagagcaagagccaggtgccccccagccatgatgctggcctgaaggaccccatgaagagcaagaagcagcccctgagccagaacaacagaacagcctgcttcatcaaggagcagccccaggcccaggagaaggacagcgtgaaccccagcaaggatgtggaccccagcaagggcatctctgtgccctgccagaaccaggaggtgtccaccaacaccatcgagcagggccccatcagcagcgcccagcccctggccttcaacggggagaccatcctgtacagcgagaggaacaccaggaacctgctgccccccaccctgagctccatgaagcagagcaacagaggccggcaggccatcagtgacagaacagactag

SEQ ID NO: 35974 - DNA, 786 bp, Artificial Sequence
  Description of Artificial Sequence: Synthetic coding sequence
atggagaacttcagcctgctgagcatcagcggcccccccatcagcagcagcgccctgagcgccttcccagacatcatgttcagccgggccaccagcctgcctgacatcgccaagacagctgtgcccacagaggccagcagccctgcccaggccctgcccccccagtaccagagcatcatcgtgcggcagggcatccagaacacagccctgagcccagactgcagcctgggggacacccagcacggggagaagctgcggaggaactgcaccatctaccggccctggttcagcccctacagctactttgtgtgtgccgacaaggagagccagctggaggcctatgacttccctgaggtgcagcaggatgagggcaagtgggacaactgcctgtctgaggacatggccgagaacatctgcagcagcagcagcagccctgagaacacctgcccccgggaggccaccaagaagagcagacatggcctggacagcatcaccagccaggacatcctgatggccagccgctggcacccagcccagcagaatggctacaagtgtgtggcctgctgcaggatgtaccccaccctggacttcctgaagagccacatcaagaggggcttccgggagggcttcagctgcaaggtgtactacaggaagctgaaggccctgtggagcaaggagcagaaggcccggctgggggaccggctgagcagcggcagctgccaggccttcaacagccctgctgagcacctgcggcagattggaggagaggcctacctgtgcctgtag

SEQ ID NO: 35975 - DNA, 1527 bp, Artificial Sequence
  Description of Artificial Sequence: Synthetic coding sequence
atgaatgaaaacaaggacacagacagcaagaagtctgaggagtatgaagatgactttgagaaggacctggagtggctgatcaatgaaaatgagaagagtgatgccagcatcatcgagatggcctgtgagaaggaggagaacatcaaccaggacctgaaggaaaatgaaacagtgatggagcacaccaagaggcacagcgaccctgacaagagcctgcaggatgaggtgagccccaggagaaatgacatcatctctgtgcccggcatccagcccctggaccccatcagtgacagcgacagtgaaaattccttccaggagagcaagctggagagccagaaggacctggaggaggaggaggatgaggaggtgcggcgctacatcatggagaagatcgtgcaggccaacaagctgctgcagaaccaggagcctgtgaatgacaagcgggagaggaagctgaagttcaaggaccagctggtggacctggaggtgccccccctggaggacaccaccaccttcaagaactactttgaaaatgaaagaaacatgtttgggaagctgagccagctgtgcatcagcaatgactttggccaggaggatgtgctgctgagcctgaccaacggcagctgtgaggagaacaaggacaggaccatcctggtggagagagatggcaagtttgagctgctgaacctgcaggacatcgccagccagggcttcctgccccccatcaacaatgccaacagcacagaaaatgacccccagcagctgctgcccaggagcagcaacagctctgtgtctggcaccaagaaggaggacagcacagccaagatccatgctgtgacccacagcagcactggagagcccctggcctacatcgcccagccccccctgaacaggaagacctgccccagcagcgctgtgaacagcgacaggagcaaaggaaatggcaagagcaaccacaggacccagagcgcccacatcagccctgtgaccagcacctactgcctgagcccccggcagaaggagctgcagaagcagctggaggagaagcgggagaagctgaagcgggaggaggagaggaggaagattgaggaggagaaggagaagaagagagaaaatgacatcgtgttcaaggcctggctgcagaagaagcgggagcaggtgctggagatgaggcgcatccagagggccaaggagattgaggacatgaacagccgggagaacagagacccccagcaggccttccggctgtggctgaagaagaagcatgaggagcagatgaaggagcggcagacagaggagctgaggaagcaggaggagtgcctcttcttcctgaagggcacagagggccgggagcgggccttcaagcagtggctgcggaggaagaggatggagaagatggccgagcagcaggccgtgcgggagaggacccggcagctgcggctggaggccaagaggagcaagcagctgcagcaccacctgtacatgtctgaggccaagcccttccgcttcacagaccactacaactag

SEQ ID NO: 35976 - DNA, 1530 bp, Artificial Sequence
  Description of Artificial Sequence: Synthetic coding sequence
atgaatgaaaacaaggacacagacagcaagaagtctgaggagtatgaagatgactttgagaaggacctggagtggctgatcaatgaaaatgagaagagtgatgccagcatcatcgagatggcctgtgagaaggaggagaacatcaaccaggacctgaaggaaaatgaaacagtgatggagcacaccaagaggcacagcgaccctgacaagagcctgcaggatgaggtgagccccaggagaaatgacatcatctctgtgcccggcatccagcccctggaccccatcagtgacagcgacagtgaaaattccttccaggagagcaagctggagagccagaaggacctggaggaggaggaggatgaggaggtgcggcgctacatcatggagaagatcgtgcaggccaacaagctgctgcagaaccaggagcctgtgaatgacaagcgggagaggaagctgaagttcaaggaccagctggtggacctggaggtgccccccctggaggacaccaccaccttcaagaactactttgaaaatgaaagaaacatgtttgggaagctgagccagctgtgcatcagcaatgactttggccaggaggatgtgctgctgagcctgaccaacggcagctgtgaggagaacaaggacaggaccatcctggtggagagagatggcaagtttgagctgctgaacctgcaggacatcgccagccagggcttcctgccccccatcaacaatgccaacagcacagaaaatgacccccagcagctgctgcccaggagcagcaacagctctgtgtctggcaccaagaaggaggacagcacagccaagatccatgctgtgacccacagcagcactggagagcccctggcctacatcgcccagccccccctgaacaggaagacctgccccagcagcgctgtgaacagcgacaggagcaaaggaaatggcaagagcaaccacaggacccagagcgcccacatcagccctgtgaccagcacctactgcctgagcccccggcagaaggagctgcagaagcagctggaggagaagcgggagaagctgaagcgggaggaggagaggaggaagattgaggaggagaaggagaagaagagagaaaatgacatcgtgttcaaggcctggctgcagaagaagcgggagcaggtgctggagatgaggcgcatccagagggccaaggagattgaggacatgaacagccggcaggagaacagagacccccagcaggccttccggctgtggctgaagaagaagcatgaggagcagatgaaggagcggcagacagaggagctgaggaagcaggaggagtgcctcttcttcctgaagggcacagagggccgggagcgggccttcaagcagtggctgcggaggaagaggatggagaagatggccgagcagcaggccgtgcgggagaggacccggcagctgcggctggaggccaagaggagcaagcagctgcagcaccacctgtacatgtctgaggccaagcccttccgcttcacagaccactacaactag

SEQ ID NO: 35977 - DNA, 1071 bp, Artificial Sequence
  Description of Artificial Sequence: Synthetic coding sequence
atgaatgaaaacaaggacacagacagcaagaagtctgaggagtatgaagatgactttgagaaggacctggagtggctgatcaatgaaaatgagaagagtgatgccagcatcatcgagatggcctgtgagaaggaggagaacatcaaccaggacctgaaggaaaatgaaacagtgatggagcacaccaagaggcacagcgaccctgacaagagcctgcaggatgaggtgagccccaggagaaatgacatcatctctgtgcccggcatccagcccctggaccccatcagtgacagcgacagtgaaaattccttccaggagagcaagctggagagccagaaggacctggaggaggaggaggatgaggaggtgcggcgctacatcatggagaagatcgtgcaggccaacaagctgctgcagaaccaggagcctgtgaatgacaagcgggagaggaagctgaagttcaaggaccagctggtggacctggaggtgccccccctggaggacaccaccaccttcaagaactactttgaaaatgaaagaaacatgtttgggaagctgagccagctgtgcatcagcaatgactttggccaggaggatgtgctgctgagcctgaccaacggcagctgtgaggagaacaaggacaggaccatcctggtggagagagatggcaagtttgagctgctgaacctgcaggacatcgccagccagggcttcctgccccccatcaacaatgccaacagcacagaaaatgacccccagcagctgctgcccaggagcagcaacagctctgtgtctggcaccaagaaggaggacagcacagccaagatccatgctgtgacccacagcagcactggagagcccctggcctacatcgcccagccccccctgaacaggaagacctgccccagcagcgctgtgaacagcgacaggagcaaaggaaatggcaagagcaaccacaggacccagagcgcccacatcagccctgtgaccagcacctactgcctgagcccccggcagaaggagctgcagaagcagctggaggagaagcgggagaagctgaagcgggagtag

SEQ ID NO: 35978 - DNA, 1527 bp, Artificial Sequence; identical to SEQ ID NO: 35975
  Description of Artificial Sequence: Synthetic coding sequence

SEQ ID NO: 35979 - DNA, 429 bp, Artificial Sequence
  Description of Artificial Sequence: Synthetic coding sequence
atgacagtgggcgcccggctgcggagcaaggccgagagcagcctgctgcggcggggcccccggggccggggccgcacagaaggagatgaggaggccgccgccatcctggagcacctggagtatgcagatgaagctgaggccgctgctgagagcggcaccagcgctgctgatgagcggggccctggcaccaggggggccaggagagtgcactttgccctgctgcctgagagatatgagcccctggaggagcccgcccccagcgagcagcccaggaagcgctacagaaggaagctgaagaagtatggcaagaatgtgggcaaggtgatcatcaagggctgccgctacgtggtgattggcctgcagggctttgctgctgcctacagcgccccctttgctgtggccacctctgtggtgtcctttgtgaggtag

SEQ ID NO: 35980 - DNA, 333 bp, Artificial Sequence
  Description of Artificial Sequence: Synthetic coding sequence
atggagtggggccctggcagtgactggagcagaggagaggccgccggcgtggaccggggcaaggccggcctgggcctgggcggccggcccccaccccagcccccccgggaggagcgggcccagcagctgctggatgctgtggagcagaggcagaggcagctgctggacaccatcgccgcctgtgaggagatgctgcggcagctgggcagaagaagacctgagcctgctgggggcggcaatgtgtctgccaagccaggggccccaccccagcctgctgtgtctgcccggggcggcttccccaaggatgctggagatggagctgctgagccctag

SEQ ID NO: 35981 - DNA, 144 bp, Artificial Sequence
  Description of Artificial Sequence: Synthetic coding sequence
atgctgcggcagctgggcagaagaagacctgagcctgctgggggcggcaatgtgtctgccaagccaggggccccaccccagcctgctgtgtctgcccggggcggcttccccaaggatgctggagatggagctgctgagccctag

SEQ ID NO: 35982 - DNA, 480 bp, Artificial Sequence
  Description of Artificial Sequence: Synthetic coding sequence
atgggccctggcctgcggctggtgactggagtgcggggcggccccagcggccgggaggagggcgcctggccccgggccagcgctggccctgaccggctgagcctggccctgagccgggccggccgcctgcctgcctggacagctggccggcggggctggggcagcgctgggggccacccccacagccggcccggccgcagcgcccccagcagctgctggacccgctggagcagcggcagcggcagctcctggacccccagccagcctgcccggcgctgctacggctcctgggccgccggggcccggagccggctggtggccggcaccagccagcccaacctggagaggcctcccagccggctgagccccccagaggccgccttccagaggatgctggccatggagctgcggagcccagaccaccccagggctgagtacccagacttcagccccagccctggccctgtggccggcctgtag

SEQ ID NO: 35983 - DNA, 144 bp, Artificial Sequence; identical to SEQ ID NO: 35981
  Description of Artificial Sequence: Synthetic coding sequence

SEQ ID NO: 35984 - DNA, 483 bp, Artificial Sequence
  Description of Artificial Sequence: Synthetic coding sequence
atgggcaagatcgccctgcagctgaaggccaccctggagaacatcaccaacctgcggcctgtgggggaggacttccgctggtacctgaagatgaagtgtggcaactgtggggagatcagtgacaagtggcagtacatccggctgatggattctgtggccctgaagggcggccggggcagcgcctccatggtgcagaagtgcaagctgtgtgccagagaaaattccattgagatcctgagcagcaccatcaagccctacaatgcagaagataatgaaaacttcaagaccatcgtggagtttgaatgtcggggcctggagcctgtggacttccagccccaggccggctttgctgctgagggcgtggagagcggcacagccttcagtgacatcaacctgcaggagaaggactggacagattatgatgagaaggcccaggagagcgtgggcatctatgaggtgacccaccagtttgtgaagtgctag

SEQ ID NO: 35985 - DNA, 414 bp, Artificial Sequence
  Description of Artificial Sequence: Synthetic coding sequence
atgggcaagatcgccctgcagctgaaggccaccctggagaacatcaccaacctgcggcctgtgggggaggacttccgctggtacctgaaggacagcgtggccctgaagggcggccggggcagcgcctccatggtgcagaagtgcaagctgtgtgcccgggagaacagcattgagatcctgagcagcaccatcaagccctacaatgctgaggacaatgaaaacttcaagaccatcgtggagtttgagtgccggggcctggagcctgtggacttccagcccctgggcctgctgctgaaggtgtggagccagggccagcccagcgtgaccctcatctgcagaagaagaacaggcctgaccatgatgaagaggcccaggagcctgtgggagagcatgaggagccccaccagcctgtag

SEQ ID NO: 35986 - DNA, 624 bp, Artificial Sequence
  Description of Artificial Sequence: Synthetic coding sequence
atggatgatgacctgatgctggccctgcggctgcaggaggagtggaacctgcaggaggccgagcgggaccacgcccaggagagcctgagcctggtggatgcctcctgggagctggtggaccccaccccagacctgcaggccctgtttgtgcagttcaatgaccagttcttctggggccagctggaggccgtggaggtgaagtggagcgtgaggatgaccctgtgtgccggcatctgcagctatgagggcaagggcggcatgtgcagcatccggctgtctgagcccctgctgaagctgcggcccaggaaggacctggtggaggtgtaccacaccttccatgatgaggtggatgagtaccgccgccactggtggcgctgcaatggcccctgccagcaccggcccccctactacggctacgtgaagagggccaccaaccgggagcccagcgcccatgactactggtgggccgagcaccagaagacctgtggcggcacctacatcaagatcaaggagcctgagaactacagcaagaagggcaagggcaaggccaagctgggcaaggagcctgtgctggccgctgagaacaagggcacctttgtgtacatcctgctgatcttcatgtag

SEQ ID NO: 35987 - DNA, 1470 bp, Artificial Sequence
  Description of Artificial Sequence: Synthetic coding sequence
atggatgatgacctgatgctggccctgcggctgcaggaggagtggaacctgcaggaggccgagcgggaccacgcccaggagagcctgagcctggtggatgcctcctgggagctggtggaccccaccccagacctgcaggccctgtttgtgcagttcaatgaccagttcttctggggccagctggaggccgtggaggtgaagtggagcgtgaggatgaccctgtgtgccggcatctgcagctatgagggcaagggcggcatgtgcagcatccggctgtctgagcccctgctgaagctgcggcccaggaaggacctggtggagaccctgctgcacgagatgattcatgcctacctgtttgtgaccaacaatgacaaggaccgggagggccacggccctgagttctgcaagcacatgcaccgcatcaacagcctgactggagccaacatcaccgtgtaccacaccttccatgatgaggtggatgagtacagaagacactggtggcgctgcaatggcccctgccagcacaggcctccctactacggctacgtgaagagggccaccaaccgggagcccagcgcccatgactactggtgggccgagcaccagaagacctgtggcggcacctacatcaagatcaaggagcctgagaactacagcaagaagggcaagggcaaggccaagctgggcaaggagcctgtgctggccgctgagaacaaggacaagcccaacagaggagaggcccagctggtgatccccttcagcggcaagggctacgtgctgggggagaccagcaacctgcccagccctgggaagctgatcaccagccacgccatcaacaagacccaggacctgctgaaccagaaccacagcgccaatgctgtgcggcccaacagcaagatcaaggtgaagtttgagcagaatggcagcagcaagaacagccacctggtgtccccagctgtgagcaacagccaccagaatgtgctgagcaactacttcccccgggtgtcctttgccaaccagaaggccttccggggcgtgaatggcagcccccgcatctctgtgacagtgggcaacatccccaagaacagcgtgagcagcagcagccagaggagagtgagcagcagcaagatcagcctgaggaacagcagcaaggtgacagagagcgcctctgtgatgcccagccaggatgtgtctggcagcgaggacaccttccccaacaagaggccccggctggaggacaagacagtgtttgacaacttcttcatcaagaaggagcagatcaagagcagtggaaatgaccccaagtacagcaccaccacagcccagaacagcagcagcagcagcagccagagcaagatggtgaactgccctgtgtgccagaatgaggtgctggagagccagatcaatgagcacctggactggtgcctggagggggacagcatcaaggtgaagtctgaggagagcctgtag

SEQ ID NO: 35988 - DNA, 564 bp, Artificial Sequence
  Description of Artificial Sequence: Synthetic coding sequence
atgaagaagaccctgctgcacgagatgattcatgcctacctgtttgtgaccaacaatgacaaggaccgggagggccacggccctgagttctgcaagcacatgcaccgcatcaacagcctgactggagccaacatcaccgtgtaccacaccttccatgatgaggtggatgagtacagaagacactggtggcgctgcaatggcccctgccagcacaggcctccctactacggctacgtgaagagggccaccaaccgggagcccagcgcccatgactactggtgggccgagcaccagaagacctgtggcggcacctacatcaagatcaaggagcctgagaactacagcaagaagggcaagggcaaggccaagctgggcaaggagcctgtgctggccgctgagaacaaggacaagcccaacagaggagaggcccagctggtgatccccttcagcggcaagggctacgtgctgggggagaccagcaacctgcccagccctgggaagctgatcaccagccacgccatcaacaagacccaggacctgctgaaccagaaccacagcgcctag

SEQ ID NO: 35989 - DNA, 753 bp, Artificial Sequence
  Description of Artificial Sequence: Synthetic coding sequence
atggatgatgacctgatgctggccctgcggctgcaggaggagtggaacctgcaggaggccgagcgggaccacgcccaggagagcctgagcctggtggatgcctcctgggagctggtggaccccaccccagacctgcaggccctgtttgtgcagttcaatgaccagttcttctggggccagctggaggccgtggaggtgaagtggagcgtgaggatgaccctgtgtgccggcatctgcagctatgagggcaagggcggcatgtgcagcatccggctgtctgagcccctgctgaagctgcggcccaggaaggacctggtggagaccctgctgcacgagatgattcatgcctacctgtttgtgaccaacaatgacaaggaccgggagggccacggccctgagttctgcaagcacatgcaccgcatcaacagcctgactggagccaacatcaccgtgtaccacaccttccatgatgaggtggatgagtacagaagacactggtggcgctgcaatggcccctgccagcacaggcctccctactacggctacgtgaagagggccaccaaccgggagcccagcgcccatgactactggtgggccgagcaccagaagacctgtggcggcacctacatcaagatcaaggagcctgagaactacagcaagaagggcaagggcaaggccaagctgggcaaggagcctgtgctggccgcagaaaataaaggcacctttgtgtacatcctgctgatcttcatgtag

SEQ ID NO: 35990 - DNA, 585 bp, Artificial Sequence
  Description of Artificial Sequence: Synthetic coding sequence
atggatgatgacctgatgctggccctgcggctgcaggaggagtggaacctgcaggaggccgagcgggaccacgcccaggagagcctgagcctggtggatgcctcctgggagctggtggaccccaccccagacctgcaggccctgtttgtgcagttcaatgaccagttcttctggggccagctggaggccgtggaggtgaagtggagcgtgaggatgaccctgtgtgccggcatctgcagctatgagggcaagggcggcatgtgcagcatccggctgtctgagcccctgctgaagctgcggcccaggaaggacctggtggaggtgtaccacaccttccatgatgaggtggatgagtaccgccgccactggtggcgctgcaatggcccctgccagcaccggcccccctactacggctacgtgaagagggccaccaaccgggagcccagcgcccatgactactggtgggccgagcaccagaagacctgtggcggcacctacatcaagatcaaggagcctgagaactacaagaagaggcagaggaagggcaagaccaggaagggcaccagcatcggccggcgggagtag

SEQ ID NO: 35991 - DNA, 2472 bp, Artificial Sequence
  Description of Artificial Sequence: Synthetic coding sequence
atgtggggcagccctgccctggcctgggccgtgtggctggcctgtgtgcagcccaccgtcttcccctggagcctgtccttcagaagtgacacagacaagcccagcagcgctgctgaggtgctgacagaggccagcagctgctggacagacacagtggagtgcttcagtgactacatgaccctgtggatccccaggagccacgtggagggcctgcggcgctggctggcccggaccctgcacctgcccggcacctggaggagcccagaccacctggacagcagcctggccaagtgtggctacttcctgcacctggccagtgatggagacttcctgttccgggtgcagtacagcgcctgctttgtgcagaaggagaaggccaactaccgcctggagatccgcatcttccagaagggcgtgatgggcctggagaggagtgaccgctacatcatgaagtgccccatgctgcggagccggctgggccaggagagcgtgcactgcggccccatgttcatccaggtgtcccggcccctgcccctgtggagggacaaccggcagaccccctggctgctgagcctgcggggggagctggtggccagcctggaggatgccagcctgatgggcctgtatgtggacatgaatgccaccaccgtgacagtgcagagcccccggcagggcctgctgcagcgctgggaggtgctgaacaccagcgctgagctgctgcccctgtggctggtgtctggccaccacgcctacagcctggaggccgcctgcccccctgtgtccttccagcctgagagcgaggtgctggtgcacatccccaagcagaggctgggcctggtgaagaggggcagctacatcgaggagaccctgagcctgcgcttcctgcgggtgcaccagagcaacatcttcatggtgacagagaacaaggactttgtggtggtgtccatcccagctgctggggtgctgcaggtgcagcgctgccaggaggtgggcggcaccccaggcacccaggccttctacagagtggacctgagcctggagtttgctgagatggccgcccctgtgctgtggacagtggagagcttcttccagtgtgtgggcagcggcacagagagccctgccagcacagctgccctgcggaccacccccagcccccccagccctggccctgagaccccacctgctggggtgcccccagctgccagcagccaggtgtgggccgccggccctgctgcccaggagtggctgagccgggacctgctgcaccggcccagtgatgccctggccaagaagggcctgggccccttcctgcagacagccaagccagcccggcggggccagaccagcgccagcatcctgccccgggtggtgcaggcccagaggggcccccagcccccacctggagaggccggcatccctggccaccccaccccaccagccaccctgcccagcgagcctgtggagggcgtgcaggccagcccctggaggcccaggcctgtgctgcccacccacccagccctgaccctgcctgtgtccagtgatgccagcagccccagccccccagcccccaggcctgagaggcctgagagcctgctggtgtctggccccagcgtgaccctgacagagggcctgggcaccgtgcggcctgagcaggaccctgccaagagccctggcagccccctgctgctgcggggcctgagcagtggagatgtggccgcccctgagcccatcatgggagagcccggccaggccagcgaggagttccagcccctggcccggccctggagggccaccctggccgctgaggagctggtgagccacaggagccctggagagccccaggagacctgcagcggcacagaggtggagcggccccggcagacaggccctggcctgccccgggagggcgcccggggccacatggacctgagcagcagcgagcccagccaggacatcgagggccctggcctgagcatcctgcctgccagagatgccaccttcagcaccccatctgtgcggcagcctgaccccagcgcctggctgagcagcggccctgagctgaccggcatgccccgggtgcggctggccgcccccctggccgtgctgcccatggagcccctgcccccagagcctgtgcggcctgctgccctgctgaccccagaggccagctctgtgggcggccctgaccaggcccgctacctggagagcgcccctggctggcctgtgggccaggaggagtggggcgtggcccacaccagcagcccccccagcacccagaccctgagcctgtgggcccccactggagtgctgctgcccagcctggtggagctggagtaccccttccaggccggccgcggggccagcctgcagcaggagctgacagagcccaccctggccctgtctgctgagagccacaggcctcctgagctgcaggacagcgtggagggcctgtctgagcggcccagcaggtag

SEQ ID NO: 35992 - DNA, 1971 bp, Artificial Sequence
  Description of Artificial Sequence: Synthetic coding sequence
atgaagtgccccatgctgcggagccggctgggccaggagagcgtgcactgcggccccatgttcatccaggtgtcccggcccctgcccctgtggagggacaaccggcagaccccctggctgctgagcctgcggggggagctggtggccagcctggaggatgccagcctgatgggcctgtatgtggacatgaatgccaccaccgtgacagtgcagagcccccggcagggcctgctgcagcgctgggaggtgtctgggggccagcaggccctgcccggggtgtccttccagcctgagagcgaggtgctggtgcacatccccaagcagaggctgggcctggtgaagaggggcagctacatcgaggagaccctgagcctgcgcttcctgcgggtgcaccagagcaacatcttcatggtgacagagaacaaggactttgtggtggtgtccatcccagctgctggggtgctgcaggtgcagcgctgccaggaggtgggcggcaccccaggcacccaggccttctacagagtggacctgagcctggagtttgctgagatggccgcccctgtgctgtggacagtggagagcttcttccagtgtgtgggcagcggcacagagagccctgccagcacagctgccctgcggaccacccccagcccccccagccctggccctgagaccccacctgctggggtgcccccagctgccagcagccaggtgtgggccgccggccctgctgcccaggagtggctgagccgggacctgctgcaccggcccagtgatgccctggccaagaagggcctgggccccttcctgcagacagccaagccagcccggcggggccagaccagcgccagcatcctgccccgggtggtgcaggcccagaggggcccccagcccccacctggagaggccggcatccctggccaccccaccccaccagccaccctgcccagcgagcctgtggagggcgtgcaggccagcccctggaggcccaggcctgtgctgcccacccacccagccctgaccctgcctgtgtccagtgatgccagcagccccagccccccagcccccaggcctgagaggcctgagagcctgctggtgtctggccccagcgtgaccctgacagagggcctgggcaccgtgcggcctgagcaggaccctgccaagagccctggcagccccctgctgctgcggggcctgagcagtggagatgtggccgcccctgagcccatcatgggagagcccggccaggccagcgaggagttccagcccctggcccggccctggagggccaccctggccgctgaggagctggtgagccacaggagccctggagagccccaggagacctgcagcggcacagaggtggagcggccccggcagacaggccctggcctgccccgggagggcgcccggggccacatggacctgagcagcagcgagcccagccaggacatcgagggccctggcctgagcatcctgcctgccagagatgccaccttcagcacccccagcgtgcggcagcctgaccccagcgcctggctgagcagcggccctgagctgaccggcatgccccgggtgcggctggccgcccccctggccgtgctgcccatggagcccctgcccccagagcctgtgcggcctgctgccctgctgaccccagaggccagctctgtgggcggccctgaccaggcccgctacctggagagcgcccctggctggcctgtgggccaggaggagtggggcgtggcccacaccagcagcccccccagcacccagaccctgagcctgtgggcccccaccggggtgctgctgcccagcctggtggagctggagtaccccttccaggccggccgcggggccagcctgcagcaggagctgacagagcccaccctggccctgtctgctgagagccaccggcccccagagctgcaggacagcgtggagggcctgtctgagcggcccagcaggtag

SEQ ID NO: 35993 - DNA, 1722 bp, Artificial Sequence
  Description of Artificial Sequence: Synthetic coding sequence
atgctgaccaggaaccccaagaccaagagcagcctgcagatcctgcaggacagcgtgaagtggcaccacatggcccacaaggtgaacagcctgctggatgcctacagcggcctgctgagcaatgaatccatgatcctggccgtgaacagcagctttgtggaccccctgctgcagtttgagagccagctgaagatcatcgagagcagctttggcatgctggtggtgatgcccagcctggacaaggtgaaggagatgggcagcagctatgagtacatcgaggacatggagaacctgtaccacaacatcctgaacatctatgagaacatcctgaccagcctggtgtccaaggacctgtacaagctgcagatcctgaaggagatgctggtgtggatgagcaaggacagcagctacctgcaggagcgcatcatggtgatcatcaacaaggtgctgcgcttcaccgtgaccaaggtgaggaagtacatctctgtggatgccccctgcctgggcctgctggccgctgagctgagcctgctgtgcagccatgaggaccccagcatcgtgaagcaggccagcctgggcatgtgccacctgctgtacatcgcccgctgccagaatgacatcggcaccaacaagcccaccaacgggaagagccacagcctgcagttccccagcagtgatgtggagttcctgcccaaggagttccagcaggatgagagcaagatcgcccagagggtgggccagaccctgctgccccccctgctgacagactttgtgcagagcctgctgatgaagctgagcagcccagatgacaagatcgccagtgatgctgccagcatcctgatcttcaccctggagttccacgccgagaaggtgaccatggtgtccaagatcgtggatgccatctaccggcagctgtgtgacaacaactgcatgaaggatgtgatgctgcaggtgatcaccctgctgacctgcaccagccccaagaaggtgatcttccagctgatggactaccctgtgcctgcagatgacaccctcatccagatgtggaaggccgcctgcagccaggcctctgtggcccctcatgtgctgaagaccatcctgctgatcctgaagggcaagccaggagagatggaggacacagtgacagagggcaagcgcttcagcctggacatcaccaacctgatgcccctggccgcctgccaggccctgtgcaccttcctgcccctgggcagctacaggaaggctgtggcccagtacttcccccagctgctgaccaccctgatgttccaggtgttctacaacagcgagctgaagcccatcctgaaggaccgggccctgtatgcccaggatgccctgcgggtgctgctgaactgcagcggcctgcagcaggtggacatcaccctgatgaaggagaacttctgggaccagctgtctgaggacctgtgctactaccatggagtgtgcttcatcgccaagaccctgtctgagtacaacttcccccagtttcctgagaccctgagctacctgtacaagctgtctgtggagggcccccggcggagtgaagatactgtgattgtgctgatcttcctgacagaggtgtcctttgtggactgtgagcagctgtgcagccacttcctgttcctgcccaagttcaagagcaagttccagttcctggtgtccctgcccctgaatgtgggcagctaccaggacctgcggagctag

SEQ ID NO: 35994 - DNA, 2586 bp, Artificial Sequence
  Description of Artificial Sequence: Synthetic coding sequence
atgctgaccaggaaccccaagaccaagagcagcctgcagatcctgcaggacagcgtgaagtggcaccacatggcccacaaggtgaacagcctgctggatgcctacagcggcctgctgagcaatgaatccatgatcctggccgtgaacagcagctttgtggaccccctgctgcagtttgagagccagctgaagatcatcgagagcagctttggcatgctggtggtgatgcccagcctggacaaggtgaaggagatgggcagcagctatgagtacatcgaggacatggagaacctgtaccacaacatcctgaacatctatgagaacatcctgaccagcctggtgtccaaggacctgtacaagctgcagatcctgaaggagatgctggtgtggatgagcaaggacagcagctacctgcaggagcgcatcatggtgatcatcaacaaggtgctgcgcttcaccgtgaccaaggtgaggaagtacatctctgtggatgccccctgcctgggcctgctggccgctgagctgagcctgctgtgcagccatgaggaccccagcatcgtgaagcaggccagcctgggcatgtgccacctgctgtacatcgcccgctgccagaatgacatcggcaccaacaagcccaccaacgggaagagccacagcctgcagttccccagcagtgatgtggagttcctgcccaaggagttccagcaggatgagagcaagatcgcccagagggtgggccagaccctgctgccccccctgctgacagactttgtgcagagcctgctgatgaagctgagcagcccagatgacaagatcgccagtgatgctgccagcatcctgatcttcaccctggagttccacgccgagaaggtgaccatggtgtccaagatcgtggatgccatctaccggcagctgtgtgacaacaactgcatgaaggatgtgatgctgcaggtgatcaccctgctgacctgcaccagccccaagaaggtgatcttccagctgatggactaccctgtgcctgcagatgacaccctcatccagatgtggaaggccgcctgcagccaggcctctgtggcccctcatgtgctgaagaccatcctgctgatcctgaagggcaagccaggagagatggaggacacagtgacagagggcaagcgcttcagcctggacatcaccaacctgatgcccctggccgcctgccaggccctgtgcaccttcctgcccctgggcagctacaggaaggctgtggcccagtacttcccccagctgctgaccaccctgatgttccaggtgttctacaacagcgagctgaagcccatcctgaaggaccgggccctgtatgcccaggatgccctgcgggtgctgctgaactgcagcggcctgcagcaggtggacatcaccctgatgaaggagaacttctgggaccagctgtctgaggacctgtgctactaccatggagtgtgcttcatcgccaagaccctgtctgagtacaacttcccccagtttcctgagaccctgagctacctgtacaagctgtctgtggagggcccccggcggagtgaagatactgtgattgtgctgatcttcctgacagagctgctgaacaacttcttcaaggaccccctgcctgaggagttcctggtgctcttcatcaactggatcaatgacagcaaccctgtggtgtcccggctcatcctgcacagaattgtgcacatgagccccatcatcaacaagacagaaaatgtgagcagcatcctgattgccatcctggatgccttcctgagcaaggatgacaacgtggtgctgcaggccctgctgaccctgcggcggctgctgaatgagctggacaaggtgacctacagcctgggcacccgcatcggcagcagctactgcaccctgatggaccacatcaatggaggcatccgctccatggccatccgccacttcggccagctggtgcgggacatgaggcagtacacctggatggtgaatgatgtggtgctggagggcctggtgcccctcatcctcttcctggaggatgatgacaagagggtggccgaggcctgcaagtacaccctgaagatctgcaccagccagctgaagtggagcaccagccggctgctgaaggatgagaactacagctttgagatggtggtgctgaacatctgcaacaacctgatcatcagccacaggaactacatcacagacctgaccagtgacaccctgcgcttcctgtggagccccaggacctacctgaagagggccagcgtcatcctgattggctacctggccaagagcggcggccacctgctgctgagagatgaaattgaggtgatgctggatgtgattgagcggctgctgagagatgaggaccccatgatcaagcagctggccgagatcacctatgacatcttcaagaagaaggcccacaagctgaccagcgcccccctgaagcagaacttccagaagctgctgaagctgttctacatcaagaagctgaagcccctgtacaactacaacagccccaacggccagattgacagccccacagacagcaaggatgtgaagaatgacaaggccctgtag

SEQ ID NO: 35995 - DNA, 564 bp, Artificial Sequence
  Description of Artificial Sequence: Synthetic coding sequence
tgaatgcccctggccgcctgccaggccctgtgcaccttcctgcccctgggcagctacaggaaggctgtggcccagtacttcccccagctgctgaccaccctgatgttccaggtgttctacaacagcgagctgaagcccatcctgaaggaccgggccctgtatgcccaggatgccctgcgggtgctgctgaactgcagcggcctgcagcaggtggacatcaccctgatgaaggagaacttctgggaccagctgtctgaggacctgtgctactaccacggcgtgtgcttcatcgccaagaccctgtctgagtacaacttcccccagtttcctgagaccctgagctacctgtacaagctgtctgtggagggccccaggagaagtgaggacaccgtcatcgtgctgatcttcctgacagagctgctgaacaacttcttcaaggaccccctgcctgaggagttcctggtgctcttcatcaactggatcaatgacagcaaccctgtggtgagccgcctcatcctgcaccgcatcgtgcacatgagccccatcatcaacaaggtggactag

SEQ ID NO: 35996 - DNA, 750 bp, Artificial Sequence
  Description of Artificial Sequence: Synthetic coding sequence
atgagggtggacagcagcgctgaccccaccatgagccaggagcagggccctggcagcagcaccccacccagcagccccaccctgctggatgccctgctgcagaacctgtatgactttggaggaacagaaggagaaacagagcagaagaagatcatcaagaagcgggagaacaagaagagagatgtgatggccagcgctgccctggccgctgagcccagccccctgcccggcagcctcatccggggccagaggaagagcgccagcagcttcttcaaggagctgcgggaggagcggcactgtgcccccagcggcacccccactggacctgagatcctggccgctgctgtgccccccagcagcctgaagaacaaccgggagcaggtggaggtggtggagttccacagcaacaagaagaggaagctgaccccagaccacaacaagaacaccaagcaggccaaccccagcgtgctggagagagatgtggacacccaggagttcaacctggagaaggcccggctggaggtgcaccgcttcggcatcaccggctacggcaagggcaaggagcgcatcctggagcaggagcgggccatcatgctgggcgccaagccacccaagaagagctatgtgaactacaaggtgctgcaggagcagatcaaggagaagaaggccgccaaggaggaggagaagaggctggcccaggagacagacatcttcaagaagaagaagaggaagggccaggaggacagatag

SEQ ID NO: 35997 - DNA, 792 bp, Artificial Sequence
  Description of Artificial Sequence: Synthetic coding sequence
atgagccaggagcagggccctggcagcagcaccccacccagcagccccaccctgctggatgccctgctgcagaacctgtatgactttggaggaacagaaggagaaacagagcagaagaagatcatcaagaagcgggagaacaagaagagagatgtgatggccagcgctgccctggccgctgagcccagccccctgcccggcagcctcatccggggccagaggaagagcgccagcagcttcttcaaggagctgcgggaggagcggcactgtgcccccagcggcacccccactggacctgagatcctggccgctgctgtgccccccagcagcctgaagaacaaccgggagcaggtggaggtggtggagttccacagcaacaagaagaggaagctgaccccagaccacaacaagaacaccaaggcccggctggaggtgcaccgcttcggcatcaccggctacggcaagggcaaggagcgcatcctggagcaggagcgggccatcatgctgggcgccaagccacccaagaagagctatgtgaactacaaggtgctgcaggagcagatcaaggagaagaaggccgccaaggaggaggagaagaggctggcccaggagacagacatcttcaagaagaagaagaggaagggccaggaggacaggaagagcaagaagaagagcgcccccagcatcctgagcaatggaagaattggccaggtgggcaagttcaagaatggcaccctcatcctgagccctgtggacatcaagaagatcaacagcagccgggtggccaagtag

SEQ ID NO: 35998 - DNA, 882 bp, Artificial Sequence
  Description of Artificial Sequence: Synthetic coding sequence
atgagggtggacagcagcgctgaccccaccatgagccaggagcagggccctggcagcagcaccccacccagcagccccaccctgctggatgccctgctgcagaacctgtatgactttggaggaacagaaggagaaacagagcagaagaagatcatcaagaagcgggagaacaagaagagagatgtgatggccagcgctgccctggccgctgagcccagccccctgcccggcagcctcatccggggccagaggaagagcgccagcagcttcttcaaggagctgcgggaggagcggcactgtgcccccagcggcacccccactggacctgagatcctggccgctgctgtgccccccagcagcctgaagaacaaccgggagcaggtggaggtggtggagttccacagcaacaagaagaggaagctgaccccagaccacaacaagaacaccaagcaggccaaccccagcgtgctggagagagatgtggacacccaggagttcaacctggagaaggcccggctggaggtgcaccgcttcggcatcaccggctacggcaagggcaaggagcgcatcctggagcaggagcgggccatcatgctgggcgccaagccacccaagaagagctatgtgaactacaaggtgctgcaggagcagatcaaggagaagaaggccgccaaggaggaggagaagaggctggcccaggagacagacatcttcaagaagaagaagaggaagggccaggaggacaggaagagcaagaagaagagcgcccccagcatcctgagcaatggaagaattggccaggtgggcaagttcaagaatggcaccctcatcctgagccctgtggacatcaagaagatcaacagcagccgggtggccaagtag

SEQ ID NO: 35999 - DNA, 879 bp, Artificial Sequence
  Description of Artificial Sequence: Synthetic coding sequence
atgagggtggacagcagcgctgaccccaccatgagccaggagcagggccctggcagcagcaccccacccagcagccccaccctgctggatgccctgctgcagaacctgtatgactttggaggaacagaaggagaaacagagcagaagaagatcatcaagaagcgggagaacaagaagagagatgtgatggccagcgctgccctggccgctgagcccagccccctgcccggcagcctcatccggggccagaggaagagcgccagcagcttcttcaaggagctgcgggaggagcggcactgtgcccccagcggcacccccactggacctgagatcctggccgctgctgtgccccccagcagcctgaagaacaaccgggagcaggtggaggtggtggagttccacagcaacaagaagaggaagctgaccccagaccacaacaagaacaccaaggccaaccccagcgtgctggagagagatgtggacacccaggagttcaacctggagaaggcccggctggaggtgcacagatttggcatcaccggctacggcaagggcaaggagcgcatcctggagcaggagcgggccatcatgctgggcgccaagccacccaagaagagctatgtgaactacaaggtgctgcaggagcagatcaaggagaagaaggccgccaaggaggaggagaagaggctggcccaggagacagacatcttcaagaagaagaagaggaagggccaggaggacaggaagagcaagaagaagagcgcccccagcatcctgagcaatggccgcatcggccaggtgggcaagttcaagaatggcaccctcatcctgagccctgtggacatcaagaagatcaacagcagccgggtggccaagtag

SEQ ID NO: 36000 - DNA, 771 bp, Artificial Sequence
  Description of Artificial Sequence: Synthetic coding sequence
ggcagcagcaccccacccagcagccccaccctgctggatgccctgctgcagaacctgtatgactttggaggaacagaaggagaaacagagcagaagaagatcatcaagaagcgggagaacaagaagagagatgtgatggccagcgctgccctggccgctgagcccagccccctgcccggcagcctcatccggggccagaggaagagcgccagcagcttcttcaaggagctgcgggaggagcggcactgtgcccccagcggcacccccaccggccctgagatcctggccgctgctgtgccccccagcagcctgaagaacaaccgggagcaggtggaggtggtggagttccacagcaacaagaagaggaagctgaccccagaccacaacaagaacaccaaggcccggctggaggtgcacagatttggcatcaccggctacggcaagggcaaggagcgcatcctggagcaggagcgggccatcatgctgggcgccaagccacccaagaagagctatgtgaactacaaggtgctgcaggagcagatcaaggagaagaaggccgccaaggaggaggagaagaggctggcccaggagacagacatcttcaagaagaagaagaggaagggccaggaggacaggaagagcaagaagaagagcgcccccagcatcctgagcaatggccgcatcggccaggtgggcaagttcaagaatggcaccctcatcctgagccctgtggacatcaagaagatcaacagcagccgggtggccaagtag

SEQ ID NO: 36001 - DNA, 438 bp, Artificial Sequence
  Description of Artificial Sequence: Synthetic coding sequence
tgaagaagaggagctggggtgcgcagcggctgtgccagccgggcctgcagcggggccctgggcggccggggccctggagagagcctgtttgcccagtaccccaggagagctgagggccggcgggagaagcagcaggtgacagagcagagaaatggctggcccagccagagctggagctgctgctgcagcacctgcagccccaacaagtgcagctacatcctgatgacccagtgcatcggcagccgggagatggagctgtctgctgagtggccaggctgcagcgtgaacatgaaggccaccaagacagcccggggcagcgagctgatcctgagcctgggcagcttcagcggccgggccggccagaggagaagacctcctcctggccaccaggacggcagtgacacccggggcctgcggcgggtgcagctggccctgtag

SEQ ID NO: 36002 - DNA, 303 bp, Artificial Sequence
  Description of Artificial Sequence: Synthetic coding sequence
atgacccacagcggctggcagggcagcggcggggccggccctggcccccgggccccagcccggagccgctgccggcccggcctgcccagcctgccctgccggcccaaccccctggaggcccggggctgcggcagcgccctgcggccctgggacctggccgcccggacccccatcccctgcttctgtgaccacagctgggccctgggcaagctgctgggccccaagaggcgggagggcaggaaaggaagtgaaagaagaagaagaggccctgggggccagcagccccagcctgctgaggagtag

SEQ ID NO: 36003 - DNA, 1074 bp, Artificial Sequence
  Description of Artificial Sequence: Synthetic coding sequence
atgagaagaacaggccctgaggaggaggcctgtggggtgtggctggatgctgctgccctgaagaggaggaaggtgcagacccacctgatcaagccaggcaccaagatgctgaccctgctgcctggagagaggaaggccaacatctacttcacccagaggcgggcccccagcacaggcatccaccagaggagcatcgccagcttcttcaccctgcagcccgggaagaccaatggaagtgaccagaagtctgtgagcagccacacagagagccagatcaacaaggagagcaagaagaatgccacccagctggaccacctgatccctggcctggcccatgactgcatggccagccccctggccaccagcaccacagctgacatccaggaggccggcctgagcccccagagcctgcagaccagcggccaccacaggatgaagacccccttcagcacagagctgagcctgctgcagcctgacaccccagactgtgccggggacagccacacccccctggccttctccttcacagaggacctggagagcagctgcctgctggacaggaaggaggagaagggggacagcgccaggaagtgggagtggctgcacgagagcaagaagaactaccagagcatggagaagcacaccaagctgcccggggacaagtgctgccagcccctgggcaagaccaagctggagaggaaggtgtctgccaaggaaaatcggcaggcccctgtgctgctgcagacctaccgggagagctggaatggagaaaatattgaatctgtgaagcagagccgcagccctgtgtctgtgttctcctgggacaatgagaagaatgacaaggacagctggagccagctgttcacagaggacagccagggccagagggtcatcgcccacaacacccgggcccccttccaggatgtgaccaacaactggaactgggacctgggccccttccccaacagcccctgggcccagtgccaggaggatggccccacccagaacctgaagccagacctgctcttcacccaggacagcgagggcaaccaggtgatccgccaccagttctag

SEQ ID NO: 36004 - DNA, 1116 bp, Artificial Sequence
  Description of Artificial Sequence: Synthetic coding sequence
atgagaagaacaggccctgaggaggaggcctgtggggtgtggctggatgctgctgccctgaagaggaggaaggtgcagacccacctgatcaagccaggcaccaagatgctgaccctgctgcctggagagaggaaggccaacatctacttcacccagaggcgggcccccagcacaggcatccaccagaggagcatcgccagcttcttcaccctgcagcccgggaagaccaatggaagtgaccagaagtctgtgagcagccacacagagagccagatcaacaaggagagcaagaagaatgccacccagctggaccacctgatccctggcctggcccatgactgcatggccagccccctggccaccagcaccacagctgacatccaggaggccggcctgagcccccagagcctgcagaccagcggccaccacaggatgaagacccccttcagcacagagctgagcctgctgcagcctgacaccccagactgtgccggggacagccacacccccctggccttctccttcacagaggacctggagagcagctgcctgctggacaggaaggaggagaagggggacagcgccaggaagtgggagtggctgcacgagagcaagaagaactaccagagcatggagaagcacaccaagctgcccggggacaagtgctgccagcccctgggcaagaccaagctggagaggaaggtgtctgccaaggaaaatcggcaggcccctgtgctgctgcagacctaccgggagagctggaatggagaaaatattgaatctgtgaagcagagccgcagccctgtgtctgtgttctcctgggacaatgagaagaatgacaaggacagctggagccagctgttcacagaggacagccagggccagagggtcatcgcccacaacacccgggcccccttccaggatgtgaccaacaactggaactgggacctgggccccttccccaacagcccctgggcccagtgccaggaggatggccccacccagaacctgaagccagacctgctcttcacccaggacagcgaggtgcaggccctggcctgccagcaggactgctgccgccgcagcatcctgaagaggcagaagcacctgaggtag

SEQ ID NO: 36005 - DNA, 297 bp, Artificial Sequence
  Description of Artificial Sequence: Synthetic coding sequence
atggccctgaagaccagcctgggctctgtgcagttcatggagcagttctgctggccccacctgcgctccttctgtgagacctgtgtgggctcctggagcatccagatgaggcagcaccaccaccagagcagcttccctggcagcctgccccaggagaccaacctgaccctgaaggtgtgcaagccccaggccccccagaagctggaccccaccctgagcagctgcttcttcatcgagagctgtggggcccaggtgcctgtggagggcagcagaagagagaccagcatcaccgtgtag

SEQ ID NO: 36006 - DNA, 390 bp, Artificial Sequence
  Description of Artificial Sequence: Synthetic coding sequence
atgtggctgtggcaggacatccagtgctgcccagcccctccttctgccccaccccgggccctggagcccggccgggcccctcctcctcctggagagggcctgggcgccggcatccccagcctgagccccccccagaagaagccccagagcgtgggcatctgtgtgcggcagaagggccggcagaaggccggcctggagaagggcaacaggaagaaggagctgcggcaggccaactgccccagcctgcggccccagaggaaaggagctgacacccggcggctgccccgggagacccggcccaccaagaagaggacagctgctgcccagcccttcctgcagctgtggaacccagccccccacaccagcaatggaagaactggagacctgtag

SEQ ID NO: 36007 - DNA, 243 bp, Artificial Sequence
  Description of Artificial Sequence: Synthetic coding sequence
atggccgagaagatcctggagaagctggatgtgctggacaagcaggccgagatcatcctggcccggaggaccaagatcaaccggctgcagagcgagggcaggaagaccaccatggccatccccctgacctttgacttccagctggagtttgaggaggccctggccaccagcgccagcaaggccatcagcaagatcaaggaggacaagagctgcagcatcaccaagagcaagatcagcgagtag

SEQ ID NO: 36008 - DNA, 243 bp, Artificial Sequence
  Description of Artificial Sequence: Synthetic coding sequence
atggccgagaagatcctggagaagctggatgtgctggacaagcaggccgagatcatcctggcccggaggaccaagatcaaccggctgcagagcgagggcaggaagaccaccatggccatccccctgacctttgacttccagctggagtttgaggaggccctggccaccagcgccagcaaggccatcagcaagatcaaggaggacaagagctgcagcatcaccaagagcaagatcagcaactag

SEQ ID NO: 36009 - DNA, 846 bp, Artificial Sequence
  Description of Artificial Sequence: Synthetic coding sequence
atggccgagaagatcctggagaagctggatgtgctggacaagcaggccgagatcatcctggcccggaggaccaagatcaaccggctgcagagcgagggcaggaagaccaccatggccatccccctgacctttgacttccagctggagtttgaggaggccctggccaccagcgccagcaaggccatcagcaagatcaaggaggacaagagctgcagcatcaccaagagcaagatgcacgtgtccttcaagtgtgagcctgagcccaggaagagcaactttgagaagagcaacctgcggcccttcttcatccagaccaacgtgaagaacaaggagagcgagagcacagagcctgtggaggagcacctgaagagccgcagcatccggccctacctgtacctgaaggacaccacagagatggagaatgccggccccctgaatgtgctgtacagccagcaccggcaggcctgcagaagaagcctgggcagcacagacttcagccccatgttcaacatccagagcaatgcccacaagaaggagaaggacagcaccctcttcaccgcccagatcgagaagaagcccaggaagcccctggacagcgtgggcctgctggagggggacaggaacaagaggaagaagagcccccagatgaatgacttcaacatcaaggagaacaagtctgtgaggaactaccagctgagcaagtacagatctgtgaggaagaagagcctgctgcccctgtgctttgaagatgagctgaagaacccccacgccaagatcgtgaatgtgagccccaccaagacagtgaccagccacatggagcagaaggacaccaaccccatcatctag

SEQ ID NO: 36010 - DNA, 1203 bp, Artificial Sequence
  Description of Artificial Sequence: Synthetic coding sequence
atggccgagaagatcctggagaagctggatgtgctggacaagcaggccgagatcatcctggcccggaggaccaagatcaaccggctgcagagcgagggcaggaagaccaccatggccatccccctgacctttgacttccagctggagtttgaggaggccctggccaccagcgccagcaaggccatcagcaagatcaaggaggacaagagctgcagcatcaccaagagcaagatgcacgtgtccttcaagtgtgagcctgagcccaggaagagcaactttgagaagagcaacctgcggcccttcttcatccagaccaacgtgaagaacaaggagagcgagagcacagcccagatcgagaagaagcccaggaagcccctggacagcgtgggcctgctggagggggacaggaacaagaggaagaagagcccccagatgaatgacttcaacatcaaggagaacaagtctgtgaggaactaccagctgagcaagtacagatctgtgaggaagaagagcctgctgcccctgtgctttgaagatgagctgaagaacccccacgccaagatcgtgaatgtgagccccaccaagacagtgaccagccacatggagcagaaggacaccaaccccatcatcttccatgacacagaatatgtgaggatgctgctgctgaccaagaaccgcttcagcagccaccccctggagaatgaaaacatctacccccacaagaggaccaacttcatcctggagaggaactgtgagatcctgaagagcatcatcggcaaccagagcatcagcctcttcaagccccagaagaccatgcccaccgtgcagaggaaggacatccagatccccatgtccttcaaggccggccacaccaccgtggatgacaagctgaagaagaagaccaacaagcagaccctggagaacagatcctggaacaccctgtacaacttcagccagaacttcagcagcctgaccaagcagtttgtgggctacctggacaaggctgtgatccacgagatgtctgcccagacaggcaagtttgagaggatgttttctgctgggaagcccaccagcatccccaccagcagcgccctgcctgtgaagtgctacagcaagcccttcaagtacatctatgagctgaacaacgtgacccccctggacaacctgctgaacctgagcaatgagatcctgaatgccagctag

SEQ ID NO: 36011 - DNA, 1203 bp, Artificial Sequence; identical to SEQ ID NO: 36010
  Description of Artificial Sequence: Synthetic coding sequence

SEQ ID NO: 36012 - DNA, 846 bp, Artificial Sequence; identical to SEQ ID NO: 36009
  Description of Artificial Sequence: Synthetic coding sequence

SEQ ID NO: 36013 - DNA, 1203 bp, Artificial Sequence; identical to SEQ ID NO: 36010
  Description of Artificial Sequence: Synthetic coding sequence

SEQ ID NO: 36014 - DNA, 477 bp, Artificial Sequence
  Description of Artificial Sequence: Synthetic coding sequence
atgaggaggagcctgcgggccggcaagaggcggcagacagctgggaagagcaagagcccccccaaggtgcccatcgtcatccaggatgacagcctgcctgctggccccccaccccagatccgcatcctgaagaggcccaccagcaatggagtggtgagcagccccaacagcaccagccggcccaccctgcctgtgaagagcctggcccagcgggaggccgagtatgcagaggccaggaagaggatcctgggcagcgccagccctgaggaggagcaggagaagcccatcctggaccggcccacccgcatcagccagcctgaggacagccggctgcagacagcccagatcaatgctgggaagaagcgctgccgccgctgctgccgccaccggctgctgggccggcccccccgggtggccctgccctggcagacagctggcctggagcagcgggagaggccagacctgctggccctgtag

SEQ ID NO: 36015 - DNA, 459 bp, Artificial Sequence
  Description of Artificial Sequence: Synthetic coding sequence
atggaggatgaggaggtggccgagagctgggaggaggccgctgacagcggggagattgaccggcggctggagaagaagctgaagatcacccagaaggagagcaggaagagcaagagcccccccaaggtgcccatcgtcatccaggatgacagcctgcctgctggccccccaccccagatccgcatcctgaagaggcccaccagcaatggagtggtgagcagccccaacagcaccagccggcccaccctgcctgtgaagagcctggcccagcgggaggccgagtatgcagaggccaggaagaggatcctgggcagcgccagccctgaggaggagcaggagaagcccatcctggaccggcccacccgcatcagccagcctgaggacagccggcagcccaacaacgtcatccggcagcccctgggcccagatggcagccagggcttcaagcagaggaggtag

SEQ ID NO: 36016 - DNA, 402 bp, Artificial Sequence
  Description of Artificial Sequence: Synthetic coding sequence
atgaggaggagcctgcgggccggcaagaggcggcagacagctggcaggaagagcaagagcccccccaaggtgcccatcgtcatccaggatgacagcctgcctgctggccccccaccccagatccgcatcctgaagaggcccaccagcaatggagtggtgagcagccccaacagcaccagccggcccaccctgcctgtgaagagcctggcccagcgggaggccgagtatgcagaggccaggaagaggatcctgggcagcgccagccctgaggaggagcaggagaagcccatcctggaccggcccacccgcatcagccagcctgaggacagccggcagcccaacaacgtcatccggcagcccctgggcccagatggcagccagggcttcaagcagaggaggtag

SEQ ID NO: 36017 - DNA, 423 bp, Artificial Sequence
  Description of Artificial Sequence: Synthetic coding sequence
atggaggatgaggaggtggccgagagctgggaggaggccgctgacagcggggagattgaccggcggctggagaagaagctgaagatcacccagaaggagagcaggaagagcaagagcccccccaaggtgcccatcgtcatccaggatgacagcctgcctgctggccccccaccccagatccgcatcctgaagaggcccaccagcaatggagtggtgagcagccccaacagcaccagccggcccaccctgcctgtgaagagcctggcccagcgggaggccgagtatgcagaggccaggaagaggatcctgggcagcgccagccctgaggaggagcaggagaagcccatcctggaccggcccacccgcatcagccagcctgaggacagccggcagcccaacaacgtcatccggcagaggaggtag

SEQ ID NO: 36018 - DNA, 480 bp, Artificial Sequence
  Description of Artificial Sequence: Synthetic coding sequence
atgtcctatgaggtggccacagccctggagaacagaagccacaaggtgcgctacagcgacagcgtggagaatggcagcatcatcttcagcctgagcggcgtggccttcctgctgatggacaccaaggaatgtctgctgagcacagaggagatcttcctggccaagattgagaagttcatcaacatccaccagaacagcttcctggtgctgtctgctgccctgcacggccctgaggagtggaagctgatgttccgcatccagcagcgcttcctgggctgcaacctgcgcatcctgcctgtgcacaacacagtgaatgccatcaacctgatgtgcaccatcgccaagaccaccagcaagccctacatcgacagcatctgctacaggatgatcacagccaaggcctacatcatcgagcagagccctgtgtggaagaccctgcagaagatcaagctgaacagcgacagcgtgaaccccaactag

SEQ ID NO: 36019 - DNA, 543 bp, Artificial Sequence
  Description of Artificial Sequence: Synthetic coding sequence
atggccgagagcggcaaggagaagatcaagtggaccaccaccatcatcatcagcagcagcctgaagagctatgaggtggccacagccctggagaacagaagccacaaggtgcgctacagcgacagcgtggagaatggcagcatcatcttcagcctgtctggagtggccttcctgctgatggacaccaaggagtgcctgctgagcacagaggagatcttcctggccaagattgagaagttcatcaacatccaccagaacagcttcctggtgctgtctgctgccctgcacggccctgaggagtggaagctgatgttccgcatccagcagcgcttcctgggctgcaacctgcgcatcctgcctgtgcacaacacagtgaatgccatcaacctgatgtgcaccatcgccaagaccaccagcaagccctacatcgacagcatctgctacaggatgatcacagccaaggcctacatcatcgagcagagccctgtgtggaagaccctgcagaagatcaagctgaacagcgacagcgtgaaccccaactag

SEQ ID NO: 36020 - DNA, 813 bp, Artificial Sequence
  Description of Artificial Sequence: Synthetic coding sequence
atgcagggcaacaacctgcagccccccagcccccggcccctggagtgctggagcctgcaccgggaggccccccagaggacagaggccagcaggacccaccccagccccttcctggccctgcccggcagccacaggacagccaaccaggcccaggtggtgcccggcctggtgcaccacccccaggagaacacccagaggctgcgcatccgggccggcctgagccccttcccccgggcccggctggccgccatcggcagcacccacggccaccgctgggtgcccggcatctgcctgccccgctgcctgtgcccagccagctgtgccctgcacgcctgccccccccactgcaacaatgctgaggcccacagctggctgcggctgggcggccccctgcagagccgctctgtggagcaccagcagcacgcctgtggctggggctgggtgacccacgccacctatggagagcggggcaccagccaggccgctgagcggcagagaattgcccacacccgggccctgtctgtgggcaactgccccaggagccacttccagtgtgagttcagcagcatcagcaagtggagcgagggcaccggcaccttcagcccccggcccagggctgtgaagtctggagtgggcggccagcccagcccccacatccgcatcacctggaggagctgcaccaccctgaccagcaagccctgcagccgggccatcaccccagaatgtgtggtgggctggagccgccgcagccgccactggtacagcgacatgaggactggagagtgccagggcctgagccccatcaccaggtag

SEQ ID NO: 36021 - DNA, 333 bp, Artificial Sequence
  Description of Artificial Sequence: Synthetic coding sequence
atgacctacccaccccaccgggccttcagcagaagtgatgtgccctaccccctgctgagcagccctgtgcagtggcccctgagcctggtggtgggggacaccagcacccgctggccccagcagcccagcgccctggagagtgactgccccggccccagccacccctgcctggccggcctgctgggccccatgcaccctgtggacatccccctgagcacagccctgcacagcaagcaccagaggcggctgacccagtgtgtgctgatggtgcagagccccagcaagcagaggagcctgtacctgctgaacaagaagatcccccatgatgcctag

SEQ ID NO: 36022 - DNA, 408 bp, Artificial Sequence
  Description of Artificial Sequence: Synthetic coding sequence
atgggcaactacctgctgaggaagctgagctgcctgggggagaaccagaagaagcccaagaagggcaacccagatgaggagaggaagaggcaggagatgaccacctttgagaggaagctgcaggaccaggacaagaagagccaggaggtgagcagcaccagcaaccaggagaatgaaaatggcagcggcagcgaggaggtgtgctacaccgtcatcaaccacatcccccaccagaggagcagcctgagcagcaatgatgatggctatgagaacatcgacagcctgaccaggaaggtgcggcagttccgggagaggagtgaaacagaatatgccctgctgcggacctctgtgtcccggccctgcagctgcacccatgaacatgactatgaggtggtgttcccccactag

SEQ ID NO: 36023 - DNA, 348 bp, Artificial Sequence
  Description of Artificial Sequence: Synthetic coding sequence
atgggcaactacctgctgaggaagctgcggcaggagatgaccacctttgagaggaagctgcaggaccaggacaagaagagccaggaggtgagcagcaccagcaaccaggagaatgaaaatggcagcggcagcgaggaggtgtgctacaccgtcatcaaccacatcccccaccagaggagcagcctgagcagcaatgatgatggctatgagaacatcgacagcctgaccaggaaggtgcggcagttccgggagaggagtgaaacagaatatgccctgctgcggacctctgtgtcccggccctgcagctgcacccatgaacatgactatgaggtggtgttcccccactag

SEQ ID NO: 36024 - DNA, 402 bp, Artificial Sequence
  Description of Artificial Sequence: Synthetic coding sequence
atggtgatgctggaggacagcaacagcagcacaggctgtggggccaggaactgtgtggagtgcctggtgttcctgtctgtgctgggctgccagagcgagaggaagggccagatgaggacccagcaggccggccgctggctgcgggccggccgggaggccagcagcgagaccaaccctgagggcaccctcatcctggacttccagagccctgagctgcccctggccgcccggggctggcaggagcacgagcctgtggtgcgctgcaatgtgctgccccacgccttcagctcctggtgcttcggccagaacttccccaagtggagcgagacccaggagctgaggaacagagtgacagtgaagcgctgggagatcatcagctgtgagaacagcggggagagctag

SEQ ID NO: 36025 - DNA, 348 bp, Artificial Sequence; identical to SEQ ID NO: 36023
  Description of Artificial Sequence: Synthetic coding sequence

SEQ ID NO: 36026 - DNA, 243 bp, Artificial Sequence
  Description of Artificial Sequence: Synthetic coding sequence
atgggcaactacctgctgaggaagctgagctgcctgggggagaaccagaagaagcccaagaagggcaacccagatgaggagaggaagaggcaggagatgaccacctttgagaggaagctgcaggaccaggacaagaagagccaggaggtgagcagcaccagcaaccaggagaatgaaaatggcagcggcagcgaggaggtgtgctacaccgtcatcaaccacatcccccaccagaggagctag

SEQ ID NO: 36027 - DNA, 348 bp, Artificial Sequence; identical to SEQ ID NO: 36023
  Description of Artificial Sequence: Synthetic coding sequence

SEQ ID NO: 36028 - DNA, 585 bp, Artificial Sequence
  Description of Artificial Sequence: Synthetic coding sequence
atgttcctgacagctgtgaacccccagcccctgagcacccccagctggcagatcgagaccaagtacagcaccaaggtgctgaccggcaactggatggaggagaggaggaagttcacccgggacacagacaagaccccccagagcatctacaggaaggagtacatccccttcccagaccacaggccagaccagatcagccgctggtacggcaagaggaaggtggagggcctgccctacaagcacctgatcacccaccaccaggagcccccccaccgctacctgatcagcacctatgatgaccactacaacagacatggctacaaccctggcctgccccccctgcggacctggaatggccagaagctgctgtggctgcctgagaagagtgacttccccctgctggccccacccaccaactacggcctgtatgagcagctgaagcagaggcagctgacccccaaggccggcctgaagcagagcacctacaccagcagctaccccaggcctcccctgtgtgccatgtcctggagggagcacgctgtgcctgtgcccccccaccggctgcaccccttcccccacttctag

SEQ ID NO: 36029 - DNA, 471 bp, Artificial Sequence
  Description of Artificial Sequence: Synthetic coding sequence
atgttcctgacagctgtgaacccccagcccctgagcacccccagctggcagatcgagaccaagtacagcaccaaggtgctgaccggcaactggatggaggagaggaggaagggcctgccctacaagcacctgatcacccaccaccaggagcccccccaccgctacctgatcagcacctatgatgaccactacaacagacatggctacaaccctggcctgccccccctgcggacctggaatggccagaagctgctgtggctgcctgagaagagtgacttccccctgctggccccacccaccaactacggcctgtatgagcagctgaagcagaggcagctgacccccaaggccggcctgaagcagagcacctacaccagcagctaccccaggcctcccctgtgtgccatgtcctggagggagcacgctgtgcctgtgcccccccaccggctgcaccccttcccccacttctag

SEQ ID NO: 36030 - DNA, 4422 bp, Artificial Sequence
  Description of Artificial Sequence: Synthetic coding sequence
atgaccaggatgagctgcccctggggcagctaccagtgggagcccggggcctgcccagctgccccccggggcattggaggaggagacatggccggcggcatcccagatgtgcggggcctgcaggaggccgccctgggcgccggccgcagccaggaggaggcccggctggtggaggaggcccagacccctgtgatgctgccccaggacagcggccagagggtggaggaggtgcctggggacctgatggccaagaggatgagcctcatcctgcacgtgcagaagctgccctgggaccacgtgccctgcctgcggaggacccggcagaacctgtaccaggatgtgggcggccacgcccacggcagcggcctgggcggggccaagagaggagctgcccggagcgccctgcggcggcccctgcccccagccacctgcaggcctgctggcatcgtgtctggccccagcccccggctggacagcaaccccaccggggcccacctgatcaagcagacccggcccctgactgtggagtggaccaaggacacccctgtgcctgagcccatggagctgcggagtgatgccagccacaaggaaaatgtgagccccaagccagctgccctgcccaagccaggcaagaggctgaagcagaggcgcttcagaagaagcctgggcatcggcctgagcggcagacatgaccagtgggtgcccggctgccaggtggagcggggcggccctgctgccacccccagccctggagctgtgctggaccaggagccctgccgggtgcagaccaacctggccagccctggcccccggctgggcctggccctgaaggacaccaccggccagctggtgaacagcagcttctggcagcagagcaacctgcagagcctggcccggcggcggcagggcaaggcccgggagtttgccatccagcagagcaacctgagcatcaatgagaccagcagcccccacctgtgcccagagcccggcggcagcagcggcccccacaagctgccctggggccccctgctgagccaggagcccctggcccggcccagcagctgcctgcggcagagcggcctgcctgcccctggcacccccagcggggacttccggcccacagaggcctttgcccccctggatggccacacccagcccggcctgcgctcctggggcggcctgggctcctggaggagccggctggtgggggagcccctgaccctggaggacctggccgtgcccagccagaaccagacccaggcccccagcagagctgctgtgcaccagctgctggcctctgtgcactgcctggcccaggaggccgcccggctgcgctgccaggccccccaggagcccccagcctggggcgtgagccccaagcagaagggggaggagggcgccccccgggagcgggtgcaccgggaggaggagaggacagccttccacctgagtgacacagtgcctgccagcagcgccagcaagaacaaggcccagaacatcacagcccctgagagcgaggccatctgctggcagctgctgagccgctgcttccgctcctggaggcacctggtgaagaggcagcgggagcctgctgctgctgctgtggccctgggccgctggcagctgctgaggaagtgcctgcaggccctgtggctgcgggaggcccagctggaggccgcctggggccagtacaccaaggtgctgctggtgcgctccttccgggaggtgtctggcctgcaggtgggccctgggggccgggtgaagcagtgccccggcagcctgcgggaggaggagatcgcccagaggctgctgagccacccccggcagaggacagacagcagacatgagcgggtgcagatcctgcaggccctgcagctggccgtgttcttcctgtggtgccagcagaagaagagggcccggcaggagcgggagaccctgaggaaggccacccgggccacccagaggacaggcagcttcccccaggcctggcacagcacagctgctggggtggcctgggtggcccccctgagcccccagcaccagagggcctggctgtgccgctgctttggagcctggcagcagtttgtgcagaggggcagccgctacagagaccacctggccgacagaagaacaggcaccctgaggaagtgcctggagcagtgggtgaggatgaagcagctgcgggagagtgatggagccaaggtgacccagctgagcctgtgccggcagaaggccggccgggaggccgtgtacacagctggccctggggcctgtggcctgggcgctgtgggccaggcccagggccagcaggagcagggccggggcagcctgcaggatgcctgctggaccctggccctgtgctgggccctgctgctgtggaagatgaggctcttccagaggcagtgggccaacagcttcttccagggcctgcagcagaggatgctgcagaggagcctgcgctggtggcacctgcgggccctgggcccagatgccaccagcagctgcaccaagacccccagcgccctggagcccctgagcagcagcaccctgcaggacagcctggagaaggtgccccgggcccccaccctgcctgacaccctgcagggcagcctgctgtgggccgccggccagaggcagcagggccagtgcctgctgctgtggcaggcccgggcccagcagttccagggcacagcccgctggtaccagcacacccggcagaggcgcatcttcctgtcctggagccgctgggccacagcccagtgggcctggagggagctggccagccaccgggcctgggacaggacctgcagagctgtgctgggcctgtggaggcagaggctgctgcagagccggctggtggagtggtgggcccaggagcggggctggaggctggccagagatgccctgtgccactggcacagctgctggcagggccagcagttcctgcacgagaagtgccagacctgggtgcaggtgcacctgcagggcctgcagaaggtggtgttccgctcctggcagcaggccgccgcccaccagcgctgcaccgtgaccaggcctgagcagctgctgctgcagagctacttccaggcctggtgtgaggtggtgcgggacaccggggtgctgcgggcccagcaccaggccttccaggacggcctgcggcggcgggccctgggcgctgtgtttgccacctggagggaggcccaggaggtggccgccggggcccaggagcagagggtggcccaggccagcctggcccgctggaggagctgtggccagcagggccaggaggatggccagcagaagaaggcccgggccccccaggccttccctgcctggcctgtggcccctggcatgcaccacgaggcccagcagcaggccggggagagcgctggggcccaggccgcccagtgctggacctggtgctgggccctgtgggtgcatgagagctgccggggccaggtgtcccgggcccacgcctcctggaagccccgggcctgggtgctggaggcctctgtgcagagcgctgtgcggggcggcgtgcagagggccatcctgacccagctgcggcctgctgagctgcggcgcttcctgaggacagtgcagctgcgggtgcggctgggcctgcctggagctgggaagaccaggagctgctggacccaggccacagagctggtgcccccagcccccagcctgcagtgcagcctgggcggccgcaggaagccccggggcacagcctgggcccagcgctgccgggagcacagcctgtgcccagccttccagctgtggccccagtggccaggccagagctcctgggtgcccggcctgcccctgtggacccgggaccagggcccccgggcccacagcagccctgagccccgggcctgcaaggcccagagcaaggcccacaagaggcggctgcgggcccggagctgccgcatcctggagaagcaggcccaggcccacggcagcgccctgctgctggccctgaagggccatgatgccctgggccaccaggaggaggtgcctgctgcccctgtgccccggggcacagccagcagagctgctggcttccctgctggccaggtgcccggcagcggcatggccgccctgggcggctgcccccggggccgggctgctggagctgaccctgcccagggcgtggcccctgagatgggcctggctgatgtggtggccgctgaccctgccacagccagcggcagcgctgtgacagctgctggccgctgggccttcaagaagtggcaccagaggctggccgcccggagccccaggagaggagctgccagcagcccccggccctggagcaagccaggccccaagggccctgagagcggccaggaggccgcccgggccccccggggctggggcctgggcgctgagcacggggcccagctgcagctgtag

SEQ ID NO: 36031 - DNA, 732 bp, Artificial Sequence
  Description of Artificial Sequence: Synthetic coding sequence
cgcagtgatgccagccacaaggaaaatgtgagccccaagccagctgccctgcccaagccagagcagaggcgcttccgccgcagcctgggcatcggcctgagcggcagacatgaccagtgggtgcccggctgccaggtggagcggggcggccctgctgccacccccagccctggagctgtgctggaccaggagccctgccgggtgcagaccaacctggccagccctggcccccggctgggcctggccctgaaggacaccaccggccagctggtgaacagcagcttctggcagcagagcaacctgcagagcctggcccggcggcggcagggcaaggcccgggagtttgccatccagcagagcaacctgagcatcaatgagaccagcagcccccacctgtgcccagagcccggcggcagcagcggcccccacaagctgccctggggccccctgctgagccaggagcccctggcccggcccagcagctgcctgcggcagagcggcctgcctgcccctggcaccccatctggggacttccggcccacagaggcctttgcccccctggatggccacacccagcccggcctgcgctcctggggcggcctgggctcctggaggagccggctggtgggggagcccctgaccctggaggacctggccgtgcccagccagaaccagacccaggcccccagcagagctgctgtgcaccagctgctggccagcaccctgggctag

SEQ ID NO: 36032 - DNA, 2187 bp, Artificial Sequence
  Description of Artificial Sequence: Synthetic coding sequence
atggagggggagggcgtgaggaacttcaaggagctgcgggccaagttccagaacctggatgccccacccctgcccggccccatcaagtttcctgctggggtgagccccaagggggacatcggcggcacccagagcacccagatcctggccaacgggaagcccctgagcagcaaccacaagcagaggaccccctactgcagcagcagcgagagccagcccctgcagccccagaagatcaagctggcccagaagtctgagatccccaagtgcagcaacagccctggccccctgggcaagagcacagtgtgcagcgccaccagcagccagaaggccagcctgctgctggaggtgacccagagcaatgtggagatcatcaccaaggagaaggtgatggtggccaacagcttcaggaacaagctgtggaactgggagaaggtgagcagccagaagtctgagatgagcagcgccctgctgctggccaactacggcagcaaggccatccacctggagggccagaagggcatgggcctgaccccagaggagcccaggaagaagctggagaccaagggggcccagaccctgcccagccagaagcacgtggtggcccccaagatcctgcacaacgtgtctgaggaccccagctttgtgatcagccagcacatcaggaagtcctgggagaaccccccacctgagaggagccctgccagcagcccctgccagcccatctatgaatgtgagctggccagccaggcccctgagaagcagccagatgtgcgccaccaccacctgcccaagaccaagcccctgcccagcattgacagcctgggccccccaccacccaagcccagcaggcctcccatcgtgaacctgcaggccttccagaggcagcctgctgctgtgcccaagacccagggcgaggtgacagtggaggagggcagcctgagccctgagcggctcttcaatgctgagtttgaggagccccacaactatgaggccaccatctcctacctgcggcacagcggcaacagcatcaacctgtgcacagccaaggagattgctgaccccacctatgaggtgggcatcgaggagctgcagaagccaggcaagaacttcccctacccagagcccagcgccaagcatgaggacaagaagatgaaggagaagcagccctgtgagctgaagcccaagaacacagagaaggagccctacagcaaccacgtgttcaaggtggatgcctgtgagggcaccccagagaagatccagatgaccaacgtgcacactggaagaagaaacatgctggccggcaagcaggaggccatgattgacatcatccagaccaacccctgcccagagggccccaagctggcccggcacagccagggccactgcggccacctggaggtgctggagagcaccaaggagaccccagacctgggcgtgtccaagaccagcagcatcagcgaggagatctatgatgatgtggagtacagcaggaaggaggtgcccaagctgaactacagcagcagcctggccagcagcagcgaggagaaccgggagctgtatgaagatgtgtacaagaccaagaacaactaccccaagattgacctggatggcaaggaggccctgaagaggctgcagcagttcttcaagaaggagaaggaccgcttcaagatcaagaagaccaagagcaaagaaaacctgagcgccttcagcatcctgctgcctgacctggagctgaagagccaggaggtgatcatctatgatgatgtggacctgtctgagaaggagagcaaggatgaggacaagctgaagatgtggaagcccaagttcctgacccccaaggagaagaaggagaagaatggagctgaggagagcgagagcttcagccccaggaacttcttcaagaccaagaagcagaacctggagaagaacaggatgaagcgggaggagaagctgttccgggagcgcttcaagtatgacaaggagatcatcgtcatcaacacagctgtggcctgcagcaacaacagcagaaatggcatctttgacctgcccatcagccctggagaggagctggaggtgattgacaccacagagcagaacctggtgatctgcaggaacagcaagggcaagtatggctacgtgctgattgagcacctggacttcaagcaccagagctggagcccctag

SEQ ID NO: 36033 - DNA, 2091 bp, Artificial Sequence
  Description of Artificial Sequence: Synthetic coding sequence
atgcccacccaggacggccagctgcggcggcctgcccggcccccaggcccccgggcctggatggagccccggggcggcggcagcagccagttcagcagctgccccggccctgccagcagcggggaccagatgcagaggctgctgcagggccctgcccccaggcctcctggagagcccccaggcagccccaagagccctggccacagcacaggcagccagaggcccccagacagccctggggccccacccaggagccccagcaggaagaagagaagagctgtgggcgccaagggcggcggccacactggagccagcgccagcgcccagacaggcagccccctgctgcctgctgccagccctgagacagccaagctgatggccaaggccggccaggaggagctgggccctggccctgctggggcccctgagcccggccccaggagccctgtgcaggaggacaggcctggccctggcctgggcctgagcacccctgtgcctgtgacagagcagggcacagaccagatccgcaccccaagaagagccaagctgcacacagtgtccaccaccgtgtgggaggccctgcctgatgtgtcccgggccaagagtgacatggctgtgtccaccccagccagcgagccccagcctgaccgggacatggctgtgtccaccccagccagcgagccccagagcgaccgggacatggctgtgtccaccccagccagcgagccccagcctgacacagacatggctgtgtccaccccagccagcgagccccagcctgaccgggacatggctgtgtccatcccagccagcaagccccagagcgacacagctgtgtccaccccagccagcgagccccagagctctgtggccctgagcacccccatcagcaagccccagctggacacagatgtggccgtgtccaccccagccagcaagcacggcctggatgtggccctgcccacagctggccctgtggccaagctggaggtggccagcagcccccctgtgtctgaggccgtgcccaggatgacagagagcagcggcctggtgtccacccctgtgcccagggcagatgctgctggcctggcctggccacccaccaggagagctggcccagatgtggtggagatggaggccgtggtgtctgagcccagcgctggggcccctggctgctgcagcggggccccagccctgggcctgacccaggtgcccaggaagaagaaggtgcgcttctctgtggccggccccagccccaacaagccaggcagcggccaggccagcgcccggcccagcgccccccagacagccaccggggcccatggaggccctggggcctgggaggccgtggccgtgggcccccggccccaccagccccgcatcctgaagcacctgccccggcccccaccttctgctgtgaccagggtgggccctggcagcagctttgctgtgaccctgcctgaggcctatgagttcttcttctgtgacaccatcgaggagaatgaggaggccgaggccgctgctgctggccaggaccctgctggggtgcagtggccagacatgtgtgagttcttcttcccagatgtgggcgcccagaggagcagaagaagaggcagccctgagcccctgcccagggctgaccctgtgcctgcccccatccctggggaccctgtgcccatcagcatccctgaggtgtatgagcacttcttctttggagaagatcggctggagggcgtgctgggccctgctgtgcccctgcccctgcaggccctggagcccccaagaagtgccagcgagggcgccggccctggcacccccctgaagccagctgtggtggagcggctgcacctggccctgcggcgggccggggagctgcggggccctgtgcccagctttgccttcagccagaatgacatgtgcctggtgtttgtggcctttgccacctgggccgtgaggaccagtgacccccacaccccagatgcctggaagacagccctgctggccaacgtgggcaccatcagcgccatccgctacttccggcggcaggtgggccagggcagaagaagccacagccccagccccagcagctag

SEQ ID NO: 36034 - DNA, 1197 bp, Artificial Sequence
  Description of Artificial Sequence: Synthetic coding sequence
atgccccggcccggccaccccaggcctgccagcggccccccccggctgggcccctgggagcggcccacagagctgtgcctggagacctatgacaagccaccccagcccccacccagcaggaggaccaggaggccagaccccaaggaccccggccaccacggccctgagagcatcaccttcatcagcggcagcgctgagcccgccctggagagccccacctgctgcctgctgtggaggccctgggtgtgggagtggtgccgggccgccttctgcttccgccgctgccgggactgcctgcagagatgtggggcctgtgtgcggggctgcagcccctgcctgagcacagaggacagcacagagggcacagctgaggccaactgggccaaggagcacaacggggtgccccccagcccagaccgggccccacccagcagaagagatggccagaggctgaagagcaccatgggcagcagcttctcctacccagatgtgaagctgaagggcatccctgtgtacccctacccccgggccaccagccctgccccagatgctgacagctgctgcaaggagcccctggccgaccccccacccatgaggcacagcctgcccagcacctttgccagcagcccccggggcagcgaggagtactacagcttccacgagagtgacctggacctgcctgagatgggcagcggctccatgagcagccgggagattgatgtgctgatcttcaagaagctgacagagctgttctctgtgcaccagattgatgagctggccaagtgcaccagtgacaccgtcttcctggagaagaccagcaagatcagtgacctgatcagcagcatcacccaggactaccacctggatgagcaggatgctgagggccgcctggtgcggggcatcatccgcatcagcaccaggaagagccgggcccggccccagaccagcgagggccgcagcaccagggctgctgcccccacagctgctgccccagattctggccacgagaccatggtgggcagcggcctgagccaggatgagctgactgtgcagatcagccaggagaccacagcagatgccatcgccaggaagctgcggccctacggggcccctggctacccagccagccatgacagcagcttccagggcacagacacagacagcagcggggcccccctgctgcaggtgtactgctag

SEQ ID NO: 36035 - DNA, 624 bp, Artificial Sequence
  Description of Artificial Sequence: Synthetic coding sequence
atgccccggcccggccaccccaggcctgccagcggccccccccggctgggcccctgggagcggcccacagagctgtgcctggagacctatgacaagccaccccagcccccacccagcaggaggaccaggaggccagaccccaaggaccccggccaccacggccctgagagcatcaccttcatcagcggcagcgctgagcccgccctggagagccccacctgcctgctgcggacccccctgcggggcctgctgaagcccaccggccccaggagcaccatggagtgccccccagccctgattgtgcaccccccagctgggggcatggccagcggcagcagccagccctgggccgccgccagcgccacccccatgctgagcagcaaggccagcctgtgcatccccacccggggccccccaccccagcccctgatgaggaccccagctgcccggagccactggcccatcccccacccctgtgacacagcctgcccagcccccctgcctgtggtgctggtggcccccaggagcaccatcctgtccatgagcaggacctggacctgccgccgctgggccgtggccccctgcagagctgagaagctgatgtgcagcagcagccgctcctag

SEQ ID NO: 36036 - DNA, 4593 bp, Artificial Sequence
  Description of Artificial Sequence: Synthetic coding sequence
atgagccacagccaccctgctggcctgctggccgcctacaacagcctgatggacaagcacctggccggctacttcaacaacacccgcatcagaagacacctgctgcggagcggcctcatcaccaggagcggccgcatcctgtctgagaaggagtacaagctgaacatgatgaagagggaccaccagaagtacatcagagaatgtctggcccaggccatcttccacaaggtgctggacatggagcgctaccaccagctggagatcaagaagaagctggagaccctggccaggaaggagcgcatccagcgcttcaagggggagcacacccggcgctctgtggagaacaacatgcccatcctgagcccccacccccctgtgggccccaagagcaacagaggccacagcgtgctggtggatgagggccacagcagccccctggccctgacagccccccggccctacacagcccctggcaacatgcagccccccatccggctgcagcccctgcccagcaacccagctgtggagaccgtgcccaaggtgaccagccgcagccgcagcaagaccagcctgctggagaatgaggccctcttccccatcggcggcaagaaggctgtgatgaagttcaggaacagcatcggcaacagccagaggatgaacagctaccagctgcccaacatcaacagctacatgatgcccatccccccacccctgcccccaacaggcaagatcaccagagaaaatagaagtgagacctggaggagaagacgcttccggcccaccacagccccaaatggcctggagcccctgctgaccaaggacagccgccgcatccacaagaccagcctgcacagcaatgctgccatcaccatgatctacctgggcaagaatgtgcacctgagcagtgacaacccagacttcagagatgagatcaaggtgtaccagcagcactgtggaggagagaacctgtgtgtgtacaagggcaagctgctggagaaggagaccttccagttcatcagcaagaggcaccacggcttccccttcagcctgaccttcttcctgaatggcatgcaggtgaaccggctgagcagctgctgtgagtacaagcacaggaagggcagccggctgggcggcaagaggggctactttggatttgtgtgtgtggagaggagcagcccctgctacaagtgcatcatcgccatgggcctggacaagaagcccagcctgcccaagagcaggaaggagaagagcacagagaagggggaggagctgaagaaggccgagggcaaggtgaggaaggagcgggagtatgtgatccccaagagaaatgagatcaaggagaacaagacctctgtgtctgccaagttcagcgcccaggagatcaagacaggcctgaaggaggtggtgacagctgtggaggagatgaccagcaagggcaagccaggccaggaggtgctggaggatgaccaggagaacaccctgaagtatgaatatgaggaggactttgaggtggatgaggagaagcagggcgagaagagcaatgaggagggccaggctgatgtgcagatgaatggcatcccccagagccccctggatgacaagaaggacaacctggaccctgagaaggagagcgagaccagcagccagaaggccccagatgcccgggacaacgtgaaggatgaaaatgatggctgcagcgagagcgagctggaggaggacaagcaggacatgaagacagccagcagcaccagcagccgcagccacccctacagcagtgacagtgaagatgagagcgctgtgggggaccgggaggcccacacagacagcagcacagatgagagcgcccggcgcagcagcagccaggagctgtctgaaaatgacaagcccaggaagagccacctgcccatcgaggagagcctggagattgaaattgaggaccaggagatcaccaaggcagatgtggagaccaagcccatgcccattgatgagagctttgaaaatgtgctgaaggagggcacagagaagggcacccaggagattgctgagggcctgtctgagaagagcggcaagcacgtgtctgctgaggagaaggagaaggacaagagcaagctgtgggaggagagcacagcccaggtgaaggacaagaaggccggcctgcccggcctggaggagggcggcaaggacagcctgcccctggcctacgtgctggccctgggcgcccccaccatgaacttcatggtggatgaaacagctgccatcaacagcaacaaggagagccagcagctggtgcagaagacctacaccctggagaagaaggaggccatggaggaggatgaggccccccagcacagagatgctgacatcgtgcagggcaagggggaggccgccctgtggggcgaggccggggctgtgcatgaggcccccctgcgggcctggaagcccacagctgagcagcctgagctggccgaggagttcacagagaagcgggagatccccccaggcatcgagagaggagctgagggcgctgctgaggccgagggcgtgcggcggctgggggagggcggcagtgaccccatcggccaggccgccgccaaggatgctgtgggcctgagcaaggatgaggcccctgagaagcaggccctgatgctgactgtgctggagacagacaaggccgccagcgagggggagcagggcctggagaaggctgtgctggccaatgaggccgccgccctgaacctggagcacctgcacgaggtggccgccctgcgggaggccgccaccagcgaggagggggaggccgagggcggcgtggccgtgtctgatgtgggggagagcgaggaggaggccagcattgacctggaggacaccggccccatggaggacacagccagcaagagagaagatggcagcgaggaggccatcctgggcggggaggagcccgccaaggagaggaaggaggtgatgaggacagagacccggctgagccccttcaccggggaggccgaggccagcaggatgcaggtgtctgagggcagccctgaggagggcagcctggccaaggaggccttcctgtgcaaggaggatgtggagggggaggagatggtgacagaggccgaggccaacagagaagatgacaggaaggagatcctgcccaaggagctggacctggcccgggagaggaggaaggccgagcggcccaagaccagcctgaggaagacagattctgagcgggaggaggtgacccgggccaatgccctgaaggatgaagatgccttcaaggaggagcagaagctgaaggccgaggagggggagacagaaacagaggtgcgggcagaggaggagaccaaggcccccccaaatgagatgggcagtgatgctgaaaatgaggcccctgtggaggccagcgagctgagtgacaaccctggcctgctgggggaggacagcctgaaggagaccgtggtgcccatctttgaggccaccccaggctttgagaagagcctggagaacatcacagccctgaggaaggagggcggcggggagcggctgtctgaggcccgggacacagagcacaaggaccgggaggagctgagcagccgggagaacagagccctgaaggagggccaccggcaggatggagagggcgccctggccgcccctgaggccgagcctgctgggaaggtgcaggcccctgagggcctcatcccagccaccggccaggccgaggagctggccgccaaggaccatgacagctgtgccggcctggagggccgggcagagggccagggcggcgtggatgtggtgctgcggacccaggaggccgtggccgaggaggaccccatcatggccgagaagttccgggaggaggccgtggatgaggaccctgaggaggaggaggacaaggaatgtaccctggagacagaggccatgcaggacaggaacagtgaaggagatggagacatggagggggagggcaacacccagaagaatgaaggcatgggcggcggccgggtggtggccgtggaggtgctgcacggcggcggggagacagctgagacagctgctgaggagcgggaggtgctggccggcagcgagacagctgaggagaagaccatcgccaacaaggccagcagcttcagtgatgtggccgaggaggagacctggcaccagcaggatgagctggtgggcaagacagctgctgctgggaaggtggtggtggaggagctggcccggtctggagaggaggtgcctgctgctgaggagatgacagtgacctacaccacagaagctggggtgggcacccctggggccctggagaggaagaccagcggcctgggccaggagcaggaggagggcagcgagggccaggaggccgccactggaagtggagatggccggcaggagaccggggctgctgagaagttccggctgggcctgagccgggagggggagcgggagctgagccctgagagcctgcaggccatggccaccctgcctgtgaagccagacttcacagagacccgggagaagcagcagcacatggtgcagggcgagagcgagacagcagatgtgagccccaacaacgtgcaggtgtag

SEQ ID NO: 36037 - DNA, 1602 bp, Artificial Sequence
  Description of Artificial Sequence: Synthetic coding sequence
atgctggccaagggcaagaaggctgtgatgaagttcagaaattccatcggcaacagccagaggatgaacagctaccagctgcccaacatcaacagctacatgatgcccatccccccacccctgccccccaccgggaagatcacccgggagaacagaagtgagacctggaggagaagacgcttccggcccaccacagcccccaacggcctggagcccctgctgaccaaggacagccgccgcatccacaagaccagcctgcacagcaatgctgccatcaccatgatctacctgggcaagaatgtgcacctgagcagtgacaacccagacttcagagatgagatcaaggtgtaccagcagcactgcggcggggagaacctgtgtgtgtacaagggcaagctgctggagaaggagaccttccagttcatcagcaagaggcaccacggcttccccttcagcctgaccttcttcctgaatggcatgcaggtgaaccggctgagcagctgctgtgagtacaagcacaggaagggcagccggctgggcggcaagaggggctacttcggctttgtgtgtgtggagaggagcagcccctgctacaagtgcatcatcgccatgggcctggacaagaagcccagcctgcccaagagcaggaaggagaagagcacagagaagggggaggagctgaagaaggccgagggcaaggtgaggaaggagcgggagtatgtgatccccaagagaaatgagatcaaggagaacaagacctctgtgtctgccaagttcagcgcccaggagatcaagacaggcctgaaggaggtggtgacagctgtggaggagatgaccagcaagggcaagccaggccaggaggtgctggaggatgaccaggagaacaccctgaagtatgaatatgaagaagattttgaggtggatgaggagaagcagggcgagaagagcaatgaggagggccaggctgatgtgcagatgaatggcatcccccagagccccctggatgacaagaaggacaacctggaccctgagaaggagagcgagaccagcagccagaaggccccagatgcccgggacaacgtgaaggatgaaaatgatggctgcagcgagagcgagctggaggaggacaagcaggacatgaagacagccagcagcaccagcagccgcagccacccctacagcagtgacagtgaagatgaatctgctgtgggggaccgggaggcccacacagacagcagcacagatgaaagtgcccggcgcagcagcagccaggagctgtctgaaaatgacaagcccaggaagagccacctgcccatcgaggagagcctggagattgaaattgaggaccaggagatcaccaaggcagatgtggagaccaagcccatgcccattgatgagagctttgaaaatgtgctgaaggagggcacagagaagggcacccaggagattgctgagggcctgtctgagaagagcggcaagcacgtgtctgctgaggagaaggagaaggacaagagcaagctgtgggaggagagcacagcccaggtgaaggacaagaaggccggcctgcccggcctggaggagggcggcaagtatggaagatag

SEQ ID NO: 36038 - DNA, 732 bp, Artificial Sequence
  Description of Artificial Sequence: Synthetic coding sequence
atgaggagcaggaagctgactggagctgtgcgcagcagcgcccggctgaaggcccggagctgcagcgctgcccggctggccagcgcccaggaggtggccggcagcaccagcgccaagacagcctgcctgaccagcagcagccacaaggccacagacaccaggaccagcaagaagttcaagtgtgacaagggccacctggtgaagtctgagctgcagaagctggtgcccaagaatgacagcgccagcctgcccaaggtgaccccagagaccccctgtgaaaatgaatttgctgagggcagcgccctgctgcccggcagcgaggccggcgtgtctgtgcagcagggcgccgccagcctgcccctgggcggctgccgggtggtgtctgacagccggctggccaagaccagagatggcctgtctgtgcccaagcacagcgctggcagcggggctgaggagagcaacagcagcagcacagtgcagaagcagaatgaacctggcctgcagacagaagatgtgcagaagccacccctgcagatggacaacagcgtcttcctggatgatgacagcaaccagcccatgcctgtgagccgcttctttggaaatgtggagctgatgcaggacctgcccccagccagcagcagctgccccagcatgagccggcgggagttcaggaagatgcacttccgggccaaggatgatgatgatgatgatgatgatgatgctgagatgtag

SEQ ID NO: 36039 - DNA, 1245 bp, Artificial Sequence
  Description of Artificial Sequence: Synthetic coding sequence
atgagggagagccaggatgctgctggggcccacggctggaacagagtgggcagcacagccaccaagtggttcaccggggccccctttggagtgcagagccacagatttgacatctctgctgtgtaccccaactggaagaagttcagcaccttcacagaggccccctacagcacccgctacagcacccaggtgagccacatcggccctggcacctacagcagcaaggagacctgcttcagcaagaagaagctgatgaaggaggtggacaccggctgggccaaggcccaggaggccacccggctgacccagctgccccacttccagtaccaggccatcatgaaggagaagaggctgaaggagcagaagctgggccctggcagctacaacctgaaggacttcctggagcagctgcgggagaagccctgcagcacccggggcctgctgagcagcggggaggtgcgcttccggggcctgactggaaactactacccaggccctggcaactatggagagaagggcaacccctacaccaagctggaggagaatgcctggaacagaagccacagcgagggcctgatgtgcaggatgagcaacaagccccacccccggccctaccagggcagcggcctgggccctggcacctacttcttcaagagtgacctggagacctacgtggcccggtctgtgggcacccggggcccctatgacaccttcagcggggacaggagcaagcccctgccctacggccactacagcatgcagaagaagaagccccgggagctgatgaacttcaagagctttgtggaggagctgaacagccaccacaacaagaagcatggagtcttcagcaagctgcccaggaaccccaagacccccacagagcgcatctactgggccaacctgagccagtgccccaggaccctggccaccagcggccccagcttctggctgccccaggagaagaagtgcaagcctgtgaaccagccccccttcctgctgaccagcaagggcagcggggccaaggcctgccagatgatcatgggctcctggaaccctgtgggcgtgggccgctacctgaacacctggctgatggagaccaaggaccggcggcagcgctaccgcagcctcttcctgagcggcagcaagcgctacctgagtgacctggcccgggacatgctgatgcagatccgcctcttctgctggaagggcctggaggtgatcaactttggcctgagccccatgtag

SEQ ID NO: 36040 - DNA, 1257 bp, Artificial Sequence
  Description of Artificial Sequence: Synthetic coding sequence
atgagggagagccaggatgctgctggggcccacggctggaacagagtgggcagcacagccaccaagtggttcaccggggccccctttggagtgcagagccacagatttgacatctctgctgtgtaccccaactggaagaagttcagcaccttcacagaggccccctacagcacccgctacagcacccaggtgagccacatcggccctggcacctacagcagcaaggagacctgcttcagcaagaagaagctgatgaaggaggtggacaccggctgggccaaggcccaggaggccacccggctgacccagctgccccacttccagtaccaggccatcatgaaggagaagaggctgaaggagcagaagctgggccctggcagctacaacctgaaggacttcctggagcagctgcgggagaagccctgcagcacccggggcctgctgagcagcggggaggtgcgcttccggggcctgactggaaactactacccaggccctggcaactatggagagaagggcaacccctacaccaagctggaggagaatgcctggaacagaagccacagcgagggcctgatgtgcaggatgagcaacaagccccacccccggccctaccagggcagcggcctgggccctggcacctacttcttcaagagtgacctggagacctacgtggcccggtctgtgggcacccggggcccctatgacaccttcagcggggacaggagcaagcccctgccctacggccactacagcatgcagaagaagaagccccgggagctgatgaacttcaagagctttgtggaggagctgaacagccaccacaacaagaagcatggagtcttcagcaagctgcccaggaaccccaagacccccacagagcgcatctactgggccaacctgagccagtgccccaggaccctggccaccagcggccccagcttctggctgccccaggagaagaagtgcaagcctgtgaaccagccccccttcctgctgaccagcaagggcagcggggccaaggcctgccagatgatcatgggctcctggaaccctgtgggcgtgggccgctacctgaacacctggctgatggagaccaaggaccggcggcagcgctaccgcagcctcttcctgagcggcagcaagcgctacctgagtgacctggcccgggacatgctgatgcaggagcgcatcacccccttcaccaagggcaaatgtcctcccaccgtggactacaacagcgaccccaccccctag

SEQ ID NO: 36041 - DNA, 372 bp, Artificial Sequence
  Description of Artificial Sequence: Synthetic coding sequence
atgctgggccccaatgcccaggtgacagtggtggtggcccagcccggccctgaccacctggaccacctgctgctggacacccagcactgccagcacagcagctgtggcagcgctgcctgcacccagctgacctgggtgccctgcctgggcggcagccacaaggccagcatcaagatgtctgcccaggccgtggtgtccacagaggccccctgggagcggccctgcttccaggcccacctgggctgcctgcagaacagcgtgctgtgcagctgcaggatggagggcttcagcctcttcctggccatgctgtggggcggcgtgggggagctgcccagcgacccccggggccacctgcagttcctggccacctag

SEQ ID NO: 36042 - DNA, 372 bp, Artificial Sequence; identical to SEQ ID NO: 36041
  Description of Artificial Sequence: Synthetic coding sequence

SEQ ID NO: 36043 - DNA, 306 bp, Artificial Sequence
  Description of Artificial Sequence: Synthetic coding sequence
atgtctgtggagaagatgaccaaggtggaggagagcttccagaaggccatgggcctgaagaagacagtggaccgctggaggaacagccacacccactgcctgtggcagatggccctgggccagaggaggaacccctatgccaccctgaggatgcaggacaccatggtgcaggagctggccctggccaagaagcagctgctgatggtgcggcaggccgccctgcaccagctgtttgagaaggagcaccagcagtaccagcaggagctgaaccagatgggcaaggccttctacgtggagcgcttctag

SEQ ID NO: 36044 - DNA, 534 bp, Artificial Sequence
  Description of Artificial Sequence: Synthetic coding sequence
atggccaccaactacagcgccaaccagtatgagaaggccttcagcagcaagtacctgcagaactggagccccaccaagcccaccaaggagagcatcagcagccatgagggctacacccagatcatcgccaatgaccggggccacctgctgcccagcgtgcccaggagcaaggccaacccctggggcagcttcatgggcacctggcagatgcccctgaagatccccccagcccgggtgaccctgaccagcaggaccacagctggagctgccagcctgaccaagtggatccagaagaacccagacctgctgaaggccagcaatggcctgtgcccagagatcctgggcaagccccatgaccctgacagccagaagaagctgaggaagaagagcatcaccaagacagtgcagcaggcccggagccccaccatcatccccagcagccctgctgccaacctgaacagcccagatgagctgcagagcagccaccccagcgctggccacaccccaggcccccagaggcctgccaagagctag

SEQ ID NO: 36045 - DNA, 510 bp, Artificial Sequence
  Description of Artificial Sequence: Synthetic coding sequence
atgccacccacccgggaccccttccagcagcccaccctggacaatgatgacagctacctgggggagctgcgggccagcaagaagctgccctacaagaaccccacccacctggcccagcagcaggagccctggagccggctgaacagcacccccaccatcacctccatgagaagagatgcctactactttgatcctgagatccccaaggatgacctggacttccggctggccgccctgtacaaccaccacacaggcaccttcaagaacaagtctgagatcctgctgaaccagaagaccacccaggacacctaccgcaccaagatccagtttcctggagagttcctgaccccacccaccccacccatcaccttcctggccaacatccgccactggatcaaccccaagaaggagagcatccacagcatccagggcagcatcgtgagcccccacacagctgccaccaatggaggctacagcaggaagaaggatggcggcttcttcagcacctag

SEQ ID NO: 36046 - DNA, 474 bp, Artificial Sequence
  Description of Artificial Sequence: Synthetic coding sequence
atggagaggagccccagcagaagaagaaggctggaggaggcccccaagctgccctacaagaaccccacccacctggcccagcagcaggagccctggagccggctgaacagcacccccaccatcacctccatgagaagagatgcctactactttgatcctgagatccccaaggatgacctggacttccggctggccgccctgtacaaccaccacacaggcaccttcaagaacaagtctgagatcctgctgaaccagaagaccacccaggacacctaccgcaccaagatccagtttcctggagagttcctgaccccacccaccccacccatcaccttcctggccaacatccgccactggatcaaccccaagaaggagagcatccacagcatccagggcagcatcgtgagcccccacacagctgccaccaatggaggctacagcaggaagaaggatggcggcttcttcagcacctag

SEQ ID NO: 36047 - DNA, 381 bp, Artificial Sequence
  Description of Artificial Sequence: Synthetic coding sequence
atgcccagcagcaccctgacctgcaagccctttgacctgaagcagaggagcagcagaagaggccccaagagcacagccagcgccagccccaggagctgcctgaagcccagctgtgggaagcaggtgtgcctgctgctgtctgtgagaagaagccagagcctggcccaccctggccgggacagcaccagggtgctgagctaccagcagaccagcagtgatgctgtgtcccagtacaagcacacaggcaaggtggaggagctgtatggcctgcggctgtcctggctgagccaggcccagttcctgctggcccaggacaagacagcctatgctgtgaagtctgtggtgctgcctgccagcaaccacaagaccaagggccagtag

SEQ ID NO: 36048 - DNA, 216 bp, Artificial Sequence
  Description of Artificial Sequence: Synthetic coding sequence
atgcccagcagcaccctgacctgcaagccctttgacctgaagcagaggagcagcagaagaggccccaagagcacagccagcgccagccccaggtcctggatcctgagccagaaccccaaggcccagagcagccatgagaagaccagcggcaagcccaagttccgggaggtgctgcagaacaccaaccagtacagcagcaagttcagccgctcctag

SEQ ID NO: 36049 - DNA, 282 bp, Artificial Sequence
  Description of Artificial Sequence: Synthetic coding sequence
atgaccaacaccaaggaccccaagagggccatggagagcaccctggccaccagcaacagcgccaccggccctgtgaccttcagccacgtgtttggccagcagtgccagctgatgcaggccgctgtgcagagcctgcacaccctgaatgaccagatcagccacttcatcgtgaccaagagcaaggccctggaggaggacaaggaccccttcctgcccacagagaaggagaccctgaagagctccatgatcctgatgaggcacctgctgatggatgcccagtag

SEQ ID NO: 36050 - DNA, 984 bp, Artificial Sequence
  Description of Artificial Sequence: Synthetic coding sequence
atggcctccatggccgccgccatcgccgccagccgctctgctgtgatgagcggcaaccggcccctggatgaccgggagaggaagcgcttcacctacttcagcagcctgagccccatggccaggaagatcatgcaggacaaggagaagatccgggagaagtatggccctgagtgggcccggctgcccccagcccagcaggatgagatcatcgaccgctgcctggtgggcccccgggccccagccccccgggaccccggggacagcgaggagctgacccgcttccctggcctgcggggccccaccggccagaaggtggtgcgctttggagatgaggacctgacctggcaggatgagcacagcgcccccttctcctgggagaccaagagccagatggagttcagcatcagcgccctgagcatccaggagcccagcaatggaacagctgccagcgagccccggcccctgagcaaggccagccagggcagccaggccctgaagagcagccagggcagccgcagcagcagcctggatgccctgggccccaccaggaaggaggaggaggccagcttctggaagatcaatgctgagaggagcagaggagagggccctgaggccgagttccagagcctgacccccagccagatcaagtccatggagaagggggagaaggtgctgcccccctgctaccggcaggagcccgcccccaaggaccgggaggccaaggtggagcggcccagcaccctgcggcaggagcagaggcccctgcccaacgtgtccacagagcgggagcggccccagcctgtgcaggccttcagcagcgccctgcacgaggccgcccccagccagctggagggcaagctgcccagcccagatgtgcggcaggatgatggagaggacaccctcttcagcgagcccaagtttgcccaggtgagcagcagcaatgtggtgctgaagacaggctttgacttcctggacaactggtag

SEQ ID NO: 36051 - DNA, 870 bp, Artificial Sequence
  Description of Artificial Sequence: Synthetic coding sequence
atggccaggaagatcatgcaggacaaggagaagatccgggagaagtatggccctgagtgggcccggctgcccccagcccagcaggatgagatcatcgaccgctgcctggtgggcccccgggccccagccccccgggaccccggggacagcgaggagctgacccgcttccctggcctgcggggccccaccggccagaaggtggtgcgctttggagatgaggacctgacctggcaggatgagcacagcgcccccttctcctgggagaccaagagccagatggagttcagcatcagcgccctgagcatccaggagcccagcaatggaacagctgccagcgagccccggcccctgagcaaggccagccagggcagccaggccctgaagagcagccagggcagccgcagcagcagcctggatgccctgggccccaccaggaaggaggaggaggccagcttctggaagatcaatgctgagaggagcagaggagagggccctgaggccgagttccagagcctgacccccagccagatcaagtccatggagaagggggagaaggtgctgcccccctgctaccggcaggagcccgcccccaaggaccgggaggccaaggtggagcggcccagcaccctgcggcaggagcagaggcccctgcccaacgtgtccacagagcgggagcggccccagcctgtgcaggccttcagcagcgccctgcacgaggccgcccccagccagctggagggcaagctgcccagcccagatgtgcggcaggatgatggagaggacaccctcttcagcgagcccaagtttgcccaggtgagcagcagcaatgtggtgctgaagacaggctttgacttcctggacaactggtag

SEQ ID NO: 36052 - DNA, 594 bp, Artificial Sequence
  Description of Artificial Sequence: Synthetic coding sequence
atggagttcagcatcagcgccctgagcatccaggagcccagcaatggaacagctgccagcgagccccggcccctgagcaaggccagccagggcagccaggccctgaagagcagccagggcagccgcagcagcagcctggatgccctgggccccaccaggaaggaggaggaggccagcttctggaagatcaatgctgagaggagcagaggagagggccctgaggccgagttccagagcctgacccccagccagatcaagtccatggagaagggggagaaggtgctgcccccctgctaccggcaggagcccgcccccaaggaccgggaggccaaggtggagcggcccagcaccctgcggcaggagcagaggcccctgcccaacgtgtccacagagcgggagcggccccagcctgtgcaggccttcagcagcgccctgcacgaggccgcccccagccagctggagggcaagctgcccagcccagatgtgcggcaggatgatggagaggacaccctcttcagcgagcccaagtttgcccaggtgagcagcagcaatgtggtgctgaagacaggctttgacttcctggacaactggtag

SEQ ID NO: 36053 - DNA, 504 bp, Artificial Sequence
  Description of Artificial Sequence: Synthetic coding sequence
atgcccagccagagcgcctgccctgtgctgagcacagcccctggcaccccctgtgacctgaggaagcacctgctgaacatggtgtctgaggagaagaggagcccccagctgagcgccaagacctggaggcggggcctgcggctgcagaagagaagaaatgccctcttcctgcctgagggggacatctgtgtggtgggcagcaccagcggggcccgggccctgatccctgagaccagcaagctggagaggagcggcaccgtcatcgcctactgcaacctggagctgctggccagcagtgacccccctgtgtgggccagccagagcacaggcatgacaggcatgagctaccgcagccagccccagctgggcttcaagagcaccccaccagcccacagctctgtgttccaccacagcgtgaaggcccccaaggaggaccaggcccaggaggccgccagccggcccctgaccagccaggacggctggaaccccaacatcaagaagtag

SEQ ID NO: 36054 - DNA, 864 bp, Artificial Sequence
  Description of Artificial Sequence: Synthetic coding sequence
atgaatgccctggccaacatcccagatgtgcctgtgaagtacaggaagaatgacatccctggccctggcttctacaacgtcatccaccagagccctgtgagcaacagcgtgtccctgagcaagaagggcacctgcatgttccccagcatgtgtgcccggctggacaccatcatcagcaagtacccagctgccaatgcctacaccatccccagcgacttcatcagcaagagggacttcagcaacagctgcagctccatgttccagctgcccagcttcatgaaggccctgaagtttgagaccccagcccccaactactacaatgcctctgtgtcctgctgcaagcagaggaacaacgtgtgcaccagggctggcttcatgagcaagacccagaggggcagctttgcctttgctgacaagggccccccacctggccactatgacatcaatgaaagcctggtgaagcagagccccaacaccctgatgagctgcttcaagagcaagaccaacagaggcctgaagctgaccagcactggacctggccctggctactacaaccccagcgactgcaccaaggtgcccaagaagaccctcttccccaagaaccccatcctgaacttcagcgcccagcccagccccctgccccccaagccacccttccctggccctggccagtatgaaattgtggactacctgggccccaggaagcacttcatcagcagcgccagctttgtgagcaacaccagccgctggacagctgccccaccccagcccggcctgcccggccctgccacctacaagccagagctgcccgggaagcagagcttcctgtacaatgaagacaagaagtggatccctgtgctgtag

SEQ ID NO: 36055 - DNA, 1005 bp, Artificial Sequence
  Description of Artificial Sequence: Synthetic coding sequence
atggacaacagcgcccagaagaatgaaagaacaggcaagcacccccggcgggccagcgaggtgcagaagggcttcaccgctgcctaccccacccagagcagcatccccttcaagagccaggccagcgtcatccctgagagcgagaagaagggcttcaacagccaggccaagcgcttcccccacaagaagaatgacatccctggccctggcttctacaacgtcatccaccagagccctgtgagcaacagcgtgtccctgagcaagaagggcacctgcatgttccccagcatgtgtgcccggctggacaccatcatcagcaagtacccagctgccaatgcctacaccatccccagcgacttcatcagcaagagggacttcagcaacagctgcagctccatgttccagctgcccagcttcatgaaggccctgaagtttgagaccccagcccccaactactacaatgcctctgtgtcctgctgcaagcagagaaataatgtgtgcacccgggccggcttcatgagcaagacccagaggggcagctttgcctttgctgacaagggccccccacctggccactatgacatcaatgaaagcctggtgaagcagagccccaacaccctgatgagctgcttcaagagcaagaccaacagaggcctgaagctgaccagcacaggccctggccctggctactacaaccccagcgactgcaccaaggtgcccaagaagaccctcttccccaagaaccccatcctgaacttcagcgcccagcccagccccctgccccccaagccacccttccctggccctggccagtatgagatcgtggactacctgggccccaggaagcacttcatcagcagcgccagctttgtgagcaacaccagccgctggacagctgccccaccccagcccggcctgcccggccctgccacctacaagccagagctgcccgggaagcagagcttcctgtacaatgaagacaagaagtggatccctgtgctgtag

SEQ ID NO: 36056 - DNA, 510 bp, Artificial Sequence
  Description of Artificial Sequence: Synthetic coding sequence
atgtgtgcccggctggacaccatcatcagcaagtacccagctgccaatgcctacaccatccccagcgacttcatcagcaagagggacttcagcaacagctgcagctccatgttccagctgcccagcttcatgaaggccctgaagtttgagaccccagcccccaactactacaatgcctctgtgtcctgctgcaagcagagaaataatgtgtgcacccgggccggcttcatgagcaagacccagaggggcagctttgcctttgctgacaagggccccccacctggccactatgacatcaatgaaagcctggtgaagcagagccccaacaccctgatgagctgcttcaagagcaagaccaacagaggcctgaagctgaccagcacaggccctggccctggctactacaaccccagcgactgcaccaaggtgcccaagaagaccctcttccctgggggcagcaaggccagtgacctggccggccacctgcccaagagcacccagcccacctag

SEQ ID NO: 36057 - DNA, 1005 bp, Artificial Sequence; identical to SEQ ID NO: 36055
  Description of Artificial Sequence: Synthetic coding sequence

SEQ ID NO: 36058 - DNA, 435 bp, Artificial Sequence
  Description of Artificial Sequence: Synthetic coding sequence
tgattcaccgctgcctaccccacccagagcagcatccccttcaagagccaggccagcgtcatccctgagagcgagaagaagggcttcaacagccaggccaagcgcttcccccacaagaagaatgacatccctggccctggcttctacaacgtcatccaccagagccctgtgagcaacagcgtgtccctgagcaagaagggcacctgcatgttccccagcatgtgtgcccggctggacaccatcatcagcaagtacccagctgccaatgcctacaccatccccagcgacttcatcagcaagagggacttcagcaacagctgcagctccatgttccagctgcccagcttcatgaaggccctgaagtttgagaccccagcccccaactactacaacgtgaggaccctgcccatgctggccaagtaccgcagcaactag

SEQ ID NO: 36059 - DNA, 1152 bp, Artificial Sequence
  Description of Artificial Sequence: Synthetic coding sequence
atggacaacagcgcccagaagaatgaaagaacaggcaagcacccccggcgggccagcgaggtgcagaagggcttcaccgctgcctaccccacccagagcagcatccccttcaagagccaggccagcgtcatccctgagagcgagaagaagggcttcaacagccaggccaagcgcttcccccacaagaagaatgacatccctggccctggcttctacaacgtcatccaccagagccctgtgagcaacagcgtgtccctgagcaagaagggcacctgcatgttccccagcatgtgtgcccggctggacaccatcatcagcaagtacccagctgccaatgcctacaccatccccagcgacttcatcagcaagagggacttcagcaacagctgcagctccatgttccagctgcccagcttcatgagcaagacccagaggggcagctttgcctttgctgacaagggccccccacctggccactatgacatcaatgaaagcctggtgaagcagagccccaacaccctgatgagctgcttcaagagcaagaccaacagaggcctgaagctgaccagcactggacctggccctggctactacaaccccagcgactgcaccaaggtgcccaagaagaccctcttccccaagaaccccatcctgaacttcagcgcccagcccagccccctgccccccaagccagcctggcccagctatgtgcaggcccgggccagcaggaaggctgtgctgcccctgcagaggggccaggagatggaccccggctctgtgggcatgagccacaaggtgaaggagaacagcagccaccagcccaccctgcccagcgtgcccaggaccttcctgcggcggcggcccatcatgtctgtggccgctgacaacctgggcggcggcagcaccaccctggcctggcaccccagcaggacagctgccatcgcctttgtgctgtcctggaggcactgcagcctggagaccagcccccagccccaccggctgcagtggctgcctgagcagaagggcggcgtggaccgggccccctggctgctgccccacgcccccatccaggccgccttcagacatgacagcctgccccagacagagggcaccccagaggcccagaccagccgccgcatcagccccccatag

SEQ ID NO: 36060 - DNA, 507 bp, Artificial Sequence
  Description of Artificial Sequence: Synthetic coding sequence
tgtgcccggctggacaccatcatcagcaagtacccagctgccaatgcctacaccatccccagcgacttcatcagcaagagggacttcagcaacagctgcagctccatgttccagctgcccagcttcatgaaggccctgaagtttgagaccccagcccccaactactacaatgcctctgtgtcctgctgcaagcagaggaacaacgtgtgcaccagggctggcttcatgagcaagacccagaggggcagctttgcctttgctgacaagggccccccacctggccactatgacatcaatgaaagcctggtgaagcagagccccaacaccctgatgagctgcttcaagagcaagaccaacagaggcctgaagctgaccagcactggacctggccctggctactacaaccccagcgactgcaccaaggtgcccaagaagaccctcttccctgggggcagcaaggccagtgacctggccggccacctgcccaagagcacccagcccacctag

SEQ ID NO: 36061 - DNA, 864 bp, Artificial Sequence; identical to SEQ ID NO: 36054
  Description of Artificial Sequence: Synthetic coding sequence

SEQ ID NO: 36062 - DNA, 708 bp, Artificial Sequence
  Description of Artificial Sequence: Synthetic coding sequence
atgggcatgctggcccctggccccctgcagggccggcggcccaggaagggccacaagggccaggaggatgctgtggcccctggctgcaaggccagcggccggggcagccgggtgacccacctgctgggctaccccacccagaatgtgagccgcagcctgcggaggaaatatgcccccccaccctgtggcggcccagaagatgtggccctggccccctgcacagctgctgctgcctgtgaggccggccccagccctgtgtatgtgaaggtgaagtctgctgagcctgctgactgtgccgagggccctgtgcagtgcaagaatggcctgctggtgagcagcccccactgtgaggagccctgtgcccacagctgtgcccaccctggcctgcccccccacctggtgcacaagctgcccctgagctacctgcagacccaggacacagatgctgccagccgccgcatcaatgcccccctggccgccggctggagctggctgcggctgtggctggtgaccctggccagcggcgtggacttcccccaggtgtctgcctggatgagggccctgcccagcccagactgccccggcctgcggaccactggagagcagatgcagaagctgctgctgaaggagaacaaggtgaagaccaggaagagcaagagaagaagtggagagggcagccacctgaccaccagcatcctggagcagtag

SEQ ID NO: 36063 - DNA, 366 bp, Artificial Sequence
  Description of Artificial Sequence: Synthetic coding sequence
atgggctgtgccagcgccaagcacgtggccaccgtgcagaatgaggaggaggcccagaagggcaagaactaccagaatggagatgtgtttggagatgagtaccgcatcaagcctgtggaggaggtgaagtacatgaagaatggagctgaggaggagcagaagattgctgccaggaaccaggagaacctggagaagagcgccagcagcaatgtgcggctgaagaccaacaaggaggtgcccggcctggtgcaccagccccgggccaacatgcacatcagcgagagccagcaggagttcttcaggatgctggatgagaagattgagaagggccgggactactgcagcgaggaggaggacatcacctag

SEQ ID NO: 36064 - DNA, 264 bp, Artificial Sequence
  Description of Artificial Sequence: Synthetic coding sequence
actggaaaccaccacagcaccttctgcctgcatgaatttgactacagccggctgctgtgcatcctggagaagttcctgtgtgacacagagaagagcgccagcagcaatgtgcggctgaagaccaacaaggaggtgcccggcctggtgcaccagccccgggccaacatgcacatcagcgagagccagcaggagttcttcaggatgctggatgagaagattgagaagggccgggactactgcagcgaggaggaggacatcacctag

SEQ ID NO: 36065 - DNA, 279 bp, Artificial Sequence
  Description of Artificial Sequence: Synthetic coding sequence
atgtggcctgtgttctggacagtggtgaggacctacgccccctacgtgaccttccctgtggcctttgtggtgggcgctgtgggctaccacctggagtggttcatccggggcaaggacccccagcctgtggaggaggagaagagcatcagcgagcggcgggaggacaggaagctggatgagctgctgggcaaggaccacacccaggtggtgtccctgaaggacaagctggagtttgcccccaaggctgtgctgaacagaaacagacctgagaagaactag

SEQ ID NO: 36066 - DNA, 279 bp, Artificial Sequence; identical to SEQ ID NO: 36065
  Description of Artificial Sequence: Synthetic coding sequence

SEQ ID NO: 36067 - DNA, 279 bp, Artificial Sequence; identical to SEQ ID NO: 36065
  Description of Artificial Sequence: Synthetic coding sequence

SEQ ID NO: 36068 - DNA, 279 bp, Artificial Sequence; identical to SEQ ID NO: 36065
  Description of Artificial Sequence: Synthetic coding sequence

SEQ ID NO: 36069 - DNA, 279 bp, Artificial Sequence; identical to SEQ ID NO: 36065
  Description of Artificial Sequence: Synthetic coding sequence

SEQ ID NO: 36070 - DNA, 381 bp, Artificial Sequence
  Description of Artificial Sequence: Synthetic coding sequence
atgctggccgtgcctgtgcggctgaaggtgggcagcaggaagccagagtggggcaccaaccggctgaccagctgcccagccaaggaccccctggaccggcggctgcagaacctgcgggaccgggagcgggtgcctgagccccagaggagcctgcggcctggggtgcaggaggacagccgggagcacggccaggtgcctgaggtgtctgacccccaggtggacctggagtttgtggacctgcaggccaagccccgctacagaagactcatcctgaagacccagatccctgaggccagtgacagccaggccgcccagaagccccaggcccaccggcagatccctgagaccacagaagctggccgggagaccaccagcaactag

SEQ ID NO: 36071 - DNA, 690 bp, Artificial Sequence
  Description of Artificial Sequence: Synthetic coding sequence
atgtttgccatccagcccggcctggccgagggcggccagttcctgggggaccccccacctggcctgtgccagcctgagctgcagcctgacagcaacagcaacttcatggccagcgccaaggatgccaatgaaaactggcacggcatgcctggccgggtggagcccatcctgcggcgcagcagcagcgagagccccagcgacaaccaggccttccaggcccctggcagccctgaggagggcgtgcgcagccccccagagggcgctgagatccctggagctgagcctgagaagatgggcggggccggcaccgtgtgcagccccctggaggacaatggctacgccagcagcagcctgagcattgacagccgcagcagcagccctgagcccgcctgtggcaccccccggggccctggccccccagaccccctgctgcccagcgtggcccaggccgtgcagcacctgcaggtgcaggagcgctacaaggagcaggagaaggagaagcaccacgtgcacctggtgatgtaccgccgcctggccctgctgcagtggatccggggcctgcagcaccagctgattgaccagcaggcccggctgcaggagagctttgacaccatcctggacaacaggaaggagctgatccgctgcctgcagcagagagctgcccccagccggccccaggaccaggcctag

SEQ ID NO: 36072 - DNA, 600 bp, Artificial Sequence
  Description of Artificial Sequence: Synthetic coding sequence
atgtttgccatccagcccggcctggccgagggcggccagttcctgggggaccccccacctggcctgtgccagcctgagctgcagcctgacagcaacagcaacttcatggccagcgccaaggatgccaatgaaaactggcacggcatgcctggccgggtggagcccatcctgcggcgcagcagcagcgagagccccagcgacaaccaggccttccaggcccctggcagccccctggaggacaatggctacgccagcagcagcctgagcattgacagccgcagcagcagccctgagcccgcctgtggcaccccccggggccctggccccccagaccccctgctgcccagcgtggcccaggccgtgcagcacctgcaggtgcaggagcgctacaaggagcaggagaaggagaagcaccacgtgcacctggtgatgtaccgccgcctggccctgctgcagtggatccggggcctgcagcaccagctgattgaccagcaggcccggctgcaggagagctttgacaccatcctggacaacaggaaggagctgatccgctgcctgcagcagagagctgcccccagccggccccaggaccaggcctag

SEQ ID NO: 36073 - DNA, 321 bp, Artificial Sequence
  Description of Artificial Sequence: Synthetic coding sequence
atgccagatgcccagttccaccgcatcatggccagcgagaagctgtccttcatccgggtgcaggagaatgagtacagcctgaacagcgtgcgggccagcggcttccagagggtgctgaacctgctggagagcagcctgctgtggctgtacctgcccaccacagagaacctgctgtgcagcagcccccggctgagcggggaccccaccggctacgccgaccccccaccccagaaccacagaagacggcagagccgcagcaccccccggctgcccggccctggccagctgctgagcagcaggaccaggaccctggagggctag

SEQ ID NO: 36074 - DNA, 2289 bp, Artificial Sequence
  Description of Artificial Sequence: Synthetic coding sequence
atggaggatgatggcagcctgctgcctgaagatgagctgctggctgatgccctgctgctggaggatgaaagagatgagctggaggaccctgagtttgacatcaagtgcctgctgcaggaggccgaggatgatgtggaccccggccacagcagctctgtgaaggagctggacacagatgctgacaagctgaagaagaagacagctgaggacaggacccaggccttccacctgcggcagaacctgagcgccctggacaagatgcatgaggagcaggagctgttcacagagaagatgagaggagagctgcgggcctgccggcagaggcgggacctgattgacaagcagcaggaggccgtggccgctgagatcgccacagaggaggaggccggcaacatggctgctgtgggccgcctgcaggccgtgtccagaagactctttgctgagctggagaatgaaagagacctgcagagcaggacagaagctgtgctgaaggagagcgagaacaccatgtggcacatcgagatccaggagggccgcctggaggccttcagaacagctgaccgggaggaggtggaggccaccggccggcggctgcaggtgcgggctgctgagcagctgtgccgggagcaggaggccctgggcaaggtggagaggaaccggctgctgcgcatcaggaagagcctgaacacccagaaggagctgggcctgcggcaccagaagctgctggaggatgccaggaagaaccacaaggtggccgtgcgcttcctgaaggccagcctgggccgcatccgggagcaggagaagaaggaggagatggagtgccacgagtacatgagaagaaggatggatgctgtggtggccctgaagggcagcatcagcgccaacagagacaccctgaggaagttccaggcctgggaccgggccaaggccgagctggccgagcagagggtgcaggccgagaagaaggccatcctggcccagggcagagatgccttccgccacctggtgcaccagaggcggcggcaggagctggaggcccagaagagggcctttgaggaggagcagaagctgaggaagcaggagatcatcagccgcatcctgaaggaggaggccgaggaggagaagaggaagaagcagcacccccccaccagcgcccggcaccggctgaccctgcgggacaagacctggaactacatcagtgacttctgcaagaagaccaccgtgcccaccaacacctacaccctggactatgaagctgctgctggccctggccccagccggctgctggaggtggtgagcagcgagctgatccagggcgaccccggggccagcagcgaggaggagaccctggccgagcctgagatcagcggcctgtggaatgaagactacaagccctaccaggtgcccaaggaggatgtggacaggaagcctgtgggcggcaccaagatggacaaggacatcctggagaggacagtggagcggctgcggagccgggtggtgcacaagcaggtggtgtggggccgggagttccagggccggcccttcaacagcaagccagagctgctgcacttccaggactttgatattggcaaggtgtacaagaagaagatcaccctggtgaacaccacctacaccatcaactactgcaagctggtgggcgtggaggagcacctgcgggacttcatccacgtggactttgaccccccaggccccctgtctgctggcatgagctgtgaggtgctggtgaccttcaagcccatgatcaacaaggacctggagggcaacatctccttcctggcccagacaggagagttctctgtgcccctgaagtgcagcaccaagaagtgcagcctgagcctggacaaggagctgattgactttggcagctatgtggtgggggagaccaccagcaggaccatcaccctgaccaacgtgggcggcctgggcaccaccttcaagttcctgcctgccagcgagccctgtgagatggatgacagccagagcgccctgaagctgagcagcctgctgacctatgaggacaagagcctgtatgacaaggccgccaccagcttcagcgagcagcagctggagggcacagagagcagccaggccgacatgcagagcaggaaggagctggagaagctggacaaggagcaggaggaggagcagcctgctggggagcccggctgccaggccaagccaggctgggccggcggggagggcctgcgggccgccttccagggcgctgagggcccccggggcggcctggagagccgggagttctcctag

SEQ ID NO: 36075 - DNA, 306 bp, Artificial Sequence
  Description of Artificial Sequence: Synthetic coding sequence
atggaggatgatggcagcctgctgcctgaagatgagctgctggctgatgccctgctgctggaggatgaaagagatgagctggaggaccctgagtttgacatcaagtgcctgctgcaggaggccgaggatgatgtggaccccggccacagcagctctgtgaaggagctggacacagatgctgacaagctgaagaagaagacagctgaggacaggacccaggccttccacctgcggcagaacctgagcgccctggacaagatgcatgaggagcaggagctgttcacagagaagatgtctgtgtcctag

SEQ ID NO: 36076 - DNA, 516 bp, Artificial Sequence
  Description of Artificial Sequence: Synthetic coding sequence
atgtttgagaacctgaacacagccctgacccccaagctgcaggccagccgctccttcccccacctgagcaagcctgtggcccctggcagcgcccccctgggcagcggggagcccggcggccctggcctgtgggtgggcagcagccagcacctgaagaacctgggcaaggccatgggcgccaaggtgaatgacttcctgcggaggaaggagcccagcagcctgggctctgtgggcgtgacagagatcaacaagacagctggggcccagctggccagcggcacagatgctgcccctgaggcctggctggaggatgagaggtctgtgctgcaggagaccttcccccggctggaccccccaccacccatcaccaggaagaggaccccccgggccctgaagaccacccaggacatgctgatcagcagccagcctgtgctgagcagcctggagtatggaacagagcccagccctggccaggcccaggacagcgcccccacagcccagccagatgtgccctag

SEQ ID NO: 36077 - DNA, 948 bp, Artificial Sequence
  Description of Artificial Sequence: Synthetic coding sequence
atgctggtgctggtggcccaggccggcggggacaccctgaaggtgacaggccactacgtgaagtgtgtgttcctgctgtttgtgagccacctgctgtctgagcccctgagcaggacagtggaccacggcatgtttgagaacctgaacacagccctgacccccaagctgcaggccagccgctccttcccccacctgagcaagcctgtggcccctggcagcgcccccctgggcagcggggagcccggcggccctggcctgtgggtgggcagcagccagcacctgaagaacctgggcaaggccatgggcgccaaggtgaatgacttcctgcggaggaaggagcccagcagcctgggctctgtgggcgtgacagagatcaacaagacagctggggcccagctggccagcggcacagatgctgcccctgaggcctggctggaggatgagaggtctgtgctgcaggagaccttcccccggctggaccccccaccacccatcaccaggaagaggaccccccgggccctgaagaccacccaggacatgctgatcagcagccagcctgtgctgagcagcctggagtatggaacagagcccagccctggccaggcccaggacagcgcccccacagcccagccagatgtgcctgcagatgccagccagcctgaggccaccatggagcgggaggagcggggcaaggtgctgcccaatggagaggtgtccctgtctgtgcctgacctgatccacaaggacagccaggatgagagcaagctgaagatgacagagtgccggcgggccagcagccccagcctcatcgagagaaatggcttcaagctgagcctgagccccatcagcctggccgagagctgggaggatggcagccccccaccccaggcccggaccagcagcctggacaatgaaggcccccacccagacctgctgagctttgaatag

SEQ ID NO: 36078 - DNA, 819 bp, Artificial Sequence
  Description of Artificial Sequence: Synthetic coding sequence
atgtttgagaacctgaacacagccctgacccccaagctgcaggccagccgctccttcccccacctgagcaagcctgtggcccctggcagcgcccccctgggcagcggggagcccggcggccctggcctgtgggtgggcagcagccagcacctgaagaacctgggcaaggccatgggcgccaaggtgaatgacttcctgcggaggaaggagcccagcagcctgggctctgtgggcgtgacagagatcaacaagacagctggggcccagctggccagcggcacagatgctgcccctgaggcctggctggaggatgagaggtctgtgctgcaggagaccttcccccggctggaccccccaccacccatcaccaggaagaggaccccccgggccctgaagaccacccaggacatgctgatcagcagccagcctgtgctgagcagcctggagtatggaacagagcccagccctggccaggcccaggacagcgcccccacagcccagccagatgtgcctgcagatgccagccagcctgaggccaccatggagcgggaggagcggggcaaggtgctgcccaacggggaggtgtccctgtctgtgcctgacctgatccacaaggacagccaggatgagagcaagctgaagatgacagaatgtagaagagccagcagccccagcctgattgaaagaaatggcttcaagctgagcctgagccccatcagcctggccgagagctgggaggatggcagccccccaccccaggcccggaccagcagcctggacaatgaaggcccccacccagacctgctgagctttgaatag

SEQ ID NO: 36079 - DNA, 297 bp, Artificial Sequence
  Description of Artificial Sequence: Synthetic coding sequence
atggccagcatcaacagaaccatcgagatcatgaagaagcacggcgtgtccaagcagcacctgctggaggagatcaacaagaagcgggagagcaactgcctggtggagaggagcaaccaggtgtccctgctgcgggtgcagaagaggcacttcccagatgcctaccagagcttcacagacaccaccaccaaggagcctgtgcccaacagcggccgcagctcctggatcaagctgagcctgctggcccacatggagaggaagcacttcccccccaagaacaatgccatctttggatag

SEQ ID NO: 36080 - DNA, 1323 bp, Artificial Sequence
  Description of Artificial Sequence: Synthetic coding sequence
atgaccagcatcaaggagcaggccgccatcagccggctgctgtccttcctgcaggagtgggacaatgccggcaaggtggcccggagccacatcctggacaagttcatcgagaccaaccagggcaagacagcccctgagctggagcaggagttcagccagggcgccagcctcttcctggtgcggctgaccaccagcctgcgcatcacctacatgacagacagctgcctggagaagctgctgcggagcatcggcatcttcctgtctgctgtgagcagcaaccgctacctgattgagttcctggaggtgggcggcgtgctgaccctgctggagatcctgggcctggagaagatcaaggaggaggccaagaaggagagcgtgaagctgctgcaggtgattgccaacagcggccgcacctacaaggagctgatctgtgagagctatggagtgcgcagcattgctgagttcctggccaagagcaagtctgaggagacccaggaggaggtgcaggtgctgctggacagcctggtgcacggcaaccccaagtaccagaaccaggtgtacaagggcctgattgccctgctgccctgtgagagccccaaggcccagcagctgagcctgcagaccctgaggacagcccagcccatcatcggcaccacccaccccagcatcgtggactgtgtgctgaaggtgctgggcaccatgcacctggaggtgcagtatgaggccatcgagctgatcaaggacctggtgggctatgatgtgcggcaggccctgctgaagggcctggtggccctgctgatccccagcgtgaaggagatcagcaagctgcaggccaagatcctgagtgaccccagcgtgctgcagctgacccccagcctgcccatgttcctgcagcaggccgccgccgccaaggccatcggcgtgctggccagaaatgacatgagcattgctgaggagctgctgtacctgcgggtggtgcggggcctgatggccgccatgggcaacacagaccacagcaacagccagaggctggccagcctgaccctggagtgctttgtgcagatgttccccctggtggccgagcacgtgaggaagtgcatgggagaggagctgtaccagctgttcctgagcaatgctgaggacctgtacatgaagattgacagcatccaggccgacatcctggccgccaacacagtgaatgtgaccaaggccctgtgcctgcacggcagcagctacagcatgaacaccctgtatggcagccgggacagcgcccagatggcctacctgacccactttgaggaggatgtggagagcaaggagtag

SEQ ID NO: 36081 - DNA, 1323 bp, Artificial Sequence; identical to SEQ ID NO: 36080
  Description of Artificial Sequence: Synthetic coding sequence

SEQ ID NO: 36082 - DNA, 714 bp, Artificial Sequence
  Description of Artificial Sequence: Synthetic coding sequence
atgggcctgtgcaccctgcagcccctgggcccccccaggaagagcagcaccagctgtggcacctggacagccagcggcctgcccagcctgggccacctgccccggcggctgcggctggcctttgacttcctggagccccgggcccggggccagagaggaggcagcggcggctgccagagcaccagggctgctgagaggaccaggcctccccaccccccaaatgctgtgctgctgctgcagcctgagcccagcctgacctgggcccagggccggggctgccggggccacttccgcagcctgcctgctgctgccagccgcagcggcagcaggaccctgcgctgtgccagcagtgacaggagcctgcgggagcagaagcagaggagagctggccctgaccccacccccagccctgcccctcctcctgctggcccccggcccagccctggcagcctgggccccagcgccccagctgcccccaggacagcccggggggcctatgagctgcagggcggggccagccaggacggccctggccaggccgctgtgggcgccacccccaccaccggccctggcaccggcggggagggcgccctgctgggctgcggcagcggccgcaccccacccaccagcgccacctggaggcggcggctgctgcctgctgaggtgcccccaggagctgctgctgccaacttccctgagcgggagcggctgtag

SEQ ID NO: 36083 - DNA, 681 bp, Artificial Sequence
  Description of Artificial Sequence: Synthetic coding sequence
atgagggccccacccctgctgctgctgctggccgcctgtgcccccccaccctgtgccgctgctgcccccaccccacctggctgggagcccaccccagatgccccctggtgcccctacaaggtgctgcctgagggccctgaggccggcggcggccgcctgtgcttccgcagccctgcccggggcttccgctgccaggcccctggctgtgtgctgcacgccccagctggccgcagcctgcgggcctctgtgctgaggaacagatctgtgctgctgcagtggaggctggccccagctgctgccaggagagtgcgggcctttgccctgaactgctcctggaggggggcctacacccgcttcccctgtgagcgggtgctgctgggcgccagctgccgggactacctgctgcctgatgtgcatgattctgtgctgtaccgcctgtgcctgcagcccctgcccctgcgggccggccctgctgctgctgcccctgagaccccagagccagcagaatgtgtggagttcaccgctgagcccgccggcatgcaggacatcgtggtggccatgacagctgtgggcggcagcatctgtgtgatgctggtggtgatctgcctgctggtggcctacatcacagagaacctgatgaggcctgccctggcccggcccggcctgcggcggcacccctag

SEQ ID NO: 36084 - DNA, 792 bp, Artificial Sequence
  Description of Artificial Sequence: Synthetic coding sequence
atgtttggcagcagcagaggaggagtgcggggcggccaggaccagttcaactgggaggatgtgaagacagacaagcagcgggagaactacctgggcaacagcctgatggcccctgtgggccgctggcagaagggccgggacctgacctggtacgccaagggccgggccccctgtgccggccccagccgggaggaggagctggccgctgtgcgggaggccgagcgggaggccctgctggccgccctgggctacaagaatgtgaagaagcagcccaccggcctgagcaaagaagattttgctgaggtgtgcaagcgggagggcggggaccctgaggagaagggcgtggaccggctgctgggcctgggcagcgccagcggctctgtgggccgggtggccatgagccgggaggacaaggaggccgccaagctgggcctgagcgtcttcacccaccaccgggtggagagcggcggccctggcaccagcgctgccagcgcccggaggaagcccagggctgaggaccagacagagagcagctgtgagagccacaggaagagcaagaaggagaagaagaagaagaagaagaggaagcacaagaaggagaagaagaagaaggacaaggagcacagaagacctgctgaggccaccagcagccccaccagccctgagcggcccaggcaccaccaccacgacagcgacagcaacagcccctgctgcaagaggaggaagaggggccacagcggggacagaagaagccccagccgccgctggcatgaccggggcagcgaggcctag

SEQ ID NO: 36085 - DNA, 1545 bp, Artificial Sequence
  Description of Artificial Sequence: Synthetic coding sequence
atggagcctgtgcccctgcaggactttgtgcgggccctggaccctgccagcctgccccgggtgctgcgggtgtgcagcggcgtgtactttgagggcagcatctatgagatctctggaaatgaatgctgcctgagcactggagacctgatcaaggtgacccaggtgcggctgcagaaggtggtgtgtgagaaccccaagaccagccagaccatggagctggcccccaacttccagggctacttcacccccctgaacaccccccagagctatgagaccctggaggagctggtgtctgccaccacccagagcagcaagcagctgcccacctgcttcatgagcacccacagaattgtgacagagggccgggtggtgacagaggaccagctgctgatgctggaggccgtggtgatgcacctgggcatccgcagcgcccgctgtgtgctgggcatggagggccagcaggtgatcctgcacctgcccctgagccagaagggccccttctggacctgggagcccagcgcccccaggaccctgctgcaggtgctgcaggaccctgccctgaaggacctggtgctgacctgccccaccctgccctggcacagcctcatcctgcggccccagtatgagatccaggccatcatgcacatgaggaggaccatcgtgaagatccccagcaccctggaggtggatgtggaggatgtgacagccagcagccgccacgtgcacttcatcaagcccctgctgctgtctgaggtgctggcctgggagggccccttccccctgtccatggagatcctggagcggctgagtgaccaggccggagaagatgaggaggaggagtgcaaggaggaggccgagagccctgagcgggtgctgctgcccttccacttccctggcagctttgtggaggagatgtctgacagccgccgctacagcctggccgacctgacagcccagttcagcctgccctgtgaggtgaaggtggtggccaaggacaccagccaccccacagaccccctgaccagcttcctgggcctgcggctggaggagaagatcacagagcccttcctggtggtgtccctggacagcgagcccggcatgtgctttgagatccccccacgctggctggacctgactgtggtgaaggccaagggccagcctgacctgcctgagggcagcctgcccatcgccaccgtggaggagctgacagacaccttctactaccgcctgaggaagctgcctgcctgtgagatccaggcccccccacccaggcctcccaagaaccagggcctgagcaagcagaggaggcacagcagcgagggcggcgtgaagagcagccaggtgctgggcctgcagcagcacgcccggctgcccaagcccaaggccaagaccctgcctgagttcatcaaggatggcagcagcacctacagcaagatcccagcccacaggaagggccacaggcctgccaagccccagaggcaggacctggatgatgatgaacatgactatgaggagatcctggagcagttccagaagaccatctag

SEQ ID NO: 36086 - DNA, 1932 bp, Artificial Sequence
  Description of Artificial Sequence: Synthetic coding sequence
atggagcctgtgcccctgcaggactttgtgcgggccctggaccctgccagcctgccccgggtgctgcgggtgtgcagcggcgtgtactttgagggcagcatctatgagatctctggaaatgaatgctgcctgagcactggagacctgatcaaggtgacccaggtgcggctgcagaaggtggtgtgtgagaaccccaagaccagccagaccatggagctggcccccaacttccagggctacttcacccccctgaacaccccccagagctatgagaccctggaggagctggtgtctgccaccacccagagcagcaagcagctgcccacctgcttcatgagcacccacagaattgtgacagagggccgggtggtgacagaggaccagctgctgatgctggaggccgtggtgatgcacctgggcatccgcagcgcccgctgtgtgctgggcatggagggccagcaggtgatcctgcacctgcccctgagccagaagggccccttctggacctgggagcccagcgcccccaggaccctgctgcaggtgctgcaggaccctgccctgaaggacctggtgctgacctgccccaccctgccctggcacagcctcatcctgcggccccagtatgagatccaggccatcatgcacatgaggaggaccatcgtgaagatccccagcaccctggaggtggatgtggaggatgtgacagccagcagccgccacgtgcacttcatcaagcccctgctgctgtctgaggtgctggcctgggagggccccttccccctgtccatggagatcctggaggtgcctgagggccggcccatcttcctgagcccctgggtgggcagcctgcagaagggccagaggctgtgtgtgtatggcctggccagccccccctggagggtgctggccagcagcaagggcaggaaggtgcccaggcacttcctggtgtctgggggctaccagggcaagctgcggcggcggccccgggagttccccacagcctatgacctgctgggcgccttccagcccggccggcccctgcgggtggtggccaccaaggactgtgagggggagcgggaggagaaccctgagttcaccagcctggccgtgggggaccggctggaggtgctgggccctggccaggcccatggagcccagggcagtgatgtggatgtgctggtgtgccagaggctgagtgaccaggccggggaggatgaggaggaggagtgcaaggaggaggccgagagccctgagcgggtgctgctgcccttccacttccctggcagctttgtggaggagatgtctgacagccgccgctacagcctggccgacctgacagcccagttcagcctgccctgtgaggtgaaggtggtggccaaggacaccagccaccccacagaccccctgaccagcttcctgggcctgcggctggaggagaagatcacagagcccttcctggtggtgtccctggacagcgagcccggcatgtgctttgagatccccccacgctggctggacctgactgtggtgaaggccaagggccagcctgacctgcctgagggcagcctgcccatcgccaccgtggaggagctgacagacaccttctactaccgcctgaggaagctgcctgcctgtgagatccaggcccccccaccccggccccccaagaaccagggcctgagcaagcagaggaggcacagcagcgagggcggcgtgaagagcagccaggtgctgggcctgcagcagcacgcccggctgcccaagcccaaggccaagaccctgcctgagttcatcaaggatggcagcagcacctacagcaagatcccagcccacaggaagggccacaggcctgccaagccccagaggcaggacctggatgatgatgaacatgactatgaggagatcctggagcagttccagaagaccatctag

SEQ ID NO: 36087 - DNA, 783 bp, Artificial Sequence
  Description of Artificial Sequence: Synthetic coding sequence
atggagcctgtgcccctgcaggactttgtgcgggccctggaccctgccagcctgccccgggtgctgcgggtgtgcagcggcgtgtactttgagggcagcatctatgagatctctggaaatgaatgctgcctgagcactggagacctgatcaaggtgacccaggtgcggctgcagaaggtggtgtgtgagaaccccaagaccagccagaccatggagctggcccccaacttccagggctacttcacccccctgaacaccccccagagctatgagaccctggaggagctggtgtctgccaccacccagagcagcaagcagctgcccacctgcttcatgagcacccacagaattgtgacagagggccgggtggtgacagaggaccagctgctgatgctggaggccgtggtgatgcacctgggcatccgcagcgcccgctgtgtgctgggcatggagggccagcaggtgatcctgcacctgcccctgagccagaagggccccttctggacctgggagcccagcgcccccaggaccctgctgcaggtgctgcaggaccctgccctgaaggacctggtgctgacctgccccaccctgccctggcacagcctcatcctgcggccccagtatgagatccaggccatcatgcacatcttcagcagcctgagaattgctgccaccaggtctgctgcccagacccagggcgaggacctggcccgggtgcaccagggctggctgcagtatgtgcagcaggacagctgcccccaggagggcccccaggccaggtag

SEQ ID NO: 36088 - DNA, 372 bp, Artificial Sequence
  Description of Artificial Sequence: Synthetic coding sequence
atggagcctgtgcccctgcaggactttgtgcgggccctggaccctgccagcctgccccgggtgctgcgggtgtgcagcggcgtgtactttgagggcagcatctatgagatctctggaaatgaatgctgcctgagcactggagacctgatcaaggtgacccaggtgcggctgcagaaggtggtgtgtgagaaccccaagaccagccagaccatggagctggcccccaacttccaggtgttcagcagcctgagaattgctgccaccaggtctgctgcccagacccagggcgaggacctggcccgggtgcaccagggctggctgcagtatgtgcagcaggacagctgcccccaggagggcccccaggccaggtag

SEQ ID NO: 36089 - DNA, 402 bp, Artificial Sequence
  Description of Artificial Sequence: Synthetic coding sequence
atggagcctgtgcccctgcaggactttgtgcgggccctggaccctgccagcctgccccgggtgctgcgggtgtgcagcggcgtgtactttgagggctacttcacccccctgaacaccccccagagctatgagaccctggaggagctggtgtctgccaccacccagagcagcaagcagctgcccacctgcttcatgagcacccaccgcatcgtgacagagggccgggtggtgacagaggaccagctgctgatgctggaggccgtggtgatgcacctgggcatccgcagcgcccgctgtgtgctgggcatggagggccagcaggtgatcctgcacctgcccctgagccagaagggccccttctggacctgggagcccagcgcccccaggaccctgctgcagtag

SEQ ID NO: 36090 - DNA, 744 bp, Artificial Sequence
  Description of Artificial Sequence: Synthetic coding sequence
atggagcctgtgcccctgcaggactttgtgcgggccctggaccctgccagcctgccccgggtgctgcgggtgtgcagcggcgtgtactttgagggcagcatctatgagatctctggaaatgaatgctgcctgagcactggagacctgatcaaggtgacccaggtgcggctgcagaaggtggtgtgtgagaaccccaagaccagccagaccatggagctggcccccaacttccaggtgcggaggaccatcgtgaagatccccagcaccctggaggtggatgtggaggatgtgacagccagcagcagacatgtgcacttcatcaagcccctgctgctgtctgaggtgctggcctgggagggccccttccccctgtccatggagatcctggaggtgcctgagggccggcccatcttcctgagcccctgggtgggcagcctgcagaagggccagaggctgtgtgtgtatggcctggccagccccccctggagggtgctggccagcagcaaaggaaggaaggtgcccaggcacttcctggtgtctgggggctaccagggcaagctgcggcggcggccccgggagttccccacagcctatgacctgctgggcgccttccagcccggccggcccctgcgggtggtggccaccaaggactgtgagggggagcgggaggagaaccctgagttcaccagcctggccgtgggggaccggctggaggtgctgggccctggccaggcccacggctag

SEQ ID NO: 36091 - DNA, 1176 bp, Artificial Sequence
  Description of Artificial Sequence: Synthetic coding sequence
tgaacctgcttcatgagcacccaccgcatcgtgacagagggccgggtggtgacagaggaccagctgctgatgctggaggccgtggtgatgcacctgggcatccgcagcgcccgctgtgtgctgggcatggagggccagcaggtgatcctgcacctgcccctgagccagaagggccccttctggacctgggagcccagcgcccccaggaccctgctgcaggtgctgcaggaccctgccctgaaggacctggtgctgacctgccccaccctgccctggcacagcctcatcctgcggccccagtatgagatccaggccatcatgcacatgaggaggaccatcgtgaagatccccagcaccctggaggtggatgtggaggatgtgacagccagcagcagacatgtgcacttcatcaagcccctgctgctgtctgagcggctgagtgaccaggccggggaggatgaggaggaggagtgcaaggaggaggccgagagccctgagcgggtgctgctgcccttccacttccctggcagctttgtggaggagatgtctgacagccgccgctacagcctggccgacctgacagcccagttcagcctgccctgtgaggtgaaggtggtggccaaggacaccagccaccccacagaccccctgaccagcttcctgggcctgcggctggaggagaagatcacagagcccttcctggtggtgtccctggacagcgagcccggcatgtgctttgagatccccccacgctggctggacctgactgtggtgaaggccaagggccagcctgacctgcctgagggcagcctgcccatcgccaccgtggaggagctgacagacaccttctactaccgcctgaggaagctgcctgcctgtgagatccaggcccccccaccccggccccccaagaaccagggcctgagcaagcagaggaggcacagcagcgagggcggcgtgaagagcagccaggtgctgggcctgcagcagcacgcccggctgcccaagcccaaggccaagaccctgcctgagttcatcaaggatggcagcagcacctacagcaagatcccagcccacaggaagggccacaggcctgccaagccccagaggcaggacctggatgatgatgaacatgactatgaggagatcctggagcagttccagaagaccatctag

SEQ ID NO: 36092 - DNA, 600 bp, Artificial Sequence
  Description of Artificial Sequence: Synthetic coding sequence
atggaggatgctgctgcccctggccgcacagagggcgtgctggagcggcagggcgcccccccagctgctggccagggcggggccctggtggagctgacccccacccctgggggcctggccctggtgagcccctaccacacccaccgggccggggaccccctggacctggtggccctggccgagcaggtgcagaaggcagatgagttcatccgggccaatgccaccaacaagctgactgtgattgctgagcagatccagcacctgcaggagcaggccaggaaggtgctggaggatgcccacagagatgccaacctgcaccacgtggcctgcaacatcgtgaagaagccaggcaacatctactacctgtacaagcgggagagcggccagcagtacttcagcatcatcagccccaaggagtggggcaccagctgcccccatgacttcctgggcgcctacaagctgcagcacgacctgtcctggaccccctatgaggacatcgagaagcaggatgccaagatctccatgatggacaccctgctgagccagagcgtggccctgcccccctgcacagagcccaacttccagggcctgacccactag

SEQ ID NO: 36093 - DNA, 336 bp, Artificial Sequence
  Description of Artificial Sequence: Synthetic coding sequence
tgaagcgccctgctgctgggcgtggatggcctgctgagcggcatcctggccatcatctacgtgtctgctgccagcttccacctgtgcttctacagccctggggtgcccagcacctacaagggcctgccctgcccctatgccagctgcatcctggccagcaccagcctgctgaccaagggcaaccgcttcatcctgtgctgcatggccagcctgatgatcctcttcatgatggaccagagctactacccctatgacaagatcctggagagcgagaactggaagaagctggtgtacatcggcggccagttccgcttcatcatcggctggaacttctag

SEQ ID NO: 36094 - DNA, 690 bp, Artificial Sequence
  Description of Artificial Sequence: Synthetic coding sequence
aaaggcaccagcttcttcctgagccatgaccagagccacagccagatcaatgaggtgtcctggaaggatgtgaccagcgccctgagcctggccaacatggtgctgggcctcttcagcatcatcttctccttcagcaggaagtgccactacgccagcaggatgctgctggtgtccttcctgctggacatggctgtgcgggccatgaccagccacatcaacatctgcagcaagctgggcgctgagctgaatgactttgctgtgttcaccaccttcggcctggccagcgccctgctgctgggcgtggatggcctgctgagcggcatcctggccatcatctacgtgtctgctgccagcttccacctgtgcttctacagccctggggtgcccagcacctacaagggcctgccctgcccctatgccagctgcatcctggccagcaccagcctgctgaccaagggcaaccgcttcatcctgtgctgcatggccagcctgatgatcctcttcatgatggaccagagctactacccctatgacaagatcctggagagcgagaactggaagaagctggtgtacatcggcggcgtcatcatgctgttcttcagccccctgagcctgagcgccttctactgcctgatgtggagcctgagctacatcttcttcccagatgccctgtggggcaaggccgcctag

SEQ ID NO: 36095 - DNA, 699 bp, Artificial Sequence
  Description of Artificial Sequence: Synthetic coding sequence
tgattcttcctgagccatgaccagagccacagccagatcaatgaggtgtcctggaaggatgtgaccagcgccctgagcctggccaacatggtgctgggcctcttcagcatcatcttctccttcagcaggaagtgccactacgccagcaggatgctgctggtgtccttcctgctggacatggctgtgcgggccatgaccagccacatcaacatctgcagcaagctgggcgctgagctgaatgactttgctgtgttcaccaccttcggcctggccagcgccctgctgctgggcgtggatggcctgctgagcggcatcctggccatcatctacgtgtctgctgccagcttccacctgtgcttctacagccctggggtgcccagcacctacaagggcctgccctgcccctatgccagctgcatcctggccagcaccagcctgctgaccaagggcaaccgcttcatcctgtgctgcatggccagcctgatgatcctcttcatgatggaccagagctactacccctatgacaagatcctggagagcgagaactggaagaagctggtgtacatcggcggcgtcatcatgctgttcttcagccccctgagcctgagcgccttctactgcctgatgtggagcctgagctacatcttcttcccagatgccctgtggggcaaggccgcctgcctgagcccccagcactag

SEQ ID NO: 36096 - DNA, 1158 bp, Artificial Sequence
  Description of Artificial Sequence: Synthetic coding sequence
atggacagccccagctctgtgtcctcctacagcagctacagcctgagcagcagcttccccaccagccctgtgaacagcgactttggcttccccagcgacagcgagagagaagataaaggagcccacggccccaggccagacacagtgggccagagaggaggcagccggcccagccctggccccatccgctgccgccacaggagcaaggtgtctggcaaccagcacacccccagccaccccaagcagaggggcagcgccagccccatggccggcagcggggccaagaggagcagagatggagagctggagaccagcctgaacacccagggctgcaccacagaaggagacctgctgtttgcccagaagtgcaaggagctgcagggcttcatcccccccctgacagacctgctgaatggcctgaagatgggccgctttgagcggggcctgagcagcttccagcagagcgtggccatggaccgcatccagagaattgtgggcgtgctgcagaagccccagatgggagagcgctacctgggcaccctgctgcaggtggagggcatgctgaagacctggttcccccagattgctgcccagaagagcagcctgggcggcggcaagcaccagctgaccaagcacttccccagccaccacagcgacagcgctgccagcagccctgccagccccatggagaagatggaccagacccagctgggccacctggccctgaagcccaagcagccctggcacctgacccagtggccagccatgaacctgacctggatccacaccacccccatctgcaacccccccctgagcagccctggcaccatctccttcagccacggccccctgggcaccggcaccggcatcggggtcatcctcttcctgcagcacggcgtgcagcccttcacccacagcgcccccaccacccctgtgccccccaccacagccagccctgtgattcctggagagcccatgaagctgtctggagagggcccccgctgctacagcctgcctgtgaccctgcccagcgactggagctacaccctgagcccccccagcctgcccaccctggccaggaagatgaccatcggccaccgggagcagcagaggagccacccccctgtggccgcagatgcccacctgctgaacctgtag

SEQ ID NO: 36097 - DNA, 1158 bp, Artificial Sequence; identical to SEQ ID NO: 36096
  Description of Artificial Sequence: Synthetic coding sequence

SEQ ID NO: 36098 - DNA, 1158 bp, Artificial Sequence; identical to SEQ ID NO: 36096
  Description of Artificial Sequence: Synthetic coding sequence

SEQ ID NO: 36099 - DNA, 504 bp, Artificial Sequence
  Description of Artificial Sequence: Synthetic coding sequence
atggctgctgaggagaaggaccccctgagctactttgctgcctacggcagcagcagcagcggcagcagtgatgaggaggacaacatcgagcctgaggagaccagcaggaggaccccagaccctgccaagtctgctgggggctgcaggaacaaggccgagaagaggctgcccggcccagatgagctgttccgctctgtgaccaggcctgccttcctgtacaaccccctgaacaagcagattgactgggagagacatgtggtgaaggcccctgaggagccccccaaggagttcaagatctggaagagcaactacgtgcccccacctgagacctacaccacagagaagaagcccccacctcctgagctggacatggccatcaagtggagcaacatctatgaagataatggagatgatgccccccagaatgccaagaaggcccggctgctgcctgagggggaggagaccctggagagcgccctggaggacctggagatccagaactag

SEQ ID NO: 36100 - DNA, 549 bp, Artificial Sequence
  Description of Artificial Sequence: Synthetic coding sequence
atggctgctgaggagaaggaccccctgagctactttgctgcctacggcagcagcagcagcggcagcagtgatgaggaggacaacatcgagcctgaggagaccagcaggaggaccccagaccctgccaagtctgctgggggctgcaggaacaaggccgagaagaggctgcccggcccagatgagctgttccgctctgtgaccaggcctgccttcctgtacaaccccctgaacaagcagattgactgggagagacatgtggtgaaggcccctgaggagccccccaaggagttcaagatctggaagagcaactacgtgcccccacctgagacctacaccacagagaagaagcccccacctcctgagctggacatggccatcaagtggagcaacatctatgaagataatggagatgatgccccccagaatgccaagaaggcccggctgctgcctgagggggaggagaccctggagagtgatgatgagaaggatgagcacaccagcaagaagaggaaggtggagcccggggagcccgccaagaagaagaagtag

SEQ ID NO: 36101 - DNA, 438 bp, Artificial Sequence
  Description of Artificial Sequence: Synthetic coding sequence
atggccgcccggcagatctgggccaggactggagctgccctgtgccggcagcccagcgctgcccctcctccagcccccctgtgggtgcgggccggcttccggcagcagctgagcctgaccctgtgcccagccaatgaaggcaactgtggcggcagcgcccccagcaccccaggccggcctgagagagctgcccggcccagcgtgtctgaggagctgacagctgctgagcggcagattgctgagctgcacgccgccgcctgtgccgccggccagctgaactacgtggaccctgccaccggctacgtggtgctgacccagatcgcccacctgcagagaggagagtgctgcggcagcgcctgccgccactgcccctacggccaggtgaatgtgaaggaccccagcaagaagaagcagttcaacagctacttctacgtgtag

SEQ ID NO: 36102 - DNA, 396 bp, Artificial Sequence
  Description of Artificial Sequence: Synthetic coding sequence
atggatgtgctgtttgtggccatctttgctgtgcccctcatcctgggccaggagtatgaagatgaggagcggctgggagaagatgagtactaccaggtggtgtactactacacagtgacccccagctatgatgacttctctgctgacttcaccatcgactacagcatctttgaaagtgaggaccggctgaaccggctggacaaggacatcacagaggccatcgagaccaccatcagcctggagacagcccgggctgaccaccccaagcctgtgacagtgaagcctgtgaccacagagcccagcccagacctgaatgatgctgtgagcagcctgcggagccccatccccctgctgctgagctgtgcctttgtgcaggtgggcatgtacttcatgtag

SEQ ID NO: 36103 - DNA, 1356 bp, Artificial Sequence
  Description of Artificial Sequence: Synthetic coding sequence
atggccgaggccgccgccctggtgtggatccggggccctggcttcggctgcaaggctgtgcgctgtgccagcggccgctgcaccgtgcgggacttcatccaccgccactgccaggaccagaatgtgcctgtggagaacttctttgtgaagtgcaatggagccctgatcaacaccagtgacacagtgcagcacggggctgtgtacagcctggagccccggctgtgtggcggcaagggcggcttcggctccatgctgcgggccctgggcgcccagatcgagaagaccaccaaccgggaggcctgccgggacctgtctggaagaaggctgagagatgtgaaccacgagaaggccatggccgagtgggtgaagcagcaggccgagcgggaggccgagaaggagcagaagaggctggagcggctgcagaggaagctggtggagcccaagcactgcttcaccagcccagactaccagcagcagtgccacgagatggccgagcggctggaggacagcgtgctgaagggcatgcaggccgccagcagcaagatggtgtctgctgagatcagtgaaaataggaagaggcagtggcccaccaagagccagacagacagaggagccagcgctgggaagaggcgctgcttctggctgggcatggagggcctggagacagctgagggcagcaacagcgagagcagtgatgatgattctgaggaggcccccagcaccagcggcatgggcttccacgcccccaagattggcagcaatggagtggagatggccgccaagttccccagcggcagccagagggcccgggtggtgaacacagaccacggcagccctgagcagctgcagatccctgtgacagattctggccgccacatcctggaggacagctgtgccgagctgggggagagcaaggagcacatggagagcaggatggtgacagaaacagaggagacccaggagaagaaggccgagagcaaggagcccatcgaggaggagcccactggagctggcctgaacaaggacaaggagacagaggagaggacagatggagagcgggtggccgaggtggcccctgaggagagagaaaatgtggccgtggccaagctgcaggagagccagcctggaaatgctgtgattgacaaggagaccatcgacctgctggccttcacctctgtggccgagctggagctgctgggcctggagaagctgaagtgtgagctgatggccctgggcctgaagtgtggcggcaccctgcaggagagagctgcccggctcttctctgtgcggggcctggccaaggagcagattgatcctgccctgtttgccaagcccctgaagggcaagaagaagtag

SEQ ID NO: 36104 - DNA, 1071 bp, Artificial Sequence
  Description of Artificial Sequence: Synthetic coding sequence
atggagcacagcctgacccctgtgacccagtgcagcatggagctgttcatcgtgtggaacccagactttgctgtggagaaggaggtgctggacctgtgcagcgagcacctggtgctgcggctgcggcggcagcccatcgagaagctggtggagcccaagcactgcttcaccagcccagactaccagcagcagtgccacgagatggccgagcggctggaggacagcgtgctgaagggcatgcaggccgccagcagcaagatggtgtctgctgagatcagcgagaacaggaagaggcagtggcccaccaagagccagacagacagaggagccagcgctgggaagaggcgctgcttctggctgggcatggagggcctggagacagctgagggcagcaacagcgagagcagtgatgatgacagcgaggaggcccccagcaccagcggcatgggcttccacgcccccaagattggcagcaatggagtggagatggccgccaagttccccagcggcagccagagggcccgggtggtgaacacagaccacggcagccctgagcagctgcagatccctgtgacagacagcggccgccacatcctggaggacagctgtgccgagctgggggagagcaaggagcacatggagagcaggatggtgacagaaacagaggagacccaggagaagaaggccgagagcaaggagcccatcgaggaggagcccaccggggccggcctgaacaaggacaaggagacagaggagaggacagatggagagcgggtggccgaggtggcccctgaggagcgggagaatgtggccgtggccaagctgcaggagagccagcctggaaatgctgtgattgacaaggagaccatcgacctgctggccttcacctctgtggccgagctggagctgctgggcctggagaagctgaagtgtgagctgatggccctgggcctgaagtgtggcggcaccctgcaggagcgggccgcccggctcttctctgtgcggggcctggccaaggagcagattgatcctgccctgtttgccaagcccctgaagggcaagaagaagtag

SEQ ID NO: 36105 - DNA, 1320 bp, Artificial Sequence
  Description of Artificial Sequence: Synthetic coding sequence
atggccgaggccgccgccctggtgtggatccggggccctggcttcggctgcaaggctgtgcgctgtgccagcggccgctgcaccgtgcgggacttcatccaccgccactgccaggaccagaatgtgcctgtggagaacttctttgtgaagtgccacggggctgtgtacagcctggagccccggctgtgtggcggcaagggcggcttcggctccatgctgcgggccctgggcgcccagatcgagaagaccaccaaccgggaggcctgccgggacctgtctggaagaaggctgagagatgtgaaccacgagaaggccatggccgagtgggtgaagcagcaggccgagcgggaggccgagaaggagcagaagaggctggagcggctgcagaggaagctggtggagcccaagcactgcttcaccagcccagactaccagcagcagtgccacgagatggccgagcggctggaggacagcgtgctgaagggcatgcaggccgccagcagcaagatggtgtctgctgagatcagtgaaaataggaagaggcagtggcccaccaagagccagacagacagaggagccagcgctgggaagaggcgctgcttctggctgggcatggagggcctggagacagctgagggcagcaacagcgagagcagtgatgatgattctgaggaggcccccagcaccagcggcatgggcttccacgcccccaagattggcagcaatggagtggagatggccgccaagttccccagcggcagccagagggcccgggtggtgaacacagaccacggcagccctgagcagctgcagatccctgtgacagattctggccgccacatcctggaggacagctgtgccgagctgggggagagcaaggagcacatggagagcaggatggtgacagaaacagaggagacccaggagaagaaggccgagagcaaggagcccatcgaggaggagcccactggagctggcctgaacaaggacaaggagacagaggagaggacagatggagagcgggtggccgaggtggcccctgaggagagagaaaatgtggccgtggccaagctgcaggagagccagcctggaaatgctgtgattgacaaggagaccatcgacctgctggccttcacctctgtggccgagctggagctgctgggcctggagaagctgaagtgtgagctgatggccctgggcctgaagtgtggcggcaccctgcaggagagagctgcccggctcttctctgtgcggggcctggccaaggagcagattgatcctgccctgtttgccaagcccctgaagggcaagaagaagtag

SEQ ID NO: 36106 - DNA, 873 bp, Artificial Sequence
  Description of Artificial Sequence: Synthetic coding sequence
atgagcaactacgtgaatgacatgtggccaggcagcccccaggagaaggacagccccagcaccagccgcagcggcggcagcagccggctgagcagccgcagccgcagccgctccttcagccgcagcagccgcagccacagccgggtgagcagccgcttcagcagccgcagccgccgcagcaagagccgcagccgcagcagaagaagacaccagaggaagtaccgccgctacagccgcagctacagccgcagccgcagccgcagccgcagccgccgctaccgggagcggcgctatggcttcacccggcgctactaccgcagccccagccgctaccgcagccgcagccgcagccgcagccgcagccggggccgcagctactgcggccgggcctatgccatcgcccggggccagcgctactacggcttcggccgcacagtgtacccagaggagcacagccgctggagggacaggagcaggaccaggagccgcagcaggacccccttccggctgtctgagaaggacaggatggagctgctggagatcgccaagaccaatgctgccaaggccctgggcaccaccaacatcgacctgcctgccagcctgaggacagtgcccagcgccaaggagaccagccggggcatcggcgtgagcagcaatggagccaagccagagctgtctgagaaggtgacagaagatggcaccaggaaccccaatgagaagcccacccagcagaggagcatcgccttcagcagcaacaacagcgtggccaagcccatccagaagagcgccaaggccgccacagaggaggccagcagccgcagccccaagattgaccagaagaagagcccctacggcctgtggatccccatctag

SEQ ID NO: 36107 - DNA, 876 bp, Artificial Sequence
  Description of Artificial Sequence: Synthetic coding sequence
atgtggccaggcagcccccaggagaaggacagccccagcaccagccgcagcggcggcagcagccggctgagcagccgcagccgcagccgctccttcagccgcagcagccgcagccacagccgggtgagcagccgcttcagcagccgcagcagaagaagcaagagccgcagccgcagcagaagaagacaccagaggaagtaccgccgctacagccgcagctacagccgcagccgcagccgcagccgcagccgccgctaccgggagaggagatatggcttcacccggcgctactaccgcagccccagccgctaccgcagccgcagccgcagccgcagccgcagccggggccgcagctactgcggccgggcctatgccatcgcccggggccagcgctactacggctttggaagaacagtgtacccagaggagcacagccgctggagggacaggagcaggaccaggagccgcagcaggacccccttccggctgtctgagaaggacaggatggagctgctggagatcgccaagaccaatgctgccaaggccctgggcaccaccaacatcgacctgcctgccagcctgaggacagtgcccagcgccaaggagaccagccggggcattgatattgatgaggagaacctgctggtgattgacacctgggccaaggccagcgagctgtctgagaaggtgacagaagatggcaccaggaaccccaatgagaagcccacccagcagaggagcatcgccttcagcagcaacaacagcgtggccaagcccatccagaagagcgccaaggccgccacagaggaggccagcagccgcagccccaagattgaccagaagaagagcccctacggcctgtggatccccatctag

SEQ ID NO: 36108 - DNA, 681 bp, Artificial Sequence
  Description of Artificial Sequence: Synthetic coding sequence
atgagcaactacgtgaatgacatgtggccaggcagcccccaggagaaggacagccccagcaccagccgcagcggcggcagcagccggctgagcagccgcagccgcagccgctccttcagccgcagcagccgcagccacagccgggtgagcagccgcttcagcagccgcagccgccgcagcaagagccgcagccgcagcagaagaagacaccagaggaagtaccgccgctacagccgcagctacagccgcagccgcagccgcagccgcagccgccgctaccgggagcggcgctatggcttcacccggcgctactaccgcagccccagccgctaccgcagccgcagccgcagccgcagccgcagccggggccgcagctactgcggccgggcctatgccatcgcccggggccagcgctactacggcttcggccgcacagtgtacccagaggagcacagccgctggagggacaggagcaggaccaggagccgcagcaggacccccttccggctgtctgagaaggacaggatggagctgctggagatcgccaagaccaatgctgccaaggccctgggcaccaccaacatcgacctgcctgccagcctgaggacagtgcccagcgccaaggagaccagccggggcatcggcgtgagcagcaatggagccaagccagagaagagctag

SEQ ID NO: 36109 - DNA, 525 bp, Artificial Sequence
  Description of Artificial Sequence: Synthetic coding sequence
atgagcaactacgtgaatgacatgtggccaggcagcccccaggagaaggacagccccagcaccagccgcagcggcggcagcagccggctgagcagccgcagccgcagccgctccttcagccgcagcagccgcagccacagccgggtgagcagccgcttcagcagccgcagccgccgcagcaagagccgcagccgcagcagaagaagacaccagaggaagtacagaagaacagtgtacccagaggagcacagccgctggagggacaggagcaggaccaggagccgcagcaggacccccttccggctgtctgagaaggacaggatggagctgctggagatcgccaagaccaatgctgccaaggccctgggcaccaccaacatcgacctgcctgccagcctgaggacagtgcccagcgccaaggagaccagccggggcatcggcgtgagcagcaatggagccaagccagaggtgtccatcctgggcctgtctgagcagaacttccagaaggccaactgccagatctag

SEQ ID NO: 36110 - DNA, 510 bp, Artificial Sequence
  Description of Artificial Sequence: Synthetic coding sequence
atggcccccagcgaggacccccgggactggagggccaacctgaagggcaccatccgggagaccggcctggagaccagcagcggcggcaagctggccggccaccagaagacagtgcccacagcccacctgacctttgtgattgactgcacccacggcaagcagctgagcctggccgccacagccagccccccccaggcccccagccccaacagaggcctggtgaccccacccatgaagacctacatcgtgttctgtggggagaactggccccacctgaccagggtgacccccatgggcggcggctgcctggcccaggcccgggccaccctgcccctgtgccggggctctgtggccagcgccagcttccctgtgagccccctgtgcccccaggaggtgcctgaggccaagggcaagcctgtgaaggccgcccctgtgcgcagcagcacctggggcaccgtgaaggacagcctgaaggccctgagcagctgtgtgtgtggccaggccgactag

SEQ ID NO: 36111 - DNA, 1872 bp, Artificial Sequence
  Description of Artificial Sequence: Synthetic coding sequence
atggccggcttcagccacttcagccagcccccctacagagacctgtgggagccccccaggcctggaggagagcgggagagcacccagaggctgggcggccagaggtctggagctgacagcacagcctgcagccgggccggcaccccaggagctgagagcgaggccggggcctgctggctgcacccccactgcagcttcaccccccggccccggcggcggggctgcagcgacagcctgcggggcagccgcagcctgagtgatgtggcccggcggcccctggagaggagcaggaagcaccggcccaggagccggcggctggaggatgcctggggcgagaccggcaccaagcccaggcctgcctggcagccccagacccagctgcccccccagaggccccagccctgcccccactaccccctggcccagggcgacagccccccaccctgccctgggggcgccggcacccccctgagcggcaccttccgggtggagaaggcccagggcggggaccagtgggccgtgcccctgggccgccacctgggccgctggagccccagctctgtgcccagcgagaggagctctgtgcccagccagaagttcaagaggcacagcgcctgtgtgtgtgcccagaagagggacagcagtgaccaggtggagagcctggccagccgggacagccagcccctggccagcagcaaggagatgaggagcccccacacccaggtgctgaagagcaagctggaggaggtggtggtgagcagccaggaccagcagatcgtggccctggtgctgacccggctgaagaaggcccagaggatccgggagctgcagcagcaggccgccaaggcctgggaggagctgaagagaagtgaccagaaggtgcagatgaccctggagcgggagcggcggctgctgctgcggcagagccaggagcagtggcaggagaaggagcagaggaagaccctgcagagccctgagcagaggggcctgcggcgggacagccagaggaagaatgtgcccccaggagagagccgctggaaggagcagcctgaggaccaggagagcccccggcaggagaagctggagaaggcccgggcccaggccgagcacaggaagcagtgccaggtgcggcggctgcgggagcaggagaagatgctgaggaacctgcgggagcagcacagcctgcagctgcagaggcggctggtggaggcctgcaggaagaggcacctgcatgctgtggagggccagaagaaggtgcaggacaccaacctgagcagcctcatcaactaccaggccaggaaggtgctgatggactgccaggccaaggccgaggagctgctgcggcagctgagcctggagcagagcttccagaggagccaggagatccaccagggcctgaggaaggagcggcagcgggagctgcgggagaaggcccagaaggaggaggagcagctgcagcaggcccgctggagggctggggagagcgaggagcagaggaagatgaggaagaggatcctggtggagctggctgatgagaagatccggcaggcccggagccacgtgcacaagaccacccgggacaaggtgcagcacctgcgggagctgaaccacctgcgggagaagaaccaccacatcctgaagctgaaggccgagaaggaggagaagtgccacatcgagggcatcaaggaggccatcaagaagaaggagcagagggtgcagcacatcagccagggcaaggaccccaacttccaggagttccagaagctgccccaggccagccggcgggaggagcgggccccacccaacagcagcctggaccagatggtgctggaggcccagctgcgggcctgccagcagaacagaggctactag

SEQ ID NO: 36112 - DNA, 753 bp, Artificial Sequence
  Description of Artificial Sequence: Synthetic coding sequence
atgtgtgaccagcagaagcagccccagtttcctcccagctgtgtgaagggcagcggcctgggcgccggccagggcagcaatggagcctctgtgaagtgccctgtgccctgccagacccagacagtgtgtgtgactggacctgccccctgccccacccagacctacgtgaagtaccaggtgccctgccagacccagacctacgtgaagtgcccagccccctgccagaggacctacgtgaagtaccccaccccctgccagacctacgtgaagtgcccagccccctgccagaccacctacgtgaagtgccccaccccctgccagacctacgtgaagtgcccagccccctgccagatgacctacatcaagagccctgccccctgccagacccagacctgctacgtgcagggcgccagcccctgccagagctactacgtgcaggccccagccagcggcagcaccagccagtactgtgtgacagacccctgcagcgccccctgcagcaccagctactgctgcctggcccccaggaccttcggcgtgagccccctgcggcgctggatccagaggccccagaactgcaacacaggcagcagcggctgctgtgagaacagcggcagcagcggctgctgcggcagcggcggctgcggctgcagctgtggctgcggcagcagcggctgctgctgcctgggcatcatccccatgaggagccggggccctgcctgctgtgaccatgaagatgactgctgctgctag

SEQ ID NO: 36113 - DNA, 753 bp, Artificial Sequence; identical to SEQ ID NO: 36112
  Description of Artificial Sequence: Synthetic coding sequence

SEQ ID NO: 36114 - DNA, 810 bp, Artificial Sequence
  Description of Artificial Sequence: Synthetic coding sequence
atgctgctgctggacctgatgagcagccccagcccccagctgctggtggccgccgcccagcagaccctgggcatgggcaagaggaggagccccccccaggccatctgcctgcacctggccggggaggtgctggccgtggcccggggcctgaagccagctgtgctgtatgactgcaactgtgccggggccagcgagctgcagagctacctggaggagctgaagggcctgggcttcctgaccttcggcctgcacatcctggagatcggggagaacagcctcatcgtgtccccagagcacgtgtgccagcacctggagcaggtgctgctgggcaccatcgcctttgtggatgtgagcagctgccagaggcaccccagcgtgtgcagcctggaccagctgcaggacctgaaggccctggtggccgagatcatcacccacctgcagggcctgcagagggacctgagcctggccgtgtcctacagccggctgcacagcagtgactggaacctgtgcaccgtgtttggcatcctgctgggctaccctgtgccctacaccttccacctgaaccagggagatgacaactgcctggccctgacccccctgcgggtcttcaccgcccgcatctcctggctgctgggccagccccccatcctgctgtacagcttctctgtgcctgagagcctcttccctggcctgcgggacatcctgaacacctgggagaaggacctgcggacccgcttccgcacccagaatgactttgctgacctgagcatcagcagcgagatcgtgaccctgcctgctgtggccctgtag

SEQ ID NO: 36115 - DNA, 552 bp, Artificial Sequence
  Description of Artificial Sequence: Synthetic coding sequence
atgaggggctctgtggagtgcacctggggctggggccactgtgcccccagccccctgctgctgtggaccctgctgctgtttgctgcccccttcggcctgctgggggagaagacccggcagctgctggagtttgacagcaccaacgtgtctgacacagctgccaagcccctgggccggccctacccaccctacagcctggccgacttctcctggaacaacatcacagacagcctggaccctgccaccctgagcgccaccttccagggccaccccatgaatgaccccaccaggacctttgccaacggcagcctggccttccgggtgcaggccttcagccgcagcagcaggcctgcccagcccccccggctgctgcacacagctgacacctgccagctggaggtggccctgattggagccagcccccggggcaacagaagcctgtttggcctggaggtggccaccctgggccagggccctgactgccccagcatgcaggagcagcacagcattgatgatgaatatgccccagctgtgttccagaggcgggactag

SEQ ID NO: 36116 - DNA, 852 bp, Artificial Sequence
  Description of Artificial Sequence: Synthetic coding sequence
atgtgtggccctgagcacctgctgtgctgccccaaggacctggccatgttcccccggcagctgagcctgacagcctgcctgcccggcacccctgtgagccacaagtgccaccacatctggctgtgggtgggcgtgcctgcctggcacccccgggccagccgctgtggcggggcccagcccagctcctggctgcggcagaaggccgcccgggccttctggctgagcctgcctgctgccaagctgcggcaccacagcagccgctggctgcggcgcagcggggccttcagcagcggcagcaccctgaagcccccacccagccccagccctgcccccctgtgccacgccgacaacctgaggacaggccgcacccggcccagcggcggccggccctggttcctgctgggcggagatgagcgggagcggctgtgggccgagctgctgaggacagtgtccccagagctgatcctggaccacgaggtgcccagcctgcctgccttccctggccaggagccccgctgtggccctgagcccacagaggtgttcaccgtgggccccaagaccttctcctggacccccttccccccagacctgtggggccctggccgcagctaccgcctgctgcacggggccggcggccacctggagagccctgcccggagcctgccccagaggcctgccccagacccctgccgggccccccgggtggagcagcagcccagcgtggagggcgctgctgccctgcggagctgccccatgtgccagaaggagtttgccccccggctgacccagctggatgtggacagccacctggcccagtgcctggccgagagcacagaagatgtgacctggtag

SEQ ID NO: 36117 - DNA, 543 bp, Artificial Sequence
  Description of Artificial Sequence: Synthetic coding sequence
atggaggccgcccggcggccccggctgggcctgagcagaagaagacccaggcctgctgggggccccagcggcggccggccctggttcctgctgggcggagatgagcgggagcggctgtgggccgagctgctgaggacagtgtccccagagctgatcctggaccacgaggtgcccagcctgcctgccttccctggccaggagccccgctgtggccctgagcccacagaggtgttcaccgtgggccccaagaccttctcctggacccccttccccccagacctgtggggccctggccgcagctaccgcctgctgcatggagctgggggccacctggagagccctgcccggagcctgccccagaggcctgccccagacccctgccgggccccccgggtggagcagcagcccagcgtggagggcgccgccgccctgcggagctgccccatgtgccagaaggagtttgccccccggctgacccagctggatgtggacagccacctggcccagtgcctggccgagagcacagaagatgtgacctggtag

SEQ ID NO: 36118 - DNA, 444 bp, Artificial Sequence
  Description of Artificial Sequence: Synthetic coding sequence
atggaggcctggggcctgtgtgcctggccccggggcctgcggggcaacttccacacctgtgcccctggcctgacccagagacatgaggtggcccggccccccctgcccggcagcagtgaagatggcagcgccaccccagacacctggcagctggccgccctgcccctgggcagcctgagcagcggccagctgtgcctgcacctgcggggcaccagcaccccagcccccacctgtgtgcccctggcccccaagctgcccccctacgtgtgggtggccagcgagatgtggggccgccgccacagcaggaagaagggcatccggggggccagcaccagcagcgagcacttcatcccccaggatgccaccaggagcctgtcctggaggagccgctctgtgcaccgggtgctcttcccctggaagatgtgcaccctggagacagcctag

SEQ ID NO: 36119 - DNA, 339 bp, Artificial Sequence
  Description of Artificial Sequence: Synthetic coding sequence
atggaggccgcccggcggccccggctgggcctgagcagaagaagacccaggcctgctgggggcagccctggagctgcccggagccccctgaagagcagcctgagtgacccccggcccttccctggccaccccttccggaggacctgtggggcccgggctgtgcccaccggctgcttcaccggccaggagggcacctggaaccccccacctggcccctgccccagcgcccggcacctgatcccagctggccccccaggctggagcagcagccggctgtggagggtgccccggccctgtgccgccgccccctgtgcccggcgcagcagccccccaggatag

SEQ ID NO: 36120 - DNA, 588 bp, Artificial Sequence
  Description of Artificial Sequence: Synthetic coding sequence
tgagaagctgcccggcggccccggctgggcctgagcagaagaagacccaggcctgctgggggccccagcggcggccggccctggttcctgctgggcggagatgagcgggagcggctgtgggccgagctgctgaggacagtgtccccagagctgatcctggaccacgaggtgcccagcctgcctgccttccctggccaggagccccgctgtggccctgagcccacagaggtgttcaccgtgggccccaagaccttctcctggacccccttccccccagacctgtggggccctggccgcagctaccgcctgctgcatggagctgggggccacctggagagccctgcccggagcctgccccagaggcctgccccagacccctgccgggccccccgggtggagcagcagcccagcgtggagggcgccgccgccctgcggagctgccccatgtgccagaaggagtttgcccccaggagcaagaacagcagcggcatgagaagacacaggagccccaagctggccgccaacaacaacaacaacaagaggaagggccgggcccgctggctgacccctgtgatcccagccctgtag

SEQ ID NO: 36121 - DNA, 1641 bp, Artificial Sequence
  Description of Artificial Sequence: Synthetic coding sequence
atgagcagcgcctggaagaccccccggggcagtgatgccatgcctgagatcatggtgaagatcatcggcagcaagcacttccagtacctggtggagaagcccaagatcaaggaaaatgacagcctgaagacagagacccagaccatgcaccagaagcccatgacagacaatgcccggcagatgagccgggacacccctgtgcccatcaacttcacagaccagcagaccacagacaacccagatgatgtgaaggagaagaagcaccctgagaacaaccagaagtctgagaacaaccagaagctgctgactggagccaacagcagccgcttcctggatggcaacatccccagccaggccaacgtgcactgcagctctgtgcccaccggggaccagagcctgtcctatgtgcacggcatccccaggaggaagctgcgggactggagcctggagcagatggtgcggggcagcagtgaccagccagaagatattggccagagccccagcggcaccaccaatgaagatgccttcctgctggccctggtgcggcgggagctgaagagccggcccctgagcagcaacctgctggagaagctgcagaaggagctgaagatcctggaccccatcagcagcggcttcctgctgcagagccagctgagccgcctcttcctgaagcatgaggtgcccctgcagctgcccaccgtgaagatcctgtgccagcgcttcagcaagaggggcagccctgagatggtgaactatgagaagctgctgtggttcctgaacagcgctgccagtgactacccccagcagaacaaggctgctgctgacctgaggaagacagagagccacggcacccacagccagagcaccccaccccagcacagcagcagccagcctgaggtgaacagaagcctgctggagatcctgaagatggccctgcggaccaccaacggccgcctgaacatcgacaacctgaacctgtccttcagaaaagaagatagaagcttcagcggctgcctgcccctgcccaaggtgcgggccatctgtgggaagcacggcctgtacctgaccctgagcctgctggagaccctgctgaaccaccaggacctgggctaccagaatgagatcaagtggcagaactttgtggagatgctgacccgggccagcagtgacctgctgagtgacctgcccaccgggaagaatgagaagaaggccccagccccacccatggagcctgaggtgcctgagatgagccagagcaagacagagcacatgaagaccccagaggaggagctgcagcctgagagcagccctgctgagaccagcgcctgcaaggaccccctgaagcccctgaagatccggcctgtgtcccagccctttgtgaacccagctgtgaagaacaaggccgaggagtgtgagacctggattgaccgcttcaggaagctggagaatgccctgtacctgtgtgacctgagcaacacaggagtgctggagaaggagcgggcccggcggctcatccacaactacaacctgatctacaacctgagcctgagcccccagaagattgaccaggccctgcggcgcttccgcagcggggagaacatgctgctggagcccgccctgcgctacctgaaggagctgtag

SEQ ID NO: 36122 - DNA, 543 bp, Artificial Sequence
  Description of Artificial Sequence: Synthetic coding sequence
atgagccggggctgcagcagtgacctgcgcttccacacctggctgggcctgaggatgctgaagaacatcatcgctgtggccctgctgatgctgggcaagaatgagaagaaggccccagccccacccatggagcctgaggtgcctgagatgagccagagcaagacagagcacatgaagaccccagaggaggagctgcagcctgagagcagccctgctgagaccagcgcctgcaaggaccccctgaagcccctgaagatccggcctgtgtcccagccctttgtgaacccagctgtgaagaacaaggccgaggagtgtgagacctggattgaccgcttcaggaagctggagaatgccctgtacctgtgtgacctgagcaacacaggagtgctggagaaggagcgggcccggcggctcatccacaactacaacctgatctacaacctgagcctgagcccccagaagattgaccaggccctgcggcgcttccgcagcggggagaacatgctgctggagcccgccctgcgctacctgaaggagctgtag

SEQ ID NO: 36123 - DNA, 714 bp, Artificial Sequence
  Description of Artificial Sequence: Synthetic coding sequence
atgagcagcgcctggaagaccccccggggcagtgatgccatgcctgagatcatggtgaagatcatcggcagcaagcacttccagtacctggtggagaagcccaagatcaaggaaaatgacagcctgaagacagagacccagaccatgcaccagaagcccatgacagacaatgcccggcagatgagccgggacacccctgtgcccatcaacttcacagaccagcagaccacagacaacccagatgatgtgaaggagaagaagcaccctgagaacaaccagaagtctgagaacaaccagaagctgctgactggagccaacagcagccgcttcctggatggaaatgtgcgggccatctgtgggaagcacggcctgtacctgaccctgagcctgctggagaccctgctgaaccaccaggacctgggctaccagaatgagatcaagtggcagaactttgtggagatgctgacccgggccagcagtgacctgctgagtgacctgcccaccgggaagaatgagaagaaggccccagccccacccatggagcctgaggtgcctgagatgagccagagcaagacagagcacatgaagaccccagaggaggagctgcagcctgagagcagccctgctgagaccagcgcctgcaaggaccccctgaagcccctgaagatccggcctgtgtcccagccctttgtgaacccagctgtgaagaactag

SEQ ID NO: 36124 - DNA, 276 bp, Artificial Sequence
  Description of Artificial Sequence: Synthetic coding sequence
atggtgtgctacctgtactgggagaccttccccagcatcagccacctgctgaagatcaccctgagcgcccgggactgccacgtgtgtggcctgaacctcttcatcttcatggaccctgtggagaaccaggccctgcaccctgtgatcatggccctgatcctgatgcccagcctgcactgctttggaaacatcctgatcctgctcttcctgaagagccctgcccagctgttctgcaggatgtctgtggacctggccctgctcttcccccacaagtag

SEQ ID NO: 36125 - DNA, 264 bp, Artificial Sequence
  Description of Artificial Sequence: Synthetic coding sequence
atggagaggaacaccatctacacaggctggctgcagagcaacctgatcctggaccctgtggagaaccaggccctgcaccctgtgatcatggccctgatcctgatgcccagcctgcactgctttggaaacatcctgatcctgctcttcctgaagagccctgcccagctgttctgccgcatcggccgctttgaaacaggagaggagaagacccggcggcgggagggcagtgatgtgaccacagaggccgccatcggcgtgatgtag

SEQ ID NO: 36126 - DNA, 447 bp, Artificial Sequence
  Description of Artificial Sequence: Synthetic coding sequence
atgcctggaggagacaccaccccagaggaggccgccgcccccagctgtgccggctacaaccctggcctgctgctcttccgggcccagaaggcccagggcgcctgtgtgaccagcacagaaggagcctggccccggcgggccagcgccctgtatggaggcaggaagatgagatgtggggagagcggggccggccctgaccccaggagcaacagcgctgaggtgagcagcagccagcctgccctggccagcaagagccagagcaagtggggccccaccagcaacaaccccaggggggccctgaccaccacagaatttgagatggccggcaacagaagccagaacatcaagcacaagcagacagccctgattgccatccccatgagcagccagacccccaggatgctgggccggcccaggaaccagggccagctgtacccccagccctag

SEQ ID NO: 36127 - DNA, 627 bp, Artificial Sequence
  Description of Artificial Sequence: Synthetic coding sequence
atggacttcagcatcatccagtacagcaagttcatgaccctgctggccatgagcctgcagaacctgaagaccctgcacatgagcctggaggagagcatcaagtggctgggggaggtgatggccgagatcggccccacccacagccagaagtctgaggactggaacatctttgatgtgaagcaggccaatgccatcatcgactacctgaagatcagcctcttccagcactacaagctgtatgagttcatgttctacagcgcccgggaggagatcgtgattggaacagagcaggtgattgaggtggtgaagagcgcctgtggccccttccccaaccccctggaggagggcatcagctttgacatctacagcaccttcatcgagccccccaccatcctggacacagagatgaagaggctggaccaggagcagggccctgaggagagccagcctgagacagacaccagtgacatggaccccctggtgggcttcaccattgaagatgtgaagtctgtgctggaccaggtgacagatgacatcctgattggcatccagacagagatcaatgagaagctgcagatccaggaggaggccttcaatgcccgcatcgagaagctgaagaaggcctag

SEQ ID NO: 36128 - DNA, 255 bp, Artificial Sequence
  Description of Artificial Sequence: Synthetic coding sequence
tgagctgaccccggcggcaaccacgccagaattggagccctgcacatgagcctggaggagagcatcaagtggctgggggaggtgatggccgagatcggccccacccacagccagaagtctgaggactggaacatctttgatgtgaagcaggccaatgccatcatcgactacctgaagatcagcctcttccagcactacaagctgtatgagttcatgttctacagcgcccgggaggagatcgtcatcggcacctag

SEQ ID NO: 36129 - DNA, 597 bp, Artificial Sequence
  Description of Artificial Sequence: Synthetic coding sequence
atggagagcagccgctgggacaaggaccccccaggagagcggcggccccagcagagccagcactggaggagctgtggggtgggcggggccggggaggccacccggggcggcctcttccctgtgcccttccccagcggggacagctggccagaggtgacccagcactggatgaggttccagggccagggcccctggtgccccggcctgtggaccaccccagcccacagccactgcaagccccagacaggagctgtggacaatgccagcccccggcagccccacgccccagaccagcacgagaagaatgccggccggcagcacctgcacctgtggagcctggcctgccccccctggctgcacagcatcccccacatcaagggcaccatcctgtctgaggccctgagcggcttcctggtgtctgacaggaggaccaagacagtggccggcctgcgctggctgtggctgaggaaggaggccacccccacagccagcaggaccaccctgagcagcagcctggccccccggggccggggcgtgaacaccctgggccggggcggctgcaccctgatggtgctgagcagtgacctgtgtgactag

SEQ ID NO: 36130 - DNA, 666 bp, Artificial Sequence
  Description of Artificial Sequence: Synthetic coding sequence
atggagagcagccgctgggacaaggaccccccaggagagcggcggccccagcagagccagcactggagggcccgggaccatggagcccggggctgcggcccccggcagcccacagccacagccagccccaggcctggcctgtggatcaccccagcccacggcagccacaccccccagaccaacaccaggaggacccaggccgacaacatcttcatctatgaatcctggctgatccaccacggcacccagatgagctctgtgctgccccagccccccctggtgcggggcccctggcacaacaccaacagcccctgggacagctgggccagccggggcaagctgcgggtgtgcccctgcaggaccccccggctgcacagcagcggctgcttcagcagcaaggccggcacagccctgagccccagcctgcctgtgcccggcctgcggccccagccccccttcctgcagaagcccctgagcatcctggccccagccaccccaccagccctggtgagccccaccccacccaagctgagccctggccagctgagcccccacagcgtgaatgtgcactggggcccccagggccacctgcacctgcccaggagcggcaccaccgtgctgcacgcctacctgcagaccctgagcagccctgccagccaccagtag

SEQ ID NO: 36131 - DNA, 681 bp, Artificial Sequence
  Description of Artificial Sequence: Synthetic coding sequence
atggccggcctggtggtgcggggcacccaggtgtcctacatcggccaggactgccgggagatccctgagcacctgggccgggactgtggccactttgccaagaggctggacctgtccttcaacctgctgcggagcctggagggcctgagcgccttccgcagcctggaggagctgatcctggacaacaaccagctgggagatgacctggtgctgcccggcctgccccggctgcacaccctgaccctgaacaagaaccgcatcacagacctggagaacctgctggaccacctggccgaggtgaccccagccctggagtacctgagcctgctgggcaatgtggcctgccccaatgagctggtgtccctggagaaggatgaggaggactacaagcgctaccgctgctttgtgctgtacaagctgcccaacctgaagttcctggatgcccagaaggtgacccggcaggagcgggaggaggccctggtgcggggcgtcttcatgaaggtggtgaagcccaaggccagcagtgaagatgtggccagcagccctgagcggcactacacccccctgcccagcgccagccgggagctgaccagccaccagggcgtgctgggcaaatgtcgctacgtgtactacggcaagaacagcgagggcaaccgcttcatcagagatgaccagctgtag

SEQ ID NO: 36132 - DNA, 597 bp, Artificial Sequence
  Description of Artificial Sequence: Synthetic coding sequence
atggagaagtacctgagcctgagcggcaaccacagcagcaacaagaggagcctggagggcctgagcgccttccgcagcctggaggagctgatcctggacaacaaccagctgggagatgacctggtgctgcccggcctgccccggctgcacaccctgaccctgaacaagaaccgcatcacagacctggagaacctgctggaccacctggccgaggtgaccccagccctggagtacctgagcctgctgggcaatgtggcctgccccaatgagctggtgtccctggagaaggatgaggaggactacaagcgctaccgctgctttgtgctgtacaagctgcccaacctgaagttcctggatgcccagaaggtgacccggcaggagcgggaggaggccctggtgcggggcgtcttcatgaaggtggtgaagcccaaggccagcagtgaagatgtggccagcagccctgagcggcactacacccccctgcccagcgccagccgggagctgaccagccaccagggcgtgctgggcaaatgtcgctacgtgtactacggcaagaacagcgagggcaaccgcttcatcagagatgaccagctgtag

SEQ ID NO: 36133 - DNA, 438 bp, Artificial Sequence
  Description of Artificial Sequence: Synthetic coding sequence
atggagagcatggcccctgagatcagcgaggacatcggctgccccctggcctacatgagggagagcgtgtgtgccctgctgatcaaccagagcttcttcagctgtgtggccgagatgtacatcccagacatgaacagacctgggaaggccgagcggcgggcagagaagggcctgcggccccccaggaagctggtgggggagacccggcggctgcagagctggcccaccctggcccgctggctgcggcgggtgtccttcagcctgtacaagccacccatccaggccgcccctgagccagaccccggcaactgggccaagagcccccggctgagcctgggccctgagggcatcaccaagggcaagcacggcttcaagttccagggcatcaaggagaagttcaacgtgtccaagaaggtgctgaagatgaccttcctgtag

SEQ ID NO: 36134 - DNA, 240 bp, Artificial Sequence
  Description of Artificial Sequence: Synthetic coding sequence
atggccaagtctgagcggcgcatctacagcatggagagcatggcccctgagatcagcgaggacatcggctgccccctggcctacatgagggagagcgtgtgtgccctgctgatcaaccagagcttcttcagctgtgtggccgagatgtacatcccagacatgaaccggctggaggagaggacagctgccctgtaccccatcggcctggtgcggcagaatggagagccccggcgggcctag

SEQ ID NO: 36135 - DNA, 468 bp, Artificial Sequence
  Description of Artificial Sequence: Synthetic coding sequence
atggccaagtctgagcggcgcatctacagcatggagagcatggcccctgagatcagcgaggacatcggctgccccctggcctacatgagggagagcgtgtgtgccctgctgatcaaccagagcttcttcagctgtgtggccgagatgtacatcccagacatgaacagacctgggaaggccgagcggcgggcagagaagggcctgcggccccccaggaagctggtgggggagacccggcggctgcagagctggcccaccctggcccgctggctgcggcgggtgtccttcagcctgtacaagccacccatccaggccgcccctgagccagaccccggcaactgggccaagagcccccggctgagcctgggccctgagggcatcaccaagggcaagcacggcttcaagttccagggcatcaaggagaagttcaacgtgtccaagaaggtgctgaagatgaccttcctgtag

SEQ ID NO: 36136 - DNA, 411 bp, Artificial Sequence
  Description of Artificial Sequence: Synthetic coding sequence
atgcagagccgggagcccagcggctggaggacagctgagaggagaagaggctggcgctgccggggcgtgcccaccccatctggggaccggggccctggggccgcccggcctgctgcccggggcggggccggggagaccaccggccagcagaggcccctgcaggtgcctggggccagcgctgctgctgcccggacccggctgctgcgctggcaccaccgggtgcccagcccccgggccaccaggagccctggcagcatccggaggaccagcccctgcagcggcggccctgacaggcctgagaggccagaatgtgctgatgcctgctgctacctgctggaccccttcaccctgcccctcatccaggacttcttccggggctgtgccgccagtgactttgaccggcgggactag

SEQ ID NO: 36137 - DNA, 285 bp, Artificial Sequence
  Description of Artificial Sequence: Synthetic coding sequence
atgttcaccaggcacaccctcttccggcagtttgctgtgctggccgacaccagcttcaactacatcaaggtgaagcccctgctggtgcagagcaggaccaccatgacagccatcagcagcagcagccactgcaccagcagcattgatggcaagcacgtggatgtggtgtctgaccaggccgccctgcagctgagccccaagggcaagctgtctgagagccccaaggaggagagcctggaggagcccagcatgaggcagagcagccctgctgagaccgtggactag

SEQ ID NO: 36138 - DNA, 285 bp, Artificial Sequence; identical to SEQ ID NO: 36137
  Description of Artificial Sequence: Synthetic coding sequence

SEQ ID NO: 36139 - DNA, 168 bp, Artificial Sequence
  Description of Artificial Sequence: Synthetic coding sequence
atggccagcaagggcctgcaggacctgaagcagcaggtggagggcacagcccaggaggccgccatggaccagctggccaagaccacccaggagaccatcgacaagacagccaaccaggccagtgacaccttctctggaattggcaagaagtttggcctgctgaagtag

SEQ ID NO: 36140 - DNA, 231 bp, Artificial Sequence
  Description of Artificial Sequence: Synthetic coding sequence
atggccagcaagggcctgcaggacctgaagcagcaggtggagggcacagcccaggaggccgtgtctgctgctggagctgctgcccagcaggtggtggaccaggccacagaggccggccagaaggccatggaccagctggccaagaccacccaggagaccatcgacaagacagccaaccaggccagtgacaccttcagcggcatcggcaagaagtttggcctgctgaagtag

SEQ ID NO: 36141 - DNA, 117 bp, Artificial Sequence
  Description of Artificial Sequence: Synthetic coding sequence
atggccagcaagggcctgcaggacctgaagcagcaggtggagggcacagcccaggaggccgccatggaccagctggccaagaccacccaggagaccatcgacaagacagccaactag

SEQ ID NO: 36142 - DNA, 636 bp, Artificial Sequence
  Description of Artificial Sequence: Synthetic coding sequence
atgtctgaaacagaccacatcgccagcaccagcagtgacaagaatgtgggcaagaccccagagctgaaggaggacagctgcaacctcttctctggaaatgaaagcagcaagctggagaatgaaagcaagctgctgagcctgaacacagacaagaccctgtgccagcccaatgagcacaacaacagaattgaggcccaggagaactacatcccagaccatggaggaggagaggacagctgtgccaagacagacaccggcagcgagaacagcgagcagatcgccaacttccccagcggcaactttgccaagcacatcagcaagaccaatgaaacagagcagaaggtgacccagatcctggtggagctgcggagcagcaccttccctgagagcgccaatgagaagacctacagcgagagcccctatgacacagactgcaccaagaagttcatcagcaagatcaagtctgtgtctgccagcgaggacctgctggaggagattgagagcgagctgctgagcacagaatttgctgagcaccgggtgcccaacggcatgaacaagggggagcacgccctggtgctgtttgagaagtgtgtgcaggacaagtacctgcagcaggagcacatcatcaagaagtag

SEQ ID NO: 36143 - DNA, 636 bp, Artificial Sequence; identical to SEQ ID NO: 36142
  Description of Artificial Sequence: Synthetic coding sequence

SEQ ID NO: 36144 - DNA, 2697 bp, Artificial Sequence
  Description of Artificial Sequence: Synthetic coding sequence
atgtctgaaacagaccacatcgccagcaccagcagtgacaagaatgtgggcaagaccccagagctgaaggaggacagctgcaacctcttctctggaaatgaaagcagcaagctggagaatgaaagcaagctgctgagcctgaacacagacaagaccctgtgccagcccaatgagcacaacaacagaattgaggcccaggagaactacatcccagaccatggaggaggagaggacagctgtgccaagacagacaccggcagcgagaacagcgagcagatcgccaacttccccagcggcaactttgccaagcacatcagcaagaccaatgaaacagagcagaaggtgacccagatcctggtggagctgcggagcagcaccttccctgagagcgccaatgagaagacctacagcgagagcccctatgacacagactgcaccaagaagttcatcagcaagatcaagtctgtgtctgccagcgaggacctgctggaggagattgagagcgagctgctgagcacagaatttgctgagcaccgggtgcccaacggcatgaacaagggggagcacgccctggtgctgtttgagaagtgtgtgcaggacaagtacctgcagcaggagcacatcatcaagaagctgatcaaggagaacaagaagcaccaggagctgtttgtggacatctgcagcgagaaggacaacctgcgggaggagctgaagaagaggacagaaacagagaagcagcacatgaacaccatcaagcagctggagagccgcatcgaggagctgaacaaggaggtgaaggccagccgggaccagctgattgcccaggatgtgacagccaagaatgctgtgcagcagctgcacaaggagatggcccagaggatggagcaggccaacaagaagtgtgaggaggcccggcaggagaaggaggccatggtgatgaagtatgtgcggggggagaaggagagcctggacctgaggaaggagaaggagaccctggagaagaagctgagagatgccaacaaggagctggagaagaacaccaacaagatcaagcagctgagccaggagaagggccgcctgcaccagctgtatgagaccaaggagggggagaccaccaggctcatccgggagattgacaagctgaaggaggacatcaacagccacgtgatcaaggtgaagtgggcccagaacaagctgaaggccgagatggacagccacaaggagaccaaggacaagctgaaggagaccaccaccaagctgacccaggccaaggaggaggccgaccagatcaggaagaactgccaggacatgatcaagacctaccaggagagcgaggagatcaagagcaatgagctggatgccaagctgcgggtgaccaagggggagctggagaagcagatgcaggagaagagtgaccagctggagatgcaccacgccaagatcaaggagctggaggacctgaagaggaccttcaaggagggcatggatgagctgcggaccctgcggaccaaggtgaagtgcctggaggatgagcggctgaggacagaagatgagctgagcaagtacaaggagatcatcaaccggcagaaggccgagatccagaacctgctggacaaggtgaagacagctgaccagctgcaggagcagctgcagaggggcaagcaggagattgagaacctgaaggaggaggtggagagcctgaacagcctcatcaatgacctgcagaaggacatcgagggcagcaggaagcgggagagcgagctgctgctcttcacagagcggctgaccagcaagaatgcccagctgcagagcgagagcaacagcctgcagagccagtttgacaaggtgtcctgcagcgagagccagctgcagagccagtgtgagcagatgaagcagaccaacatcaacctggagagccggctgctgaaggaggaggagctgaggaaggaggaggtgcagaccctgcaggccgagctggcctgccggcagacagaggtgaaggccctgagcacccaggtggaggagctgaaggatgagctggtgacccagaggaggaagcacgccagcagcatcaaggacctgaccaagcagctgcagcaggcccggaggaagctggaccaggtggagagcggcagctatgacaaggaggtgtcctccatgggcagccgcagcagcagcagcggcagcctgaatgcccggagcagcgcagaagatagaagccctgagaacacaggcagctctgtggccgtggacaacttcccccaggtggacaaggccatgctgattgaaagaattgtgcggctgcagaaggcccacgccaggaagaatgagaagattgagttcatggaggaccacatcaagcagctggtggaggagatcaggaagaagaccaagatcatccagagctacatcctgcgggaggagagcggcaccctgagcagcgaggccagtgacttcaacaaggtgcacctgagccggcggggcggcatcatggccagcctgtacaccagccaccctgctgacaatggcctgaccctggagctgagcctggagatcaacaggaagctgcaggccgtgctggaggacaccctgctgaagaacatcaccctgaaggagaacctgcagaccctgggcacagaaattgagcggctcatcaagcaccagcacgagctggagcagaggaccaagaagacctag

SEQ ID NO: 36145 - DNA, 1311 bp, Artificial Sequence
  Description of Artificial Sequence: Synthetic coding sequence
tgaagactcatccgggagattgacaagctgaaggaggacatcaacagccacgtgatcaaggtgaagtgggcccagaacaagctgaaggccgagatggacagccacaaggagaccaaggacaagctgaaggagaccaccaccaagctgacccaggccaaggaggaggccgaccagatcaggaagaactgccaggacatgatcaagacctaccaggagagcgaggagatcaagagcaatgagctggatgccaagctgcgggtgaccaagggggagctggagaagcagatgcaggagaagagtgaccagctggagatgcaccacgccaagatcaaggagctggaggacctgaagaggaccttcaaggagggcatggatgagctgcggaccctgcggaccaaggtgaagtgcctggaggatgagcggctgaggacagaagatgagctgagcaagtacaaggagatcatcaaccggcagaaggccgagatccagaacctgctggacaaggtgaagacagctgaccagctgcaggagcagctgcagaggggcaagcaggagattgagaacctgaaggaggaggtggagagcctgaacagcctcatcaatgacctgcagaaggacatcgagggcagcaggaagcgggagagcgagctgctgctcttcacagagcggctgaccagcaagaatgcccagctgcagagcgagagcaacagcctgcagagccagtttgacaaggtgtcctgcagcgagagccagctgcagagccagtgtgagcagatgaagcagaccaacatcaacctggagagccggctgctgaaggaggaggagctgaggaaggaggaggtgcagaccctgcaggccgagctggcctgccggcagacagaggtgaaggccctgagcacccaggtggaggagctgaaggatgagctggtgacccagaggaggaagcacgccagcagcatcaaggacctgaccaagcagctgcagcaggcccggaggaagctggaccaggtggagagcggcagctatgacaaggaggtgtcctccatgggcagccgcagcagcagcagcggcagcctgaatgcccggagcagcgctgaggacaggagcccagaaaatacaggcagctctgtggccgtggacaacttcccccaggtggacaaggccatgctgattgagcgcatcgtgcggctgcagaaggcccacgccaggaagaatgagaagattgagttcatggaggaccacatcaagcagctggtggaggagatcaggaagaagaccaagaagatctacaagcacctggagcagaagtag

SEQ ID NO: 36146 - DNA, 3015 bp, Artificial Sequence
  Description of Artificial Sequence: Synthetic coding sequence
gtgggctgtgtgagccaccggggcctcttcctgcccctgctggccggctggacccccctgtggaagtcctggcccctgagccagagcagcagcagcctggtgcgggcctggccagaggcctggatcagcggcaggaagaagtcctggatcagcagccagaacatctggatccgcatcctgctgctgagcctggacaacctggtgacctgtggcaaccagaagcgggagtacagcaagaacacccagtacagcccccgctgcaagaccaagatccgcagcagatttgaggagctgcagagcgagctggtgcctgtgtccatgtctgaaacagaccacatcgccagcaccagcagtgacaagaatgtgggcaagaccccagagctgaaggaggacagctgcaacctcttctctggaaatgaaagcagcaagctggagaatgaaagcaagctgctgagcctgaacacagacaagaccctgtgccagcccaatgagcacaacaacagaattgaggcccaggagaactacatcccagaccatggaggaggagaggacagctgtgccaagacagacaccggcagcgagaacagcgagcagatcgccaacttccccagcggcaactttgccaagcacatcagcaagaccaatgaaacagagcagaaggtgacccagatcctggtggagctgcggagcagcaccttccctgagagcgccaatgagaagacctacagcgagagcccctatgacacagactgcaccaagaagttcatcagcaagatcaagtctgtgtctgccagcgaggacctgctggaggagattgagagcgagctgctgagcacagaatttgctgagcaccgggtgcccaacggcatgaacaagggggagcacgccctggtgctgtttgagaagtgtgtgcaggacaagtacctgcagcaggagcacatcatcaagaagctgatcaaggagaacaagaagcaccaggagctgtttgtggacatctgcagcgagaaggacaacctgcgggaggagctgaagaagaggacagaaacagagaagcagcacatgaacaccatcaagcagctggagagccgcatcgaggagctgaacaaggaggtgaaggccagccgggaccagctgattgcccaggatgtgacagccaagaatgctgtgcagcagctgcacaaggagatggcccagaggatggagcaggccaacaagaagtgtgaggaggcccggcaggagaaggaggccatggtgatgaagtatgtgcggggggagaaggagagcctggacctgaggaaggagaaggagaccctggagaagaagctgagagatgccaacaaggagctggagaagaacaccaacaagatcaagcagctgagccaggagaagggccgcctgcaccagctgtatgagaccaaggagggggagaccaccaggctcatccgggagattgacaagctgaaggaggacatcaacagccacgtgatcaaggtgaagtgggcccagaacaagctgaaggccgagatggacagccacaaggagaccaaggacaagctgaaggagaccaccaccaagctgacccaggccaaggaggaggccgaccagatcaggaagaactgccaggacatgatcaagacctaccaggagagcgaggagatcaagagcaatgagctggatgccaagctgcgggtgaccaagggggagctggagaagcagatgcaggagaagagtgaccagctggagatgcaccacgccaagatcaaggagctggaggacctgaagaggaccttcaaggagggcatggatgagctgcggaccctgcggaccaaggtgaagtgcctggaggatgagcggctgaggacagaagatgagctgagcaagtacaaggagatcatcaaccggcagaaggccgagatccagaacctgctggacaaggtgaagacagctgaccagctgcaggagcagctgcagaggggcaagcaggagattgagaacctgaaggaggaggtggagagcctgaacagcctcatcaatgacctgcagaaggacatcgagggcagcaggaagcgggagagcgagctgctgctcttcacagagcggctgaccagcaagaatgcccagctgcagagcgagagcaacagcctgcagagccagtttgacaaggtgtcctgcagcgagagccagctgcagagccagtgtgagcagatgaagcagaccaacatcaacctggagagccggctgctgaaggaggaggagctgaggaaggaggaggtgcagaccctgcaggccgagctggcctgccggcagacagaggtgaaggccctgagcacccaggtggaggagctgaaggatgagctggtgacccagaggaggaagcacgccagcagcatcaaggacctgaccaagcagctgcagcaggcccggaggaagctggaccaggtggagagcggcagctatgacaaggaggtgtcctccatgggcagccgcagcagcagcagcggcagcctgaatgcccggagcagcgcagaagatagaagccctgagaacacaggcagctctgtggccgtggacaacttcccccaggtggacaaggccatgctgattgaaagaattgtgcggctgcagaaggcccacgccaggaagaatgagaagattgagttcatggaggaccacatcaagcagctggtggaggagatcaggaagaagaccaagatcatccagagctacatcctgcgggaggagagcggcaccctgagcagcgaggccagtgacttcaacaaggtgcacctgagccggcggggcggcatcatggccagcctgtacaccagccaccctgctgacaatggcctgaccctggagctgagcctggagatcaacaggaagctgcaggccgtgctggaggacaccctgctgaagaacatcaccctgaaggagaacctgcagaccctgggcacagaaattgagcggctcatcaagcaccagcacgagctggagcagaggaccaagaagacctag

SEQ ID NO: 36147 - DNA, 1218 bp, Artificial Sequence
  Description of Artificial Sequence: Synthetic coding sequence
atggacagccacaaggagaccaaggacaagctgaaggagaccaccaccaagctgacccaggccaaggaggaggccgaccagatcaggaagaactgccaggacatgatcaagacctaccaggagagcgaggagatcaagagcaatgagctggatgccaagctgcgggtgaccaagggggagctggagaagcagatgcaggagaagagtgaccagctggagatgcaccacgccaagatcaaggagctggaggacctgaagaggaccttcaaggagggcatggatgagctgcggaccctgcggaccaaggtgaagtgcctggaggatgagcggctgaggacagaagatgagctgagcaagtacaaggagatcatcaaccggcagaaggccgagatccagaacctgctggacaaggtgaagacagctgaccagctgcaggagcagctgcagaggggcaagcaggagattgagaacctgaaggaggaggtggagagcctgaacagcctcatcaatgacctgcagaaggacatcgagggcagcaggaagcgggagagcgagctgctgctcttcacagagcggctgaccagcaagaatgcccagctgcagagcgagagcaacagcctgcagagccagtttgacaaggtgtcctgcagcgagagccagctgcagagccagtgtgagcagatgaagcagaccaacatcaacctggagagccggctgctgaaggaggaggagctgaggaaggaggaggtgcagaccctgcaggccgagctggcctgccggcagacagaggtgaaggccctgagcacccaggtggaggagctgaaggatgagctggtgacccagaggaggaagcacgccagcagcatcaaggacctgaccaagcagctgcagcaggcccggaggaagctggaccaggtggagagcggcagctatgacaaggaggtgtcctccatgggcagccgcagcagcagcagcggcagcctgaatgcccggagcagcgcagaagatagaagccctgagaacacaggcagctctgtggccgtggacaacttcccccaggtggacaaggccatgctgattgaaagaattgtgcggctgcagaaggcccacgccaggaagaatgagaagattgagttcatggaggaccacatcaagcagctggtggaggagatcaggaagaagaccaagaagatctacaagcacctggagcagaagtag

SEQ ID NO: 36148 - DNA, 3744 bp, Artificial Sequence
  Description of Artificial Sequence: Synthetic coding sequence
atgcagagcagcgccctggtggagagcctcatcaccgtgaagatggctgctgagaacagcgaggagggcaacacctgcatcatcccccagaggaacctcttcaaggccctgtctgaggaggcctggaacagcggcttcatgggcaacagcagcaggacagctgacaaggagaacaccctgcagtgccccaagacccccctgcggcaggacctggaggccaatgagcaggatgcccggcccaagcaggagaaccacctgcacagcctgggcaggaacaaggtgggctaccacctgcaccccagcgacaagggccagtttgaccacagcaaggatggctggctgggccctggccccatgcctgctgtgcacaaggccgccaacggccacagcaggaccaagatgatcagcaccagcatcaagacagccaggaagagcaagagggccagcggcctgcgcatcaatgactatgacaaccagtgtgatgtggtgtacatcagccagcccatcacagagtgccactttgagaaccagaagagcatcctgagcagcaggaagacagccaggaagagcacccggggctacttcttcaatggagactgctgtgagctgcccaccgtgaggaccctggccaggaacctgcacagccaggagaaggccagctgcagcgccctggccagcgaggccgtgttcacccccaagcagaccctgaccatcccagcccccaggcacacagtggatgtgcagctgccccgggaggacaaccctgaggagcccagcaaggagatcaccagccatgaggagggcggcggagatgtgagccccaggaaggagccccaggagcctgaggtgtgccccaccaagatcaagcccaacctgagcagcagccccaggtctgaggagaccacagccagcagcctggtgtggcccctgcctgcccacctgcctgaggaggacctgcctgagggcggcagcacagtgtctgcccccacagccagcggcatgagcagccctgagcacaaccagccccctgtggccctgctggacacagaggagatgtctgtgccccaggactgccacctgctgcccagcacagagagcttcagcggcggcgtgtctgaagatgtgatcagccggccccacagccccccagaaattgtgtcccgggaggagagcccccagtgcagcgagaaccagagcagccccatgggcctggagccccccatgagcctgggcaaggccgaggacaaccagagcatctctgctgaggtggagagcggggacacccaggagctgaatgtggaccccctgctgaaggagagcagcaccttcacagatgagaaccccagcgagacagaggagagcgaggccgccggcggcatcggcaagctggagggggaggatggagatgtgaagtgcctgtctgagaaggacacctatgacaccagcattgacagcctggaggagaacctggacaagaagaagaagggcaagaagtttcctgaggccagtgaccgctgcctgcggagccagctgagtgacagcagcagcgctgaccgctgcctgaggaaccagagcagtgacagcagcagcgcctgcctggagatcaaggtgcccaagaaccccagcgccaagaggagcaagaaggagggccaccctgggggcaccacccccaagggcctgctgcctgacagcttccacacagagaccctggaggacacagagaagcccagcgtgaatgaaagaccttctgagaaggatgctgagcaggagggggagggcggcggcatcatcacccggcagaccctgaagaacatgctggacaaggaggtgaaggagctgcggggggagatcttccccagccgggaccccatcaccacagctggccagcccctgcccggggagcggctggagatctacgtgcagagcaagatggatgagaagaatgcccacatccccagcgagagcatcgcctgcaagagggaccctgagcaggccaaggaggagcccggccacatccccacccagcacgtggaggaggccgtgaatgaggtggacaatgaaaacacccagcagaaggatgatgaaagtgatgccccctgcagcagcctgggcctgagcagcagcggcagcggagatgctgcccgggcccccaagtctgtgccccggcccaagaggctgaccagcagcacctacaacctgcggcatgcccacagcctgggcagcctggatgccagcaaggtgaccagcgagaaggaggccgcccaggtgaaccccatcatgcccaaggaaaatggagccagcgagagcggggaccccctggatgaagatgatgtggacacagtggtggatgagcagcccaagttcatggagtggtgtgccgaggaggagaaccaggagctgattgccaacttcaatgcccagtacatgaaggtgcagaagggctggatccagctggagaaggagggccagcccaccccccgggccaggaacaagagtgacaagctgaaggagatctggaagagcaagaagaggagcaggaaatgtcgcagcagcctggagagccagaagtgcagccctgtgcagatgctgttcatgaccaacttcaagctgagcaatgtgtgcaagtggttcctggagaccacagagaccaggagcctggtgattgtgaagaagctgaacacccggctgcctggagatgtgccccctgtgaagcaccccctgcagaagtatgcccccagcagcctgtaccccagcagcctgcaggccgagcggctgaagaagcacctgaagaagtttcctggggccaccccagccaagaacaactggaagatgcagaagctgtgggccaagttcagagaaaatccagaccaggtggagccagaagatggcagtgatgtgtccccaggccccaacagtgaagattccattgaggaggtgaaggaggacaggaacagccaccccccagccaacctgcccaccccagccagcacccgcatcctgaggaagtacagcaacatccggggcaagctgcgggcccagcagaggctcatcaagaatgagaagatggagtgcccagatgccctggccgtggagagcaagcccagcaggaagtctgtgtgcatcaaccccctgatgagccccaagctggccctgcaggtggatgctgatggcttccctgtgaagcccaagagcacagagggcatgaagggcaggaagggcaagcaggtgtctgagatcctgcccaaggccgaggtgcagagcaagaggaagaggacagagggcagcagccccccagacagcaagaacaagggccccaccgtgaaggccagcaaggagaagcatgctgatggagccaccaagaccccagctgccaagaggcctgctgcccgggacaggagcagccagccccccaagaagaccagcctgaaggagaacaaggtgaagatccccaagaagtctgctgggaagagctgcccccccagcaggaaggagaaggagaacaccaacaagaggcccagccagagcatcgccagcgagaccctgaccaagccagccaagcagaagggggccggggagagcagcagccggccccagaaggccaccaacaggaagcagagcagcggcaagacccgggcccggcccagcaccaagaccccagagagcagcgctgcccagaggaagaggaagctgaaggccaagctggactgcagccacagcaagagaagaaggctggatgccaagtag

SEQ ID NO: 36149 - DNA, 2970 bp, Artificial Sequence
  Description of Artificial Sequence: Synthetic coding sequence
cagcccatcacagagtgccactttgagaaccagaagagcatcctgagcagcaggaagacagccaggaagagcacccggggctacttcttcaatggagactgctgtgagctgcccaccgtgaggaccctggccaggaacctgcacagccaggagaaggccagctgcagcgccctggccagcgaggccgtgttcacccccaagcagaccctgaccatcccagcccccaggcacacagtggatgtgcagctgccccgggaggacaaccctgaggagcccagcaaggagatcaccagccatgaggagggcggcggagatgtgagccccaggaaggagccccaggagcctgaggtgtgccccaccaagatcaagcccaacctgagcagcagccccaggtctgaggagaccacagccagcagcctggtgtggcccctgcctgcccacctgcctgaggaggacctgcctgagggcggcagcacagtgtctgcccccacagccagcggcatgagcagccctgagcacaaccagccccctgtggccctgctggacacagaggagatgtctgtgccccaggactgccacctgctgcccagcacagagagcttcagcggcggcgtgtctgaagatgtgatcagccggccccacagccccccagaaattgtgtcccgggaggagagcccccagtgcagcgagaaccagagcagccccatgggcctggagccccccatgagcctgggcaaggccgaggacaaccagagcatctctgctgaggtggagagcggggacacccaggagctgaatgtggaccccctgctgaaggagagcagcaccttcacagatgagaaccccagcgagacagaggagagcgaggccgccggcggcatcggcaagctggagggggaggatggagatgtgaagtgcctgtctgagaaggacacctatgacaccagcattgacagcctggaggagaacctggacaagaagaagaagggcaagaagtttcctgaggccagtgaccgctgcctgcggagccagctgagtgacagcagcagcgctgaccgctgcctgaggaaccagagcagtgacagcagcagcgcctgcctggagatcaaggtgcccaagaaccccagcgccaagaggagcaagaaggagggccaccctgggggcaccacccccaagggcctgctgcctgacagcttccacacagagaccctggaggacacagagaagcccagcgtgaatgaaagaccttctgagaaggatgctgagcaggagggggagggcggcggcatcatcacccggcagaccctgaagaacatgctggacaaggaggtgaaggagctgcggggggagatcttccccagccgggaccccatcaccacagctggccagcccctgcccggggagcggctggagatctacgtgcagagcaagatggatgagaagaatgcccacatccccagcgagagcatcgcctgcaagagggaccctgagcaggccaaggaggagcccggccacatccccacccagcacgtggaggaggccgtgaatgaggtggacaatgaaaacacccagcagaaggatgatgaaagtgatgccccctgcagcagcctgggcctgagcagcagcggcagcggagatgctgcccgggcccccaagtctgtgccccggcccaagaggctgaccagcagcacctacaacctgcggcatgcccacagcctgggcagcctggatgccagcaaggtgaccagcgagaaggaggccgcccaggtgaaccccatcatgcccaaggaaaatggagccagcgagagcggggaccccctggatgaagatgatgtggacacagtggtggatgagcagcccaagttcatggagtggtgtgccgaggaggagaaccaggagctgattgccaacttcaatgcccagtacatgaaggtgcagaagggctggatccagctggagaaggagggccagcccaccccccgggccaggaacaagagtgacaagctgaaggagatctggaagagcaagaagaggagcaggaaatgtcgcagcagcctggagagccagaagtgcagccctgtgcagatgctgttcatgaccaacttcaagctgagcaatgtgtgcaagtggttcctggagaccacagagaccaggagcctggtgattgtgaagaagctgaacacccggctgcctggagatgtgccccctgtgaagcaccccctgcagaagtatgcccccagcagcctgtaccccagcagcctgcaggccgagcggctgaagaagcacctgaagaagtttcctggggccaccccagccaagaacaactggaagatgcagaagctgtgggccaagttcagagaaaatccagaccaggtggagccagaagatggcagtgatgtgtccccaggccccaacagtgaagattccattgaggaggtgaaggaggacaggaacagccaccccccagccaacctgcccaccccagccagcacccgcatcctgaggaagtacagcaacatccggggcaagctgcgggcccagcagaggctcatcaagaatgagaagatggagtgcccagatgccctggccgtggagagcaagcccagcaggaagtctgtgtgcatcaaccccctgatgagccccaagctggccctgcaggtggatgctgatggcttccctgtgaagcccaagagcacagagggcatgaagggcaggaagggcaagcaggtgtctgagatcctgcccaaggccgaggtgcagagcaagaggaagaggacagagggcagcagccccccagacagcaagaacaagggccccaccgtgaaggccagcaaggagaagcatgctgatggagccaccaagaccccagctgccaagaggcctgctgcccgggacaggagcagccagccccccaagaagaccagcctgaaggagaacaaggtgaagatccccaagaagaaggagaagtag

SEQ ID NO: 36150 - DNA, 1008 bp, Artificial Sequence
  Description of Artificial Sequence: Synthetic coding sequence
atgatccgggagtggaagaatgactgccagagaattgagaagcagagggccagtgacaccatggtgcaggagaggaagaatgagaagcctgtgcgcatcttcaacaccaacagcagcttccaggaccaggcccccacctgctgccaggaggacctgagcagcgccagccccctgcgcatctggagcaagttctacagaagtgaccccagaattgccctgggcaagtacagccccctggagaaggagatcctgcggctgggcggcatccacaccatcgccgcccggcggctgctggcctacaagcaggaggaggagtgcaggatgctgaaggagctgcagctgctgagcccagactacaagcaggccatggagtacaagaagaagcacagcagcccctgtgccatctgtgtgcccctggagaagatctggacagccaaggtgattgcccccctggaggccttcaagatgccccagcgggagcaggtgaatgtgtccaagcacatcgagaggatgaggctggcccgggccctgggcaaccaccagcccctgccctacatcgagcgcttcaccaggagcagcttcctgagcggcgtgggcctgggccccatggccaagaacaaggcccggaggaaggaggacaactatgacacccacaactgtgatgatgccaaccaggacaagaaggaggaggccgagggcaagaacaccaagaggcgggagatcaagatgaatgtggtgttcaagagcaaggagcccaagaagtgcctgacctaccatggaaatgacaggaagagcttcctgcctgccaagaagccagagaggagcattgctggcctgaccaacagaaacctcttctgcatcagcgagttccctggggacctgatgctgatgaaccaggacttcatcagccggcgggaccacttcagtgacctggtgaagacctacagcctggaggaggagagcatctggaaggagaggatgaggaaggccaccccctaccactactag

SEQ ID NO: 36151 - DNA, 480 bp, Artificial Sequence
  Description of Artificial Sequence: Synthetic coding sequence
tgatgccagagaattgagaagcagagggccagtgacaccatggtgcaggagaggaagaatgagaagcctgtgcgcatcttcaacaccaacagcagcttccaggaccaggcccccacctgctgccaggaggacctgagcagcgccagccccctgcgcatctggagcaagttctacagaagtgacccccgcatcgccctgggcaagtacagccccctggagaaggagatcctgcggctgggcggcatccacaccatcgccgcccggcggctgctggcctacaagcaggaggaggagtgcaggatgctgaaggagctgcagctgctgagcccagactacaagcaggccatggagtacaagaagaagcacagcagcccctgtgccatctgtgtgcccctggagaagatctggacagccaaggtgattgcccccctggaggccttcaagatgccccagcgggagcagaacagcctggtgacctag

SEQ ID NO: 36152 - DNA, 561 bp, Artificial Sequence
  Description of Artificial Sequence: Synthetic coding sequence
atgaccaagggccgccgcttcaaccccccaagtgacaaggatggccgctggttcccccacatcggcctgacccagaagaccccagagagcatcaccagcgccaccagcaaggagccccagagcccccacctgccccggcaggccgagggcaagctgccccccatctacaaggtgcgggagaagcaggccgtgaacaaccagttccccttctctgtgcatgacaacagacacagcctggagaacagcggctgctacctggacagcggcctgggcaggaagaagatcagcccagacaagaggcagcacgtgtccaggaacttcaacctgtgggcctgtgactatgtgcccagctgcctggatggcttcagcaacaaccagatctcctatgtgtacaaggaggccatggtggtgtcctccttccgccgcttcccccgctgctacaaggagatctggaatgccttcaccttcctgcctgagaggagctacacagaggtgctgaagaagaagcccaaggtgcgcttcaccgtggacaagaaggtggtgagcagcctggagagctag

SEQ ID NO: 36153 - DNA, 405 bp, Artificial Sequence
  Description of Artificial Sequence: Synthetic coding sequence
atggtggccctgaagggcgtgcctgccctgctgagccctgagctgctgtatgccctggccaggatgggccatggagatgagatcgtgctggccgacctgaacttccctgccagcagcatctgccagtgtggccccatggagatccgggcagatggcctgggcatcccccagctgctggaggccgtgctgaagctgctgcccctggacacctacgtggagagccctgctgctgtgatggagctggtgcccagcgacaaggagcggggcctgcagacccctgtgtggacagaatatgagagcatcctgcggcgggccggctgtgtgcgggccctggccaagattgaaagatttgagttctatgaaagagccaagaaggcctttgctgtggtggccaccggctgctag

SEQ ID NO: 36154 - DNA, 330 bp, Artificial Sequence
  Description of Artificial Sequence: Synthetic coding sequence
atggagatccgggcagatggcctgggcatcccccagctgctggaggccgtgctgaagctgctgcccctggacacctacgtggagagccctgctgctgtgatggagctggtgcccagcgacaaggagcggggcctgcagacccctgtgtggacagaatatgagagcatcctgcggcgggccggctgtgtgcgggccctggccaagattgaaagatttgagttctatgagcgggccaagaaggcctttgctgtggtggccactggagaaacagccctgtatggcaacctgatcctgaggaagggcgtgctggccctgaaccccctgctgtag

SEQ ID NO: 36155 - DNA, 465 bp, Artificial Sequence
  Description of Artificial Sequence: Synthetic coding sequence
atggtggccctgaagggcgtgcctgccctgctgagccctgagctgctgtatgccctggccaggatgggccatggagatgagatcgtgctggccgacctgaacttccctgccagcagcatctgccagtgtggccccatggagatccgggcagatggcctgggcatcccccagctgctggaggccgtgctgaagctgctgcccctggacacctacgtggagagccctgctgctgtgatggagctggtgcccagcgacaaggagcggggcctgcagacccctgtgtggacagaatatgagagcatcctgcggcgggccggctgtgtgcgggccctggccaagattgaaagatttgagttctatgaaagagccaagaaggcctttgctgtggtggccaccggggagacagccctgtatggcaacctgatcctgaggaaaggagtgctggccctgaaccccctgctgtag

SEQ ID NO: 36156 - DNA, 333 bp, Artificial Sequence
  Description of Artificial Sequence: Synthetic coding sequence
atgggccatggagatgaaattggcctgggcatcccccagctgctggaggccgtgctgaagctgctgcccctggacacctacgtggagagccctgctgctgtgatggagctggtgcccagcgacaaggagcggggcctgcagacccctgtgtggacagaatatgagagcatcctgcggcgggccggctgtgtgcgggccctggccaagattgaaagatttgagttctatgaaagagccaagaaggcctttgctgtggtggccaccggggagacagccctgtatggcaacctgatcctgaggaaaggagtgctggccctgaaccccctgctgtag

SEQ ID NO: 36157 - DNA, 519 bp, Artificial Sequence
  Description of Artificial Sequence: Synthetic coding sequence
atgaaccactgcatccagttcagcccccagagcctgcagcgctggctgatcctgccctgctatgacctgaagctgcccatctgggccaacaccacagagttctgcccccacggcccccggcgggccagccaggacccccagctgctggcctggctgcctgaccagagcctggaggtgtccctggagctgtatgactggaacagcatgaccttcaccctcttcctggagaccgtggagcctgtggccgtggagagcgagggcagcggcatcttctcctttgtgtggcagcagctgatcttccctgctgaggcccgctggtgcttctcctgggcccaggactgtggcctggatggcagcttccctggcagcgcccacacagagccctttgggaaggctgctgctggccagggctctgtggccggcaaggaggccaagaaggccggccctggcttccaccggcagctgctgtacctgcagttccagaagcgctgcctcttcaactacccagagctgctgtag

SEQ ID NO: 36158 - DNA, 480 bp, Artificial Sequence
  Description of Artificial Sequence: Synthetic coding sequence
atgaacctgggcgtgtccatgctgcgcatcctcttcctgctggatgtgggcggggcccaggtgctggccaccgggaagaccccaggagctgagattgacttcaagtatgccctgattggaacagctgtgggcgtggccatctctgctggcttcctggccctgaagatctgcatgatccgccgccacctgtttgatgatgacagcagtgacctgaagagcaccccaggcggcctgagtgacaccatccccctgaagaagagggccccccgggcccacgtgctgagagatggccctgccctgggccccctgcacctgctcttcagcgtcatcggcatgctgtttgccaggaagctgcaggccagcaccctcttctccttcaagagcctgctgcagtgccaccactgcatcatggagggcctcttcaaggccaagccccagttcctgcagaaggtgtcctgcaagagtgaccacctgtcctag

SEQ ID NO: 36159 - DNA, 354 bp, Artificial Sequence
  Description of Artificial Sequence: Synthetic coding sequence
atgctgcgcatcctcttcctgctggatgtgggcggggcccaggtgctggccaccgggaagaccccaggagctgagattgacttcaagtatgccctgattggaacagctgtgggcgtggccatctctgctggcttcctggccctgaagatctgcatgatccgccgccacctgtttgatgatgacagcagtgacctgaagagcaccccaggcggcctgtctggagagaccaccatcagccccaaggccagcggccagatctgtgccaacagccccaccacagaaagtgagaagttccccaagatctgcctgctgaccagcagaaatgacttctccttctgccaccagagcggctag

SEQ ID NO: 36160 - DNA, 519 bp, Artificial Sequence
  Description of Artificial Sequence: Synthetic coding sequence
atgaacctgggcgtgtccatgctgcgcatcctcttcctgctggatgtgggcggggcccaggtgctggccaccgggaagaccccaggagctgagattgacttcaagtatgccctgattggaacagctgtgggcgtggccatctctgctggcttcctggccctgaagatctgcatgatccgccgccacctgtttgatgatgacagcagtgacctgaagagcaccccaggcggcctgagtgacaccatccccctgaagaagagggccccccgggcccacgtgctgagagatggccctgccctgggccccctgcacctgctcttcagcgtcatcggcatgctgtttgccaggaagctgcaggccagcaccctcttctccttcaagagcctgctgcagtgccaccactgcatcatggagggcctcttcaaggccaagccccagttcctgcagaagcacctggcccggtctgtgcagatccaccagctgcagaaggtgaagagcttccccaagtatgcctactag

SEQ ID NO: 36161 - DNA, 390 bp, Artificial Sequence
  Description of Artificial Sequence: Synthetic coding sequence
atgaacctgggcgtgtccatgctgcgcatcctcttcctgctggatgtgggcggggcccaggtgctggccaccgggaagaccccaggagctgagattgacttcaagtatgccctgattggaacagctgtgggcgtggccatctctgctggcttcctggccctgaagatctgcatgatccgccgccacctgtttgatgatgacagcagtgacctgaagagcaccccaggcggcctgagtgacaccatccccctgaagaagagggcccccaggaagctgcaggccagcaccctcttctccttcaagagcctgctgcagtgccaccactgcatcatggagggcctcttcaaggccaagccccagttcctgcagaagcgctgcacaggagactag

SEQ ID NO: 36162 - DNA, 348 bp, Artificial Sequence
  Description of Artificial Sequence: Synthetic coding sequence
cgcatcctcttcctgctggatgtgggcggggcccaggtgctggccaccgggaagaccccaggagctgagattgacttcaagtatgccctgattggaacagctgtgggcgtggccatctctgctggcttcctggccctgaagatctgcatgatccgccgccacctgtttgatgatgacagcagtgacctgaagagcaccccaggcggcctgtctggagagaccaccatcagccccaaggccagcggccagatctgtgccaacagccccaccacagaaagtgagaagttccccaagatctgcctgctgaccagcagaaatgacttctccttctgccaccagagcggctag

SEQ ID NO: 36163 - DNA, 771 bp, Artificial Sequence
  Description of Artificial Sequence: Synthetic coding sequence
atgtctgaggagatggacaacatcacagctgaggagatcatcgacaagcacctgcagaaggacctggatgctgaggagaaccagaatgtggccaagaccctgcggggcaaggtgcgggagaagctgaagatcagcaagatcaacaagggggagaagagcagcacagagcagctgattgattctgagatccaccagaggagcaagctgagcccccagacagaggtgtccctggatgagagcctgtccttcttcatcctgtctggagaggagggcagcgccctgggcaagagcagcgagcagaggcctgtgaacagaagctaccccaagtgcttcagcctgggcgtgaacctgcagaatgtggccgagagcgaggaggaggagttcatgaaggagttcatcctgacagacatcctgaaggtgaaggctgctgactatgaagatgaccaggagcagatcaagaagcagaaggccaacatctttgtgcccagcagcagccctgtggtgaaccagaggaagctgcccaaggacatgatgccccgcatcctggaggatgagggcttctacatccagaggaagccagagatctacaagaagacctgcaacaagatggagaaccggctgctgaagctggaggaggccaagtgctggtttggagagagcggggagatcatgagcctgcccacccccatcaagcagagctggaacttccggctgaatgtgaggaaggagcccctgaaccccctgctgaagaccatctacaggaagctgtag

SEQ ID NO: 36164 - DNA, 531 bp, Artificial Sequence
  Description of Artificial Sequence: Synthetic coding sequence
atgggcgtgcagatgtctgaggagatggacaacatcacagctgaggagatcatcgacaagcacctgcagaaggacctggatgctgaggagaaccagaatgtggccaagaccctgcggggcaaggtgcgggagaagctgaagatcagcaagatcaacaagggggagaagagcagcacagagcagctgattgattctgagatccaccagaggagcaagctgagcccccagacagaggtgtccctggatgagagcctgtccttcttcatcctgtctggagaggagggcagcgccctgggcaagagcagcgagcagaggcctgtgaacagaagctaccccaagtgcttcagcctgggcgtgaacctgcagaatgtggccgagagcgaggaggaggagttcatgaaggagttcatcctgacagacatcctgaaggtgaaggctgctgactatgaagatgaccaggagcagatcaagaagcagaaggccaacatctttgtgcccagcagcagccctggcaacatcctgagccagtag

SEQ ID NO: 36165 - DNA, 2337 bp, Artificial Sequence
  Description of Artificial Sequence: Synthetic coding sequence
atgcagcaggagagcgagcgctgccgggtgcgggcccggcggccagacatggccctgtatgtgcccaaggccaggagaggagctgtgctgctgaagacaggagatgaggaggagagctgtggcagccccaacagcgtggtgaaggagaagcagaaggagagcagcctgagccagaaggaggtgttcaaggacaagccagaggcccggcggctgaacatcaacccagacaggaaggagcacaactgccgggaggagaagaagagcagcaccaagctgaggatggacacctgcctgcagaagaccaacagagtgtgcagcaagaggggcaccacagagagcaaggaggtgctgagccagggccagcagcagggcgccccaaatgctggggtcatcaccaatgcccccctgcagaggcacttcaagcccaagaaggtggagtgcctggaggtggagaccacagatgtgacaggccacgagcgcatcctgctgagccaggcctgcctggagatcagcgaggcccaggtgcccagcaagcccttccagaatgtggagttctgtgacttcagcagacatgagccagatggagaggcctttgaggacaaggacctggagggcagaattgaaacagacaccaaggtgctggagatcctgtatgagttccccagggtcttcagctctgtgatgaagccagagaacatgattgtgcccatcaagctgagcagtgacagcgagatcgtgcagcagagcatgcagaccagtgatggcatcctgaaccccagcagcggcggcatcaccaccacctctgtgcccggcagcccagatggagtgtttgaccagacctgtgtggactttgaggtggagagcgtgggcggcatcgccaacagcacaggcttcatcctggaccagaaggacacagacagcatcccagccaccatgggccacatcagcctgtctgagagcaccaatgacacagtgtcccctgtgatgatccgggagtgtgagaagaatgacagcacagcagatgagctgcacgtgaagcatgagcccccagacacagctgtgctggcccacgagacccaccgggacagcggcttcaagaatgtgggggacatcaccaacaaggcctgcatgatggacaccaccggcatgagctgcagcgaccacgtgacagtggacagcccctacgtggtggccgtgagaattgctgatgagaccagcatcaacaccaggagcttcagcaagtttgtgggcatgtctgcagatgccacccccctgcacgtggcccggtctggaaatgacacagaggacttcagcaaccccagcgcctgcagcgacatctatggagagagcatcagcagccacttcacagagagcacaggcaagctgattgagagcctgagtgactgtgccagcagcctgcccatcaagaagattgctggcagcaactacaacaccttcctggacagcgagctgtccatgctgaatggcaccaaggtgctgagtgacagcgctgtgggcatcgacctgggcagcactggagacaccacagaggccctgcacgagctgaggacagctgaggagttcaagacagaggagcaggatgacagcggcagcattgaatttggagtgtccttcccagaccgggagagcagctccatggagaccagcattgagcccaaggccacagagaccagccacacagagggcatcacagccatcgaggagagctgggagagcatgtttaatgatgatggagactgcctggacccccggctgctgcaggagctgagcggcaacaccaagagccgggagagcatccaggagcccaggagtgactactacaaccacgaggtgcctgacatcgacctgagtgactgtgagttcccccacgtgattgagatctatgacttcccccaggagttccacacagaggacctgctgcgggtcttctgcagctaccagaagaagggctttgacatcaagtgggtggatgacacccacgccctgggcgtcttcagcagccccatcacagccagagatgccctgggcatcaagcacaccatggtgaagatccggcccctgagccaggccacccgggccgccaaggccaaggcccgggcctatgcagagttcctgcagcctgccaaggagaggcctgagaccagcgctgccctggcccggcggctggtgatcagcgccctgggcgtgcgcagcaagcagagcaagacagagcgggaggccgagctgaagaagctgcaggaggcccgggagaggaagaggctggaggccaagcagcgggaggacatctgggagggccgggaccagagcacagtgtag

SEQ ID NO: 36166 - DNA, 585 bp, Artificial Sequence
  Description of Artificial Sequence: Synthetic coding sequence
atgcacatcaagccagagaaccactgcagcaagctgagcggcaacaccaagagccgggagagcatccaggagcccaggagtgactactacaaccacgaggtgcctgacatcgacctgagtgactgtgagttcccccacgtgattgagatctatgacttcccccaggagttccacacagaggacctgctgcgggtcttctgcagctaccagaagaagggctttgacatcaagtgggtggatgacacccacgccctgggcgtcttcagcagccccatcacagccagagatgccctgggcatcaagcacaccatggtgaagatccggcccctgagccaggccacccgggccgccaaggccaaggcccgggcctatgcagagttcctgcagcctgccaaggagaggcctgagaccagcgctgccctggcccggcggctggtgatcagcgccctgggcgtgcgcagcaagcagagcaagacagagcgggaggccgagctgaagaagctgcaggaggcccgggagaggaagaggctggaggccaagcagcgggaggacatctgggagggccgggaccagagcacagtgtag

SEQ ID NO: 36167 - DNA, 2337 bp, Artificial Sequence; identical to SEQ ID NO: 36165
  Description of Artificial Sequence: Synthetic coding sequence

SEQ ID NO: 36168 - DNA, 555 bp, Artificial Sequence
  Description of Artificial Sequence: Synthetic coding sequence
atgctgagcggcaacaccaagagccgggagagcatccaggagcccaggagtgactactacaaccacgaggtgcctgacatcgacctgagtgactgtgagttcccccacgtgattgagatctatgacttcccccaggagttccacacagaggacctgctgcgggtcttctgcagctaccagaagaagggctttgacatcaagtgggtggatgacacccacgccctgggcgtcttcagcagccccatcacagccagagatgccctgggcatcaagcacaccatggtgaagatccggcccctgagccaggccacccgggccgccaaggccaaggcccgggcctatgcagagttcctgcagcctgccaaggagaggcctgagaccagcgctgccctggcccggcggctggtgatcagcgccctgggcgtgcgcagcaagcagagcaagacagagcgggaggccgagctgaagaagctgcaggaggcccgggagaggaagaggctggaggccaagcagcgggaggacatctgggagggccgggaccagagcacagtgtag

SEQ ID NO: 36169 - DNA, 984 bp, Artificial Sequence
  Description of Artificial Sequence: Synthetic coding sequence
atgcagcaggagagcgagcgctgccgggtgcgggcccggcggccagacatggccctgtatgtgcccaaggccaggagaggagctgtgctgctgaagacaggagatgaggaggagagctgtggcagccccaacagcgtggtgaaggagaagcagaaggagagcagcctgagccagaaggaggtgttcaaggacaagccagaggcccggcggctgaacatcaacccagacaggaaggagcacaactgccgggaggagaagaagagcagcaccaagctgaggatggacacctgcctgcagaagaccaacagagtgtgcagcaagaggggcaccacagagagcaaggaggtgctgagccagggccagcagcagggcgccccaaatgctggggtcatcaccaatgcccccctgcagaggcacttcaagcccaagaaggtggagtgcctggaggtggagaccacagatgtgacaggccacgagcgcatcctgctgagccaggcctgcctggagatcagcgaggcccaggtgcccagcaagcccttccagaatgtggagttctgtgacttcagcagacatgagccagatggagaggcctttgaggacaaggacctggagggcagaattgaaacagacaccaaggtgctggagatcctgtatgagttccccagggtcttcagctctgtgatgaagccagagaacatgattgtgcccatcaagctgagcagtgacagcgagatcgtgcagcagagcatgcagaccagtgatggcatcctgaaccccagcagcggcggcatcaccaccacctctgtgcccggcagcccagatggagtgtttgaccagacctgtgtggactttgaggtggagagcgtgggcggcatcgccaacagcacaggcttcatcctggaccagaagatccagatccccttcctgcagctgtgggtgaccagcctgtgccagagggcccagatgaccctgctggtgcagtag

SEQ ID NO: 36170 - DNA, 558 bp, Artificial Sequence
  Description of Artificial Sequence: Synthetic coding sequence
cagaagctgagcggcaacaccaagagccgggagagcatccaggagcccaggagtgactactacaaccacgaggtgcctgacatcgacctgagtgactgtgagttcccccacgtgattgagatctatgacttcccccaggagttccacacagaggacctgctgcgggtcttctgcagctaccagaagaagggctttgacatcaagtgggtggatgacacccacgccctgggcgtcttcagcagccccatcacagccagagatgccctgggcatcaagcacaccatggtgaagatccggcccctgagccaggccaccagggctgccaaggccaaggcccgggcctatgcagagttcctgcagcctgccaaggagaggcctgagaccagcgctgccctggcccggcggctggtgatcagcgccctgggcgtgcgcagcaagcagagcaagacagagcgggaggccgagctgaagaagctgcaggaggcccgggagaggaagaggctggaggccaagcagcgggaggacatctgggagggccgggaccagagcacagtgtag

SEQ ID NO: 36171 - DNA, 321 bp, Artificial Sequence
  Description of Artificial Sequence: Synthetic coding sequence
atgatggccaccggcaccccagagagccaggccaggtttggccagagcgtgaagggcctgctgacagagaaggtgaccacctgtggcacagatgtgattgccctgaccaagcaggtgctgaagggcagccgcagcagcgagctgctgggccaggccgccaggaacatggtgctgcaggaggatgccatcctgcacagcgaggacagcctgaggaagatggccatcatcaccacccacctgcagtaccagcaggaggccatccagaagaatgtggagcagagcagtgacctgcaggaccagctgaaccacctgctgaagtag

SEQ ID NO: 36172 - DNA, 321 bp, Artificial Sequence; identical to SEQ ID NO: 36171
  Description of Artificial Sequence: Synthetic coding sequence

SEQ ID NO: 36173 - DNA, 387 bp, Artificial Sequence
  Description of Artificial Sequence: Synthetic coding sequence
atgaagcacaagtacaacaccctgtcctggtacaagaaggagaggagcacccagctgcggcgcttcatcgtgcaccagcctgaggtgggcctcttcttcttcctgagagatgtggtgtacaactacatcacagagaagaccacctgccgctgccccctgacccaggagcggccctgtgacacaggaggcaagtttggccgcatctggatctgccagcctgaggagctgggcaagatgcagatctggatctgccagcctgaggagctgggcaagatgcagattgacaagaacagaaccatggtgcagcagatgtggtacatctggtatggaggcctggacaccagcaccaacagcctgctgcccatcctggtgcggggcatggcctag

SEQ ID NO: 36174 - DNA, 387 bp, Artificial Sequence; identical to SEQ ID NO: 36173
  Description of Artificial Sequence: Synthetic coding sequence

SEQ ID NO: 36175 - DNA, 387 bp, Artificial Sequence; identical to SEQ ID NO: 36173
  Description of Artificial Sequence: Synthetic coding sequence

SEQ ID NO: 36176 - DNA, 912 bp, Artificial Sequence
  Description of Artificial Sequence: Synthetic coding sequence
atggaggagagcatggaggaggaggagggcggcagctatgaggccatgatggatgaccagaaccacaacaactgggaggccgctgtggatggcttccggcagcccctgcccccacctcctccacccagcagcatcccagccccagcccgggagcccccaggcggccagctgctggccgtgcctgctgtgtctgtggacaggaagggccccaaggagggcctgcccatgggcccccagcccccacctgaggccaatggagtcatcatgatgctgaagagctgtgatgctgctgctgctgtggccaaggccgccccagcccccacagccagcagcaccatcaacatcaacaccagcaccagcaagttcctgatgaatgtcatcaccatcgaggactacaagagcacctactggcccaagctggatggagccatcgaccagctgctgacccagagccctggggactacatccccatctcctatgagcagatctacagctgtgtgtacaagtgtgtgtgccagcagcacagcgagcagatgtacagcgacctgatcaagaagatcaccaaccacctggagcgggtgtccaaggagctgcaggccagccccccagacctgtacatcgagcgcttcaacatcgccctgggccagtacatgggcgccctgcagagcatcgtgcccctcttcatctacatgaacaagttctacatcgagaccaagctgaacagagacctgaaggatgacctgatcaagctgttcacagaacatgtggccgagaagcacatctacagcctgatgcccctgctgctggaggcccagagcacccccttccaggtgacccccagcaccatggccaacatcgtgaagggcctgtacaccctgcggcctgtgtcccagaacttcaccgctgtgtag

SEQ ID NO: 36177 - DNA, 1110 bp, Artificial Sequence
  Description of Artificial Sequence: Synthetic coding sequence
atggaggagagcatggaggaggaggagggcggcagctatgaggccatgatggatgaccagaaccacaacaactgggaggccgctgtggatggcttccggcagcccctgcccccacctcctccacccagcagcatcccagccccagcccgggagcccccaggcggccagctgctggccgtgcctgctgtgtctgtggacaggaagggccccaaggagggcctgcccatgggcccccagcccccacctgaggccaatggagtcatcatgatgctgaagagctgtgatgctgctgctgctgtggccaaggccgccccagcccccacagccagcagcaccatcaacatcaacaccagcaccagcaagttcctgatgaatgtcatcaccatcgaggactacaagagcacctactggcccaagctggatggagccatcgaccagctgctgacccagagccctggggactacatccccatctcctatgagcagatctacagctgtgtgtacaagtgtgtgtgccagcagcacagcgagcagatgtacagcgacctgatcaagaagatcaccaaccacctggagcgggtgtccaaggagctgcaggccagccccccagacctgtacatcgagcgcttcaacatcgccctgggccagtacatgggcgccctgcagagcatcgtgcccctcttcatctacatgaacaagttctacatcgagaccaagctgaacagagacctgaaggatgacctgatcaagctgttcacagaacatgtggccgagaagcacatctacagcctgatgcccctgctgctggaggcccagagcacccccttccaggtgacccccagcaccatggccaacatcgtgaagggcctgtacaccctgcggcctgagtgggtgcagatggcccccaccctcttcagcaagttcatccccaacatcctgcccccagctgtggagagcgagctgtctgaatatgctgcccaggaccagaagttccagcgggagctgatccagaatggcttcaccaggggggaccagagcaggaagagagctggagatgagctggcctacaacagcagcagcgcctgtgccagcagccggggctacagatag

SEQ ID NO: 36178 - DNA, 741 bp, Artificial Sequence
  Description of Artificial Sequence: Synthetic coding sequence
atgaatgtcatcaccatcgaggactacaagagcacctactggcccaagctggatggagccatcgaccagctgctgacccagagccctggggactacatccccatctcctatgagcagatctacagctgtgtgtacaagtgtgtgtgccagcagcacagcgagcagatgtacagcgacctgatcaagaagatcaccaaccacctggagcgggtgtccaaggagctgcaggccagccccccagacctgtacatcgagcgcttcaacatcgccctgggccagtacatgggcgccctgcagagcatcgtgcccctcttcatctacatgaacaagttctacatcgagaccaagctgaacagagacctgaaggatgacctgatcaagctgttcacagagcacgtggccgagaagcacatctacagcctgatgcccctgctgctggaggcccagagcacccccttccaggtgacccccagcaccatggccaacatcgtgaagggcctgtacaccctgcggcctgagtgggtgcagatggcccccaccctcttcagcaagttcatccccaacatcctgcccccagctgtggagagcgagctgtctgaatatgctgcccaggaccagaagttccagcgggagctgatccagaatggcttcaccaggggggaccagagcaggaagagagctggagatgagctggcctacaacagcagcagcgcctgtgccagcagccggggctacagatag

SEQ ID NO: 36179 - DNA, 543 bp, Artificial Sequence
  Description of Artificial Sequence: Synthetic coding sequence
atgaccaccacccctgtgctgagcagatttgccagccccccagacctgtacatcgagcgcttcaacatcgccctgggccagtacatgggcgccctgcagagcatcgtgcccctcttcatctacatgaacaagttctacatcgagaccaagctgaacagagacctgaaggatgacctgatcaagctgttcacagagcacgtggccgagaagcacatctacagcctgatgcccctgctgctggaggcccagagcacccccttccaggtgacccccagcaccatggccaacatcgtgaagggcctgtacaccctgcggcctgagtgggtgcagatggcccccaccctcttcagcaagttcatccccaacatcctgcccccagctgtggagagcgagctgtctgaatatgctgcccaggaccagaagttccagcgggagctgatccagaatggcttcaccaggggggaccagagcaggaagagagctggagatgagctggcctacaacagcagcagcgcctgtgccagcagccggggctacagatag

SEQ ID NO: 36180 - DNA, 1308 bp, Artificial Sequence
  Description of Artificial Sequence: Synthetic coding sequence
atgcctgtgacccacaggaagagtgatgccagtgacatgaacagcgacaccagccccagctgccgcctgcgggccttcagcagaggaggcagcctggagagccgcagcagcagcagccgcagccgctccttcaccctggatgatgagagcctgaagtacctgacccatgaggagaaggatgtgctgctcttctttgaggagaccatcgacagcctggatgaggactttgaggagcctgtgctgtgtgatggaggagtgtgctgcctgtgcagccccagcctggaggagagcaccagcagccccagcgagccagaagatgtgattgacctggtgcagcctgcccctggagctggggaggccgagggcctgcctgagggcacccaggccgccggccctgccccagctgggaaggagcacaggaagcaggatgctgagaccccacctcctccagaccccccagcccctgagaccctgctggcccccccacccctgcccagcaccccagaccccccccggcgggagctgcgggcccccagcccccctgtggagcacccccggctgctgcggtctgtgcccacccccctggtgatggcccagaagatcagcgagaggatggctggaaatgaggccctgagccccaccagccccttccgggagggccggcctggagagtggaggaccccagctgcccggggccccaggtctggggaccccggccctggccccagccacccagcccagcccaaggccccccgcttccccagcaacatcatcgtgaccaatggagctgcccgggagcccaggaggaccctgagcagagctgctgtgtctgtgcaggagcggcgggcccaggtgctggccaccatccacggccatgctggggccttccctgctgctggagatgctggggagggcgcccctgggggcggcagcagccctgagcgggtggcccggggccggggcctgcccggccctgctgagagcctgcgggccggcggccaggccccccggggccctgccctggccaacggcttccccagcgcccacgaggccctgaagagcgcccccagcagctttgccccagctgggaagagcctgtgcttccggcccggccctgccctgcccagcacccgggcccggcagagcttccctggcccccggcagcccaacggggcccaggactggaggagagctgacagcctgccccggccccagggcatcaccgtgcagtttgctggccggggcagcagcgaggaggcccggcgggaggccctgaggaagctgggcctgctgcgggagagcagctag

SEQ ID NO: 36181 - DNA, 720 bp, Artificial Sequence
  Description of Artificial Sequence: Synthetic coding sequence
atggcccagaagatcagcgagaggatggctggaaatgaggccctgagccccaccagccccttccgggagggccggcctggagagtggaggaccccagctgcccggggccccaggtctggggaccccggccctggccccagccacccagcccagcccaaggccccccgcttccccagcaacatcatcgtgaccaatggagctgcccgggagcccaggaggaccctgagcagagctgctgtgtctgtgcaggagcggcgggcccaggtgctggccaccatccacggccatgctggggccttccctgctgctggagatgctggggagggcgcccctgggggcggcagcagccctgagcgggtggcccggggccggggcctgcccggccctgctgagagcctgcgggccggcggccaggccccccggggccctgccctggccaacggcttccccagcgcccacgaggccctgaagagcgcccccagcagctttgccccagctgggaagagcctgtgcttccggcccggccctgccctgcccagcacccgggcccggcagagcttccctggcccccggcagcccaacggggcccaggactggaggagagctgacagcctgccccggccccagggcatcaccgtgcagtttgctggccggggcagcagcgaggaggcccggcgggaggccctgaggaagctgggcctgctgcgggagagcagctag

SEQ ID NO: 36182 - DNA, 1029 bp, Artificial Sequence
  Description of Artificial Sequence: Synthetic coding sequence
atgcctgtgacccacaggaagagtgatgccagtgacatgaacagcgacaccagccccagctgccgcctgcgggccttcagcagaggaggcagcctggagagccgcagcagcagcagccgcagccgctccttcaccctggatgatgagagcctgaagtacctgacccatgaggagaaggatgtgctgctcttctttgaggagaccatcgacagcctggatgaggactttgaggagcctgtgctgtgtgatggaggagtgtgctgcctgtgcagccccagcctggaggagagcaccagcagccccagcgagccagaagatgtgattgacctggtgcagcctgcccctggagctggggaggccgagggcctgcctgagggcacccaggccgccggccctgccccagctgggaaggagcacaggaagcaggatgctgagaccccacctcctccagaccccccagcccctgagaccctgctggcccccccacccctgcccagcaccccagaccccccccggcgggagctgcgggcccccagcccccctgtggagcacccccggctgctgcggtctgtgcccacccccctggtgatggcccagaagatcagcgagaggatggctggaaatgaggccctgagccccaccagccccttccgggagggccggcctggagagtggaggaccccagctgcccggggccccaggtctggggaccccggccctggccccagccaccccccagccctggccaacggcttccccagcgcccacgaggccctgaagagcgcccccagcagctttgccccagctgggaagagcctgtgcttccggcccggccctgccctgcccagcacccgggcccggcagagcttccctggcccccggcagcccaatggagcccaggactggaggagagctgacagcctgccccggccccagggcatcaccgtgcagtttgctggccggggcagcagcgaggaggcccggcgggaggccctgaggaagctgggcctgctgcgggagagcagctag

SEQ ID NO: 36183 - DNA, 1026 bp, Artificial Sequence
  Description of Artificial Sequence: Synthetic coding sequence
atgcctgtgacccacaggaagagtgatgccagtgacatgaacagcgacaccagccccagctgccgcctgcgggccttcagcagaggaggcagcctggagagccgcagcagcagcagccgcagccgctccttcaccctggatgatgagagcctgaagtacctgacccatgaggagaaggatgtgctgctcttctttgaggagaccatcgacagcctggatgaggactttgaggagcctgtgctgtgtgatggaggagtgtgctgcctgtgcagccccagcctggaggagagcaccagcagccccagcgagccagaagatgtgattgacctggtgcagcctgcccctggagctggggaggccgagggcctgcctgagggcacccaggccgccggccctgccccagctgggaaggagcacaggaagcaggatgctgagaccccacctcctccagaccccccagcccctgagaccctgctggcccccccacccctgcccagcaccccagaccccccccggcgggagctgcgggcccccagcccccctgtggagcacccccggctgctgcggtctgtgcccacccccctggtgatggcccagaagatcagcgagaggatggctggaaatgaggccctgagccccaccagccccttccgggagggccggcctggagagtggaggaccccagctgcccggggccccaggtctggggaccccggccctggccccagccacccagccctggccaacggcttccccagcgcccacgaggccctgaagagcgcccccagcagctttgccccagctgggaagagcctgtgcttccggcccggccctgccctgcccagcacccgggcccggcagagcttccctggcccccggcagcccaacggggcccaggactggaggagagctgacagcctgccccggccccagggcatcaccgtgcagtttgctggccggggcagcagcgaggaggcccggcgggaggccctgaggaagctgggcctgctgcgggagagcagctag

SEQ ID NO: 36184 - DNA, 258 bp, Artificial Sequence
  Description of Artificial Sequence: Synthetic coding sequence
atgcctgtgacccacaggaagagtgatgccagtgacatgaacagcgacaccagccccagctgccgcctgcgggccttcagcagaggaggcagcctggagagccgcagcagcagcagccgcagccgctccttcaccctggatgatgagagcctgaagtacctgacccatgaggagaaggatgtgctgctcttctttgaggagaccatcgacagcctggatgaggactttgaggagcctgtgctgtgtgatggcggctag

SEQ ID NO: 36185 - DNA, 282 bp, Artificial Sequence
  Description of Artificial Sequence: Synthetic coding sequence
atgcccaagaatgctgtggtgatcctgcgctatggcccctacagcgctgctggcctgcctgtggagcaccacaccttccggctgcagggcctgcaggccgtgctggccattgatggccacgaggtgatcctggagaagattgaggactggaatgtggtggagctgatggtgaatgaggaggtgatcttccactgcaacatcaaggacctggagtttggaggagatggcaagctggaccccctgtgtgagaaggccagaattgctgtgctgaatgcctactag

SEQ ID NO: 36186 - DNA, 474 bp, Artificial Sequence
  Description of Artificial Sequence: Synthetic coding sequence
atgcccaagaatgctgtggtgatcctgcgctatggcccctacagcgctgctggcctgcctgtggagcaccacaccttccggctgcagggcctgcaggccgtgctggccattgatggccacgaggtgatcctggagaagattgaggactggaatgtggtggagctgatggtgaatgaggaggtgatcttccactgcaacatcaaggacctggagtttgggaagctgacccccagcagtgacaagaggaccaccagcagcagccggctgaccttccaccagctgagcagcccctgcaggatgaaggtgagccccctgcagcagttcccccagaagacccaggacctgacctgcaccgtgctggcccagatcggcagctgcatccacttccagaccaacctgtgtgacctgggctggccaggcctggaccacatgctgatcagcggcctggagaagaggggcacccagccctactag

SEQ ID NO: 36187 - DNA, 282 bp, Artificial Sequence
  Description of Artificial Sequence: Synthetic coding sequence
atgcccaagaatgctgtggtgatcctgcgctatggcccctacagcgctgctggcctgcctgtggagcaccacaccttccggctgcagggcctgcaggccgtgctggccattgatggccacgaggtgatcctggagaagattgaggactggaatgtggtggagctgatggtgaatgaggaggtgatcttccactgcaacatcaaggacctggagtttgggaagccctttggagatgccagcagccagcagtttgccagcagcgaggagagcctgaacttctag

SEQ ID NO: 36188 - DNA, 474 bp, Artificial Sequence; identical to SEQ ID NO: 36186
  Description of Artificial Sequence: Synthetic coding sequence

SEQ ID NO: 36189 - DNA, 456 bp, Artificial Sequence
  Description of Artificial Sequence: Synthetic coding sequence
atgttcctgcacctggacagccacagcagcctggagaggaccaagcccaccgtggtgggcgtggacacccacatggagctggatgaggtgcactgctgccccggccgggacagcggcggcggcttcatcaagggccccatgctgcagggcctgcagggcgagggcaagctggcccccatccccaagcccaccctgcccagccccagccggctgaccctgtttgtgagcagcagccagatggaggaccacggcttccctgccaggagaaatggcctgacccaggccagcttcatctaccagatgcctgctggctggggcagccctgggggcctcttcctgccctgccagcctgtgcccacccctgtggtgctgaagccacccctgcccccctgccccatctcctggggcgagagcggccctgctgtggatggcatccggaggaccccagccccctag

SEQ ID NO: 36190 - DNA, 456 bp, Artificial Sequence; identical to SEQ ID NO: 36189
  Description of Artificial Sequence: Synthetic coding sequence

SEQ ID NO: 36191 - DNA, 558 bp, Artificial Sequence
  Description of Artificial Sequence: Synthetic coding sequence
atgatggccctggtgcgggaccggcgggcccactacgtgatgagcatcgtcatccgctgggtgcactgcttcagcagcagcctgcggggcaccttcggcacccgctgggaggccatgaaggccaaggccacagagctgcgggtgtgctgtgcccggaggaagcgggaggcccgggagttcaagccaccccagatgaggggcagcacccggctgaacatcagtgatgacctgaagattggcttcttcagcacagaccacgccacccagacagacagcagcgagatcctgtctgtgaaggagctgagcagcagcacccagaagctggcccagatgatgaagagcctgcaggtggactttggcttcctgaagcagctgctgcagctgaagtttgaagatcggctgaaggaggagagcctgagcctcttcaccatcctgcatgaccgcatcctggagattgagaagcactaccagcagaatgaagacaagatgaggaagagcttcaaccagcagctggctgatgccatcgccgtcatcaagggcatgtaccagcccctgtag

SEQ ID NO: 36192 - DNA, 891 bp, Artificial Sequence
  Description of Artificial Sequence: Synthetic coding sequence
ggcaggaagatcatggagggcctggaggccagcattgagcagttccagttcaacccccggctgaacatcagtgatgacctgaagattggcttcttcagcacagaccacgccacccagacagacagcagcgagatcctgtctgtgaaggagctgagcagcagcacccagaagctggcccagatgatgaagagcctgcaggtggactttggcttcctgaagcagctgctgcagctgaagtttgaagatcggctgaaggaggagagcctgagcctcttcaccatcctgcatgaccgcatcctggagattgagaagcactaccagcagaatgaagacaagatgaggaagagcttcaaccagcagctggctgatgccatcgccgtcatcaagggcatgtaccagcagttctttgaggtggaggaggagaatgtgtccctgcaggatgccagcacagtgaagaccaacatcctgctgaggaagctgaaggagaaggaggaggtgatcaaggagctgaaggaggagctggaccagtacaaggactttggcttccacaagatggagagctttgccaaggagaccagcagccccaagagcaacctggagaaggagaacctggagtacaaggtggagaatgaaaggctgctgcagatcatcagcgagctggaggaggagatccagatcaacctgaaggagaacagcggcctggaggatgagctgatctccatgaaggagatggccgagaaggaccacaagaccatccagaagctgatggacagccgggaccggctgcgggaggagctgcactatgagaagagcctggtgcaggatgtgatcaacaagcagaaggaggacaaggagatgaggaagaagtatggcagcctgtctgtgaagtag

SEQ ID NO: 36193 - DNA, 1887 bp, Artificial Sequence
  Description of Artificial Sequence: Synthetic coding sequence
atgacagaggagcagacctaccaggccgctgagaagagccaggcccacaatgaggtgcccaatgaaaggctggtggtggagcaccaggagagcctgagcaagaccaagctgcagatcaagaagcaggagaccagcacagagcagcccctgaccaccccagacaaggagcccaatgaaaatctcatcctgcggcaccaggacagcatgagcaagtctgagatgcaggtgaaggagcagaggaccctgaagggccagaggatcatcacccatgatgaggagcccgggaagaacctggtgctggagcaccaggacagcgtgtccaagctggagatgcagatcgagaagaccaagaagctgccccgggagaagaggcacagcacccatgatgaggagagcggggagaaccccatgctgaagcaccaggacagcgtgtccaagatccaggtgcagctggagatccaggagaccagcgagggggagggccgcagcatcccagacaagaacagcatgtttgtgcaccaggacagcgtgtccaagctgcagatgcaggagaagaagaagatcaccccaggccgggagaggaggaacaccagaattgtggtgcccaatgaaaatgtcatctctgtgcaccaggacagcaagagcaagctgcagatgcaggagaagaagcagatcaacagcggcgtggagcggcacaagaccttccccctggagatcaagaagaaggacatcagcctggagcacctgctgcctgaggagaaggtgctgctgagccgctctgagagccagaccaagaagctgcaggccaaggtgaccagcaggaagaagacagacatcgagagcctgcggggggccctgggccggcggctgctgaatgatgagttcaagacccagagcaagagcttccctggccctgacatcgagcagctgacagatgccttcggccgggacatcctgaaggatgagttcaagaccaggagcaagagcctgcctgagacagatgagcggctgcacagcaccacagagcggggcaccatcaatgatgccatcaagacccagctgaagaggaagagctacccagagaccgtgctgaagcacctgaagggcgtgaatggcaaggacatcatcaagcacctgatcaacatccagagcaagagccatggagaaacagacaagaacttctttgcctatgccaccggccggggcctgatgaaggagagcaccaccacccagctgaagagccaccctgagacagacaaggagttcctggctgatgccatcggccggggcatcatcatcggccccatcaccacccagctgaagagccaccgggagacagacaaggagctgctgaaggatgccatcggccgggacatcatcaagggccccatcagcgcccagctgaagagccaccaggagacagatgtggagcccctgaccaatgccatcggcagcagcaagaccatcggggagatcaagacccagctgcggacccactatgatgtgaacctcttcaagaacaaggacatgtctgtgcagaggcaggagggcatcttcaccaggagcatcacccccagcaagttccccaccaaggtgatcaacctgagcccctttgagaacaaggaggagacctatgagtacagcagcccctacgtgacagcccccagcaaggccatctaccgcacctacagagctggccccagcttcagcaaggacatccacctgcccctgctgaaccagctgcccagcggccacagcaaggtggtgaccctgagccagaagaccatcgagttcaccctgcccaccgtgaccaacacagtgggcaagcccacctacaaggtgctgcatgctgctgccaggaagtctgtgccccacccctacttctag

SEQ ID NO: 36194 - DNA, 2079 bp, Artificial Sequence
  Description of Artificial Sequence: Synthetic coding sequence
atgacagaggagcagacctaccaggccgctgagaagagccaggcccacaatgaggtgcccaatgaaaggctggtggtggagcaccaggagagcctgagcaagaccaagctgcagatcaagaagcaggagaccagcacagagcagcccctgaccaccccagacaaggagcccaatgaaaatctcatcctgcggcaccaggacagcatgagcaagtctgagatgcaggtgaaggagcagaggaccctgaagggccagaggatcatcacccatgatgaggagcccgggaagaacctggtgctggagcaccaggacagcgtgtccaagctggagatgcagatcgagaagaccaagaagctgccccgggagaagaggcacagcacccatgatgaggagagcggggagaaccccatgctgaagcaccaggacagcgtgtccaagatccaggtgcagctggagatccaggagaccagcgagggggagggccgcagcatcccagacaagaacagcatgtttgtgcaccaggacagcgtgtccaagctgcagatgcaggagaagaagaagatcaccccaggccgggagaggaggaacaccagaattgtggtgcccaatgaaaatgtcatctctgtgcaccaggacagcaagagcaagctgcagatgcaggagaagaagcagatcaacagcggcgtggagcggcacaagaccttccccctggagatcaagaagaaggacatcagcctggagcacctgctgcctgaggagaaggtgctgctgagccgctctgagagccagaccaagaagctgcaggccaaggtgaccagcaggaagatcaagaatgaggccgccagcgagctgcctgacacagctgagaacctgcctgccatgtaccccagcatcagtgacctgatcatccagtttgacctgaacaaggtggtggagacagacatcgagagcctgcggggggccctgggccggcggctgctgaatgatgagttcaagacccagagcaagagcttccctggccctgacatcgagcagctgacagatgccttcggccgggacatcctgaaggatgagttcaagaccaggagcaagagcctgcctgagacagatgagcggctgcacagcaccacagagcggggcaccatcaatgatgccatcaagacccagctgaagaggaagagctacccagagaccgtgctgaagcacctgaagggcgtgaatggcaaggacatcatcaagcacctgatcaacatccagagcaagagccatggagaaacagacaaggagcacctggctgatgacaccggccggggcatcatcaagggcagcatcaatgcccagctgaagggccaccagaagacagacaagaacttctttgcctatgccaccggccggggcctgatgaaggagagcaccaccacccagctgaagagccaccctgagacagacaaggagttcctggctgatgccatcggccggggcatcatcatcggccccatcaccacccagctgaagagccaccgggagacagacaaggagctgctgaaggatgccatcggccgggacatcatcaagggccccatcagcgcccagctgaagagccaccaggagacagatgtggagcccctgaccaatgccatcggcagcagcaagaccatcggggagatcaagacccagctgcggacccactatgatgtgaacctcttcaagaacaaggacatgtctgtgcagaggcaggagggcatcttcaccaggagcatcacccccagcaagttccccaccaaggtgatcaacctgagcccctttgagaacaaggaggagacctatgagtacagcagcccctacgtgacagcccccagcaaggccatctaccgcacctacagagctggccccagcttcagcaaggacatccacctgcccctgctgaaccagctgcccagcggccacagcaaggtggtgaccctgagccagaagaccatcgagttcaccctgcccaccgtgaccaacacagtgggcaagcccacctacaaggtgctgcatgctgctgccaggaagtctgtgccccacccctacttctag

SEQ ID NO: 36195 - DNA, 1815 bp, Artificial Sequence
  Description of Artificial Sequence: Synthetic coding sequence
gcccacaatgaggtgcccaatgaaaggctggtggtggagcaccaggagagcctgagcaagaccaagctgcagatcaagaagcaggagaccagcacagagcagcccctgaccaccccagacaaggagcccaatgaaaatctcatcctgcggcaccaggacagcatgagcaagtctgagatgcaggtgaaggagcagaggaccctgaagggccagaggatcatcacccatgatgaggagagcggggagaaccccatgctgaagcaccaggacagcgtgtccaagatccaggtgcagctggagatccaggagaccagcgagggggagggccgcagcatcccagacaagaacagcatgtttgtgcaccaggacagcgtgtccaagctgcagatgcaggagaagaagaagatcaccccaggccgggagaggaggaacaccagaattgtggtgcccaatgaaaatgtcatctctgtgcaccaggacagcaagagcaagctgcagatgcaggagaagaagcagatcaacagcggcgtggagcggcacaagaccttccccctggagatcaagaagaaggacatcagcctggagcacctgctgcctgaggagaaggtgctgctgagccgctctgagagccagaccaagaagctgcaggccaaggtgaccagcaggaagaagacagacatcgagagcctgcggggggccctgggccggcggctgctgaatgatgagttcaagacccagagcaagagcttccctggccctgacatcgagcagctgacagatgccttcggccgggacatcctgaaggatgagttcaagaccaggagcaagagcctgcctgagacagatgagcggctgcacagcaccacagagcggggcaccatcaatgatgccatcaagacccagctgaagaggaagagctacccagagaccgtgctgaagcacctgaagggcgtgaatggcaaggacatcatcaagcacctgatcaacatccagagcaagagccatggagaaacagacaaggagcacctggctgatgacaccggccggggcatcatcaagggcagcatcaatgcccagctgaagggccaccagaagacagacaagaacttctttgcctatgccaccggccggggcctgatgaaggagagcaccaccacccagctgaagagccaccctgagacagacaaggagttcctggctgatgccatcggccggggcatcatcatcggccccatcaccacccagctgaagagccaccgggagacagacaaggagctgctgaaggatgccatcggccgggacatcatcaagggccccatcagcgcccagctgaagagccaccaggagacagatgtggagcccctgaccaatgccatcggcagcagcaagaccatcggggagatcaagacccagctgcggacccactatgatgtgaacctcttcaagaacaaggacatgtctgtgcagaggcaggagggcatcttcaccaggagcatcacccccagcaagttccccaccaaggtgatcaacctgagcccctttgagaacaaggaggagacctatgagtacagcagcccctacgtgacagcccccagcaaggccatctaccgcacctacagagctggccccagcttcagcaaggacatccacctgcccctgctgaaccagctgcccagcggccacagcaaggtggtgaccctgagccagaagaccatcgagttcaccctgcccaccgtgaccaacacagtgggcaagcccacctacaaggtgctgcatgctgctgccaggaagtctgtgccccacccctacttctag

SEQ ID NO: 36196 - DNA, 2160 bp, Artificial Sequence
  Description of Artificial Sequence: Synthetic coding sequence
atgatgcagggcaacaagaagtgcacagatgccttcagtgacagcagcagcatcggctctgtgctggatgatgctgaccgggaggtgagcagcctgacagaccgggccttccgcagcctgtgcatcagcgaggacaccagcttccatgacagctacctggccgtgtccccagacatcacccggcaggtgtttggcaccttccaccagaggacagtgggccacacccagaggaagagcggcatctggagccagctgcccagccagggcacagagcacagcggctgggccgccaccttccagcagctgcccaagtatgtgcagggcgaggagaagtaccccaagaccagccccccacccacccctgtgcagaggcggctggaggtgcctgtgtctggcctgcggagcagcaacaagcctgtgtccaaggtgtccaccctcatcaagagctttgacagaacagagagccagagatgtgagagccggcccacagccagcaagcccccagccctgaagaacccccccaagtttgcccccctgcctgaaaattctgtgaacttctgctttgacagcgccttcctgactgtgcggcgggtgcctgctgaggtgagcaacacccaccagaacagctaccagcccggcaggaagcacggggagcaggagagcagcaagaaccctgagatggcctgccacggcagcagcagcttcctgcctgctgccaatgacacagccaccctgtgtgagagcaagttccccagcccccaccacaagcctgtgactggagagcccggccggggcaagggcaccttcctgcacagtgaaaattctgcctttgagagctggaatgcccaccagcccaagctgctggagaggaaggacacagctggcaccgtgcctgagagcaaggcccccaagcactacggggacaccaccctgctgcgggagccctgccccccagagaggacagtgagcccctgccaggtgcaggccagctgcagccaggaggagaaccggctggccgccggggccctgagcaccagcatcccctggggctgccgggaccccggggcccaggtgtttgctgtggagggcaaggcccccagcagccagcctgacagccaggagaagccagcccagcccccctggaggaagcccaagacaggcaagaagggcaaggagagcctgcaggacaccctggaggagaagacccagaccaaccagaggggcccccccctgtacaccaagcacaacccccaggagcagttctctgaaaataatgccctggacctgcctgtggagcccaatgagcactatgacccccccttcaacatcagcaagctgctgacccccatcatccccagcaagcacgccctggacagcgctgacagccagcctgctgagaggacccccagccccccaggccagctgaatggctaccaggagaaggagcccagcgagtgccagagccgggacagctacaagagcaaggcccccagcctgctcttcaacctgaaggatgtgaggaagagggtgaagagcacctacagcagcagccccctgctgaaggtgctggatgagaagacccggggcaaggtggatggcaagcaggagcctgtgtccaatggagtcatcctgcccaacggcctggaggagagccccccaaatgagctgagcaaggagaggcctgcagatgaccccacagccagccacatcaacccccagaaggaccccacagctgaccccagcgagcccagcgctgacagctacctgaccctgagcacagcccccaccatcgccaaggcccccttctacgtgaatggagaggccgctgagaggagcagctatgagaacaaggaggtggagggggagctggagatgggccctgctggcagctcctggtgcccagacagccgggagcaccggcccaggaagcacctgagcctgcggctgtgcaacagagatcctgagcccggcggggccacagagaagatgaagacccaccagctggagaatggcctgagccgctctgtgtcccaggagacagagcctgagcgggaggccggcctgcagaacacccacacccacacccacacccacacccacacccatgaccaccagcacatcctgagcctcttccgcagcatcaagagccggcggcagtag

SEQ ID NO: 36197 - DNA, 4308 bp, Artificial Sequence
  Description of Artificial Sequence: Synthetic coding sequence
atgatgcagggcaacaagaagtgcacagatgccttcagtgacagcagcagcatcggctctgtgctggatgatgctgaccgggaggtgagcagcctgacagaccgggccttccgcagcctgtgcatcagcgaggacaccagcttccatgacagctacctggccgtgtccccagacatcacccggcaggtgtttggcaccttccaccagaggacagtgggccacacccagaggaagagcggcatctggagccagctgcccagccagggcacagagcacagcggctgggccgccaccttccagcagctgcccaagtatgtgcagggcgaggagaagtaccccaagaccagccccccacccacccctgtgcagaggcggctggaggtgcctgtgtctggcctgcggagcagcaacaagcctgtgtccaaggtgtccaccctcatcaagagctttgacagaacagagagccagagatgtgagagccggcccacagccagcaagcccccagccctgaagaacccccccaagtttgcccccctgcctgaaaattctgtgaacttctgctttgacagcgccttcctgactgtgcggcgggtgcctgctgaggtgagcaacacccaccagaacagctaccagcccggcaggaagcacggggagcaggagagcagcaagaaccctgagatggcctgccacggcagcagcagcttcctgcctgctgccaatgacacagccaccctgtgtgagagcaagttccccagcccccaccacaagcctgtgactggagagcccggccggggcaagggcaccttcctgcacagtgaaaattctgcctttgagagctggaatgcccaccagcccaagctgctggagaggaaggacacagctggcaccgtgcctgagagcaaggcccccaagcactacggggacaccaccctgctgcgggagccctgccccccagagaggacagtgagcccctgccaggtgcaggccagctgcagccaggaggagaaccggctggccgccggggccctgagcaccagcatcccctggggctgccgggaccccggggcccaggtgtttgctgtggagggcaaggcccccagcagccagcctgacagccaggagaagccagcccagcccccctggaggaagcccaagacaggcaagaagggcaaggagagcctgcaggacaccctggaggagaagacccagaccaaccagaggggcccccccctgtacaccaagcacaacccccaggagcagttctctgaaaataatgccctggacctgcctgtggagcccaatgagcactatgacccccccttcaacatcagcaagctgctgacccccatcatccccagcaagcacgccctggacagcgctgacagccagcctgctgagaggacccccagccccccaggccagctgaatggctaccaggagaaggagcccagcgagtgccagagccgggacagctacaagagcaaggcccccagcctgctcttcaacctgaaggatgtgaggaagagggtgaagagcacctacagcagcagccccctgctgaaggtgctggatgagaagacccggggcaaggtggatggcaagcaggagcctgtgtccaatggagtcatcctgcccaacggcctggaggagagccccccaaatgagctgagcaaggagaggcctgcagatgaccccacagccagccacatcaacccccagaaggaccccacagctgaccccagcgagcccagcgctgacagctacctgaccctgagcacagcccccaccatcgccaaggcccccttctacgtgaatggagaggccgctgagaggagcagctatgagaacaaggaggtggagggggagctggagatgggccctgctggcagctcctggtgcccagacagccgggagcaccggcccaggaagcacctgagcctgcggctgtgcaacagagatcctgagcccggcggggccacagagaagatgaagacccaccagctggagaatggcctgagccgctctgtgtcccaggagacagagcctgagcgggaggccggcctgcagaacacccacctgaaccagaagttcttccctggccccctgagccctgaggaggaggatgtgttctacagcgacagccagagcgacttcatgcccagcctgaagggcaaggccaagttcagcaccagcagcagtgaccagagctttgccagctttgatgaccagcagaagatgtggttcacagagaaccagcgggaggacaggaggaaggatgtgtctgctggggacagccagaaggatgagaaggaaaatgtgatgaggaaggatgagctgcagtactgtgccctgagcaatggccacgcctgcctggagaacagaagccagggcgaggccctgcagcgggagcgggagagcgtgtctgggggccgcaccaggaaggccagcgctgaggaggccaacttccggggctcctggattggagaaaataaaggcaccaccttcagccaggccaaggacctgacccccagccccagcagcgccagcaacagacacatgctgttcaccatcaaggacaacaccctgcgggccacccctgtgatcaagcccatcatgctgcccctgctgcggaccatgagcctggaggacagcctgagcagcggccacaaggaggaggagctgcccaggcctgagtggggagaagatcctggcttctgtgcccctgagaaccaggacatcctgggcaccagcacccccaccaacacccggggcaccagggtgaagtgcatggccaatgaggtgatggaggaccccggccagggcagctccatggccaggatggaggccagccagcctgcccccaagggcaacttccccagcatgcccctggtgggggagggggacagagtgaaggcccccccagatgctgcccctggcctggtggccagcaactgcaagagcggcagcgctgacagcggcaagctggccgccccctggcacatccccaccatcgccctgcctgagggggacatcgaggaccagcccccaccctggcagcctgagaactgctgggaggagcagaccccaggcttcaagagccacttcctgagcacccccagggctggccccccaggccggcggctggtgcccagcgagcgggccaacagccccaaccctggcagccctggagagagcagcgcctgcagccctgctgccagcaacatctgggaggagagcagccaggcccctgggggccctgagctgctgcctgaggagcccaaccaggccagcccctgggccagcagcagccctgcccgggtgacccggcgggaggacctgacccacgccctggtgtgggagggcggcagtgaccccctgctggagctgtctgctgaggacctgcggaccctgagcccccggggcagcctgctggatgtggccaccagccctgctggcaccagcggccgcctggagctgcctgcccagctggagaggacagccagcaagcccccagctgtgccccccaagacagagaaggccctgcggcgggccaagaagctggccagcaagaggaggaagacagaccaggcccaggagaagcatggagagagccaggagggcaagccctgcccagaggacctggagcagacccagcagaggcccctgtgcccccgggagcggcccaggcacaacttccctgtggtgcgcagcctgcccccacctgtgcaccgccacagcgtgtctggcttcagcgagcctgtgggccggcggcctgggggcccccagagcctgacccccctgcctgcctacccagccacccagaaggtgctgcaggacccccagagcggggagtactttgtgtttgacctgcccctgcaggtgaagatcaagaccttctatgaccctgagaccgggaagtatgtgaaggtgtccatccccagcagcgagggcgccagccctgagcccccacctccagatgccctggccgccccctacgtgctgtacccaggcttccagcctgtgcctgtgacagccctgatgcccctgcgctgcagcagccagctgagcgcccccaccttcctgcggcagggcccccgggccagcgctgcccgggcccggacccagagcgtgcatgagagcggcctgcagctggaccccggcccccatggagactgcaccccccacagcgctggccagaggccccacggccccccccagagccctggagaggagggcgtggaggcccctggcctgggcatcatcagcacagatgacctggaggactttgccacagagggcatctcctag

SEQ ID NO: 36198 - DNA, 480 bp, Artificial Sequence
  Description of Artificial Sequence: Synthetic coding sequence
cccatgaggcacaggaagaaggctgctgacaagaacctgccctgccggcccctggtgtgtgctgtgctggacctgatggtggagttcatcgtgacccacatgatgaaggagttccccatggacctgtacatccgctgcatccaggtggtgcacaagctgctgtgctaccagaagaagtgccgggtgcggctgcactacacctggagggagctgtggagcgccctgatcaacctgctgaagttcctgatgagcaatgaaacagtgctgctggccaagcacaacatcttcaccctggccctgatgattgtgaacctcttcaacatgttcatcacctacggggacaccttcctgcccacccccagcagctatgatgagctgtactatgagatcatccgcatgcaccagagctttgacaacctgtacagcatggagcccagcagcaccaccctgacccccaagctgagccccaccctgctgtag

SEQ ID NO: 36199 - DNA, 597 bp, Artificial Sequence
  Description of Artificial Sequence: Synthetic coding sequence
atggagagctacttcttcaaggagaccagccatgaatctgtggacagcagcaaggaggagccccagaccctgcctgagacccaggatggagacctgcacctgcaggagcagggcagcggcatcgactggtgcctgagccctgcagatgtggaggcccagaccaccaatgaccagaagggcaacatcccagatgagagccaggtggagaagctgaatgtgttcctgagccccccagatgtgatcaactacctggccctgacagaggccaccggccgcatctgtgtgtcccagtgggagggccccccccggctgggctgcatcttctgccacggggaccacctgctggccgtgaatgacctgaagccccagagcctggaggaggtgtccctcttcctgaccaggagcatccagaaggagaagctgaagctgaccatcggccgcatccccaacagcgagaccttccacgccgccagctgcatgtgccccagcaagtgccagagcgctgcccccagccagctggacaagccccggctgaacagagcccccaagaggagccctgccatcaagaagagccagcagaagggggcccgggagtag

SEQ ID NO: 36200 - DNA, 1092 bp, Artificial Sequence
  Description of Artificial Sequence: Synthetic coding sequence
atggagcccaagccccagaagagccctgggaagcagttcaccttctcctatgaaaatgaggtgtgcaagcaggactacttcatcaagagcccccccagccagctgttcagctctgtgacctcctggaagaagcgcttcttcatcctgagcaaggccggggagaagagcttcagcctgagctactacaaggaccaccaccaccggggcagcattgaaattgaccagaacagctctgtggaggtgggcatcagcagccaggagaagatgcagagcgtgcagaagatgttcaagtgccacccagatgaggtgatgagcatccgcaccaccaaccgggagtacttcctgattggacatgaccgggagaagatcaaggactgggtgtccttcatgagcagcttccggcaggacatcaaggccacccagcagaacacagaggaggagctgagcctgggcaacaagaggaccctcttctacagcagccccctgctgggccccagcagcaccagcgaggccgtgggcagcagcagccccagaaatggcctgcaggacaagcacctgatggagcagagcagccctggcttccggcagacccacctgcaggacctgtctgaggccacccaggatgtgaaggaggagaaccactacctgacccccaggtctgtgctgctggagctggacaacatcatcgccagcagtgacagcggggagagcattgaaacagatggccctgaccaggtgtctggaagaattgagtgccactatgagcccatggagagctacttcttcaaggagaccagccatgaatctgtggacagcagcaaggaggagccccagaccctgcctgagacccaggatggagacctgcacctgcaggagcagggcagcggcatcgactggtgcctgagccctgcagatgtggaggcccagaccaccaatgaccagaagggcagcgccagcctgactgtggtgcagctgagcatcctgatcaacaacatcccagatgagagccaggtggagaagctgaatgtgttcctgagccccccagatgtgatcaactacctggccctgacagaggccaccggccgcatctag

SEQ ID NO: 36201 - DNA, 849 bp, Artificial Sequence
  Description of Artificial Sequence: Synthetic coding sequence
atggagcagagcagccctggcttccggcagacccacctgcaggacctgtctgaggccacccaggatgtgaaggaggagaaccactacctgacccccaggtctgtgctgctggagctggacaacatcatcgccagcagtgacagcggggagagcattgaaacagatggccctgaccaggtgtctggaagaattgagtgccactatgagcccatggagagctacttcttcaaggagaccagccatgaatctgtggacagcagcaaggaggagccccagaccctgcctgagacccaggatggagacctgcacctgcaggagcagggcagcggcatcgactggtgcctgagccctgcagatgtggaggcccagaccaccaatgaccagaagggcagcgccagcctgactgtggtgcagctgagcatcctgatcaacaacatcccagatgagagccaggtggagaagctgaatgtgttcctgagccccccagatgtgatcaactacctggccctgacagaggccaccggccgcatctgtgtgtcccagtgggagggccccccccggctgggctgcatcttctgccacggggaccacctgctggccgtgaatgacctgaagccccagagcctggaggaggtgtccctcttcctgaccaggagcatccagaaggagaagctgaagctgaccatcggccgcatccccaacagcgagaccttccacgccgccagctgcatgtgccccagcaagtgccagagcgctgcccccagccagctggacaagccccggctgaacagagcccccaagaggagccctgccatcaagaagagccagcagaagggggcccgggagtag

SEQ ID NO: 36202 - DNA, 1398 bp, Artificial Sequence
  Description of Artificial Sequence: Synthetic coding sequence
atggccggcggcaagcagttcaccttctcctatgaaaatgaggtgtgcaagcaggactacttcatcaagagcccccccagccagctgttcagctctgtgacctcctggaagaagcgcttcttcatcctgagcaaggccggggagaagagcttcagcctgagctactacaaggaccaccaccaccggggcagcattgaaattgaccagaacagctctgtggaggtgggcatcagcagccaggagaagatgcagagcgtgcagaagatgttcaagtgccacccagatgaggtgatgagcatccgcaccaccaaccgggagtacttcctgattggacatgaccgggagaagatcaaggactgggtgtccttcatgagcagcttccggcaggacatcaaggccacccagcagaacacagaggaggagctgagcctgggcaacaagaggaccctcttctacagcagccccctgctgggccccagcagcaccagcgaggccgtgggcagcagcagccccagaaatggcctgcaggacaagcacctgatggagcagagcagccctggcttccggcagacccacctgcaggacctgtctgaggccacccaggatgtgaaggaggagaaccactacctgacccccaggtctgtgctgctggagctggacaacatcatcgccagcagtgacagcggggagagcattgaaacagatggccctgaccaggtgtctggaagaattgagtgccactatgagcccatggagagctacttcttcaaggagaccagccatgaatctgtggacagcagcaaggaggagccccagaccctgcctgagacccaggatggagacctgcacctgcaggagcagggcagcggcatcgactggtgcctgagccctgcagatgtggaggcccagaccaccaatgaccagaagggcaacatcccagatgagagccaggtggagaagctgaatgtgttcctgagccccccagatgtgatcaactacctggccctgacagaggccaccggccgcatctgtgtgtcccagtgggagggccccccccggctgggctgcatcttctgccacggggaccacctgctggccgtgaatgacctgaagccccagagcctggaggaggtgtccctcttcctgaccaggagcatccagaaggaggacagcttccgcatcctgagctaccaggtggcctttggagagggcacagagctgcgggaccgggcccctggcttccgcaccagtgacagacatgatgtggccaagagggcctgcatggagagtgactggtgccgggacagcaagacagcccccagcaccaacctgtgcctgtccttcctgttctgcaagatcatgaccaatgatggagctggctgctggatcatcaagtag

SEQ ID NO: 36203 - DNA, 1101 bp, Artificial Sequence
  Description of Artificial Sequence: Synthetic coding sequence
atgcagagcgtgcagaagatgttcaagtgccacccagatgaggtgatgagcatccgcaccaccaaccgggagtacttcctgattggacatgaccgggagaagatcaaggactgggtgtccttcatgagcagcttccggcaggacatcaaggccacccagcagaacacagaggaggagctgagcctgggcaacaagaggaccctcttctacagcagccccctgctgggccccagcagcaccagcgaggccgtgggcagcagcagccccagaaatggcctgcaggacaagcacctgatggagcagagcagccctggcttccggcagacccacctgcaggacctgtctgaggccacccaggatgtgaaggaggagaaccactacctgacccccaggtctgtgctgctggagctggacaacatcatcgccagcagtgacagcggggagagcattgaaacagatggccctgaccaggtgtctggaagaattgagtgccactatgagcccatggagagctacttcttcaaggagaccagccatgaatctgtggacagcagcaaggaggagccccagaccctgcctgagacccaggatggagacctgcacctgcaggagcagggcagcggcatcgactggtgcctgagccctgcagatgtggaggcccagaccaccaatgaccagaagggcaacatcccagatgagagccaggtggagaagctgaatgtgttcctgagccccccagatgtgatcaactacctggccctgacagaggccaccggccgcatctgtgtgtcccagtgggagggccccccccggctgggctgcatcttctgccacggggaccacctgctggccgtgaatgacctgaagccccagagcctggaggaggtgtccctcttcctgaccaggagcatccagaaggagaagctgaagctgaccatcggccgcatccccaacagcgagaccttccacgccgccagctgcatgtgccccagcaagtgccagagcgctgcccccagccagctggacaagccccggctgaacagagcccccaagaggagccctgccatcaagaagagccagcagaagggggcccgggagtag

SEQ ID NO: 36204 - DNA, 591 bp, Artificial Sequence
  Description of Artificial Sequence: Synthetic coding sequence
tgacaggagcagggcagcggcatcgactggtgcctgagccctgcagatgtggaggcccagaccaccaatgaccagaagggcagcgccagcctgactgtggtgcagctgagcatcctgatcaacaacatcccagatgagagccaggtggagaagctgaatgtgttcctgagccccccagatgtgatcaactacctggccctgacagaggccaccggccgcatctgtgtgtcccagtgggagggccccccccggctgggctgcatcttctgccacggggaccacctgctggccgtgaatgacctgaagccccagagcctggaggaggtgtccctcttcctgaccaggagcatccagaaggaggacagcttccgcatcctgagctaccaggtggccttcggggagggcacagagctgcgggaccgggcccctggcttccgcaccagtgacagacatgatgtggccaagagggcctgcatggagagtgactggtgccgggacagcaagacagcccccagcaccaacctgtgcctgtccttcctgttctgcaagatcatgaccaatgatggagctggctgctggatcatcaagtag

SEQ ID NO: 36205 - DNA, 465 bp, Artificial Sequence
  Description of Artificial Sequence: Synthetic coding sequence
atggagcccagcaagaccttcatgaggaacctgcccatcaccccaggctacagcggctttgtgcccttcctgagctgccagggcatgagcaaggaggatgacatgaaccactgtgtgaagaccttccaggagaagacccagcgctacaaggagcagctgcgggagctgtgctgtgctgtggccacagcccccaagctgaagcctgtgaacagcgaggagaccgtgctgcaggccctgcaccagtacaacctgcagtaccaccccctcatcctggagtgcaagtatgtgaagaagcccctgcaggagccccccatccctggctgggccggctacctgccccgggccaaggtgacagaatttggctgcggcacccgctacacagtgatggccaagaactgctacaaggacttcctggagatcacagagcgggccaagaaggcccacctgaagccctatgaggagtag

SEQ ID NO: 36206 - DNA, 693 bp, Artificial Sequence
  Description of Artificial Sequence: Synthetic coding sequence
atggagcccagcaagaccttcatgaggaacctgcccatcaccccaggctacagcggctttgtgcccttcctgagctgccagggcatgagcaaggaggatgacatgaaccactgtgtgaagaccttccaggagaagacccagcgctacaaggagcagctgcgggagctgtgctgtgctgtggccacagcccccaagctgaagcctgtgaacagcgaggagaccgtgctgcaggccctgcaccagtacaacctgcagtaccaccccctcatcctggagtgcaagtatgtgaagaagcccctgcaggagccccccatccctggctgggccggctacctgccccgggccaaggtgacagaatttggctgcggcacccgctacacagtgatggccaagaactgctacaaggacttcctggagatcacagagcgggccaagaaggcccacctgaagccctatgaggagatctacggcgtgagcagcaccaagaccagcgcccccagccccaaggtgctgcagcacgaggagctgctgcccaagtacccagacttcagcatcccagatggcagctgcccagccctgggccggcccctgcgggaggaccccaagacccccctgacctgtggctgtgcccagaggcccagcatcccctgcagcggcaagatgtacctggagcccctgagcagcgccaagtag

SEQ ID NO: 36207 - DNA, 387 bp, Artificial Sequence
  Description of Artificial Sequence: Synthetic coding sequence
atggcctggagggtgcctggggtgcggcctgccagcaccttcttcccccaggtgctgcgggccagcagcgagctgcccaaccggctgcctgagggcagcacagtgggccccaagccagacagctcctgggaggccggcagccagggcaactggggcctgaccagcagcggggccggccaggacagcagcgcccagaagctgggcatcctgtctgtgcagatcagcctgaagatctggacctgggagaagcccagcggctggggccacctgcacgccgctgtgactggagccagctgctgcagccccctgagccagggcggggccatctgcctggtgacagccccccaggacaagccagactgcagcccctgcaccagcggccactag

SEQ ID NO: 36208 - DNA, 1338 bp, Artificial Sequence
  Description of Artificial Sequence: Synthetic coding sequence
atggagaccaggacagaagatggcggcctgacccggcggcccaccctggccagctcctgggatgtggccggcggggccctgacccacagcctgctgctgacccgggccggcctgggccctggggactttgactgggaggagctgctggcccccccagcccctggccaggacctggtgatcctgaagaggaaccacaacaacaaggatgagaacccctgcttcctgtacctgcgctgtggcccagatggaggagaggagatcgccagcatcggcatcctgagcagcgccaggaacatggaggtgtacctgggggaggagtactgcggcaccagccggggcaagaatgtgtgcaccgtgctggatgattctgaacatgagaagatcatcctgtacaagaagaacctgaagctggagagcagcacccacgcctgcaagatcaagctgctgagctttggagagcggcagtgtgtgttcatcagcaaggtggtggtgcacatgaggtctgtgtttgccaacagcagcaccagcagccctgccctgggcagcagaattgacctggacaaggtgcagaccatcatggagagcatgggcagcaagctgagccctggggcccagcagctgatggacatggtgcgctgccagcagaggaactgcatccccatcggggagcagctgcagagcgtgctgggcaacagcggctacaagcacatgattggcctgcagagcagcagcaccctgggcaccctgaacaagagcagcagcacccccttccccttcagaacaggcctgaccagcggaaatgtgacagagaacctgcagacctacatcgacaagagcacccagctgcctggaggagagaacagcaccaagctggatgagtgcaaggtgatgccccagaaccacagcttcctggagaatgacctgaagaatgccatggccagcttcctgcccaagaaggtgtctgacaacagcaacatccccaacagcgagctgctgcccttcctgcagaacctgtgcagccaggtgaaccacctgcacgtgggcaacaagacagagtgccaggagaacatcaccaagcacggggagcgcatcctgggcgtgggcatggaggagcagagcatctgcagctacctggagaagatcctgagcaagaacatggagctgatggagaagaagctgatggactacatcgaccagaggatccacgagctgcaggagcacattgatgacaagatcgccctgctgctggacctgctgcagaaccccaacagccccccaacaggcatccccctgcggcactatgacagcggggagcggctgagcaatggagagaggtag

SEQ ID NO: 36209 - DNA, 438 bp, Artificial Sequence
  Description of Artificial Sequence: Synthetic coding sequence
atgtggagcttcctgcccggggctgagagcgtgtccatgggccctgtgcctggggtgagcagcctgggcgcctgctggacccatgaccaggacagcggccgggcagaggaccggccccaggccccccgcatcacccagtacacctgggtgctgtccttcctgttcacagagaagccccagaccaggagcaccagccccatcagccaccagggccagccccagaccacccgggccctgagcctgcggcagccccagcaccccagcgccccagccagcggccggcccaggcctccccacagcagcggccctgacctggccgaggccgcccctgtggtggaccaggccagccaggccgccggccgggccagcagcggcctgggcctgtgggagcaggcctctgtgtcccagggcttcagaaatgctgcctttgaggcctag

SEQ ID NO: 36210 - DNA, 438 bp, Artificial Sequence; identical to SEQ ID NO: 36209
  Description of Artificial Sequence: Synthetic coding sequence

SEQ ID NO: 36211 - DNA, 774 bp, Artificial Sequence
  Description of Artificial Sequence: Synthetic coding sequence
atggagaggagcaatgctgccaccaagtgtggggaggagcccaggagcggcagccggcggctgcccaaggccgagggggacaagagcggcagcgctggggcccccagcaagaacagcagccggctgggcggccggccctgcatgtgcacagctggaagaagacccaacagagccagcggcagaagaagaagaagctgcagccctgcccccacctggccacccctgtgctgctacccccagagccggcccacagccagcgctgctggccctggggcctgcatgagggccagcggccggccccacggcaacaccacagccagcacagccccacccaggcacccccggcccaggaggcctgggggccctgccctgcggcccaccccccggccctgtgccggccctgcccctcctccagccagccgggactgccgctgccggcggccccggcgctggccccgggccggccggcggggcagaagagctggggcctgcaagcccagctgtgccggggccgcctggagcgcccggggggcccccctgtgcagctaccgcaccagctgtgccggcagctgtggggccaggacagcccccaccccagcccccacctgtgccagccccagcgctgctgccagcagctgctgcagaagaagaagagcctgcagcagccccaccacagcctggagcggggcctgtggggccggccccacagctgccacagctgcccagcccgggaagcccaggtctgctgctgcccctggccgggcccgggcctag

SEQ ID NO: 36212 - DNA, 777 bp, Artificial Sequence
  Description of Artificial Sequence: Synthetic coding sequence
atgagcctggagagcctcttccagcacatcatcttcacagagcaccaggccgaggagagccggcggctgatgagggaggtgcgctctgagatcacccgctgccgggagaagatcaagaaggccacagaggagctgaatgaggagaagatcaagctggagagcaaggtgcagcagttctttgagaagagcttcttcctgcagctgctgaaggcccatgaaaatgccctggagaagcagtacagcgagatcaccaaccacaggaacatgctgctgcagacctttgaggccatcaagaagcagatgattgaggaggaggacaagttcatcaaggagatcacagacttcaacaatgactatgagatcaccaagaagcgggagctgctgatgaaggaaaatgtgaagattgagatcagtgacctggagaaccaggccaacatgctgaagtctgagatgaagtccatggagcatgacagcagccagctgaatgagctgcagaagcagaagtctgagctgatccaggagctgttcaccctgcagaggaagctgaaggtgtttgaagatgaagaaaatgaaagcatctgcaccaccaagtacctggaggccgagaagatcaagatcagcgagaagccccagaatgacacagaatgtctgcggctgaagaaggagctggagctgtacaaggaggatgacatggagagcgtgtatgaggccctgcagacagaaattgagttcctggagctgaccctggcccagaaggacctgcaggagagcaagtag

SEQ ID NO: 36213 - DNA, 543 bp, Artificial Sequence
  Description of Artificial Sequence: Synthetic coding sequence
atgagcctggagagcctcttccagcacatcatcttcacagagcaccaggccgaggagagccggcggctgatgagggaggtgcgctctgagatcacccgctgccgggagaagatcaagaaggccacagaggagctgaatgaggagaagatcaagctggagagcaaggtgcagcagttctttgagaagagcttcttcctgcagctgctgaaggcccatgaaaatgccctggagaagcagtacagcgagatcaccaaccacaggaacatgctgctgcagacctttgaggccatcaagaagcagatgattgaggaggaggacaagttcatcaaggagatcacagacttcaacaatgactatgagatcaccaagaagcgggagctgctgatgaaggaaaatgtgaagattgagatcagtgacctggagaaccaggccaacatgctgaagagtgaccggctgaagaaggagctggagctgtacaaggaggatgacatggagagcgtgtatgaggccctgcagacagaaattgagttcctggagctgtag

SEQ ID NO: 36214 - DNA, 1404 bp, Artificial Sequence
  Description of Artificial Sequence: Synthetic coding sequence
atggagagcagcacaggccccaggatgcccctgctgaagtactgcagcgtggccaccagcctgaaggcccctggctgggatggagctgccccaccctgggacctgtccttcacctacccctttgccctgcaggccccctggctgaccggccacaagcccctggcccggcatgccagcagctgcccctgcctgcacgtggccgaccctgcctggcagggccctggctggctgggccgggctggagatgctgccaacacctgggtgctggcccggcgggaggctgatggcttctactaccgggcccagatcaaggccaccccagagctggagcggcagggcgtgctgctggtggagtttgaggcccccctggtggccggccccaagctgcctgcccagcagcagagggtggtgctggaggaggatgtgatccccctgagccccagcgtgggctacagcctgcggcctggggacaaggtgctggccctgtgggagcccggccagcagcagtatggccctggcaccgtgctgctgggcctggagatgagggacccccagagggccagcaaggagaaggagatcaccgtgcacttctggaatggcaaggccgccaaggtgcccctgggcggcgtgcagagcgtgtccctgaccatctggaagaaggctgtggagcggctgcacaagagcttcacccgggagcacccccggcccctgcactgggccccctgctgcagcctgctgggccccatcaccggccgcatcaccaatgagctgcccccagatgcccccttcctgtgccccctgtgccaccaccacgcctgctgccagctgctgtgccagggctgcctgtgtggctgccccccctgtggcaccacctggtggcccctgaccaggaccagcgaggtgatggcccgggagctgcctgagctggagcccacagcccagctgctgcccctggagggccccaaggaggagaaggtggccatgcacgcccccctggccgtgagcagcagcagcagcagcagctgtgagcaggatggagtggagaatgacctggagatgggccccccccagaggctgatggtgaacagcgctgtgaacacagaccccatcttcctggagatgcccctgcggcagagcggcctgtgccagcctgagtggagatactggaagagaaatggacctgagccctgcctgggcaagccaggcacccgctacagcaacatctgcaaggaggagaaggaccacaagcagcagagggcccagacagctgtggtgggcaccaccaaggagctggtgtccaaggccacccacatgaagccacccaggaccccacctggagaggccgagcacaggaagaggagccagagcctggccatctgccagtggaacaagaacagcaggtag

SEQ ID NO: 36215 - DNA, 1215 bp, Artificial Sequence
  Description of Artificial Sequence: Synthetic coding sequence
atggagagcagcacaggccccaggatgcccctgctgaagtactgcagcgtggccaccagcctgaaggcccctggctgggatggagctgccccaccctgggacctgtccttcacctacccctttgccctgcaggccccctggctgaccggccacaagcccctggcccggcatgccagcagctgcccctgcctgcacgtggccgaccctgcctggcagggccctggctggctgggccgggctggagatgctgccaacacctgggtgctggcccggcgggaggctgatggcttctactaccgggcccagatcaaggccaccccagagctggagcggcagggcgtgctgctggtggagtttgaggcccccctggtggccggccccaagctgcctgcccagcagcagagggtggtgctggaggaggatgtgatccccctgagccccagcgtgggctacagcctgcggcctggggacaaggtgctggccctgtgggagcccggccagcagcagtatggccctggcaccgtgctgctgggcctggagatgagggacccccagagggccagcaaggagaaggagatcaccgtgcacttctggaatggcaaggccgccaaggtgcccctgggcggcgtgcagagcgtgtccctgaccatctggaagaaggctgtggagcggctgcacaagagcttcacccgggagcacccccggcccctgcactgggccccctgctgcagcctgctgggccccatcaccggccgcatcaccaatgagctgcccccagatgcccccttcctgtgccccctgtgccaccaccacgcctgctgccagctgctgtgccagggctgcctgtgtggctgccccccctgtggcaccacctggtggcccctgaccaggaccagcgaggtgatggcccgggagctgcctgagctggagcccacagcccagctgctgcccctggagggccccaaggaggagaaggtggccatgcacgcccccctggccgtgagcagcagcagcagcagcagctgtgagcaggatggagtggagaatgacctggagatgggccccccccagaggctgatggtgaacagcgctgtgaacacagaccccatcttcctggagatgcccctgcggcagagcggcctgtgccagcctgagtggagatactggaagagaaatggacctgagccctgcctgggcaagccaggcaaggagtag

SEQ ID NO: 36216 - DNA, 363 bp, Artificial Sequence
  Description of Artificial Sequence: Synthetic coding sequence
atggccccccggggcaggaagaggaaggccgaggccgctgtggtggccgtggccgagaagcgggagaagctggccaacggcggggagggcatggaggaggccaccgtggtgattgagcactgcaccagggtgtatggaagaaatgctgctgccctgagccaggccctgcggctggaggcccctgagctgcctgtgaaggtgaaccccaccaagccccggcggggcagctttgaggtgaccctgctgcggccagatggcagcagcgctgagctgtggacaggcatcaagaagggcccccccaggaagctgaagtttcctgagccccaggaggtggtggaggagctgaagaagtacctgtcctag

SEQ ID NO: 36217 - DNA, 279 bp, Artificial Sequence
  Description of Artificial Sequence: Synthetic coding sequence
tgaggcatggaggaggccaccgtggtgattgagcactgcaccagggtgtatggaagaaatgctgctgccctgagccaggccctgcggctggaggcccctgagctgcctgtgaaggtgaaccccaccaagccccggcggggcagctttgaggtgaccctgctgcggccagatggcagcagcgctgagctgtggacaggcatcaagaagggcccccccaggaagctgaagtttcctgagccccaggaggtggtggaggagctgaagaagtacctgtcctag

SEQ ID NO: 36218 - DNA, 363 bp, Artificial Sequence; identical to SEQ ID NO: 36216
  Description of Artificial Sequence: Synthetic coding sequence

SEQ ID NO: 36219 - DNA, 1905 bp, Artificial Sequence
  Description of Artificial Sequence: Synthetic coding sequence
atgcgctggctgcggcctgctggaagaagaagagagcaggagagcgtgtctggccacctgggccccccagctggggccccagctgcccctgagacccccacctgcctgcctgacaccaccccccacccagcccctgtggtgtgcagcgctgacccccagctggccctggagagcctggaccccaggaccctgcggctgctgtggaggcagcgggagctggagatccaggccctgcgctgggccatccagaatggagaagatgcccggctgtgccacatcctggaggaggtggccggcctgccccccaagaggagcagccacagccaggagaagctgctgcagaaccaggtgcagaagctgatccaggagctgaaggagcagaaggagcgggcccagtgggagaaggagcacctggaggagcggctgctgcagaccaccaggaccctgcaggagatggaggccgagctgcagaacctgcagaagagctgcctgctgcagctggcccggagctcctgggtgggccgcatgctgcggagccagacaggctctgtggaggtggtgacagctgagaccctgatggaccccagcgacctgtctgagaacatccaggcccccaccggggagggcttccggctggaggatgtggactggaacagcgtggcccggcgctaccccaacctcttcaccaacatggagcccagcagcaagcagaagcagccccggccctggccccagctggacaccggcagccctgagagcagcggcaagcacagcgagcggcaccacaagacagtggagtggggcagcctgccctgcctgaacaccagcagcagcggcggcgctgacagcgacagcagcagctgccggcccggcctgcccagctttgtgcaggtgattggccaccccccccgggaccaccgggccagcagcgagcaggccctggtgcaggccggcagctacagccgggacagcgaggacctgcagaagacccacagccccaggcatggagagcctgtgctgagcccccagccctgcacagatcctgaccactggagccctgagctgctgcagagccccaccggcctgaagatcgtggccgtgtcctgccgggagaagtttgtgcgcatcttcaaccccagccaggagagcacagctgacctgagcggcatggtgctgaagcagctggtgcggggcttccctgagcggctgtaccgcttccccccaggcaccctgctggcccccaggcaccacgtgacagtgtggggcgaggccaccaggtctgccaagaagcccctgcgggccagcagcagccgggagcctgtgcccctgctgagcatccggggctgtgccaccctgctgctgagccccaagggggaggtgctgtctgagcaccgcatcccccggcgggagaccccagccccccgggtgtttgctgatggaacagacctgagcattgaccgcttccccctgcctgaggccggccctggagctgacaccaggaagccacccaggcctccccggcccctgaggaagggccgggtgcgggagccccgggtgtccagaagaagacctggcacccggggcctgctgccccctgtgtcctctgggaagctgttccacgcccgggagggccctgcccggccagaaaatcctgagatcccagccccccagcacctgcctgccatccctggggaccccaccctgcccagccccccagctgaggccggcctgggcctggaggactgccgcctgcagaaggagcaccgggtgcgggtgtgcaggaagtctgtggacaggagctgccccctggtggccctgtctgtgcagaacacagctgagagccgcttcggcttccgcttcctgagctgcctgcctgtgacagctgacacctgccgcggggcctag

SEQ ID NO: 36220 - DNA, 477 bp, Artificial Sequence
  Description of Artificial Sequence: Synthetic coding sequence
atggacctggccagcgagatcaccagcgccacccagaccagcagcctgtgcagcagcggccggggccacgccggctacccagcccctggcatcgtggcccacggctttgagacccatggaacagcccgggtggcccagggccacctgctgcccccctgcctgctgcccccaccccagatgcctgtgctggccgccctgcgggacctgagcagaagaggcagcaccagcagcagccgcagccccagcaggcctgtgtccaccagcgccagcaagccctgcctgcctgccagctgcctgggggagacctggagcatcagcatcaacctggtgggcagcagcggccacctgcagagccctggggcccagagagatgcccagcgggagaccggctgcctgggccccagctggctgccccaccaccagggcagagatgaggagctgagcctgagccacagcgcccagggcgaggagttctag

SEQ ID NO: 36221 - DNA, 477 bp, Artificial Sequence; identical to SEQ ID NO: 36220
  Description of Artificial Sequence: Synthetic coding sequence

SEQ ID NO: 36222 - DNA, 87 bp, Artificial Sequence
  Description of Artificial Sequence: Synthetic coding sequence
atggacctggccagcgagatcaccagcgccacccagaccagcagcctgtgcagcagcggccggggccacgccggctacccagcctag

SEQ ID NO: 36223 - DNA, 477 bp, Artificial Sequence; identical to SEQ ID NO: 36220
  Description of Artificial Sequence: Synthetic coding sequence

SEQ ID NO: 36224 - DNA, 423 bp, Artificial Sequence
  Description of Artificial Sequence: Synthetic coding sequence
atgaagggccaggagggcatccggggggagggctgcacagatcctgagatcaaggccagcccccagatgtgggccgcccgcttccggggcatgaggagccgcttcagccccctcttcagccaggccacagagatgggcccccgggtgtctgctggctggtgcctgagcggcggcggcaggaaggtgagcagcctgcagggcgacttccccccaggcggcttctgggccctgagcaatgattctgccctgagcctgccccccctgagcctgccccacccccaccccctgcggcccccaggcctgggcgtgaatgagttcacccagggcctgcacccccccctgcaccctgctgcctctgtgttccagacctgcttctacaggaagccccactactgcagcaccctgcggcccaccaccacctag

SEQ ID NO: 36225 - DNA, 654 bp, Artificial Sequence
  Description of Artificial Sequence: Synthetic coding sequence
atggccctggtgcaggccctggtgccccgggagcgggagcccaagctgagcatcctgcagatggacagaggagacccccagcacagcagccactggtgcccagagcgggagaaggtgaagctgctgaccctgaagccccgggagaccagcaagaacatcctgatcaacttctaccgggccttcaacctggacaaggatgtgttcatccaccaggccaaccaccccctgactgtgcccagctctgtggtgatgggagacaatggccacaccctggctgaagatgacaagaggccctgcttccgggtgctgccctgctacctggagcgggtgagcagcggcatcagcatctcctggatcagcgcccccctgcctgtgggcgccatgaagcaccagctgctgtgtgacctgatggacctgatcaccctgtccttctggctggccggccagtgcatgagcctgaaggccaccaacatgcagcactgcaagtgcagcatcgccaccagtgactgggccatcgagctggacagaacagactacaagaccctgcccagcgagtacagcatcctggccctgctgcaggtgtttgctgggaagaactgcatggacagagtgctgctgcacgtggatgtgaactacctgaagagcctgccctag

SEQ ID NO: 36226 - DNA, 1002 bp, Artificial Sequence
  Description of Artificial Sequence: Synthetic coding sequence
atgctggtgggcacccccaacctgctgaccctggatgaagcagatgccacctggaccctcatcaaggacaaggtgattgaggagcacttcggccccaatgctgtggccgtgcccttcctgagtgatgctgcctgctatgacctgctgggcgtgctggtgaagcagagcaggcctgcccacacccggctggccctgcccggccggcagggcagaagagccctgaagcctgtgggccccctgcccagcctgctggagcaggccggcagcgagggcgcctttgcccactgcacccgggagtacagccccaacggccgggcagagcgggcctatgaggagaccaggatgctggatggccagccctgcaagatccggctgcacatgggagacctgaggaagaaggtggccttcctgctgctgcccccaggccaggtgtccctgcagcagaccctgccctggctgcggagcacccacagcatctacgtgatctaccaggtgttcagctgctcctggctgcagctgggcctgaccagcacagcccgggagccccagctgctgcggctgctgcggagcctgcctgtggccttcagctgcctgaagttcagcctgcagagcaaaggagtgctgggcccccagaagcccctgaccaaggaccccctgccccatggagccaactgggtgcggcccaacctgagcatcatgccacccctggcccccaccagcgccccagctgacaccacagaggccgcagatgtgcccccacctgtgcctgccccacccaccccaccaccccaggagggccctgaggacaagcccacccgcttctcctacaagggcaggaaccccttctggaggggcccccagatcctgtctgagaactggctgttcagccccaggagccccccacctggggcccagggcggcggcccccgggaccctgatggccacagcatgagcctgcccctgctgcagggcctgagcagcgagtttgacagtgatgactag

SEQ ID NO: 36227 - DNA, 792 bp, Artificial Sequence
  Description of Artificial Sequence: Synthetic coding sequence
atggccctggtgcccggccgcagcaaggaggatggcctgtggaccaggaacagccctggcagcagccagcaccctgagagcccccggctgcccaaccccctgtgggaccggggcaagattggcaaggtggagggccaccagcacatccaggacttcagccagaagagccacctgcccagcatcgtggtggagagcagcgaggtgaatgaggagagcggggacctgcacctgccccatgaggagctgctgctgctgacagatggagaggaggaggatgctgaggccttcttccaggaccagagcgaggagcccggctgggcctggagcccccaggaccccaggagccccctgcggaccttcaatgccggcctgtcctggggccaggaccaggatgaagaagatgcctgctggatcctggaggacacagcctgcctggaggccaccaaccactgccccttctgggacagcacaggcagccgggtgtgccgcagcggctttgtggagtacagccacctgctgccccccaacagctttgagggcgctgaggaggaggccgtgcagaccccagctggggtggagagcggggccgccagcgaggcccctgggggccggggctgtgaccggcccagggctgaccacgccgccccaccccaggaggccggcgtgcagtgcacctgccagcactacacagtgcgggaggaggcccagaagaccccacctgctgaccctgcctgcccagagcgggaggacagccacggcagcggcagccccttcaaggccagccaggactag

SEQ ID NO: 36228 - DNA, 870 bp, Artificial Sequence
  Description of Artificial Sequence: Synthetic coding sequence
atggccctggtgcccggccgcagcaaggaggatggcctgtggaccaggaacagccctggcagcagccagcaccctgagagcccccggctgcccaaccccctgtgggaccggggcaagattggcaaggtggagggccaccagcacatccaggtgtccaccagcagcgcctgtgtgtggcagctggcctacccacctgtgtggcccaacctgcctgctgtgcccatccaggacttcagccagaagagccacctgcccagcatcgtggtggagagcagcgaggtgaatgaggagagcggggacctgcacctgccccatgaggagctgctgctgctgacagatggagaggaggaggatgctgaggccttcttccaggaccagagcgaggagcccggctgggcctggagcccccaggaccccaggagccccctgcggaccttcaatgccggcctgtcctggggccaggaccaggatgaagaagatgcctgctggatcctggaggacacagcctgcctggaggccaccaaccactgccccttctgggacagcacaggcagccgggtgtgccgcagcggctttgtggagtacagccacctgctgccccccaacagctttgagggcgctgaggaggaggccgtgcagaccccagctggggtggagagcggggccgccagcgaggcccctgggggccggggctgtgaccggcccagggctgaccacgccgccccaccccaggaggccggcgtgcagtgcacctgccagcactacacagtgcgggaggaggcccagaagaccccacctgctgaccctgcctgcccagagcgggaggacagccacggcagcggcagccccttcaaggccagccaggactag

SEQ ID NO: 36229 - DNA, 249 bp, Artificial Sequence
  Description of Artificial Sequence: Synthetic coding sequence
atggccctggtgcccggccgcagcaaggaggatggcctgtggaccaggaacagccctggcagcagccagcaccctgagagcccccggctgcccaaccccctgtgggaccggggcaagattggcaaggtggagggccaccagcacatccaggacttcagccagaagagccacctgcccagcatcgtggtggagagcagcgaggtgaatgaggagagcggggacctgcacctgccccatgaggagctgtag

SEQ ID NO: 36230 - DNA, 792 bp, Artificial Sequence; identical to SEQ ID NO: 36227
  Description of Artificial Sequence: Synthetic coding sequence

SEQ ID NO: 36231 - DNA, 996 bp, Artificial Sequence
  Description of Artificial Sequence: Synthetic coding sequence
atgctgagccctgagcggctggccctgcctgactatgagtacctggcccagagacatgtgctgacctacatggaggatgctgtgtgccagctgctggagaaccgggaggacatcagccagtatggaattgcccgcttcttcacagagtacttcaacagcgtgtgccagggcacccacatcctcttccgggagttctcctttgtgcaggccaccccccacaacagagtgtccttcctgcgggccttctggcgctgcttcagaacagtgggcaagaatggagacctgctgaccatgaaggagtaccactgcctgctgcagctgctgtgcccagacttccccctggagctgacccagaaggccgccagaattgtgctgatggatgatgccatggactgcctgatgtccttcagtgacttcctgtttgccttccagatccagttctactacagcgagttcctggacagcgtggccgccatctatgaggacctgctgagcggcaagaaccccaacacagtgattgtgcccaccagcagcagcggccagcaccggcagaggcctgccctgggcggggccggcaccctggagggcgtggaggccagcctcttctaccagtgcctggagaacctgtgtgacagacacaagtacagctgccccccaccagccctggtgaaggaggccctgagcaatgtgcagaggctgaccttctacggcttcctgatggccctgagcaagcaccggggcatcaaccaggccctgggcgccctgcctgacaagggggacctgatgcatgaccctgccatggatgaggagctggagcggctgctggcccaggtgcccggcctggtgaacagcgtgacagccagccctgaggccagctgcctgcccagcaggaccccaccccgggtgggcagcccctggaggcccctgcaccacagcaggaaggtggatggagagagtgatggcagcacagaggagacagatgaaagtgagacctag

SEQ ID NO: 36232 - DNA, 1014 bp, Artificial Sequence
  Description of Artificial Sequence: Synthetic coding sequence
atgctgagccctgagcggctggccctgcctgactatgagtacctggcccagagacatgtgctgacctacatggaggatgctgtgtgccagctgctggagaaccgggaggacatcagccagtatggaattgcccgcttcttcacagagtacttcaacagcgtgtgccagggcacccacatcctcttccgggagttctcctttgtgcaggccaccccccacaacagagtgtccttcctgcgggccttctggcgctgcttcagaacagtgggcaagaatggagacctgctgaccatgaaggagtaccactgcctgctgcagctgctgtgcccagacttccccctggagctgacccagaaggccgccagaattgtgctgatggatgatgccatggactgcctgatgtccttcagtgacttcctgtttgccttccagatccagttctactacagcgagttcctggacagcgtggccgccatctatgaggacctgctgagcggcaagaaccccaacacagtgattgtgcccaccagcagcagcggccagcaccggcagaggcctgccctgggcggggccggcaccctggagggcgtggaggccagcctcttctaccagtgcctggagaacctgtgtgacagacacaagtacagctgccccccaccagccctggtgaaggaggccctgagcaatgtgcagaggctgaccttctacggcttcctgatggccctgagcaagcaccggggcatcaaccaggccctgggcgccctgcctgacaagggggacctgatgcatgaccctgccatggatgaggagctggagcggctgctgctgcccttcttccggctggcccaggtgcccggcctggtgaacagcgtgacagccagccctgaggccagctgcctgcccagcaggaccccaccccgggtgggcagcccctggaggcccctgcaccacagcaggaaggtggatggagagagtgatggcagcacagaggagacagatgaaagtgagacctag

SEQ ID NO: 36233 - DNA, 825 bp, Artificial Sequence
  Description of Artificial Sequence: Synthetic coding sequence
atgctgagccctgagcggctggccctgcctgactatgagtacctggcccagagacatgtgctgacctacatggaggatgctgtgtgccagctgctggagaaccgggaggacatcagccagtatggaattgcccgcttcttcacagagtacttcaacagcgtgtgccagggcacccacatcctcttccgggagttctcctttgtgcaggccaccccccacaacagagtgtccttcctgcgggccttctggcgctgcttcagaacagtgggcaagaatggagacctgctgaccatgaaggagtaccactgcctgctgcagctgctgtgcccagacttccccctggagctgacccagaaggccgccagaattgtgctgatggatgatgccatggactgcctgatgtccttcagtgacttcctgtttgccttccagatccagttctactacagcgagttcctggacagcgtggccgccatctatgaggacctgctgagcggcaagaaccccaacacagtgattgtgcccaccagcagcagcggccagcaccggcagaggcctgccctgggcggggccggcaccctggagggcgtggaggccagcctcttctaccagtgcctggagaacctgtgtgacagacacaagtacagctgccccccaccagccctggtgaaggaggccctgagcaatgtgcagaggctgaccttctacggcttcctgatggccctgagcaagcaccggggcatcaaccaggccctgggcgccctgcctgacaagggggacctgatgcatgaccctgccatggatgaggagctggagcggctgtag

SEQ ID NO: 36234 - DNA, 705 bp, Artificial Sequence
  Description of Artificial Sequence: Synthetic coding sequence
atgaaggagtaccactgcctgctgcagctgctgtgcccagacttccccctggagctgacccagaaggccgcccgcatcgtgctgatggatgatgccatggactgcctgatgtccttcagtgacttcctgtttgccttccagatccagttctactacagcgagttcctggacagcgtggccgccatctatgaggacctgctgagcggcaagaaccccaacacagtcatcgtgcccaccagcagcagcggccagcaccggcagaggcctgccctgggcggggccggcaccctggagggcgtggaggccagcctcttctaccagtgcctggagaacctgtgtgacagacacaagtacagctgccccccaccagccctggtgaaggaggccctgagcaatgtgcagaggctgaccttctacggcttcctgatggccctgagcaagcaccggggcatcaaccaggccctgggcgccctgcctgacaagggggacctgatgcatgaccctgccatggatgaggagctggagcggctgctggcccaggtgcccggcctggtgaacagcgtgacagccagccctgaggccagctgcctgcccagcaggaccccaccccgggtgggcagcccctggaggcccctgcaccacagcaggaaggtggatggagagagtgatggcagcacagaggagacagatgagagcgagacctag

SEQ ID NO: 36235 - DNA, 744 bp, Artificial Sequence
  Description of Artificial Sequence: Synthetic coding sequence
atggagctgcccggcagcagcctgaacaacctgctgaccatgaaggagtaccactgcctgctgcagctgctgtgcccagacttccccctggagctgacccagaaggccgccagaattgtgctgatggatgatgccatggactgcctgatgtccttcagtgacttcctgtttgccttccagatccagttctactacagcgagttcctggacagcgtggccgccatctatgaggacctgctgagcggcaagaaccccaacacagtgattgtgcccaccagcagcagcggccagcaccggcagaggcctgccctgggcggggccggcaccctggagggcgtggaggccagcctcttctaccagtgcctggagaacctgtgtgacagacacaagtacagctgccccccaccagccctggtgaaggaggccctgagcaatgtgcagaggctgaccttctacggcttcctgatggccctgagcaagcaccggggcatcaaccaggccctgggcgccctgcctgacaagggggacctgatgcatgaccctgccatggatgaggagctggagcggctgctggcccaggtgcccggcctggtgaacagcgtgacagccagccctgaggccagctgcctgcccagcaggaccccaccccgggtgggcagcccctggaggcccctgcaccacagcaggaaggtggatggagagagtgatggcagcacagaggagacagatgaaagtgagacctag

SEQ ID NO: 36236 - DNA, 981 bp, Artificial Sequence
  Description of Artificial Sequence: Synthetic coding sequence
atgctgagccctgagcggctggccctgcctgactatgagtacctggcccagagacatgtgctgacctacatggaggatgctgtgtgccagctgctggagaaccgggaggacatcagccagtatggaattgcccgcttcttcacagagtacttcaacagcgtgtgccagggcacccacatcctcttccgggagttctcctttgtgcaggccaccccccacaacagagtgtccttcctgcgggccttctggcgctgcttcagaacagtgggcaagaatggagacctgctgaccatgaaggagtaccactgcctgctgcagctgctgtgcccagacttccccctggagctgacccagaaggccgccagaattgtgctgatggatgatgccatggactgcctgatgtccttcagtgacttcctgtttgccttccagatccagttctactacagcgagttcctggacagcgtggccgccatctatgaggacctgctgagcggcaagaaccccaacacagtgattgtgcccaccagcagcagcggccagcaccggcagaggcctgccctgggcggggccggcaccctggagggcgtggaggccagcctcttctaccagtgcctggagaacctgtgtgacagacacaagtacagctgccccccaccagccctggtgaaggaggccctgagcaatgtgcagaggctgaccttctacggcttcctgatggccctgagcaagcaccggggcatcaaccaggccctgggcgccctgcctgacaagggggacctgatgcatgaccctgccatggatgaggagctggagcggctggtggtgcgcagcaagctgcacaggaccagccggcagcaccgggccaaggagcccggggccttcggcttccagaggcgggagaagcaggaggccctggagcgggtgtcctctgcctctgtgcccaccccctaccactaccgctgggagccccgggagtag

SEQ ID NO: 36237 - DNA, 732 bp, Artificial Sequence
  Description of Artificial Sequence: Synthetic coding sequence
atggccgccagcagcatcagcagcccctggggcaagcacgtgttcaaggccatcctgatggtgctggtggccctgatcctgctgcacagcgccctggcccagagccggcgggactttgcccctcctggccagcagaagcgggaggcccctgtggatgtgctgacccagatcggccgctctgtgcggggcaccctggatgcctggattggccctgagaccatgcacctggtgtctgagagcagcagccaggtgctgtgggccatcagcagcgccatctctgtggccttctttgccctgagcggcattgctgcccagctgctgaatgccctgggcctggccggggactacctggcccagggcctgaagctgagccctggccaggtgcagaccttcctgctgtggggcgctggggccctggtggtgtactggctgctgagcctgctgctgggcctggtgctggccctgctgggccgcatcctgtggggcctgaagctggtgatcttcctggccggctttgtggccctgatgaggtctgtgcctgaccccagcacccgggccctgctgctgctggccctgctgatcctgtatgccctgctgagccggctgaccggcagccgggccagcggggcccagctggaggccaaggtgcggggcctggagcggcaggtggaggagctgcgctggaggcagaggagagctgccaagggggcccggtctgtggaggaggagtag

SEQ ID NO: 36238 - DNA, 366 bp, Artificial Sequence
  Description of Artificial Sequence: Synthetic coding sequence
atgagcaccctcttccccagcctcttcccccgggtgacagagaccctgtggttcaacctggaccggccctgtgtggaggagacagagctgcagcagcaggagcagcagcaccaggcctggctgcagagcattgctgagaaggacaacaacctggtgcccatcggcaagccagccagcgagcactatgatgatgaggaggaggaggatgatgaagatgatgaggacagcgaggaggacagtgaagatgatgaggacatgcaggacatggatgagatgaatgactacaatgaatctccagatgatggagaggtgaatgaggtggacatggagggcaatgagcaggaccaggaccagtggatgatctag

SEQ ID NO: 36239 - DNA, 366 bp, Artificial Sequence; identical to SEQ ID NO: 36238
  Description of Artificial Sequence: Synthetic coding sequence

SEQ ID NO: 36240 - DNA, 366 bp, Artificial Sequence; identical to SEQ ID NO: 36238
  Description of Artificial Sequence: Synthetic coding sequence

SEQ ID NO: 36241 - DNA, 366 bp, Artificial Sequence; identical to SEQ ID NO: 36238
  Description of Artificial Sequence: Synthetic coding sequence

SEQ ID NO: 36242 - DNA, 138 bp, Artificial Sequence
  Description of Artificial Sequence: Synthetic coding sequence
atgagcaccctcttccccagcctcttcccccgggtgacagagaccctgtggttcaacctggaccggccctgtgtggaggagacagagctgcagcagcaggagcagcagcaccaggcctggctgcagagcatcgcctag

SEQ ID NO: 36243 - DNA, 366 bp, Artificial Sequence; identical to SEQ ID NO: 36238
  Description of Artificial Sequence: Synthetic coding sequence

SEQ ID NO: 36244 - DNA, 198 bp, Artificial Sequence
  Description of Artificial Sequence: Synthetic coding sequence
atgagcaccctcttccccagcctcttcccccgggtgacagagaccctgtggttcaacctggaccggccctgtgtggaggagacagagctgcagcagcaggagcagcagcaccaggcctggctgcagagcattgctgagaaggacaacaacctggtgcccatcggcaagccagccagcgagcactatgatgatgaatag

SEQ ID NO: 36245 - DNA, 366 bp, Artificial Sequence; identical to SEQ ID NO: 36238
  Description of Artificial Sequence: Synthetic coding sequence

SEQ ID NO: 36246 - DNA, 372 bp, Artificial Sequence
  Description of Artificial Sequence: Synthetic coding sequence
atgggcaacagagtgtgctgcggcggctcctggagctgccccagcaccttccagaagaagaagaagacaggcagccagaccaggaggaccctgaagccccagccccagcagctgcagcagaacctgcccaagggccacgagaccaccggccacacctatgagcgggtgctgcagcagcagggcagccaggagaggagccctggcctgatgtctgaggacagcaacctgcactatgctgacatccaggtgtgcagccggccccacgcccgggaggtgaagcacgtgcacctggagaatgccacagaatatgccaccctgcgcttcccccaggccacccccaggtatgacagcaagaatggcaccctggtgtag

SEQ ID NO: 36247 - DNA, 135 bp, Artificial Sequence
  Description of Artificial Sequence: Synthetic coding sequence
atgggcaacagagtgtgctgcggcggctcctggagctgccccagcaccttccagaagaagaagaagacaggcagccagaccaggaggaccctgaagccccagccccagcagctgcagcagaacctgcccaagtag

SEQ ID NO: 36248 - DNA, 711 bp, Artificial Sequence
  Description of Artificial Sequence: Synthetic coding sequence
atgcctggcagccctgtgaccagcggctactatggagtgcggcgctccttcctgagtgacagcgacttccacaacagcaagcagttcagcaatgatgtgtacaccagctctgtgggcaagcccttcccctgtgagagcagcgctggccagagccatgctgccctgctggagccctacttcccccaggagccctatggagactaccggcccccagccctgaccccaaatgccggcagcctcttcagcgccagccccctgccccccctgctgcccccacccttccctggggaccctgcccacttcctgttccgggacagctgggagcagaccctgcctgatggcctgagccagcctgaccctgtgtctgcagatgccctgctgaccctgccccccagcaccagctgcctgagccagctggagagcggcagcatcgcccagcaccggggcagctcctggggcagcagcctggccggggcccagagctacagcctgcacgccctggaggacctgcaccacaccccaggctaccccaccccaccaccctaccccttcacccccttcatgacagtgtccaatgacctgccccccaaggtgggccccctgagcccagatgaggaggccgacaccggcagcctgcatgaccccagcccctgggtgaaggaggatggcagcatcgcctggggcagctatgaatgtagaagagcctactag

SEQ ID NO: 36249 - DNA, 366 bp, Artificial Sequence
  Description of Artificial Sequence: Synthetic coding sequence
atgatgaggagcatcttcctgccccacaggaagctgatctgcagccggcggggccacctggacccccggggctgggaggaggatgagaagatcctggtgcctgatgccatccccaccctgcccccctacgtgttcatcagaacagaccaggcctgtgtgaaggtgtacccaggctttgtgctgatcagaaatggcaagacccaccgccacagaggagactgccacgaggaggaggtgtgtgcccacaggaccctggagactggaggcatggcctgccacgtgggcccccatggagagggccccagcctgtggggcttctggggctcctggaagcaggtgctcttcttcctgcctgtggaccactag

SEQ ID NO: 36250 - DNA, 879 bp, Artificial Sequence
  Description of Artificial Sequence: Synthetic coding sequence
atgagccgcatccccctgggcaaggtgctgctgagaaatgtcatccgccacacagatgcccacaacaagatccaggaggagagtgacatgtggaagatccgggagctggagaagcagatggaggatgcctaccggggcaccaagaggaagatgctgcccagcagcagcagcaggatgagaagtgatggctttgatgaggagagccagcgctactactggaggcccaagaatgagatcagcggcaccctggaggatgacttcctgaaggccaagtcctggaacaagaagttctatgactatgaggccaacatgccagaccgctggggccacagcggctacaaggagctgtacccagaggagtttgaaacagacagcgaccagcaggacatcaccaacgggaagaagaccagcccccaggtgaagagcagcacccatgagagcaggaagcacaagaagagcaagaagagccacaagaagaagcagaagaagaggagccacaagaagcagaagaagagcaagaaggaggccacagacatcacagctgacagcagcagcgagttcagcgaggagactggagccagcggcaccaggaagggcaagcagccccacaagaggaagaagaagagcaggaagaagagcctgaagaagccagccctcttcctggaggccgagagcaacaccagccacagtgatgattctgccagcagcagcagcgaggagagcgaggagcgggacaccaagaagaccaagaggaagaagcgggagaagaaggcccacacctctgtggccaacaatgagatccaggagaggaccaacaagaggaccaactggaaggtggccacagatgagaggtctgctgagagcagtgaagatgactag

SEQ ID NO: 36251 - DNA, 882 bp, Artificial Sequence
  Description of Artificial Sequence: Synthetic coding sequence
atgagccgcatccccctgggcaaggtgctgctgagaaatgtcatccgccacacagatgcccacaacaagatccaggaggagagtgacatgtggaagatccgggagctggagaagcagatggaggatgcctaccggggcaccaagaggaagatgctgcccagcagcagcagcaggatgagaagtgatggctttgatgaggagagccagcgctactactggaggcccaagaatgagatcagcggcaccctggaggatgacttcctgaaggccaagtcctggaacaagaagttctatgactatgaggccaacatgccagaccgctggggccacagcggctacaaggagctgtacccagaggagtttgaaacagacagcagtgaccagcaggacatcaccaacgggaagaagaccagcccccaggtgaagagcagcacccatgagagcaggaagcacaagaagagcaagaagagccacaagaagaagcagaagaagaggagccacaagaagcagaagaagagcaagaaggaggccacagacatcacagctgacagcagcagcgagttcagcgaggagaccggggccagcggcaccaggaagggcaagcagccccacaagaggaagaagaagagcaggaagaagagcctgaagaagccagccctcttcctggaggccgagagcaacaccagccacagtgatgacagcgccagcagcagcagcgaggagagcgaggagcgggacaccaagaagaccaagaggaagaagcgggagaagaaggcccacacctctgtggccaacaatgagatccaggagaggaccaacaagaggaccaactggaaggtggccacagatgagaggtctgctgagagcagtgaagatgactag

SEQ ID NO: 36252 - DNA, 444 bp, Artificial Sequence
  Description of Artificial Sequence: Synthetic coding sequence
atgaacccagccaacaccaggagccagaggaaccccaccaagaagcagaagaagaggagccacaagaagcagaagaagagcaagaaggaggccacagacatcacagctgacagcagcagcgagttcagcgaggagaccggggccagcggcaccaggaagggcaagcagccccacaagaggaagaagaagagcaggaagaagagcctgaagaagccagccctcttcctggaggccgagagcaacaccagccacagtgatgacagcgccagcagcagcagcgaggagagcgaggagcgggacaccaagaagaccaagaggaagaagcgggagaagaaggcccacacctctgtggccaacaatgagatccaggagaggaccaacaagaggaccaactggaaggtggccacagatgagaggtctgctgagagcagtgaagatgactag

SEQ ID NO: 36253 - DNA, 879 bp, Artificial Sequence; identical to SEQ ID NO: 36250
  Description of Artificial Sequence: Synthetic coding sequence

SEQ ID NO: 36254 - DNA, 648 bp, Artificial Sequence
  Description of Artificial Sequence: Synthetic coding sequence
atgtggaagatccgggagctggagaagcagatggaggatgcctaccggggcaccaagaggaagatgctgcccagcagcagcagcaggatgagaagtgatggctttgatgaggagagccagcgctactactggaggcccaagaatgagatcagcggcaccctggaggatgacttcctgaaggccaagtcctggaacaagaagttctatgactatgaggccaacatgccagaccgctggggccacagcggctacaaggagctgtacccagaggagtttgaaacagacagcagtgaccagcaggacatcaccaacgggaagaagaccagcccccaggtgaagagcagcacccatgagagcaggaagcacaagaagagcaagaagagccacaagaagaagcagaagaagaggagccacaagaagcagaagaagagcaagaaggaggccacagacatcacagctgacagcagcagcgagttcagcgaggagactggagccagcggcaccaggaagggcaagcagccccacaagaggaagaagaagagcaggaagaagagcctgaagaagccagccctcttcctggaggccgagagcaacaccagccacagtgatgattctgccagcagcagcagcgaggagagcgaggagtag

SEQ ID NO: 36255 - DNA, 276 bp, Artificial Sequence
  Description of Artificial Sequence: Synthetic coding sequence
atgagccgcatccccctgggcaaggtgctgctgagaaatgtcatccgccacacagatgcccacaacaagatccaggaggagagtgacatgtggaagatccgggagctggagaagcagatggaggatgcctaccggggcaccaagaggaagatgctgcccagcagcagcagcaggatgagaagtgatggctttgatgaggagagccagcgctactactggaggcccaagaatgagatcagcggcaccctggaggatgacttcctgaaggccaagtag

SEQ ID NO: 36256 - DNA, 795 bp, Artificial Sequence
  Description of Artificial Sequence: Synthetic coding sequence
atgtggaagatccgggagctggagaagcagatggaggatgcctaccggggcaccaagaggaagatgctgcccagcagcagcagcaggatgagaagtgatggctttgatgaggagagccagcgctactactggaggcccaagaatgagatcagcggcaccctggaggatgacttcctgaaggccaagtcctggaacaagaagttctatgactatgaggccaacatgccagaccgctggggccacagcggctacaaggagctgtacccagaggagtttgaaacagacagcagtgaccagcaggacatcaccaacgggaagaagaccagcccccaggtgaagagcagcacccatgagagcaggaagcacaagaagagcaagaagagccacaagaagaagcagaagaagaggagccacaagaagcagaagaagagcaagaaggaggccacagacatcacagctgacagcagcagcgagttcagcgaggagactggagccagcggcaccaggaagggcaagcagccccacaagaggaagaagaagagcaggaagaagagcctgaagaagccagccctcttcctggaggccgagagcaacaccagccacagtgatgattctgccagcagcagcagcgaggagagcgaggagcgggacaccaagaagaccaagaggaagaagcgggagaagaaggcccacacctctgtggccaacaatgagatccaggagaggaccaacaagaggaccaactggaaggtggccacagatgagaggtctgctgagagcagtgaagatgactag

SEQ ID NO: 36257 - DNA, 879 bp, Artificial Sequence; identical to SEQ ID NO: 36250
  Description of Artificial Sequence: Synthetic coding sequence

SEQ ID NO: 36258 - DNA, 1167 bp, Artificial Sequence
  Description of Artificial Sequence: Synthetic coding sequence
atgaagaccctgattgctgcctacagcggcgtgctgcggggggagcggcaggccgaggccgacaggagccagaggagccatggaggccctgccctgagccgggagggcagcggccgctggggcaccggcagcagcatcctgagcgccctgcaggacctcttctctgtgacctggctgaacagaagcaaggtggagaagcagctgcaggtgatctctgtgctgcagtgggtgctgtccttcctggtgctgggcgtggcctgcagcgccatcctgatgtacatcttctgcacagactgctggctgattgctgtgctgtacttcacctggctggtgtttgactggaacacccccaagaagggcggccgccgcagccagtgggtgaggaactgggccgtgtggagatacttccgggactacttccccatccagctggtgaagacccacaacctgctgaccaccaggaactacatcttcggctaccacccccacggcatcatgggcctgggcgccttctgcaacttcagcacagaggccacagaggtgtccaagaagtttcctggcatccggccctacctggccaccctggccggcaacttcaggatgcctgtgctgcgggagtacctgatgtctgggggcatctgccctgtgtcccgggacaccatcgactacctgctgagcaagaatggcagcggaaatgccatcatcatcgtggtgggcggcgctgctgagagcctgagctccatgcctgggaagaatgctgtgaccctgaggaacaggaagggctttgtgaagctggccctgcggcatggagctgacctggtgcccatctacagctttggagaaaatgaggtgtacaagcaggtgatctttgaggagggctcctggggccgctgggtgcagaagaagttccagaagtacatcggctttgccccctgcatcttccacggccggggcctcttcagcagtgacacctggggcctggtgccctacagcaagcccatcaccaccgtggtgggggagcccatcaccatccccaagctggagcaccccacccagcaggacatcgacctgtaccacaccatgtacatggaggccctggtgaagctgtttgacaagcacaagaccaagtttggcctgcctgagacagaggtgctggaggtgaactag

SEQ ID NO: 36259 - DNA, 420 bp, Artificial Sequence
  Description of Artificial Sequence: Synthetic coding sequence
atgggcgccggcaagaaggagcacacaggccgcctggtgattggagaccacaagagcaccagccacttcagaactggagaggaggacaagaagatcaatgaggagctggagagccagtaccagcagagcatggacagcaagctgagcggccgctacagaagacactgcggcctgggcttcagcgaggtggaggaccatgatggagaaggagatgtggccggagatgatgatgatgatgatgatgacagcccagaccctgagagcccagatgacagcgagagtgacagcgagagcgagaaggaggagagcgctgaggagctgcaggccgctgagcacccagatgaggtggaggaccccaagaacaagaaggatgccaagagcaactacaagatgatgtttgtgaagagcagcggcagctag

SEQ ID NO: 36260 - DNA, 1524 bp, Artificial Sequence
  Description of Artificial Sequence: Synthetic coding sequence
atggccgccccctgtggcagcgagctgcctgccaacagccccctgaagatccccaagatggaggtgctgagccctgccagccctgggggcctgagtgatggcaaccccagcctgagtgaccccagcacccccaggggggccagccccctgggccctggcagcgctgctggcagcggggctgctgccagcggcggcctgggcctgggcctgggcggccgctctgctgccagcagctctgtgtccttcagccctgggggcggcggcggcggcgctgctgctgctgctgctgctgcctgccggggcatgtcctggaccccagctgagaccaatgccctgattgctgtgtggggcaatgaaaggctggtggaggcccgctaccagcagctggagggcgccggcaccgtgtttggcagcaaggcccctggccctgccatgtatgaaagagtgtcccgggccctggccgagctgggctatgaaagaacacccagccagtgccgggagcgcatcaaggagctggagagtgatggcagcaccatggaggactacagccaggaggactggggcaaccacagccaggacctgcacggctaccccacagaccaggagctggatgagatccctgtgaccaagaggaccctgaagatcaagcaggagagcagcgaggaggcccagaagagggacatcatgcagaacatcgtgcagatcctggagagcgtgcagctgaagtgggagctgttccagagctggacagacttcagccggctgcacctgagcaacaagctggccatcttcggcatcggctacaacacccgctggaaggaggacatccgctaccactatgcagagatcagcagccaggtgcccctgggcaagaggctgcgggagtacttcaacagcgagaagccagagggccgcatcatcatgaccagggtgcagaagatgaactggaagaatgtgtactacaagttcctggagatcaccatcagcgaggcccgctgcctggagctgcacatggagattgactggatccccatcgcccacagcaagcccactggaggaaatgtggtgcagtacctgctgcccggcggcatccccaagagccctggcctgtatgccatcggctatgaagaatgtattgagcggcccctgagcccccacatggagcagagcagcctggaccccgggaaggagggccgggtggacctggagaccctgagcgcccaggccagcctgcaggtggagattgagcccacccgcatcatctactgctacctgggcattgctgaggtgaggaccctgcagcagtgcctcttcctgcacttccaggccaacaccaagaccttcagcaaggactgggtgggcatcaatggcttcctgagccagaactgcatcgtggaccccggggtgagccccaagagcatctacatcaagtttgtggaggtggagcgggacttcctgtctgctggcagcctggtggagtgcctggagaaggccatcggctaccccctgaagttcaacaactag

SEQ ID NO: 36261 - DNA, 1680 bp, Artificial Sequence
  Description of Artificial Sequence: Synthetic coding sequence
atggccgccccctgtggcagcgagctgcctgccaacagccccctgaagatccccaagatggaggtgctgagccctgccagccctgggggcctgagtgatggcaaccccagcctgagtgaccccagcacccccaggggggccagccccctgggccctggcagcgctgctggcagcggggctgctgccagcggcggcctgggcctgggcctgggcggccgctctgctgccagcagctctgtgtccttcagccctgggggcggcggcggcggcgctgctgctgctgctgctgctgcctgccggggcatgtcctggaccccagctgagaccaatgccctgattgctgtgtggggcaatgaaaggctggtggaggcccgctaccagcagctggagggcgccggcaccgtgtttggcagcaaggcccctggccctgccatgtatgaaagagtgtcccgggccctggccgagctgggctatgaaagaacacccagccagtgccgggagcgcatcaagaccctgcggcgctgctacagccgggtgaaggagcacggcgtgggcaagaggaagagcagctacacctttgagcagctggagcaggtgtttggccagggcggctgggatgcccagccctgccagcctgtgctgatcaacagcagcggcctgtaccaggagctggagagtgatggcagcaccatggaggactacagccaggaggactggggcaaccacagccaggacctgcacggctaccccacagaccaggagctggatgagatccctgtgaccaagaggaccctgaagatcaagcaggagagcagcgaggaggcccagaagagggacatcatgcagaacatcgtgcagatcctggagagcgtgcagctgaagtgggagctgttccagagctggacagacttcagccggctgcacctgagcaacaagctggccatcttcggcatcggctacaacacccgctggaaggaggacatccgctaccactatgcagagatcagcagccaggtgcccctgggcaagaggctgcgggagtacttcaacagcgagaagccagagggccgcatcatcatgaccagggtgcagaagatgaactggaagaatgtgtactacaagttcctggagatcaccatcagcgaggcccgctgcctggagctgcacatggagattgactggatccccatcgcccacagcaagcccactggaggaaatgtggtgcagtacctgctgcccggcggcatccccaagagccctggcctgtatgccatcggctatgaagaatgtattgagcggcccctgagcccccacatggagcagagcagcctggaccccgggaaggagggccgggtggacctggagaccctgagcgcccaggccagcctgcaggtggagattgagcccacccgcatcatctactgctacctgggcattgctgaggtgaggaccctgcagcagtgcctcttcctgcacttccaggccaacaccaagaccttcagcaaggactgggtgggcatcaatggcttcctgagccagaactgcatcgtggaccccggggtgagccccaagagcatctacatcaagtttgtggaggtggagcgggacttcctgtctgctggcagcctggtggagtgcctggagaaggccatcggctaccccctgaagttcaacaactag

SEQ ID NO: 36262 - DNA, 990 bp, Artificial Sequence
  Description of Artificial Sequence: Synthetic coding sequence
atggaggactacagccaggaggactggggcaaccacagccaggacctgcacggctaccccacagaccaggagctggatgagatccctgtgaccaagaggaccctgaagatcaagcaggagagcagcgaggaggcccagaagagggacatcatgcagaacatcgtgcagatcctggagagcgtgcagctgaagtgggagctgttccagagctggacagacttcagccggctgcacctgagcaacaagctggccatcttcggcatcggctacaacacccgctggaaggaggacatccgctaccactatgcagagatcagcagccaggtgcccctgggcaagaggctgcgggagtacttcaacagcgagaagccagagggccgcatcatcatgaccagggtgcagaagatgaactggaagaatgtgtactacaagttcctggagatcaccatcagcgaggcccgctgcctggagctgcacatggagattgactggatccccatcgcccacagcaagcccactggaggaaatgtggtgcagtacctgctgcccggcggcatccccaagagccctggcctgtatgccatcggctatgaagaatgtattgagcggcccctgagcccccacatggagcagagcagcctggaccccgggaaggagggccgggtggacctggagaccctgagcgcccaggccagcctgcaggtggagattgagcccacccgcatcatctactgctacctgggcattgctgaggtgaggaccctgcagcagtgcctcttcctgcacttccaggccaacaccaagaccttcagcaaggactgggtgggcatcaatggcttcctgagccagaactgcatcgtggaccccggggtgagccccaagagcatctacatcaagtttgtggaggtggagcgggacttcctgtctgctggcagcctggtggagtgcctggagaaggccatcggctaccccctgaagttcaacaactag

SEQ ID NO: 36263 - DNA, 1182 bp, Artificial Sequence
  Description of Artificial Sequence: Synthetic coding sequence
atgtggtggagggtgctgagcctgctggcctggttccccctgcaggaggccagcctgaccaaccacacagagaccatcaccgtggaggagggccagaccctgaccctgaagtgtgtgaccagcctgaggaagaacagcagcctgcagtggctgacccccagcggcttcaccatcttcctgaatgagtacccagccctgaagaacagcaagtaccagctgctgcaccacagcgccaaccagctgagcatcaccgtgcccaacgtgaccctgcaggatgagggcgtgtacaagtgcctgcactacagcgacagcgtgtccaccaaggaggtgaaggtgattgtgctggccacccccttcaagcccatcctggaggccagcgtcatcaggaagcagaatggagaggagcacgtggtgctgatgtgcagcaccatgaggagcaagcccccaccccagatcacctggctgctgggcaacagcatggaggtgtctgggggcaccctgcacgagtttgaaacagatggcaagaagtgcaacaccaccagcaccctcatcatccacacctacggcaagaacagcacagtggactgcatcatccgccaccggggcctgcagggcaggaagctggtggcccccttccgctttgaggacctggtgacagatgaggagacagccagtgatgccctggagaggaacagcctgagcagccaggacccccagcagcccaccagcacagtgtctgtgacagaggacagcagcaccagcgagattgacaaggaggagaaggagcagaccacccaggaccctgacctgaccacagaggccaacccccagtacctgggcctggccaggaagaagagcggcatcctgctgctgaccctggtgtccttcctgatcttcatcctcttcatcatcgtgcagctgttcatcatgaagctgaggaaggcccacgtgatctggaagaaggaaaatgaggtgtctgagcacaccctggagagctaccgcagccgcagcaacaatgaggagaccagcagcgaggagaagaatggccagagcagccaccccatgcgctgcatgaactacatcaccaagctgtacagcgaggccaagaccaagaggaaagaaaatgtgcagcacagcaagctggaggagaagcacatccaggtgcctgagagcatcgtgtag

SEQ ID NO: 36264 - DNA, 924 bp, Artificial Sequence
  Description of Artificial Sequence: Synthetic coding sequence
atgagcaagaggaagctgatccccaagctgagcatccagagccctgtgctgcacaccaacctgaatgtgcagagcacccacccccccctgaagaaggaggacctgcaccgcatcagcaaggacagcctggagagtgacagcgagagcctgacccaggagatcatgtgccacagcgagtttgatgaccgcatcagaggaaatggcatggagccagacagcctggatgaggaggagagcccccgctggggcagcctgcacgagatggaggaggaggccagcggcaaggccgcccagatggcccgggagcagaaccaccacacctgggaccagggcgccaacaaccggcagcagcccatcgaggacaagtacagcgacctgcgctatgaccccaactggaagagcaagaaggaggagggccagctgctgtctgtggaggccctgcctgagagcacagacagcagcctggagaacctgcccctggcccccctgtaccccagccaggagacctccatggagctgagcggcggcaaaggagagcagaaggagagcccccagagcgctgccagcctgctgggcagcgagttcctgagccccaactatgagcacggggcccggcgcagcaagcccttcagcgagctgagtgacagcgacctggaggagaagagcagcagcctgagcccctacgtgaagagcagcagcagccacaatgaggtgttcctgcccggcagccggggccccaggaggaggaagagcaagcagcactttgtggagaagaacaagctgaccctgggcctgcccacccccaagacagacagctacctgcagctgcacaacaagaagagaggagagagccaccctgagcaggtgatcctgcgggtgaacagcctgcccagagatggcttcaagaccttctggagccagtag

SEQ ID NO: 36265 - DNA, 2337 bp, Artificial Sequence
  Description of Artificial Sequence: Synthetic coding sequence
atgagcaagaggaagctgatccccaagctgagcatccagagccctgtgctgcacaccaacctgaatgtgcagagcacccacccccccctgaagaaggaggacctgcaccgcatcagcaaggacagcctggagagtgacagcgagagcctgacccaggagatcatgtgccacagcgagtttgatgaccgcatcagaggaaatggcatggagccagacagcctggatgaggaggagagcccccgctggggcagcctgcacgagatggaggaggaggccagcggcaaggccgcccagatggcccgggagcagaaccaccacacctgggaccagggcgccaacaaccggcagcagcccatcgaggacaagtacagcgacctgcgctatgaccccaactggaagagcaagaaggaggagggccagctgctgtctgtggaggccctgcctgagagcacagacagcagcctggagaacctgcccctggcccccctgtaccccagccaggagacctccatggagctgagcggcggcaaaggagagcagaaggagagcccccagagcgctgccagcctgctgggcagcgagttcctgagccccaactatgagcacggggcccggcgcagcaagcccttcagcgagctgagtgacagcgacctggaggagaagagcagcagcctgagcccctacgtgaagagcagcagcagccacaatgaggtgttcctgcccggcagccggggccccaggaggaggaagagcaagcagcactttgtggagaagaacaagctgaccctgggcctgcccacccccaagacagacagctacctgcagctgcacaacaagaagagaggagagagccaccctgagcagatctcctaccctgtgcgggtgacagacaagaccagcatccagaatgccaaggagatggagaatgctgccatcgaccctgaggacaagtggcaccagagggcccagcagctgaagaactaccaggagcactggagccagtatgagagcaccaagagcagcaatgtgccccggggccagcccagcgacatggtgaatgaccaccagcccagcagaagacctgccaagctgaagatcaggaagcagtgcaagcaccagaatggcctgaagagcagcaccacagaggaggtgacagccagccagggcaaccagaacaaccccccccggcagcagcagaaccagaacaagcccctggacaccagcaccaagccagagagcatcgtcatcatgcacgccagcaacaatgatgtgcaggccagccgggccctgcggagccacaacctgaaggagaccagcaacacctttgccccacccaagcaggcctttgacaaggtgctgagcaagaacagcacaggctgtgacagcggcctgaatgtgaacaaggagcggggccacaaggaccaggaggagaagcgcttctcctaccagcagctgcacaccctgagtgacatggacctgaacaacctgaatgagctgagcaagagacatgtgctgctgagccagaagggcagccagtttgtgtaccacatcaacacccacggcagcaccaagaacaagaagcagctgaagcagccctacacagagaccaagtacagaaacctggagatgctgtggaagttccacagcagcagtgacagccagacagtgcgggccagcccagacagctggctgacccagatcatggagcagcaccagcaggccctggtgcagctgacagatgtgcagcccagcgagggcgccctgagctctgtgaccctgccccccatcctgagccgggtggagagcgagagccagctgagcagcgagaggagccagaggaaccaggtgaagatcagccgcagcaacagcgagggctacctgttccagctggagaagggcaagaagcacaagaagaggagcagcagcaagaacaccaagctgaagggctaccagaagagagatgtgaagctgggcggcctgggccctgactttgagagcatccgggacaagacccagaagctgatccagcagaaggagtatgccaagcaggtgaaggagtacaacatgaagaccctgagcatcctgagcaagccccagacagagaagacccagaagaagagcgccatcccccggcagaaggccctggagtatgccaagaccatccccaagcccaagcccagcaacctgacccaccaggccagcaaggagcagaagaaccccacctacgccggcaaggaggagagcctgcctgagatcagcctgctggagatcctgcagaacagacatgagcgggagaagcaggccgtggccgccttcaaggtgctgcacatcgtgtag

SEQ ID NO: 36266 - DNA, 942 bp, Artificial Sequence
  Description of Artificial Sequence: Synthetic coding sequence
atgccctggaaggaggagagcgagttcaccaagcaggacaaggccgcccgggtcatccagcaggcctggaagagcttcctgaatgtggccatcttccagcacttcaagagcctgattgacctgcggcggcagggcgagccccggcagatcgtgaagtacatcaaccccaaggaggccgagctgctggatgctgctgctggcatccacgtgcgcttccggctgggcggcgtgaagttccccccagacatctactacaagatcttcacccaccggcccatcgaggacctgtgtgccaacagccccaggaactatgccaagctgcctgccaagcacaccagccacaacaagaatgaccacctgcaggaggaggaccacagcggctggtaccacagaattgaaaataatggctggaggcctgtgtctgacaccttctggctgagcacagatggcatggtggtggaggacaagaaggagagcgagttccacttcagcaagctgaagaggcggcaggacctggagaagaagaggaagctgaggaagattgagtggatgaggcagatgtactacagcggcagcctggaggccaagagcacccaccacgagaccctgggcctcatccacacagccaccaagggcctcatccgggcctttgaagatggcggcatcgacagcgtgatggagtgggaggtggatgaggtgctgaactggaccaacaccctgaactttgatgagtacatcgcctcctggaaggagatcgccaccagcaacagcagcgccaacttcaagggcttccgcttcaaccaggcccagaagaacatctacaactacggcggggacatcagcaagatgcagatgggcatcccagatgacacctactatgaaaatgtgtaccaggagcccaacgtgacccggctgaccccagacagcacctacggcctgtag

SEQ ID NO: 36267 - DNA, 942 bp, Artificial Sequence; identical to SEQ ID NO: 36266
  Description of Artificial Sequence: Synthetic coding sequence

SEQ ID NO: 36268 - DNA, 369 bp, Artificial Sequence
  Description of Artificial Sequence: Synthetic coding sequence
atgaccagccctgagatcgccagcctgtcctggggccagatgaaggtgaagggcagcaacaccacctacaaggactgcaaggtgtggccaggcggcagcaggacctgggactggagggagactggaacagagcacagccctggggtgcagcctgcagatgtgaaggaggtggtggagaagggcgtgcagaccctggtgattggccggggcatgtctgaggccctgaaggtgcccagcagcacagtggagtacctgaagaagcacggcattgatgtgcgggtgctgcagacagagcaggccgtgaaggagtacaatgccctggtggcccagggcgtgcgggtgggcggcgtcttccacagcacctgctag

SEQ ID NO: 36269 - DNA, 369 bp, Artificial Sequence; identical to SEQ ID NO: 36268
  Description of Artificial Sequence: Synthetic coding sequence

SEQ ID NO: 36270 - DNA, 882 bp, Artificial Sequence
  Description of Artificial Sequence: Synthetic coding sequence
atggctgctgctgctgctgctgctgtggccggcgtgggccggggcggcggcggcgctgagccccggcaggagaggagccgggcccggggctgggccggcgtggagaggtctgagggccgcagcaggatggagcctggagaggagctggaggaggagggcagccctgggggcagagaagatggcttcaccgctgagcacctggccgctgaggccatggctgctgacatggacccctggctggtgtttgatgcccggaccaccccagccacagagctggatgcctggctggccaagtacccacccagccaggtgaccaggtatggagaccccggcagccccaacagcgagcctgtgggctggattgctgtgtatggccagggctacagccccaacagcggagatgtgcagggcctgcaggccgcctgggaggccctgcagaccagcggccggcccatcaccccaggcaccctgcggcagctggccatcacccaccacgtgctgagcggcaagtggctgatgcacctggcccctggcttcaagctggaccacgcctgggccggcatcgcccgggctgtggtggagggccagctgcaggtggccaaggtgagcccccgggccaaggagggcggccggcaggtgatctgtgtgtacacagatgacttcacagaccggctgggcgtgctggaggccgacagcgccatccgggctgctggcatcaagtgcctgctgacctacaagccagatgtgtacacctacctgggcatctaccgggccaaccgctggcacctgtgccccaccctgtatgagagccgcttccagctgggcggcagcgcccggggcagccgggtgctggaccgggccaacaacgtggagctgacctag

SEQ ID NO: 36271 - DNA, 879 bp, Artificial Sequence
  Description of Artificial Sequence: Synthetic coding sequence
atggctgctgctgctgctgctgctgtggccggcgtgggccggggcggcggcggcgctgagccccggcaggagaggagccgggcccggggctgggccggcgtggagaggtctgagggccgcaggatggagcccggggaggagctggaggaggagggcagccctgggggccgggaggatggcttcaccgctgagcacctggccgctgaggccatggctgctgacatggacccctggctggtgtttgatgcccggaccaccccagccacagagctggatgcctggctggccaagtacccacccagccaggtgacccgctacggggaccccggcagccccaacagcgagcctgtgggctggattgctgtgtatggccagggctacagccccaacagcggagatgtgcagggcctgcaggccgcctgggaggccctgcagaccagcggccggcccatcaccccaggcaccctgcggcagctggccatcacccaccacgtgctgagcggcaagtggctgatgcacctggcccctggcttcaagctggaccacgcctgggccggcatcgcccgggctgtggtggagggccagctgcaggtggccaaggtgagcccccgggccaaggagggcggccggcaggtgatctgtgtgtacacagatgacttcacagaccggctgggcgtgctggaggccgacagcgccatccgggccgccggcatcaagtgcctgctgacctacaagccagatgtgtacacctacctgggcatctaccgggccaaccgctggcacctgtgccccaccctgtatgagagccgcttccagctgggcggcagcgcccggggcagccgggtgctggaccgggccaacaacgtggagctgacctag

SEQ ID NO: 36272 - DNA, 165 bp, Artificial Sequence
  Description of Artificial Sequence: Synthetic coding sequence
atgctgggccgcatcaaggcccaggccttcggctttgaccagaccttccagagctacaggaaggatgactttgtgatgggcttcttccagaggcccaagtgctacagccagtttgaggtgaccttccgcttcttctggaccatggaccacatccgcttctgctag

SEQ ID NO: 36273 - DNA, 804 bp, Artificial Sequence
  Description of Artificial Sequence: Synthetic coding sequence
atggccactggagagctgggggacctgggcggctactacttccgcttcctgccccagaagaccttccagagcctgagcagcaaggagatcaccagccggctgcggcagtggagcatgctgggccgcatcaaggcccaggccttcggctttgaccagaccttccagagctacaggaaggatgactttgtgatggccttcttcaaggaccccaacgtcatccccaacctgaagctgctgagtgacagcagcggccagtggatcatcctgggcacagaggtgaagaagattgaggccatcaacgtgccctgcacccagctgtccatgtccttcttccaccggctgtatgatgaagatattgtgcgggacagcggccacatcgtgaagtgcctggacagcttctgtgaccccttcctgatcagtgatgagctgcggcgggtgctgctggtggaggacagcgagaagtatgagatcttcagccagcctgaccgggaggagttcctgttctgcctcttcaagcacctgtgcctgggcggggccctgtgccagtatgaagatgtgatcagcccctacctggagaccaccaagctgatctacaaggacctggtgtctgtgaggaagaacccccagaccaagaagatccagatcaccagcagcgtcttcaaggtgtctgcctatgattctgctggcatgtgctaccccagcgccaagaaccacgagcagaccttctcctacttcatcgtggaccccatcagaagacacctgcacgtgctgtaccactgctatggagtgggggacatgtcctag

SEQ ID NO: 36274 - DNA, 300 bp, Artificial Sequence
  Description of Artificial Sequence: Synthetic coding sequence
atggccactggagagctgggggacctgggcggctactacttccgcttcctgccccagaagaccttccagagcctgagcagcaaggagatcaccagccggctgcggcagtggagcatgctgggccgcatcaaggcccaggccttcggctttgaccagaccttccagagctacaggaaggatgactttgtgatggccttcttcaaggaccccaacgtcatccccaacctgaagctgctgagtgacagcagcggccagtggatcatcctgggctttgccagcggccgcctgaggaagatctag

SEQ ID NO: 36275 - DNA, 444 bp, Artificial Sequence
  Description of Artificial Sequence: Synthetic coding sequence
atggccctgaacaacgtgtccctgagcagcggggaccagaggagccgggtggcctaccgcagcagccatggagacctgcggccccgggccagcgccctggccatggtgtctggagatggcttcctggtgtccaggcctgaggccatccacctgggcccccggcaggccgtgcggcccagcgtgcgggcagagagccggcgggtggatggcggcggccgcagcccccgggagccagatggccggggccgcagccggcaggcccgcttcagcccctaccccatcccagctgtggagccagacctgctgcggtctgtgctgcagcagaggctgattgccctgggcgtgaccacctggaccctgaagctgtctgagagcgccaccccagacctgcgctggtgcagcacctgcagccacagcaacatctttgagatcctggtgatctag

SEQ ID NO: 36276 - DNA, 756 bp, Artificial Sequence
  Description of Artificial Sequence: Synthetic coding sequence
atgacccagctgcctgagctgggcctgcggagccccaacaacaagagccccaccggcccccaccccctggagcacctgctggcccggctgctgaagagaagaagaagaagcaccctgatgagcagccccaggagcctgctgtgcagcatcagcggccctggcagccacctgctgagcacccaccccatcctgtgccacagcgtgtaccagcccccccagcctgccagccggccccaggccaagcgctaccagggcctgctgcctgtgcccctggccccccaccccctgtgcctgagcggccagctgtacctgcccaacatcccctgcaccgtgattgatggctgcggccctgtgatcagccacctgaagctgaccatgtacccctggggcctgccccccagccacctgggcagcagcagccccttcagcgccaacatggagcagtgggactactacaagagccagaccaggtttgcccccttcctgcctgagagcttctgtggcagccccctgcccagcgagcagagcagccggcccttcggcctggccttcaaggtgctgtgtgccgccacctgccagcccccccagttccagctgctgtggctgtgcccctacaagctggacctgcaccagaggatctgcctgccccccaacctggccctggtgctgctgggcgccctgtggaccagccccccacctggcagcttcctgcagcccccctacaaccggccctacaagctgtacaagaccaactag

SEQ ID NO: 36277 - DNA, 756 bp, Artificial Sequence; identical to SEQ ID NO: 36276
  Description of Artificial Sequence: Synthetic coding sequence

SEQ ID NO: 36278 - DNA, 666 bp, Artificial Sequence
  Description of Artificial Sequence: Synthetic coding sequence
atgtctgcccacatgagcggcctggagatcatggatgaggaccagctgatcaaggatgtgctggacaagttcctgaactgccacgagcagacctatgatgaggagttcctgaacaccttcacccacctgagccaggaggaccacgtgtccaagaggggcgtgtttggaacagacagcagcgagaacatcttcaccagcgccaaggtgacccacaagaatgaagcagatgactaccacctgaggaacaagaccatcttcctgcggaccagcagccagtgcctggaggagcaggtggacaacttcctggacctggaggacctggacatggatgaggagatcaagccccagatgtctgaggacctgctgctgctgcctggagaggtggagcaggatgtgtccaccagcatccccagctgcatcccctttgtggcccagccccccacctgtgaggtgaagcccaagcccagcgtgaagaggatggacaagcagacagaggagatcctgggagatgaggtgcagctgttcagcctggatgaggagtttgattatgacaacgtgatgctgaccagcaagttcagccctgctgagattgagaacatcaaggagctgtgcaagcagcagaagaggaaggacaccagcccagacctggagaagagctgtgactag

SEQ ID NO: 36279 - DNA, 444 bp, Artificial Sequence
  Description of Artificial Sequence: Synthetic coding sequence
atgtctgcccacatgagcggcctggagatcatggatgaggaccagctgatcaaggatgtgctggacaagttcctgaactgccacgagcagacctatgatgaggagttcctgaacaccttcacccacctgagccaggacctgctgctgctgcctggagaggtggagcaggatgtgtccaccagcatccccagctgcatcccctttgtggcccagccccccacctgtgaggtgaagcccaagcccagcgtgaagaggatggacaagcagacagaggagatcctgggagatgaggtgcagctgttcagcctggatgaggagtttgattatgacaacgtgatgctgaccagcaagttcagccctgctgagattgagaacatcaaggagctgtgcaagcagcagaagaggaaggacaccagcccagacctggagaagagctgtgactag

SEQ ID NO: 36280 - DNA, 504 bp, Artificial Sequence
  Description of Artificial Sequence: Synthetic coding sequence
atgtctgcccacatgagcggcctggagatcatggatgaggaccagctgatcaaggatgtgctggacaagttcctgaactgccacgagcagacctatgatgaggagttcctgaacaccttcacccacctgagccaggaggaccacgtgtccaagaggggcgtgtttggaacagacagcagcgagaacatcttcaccagcgccaaggtgacccacaagaatgaagcagatgactaccacctgaggaacaagaccatcttcctgcggaccagcagccagtgcctggaggagcaggtggacaacttcctggacctggaggacctggacatggatgaggagatcaagccccagatgtctgaggacctgctgctgctgcctggagaggtggagcaggatgtgtccaccagcatccccagctgcatcccctttgtggcccagccccccacctgtgaggtgaagcccaagcccagcgtgaagaggatggacaagcagacagaggagagctag

SEQ ID NO: 36281 - DNA, 273 bp, Artificial Sequence
  Description of Artificial Sequence: Synthetic coding sequence
atgtctgcccacatgagcggcctggagatcatggatgaggaccagctgatcaaggatgtgctggacaagttcctgaactgccacgagcagacctatgatgaggagttcctgaacaccttcacccacctgagccaggacctgctgctgctgcctggagaggtggagcaggatgtgtccaccagcatccccagctgcatcccctttgtggcccagccccccacctgtgaggtgaagcccaagcccagcgtgaagaggatggacaagcagacctag

SEQ ID NO: 36282 - DNA, 252 bp, Artificial Sequence
  Description of Artificial Sequence: Synthetic coding sequence
atgtctgcccacatgagcggcctggagatcatggatgaggaccagctgatcaaggatgtgctggacaagttcctgaactgccacgagcagacctatgatgaggagttcctgaacaccttcacccacctgagccaggaggaccacgtgtccaagaggggcgtgtttggaacagacagcagcgagaacatcttcaccagcgccaaggtgacccacaagaatgaagcagatgactaccacctgaggaacaagtag

SEQ ID NO: 36283 - DNA, 543 bp, Artificial Sequence
  Description of Artificial Sequence: Synthetic coding sequence
atgtctgcccacatgagcggcctggagatcatggatgaggaccagctgatcaaggatgtgctggacaagttcctgaactgccacgagcagacctatgatgaggagttcctgaacaccttcacccacctgagccaggaggaccacgtgtccaagaggggcgtgtttggaacagacagcagcgagaacatcttcaccagcgccaaggtgacccacaagaatgaagcagatgactaccacctgaggaacaagaccatcttcctgcggaccagcagccagtgcctggaggagcaggtggacaacttcctggacctggaggacctggacatggatgaggagatcaagccccagatgtctgaggacctgctgctgctgcctggagaggtggagcaggatgtgtccaccagcatccccagctgcatcccctttgtggcccagccccccacctgtgaggtgaagcccaagcccagcgtgaagaggatggacaagcagacagaggagatcctgggagatgaggtgcagctgttcagcctggatgaggagtag

SEQ ID NO: 36284 - DNA, 360 bp, Artificial Sequence
  Description of Artificial Sequence: Synthetic coding sequence
atgtctgcccacatgagcggcctggagatcatggatgaggaccagctgatcaaggatgtgctggacaagttcctgaactgccacgagcagacctatgatgaggagttcctgaacaccttcacccacctgagccaggaggaccacgtgtccaagaggggcgtgtttggaacagacagcagcgagaacatcttcaccagcgccaaggtgacccacaagaatgaagcagatgactaccacctgaggaacaagaccatcttcctgcggaccagcagccagtgcctggaggagcaggtggacaacttcctggacctggaggacctggacatggatgaggagatcaagccccagatgtctgagtag

SEQ ID NO: 36285 - DNA, 444 bp, Artificial Sequence; identical to SEQ ID NO: 36279
  Description of Artificial Sequence: Synthetic coding sequence

SEQ ID NO: 36286 - DNA, 1461 bp, Artificial Sequence
  Description of Artificial Sequence: Synthetic coding sequence
atggtggccagcgctggcagcctgtttggaggcatggtgctgaagaagttcctgaaggagatccagagcatcctgcccggcatcagcgccaagctgacctggaccagcgaggagggcagctacagccaggacatgactggagtgacccccttccagatgatctttgaggtggatgagaagcccaggaccctgatgacagactgcctggtgatcaagcacttcctgaggaagatcatcatggtgcaccccaaggtgcgcttccacttctctgtgaaggtgaatggcatcctgagcacagagatcttcggcgtggagaatgagcccaccctgaacctgggcaatggcatcgccctgctggtggacagccagcactacgtgtcccggcccaactttggcaccatcgagagccactgcagccgcatccaccctgtgctgggccaccctgtgatgctgttcatcccagaagatgtggccggcatggacctgctgggggagctgatcctgaccccagctgctgccctgtgccccagccccaaggtgagcagcaaccagctgaaccgcatcagctctgtgtccatcttcctgtatggccccctgggcctgcccctcatcctgagcacctgggagcagcccatgaccaccttcttcaaggacaccagcagcctggtggactggaagaagtaccacctgtgcatgatccccaacctggacctgaacctggaccgggacctggtgctgcctgatgtgtcctaccaggtggagagcagcgaggaggaccagagccagaccatggacccccagggccagaccctgctgctcttcctgtttgtggacttccacagcgccttccctgtgcagcagatggagatctggggcgtgtacaccctgctgaccacccacctgaatgccatcctggtggagagccacagcgtggtgcagggcagcatccagttcaccgtggacaaggtgctggagcagcaccaccaggccgccaaggctgctgacacccaggagttccgcaccaagctgcacaaggtgttccgggagatcacccagcaccagttcctgcaccactgcagctgtgaggtgaagcagcagctgaccctggagaagaaggacagcgcccagggcacagaagatgccccagacaacagcagcctggagctgctggccgacaccagcggccaggccgagaacaagaggctgaagaggggcagccccagaattgaggagatgagggccctgcggagcgcccgggcccccagccccagcgaggccgcccccaggaggcctgaggccacagctgcccccctgaccccccggggccgggagcaccgggaggcccacggccgggccctggcccctggccgggccagcctgggcagccggctggaggatgtgctgtggctgcaggaggtgagcaacctgtctgagtggctgagccccagccctggcccctag

SEQ ID NO: 36287 - DNA, 2034 bp, Artificial Sequence
  Description of Artificial Sequence: Synthetic coding sequence
atgggcagccgctgccgggcctgggcctggacccgggcctgggccctggccgagttccaggcccgggcagaggagggcgctgctgctgctgctgctgctgctgggggctaccccagcacaggccgctgccgctgcagcctgcggggcatggagggcacagctgtggccgtgtttgagatcctgcgcttcctgatcatccactggaagtgtgacattgatgtgtccaagggggccctgctggagggccagctggtgatcagcattgagggcctgaacagcaagcaccaggccaatgccctgcactgtgtgaccacccgctggagcctgaccctgctgcccaggcctgagtgcagcggggctgtgtctgcccactgcaacctgcacctgcccggcagcagtgacagccacgcctctgtgccccgggtggccggcatcacagatgcccaccaccacgcctggctgatcatggtggccagcgctggcagcctgtttggaggcatggtgctgaagaagttcctgaaggagatccagagcatcctgcccggcatcagcgccaagctgacctggaccagcgaggagggcagctacagccaggacatgactggagtgacccccttccagatgatctttgaggtggatgagaagcccaggaccctgatgacagactgcctggtgatcaagcacttcctgaggaagatcatcatggtgcaccccaaggtgcgcttccacttctctgtgaaggtgaatggcatcctgagcacagagatctttggagtggagaatgagcccaccctgaacctgggcaatggaattgccctgctggtggacagccagcactacgtgcggcccaactttggcaccatcgagagccactgcagccgcatccaccctgtgctgggccaccctgtgatgctgttcatcccagaagatgtggccggcatggacctgctgggggagctgatcctgaccccagctgctgccctgtgccccagccccaaggtgagcagcaaccagctgaaccgcatcagctctgtgtccatcttcctgtatggccccctgggcctgcccctcatcctgagcacctgggagcagcccatgaccaccttcttcaaggacaccagcagcctggtggactggaagaagtaccacctgtgcatgatccccaacctggacctgaacctggaccgggacctggtgctgcctgatgtgtcctaccaggtggagagcagcgaggaggaccagagccagaccatggacccccagggccagaccctgctgctcttcctgtttgtggacttccacagcgccttccctgtgcagcagatggagatctggggcgtgtacaccctgctgaccacccacctgaatgccatcctggtggagagccacagcgtggtgcagggcagcatccagttcaccgtggacaaggtgctggagcagcaccaccaggccgccaaggcccagcagaagctgcaggccagcctgtctgtggccgtgaacagcatcatgagcatcctgaccggcagcaccaggagcagcttcaggaagatgtgcctgcagaccctgcaggccgctgacacccaggagttccgcaccaagctgcacaaggtgttccgggagatcacccagcaccagttcctgcaccactgcagctgtgaggtgaagcagcagctgaccctggagaagaaggacagcgcccagggcacagaagatgccccagacaacagcagcctggagctgctggccgacaccagcggccaggccgagaacaagaggctgaagaggggcagcccccgcatcgaggagatgagggccctgcggagcgcccgggcccccagccccagcgaggccgccccccggcggcctgaggccacagctgcccccctgaccccccggggccgggagcaccgggaggcccacggccgggccctggcccctggccgggccagcctgggcagccggctggaggatgtgctgtggctgcaggaggtgagcaacctgtctgagtggctgagccccagccctggcccctag

SEQ ID NO: 36288 - DNA, 1536 bp, Artificial Sequence
  Description of Artificial Sequence: Synthetic coding sequence
atggtgctgaagaagttcctgaaggagatccagagcatcctgcccggcatcagcgccaagctgacctggaccagcgaggagggcagctacagccaggacatgactggagtgacccccttccagatgatctttgaggtggatgagaagcccaggaccctgatgacagactgcctggtgatcaagcacttcctgaggaagatcatcatggtgcaccccaaggtgcgcttccacttctctgtgaaggtgaatggcatcctgagcacagagatctttggagtggagaatgagcccaccctgaacctgggcaatggaattgccctgctggtggacagccagcactacgtgtcccggcccaactttggcaccatcgagagccactgcagccgcatccaccctgtgctgggccaccctgtgatgctgttcatcccagaagatgtggccggcatggacctgctgggggagctgatcctgaccccagctgctgccctgtgccccagccccaaggtgagcagcaaccagctgaaccgcatcagctctgtgtccatcttcctgtatggccccctgggcctgcccctcatcctgagcacctgggagcagcccatgaccaccttcttcaaggacaccagcagcctggtggactggaagaagtaccacctgtgcatgatccccaacctggacctgaacctggaccgggacctggtgctgcctgatgtgtcctaccaggtggagagcagcgaggaggaccagagccagaccatggacccccagggccagaccctgctgctcttcctgtttgtggacttccacagcgccttccctgtgcagcagatggagatctggggcgtgtacaccctgctgaccacccacctgaatgccatcctggtggagagccacagcgtggtgcagggcagcatccagttcaccgtggacaaggtgctggagcagcaccaccaggccgccaaggcccagcagaagctgcaggccagcctgtctgtggccgtgaacagcatcatgagcatcctgaccggcagcaccaggagcagcttcaggaagatgtgcctgcagaccctgcaggccgctgacacccaggagttccgcaccaagctgcacaaggtgttccgggagatcacccagcaccagttcctgcaccactgcagctgtgaggtgaagcagctgaccctggagaagaaggacagcgcccagggcacagaagatgccccagacaacagcagcctggagctgctggccgacaccagcggccaggccgagaacaagaggctgaagaggggcagcccccgcatcgaggagatgagggccctgcggagcgcccgggcccccagccccagcgaggccgccccccggcggcctgaggccacagctgcccccctgaccccccggggccgggagcaccgggaggcccacggccgggccctggcccctggccgggccagcctgggcagccggctggaggatgtgctgtggctgcaggaggtgagcaacctgtctgagtggctgagccccagccctggcccctag

SEQ ID NO: 36289 - DNA, 1146 bp, Artificial Sequence
  Description of Artificial Sequence: Synthetic coding sequence
atggccctgaaggccgagggcgccgccctggactgctttgaggtgaccctgaagtgtgaggagggagaagatgaggaggaggccatggtggtggccgtcatccccaggcctgagcccatgctgcgggtgacccagcaggagaagaccccaccaccccggcccagccccctggaggccggcagtgatggctgtgaggagcccaagcagcaggtgtcctgggagcaggagttcctggtgggcagcagccctgggggcagcggccgggccctgtgcatggtgtgtggggctgagatccgggcccccagcgctgacacagcccggagccacatcctggagcagcacccccacaccctggacctgagccccagcgagaagagcaacatcctggaggcctggagcgagggcgtggccctgctgcaggatgtgcgggcagagcagcccagcccccccaacagcgacagcggccaggatgcccacccagaccctgatgccaacccagatgctgccaggatgcctgctgagatcgtggtgctgctggacagcgaggacaaccccagcctgcccaagaggagccggccccggggcctgcggcccctggagctgcctgctgtgcctgccacagagcccggcaacaagaagccccggggccagcgctggaaggagcccccaggagaggagcctgtgaggaagaagaggggccggcccatgaccaagaacctggaccctgaccctgagccccccagcccagacagccccacagagacctttgctgccccagctgaggtgcgccacttcacagatggcagcttccctgctggctttgtgctgcagctgttcagccacacccagctgcggggccctgacagcaaggacagccccaaggaccgggaggtggccgagggcggcctgcccagggctgagagccccagccctgcccctcctcctggcctgcggggcaccctggacctgcaggtgatccgggtgaggatggaggagcccccagctgtgtccctgctgcaggactggagccgccacccccagggcaccaagagggtgggcgctggggacaccagtgactggcccaccgtgctgtctgagagcagcaccaccgtggccggcaagccagagaagggaaatggagtgtag

SEQ ID NO: 36290 - DNA, 651 bp, Artificial Sequence
  Description of Artificial Sequence: Synthetic coding sequence
atgagcctgaagcccttcacctaccccttccctgagacccgcttcctgcacgccggccccaacgtgtacaagttcaagatccgctatggcaagagcatccggggggaggagattgagaacaaggaggtgatcacccaggagctggaggacagcgtgcgggtggtgctgggcaacctggacaacctgcagccctttgccacagagcacttcatcgtgttcccctacaagagcaagtgggagcgggtgagccacctgaagttcaagcatggagagatcatcctgatcccctacccctttgtgttcaccctgtatgtggagatgaagtggttccacgagaacctgagccctgggaagcccatcagtgacagccccctgggcctggtgcctgtggagaagaaggctgtgggcgctgtgatgaggaagaggaagcacatggatgagcccagcagccccagccggcccggcctggacagaattggcaaggagaagcccaacaaggactgccggcggctgtggcccctcatcagcctgatgagcaggaacaagatcctgagcggggacacagcctgccagggcgagctgagccacccctgcagcaccacccacctgcacctgcggtctgagcagcccccagccagcctgggcttctag

SEQ ID NO: 36291 - DNA, 651 bp, Artificial Sequence; identical to SEQ ID NO: 36290
  Description of Artificial Sequence: Synthetic coding sequence

SEQ ID NO: 36292 - DNA, 447 bp, Artificial Sequence
  Description of Artificial Sequence: Synthetic coding sequence
atgaagtggttccacgagaacctgagccctgggaagcccatcagtgacagccccctgggcctggtgcctgtggagaagaaggctgtgggcgctgtgatgaggaagaggaagcacatggatgagcccagcagccccagccggcccggcctggaccgggccaagattggcaccagcagccagggccccagcaagaagaagccccctgtggagaccaggaggaaccgggagaggaagacccagcagggcctgcaggagaccctggccagtgacatcacagatgtgcagaagcaggacagcgagtggggccacagcctgcccggcagaattgtgccccccctgcagcacaacagccccccacccaaggagcgggccgccaccggcttcttcggcttcctgagcagcctcttccccttccgctacttcttcaggaagagcagccacagctag

SEQ ID NO: 36293 - DNA, 348 bp, Artificial Sequence
  Description of Artificial Sequence: Synthetic coding sequence
atgggcaccggcctgcggagccagagcctgcgggagccccggcccagctatggcaagctgcaggagccctggggccggccccaggagggccagctgcggcgggccctgagcctgcggcagggccaggagaagagccgcagccagggcctggagcggggcacagagggcccagatgccacagcccaggagcgggtgcccggcagcctgggggacacagagcagctgatccaggcccagaggcggggcagccgctggtggctgcggcgctaccagcaggtgagaagacgctgggagagctttgtggccatcttccccagcgtgaccctgagccagcctgccagcccctag

SEQ ID NO: 36294 - DNA, 510 bp, Artificial Sequence
  Description of Artificial Sequence: Synthetic coding sequence
atggagaccggccccagcgaggagcccagcggcaggaaggagagccaggagatgtgccccccaggcctgctggtgtttgctggcagcagcgagcaggatgccaacctggccaagcagttctggatcagcgcctccatgtacccacccagcgagagccagctggtgctgcggcgggacagcagccagaggctgcctgtggcccggccccggcgcagccggggcagcgagaacagccacagcagccagagcttccacctggccagcaacaagaacagagacatctttgctgaggccctgaagatccaggagagcgaggagaaggtgaagtacctgcagaaggccaagacccgggaggagatcctgcagctgctgaggaagcagcgggaggagcgcatcagcaaggagctgatcagcctgccctacaagcccaaggccaaggagcacaaggccaagaaggtggtgtctgagagtgacaaggaggaccaggaggaggtgaagaccctggactag

SEQ ID NO: 36295 - DNA, 537 bp, Artificial Sequence
  Description of Artificial Sequence: Synthetic coding sequence
atggagaccggccccagcgaggagcccagcggcaggaaggagagccaggagatgtgccccccaggcctgctggtgtttgctggcagcagcgagcaggatgccaacctggccaagcagttctggatcagcgcctccatgtacccacccagcgagagccagctggtgctgcggcgggacagcagccagaggctgcctgtggcccggccccggcgcagccggggcagcgagaacagccacagcagccagagcttccacctggccagcaacaagaacagagacatctttgctgaggccctgaagatccaggagagcgaggagaaggtgaagtacctgcagaagaccaggagccacagcgtgacccagaatgaggtgcagtggcatgaccacggcagcctgcagccccagctgagccgcatccaggccaagacccgggaggagatcctgcagctgctgaggaagcagcgggaggagcgcatcagcaaggagctgatcagcctgccctacaagcccaaggccaaggagcacaaggccaagtag

SEQ ID NO: 36296 - DNA, 1440 bp, Artificial Sequence
  Description of Artificial Sequence: Synthetic coding sequence
atgctgatctctgctgcctccatggcccctgaggtgtgtggccccagcctgcagggcaccccaggccccccaccacccctgctgcccaagccaggcaaggacaacctgcggctgcagaagctgctgaggaaggccgccaggaagaagatgatgggcggcacccacctggccccaccccgggccttccgcaccagcctgagccctgtgtctgaggccagccatgaccaggaggtgacagcccctcatgctgctgagggcccccaccctgctgaggccccccggctgcctgaggcccccaggcctgctgaggcccccaggatggtggccgccctgcccaggagcccccacacccccatcatccaccacgtggccagccccctgcagaagagcaccttcagcatcggcctgacccagaggcgcatcctggccgcccagttccgggccatgggcccccaggtggtggccagcgcccctgagcccaccaggcctccttctggctttgtgcctgtgtctgggggcggcggcacccacgtgacccaggtgcacatccagctggcccccagcccccacaacggcaccccagagccccccaggacagcccctgaggtgggcagcaacagccaggatggagatgccacccccagccccccccgggcccagcccctggtgcctgtggcccacatccggcccctgcccaccaccgtgcaggccgccagccccctgcctgaggagccccctgtgccccggcccccacctggcttccaggcctctgtgccccgggaggccagcgcccgggtggtggtgcccatcgcccccacctgccgcagcctggagagcagcccccacagcctggtgcccatgggccctggccgggagcacctggaggagccccccatggccggccctgctgctgaggccgagcgggtgagcagccctgcctgggccagcagccccaccccacccagcggcccccacccctgccctgtgcccaaggtggcccccaagccccggctgagcggctggacctggctgaagaagcagctgctggaggaggcccctgagcccccctgcccagagccccggcagagcctggagcctgaggtgcccacccccacagagcaggaggtgcctgcccccacagagcaggaggtgcctgccctgacagccccccgggccccagccagcaggaccagcaggatgtgggatgctgtgctgtacaggatgtctgtggccgaggcccagggccgcctggccggccccagcggcggggagcacaccccagccagcctgacccggctgcccttcctgtaccggccccgcttcaatgccaggaagctgcaggaggccacccggcccccacccaccgtgcgcagcatcctggagctgagcccccagcccaagaacttcaacagaacagccaccggctggaggctgcagtag

SEQ ID NO: 36297 - DNA, 582 bp, Artificial Sequence
  Description of Artificial Sequence: Synthetic coding sequence
atgcccaagggcagaagaggcagccacagccccaccatgagccagaggtctgccccacccctgtacttccccagcctgtatgaccggggcatcagcagcagccccctgagtgacttcaacatctggaagaagctgtttgtgcccctgaaggccggcggggcccctgtgggcggggccgccggggcccggagcctgagccaggccctgcctgccccagcccctcctcctcctcctcctcctggcctgggccccagcagcgagcggccctggcccagcccctggcccagcggcctggccagcatcccctatgagcccctgcgcttcttctacagccccccacctggccctgaggtggtggccagccccctggtgccctgccccagcaccccccggctggccagcgccagccaccctgaggagctgtgtgagctggagatccgcatcaaggagctggagctgctgaccatcactggagatggctttgacagccagagctacaccttcctgaaggccctgaaggatgagaagctgcagggcctgaagaccaagcagcccgggaagaagagcgccagcctgtcctag

SEQ ID NO: 36298 - DNA, 555 bp, Artificial Sequence
  Description of Artificial Sequence: Synthetic coding sequence
atgcccaagggcagaagaggcagccacagccccaccatgagccagaggtctgccccacccctgtacttccccagcctgtatgaccggggcatcagcagcagccccctgagtgacttcaacatctggaagaagctgtttgtgcccctgaaggccggcggggcccctgtgggcggggccgccggggcccggagcctgagccaggccctgcctgccccagcccctcctcctcctcctcctcctggcctgggccccagcagcgagcggccctggcccagcccctggcccagcggcctggccagcatcccctatgagcccctgcgcttcttctacagccccccacctggccctgaggtggtggccagccccctggtgccctgccccagcaccccccggctggccagcgccagccaccctgaggagctgtgtgagctggagatccgcatcaaggagctggagctgctgaccatcactggagatggctttgacagccagagcttcctgggcctgtggaccacctgtgctgatgctggccgcatcccccagcccaccagctag

SEQ ID NO: 36299 - DNA, 375 bp, Artificial Sequence
  Description of Artificial Sequence: Synthetic coding sequence
atggagagctgcagcgtggcccaggccggcgtgctgaccagccccttcatgtggcgctggacaggcatggccggggccctgagcgccctggacaacaccattgaagatgatgctgatgaccagctgccctgtggggagggccggcccggctgggtgcggggggagctgctgggcagccagggcgtgtgcaaggacagcaaggacctgtttgtgcccaccagcagcagcctgtatggctgcttctgtgtgggcctggtgtctggcatggccatctctgtgctgctgctggccagtgacttcaggaagctggacttcagcaggcctgagccctgctttgagaaggaggccagcctgtggtttgtggcccagcactag

SEQ ID NO: 36300 - DNA, 375 bp, Artificial Sequence; identical to SEQ ID NO: 36299
  Description of Artificial Sequence: Synthetic coding sequence

SEQ ID NO: 36301 - DNA, 375 bp, Artificial Sequence; identical to SEQ ID NO: 36299
  Description of Artificial Sequence: Synthetic coding sequence

SEQ ID NO: 36302 - DNA, 465 bp, Artificial Sequence
  Description of Artificial Sequence: Synthetic coding sequence
atgcaccctgagcccctgctgaacagcacccagagcgccccccaccacttcccagacagcttccaggccacccccttctgcttcaaccagagcctcatccctggcagccccagcaacagcagcatcctgagcggcagcctggactacagctacagccctgtgcagctgcccagctatgcccctgagaactacaacagccctgccagcctggacaccaggacctgtggctacccacctgaggaccacagctaccagcacctgagcagccacgcccagtacagctgcttcagcagcgccaccaccagcatctgctactgtgccagctgtgaggccgaggacctggatgccctgcaggccgctgagtacttctaccccagcacagactgtgtggactttgcccccagcgctgctgccaccagtgacttctacaagcgggagaccaactgtgacatctgctacagctag

SEQ ID NO: 36303 - DNA, 465 bp, Artificial Sequence; identical to SEQ ID NO: 36302
  Description of Artificial Sequence: Synthetic coding sequence

SEQ ID NO: 36304 - DNA, 324 bp, Artificial Sequence
  Description of Artificial Sequence: Synthetic coding sequence
atgcaccctgagcccctgctgaacagcacccagagcgccccccaccacttcccagacagcttccaggccacccccttctgcttcaaccagagcctcatccctggcagccccagcaacagcagcatcctgagcggcagcctggactacagctacagccctgtgcagctgcccagctatgcccctgagaactacaacagccctgccagcctggacaccaggacctgtggctacccacctgaggaccacagctaccagcacctgagcagccacgcccagtacagctgcttcagcagcgccaccaccagcatctgctactgtgcctag

SEQ ID NO: 36305 - DNA, 1308 bp, Artificial Sequence
  Description of Artificial Sequence: Synthetic coding sequence
atgggcaacaagcagccccagaaggtgacagtgcccactggaacagccctgcagggcgtggtgctgattgtgtccaccctgcaccagcccggcggctggatctgtgggaaggacccctgctgcagcctgcggcccctgagcaacagcgtgcagaatgccctggcctgcaagagcaagcaggactaccaggccggcatcctcttcaagacccgggccttcatcagccgggactgtggcagtgatgctgctgaggacagcgccagcaaaggagagacctacaccctgaccctggagcacaagggggccggggagggggacctgcggccccggggccagcccggctggtgccgcctgggggacccccggcgggacagcgcccggcctgtggccgccatcgagggcccctgccctggagctgcccgggccagccgggtgctgcggggccggggcttcagcaggaacccccggggccggggcctgcccagcggggccggctggagaggagctggaggagctggggagggcgctgtgaccttccctgagaggagaggagatgtgagaagaaaaggagctggccgggcccgcttcaagtggcacagcctgagcagcgagctgcgggctgtgtgggccgccgccggctacatcagccgggagcctggaagaagaggagcagatggagacagcagtggaggagagcggctgggcgcccggaggaacagcgccccccgggccccctgccccccaactggacctccagcccggccccccagcagaggagccccagcccgggcccgggagggccgccgccaccctgctgctgacctggaccccccacctggagagcccccagctgctgccagcagaggagccccagcccagaggcctccttctgagagccctggggcccctcctcctggccctgcagatgctgggggcgccatggccgccaagccaggagagctgatgggcatctgcagcagctaccaggccgtgatgccccactttgtgtgcctggctgatgagttcccccagcctgtgcggcctgccaagctgcccaagggccggggccgcctgcggcggccccggcagagccgcttcaagacccagcctgtgacctttgatgagatccaggaggtggaggaggagggcgtgagccccatggaggaggagaaggccaagaagagcttcctgcagagcctggagtgcctgcggcgcagcacccagagcctgagcctgcagcgggagcagctgagcagctgcaagctgaggaacagcctggacagcagtgacagcgacagcgccctgtag

SEQ ID NO: 36306 - DNA, 1254 bp, Artificial Sequence
  Description of Artificial Sequence: Synthetic coding sequence
atggcctttgctgtgatccgggcccagagccgggtgggcagccggggcctgtacaagccccgggcctggccaccccggggcagaagacggcagcagaggcggcgggcccccaggtctgctgctgagcagaggcctcccagccctgtgcccccagatggcagcgcccggcccccagccctgcccaggtctgctggccctggcccccggggccccccaccacccaggagccgcttcggcagccctgcccggcgggcccctggctgctgcctgcccggcggccctggagctgctgctgccctgggggagccccggcggcctgctgcccggcccaggagaagaagaagaagacatggccggcaggcccggcgggcagatggccacctgctgcagctgcctggaggagatgctgccctgcgggtgcctggaagaagagtgcctgctgcccgggccgcccggcaggccgcccagggccctggccctgctgctgctgctgcccctgtgtccctgcaggatgctgctggggacctgcggcgggaccccggcggcggcggcggcggcggcgtgccccacggcggcggggagggccaggaggtggtgcctgctgagcccggggtgcctgccccccagcacgccgagcctgtggccgctgctggagctgcccagcagctgcagacagaggagcagcccggcctgcagaggctgcggctgggccctgtgcggggggccgcccggggaggagatgcccgggtgcggggccccaggggggacagaagagtgaaccctgagagcgcccgggccctgctgcccggggacccccagggccctggaacagctgccccccgggccctgggcctgcccccaagatgtgagcctgtgggcgcccccctggccgccctggccctggcccgggagcggcgggagcggggccgcttcccccggccctgcaagtgcctcttcttcaacagcagccagtgtgagctgtgctgtgaatgtgtgcggggcggggccccagccctgagcagaagaagagtggccaccccctgcccctgccccatggtgtgcaacagcgactttgcccacaggagcacagtgcccccatctgcccaccccttcaccctgacccccaccctgagcctgaacaccttcatcatcgtgcggcggggccgctgggactttggccgctctgctgctgccacagccagcggcggcctcatcttcatctttgccctgcgctggctgaaggccttcatctag

SEQ ID NO: 36307 - DNA, 822 bp, Artificial Sequence
  Description of Artificial Sequence: Synthetic coding sequence
atgctgggccagctgctgccccacacagcccggggcctgggcgctgctgagatgcctggccagggccctggcagtgactggacagagaggagcagcagcgctgagcccccagctgtggccggcacagagggcggcggcggcggcagcgctggctacagctgctaccagaacagcaaaggaagtgaccgcatcaaggatggctacaaggtgaacagccacatcgccaagctgcaggagctgtggaagaccccccagaaccagaccatccacctgagcaagtccatgatggaggccagcttcttcaagcacccagacctgaccaccggccagaagcgctacctgtgcagcatcgccaagatctacaatgccaactacctgaagatgctgatgaagaggcagtacatgcacgtgctgcagcacagcagccagaagccaggagtgctgacccaccacaggagccggctgagcagccgctacagccagaagcagcactacccctgcaccacctggaggcaccagctggagagagaagattctggcagcagtgacattgctgctgccagcgcccctgagatgctgatccagcacagcctgtggaggcctgtgaggaacaaggagggcatcaagacaggctacgccagcaagacccgctgcaagagcctgaagatcttcagaagacccaggaagctgttcatgcagacagtgtccagtgatgacagcgagagccacatgtctgaggagaagaaggaggaggacctgctgaacaacttcatgcagagcatgagcattgaggagcagggcgagcacctgatgctgacctag

SEQ ID NO: 36308 - DNA, 1812 bp, Artificial Sequence
  Description of Artificial Sequence: Synthetic coding sequence
atggccgccagctgccccctgcctgtgaccccagacctgcccaccctgcgggccaagctgcagggcctgctgcagttcctgagagatgccctgagcatcagcaatgcccacacagtggacttctacacagaatctgtgtgggaggagctggtggacctgcccccagagaccgtgctggccgccctgaggaagagcgccagcgagacagaggccctgcccagcgagacccggcccctggtggaggccgagtgggaggccggcatgacagacttccccaagatcttctgtgagaccagccagaagctggtgtctgtggaggcctttgccctggccgccaagtactacagcgtgcagaacctgggcatctgcaccccatttgagcagctgctggtggccctgcggggcaaccagaaccagagaattggagagaaccagaaggctgtggagttcatgaacatgaagaagagccatgaggtgcaggccatgtctgagctgatcagcagcattgctgactactacggcatcaagcaggtgattgacctgggcagcggcaagggctacctgagcagcttcctgagcctgaagtatggcctgaaggtgtatggaattgacagcagcaacaccaacacccatggagctgaggagaggaacaggaagctgaagaagcactggaagctgtgccacgcccagagccggctggatgtgaatggcctggccctgaagatggccaaggagaggaaggtgcagaacaaggtgaagaacaaggctgacacagaggaggtgttcaacaacagccccaccaaccaggagaagatgcccaccagcgccatcctgcctgacttcagcggcagcgtcatcagcaacatccggaaccagatggagaccctgcacagccagccccaccaggaggagaacctgtgctttgaaaattccttcagcctcatcaacctgctgcccatcaatgctgtggagcccaccagcagccagcagatccccaaccgggagaccagcgaggccaacaaggagaggaggaagatgaccagcaagagcagcgagagcaacatctacagccccctgaccagcttcatcacagctgacagcgagctgcatgacatcatcaaggacctggaggactgcctgatggtgggcctgcacacctgtggggacctggcccccaacaccctgcgcatcttcaccagcaacagcgagatcaagggcgtgtgcagcgtgggctgctgctaccacctgctgtctgaggagtttgagaaccagcacaaggagaggacccaggagaagtggggcttccccatgtgccactacctgaaggaggagcgctggtgctgcggcagaaatgccaggatgtctgcctgcctggccctggagcgggtggccgccggccagggcctgcccacagagagcctcttctacagagctgtgctgcaggacatcatcaaggactgctacggcatcaccaagtgtgacagacatgtgggcaagatctacagcaagtgcagcagcttcctggactatgtgcggcgcagcctgaagaagctgggcctggatgagagcaagctgcctgagaagatcatcatgaactactatgagaagtacaagcccaggatgaatgagctggaggccttcaacatgctgaaggtggtgctggccccctgcatcgagaccctcatcctgctggaccggctgtgctacctgaaggagcaggaggacatcgcctggagcgccctggtgaagctgtttgatcctgtgaagagcccccgctgctatgctgtgattgccctgaagaagcagcagtag

SEQ ID NO: 36309 - DNA, 828 bp, Artificial Sequence
  Description of Artificial Sequence: Synthetic coding sequence
atggccttctgtgccctgaccatcgtggccctgtacatcctgagcctgaaggaccaggacagaagagtgcccaacctgccccccagcaacatcaccagcagccaggagcccgccctgctgcccacagccagcagcagcgcccccaacaccagcctggtgaccaccccagccagcctgcaggtgcctgagatcaccttctgtgagatcctgccctgccaggagacctactgctgccccatccggggcatgaaggaggtgagcagcagccctgtgcagaggcagagcgaggagaaggagttccaccagaggcgctggagcgaggacaagagcaagtctgtgctggccagaaatgccctgagcggccctgactgggagagtgactggattgacaccaccatcagcagcatccagatcatggagatccagcagatcatcgaccaccagtactgcatccagagcctgcagtgtggcagcggcaactacaactacaacatccctgtgaacaagcacacccccaccaacgtgaagttcagcctggagatcaacaccacagagcccctcatcgtgttccagtgcaagttcaccctgggcaacatctgcttccacagcaagaggggcaccaagggcctggagagccaccgggagatcagccaggagatgacccagggctaccagcacatctggagcctgcctgtggcccccttcagtgacagcatgttccacttccgggtggccgccccagacctggccgactgcagcacagacccctactttgctggcatcttcttcacagactacttcttctacttctaccgccgctgtgcctag

SEQ ID NO: 36310 - DNA, 978 bp, Artificial Sequence
  Description of Artificial Sequence: Synthetic coding sequence
atgaagaggctgggctctgtgcagaggaagatgccctgtgtgtttgtgacagaggtgaaggaggagcccagcagcaagcgggagcaccagcccttcaaggtgctggccacagaaacagtgagccacaaggccctggatgctgacatctacagcgccatccccacagagaaggtggatggcacctgctgctacgtgaccacctacaaggaccagccctacctgtgggcccggctggacaggaagcccaacaagcaggccgagaagcgcttcaagaacttcctgcacagcaaggagaaccccaaggagttcttctggaatgtggaggaggacttcaagccagcccctgagtgctggatcccagccaaggagacagagcagatcaatggaaatcctgtgcctgatgaaaatggccacatccctggctgggtgcctgtggagaagaacaacaagcagtactgctggcacagctctgtggtgaactatgaatttgaaattgccctggtgctgaagcaccacccagatgacagcggcctgctggagatctctgctgtgcccctgagtgacctgctggagcagaccctggagctgattggcaccaacatcaatggaaacccctacggcctgggcagcaagaagcaccccctgcacctgctgatcccccatggagccttccagatccggaacctgcccagcctgaagcacaatgacctggtgtcctggtttgaggactgcaaggagggcaagattgagggcatcgtgtggcactgcagtgatggctgcctgatcaaggtgcaccgccaccacctgggcctgtgctggcccatcccagacacctacatgaacagcaggcctgtgatcatcaacatgaacctgaacaagtgtgacagcgcctttgacatcaagtgcctcttcaaccacttcctgaagattgacaaccagaagtttgtgcggctgaaggacatcatctttgatgtgtag

SEQ ID NO: 36311 - DNA, 1359 bp, Artificial Sequence
  Description of Artificial Sequence: Synthetic coding sequence
atgctggcctgcctgcagaggacccagaatgcccctggccagcacctggcctgccccagcaagagcctggagctgaggaaatgtgaggccgtggccagcgccatgcacagcagccgctaccccagccctgctgagctggatgcctatgcagagaaggtggccaacagccccctgagcatcaagatcttccccaccaacatccgggtgccccagcacaagcacctgagcaggacagtgaatggctatgacaccagcggccagcgctacagcccctacccccagcacacagctggctaccagggcctgctggccatcgtgaaggctgctgtgagcagcagcagcacagctgccccagctggccctgccaagtctgtgctgaagtctgctgagggcaagaggaccaagctgagccctgctgctgtgcaggtgggcatcgccccctaccctgtgcccagcaccctgggccccctggcctaccccaagcccccagaggccccagcccctcctcctggcctgcctgctgctgccacagctgccagcgtcatccccctgcccggccggggcctgcccctgccccccagcaacctgcccagcatccacagcctgctgtaccagctgaaccagcagtgccaggcccctggagctgcccccccagcctgccagggcatggccatcccccaccccagccctgccaagcacggccctgtgcccagcttccccagcatggcctacagcgctgctgctggcctgcctgactgcaggaaaggaacagagctgggccagggcgccacccaggccctgaccctggccggggccgccaagccagctggctatgctgacagcggcctggactacctgctgtggccccagaagcccccacctcctccaccccagcccctgcgggcctacagcggcagcacagtggccagcaagagccctgaggcctgtggcggccgggcctatgagcgggccagcggcagccccctgaactgtggggtgggcctgcccaccagcttcaccgtgggccagtactttgctgccccctggaacagcgtgctggtgacccccaccagtgactgctacaacccagctgctgctgtggtggtgacagagctgggccctggggccgcccgggagctggccggccccccagcagatgccctgagcggcctgcccagcaagtctgtgtgcaacacctctgtgctgagcagcagcctgcagagcctggagtacctgatcaatgacatccggcccccctgcatcaaggagcagatgctgggcaagggctatgagaccgtggccgtgccccggctgctggaccaccagcacgcccacatccggctgcctgtgtacagatag

SEQ ID NO: 36312 - DNA, 1359 bp, Artificial Sequence; identical to SEQ ID NO: 36311
  Description of Artificial Sequence: Synthetic coding sequence

SEQ ID NO: 36313 - DNA, 5244 bp, Artificial Sequence
  Description of Artificial Sequence: Synthetic coding sequence
atgaactggaatgagaagcccaagagcgccaccctgccccccctgtaccccaagagccagccccccttcctgcaccagagcctcatcaaccagatcaccaccaccagccagagcagcttctcctacccaggcagcaaccaggaggcctgcatgtacccaggcaacagcaaccccatcagccagcccctgctgaacatccagaactacccccagcagatctctgtgtctgacatgcacaacggcaccgtggtggccagccacacctctgtggagcgcatcacctacgccaacgtgaatggccccaagcagctgacccacaacctgcagatgagcagcggcgtgacccagaatgtgtggctgaacagccccatgagaaatcctgtgcacagccacatcggggccaccgtgagccaccagacagactttggagccaacgtgcccaacatgcctgccctgcagagccagctgatcaccagtgacacctacagcatgcagatgcagatgatccccagcaacagcacccggctgcctgtggcctaccagggcaaccagggcctgaaccagagcttcagcgagcagcaggtggactggacccagcagtgcatcagcaagggcctgacctacccagactacagacctccacccaagctgtaccgctacagcccccagagcttcctgcctgacagcaccatccagaagcagaacttcatcccccacaccagcctgcaggtgaagaacagccagctgctgaacagcgtgctgaccctgcccagccggcagaccagcgctgtgcccagccagcagtatgccacccagacagacaagaggcctcctcctccaccctacaactgccgctatggcagccagcccctgcagagcacccagcacatcaccaagcacctgtccatggaggtgccccagagccgggagatgctgagcagcgagatccgcaccagcttccagcagcagtggcagaaccccaatgaaaatgtgtccaccatcggcaacttcaccaacctgaaggtgaacaccaacagcaagcagcccttcaacagccccatccgcagctctgtggatggagtgcagaccctggcccagaccaatgaggagaagatcatggacagctgcaaccccaccagcaaccaggtgctggacacctctgtggccaaggagaagctggtgcgggacatcaagaccctggtggagatcaagcagaagttcagcgagctggccaggaagatcaagatcaacaaggacctgctgatggccgccggctgcatcaagatgaccaacaccagctacagcgagcccgcccagaacagcaagctgagcctgaagcagacagccaagatccagagcggcccccagatcacccctgtgatgccagaaaatgctgagcggcagacccccaccgtggtggagagcgctgagaccaacaagacccagtgcatgctgaacagcgacatccaggaggtgaactgccgccgcttcaaccaggtggacagcgtgctgcccaaccctgtgtacagcgagaagaggcccatgccagacagcagccatgatgtgaaggtgctgaccagcaagaccagcgctgtggagatgacccaggccgtgctgaacacccagctgagcagtgaaaatgtgaccaaggtggagcagaacagccctgctgtgtgtgagaccatctctgtgcccaagtccatgagcacagaggagtacaagagcaagatccagaatgaaaacatgctgctgctggccctgctgagccaggccaggaagacccagaagacagtgctgaaggatgccaaccagaccatccaggacagcaagccagacagctgtgagatgaaccccaacacccagatgactggaaaccagctgaacctgaagaacatggagacccccagcaccagcaatgtgtctggccgggtgctggacaacagcttctgcagcggccaggagagcagcaccaagggcatgcctgccaagagtgacagcagctgcagcatggaggtgctggccacctgcctgagcctgtggaagaagcagcccagcgacacagccaaggagaaggaatgtgacaagctgcggaccaacaccacagctgtgggcatcagcaagccagccaacatccacgtgaagagcccctgcagcgtggtgggcaacagcaacagccagaacaagatcagcaaccccagccagcagacagccctgtccatggtgatgcacaactatgagagcagcggcatcaacatcaccaagggcacagagctgcagattgctgtggtgagccccctggtgctgtctgaggtgaagaccctgtctgtgaagggcatcaccccagctgtgctgcctgagaccgtgtaccctgtgatcaaggagggctctgtgtgcagcctgcagaaccagctggccgagaatgccaaggccacagctgccctgaaggtggatgtgtctggccctgtggccagcacagccaccagcaccaagatcttccccctgacccagaaggagaagcagaatgaaagcaccaatggaaacagcgaggtgaccccaaatgtgaaccagggcaagcacaacaagctggagagcgccatccacagccccatgaatgaccagcagatcagccaggagagcaggaacagcacagtggtgtccagtgacaccctgcagattgacaacatctgcagcctggtggagggggacaccagctacaacagccagatcgccaagatcttcagcagcctgcccctgaagatggtggagccccagaagcccagcctgcccaaccagcagggcatcggcagccgggagcctgagaagcagctggacaacaccacagagaacaaggactttggcttccagaaggacaagcctgtgcagtgcacagatgtgagccacaagatctgtgaccagagcaagtctgagccccccctggagagcagcttcaacaacctggagaccaacagagtcatcctggagaagagcagcctggagcacgccacagagaagagcacagccaatgacacctgcagcagcgctgccatccaggaggacatctacccccaggagattgatgccagcagcaactacaccccccaggaccctgccagaaatgagatccacagcgacaaggcccctgtgctgtacctgcatgaccagctgtctgagctgctgaaggagttcccctacggcatcgaggccgtgaacacccgggagggctctgtgggccagcagaccacctaccagaccagcgaggaccagacagctgacaagaccagcagtgacagcaaggaccctgctgaccagatccagatcaccatcctgagcagcgagcagatgaaggagatcttccctgagcaggatgaccagccctacgtggtggacaagctggccgagccccagaaggaggagcccatcacagaggtggtgtcccagtgtgacctgcaggccccagctgctggccagagccgggacagcgtcatcctggacagcgagaaggatgacatccactgctgtgccctgggctggctgtccatggtgtatgagggcgtgccccagtgccagtgcaacagcatcaagaacagcagcagcgaggaggagaagcagaaggagcagtgcagccccctggacaccaacagctgcaagcagggcgagaggaccagtgacagagatgtgacagtggtgcagttcaagagcctggtgaacaaccccaagaccccaccagatggcaagagccacttccctgagctgcaggatgacagcaggaaggacacccccaagaccaagcacaagagcctgcccaggacagagcaggagctggtggccggccagttcagcagcaaatgtgacaagctgaaccccctgcagaaccacaagaggaagaagctgcgcttccacgaggtgaccttccacagcagcaacaagatgacagccagctatgagcaggccagccaggagacccggcagaagaagcacgtgacccagaacagccggcccctgaagaccaagacagccttcctgcccaacaaggatgtgtacaagaagcacagcagcctgggccagagcctgagccctgagaagatcaagctgaagctgaagtctgtgtccttcaagcagaagaggaagctggaccagggcaatgtgctggacatggaggtgaagaagaagaagcatgacaagcaggagcagaagggctctgtgggcgccaccttcaagctgggggacagcctgagcaaccccaatgaaagagccatcgtgaaggagaagatggtgagcaacaccaagtctgtggacaccaaggccagcagcagcaagttcagccgcatcctgacccccaaggagtacctgcagaggcagaagcacaaggaggccctgagcaacaaggccagcaagaagatctgtgtgaagaatgtgccctgtgacagcgagcacatgaggcccagcaagctggccgtgcaggtggagagctgtgggaagagcaatgagaagcacagcagcggcgtgcagaccagcaaggagagcctgaatggcctgaccagccacggcaagaacctgaagatccaccacagccaggagagcaagacctacaacatcctgagaaatgtgaaggagaaggtgggcggcaagcagcctgacaagatctggattgacaagaccaagctggacaagctgaccaacatcagcaatgaggcccagttcagccagatgccaccccaggtgaaggaccagaagaagctgtacctgaacagagtgggcttcaagtgcacagagcgggagagcatcagcctgaccaagctggagagcagccccaggaagctgcacaaggacaagaggcaggagaacaagcacaagaccttcctgcctgtgaagggcaacacagagaagagcaacatgctggagttcaagctgtgcccagacatcctgctgaagaacaccaacagcgtggaggagaggaaggatgtgaagccccaccccaggaaggagcaggcccccctgcaggtgtctggcatcaagagcaccaaggaggactggctgaagtttgtggccaccaagaagaggacccagaaggacagccaggagcgggacaacgtgaacagccggctgagcaagaggagcttcagcgcagatggctttgagatgctgcagaaccctgtgaaggacagcaaggagatgttccagacctacaagcagatgtacctggagaagaggagccgcagcctgggcagcagccctgtgaagtag

SEQ ID NO: 36314 - DNA, 2028 bp, Artificial Sequence
  Description of Artificial Sequence: Synthetic coding sequence
atgaactggaatgagaagcccaagagcgccaccctgccccccctgtaccccaagagccagccccccttcctgcaccagagcctcatcaaccagatcaccaccaccagccagagcagcttctcctacccaggcagcaaccaggaggcctgcatgtacccaggcaacagcaaccccatcagccagcccctgctgaacatccagaactacccccagcagatctctgtgtctgacatgcacaacggcaccgtggtggccagccacacctctgtggagcgcatcacctacgccaacgtgaatggccccaagcagctgacccacaacctgcagatgagcagcggcgtgacccagaatgtgtggctgaacagccccatgagaaatcctgtgcacagccacatcggggccaccgtgagccaccagacagactttggagccaacgtgcccaacatgcctgccctgcagagccagctgatcaccagtgacacctacagcatgcagatgcagatgatccccagcaacagcacccggctgcctgtggcctaccagggcaaccagggcctgaaccagagcttcagcgagcagcaggtggactggacccagcagtgcatcagcaagggcctgacctacccagactacagacctccacccaagctgtaccgctacagcccccagagcttcctgcctgacagcaccatccagaagcagaacttcatcccccacaccagcctgcaggtgaagaacagccagctgctgaacagcgtgctgaccctgcccagccggcagaccagcgctgtgcccagccagcagtatgccacccagacagacaagaggcctcctcctccaccctacaactgccgctatggcagccagcccctgcagagcacccagcacatcaccaagcacctgtccatggaggtgccccagagccgggagatgctgagcagcgagatccgcaccagcttccagcagcagtggcagaaccccaatgaaaatgtgtccaccatcggcaacttcaccaacctgaaggtgaacaccaacagcaagcagcccttcaacagccccatccgcagctctgtggatggagtgcagaccctggcccagaccaatgaggagaagatcatggacagctgcaaccccaccagcaaccaggtgctggacacctctgtggccaaggagaagctggtgcgggacatcaagaccctggtggagatcaagcagaagttcagcgagctggccaggaagatcaagatcaacaaggacctgctgatggccgccggctgcatcaagatgaccaacaccagctacagcgagcccgcccagaacagcaagctgagcctgaagcagacagccaagatccagagcggcccccagatcacccctgtgatgccagaaaatgctgagcggcagacccccaccgtggtggagagcgctgagaccaacaagacccagtgcatgctgaacagcgacatccaggaggtgaactgccgccgcttcaaccaggtggacagcgtgctgcccaaccctgtgtacagcgagaagaggcccatgccagacagcagccatgatgtgaaggtgctgaccagcaagaccagcgctgtggagatgacccaggccgtgctgaacacccagctgagcagtgaaaatgtgaccaaggtggagcagaacagccctgctgtgtgtgagaccatctctgtgcccaagtccatgagcacagaggagtacaagagcaagatccagaatgaaaacatgctgctgctggccctgctgagccaggccaggaagacccagaagacagtgctgaaggatgccaaccagaccatccaggacagcaagccagacagctgtgagatgaaccccaacacccagatgactggaaaccagctgaacctgaagaacatggagacccccagcaccagcaatgtgtctggccgggtgctggacaacagcttctgcagcggccaggagagcagcaccaagggcatgcctgccaagagtgacagcagctgcagcatggaggtgctggccacctag

SEQ ID NO: 36315 - DNA, 108 bp, Artificial Sequence
  Description of Artificial Sequence: Synthetic coding sequence
atgaactggaatgagaagcccaagagcgccaccctgccccccctgtaccccaagagccagccccccttcctgcaccagagcctcatcaaccagatcaccaccacctag

SEQ ID NO: 36316 - DNA, 417 bp, Artificial Sequence
  Description of Artificial Sequence: Synthetic coding sequence
atggagcgcttcctgaacagcaaggcccggcggctgggcagctgcagccacccagccttctacctgctgtgtgtgcctgatgaggacaccagctgcagcaccatctacctgcccctgaagagaagagctgaccctgaccagctgttcagtgacctgctgggcggcacccagaggctgtggagcaacagatttggaaatgaggagagcttccctggccgggtgcgggccctggtggacaccttctgctggatcgcccgggccccacccctgggcaaccccctgcggctggaggagcgcatcgcctggaggatccagaggctgaagagcggccagacagccctgattgagaagaagaagcagaagattgaggaggatgtgcgccaccagtgccagcagaccacctgtgaccgctgctag

SEQ ID NO: 36317 - DNA, 417 bp, Artificial Sequence; identical to SEQ ID NO: 36316
  Description of Artificial Sequence: Synthetic coding sequence

SEQ ID NO: 36318 - DNA, 1659 bp, Artificial Sequence
  Description of Artificial Sequence: Synthetic coding sequence
atgaagaagaaccgggagcgcttctgcaaccgggagcgggagtttgtgtacaagttcaaggtgggcagccagtgcctggagctgcgggtgcccctgaagtttcctgtgcaggagaatgccagccacctgcacggccgcctgatgctgctgcacagcctgccctgcttcatcgagaaggacctgaaggaggccctgacccagttcatcgaggaggagagcctgagtgactatgacagagatgctgaggccagcctggccgctgtgaagagcggggaggtggacctgcaccagctggccagcacctgggccaaggcctatgcagagaccaccctggagcacgcccggcctgaggagcccagctgggatgaagattttgctgatgtgtaccatgacctgatccacagccctgccagcgagaccctgctgaacctggagcacaactactttgtgtccatcagcgagctgattggagagagagatgtggagctgaagaagctgcgggagcggcagggcatcgagatggagaaggtgatgcaggagctgggcaagagcctgacagaccaggatgtgaacagcctggccgcccagcactttgagagccagcaggacctggagaacaagtggagcaatgagctgaagcagagcacagccatccagaagcaggagtaccaggagtgggtgatcaagctgcaccaggacctgaagaaccccaacaacagcagcctgtctgaggagatcaaggtgcagcccagccagttccgggagagcgtggaggccatcggccgcatctatgaggagcagaggaagctggaggagagcttcaccatccacctgggcgcccagctgaagaccatgcacaacctgcggctgctgcgggctgacatgctggacttctgcaagcacaagaggaaccacaggtctggagtgaagctgcaccggctgcagacagccctgagcctgtacagcaccagcctgtgtggcctggtgctgctggtggacaaccgcatcaacagctacagcggcatcaagagggactttgccaccgtgtgccaggagtgcacagacttccacttccccagaattgaggagcagctggaggtggtgcagcaggtggtgctgtatgcccggacccagaggaggagcaagctgaaggagagcctggacagcggcaaccagaatggaggaaatgatgacaagaccaagaatgctgagaggaactacctgaatgtgctgcccggggagttctacatcaccaggcacagcaacctgtctgagatccacgtggccttccacctgtgtgtggatgaccacgtgaagagcggcaacatcacagcccgggaccctgccatcatgggcctgaggaacatcctgaaggtgtgctgcacccatgacatcaccaccatcagcatccccctgctgctggtgcatgacatgtctgaggagatgaccatcccctggtgcctgcggcgggcagagctggtgttcaagtgtgtgaagggcttcatgatggagatggcctcctgggatggcggcatcagcaggacagtgcagttcctggtgccccagagcatcagcgaggagatgttctaccagctgagcaacatgctgccccagatcttccgggtgagcagcaccctgaccctgaccagcaagcactag

SEQ ID NO: 36319 - DNA, 1659 bp, Artificial Sequence; identical to SEQ ID NO: 36318
  Description of Artificial Sequence: Synthetic coding sequence

SEQ ID NO: 36320 - DNA, 1959 bp, Artificial Sequence
  Description of Artificial Sequence: Synthetic coding sequence
atgaactgggtgggcggcagccgcagccgggtgctgatcaagcaggagaggaggaagcagaaggagtactttgagaagcaccggctgaagagcaagatgaagagcctgggcgtgctgagccctgtgaagaacagcgctgtgtccctggacatcctgaacctgtacatggtgaaccagatcagctgcaagaagaagatccctgagaccgtgaggaagcccacccacgtgaacatgaacagagacatcaagatgcccctgaggaagcacaacctggagctgaccatgagcccccactgtgtgcccagcaagctgtgcctggatgacacagagaccaacgtgaactgccagaggctgagcagcaaggaggacctgggccctgtgcagagccagggcatggacagctacagcatgctgcacccccagttcagcaagattgagaactgcagcttcacccccagcagcttctctgtggagctgcccagcaacagacacatcagcaagctgaacttcaccagcggcatcgcccccaccccccagaagctggcctatgagaagaagcagaatgaccagaggagcacagtgaactgcagcgacagcctgctgagcaagctgaacaagagccaggatgtgttcagccccagccacaagaccacccgcttcggcaccctgtttgagcggctgaacagcctgggcaacagaaacctgctgaccaagagccctgctgtgatcatggatgaggactgccgcagcacagatgagatccggcagagcgactacatcacagagaagcacagcatccagcacatctggggcaagaatggcaaggaggtgagcaacttcctggaggatgtgaaccagagcacccccaacctgctgtctgagaactgtgacagctttgtgtcccagaacatgatcaacgtgctgaacattgatgagcagaggatcaagaagaccttcaacaagtgtgactatgacagcatgggagacacctgtgtggtgaccagcagtgacaagaaccacgtgacagaccgctgcatccggaacatcttcaccgtgcctgagctgaccttcagcaacagcaccctgaacaagaccagctacccagagaagtgccagcccaacaagaagtaccagcgggagtacaacaagaatgaaagaaatgacctgagcaccagctttgaaaatgactactaccccagcagcagcgagaggaaggagaagtttgaaaatgactaccaggagaagaccccccagaagagcatccagaagtacccagccaacagcatgggcaacatccccagcgaggagctgcacagcaagcagagctgggactttggcctggatgagatcctgatggaggagggcggcatctacagcctgaagagcaagaggatcagcaccaagaagatcagcctggacagcgcccagagcagccgcagcaccagctacagcccccggcccacagacagctgcttcagcagcagcagtgacctgcccagtgaagatgaggaccagatcagccagcagatcgaggacagcaacaggatgaccatcaagaccaaggagaagatgaacaacttctacgtggagaggatggccaagctgagcggggaccgcatcgtgaagaatgatgacaagatccacaagcagaatgaaaacttctaccagttctctgtgaagaacaacacagaccagttcccccagctgcagtgcaacagcgcccacatcctgcagaacaagaccaatgacaactgtgtgctgcaggccgcccgctgtgatgctggcatccagacagagagcgagagcgtgatggaggagaagctggatgtggccatccagtgtgacctgatcagcaagtgcacctgccgcagtgatgtgtccctgtgcaacctggagcgctgcagcggcaacatcaaggctgacaccactggaggccaggagatccacaagaacaactag

SEQ ID NO: 36321 - DNA, 1185 bp, Artificial Sequence
  Description of Artificial Sequence: Synthetic coding sequence
atgaacagagacatcaagatgcccctgaggaagcacaacctggagctgaccatgagcccccactgtgtgcccagcaagctgtgcctggatgacacagagaccaacgtgaactgccagaggctgagcagcaaagaagacctgggccctgtgcagagccagggcatggacagctacagcatgctgcacccccagttcagcaagattgagaactgcagcttcacccccagcagcttctctgtggagctgcccagcaacagacacatcagcaagctgaacttcaccagcggcatcgcccccaccccccagaagctggcctatgagaagaagcagaatgaccagaggagcacagtgaactgcagcgacagcctgctgagcaagctgaacaagagccaggatgtgttcagccccagccacaagaccaccaggtttggcaccctgtttgagcggctgaacagcctgggcaacagaaacctgctgaccaagagccctgctgtgatcatggatgaggactgccgcagcacagatgagatccggcagagcgactacatcacagagaagcacagcatccagcacatctggggcaagaatggcaaggaggtgagcaacttcctggaggatgtgaaccagagcacccccaacctgctgtctgagaactgtgacagctttgtgtcccagaacatgatcaacgtgctgaacattgatgagcagaggatcaagaagaccttcaacaagtgtgactatgacagcatgggagacacctgtgtggtgaccagcagtgacaagaaccacgtgacagaccgctgcatccggaacatcttcaccgtgcctgagctgaccttcagcaacagcaccctgaacaagaccagctacccagagaagtgccagcccaacaagaagtaccagcgggagtacaacaagaatgaaagaaatgacctgagcaccagctttgaaaatgactactaccccagcagcagcgagaggaaggagaagtttgaaaatgactaccaggagaagaccccccagaagagcatccagaagtacccagccaacagcatctggtgcaccaagtgcagcgagttcaaggtgatcttcaccctcatccactacgtgctgatgctgaacctcttcctgaagagcctgaggacagccttccaggccttcctgaacaatgacctgcagctgtag

SEQ ID NO: 36322 - DNA, 324 bp, Artificial Sequence
  Description of Artificial Sequence: Synthetic coding sequence
atgagcaccgtcatctgcatgaagcagcgggaggaggagttcctgctgaccatccggccctttgccaacaggatgcagaagagcccctgctacatccccatcgtgtcctctgccaccctgtgggacaggagcaccccatctgccaagcacatcccctgctatgaaagaacatctgtgccctgcagccgcttcatcaaccacatgaagaacttcagcgagagccccaagttccgcagcctgcacttcctgaacttccctggcagccaccacggccaggccacccagaagctgcagggcgccatggtgctgcacctggaggagtag

SEQ ID NO: 36323 - DNA, 1083 bp, Artificial Sequence
  Description of Artificial Sequence: Synthetic coding sequence
atgagcaccgtcatctgcatgaagcagcgggaggaggagttcctgctgaccatccggccctttgccaacaggatgcagaagagcccctgctacatccccatcgtgtcctctgccaccctgtgggacaggagcaccccatctgccaagcacatcccctgctatgaaagaacatctgtgccctgcagccgcttcatcaaccacatgaagaacttcagcgagagccccaagttccgcagcctgcacttcctgaacttccctgtgtttcctgagaggacccagaacagcatggcctgcaagaggctgctgcacacctgccagtacatcgtgccccgctgcagcgtgtccacagtgtcctttgatgaggagagctatgaggagttccgcagcagccctgcccccagcagcgagacagatgaggcccccctcatcttcaccgcccggggggagacagaggagcgggcccggggggcccccaagcaggcctggaacagcagcttcctggagcagctggtgaagaagcccaactgggcccacagcgtgaaccctgtgcacctggaggcccagggcatccacatcagccgccacacccggcccaagggccagcccctgagcagccccaagaagaacagcggcagcgctgcccggcccagcacagccatcggcctgtgccgccgcagccagacccctggggccctgcagagcacaggccccagcaacacagagctggagcctgaggagaggatggctgtgcctgctggggcccaggcccacccagatgacatccagagccggctgctgggcgccagcggcaaccctgtgggcaaaggagctgtggccatggcccctgagatgctgcccaagcacccccacaccccccgggacagaagaccccaggccgacaccagcctgcacggcaacctggccggggcccccctgcccctgctggccggggccagcacccacttccccagcaagaggctcatcaaggtgtgcagcagcgccccaccccggcccacccggcgcttccacacagtgtgcagccaggccctgagcaggcctgtggtgaatgcccacctgcactag

SEQ ID NO: 36324 - DNA, 1083 bp, Artificial Sequence; identical to SEQ ID NO: 36323
  Description of Artificial Sequence: Synthetic coding sequence

SEQ ID NO: 36325 - DNA, 624 bp, Artificial Sequence
  Description of Artificial Sequence: Synthetic coding sequence
atgagcaccgtcatctgcatgaagcagcgggaggaggagttcctgctgaccatccggccctttgccaacaggatgcagaagagcccctgctacatccccatcgtgtcctctgccaccctgtgggacaggagcaccccatctgccaagcacatcccctgctatgaaagaacatctgtgccctgcagccgcttcatcaaccacatgaagaacttcagcgagagccccaagttccgcagcctgcacttcctgaacttccctgtgtttcctgagaggacccagaacagcatggcctgcaagaggctgctgcacacctgccagtacatcgtgccccgctgcagcgtgtccacagtgtcctttgatgaggagagctatgaggagttccgcagcagccctgcccccagcagcgagacagatgaggcccccctcatcttcaccgcccggggggagacagaggagcgggcccggggggcccccaagcaggcctggaacagcagcttcctggagcagctggtgaagaagcccaactgggcccacagcgtgaaccctgtgcacctggaggcccagggcatccacatcagccgccacacccggcccaagggccagcccctgagcagccccaagtag

SEQ ID NO: 36326 - DNA, 558 bp, Artificial Sequence
  Description of Artificial Sequence: Synthetic coding sequence
atggaggtgcacggcaagcccaaggccagccccagctgcagcagccccacccgggacagcagtggagtgcctgtgtccaaggagctgctgacagctggcagtgatggccggggcggcatctgggaccggctgctgatcaacagccagcccaagagcaggaagaccagcaccctgcagacagtgagaattgaaagaagccccctgctggaccaggtgcagaccttcctgccccagatggcccgggccaatgagaagctgaggaaggagatggccgccgcccctcctggccgcttcaacattgaaaatattgatggcccccacagcaaggtgatccagatggatgtggccctgtttgagatgaaccagagcgacagcaaggaggtggacagcagcgaggagagcagccaggacagcagcgagaacagcagcgagagtgaagatgaagatgacagcatccccagcgaggtgaccatcgacaacatcaagctgcccaacagcgagggcggcaagggcaagattgaggtgctggacagccctgccagcaagaagaagaagtag

SEQ ID NO: 36327 - DNA, 1245 bp, Artificial Sequence
  Description of Artificial Sequence: Synthetic coding sequence
atggagatgcagcagaactgcagcatcagctgcttctgggagacccagcccctgggctgtgtgaagatcagctgcatcttctaccacagcaagcccaggaacatcaatggcctcttcctgccccccagcagcaacatcaccctgcagaaggagatccaggagggcatccccctgcagagccagagccaggagcccctgaagccccaggagaacatcagccggcccatccaccaccccctggtgctgaagaccaactttgaggaggaggaggaggtggatgagcagaatgatgccagcagcctgtggaccaagaccccagaggagattgaggagaagagggccatcaaggagatgtgctacaagagcggggagtactaccgcttccacaccccaccagacatcctgagcagcaagtccatgacccccacagctgagaagcagctggagaagcccctggagaatggcagcgagctgcaggagggggacagcctgactgtgcccaccaagctgagccagtatgagcggcagggcgagatcaagaccagcctgcacggcaagcccaagacagacattgctgcctttgaaaatggaggaggagactgctacgtgccccagagggtcatcttcctgggcgtggatgaaagtgaggccctgacagaggagaaggagatcaccatcagcaagtgcagcaacaccaaggacaacaaggacagcccccaccccaagcacagcctgaccacccggctggtgcccaccacccacgtgctgaatgccacagagaacatctccatgaagtgccgggaggaccccagctccatgaatgatgtgcagcctgtgaagaagccccacttcaagggcgtgaagaagaggaagtggatctatgatgagccccagaacttccccaacagcggcatgcagagagctgtgcaggccccccggccccagaacaagatgagctaccacaggaacaacaagaacagaaatgcagaaaatgccagctacatccacgtgcagagagatgctgtgaggacagtggccctgaatgcccccagccgcagccggcccacccacggcagctacaacaaggtgcacgccaaccgggagcccaagcccaacctgagcccagacaagtacaccagcaccagctacaatgacagcgcctggaggaagaggatccccttcagcaagacctacagcaagtctgagaagatctacccagagcccaggagaaatggcagcaagtag

SEQ ID NO: 36328 - DNA, 294 bp, Artificial Sequence
  Description of Artificial Sequence: Synthetic coding sequence
atggagatgcagcagaactgcagcatcagctgcttctgggagacccagcccctgggctgtgtgaagatcagctgcatcttctaccacagcaagcccaggaacatcaatggcctcttcctgccccccagcagcaacatcaccctgcagaaggagatccaggagggcatccccctgcagagccagagccaggagcccctgaagccccaggagaacatcagccggcccatccaccaccccctggtgctgaagaccaactttgaggaggaggaggaggtggatgagcagaatggatag

SEQ ID NO: 36329 - DNA, 384 bp, Artificial Sequence
  Description of Artificial Sequence: Synthetic coding sequence
atggcccagcacccctgccaggaccaggagcagaaggtggagatgaccagcaagcagcagaggagcaccagcattgaggagaccatgaggccccaggagaagcaggtgaccatcacagagaccctgtgggaccaggtgctgaccgtcttcaaggacatccagaaggagctgcaggaggatgcccgcatccggggcatgagcaactgcagcatgacccccatgaccagcgcccccaggacaggcagcatccggcccccagacagcctgatgacccccaagctgcggcggctgcagttcagcagtggagagcagcccagcggcggccgcatccacaacctgaagacccagctgttcagccagagcgcctactacccaggcccctag

SEQ ID NO: 36330 - DNA, 384 bp, Artificial Sequence; identical to SEQ ID NO: 36329
  Description of Artificial Sequence: Synthetic coding sequence

SEQ ID NO: 36331 - DNA, 1389 bp, Artificial Sequence
  Description of Artificial Sequence: Synthetic coding sequence
atggccagccccctgcccagcggcttccctgcccggaggaacagccggctggatgtgttcctgcggcggcacctgcccccagaggtgtatgatgctgtgcgggcctatgagccctgcatcgtggtgagcaacagcgagaaccacatcctgaagtatgtggtgctgagtgaccggctggtgtacctgacagagaacccccccaagagcatcagaagagtggtggccctgagagatgtggtggccatcgacctgattgatgactacccagagttcctgagcagcccagaccgggagatcagccagcacatccgcatcatctacagcagcacagtgctgaagaaggagtgcaagaagagcaacagcgtgaggaagttcctgttccccttccaccacaccaaggccaacaacaagaaggtgaaggaggagaagaatggcctggccttctggaggagcaaggagagccgcagcctgaaggagagccccctgcggtctgaggagaagatcaagcacttcagccagctgaagtctgagctgttcctgaaggacaacagcctgcggcgcatcctgagcctgctgatggagctgaaggtggccgcccagaagaacttcatcctgaagaggctcttctggaagaccagtgacctcttctacttcatcgtgaacaagctgcacgagtacctgcctgagagccgggacaagaatgccctgcagaaccagagccagagggtggatgagctggtggcctgcatcgagatcatccagaccctggtgctgatgttccgggagacagaaacagagagcagccggctgaacaccctggccgccaagaagggggccctcttcaacctgctggtgatcctgatcagcgagccccagatccccaagagctgccctgtgtttgacatccagctggtggccgacagcgccctggtgaggatgagctttgatgctgagctgcagaagctgatcctggagtacaccaacacagccacagccctgctgtatgagatcctgctggtgttccagcagggcaacctgggcctgggcagcaccaagtttgccatctcctggatcatgtccttcctgcagagctgcccccccatcatcacctttgtggccagcatcgtgaagcaggtggtgcggggcctgagcgccagcttccagctgctgagcccctgccaggccgtgctgctgtaccagcagttctacatcctgaagagctgcctgcggcacagcaggaccctggccgagtacatccggaacaactaccgggaggagttccgctacttcatccacatgcctgccctgcagaagaggctgcccctgtgctaccccatcacccagcccaccatccagctgttccacgaggtgctgaagctggtggagtag

SEQ ID NO: 36332 - DNA, 1878 bp, Artificial Sequence
  Description of Artificial Sequence: Synthetic coding sequence
atggccagccccctgcccagcggcttccctgcccggaggaacagccggctggatgtgttcctgcggcggcacctgcccccagaggtgtatgatgctgtgcgggcctatgagccctgcatcgtggtgagcaacagcgagaaccacatcctgaagtatgtggtgctgagtgaccggctggtgtacctgacagagaacccccccaagagcatcagaagagtggtggccctgagagatgtggtggccatcgacctgattgatgactacccagagttcctgagcagcccagaccgggagatcagccagcacatccgcatcatctacagcagcacagtgctgaagaaggagtgcaagaagagcaacagcgtgaggaagttcctgttccccttccaccacaccaaggccaacaacaagaaggtgaaggaggagaagaatggcctggccttctggaggagcaaggagagccgcagcctgaaggagagcatcctgcctgaccgggaccagcaggagagcagcacccccagcaaggacagcaccctgtgccccaggcctggcctgaagaagctgagcctgcacggccagggcgccttccggcccctgcccagccccagccgccgcagcagccagagcgcccccaccaccgggaaggctgtgtctgagcccagctgcaccaccaacaccaaggagccccagggcctgcctgaccacaacagcatcagcgagatccccttcaagtgcaatggaaatggaaatgagttctacctgggcaacagcctgctggacagccccagccagagcaacagcaacctggagaagaaggagagcgagctgcacctgtatgtgatcagcaccaccagcagcatcttcctgcacctgaagagctcctggaacaactacatcatcgtgaaggccaccctgctgcaggaccccttctacgccagcgagttctccccagccatcggcagccagaagccctacagaagtgaggagaagatcaagcacttcagccagctgaagtctgagctgttcctgaaggacaacagcctgcggcgcatcctgagcctgctgatggagctgaaggtggccgcccagaagaacttcatcctgaagaggctcttctggaagaccagtgacctcttctacttcatcgtgaacaagctgcacgagtacctgcctgagagccgggacaagaatgccctgcagaaccagagccagagggtggatgagctggtggcctgcatcgagatcatccagaccctggtgctgatgttccgggagacagaaacagagagcagccggctgaacaccctggccgccaagaagggggccctcttcaacctgctggtgatcctgatcagcgagccccagatccccaagagctgccctgtgtttgacatccagctggtggccgacagcgccctggtgaggatgagctttgatgctgagctgcagaagctgatcctggagtacaccaacacagccacagccctgctgtatgagatcctgctggtgttccagcagggcaacctgggcctgggcagcaccaagtttgccatctcctggatcatgtccttcctgcagagctgcccccccatcatcacctttgtggccagcatcgtgaagcaggtggtgcggggcctgagcgccagcttccagctgctgagcccctgccaggccgtgctgctgtaccagcagttctacatcctgaagagctgcctgcggcacagcaggaccctggccgagtacatccggaacaactaccgggaggagttccgctacttcatccacatgcctgccctgcagaagaggctgcccctgtgctaccccatcacccagcccaccatccagctgttccacgaggtgctgaagctggtggagtag

SEQ ID NO: 36333 - DNA, 2328 bp, Artificial Sequence
  Description of Artificial Sequence: Synthetic coding sequence
ggcttcctgatccaccccctggtggtggccctgcagcagccccccctgcctgtgctgccccccctgcccctgcccccacctcctcctcctccaccctacggccgcctgctggccaacagcaatgcccaccctggccccttcccccccagcactggagcccagagcacagcccacccccctgtgtccacccaccaccaccaccaccagcagcagcagcagcagcagcagcagcagcagcagcagcagcagcagcagcagcagcaccacggcaacagcggccccccacctcctggggccttcccccaccccctggagggcggcagcagccaccacgcccacccctatgccatgagccccagcctgggcagcctgcggccctacccacctggccctgcccacctgcccccaccccacagccaggtgtcctacagccaggccggccccaatggacctcctgtgagcagcagcagcaacagcagcagcagcaccagccagggcagctacccctgcagccaccccagccccagccagggcccccagggcgccccctaccccttcccccctgtgcccaccgtgaccaccagcagcgccaccctgagcacagtgattgccaccgtggccagcagccctgctggctacaagacagccagccccccaggccccccaccctacggcaagagggcccccagccctggggcctacaagacagccaccccacctggctacaagccaggcagccccccatccttcagaacaggcaccccacctggctaccggggcaccagccccccagctggccctggcaccttcaagccaggcagccccaccgtgggccctggccccctgcccccagctggccccagcggcctgcccagcctgcccccacctcctgctgccccagccagcggcccccccctgagcgccacccagatcaagcaggagcctgctgaggagtatgagaccccagagagccctgtgcccccagcccggagccccagccccccacccaaggtggtggatgtgcccagccacgccagccagagcgcccgcttcaacaagcacctggaccggggcttcaacagctgtgcccggagtgacctgtactttgtgcccctggagggcagcaagctggccaagaagagagctgacctggtggagaaggtgagaagagaggccgagcagagggcccgggaggagaaggagcgggagcgggagcgggagcgggagaaggagcgggagcgggagaaggagcgggagctggagaggtctgtgaagctggcccaggagggccgggcccctgtggagtgccccagcctgggccctgtgccccaccggcccccatttgagcccggcagcgctgtggccaccgtgcccccctacctgggccctgacaccccagccctgcggaccctgtctgaatatgcccggccccacgtgatgagccctggcaacagaaaccaccccttctacgtgcccctgggcgctgtggaccccggcctgctgggctacaacgtgcctgccctgtacagcagtgaccctgctgcccgggagcgggagcgggaggcccgggagcgggacctgcgggaccggctgaagccaggctttgaggtgaagcccagcgagctggagcccctgcacggcgtgcccggccctggcctggaccccttccccaggcatggaggcctggccctgcagcccggccccccaggcctgcaccccttccccttccaccccagcctgggccccctggagcgggagcggctggccctggccgccggccctgccctgcggccagacatgtcctatgcagagcggctggccgctgagcggcagcacgccgagcgggtggccgccctgggcaatgaccccctggcccggctgcagatgctgaatgtgaccccccaccaccaccagcacagccacatccacagccacctgcacctgcaccagcaggatgccatccacgccgccagcgcctctgtgcaccccctgattgaccccctggccagcggcagccacctgacccgcatcccctacccagctggcaccctgcccaaccccctgctgccccaccccctgcatgaaaatgaggtgctgcggcaccagctgtttgctgccccctacagagacctgcctgccagcctgagcgcccccatgtctgctgcccaccagctgcaggccatgcacgcccagagcgctgagctgcagaggctggccctggagcagcagcagtggctgcacgcccaccaccccctgcacagcgtgcccctgcctgcccaggaggactactacagccacctgaagaaggagagtgacaagcccctgtag

SEQ ID NO: 36334 - DNA, 738 bp, Artificial Sequence
  Description of Artificial Sequence: Synthetic coding sequence
atgagcagcgagagcgagaaggacaaggagcggctcatccaggccgccaagatgttcttcttccacgtgcaggacctggccagcgtcatcaacaccctgacagagctgttcagccgctccatgaacacccagatcctgctgatggctgtgaagaacaacagctacatcaaggacttctttgagcagatgctgaagatcttcaaggagatgcagagcgtggtggatgcccggcatgacaagatccagaaggagagcctgtgcagcaaggtggccatggccatgtgcagcgtggtgcagaagagcaccaacgtggaggagctgcaccagagcgccaaggaggtgttcaagagcgcccacacccctgtgatcatctctgtgctgaacagcagcaacatcctgggcagcctggagagcagcctgagccacctgatgaagttccccatcatgaacctgcagctgagtgacttctacacagaggacaccaaggagcagagtgatgtgaccaccagcgagaggaccaggagccccccaggcagcagcaagaccaccatgattgacaccctgaagaagctgcaggatgtgctgaagacagaggacagcaagaaccccaccaagtctgctgctgacctgctggagcagatcgtgaaggccatgggccccatcctggagatcctgcagaaggccatcaagaccatggagatgaacatctctgtgttcaagaaggccagtgacaagtag

SEQ ID NO: 36335 - DNA, 396 bp, Artificial Sequence
  Description of Artificial Sequence: Synthetic coding sequence
atgggcggcaagtctgctgtgcgccaccagctggtgctggactgcccccgggaggccgccagcagcgccccagccctgcggcccctgggcgccgccgccaccagcagagctgcccccctggcccccctgcctgcccccagcccccgctggggcctgggctgcggccgggtgcgctacccaggcccccaccccaggagagctgtggagcctgctgctggccccctgagcgcccccatcatcgccggcggccaccctgctgaggccgccgccggcagcgccaagcagcagcccaggcacagccgggaggtgccccggccccctgtgccccagcaccccagcggcaacagccgcagcgccctgcaggaggccaagacagagcagaccaagaccccctag

SEQ ID NO: 36336 - DNA, 2418 bp, Artificial Sequence
  Description of Artificial Sequence: Synthetic coding sequence
atggccgcccagggcagccccagcagcagccccagtgatgacagcaccaccagcggcagcctgcctgagctgccccccaccagcacagccaccagccgcagccccccagagagcaagggcagcagccgcagcagcctgctgcagtggacctgcccagaggacagcctgcccctggccgtgttctacggccccctggatgccaagaaccccctgctggccagctgtgagaaggagatccaggagctgctgggcttcatgaggaagaagaaggccctggccaccacagaggaggagaagcatgagttcagaagaagatgtgccaccagcctcttcaacatctggaccaagtatgccccccggctgcctgctgactactacaatgagaagctgctgaaggtgggggacagcctgtgccagatgaaggagtacaagctggccctgctgcagtgctacggccgctacctgcagcagttcaacaccaactttgatgagaacaaggtggatgtgacccagttcaaggccaccttcttccccaagggcttcaaggacaagacagctggcctgaccttccacgccctgagcggcaagaacatgtgcaactaccagctggtgtgtgacagtgatgagaacctgaagaacaaggagagcgtggtgcagtgcctgcacatcctgagcagcctgcggctcatcatgcaggtggccctgccccaggagcacctgtgctggatcatcttcaacggcaccatctacatctacaccatctgcaggaagctgatggtgattggccagagcagcaaggccctggagtacctgctgtgggcctccatgtgcatggagagcctggtgcccctgctgagcctgcgctacctgacctggagggccaccctgtacacagctgtgtgccagtgctgctatgactgccacgccggcatccacggggaggcctttgcccggcgggccctggccaagattgatgagctgcggcagctggagctgatgagcagcagcaagagccaggaggagagccgccgctacttccgggaggccaccatgaagatggctgtgatgatcttcaagaggggcgtgtttgagagcaggaggaagaacaaggctgtgttccggcccaagatccgcatcaacctgcgggaggtgcagaccctgtcctggcccaggacagtgacagagcggctgctggatgagatgtttgacagcacagccagccagttcctggccgtgctggaggccctgagtgacagcaacagacgcatcctgcagacaggccccatcgtgacagatgaggtggagatccatgatgtggtgtctgagctgttcatggccggcaaggagctgctgatcatgagcaacatcggggctgatggcatgctggacttccccaagaccagcctgctggagctgatgattggaaggaaggatgtgatctctgtggatgctgctgtgaagttcatcaagctggccttcacctatgaggagtggagcctgtttgagagcagcgctgtgcacctgatctacttcctgcagaggcaggatgatcctgagagcaagaaggccgagaaggacctgaccctgctgattgccatggagcccctcatcaacgtgaagagaaataaaggcctcatcttccccctggagaactacaaggagggccagagcacccagatctacctgaagaagattgctgtgcatgacacctgcctgaagacctgtggctacagcgaggacatcttccacctggccgccaccctgtatgtgtgtgtgtgcacagccccccaggatgtgcagcctgacaaggagatcgtggtggacaccatcatgttcctgtggcagaagtgcaagctgggcatccagaggctgaacatcagcagaaatgactatgccaagttcacccagaagatcagcaccaacaagtggatctacctgctgtggcagatcaatgaagtcatccactgctacaagatggaggacatcgacatcgtggtggtggccgaggtgaccctgcggctgtctgagatcctggagagcctgggcagccctggcaggaagttcaagcagagcctggatgtgcccctgcgggagggcaccaacaagtttcctggggcccccaagggcatcacagagatcctgcccatcctgcagaagaaccctgtggagcagctgctgtttgcctacaagctgctggaccgggccatcggcggcatcaacctgaactgcatgctgaccagcctgcccaacggcagctctgtgattgaccactgctacgccaagaggacccaccacattgatggagacacctacaagcccctggccagcaacagcttcatgatggacctgcacctggagctgatccaggcccagcacagaattgctgtggtgctgctggacaagctgcagggcagctag

SEQ ID NO: 36337 - DNA, 3594 bp, Artificial Sequence
  Description of Artificial Sequence: Synthetic coding sequence
atgtctgatgagaacatgagcaagacccagacagtgtatgacagcgacagccagagcggcagcagcgccaaggagaaggacagaggagccaacctgtgtgtgatggaccacttcatgaagatcttcctgtactgccggcgggccatggtgctggcccacagaggaggctactggaccctgctgcagaactgctgccgggccctgtggaacttcacccaggagctgcagatcctgctgaagcaggccgtggacctggacaagaccttccccatcagccaggacggcttcctgtgcacctctgtgctgcccttctacctgggcgctgagctgctgattgacatgctgatccagctgcagaacaccagcagcatcaagcccatcgaggacaagggggagttctctgtgcccagctgctacggcaacatcaagaatgacaatggaggcagcagcctgacctttgagcaccccctggatgatgtgaatgtggtggacctgaagtggattcatgactttgtgctgaagagcctggaggtgctgtaccaggtggagaagtgggagaccctggtgtccctggccatccagttcaacacagtgtcccatgagcgctacacagagcaggtgacccccctgctggtgtatgcccagaggcagctgctgctgcgcatccagaagttcaagggccctgacatcacccagcagccctgtgcccgctatgaggccgagtatggagagaagatcacctgcaggaacttcatcggcaagcagctgaagatcaacagcagcaccatcgaggccaccagcaactgcacagacctgctgaagatgctgatcagcagcgagtacagccgggccaaggccctggtgtgtgtgcctgtggatgtgacagacaccctgcgctgcttccgggagaccctggagaagagcaagtaccacaacagaagcatccgccacagcaggaagctgctgagcctcttcctggcccagacccaggatgtgctgcaggccagcaaccagaggagcctgaaggtgcaggccctgcacagcctgggcagcctgctgatctttgctgagaagaagagagctgccttcaagtgctggtgccaggccctggatgacatcttcaggaagccagatgtgctgcacacctggaaggagtttggccccagcctgaccaacgtgaccaacagccacagccccccaggcttcaaggactacagcgaggagttcctgagccgggtgggcatctggggctgcctgcagggcgccgtcatcagcgccaagatcgcccagttcatcaagagcctgaatgtggagaagaagacagactgctgcatcctgagcgccctgctcttccagggcctgctgcggaccaccctgccccaccccaaggccgagcgctgctacgcccagtatgagatcacccagctgctgcccggcatcgagctgttcagtgaccgctacagagctgacatctgcagcgtgattgccagcctgtactacatcatccgggagctgcactttgtgcggcagaacctgattgtgctgcccctgctggccctgtaccagtactttgtgtctggcatctgccaggacatcaccaggaacctggaggcccgcatcctgaagattgaggtgctgattgacctgcgcttcttcagcgaggccttctatgagatcagccagatcttctacggcaagaacatgccctgccccatcccagctggctacaaggccaccgggaagatgaagatcttccagagctttgacagcggcaagctgctgaccagcaaggagaacatccaggccattgatgagctgagaaataaaggcctgcctgctgtgctggtgaccatcggccagccccacctgctgaacaagttcaactttgtgaaggcctacttcttcctgtctgtggccgccaccatcaactgtgtgcctgagaacaagttcaagacagtcatcaccaacaagagcaagcccaacctgcccaacctggaggagatctacagcaaggatgatggcagcagcttctacaacctgaccaagctgaaggatgagatcaccctgtccatgctgaagtccatgctgctgatggaggctgaagatcggctgaacttcctgctgtctgaggtggagcagaagaccctgagccagtgcagcgctggggagctggagatcgtggtggaggcccggctgcagctggccgctgtggccctgcagaggcaccgggccgcctacagcgctgccatcgtgttcagcaccctgaccctgctgcaggacagcaagctgtttgagaagaaggtggtgcaggatgacacagagaaccctgtgtccccaggcacctctgtgacagagaacaaggatgacagcgagttcctggaccccatcagcctgaatgcccgggagtacttcaacatccacctgtggctgcgctgccgcctggccctggtgacagcctttgtggcccagatccatggaattggaattgtgaaggaggatgacatgacagactgcctgagcctcatcaatgaggtgtgcatggaggccaagtctgctggggacacagagctgcaggccgagttcctgacccaggccgtcatcctgggcctgcaggagaagcacctgaaggctgacatcatgaccaacctgcaggacatcatccacctgctggagggcaatgagttcatcagcccccagagccggctgaccctggcccggagcctggtgctgctggatgacctgaccaaggccgagaagttcaaggagagccccagcagcaagacaggcaagctgaacctgctgacccgggcccacagcatcctgacagagcagatgctggccttcggggagaccatcgagttccgcagcagcaacaccaagtatgccaaccccctgcagcccctgaagaacatctacctgccccacgtgatgctgctggccaagatcaagatgagaattggccacacagtggccaagcaggtgtactacaagaacaagaggaaggaccccagcaagtggctgcctgccctgcacctgtttgatgtggccctgaagctgtgcaggaccacagctgtggaggagcacgaggtggaggccgagatcctcttccagaagggcaagattgagcggcagatcctgatggaggagaagagccccagcttccagctggagagcctgtatgaggccatccagctgagcctgaagaatgaccagaacagcggcctcatccgggacagctacctggagatggccctgctgtacttccacctgaagaagcccaagatcaagatcagcggcagccccctgaccctgaagccacccctgcggcgcagcagctctgtgaaggagaccagcgccaacaagtttgagatgtacagcagcctggcctggatcgccatccgggccgccgcccaggtgtctgaggccgtgctggccatcaacctgctgattggcaagaagaacaccaggatgcacaaggtgaaccaggtggccctgcccaacatccctgagtttgctgccctggacctgctgagcagctacacagactacctgctgggcatgtttggctgcctgcacatcatgcagaagaactag

SEQ ID NO: 36338 - DNA, 1338 bp, Artificial Sequence
  Description of Artificial Sequence: Synthetic coding sequence
atgggagagagcatccccctggccgcccctgtgcctgtggagcaggccgtgctggagaccttcttcagccacctgggcatcttctcctatgacaaggccaaggacaacgtggagaaggagcgggaggccaacaagtctgctgggggctcctggctgagcctgctggccgccctggcccacctggccgctgctgagaaggtgtaccacagcctgacctacctgggccagaagctgggcggccagagcttcttcagcaggaaggacagcatccgcaccatctacaccagcctgcacaatgagctgaagaaggtggtgacaggccgcggggccctgggcggcacagcccctcatgtggaggagctgctgagccacctgtctgagcagctgtgcttctttgtgcaggccaggatggagatggctgacttctatgagaagatgtacaccctgagcacccagaagttcatcaatgctgaggagctggtgggcctgctggatgccatcatgaagaagtacagcagccgcttccaccaccccatcctgagccccctggagagcagcttccagctggaggtggatgtgctgtgccacctgctgaaggcccaggcccaggtgtctgagtggaagttcctgcccagcctggtgaacctgcacagcgcccacaccaagctgcagacctggggccagatctttgagaagcagcgggagaccaagaagcacctgtttggaggccagagccagaaggctgtgcagcccccccacctgttcctgtggctgatgaagctgaagaacatgctgctggccaagttctccttctacttccacgaggccctgagccggcagaccacagccagcgagatgaagaccctgacagccaaggccaacccagacttcttcggcaagatcagcagcttcatcagaaaatatgatgctgccaacgtgtccctcatctttgacaacagaggcagcgagagcttccagggccacggctaccaccacccccacagctaccgggaggcccccaagggcgtggaccagtacccagctgtggtgtccctgcccagcgacaggcctgtgatgcactggcccaacgtcatcatgatcatgacagacaggaccagtgacctgaacagcctggagaaggtggtgcacttctatgatgacaaggtgcagagcacctacttcctgaccaggcctgagccccacttcaccatcgtcatcatctttgagagcaagaagtctgagcgggacagccacttcatctccttcctgaatgaggtgtccctggccctgaagaaccccaaggtgtttgccagcctgaagccaggggccaagggctag

SEQ ID NO: 36339 - DNA, 1032 bp, Artificial Sequence
  Description of Artificial Sequence: Synthetic coding sequence
atggccctgacccccaccaacctgaacaacaagatgagcctgcagatgaagatggactgccaggagcagcagctgaccaagaagaacaacggcttcttccagaagctgaatgtgacagaaggagccatgcaggacctgctgaaggagatcatcaaggtggaccacatcctggacagaagtgatgatgaagatgacatcagcagcgagaacccccagacagacttcctgcacaagggcatgctggagctggaggccgagcatgaccaggacctgagcaagcaggacaagcaggagacagatgtggatgaggacccccaggccagcaccagcctgcagttcagcaagaagaacctgctggagctgtgcctgaagggcatgttcctgaagctgaactactggaacaccaagattggcctgcaggtgaaggagctgggcgctgactacattgatggaacagagaagattgacaacatcatcaagaagatcaacgtgacagagaacacagtgaagagcctgctgaaggacatgctgaccctgaagggccagatcgagaagctggaggaccggggcctggacctggaccagggcaccagcacagaggtgaacacctgcaatgaggtgtatgagctgaagaagaaggtgattgagcggctggaggacctgtgcaagaatgtggagctgctgagcgccaagctgaggatgtaccagatggaggccgaggacacagacagccacagcagcgaggagattgacacagaggagatggaggccctgctgccccaggccccagccagcttcctggtgcagaagagcccccccaggaacacagcctggaagagggccctgcgcatcttcatcatgtttgatgtgctgactgtgacaggcctgctgtgctacatcctcttctttggagccaccttcctgtttgagcgggtgctgctgaggatgctgggctgcaggaccacctgggacctgcgggagatgagggagcccttcctgaacctggaggtggaggccctgctgcccagctag

SEQ ID NO: 36340 - DNA, 1032 bp, Artificial Sequence; identical to SEQ ID NO: 36339
  Description of Artificial Sequence: Synthetic coding sequence

SEQ ID NO: 36341 - DNA, 906 bp, Artificial Sequence
  Description of Artificial Sequence: Synthetic coding sequence
atggcctacagcagcagcaacagcgacattgaagatgacagcagcaagagcaacagcaacctgagcctgtctgtgggctacttcccctgtgaggacaccccctgtgaggacaccacctcctgggaggatgcccccagcaagggccccagcatccacttcctgccccctgtgcagggcgcctggggcacagagcgcatcggccgcaggatgaagaggcaggaccagatccaggatgagcctgagcagttctgcaagctgagcatcttcctggcctgggatgtggacatcggcagtgacaacacagacagccgggccaaccggctgctgaatggagacaacctgtggattgacaagctgcccaaggagaggaccaagctgtctgtgggcaagctgaacaacctggtgcaggagttccagatcttcctggagaacctgaaggatgatgatgctgtgtttcctgagacagcccagcaggacttccagctgagcagcggcagccccccagagatggtgcaggtgagccaccaggagtatgatgcctgccaggacctgcccaagtgcaagcccccagagaacaaggatgtgatgctgaagggccacgagctggccgagatgatcagccaggccacagccagccagaggaccagcgcccctgagatcagcagcatcctgtctgagcagcctgagaaggatgacacccccagccacacccaggcccagtgctgcctgaactttggctgggccttctcctggctgcggcagaggatcctgcccagcctgctgcggcgggaccaccctgtgaatgccaccaagagcccccacaggtctgcccccaccaagaggctcttccaccggggcaagaggatccagccccaggagaccctggagctgggccaccccatctag

SEQ ID NO: 36342 - DNA, 810 bp, Artificial Sequence
  Description of Artificial Sequence: Synthetic coding sequence
atggcctacagcagcagcaacagcgacattgaagatgacagcagcaagagcaacagcaacctgagcctgtctgtgggctacttcccctgtgaggacaccccctgtgaggacaccacctcctgggaggatgcccccagcaagggccccagcatccacttcctgccccctgtgcagggcgcctggggcacagagcgcatcggccgcaggatgaagaggcaggaccagatccaggatgagcctgagcagttctgcaagctgagcatcttcctggcctgggatgtggacatcggcagtgacaacacagacagccgggccaaccggctgctgaatggagacaacctgtggattgacaagctgcccaaggagaggaccaagctgtctgtgggcaagctgaacaacctggtgcaggagttccagatcttcctggagaacctgaaggatgatgatgctgtgtttcctgagacagcccagcaggacttccagctgagcagcggcagccccccagagatggtgcagatgatcagccaggccacagccagccagaggaccagcgcccctgagatcagcagcatcctgtctgagcagcctgagaaggatgacacccccagccacacccaggcccagtgctgcctgaactttggctgggccttctcctggctgcggcagaggatcctgcccagcctgctgcggcgggaccaccctgtgaatgccaccaagagcccccacaggtctgcccccaccaagaggctcttccaccggggcaagaggatccagccccaggagaccctggagctgggccaccccatctag

SEQ ID NO: 36343 - DNA, 573 bp, Artificial Sequence
  Description of Artificial Sequence: Synthetic coding sequence
atggagaagacagagagcttctgcccagaggtgcccccccaggactgtggggccagcccccggcccagcctgcggagcctgcccaagaaccagggcagcctgctgcagtttgaccggcaggcccctggccgcatcagcaccagccccaccctgcggcggctgcggacccggggctgcggcacccggcaggatgcctggcaggtgaccacctggggctcctggggcgcccctgtgggcttcccctgctacctgagcaagagcctgcccggcagccccaaggacagcagccacctgctgagccccctgcggctgcacagccggctgaccagcgagcctgagcgggccctgaatgctgctgacagcctggagccccagacccggcccacagacaagtacctgcccccagagctgcagcctgtgaatgaaggcagcctgcaccaggccagcctgcggcagcaggagggccacttcctgcccagccccaccctgcggcaccccagcccccagggcgaggagctgcaccccagccgctgtgtgtgcatctacttcctgcgctgctatgacatctgctag

SEQ ID NO: 36344 - DNA, 522 bp, Artificial Sequence
  Description of Artificial Sequence: Synthetic coding sequence
atggagaagacagagagcttctgcccagaggtgcccccccaggactgtggggccagcccccggcccagcctgcggagcctgcccaagaaccagggcagcctgctgcagtttgaccggcaggcccctggccgcatcagcaccagccccaccctgcggcggctgcggacccggggctgcggcacccggcaggatgcctggcaggtgaccacctggggctcctggggcgcccctgtgggcttcccctgctacctgagcaagagcctgcccggcagccccaaggacagcagccacctgctgagccccctgcggctgcacagccggctgaccagcgagcctgagcgggccctgaatgctgctgacagcctggagccccagacccggcccacagacaagtacctgcccccagagctgcagcctgtgaatgaaggcagcctgcaccaggccagcctgcggcagcaggagggccacttcctgcccagccccaccctgcggcaccccagcccccaggtgacccagctgtag

SEQ ID NO: 36345 - DNA, 192 bp, Artificial Sequence
  Description of Artificial Sequence: Synthetic coding sequence
atgggctgcggcaacagcacagccaccagcgctggagctggccagggccctgctggggccgccaaggatgtgacagaggagagcgtgacagaagatgacaagagaagaaactacggcggcgtgtatgtgggcctgcccagcgaggccgtgaacatggtgagcagccagaccaagacagtgaggaagaactag

SEQ ID NO: 36346 - DNA, 408 bp, Artificial Sequence
  Description of Artificial Sequence: Synthetic coding sequence
atgttccagaacctgcagggcacctttgagaaggagatcggcaagatcatccccttcaccatcgccttcaagagagctgaggccgtggagccagatggctgtgtgcagagctggcgctgctgcctgccctgtgacctgggccaggccagccgcttcatccacaccaccgtgtgcagcgccatccgctggaggagctgcaagggggagaggaactttgctgagcggcacatcctgcctgctgagctggaggagcagagcaaccacgccggcatgggccccatcctgcctgccatgcccagcgtggatggcaaccacttccagcaccctgctggggactgccacccctacggcatcctgtgcctgcaggcccacagcgcctctgtgacagcccggcaggtgctgcagtag

SEQ ID NO: 36347 - DNA, 438 bp, Artificial Sequence
  Description of Artificial Sequence: Synthetic coding sequence
atgatccccaagctggccaccccccgggacatcagcctgctggtgatcaaggaggccagcagccgggccaggaacaacatccagatcctggaccccctggaccacatcgcccggctgaccaactacaccctgaccagctgcttcagcagcaacaaggtgcccaccatgcctggcagcctgcccaccggcagcaagcagggcaatgtgcagaccctggacagcatccgctggatgcctgccacccctgtgcctgcccctgagtgccaccagaagtatgccatcagcacagaaacagccttccccaccctgagcaccttcatgaacacagagaagtctgtgaagggcagcaatgctgacttcaccaagaggaacccccgctggaggttcctgctgggcatctactgcagcctgcaccacgccatgaccatcttcatctag

SEQ ID NO: 36348 - DNA, 870 bp, Artificial Sequence
  Description of Artificial Sequence: Synthetic coding sequence
atggagcagcccggcccccgggccccagaccccagcctgtgccaccacaacctgcagcccacagatgaccccaactgggacagctatgccaccaccatgaggacagccttcacccccaagacaggagctgtgcctgccctgatccggcagaatggcatccggcggctgggctacacctacagcctgagtgaccccatcctgaaccagacccagtacagtgatgagtacacctggaagagccacagcaaggaggacctgatcaagacagagaccagccggggcatcaagagccacaagagccacctgaatgaagacatcttcctgtggaccctgccccactgccagcagacaggcaccctgaagaactgcctgccctggaagatcccagcctccatgaaggaggtgaacaaggccctgagcaaccagttcatcagcctgaccaagagggactttgtggacaggagcaaggcccagaagatcaagaagagcagccacctgagcctggagtggaagaagctgctgccccagcccccagacacagagttcagaagaaactaccagatcccagccaagatccctgagctgcaggacttctccttcaagtatggctgctacagcagcctgcctgtggccagccagggcctggtgcccagcgtgctgcacagctacctgaggaaccaggagcacaccaagaagcagaccacctaccagagcgactatgacaagacctacccagacttcctgatgctgctgaacagcttcaccagcagccaggtgaaggagtacctgcagagcctgagctacaaggaccggcagatcatcgaccgcttcatccgcacccactgtgacaccaacaagaagaagaagtag

SEQ ID NO: 36349 - DNA, 561 bp, Artificial Sequence
  Description of Artificial Sequence: Synthetic coding sequence
atgaacctgccccacctgatgagcctggccagccacctggccagccacggcttcttctgcctgcgcttcacctgcaagggcctgaacatcgtgcaccgcatcaaggcctacaagtctgtgctgaactacctgaagaccagcggggagtacaagctggccggggtcttcctgggcggccgctccatgggcagcagagctgctgcctctgtgatgtgccacatcgagccagatgatggagatgactttgtgcggggcctcatctgcatctcctaccccctgcaccaccccaagcagcagcacaagctgagagatgaagatctcttccggctgaaggagcctgtgctgtttgtgtctggcagcgcagatgagatgtgtgagaagaacctgctggagaaggtggcccagaagatgcaggccccccacaagatccactggattgagaaggccaaccacagcatggctgtgaagggccgcagcaccaatgatgtgttcaaggagatcaacacccagatcctcttctggatccaggagatcacagagatggacaagaagtgccactag

SEQ ID NO: 36350 - DNA, 561 bp, Artificial Sequence; identical to SEQ ID NO: 36349
  Description of Artificial Sequence: Synthetic coding sequence

SEQ ID NO: 36351 - DNA, 684 bp, Artificial Sequence
  Description of Artificial Sequence: Synthetic coding sequence
atgagccacacagaggtgaagctgaagatccccttcggcaacaagctgctggatgctgtgtgcctggtgcccaacaagagcctgacctacggcatcatcctgacccacggggccagcggggacatgaacctgccccacctgatgagcctggccagccacctggccagccacggcttcttctgcctgcgcttcacctgcaagggcctgaacatcgtgcaccgcatcaaggcctacaagtctgtgctgaactacctgaagaccagcggggagtacaagctggccggggtcttcctgggcggccgctccatgggcagcagagctgctgcctctgtgatgtgccacattgaaccagatgatggagatgactttgtgcggggcctcatctgcatctcctaccccctgcaccaccccaagcagcagcacaagctgagagatgaggacctcttccggctgaaggagcctgtgctgtttgtgtctggcagcgcagatgagatgtgtgagaagaacctgctggagaaggtggcccagaagatgcaggccccccacaagatccactggattgagaaggccaaccacagcatggctgtgaagggccgcagcaccaatgatgtgttcaaggagatcaacacccagatcctcttctggatccaggagatcacagagatggacaagaagtgccactag

SEQ ID NO: 36352 - DNA, 420 bp, Artificial Sequence
  Description of Artificial Sequence: Synthetic coding sequence
atgggccagaactggaagaggcagcagaagctgtggaatgtgccccagctgcccttcatccgggtgcccccatccatctatgacaccagcctgctgaaggccctgaaccagggccagcagcgctacttctacagcatcatgaggatctacaacagccggccccagtgggaggccctgcagacccgctacatccacagcctgcagcaccagcagctgctgggctacatcacccagcgggaggccctgtcctatgccctggtgctgcgggacagcaccaagagggccagcgccaaggtggccccccagaggaccatccccaggaagaccagcgccatgacccggcgctgccccagcgtgctgcctgtgtctgtggtgctgccccgggcccagagcaagaggcggcaggtgctgaggaactag

SEQ ID NO: 36353 - DNA, 420 bp, Artificial Sequence; identical to SEQ ID NO: 36352
  Description of Artificial Sequence: Synthetic coding sequence

SEQ ID NO: 36354 - DNA, 912 bp, Artificial Sequence
  Description of Artificial Sequence: Synthetic coding sequence
atggccggggccgcctgtgagcctgtggcccggcccagcctgaccagcatcagcagtggagagctgcggagcctgtggacctgtgactgtgagctggccctgctgcccctggcccagctgctgcggctgcagcccggggccttccagctgagcggggaccagctggtggtggcccggcctggagagcctgctgctgcccggggcggcttcaacgtgtttggagatggcctggtgcggctggatggccagctgtaccgcctgagcagctacatcaagcgctacgtggagctgaccaactactgtgactacaaggactaccgggagaccatcctgagcaagcccatgctgttcttcatcaacgtgcagaccaagaaggacaccagcaaggagaggacctacgccttcctggtgaacaccaggcaccccaagatccggcggcagatcgagcagggcatggacatggtgatcagcagcgtcatcggggagagctaccgcctgcagtttgacttccaggaggccgtgaagaacttcttccccccaggaaatgaggtggtgaatggagagaacctgagctttgcctatgagttcaaggcagatgccctgtttgacttcttctactggtttggcctgagcaacagcgtggtgaaggtgaatggcaaggtgctgaacctgagcagcaccagccctgagaagaaggagaccatcaagctgttcctggagaagatgtctgagcccctcatccgccgcagcagcttcagtgacaggaagttctctgtgaccagccggggcagcattgatgatgtgttcaactgcaacctgagccccaggagcagcctgacagagcccctgctggccgagctgcccttccccagcgtgctggagagcgaggagacccccaaccagttcatctag

SEQ ID NO: 36355 - DNA, 366 bp, Artificial Sequence
  Description of Artificial Sequence: Synthetic coding sequence
atgaacagccctgaggcccggctgtgtgtggcccagtgccgggacagctacccaggctgccagcccctgaaggacacccgggcctgggccagcagcctgaagatggaccctgctggcctggagggcggccccagagatgagagcagagatgagccccccatccgggcccaggccgcctcctgggaccagccccagggctgcctgacctacaagggcagaagaagtgccagcggcacccagaagcagctgcagctgcctgacaccctgagcagcctgctgtgctggaggggggccatcatggtgtacatcaaggtgacagtgcagacagatgacagcaacaagctgctgagcctgctgtacagatag

SEQ ID NO: 36356 - DNA, 3495 bp, Artificial Sequence
  Description of Artificial Sequence: Synthetic coding sequence
atggccctcttccctgcctttgctggcctgtctgaggccccagatggcggcagcagcaggaaggagctggactggctgagcaaccccagcttctgtgtgggcagcatcaccagcctgagccagcagacagaagctgccccagcccacgtgtctgagggcctgcccctgaccaggagccacctgaagtctgagagcagtgatgaaagtgacaccaacaagaagctgaagcagaccagcaggaagaagaagaaggagaagaagaagaagaggaagcaccagcaccacaagaagaccaagaggaagcacggccccagcagcagcagccgctcagaaacagacacagacagcgagaaggacaagcccagccggggcgtgggcggcagcaagaaggagagcgaggagcccaaccagggcaacaatgctgctgctgacaccggccacagatttgtgtggctggaggacatccaggccgtgactggagagaccttcagaacagacaagaagccagaccctgccaactgggagtacaagagcctgtacagaggagacatcgcccgctacaagaggaagggggacagctgcctgggcatcaaccccaagaagcagtgcatctcctgggagggcaccagcacagagaagaagcacagcaggaagcaggtggagcgctacttcaccaagaagtctgtgggcctgatgaacattgatggagtggccatcagcagcaagacagagccccccagcagcgagcccatctccttcatccctgtgaaggacctggaggatgctgcccctgtgaccacctggctgaaccccctgggcatctatgaccagagcaccacccactggctgcagggccagggccccccagagcaggagagcaagcagccagatgcccagcctgacagcgagagcgctgccctgaaggccaaggtggaggagttcaacagaagagtgcgggagaacccccgggacacccagctgtggatggcctttgtggccttccaggatgaggtgatgaagagccctggcctgtatgccatcgaggagggggagcaggagaagaggaagaggagcctgaagctgatcctggagaagaagctggccatcctggagcgggccatcgagagcaaccagagctctgtggacctgaagctggccaagctgaagctgtgcacagagttctgggagcccagcaccctggtgaaggagtggcagaagctgatcttcctgcaccccaacaacacagccctgtggcagaagtacctgctcttctgccagagccagttcagcaccttcagcatcagcaagatccacagcctgtatggcaagtgcctgagcaccctgtctgctgtgaaggatggcagcatcctgagccacccagccctgcctggaacagaggaggccatgtttgccctcttcctgcagcagtgccacttcctgcggcaggccggccacagcgagaaggccatcagcctcttccaggccatggtggacttcaccttcttcaagccagacagcgtgaaggacctgcccaccaagggccaggtggagttctttgagcccttctgggacagcggggagccccgggccggggagaagggggcccggggctggaaggcctggatgcaccagcaggagcggggcggctgggtggtgatcaacccagatgaagatgatgatgagcctgaggaggatgaccaggagatcaaggacaagaccctgccccgctggcagatctggctggccgctgagaggagccgggaccagaggcactggaggccctggaggccagacaagaccaagaagcagacagaggaggactgtgaagatcctgagcggcaggtgctgtttgatgacatcggccagagcctcatccggctgagcagccatgacctgcagttccagctggtggaggccttcctgcagttcctgggcgtgcccagcggcttcaccccaccagccagctgcctgtacctggccatggatgaaaattccatctttgacaatggcctgtatgatgagaagcccctgaccttcttcaaccccctcttcagcggggccagctgtgtgggccgcatggaccggctgggctacccccgctggacccggggccagaaccgggagggggaggagttcatcagaaatgtgttccacctggtgatgcccctcttcagcggcaaggagaagagccagctgtgcttctcctggctgcagtatgaaattgccaaggtgatctggtgcctgcacaccaagaacaagaagaggctgaagagccagggcaagaactgcaagaagctggccaagaacctgctgaaggagcctgagaactgcaacaacttctgcctgtggaagcagtatgcccacctggagtggctgctgggcaacacagaagatgccaggaaggtgtttgacacagccctgggcatggccggcagccgggagctgaaggacagcgacctgtgtgagctgagcctgctgtatgcagagctggaggtggagctgagccctgaggtgagaagagctgccacagcccgggctgtgcacatcctgaccaagctgacagagagcagcccctacggcccctacacaggccaggtgctggccgtgcacatcctgaaggccaggaaggcctatgagcacgccctgcaggactgcctgggggacagctgtgtgagcaacccagcccccacagacagctgcagccgcctcatcagcctggccaagtgcttcatgctgttccagtacctgaccatcggcattgatgctgctgtgcagatctatgagcaggtgtttgccaagctgaacagctctgtgtttcctgagggcagcggggagggggacagcgccagcagccagagctggacctctgtgctggaggccatcaccctgatgcacaccagcctgctgcgcttccacatgaaggtgtctgtgtaccccctggcccccctgcgggaggccctgagccaggccctgaagctgtacccaggcaaccaggtgctgtggaggagctatgtgcagatccagaacaagagccacagcgccagcaagacccggcgcttctttgacaccatcaccaggtctgccaagcccctggagccctggctgtttgccatcgaggccgagaagctgaggaagaggctggtggagaccgtgcagaggctggatggccgggagatccacgccaccatccctgagaccggcctgatgcaccgcatccaggccctgtttgaaaatgccatgagaagtgacagcggcagccagtgccccctgctgtggaggatgtacctgaacttcctggtgtccctgggcaacaaggagaggagcaaaggagtcttctacaaggccctgcagaactgcccctgggccaaggtgctgtacctggatgctgtggagtacttcccagatgagatgcaggagatcctggacctgatgacagagaaggagctgcgggtgcggctgcccctggaggagctggagctgctgctggaggactag

SEQ ID NO: 36357 - DNA, 2802 bp, Artificial Sequence
  Description of Artificial Sequence: Synthetic coding sequence
atgaacattgatggagtggccatcagcagcaagacagagccccccagcagcgagcccatctccttcatccctgtgaaggacctggaggatgctgcccctgtgaccacctggctgaaccccctgggcatctatgaccagagcaccacccactggctgcagggccagggccccccagagcaggagagcaagcagccagatgcccagccagattctgagagcgctgccctgaaggccaaggtggaggagttcaacagaagagtgcgggagaacccccgggacacccagctgtggatggcctttgtggccttccaggatgaggtgatgaagagccctggcctgtatgccatcgaggagggggagcaggagaagaggaagaggagcctgaagctgatcctggagaagaagctggccatcctggagcgggccatcgagagcaaccagagctctgtggacctgaagctggccaagctgaagctgtgcacagagttctgggagcccagcaccctggtgaaggagtggcagaagctgatcttcctgcaccccaacaacacagccctgtggcagaagtacctgctcttctgccagagccagttcagcaccttcagcatcagcaagatccacagcctgtatggcaagtgcctgagcaccctgtctgctgtgaaggatggcagcatcctgagccacccagccctgcccggcacagaggaggccatgtttgccctcttcctgcagcagtgccacttcctgcggcaggccggccacagcgagaaggccatcagcctcttccaggccatggtggacttcaccttcttcaagccagattctgtgaaggacctgcccaccaagggccaggtggagttctttgagcccttctgggacagcggggagcccagggctggggagaagggggcccggggctggaaggcctggatgcaccagcaggagcggggcggctgggtggtgatcaacccagatgaagatgatgatgagccagaagaagatgaccaggagatcaaggacaagaccctgccccgctggcagatctggctggccgctgagaggagccgggaccagaggcactggaggccctggaggccagacaagaccaagaagcagacagaggaggactgtgaggaccctgagcggcaggtgctgtttgatgacatcggccagagcctcatccggctgagcagccatgacctgcagttccagctggtggaggccttcctgcagttcctgggcgtgcccagcggcttcaccccaccagccagctgcctgtacctggccatggatgagaacagcatctttgacaatggcctgtatgatgagaagcccctgaccttcttcaaccccctcttcagcggggccagctgtgtgggccgcatggaccggctgggctacccccgctggacccggggccagaaccgggagggggaggagttcatcagaaatgtgttccacctggtgatgcccctcttcagcggcaaggagaagagccagctgtgcttctcctggctgcagtatgagatcgccaaggtgatctggtgcctgcacaccaagaacaagaagaggctgaagagccagggcaagaactgcaagaagctggccaagaacctgctgaaggagcctgagaactgcaacaacttctgcctgtggaagcagtatgcccacctggagtggctgctgggcaacacagaagatgccaggaaggtgtttgacacagccctgggcatggccggcagccgggagctgaaggacagcgacctgtgtgagctgagcctgctgtatgcagagctggaggtggagctgagccctgaggtgcggcgggccgccacagcccgggctgtgcacatcctgaccaagctgacagagagcagcccctacggcccctacacaggccaggtgctggccgtgcacatcctgaaggccaggaaggcctatgaacatgccctgcaggactgcctgggggacagctgtgtgagcaacccagcccccacagacagctgcagccgcctcatcagcctggccaagtgcttcatgctgttccagtacctgaccatcggcattgatgctgctgtgcagatctatgagcaggtgtttgccaagctgaacagcagcgtcttccctgagggcagcggggagggggacagcgccagcagccagagctggacctctgtgctggaggccatcaccctgatgcacaccagcctgctgcgcttccacatgaaggtgtctgtgtaccccctggcccccctgcgggaggccctgagccaggccctgaagctgtacccaggcaaccaggtgctgtggaggagctatgtgcagatccagaacaagagccacagcgccagcaagacccggcgcttctttgacaccatcaccaggtctgccaagcccctggagccctggctgtttgccattgaagctgagaagctgaggaagaggctggtggagaccgtgcagaggctggatggccgggagatccacgccaccatccctgagaccggcctgatgcaccgcatccaggccctgtttgaaaatgccatgagaagtgacagcggcagccagtgccccctgctgtggaggatgtacctgaacttcctggtgtccctgggcaacaaggagaggagcaagggcgtcttctacaaggccctgcagaactgcccctgggccaaggtgctgtacctggatgctgtggagtacttcccagatgagatgcaggagatcctggacctgatgacagagaaggagctgcgggtgcggctgcccctggaggagctggagctgctgctggaggactag

SEQ ID NO: 36358 - DNA, 744 bp, Artificial Sequence
  Description of Artificial Sequence: Synthetic coding sequence
atgtctgggaaggacagaattgagatcttccccagcaggatggcccagaccatcatgaaggcccggctgaagggggcccagacaggcaggaacctgctgaagaagaagagtgatgccctgaccctgcgcttccggcagatcctgaagaagatcatcgagaccaagatgctgatgggagaggtgatgagggaggccgccttcagcctggccgaggccaagttcaccgctggggacttcagcaccaccgtcatccagaatgtgaacaaggcccaggtgaagatccgggccaagaaggacaacgtggccggcgtgaccctgcctgtgtttgagcactaccacgagggcacagacagctatgagctgaccggcctggcccggggcggggagcagctggccaagctgaagaggaactatgccaaggctgtggagctgctggtggagctggccagcctgcagaccagctttgtgaccctggatgaggccatcaagatcaccaacagaagagtgaatgccatcgagcacgtgatcatcccccgcatcgagaggaccctggcctacatcatcacagagctggatgagcgggagcgggaggagttctaccgcctgaagaagatccaggagaagaagaagatcctgaaggagaagtctgagaaggacctggagcagaggagagctgctggggaggtgctggagcccgccaacctgctggccgaggagaaggatgaggacctgctgtttgaatag

SEQ ID NO: 36359 - DNA, 1449 bp, Artificial Sequence
  Description of Artificial Sequence: Synthetic coding sequence
atggatgagctggtgcatgacctggccagcgccctggagcagaccagcgagcagaacaagctgggggagctgtgggaggagatggccctgagcccccggcagcagaggcggcagctgaggaagaggcggggcaggaagagaagaagtgacttcacccacctggccgagcacacctgctgctacagcgaggccagcgagagcagcctggatgaggccaccaaggactgccgggaggtggcccctgtgaccaacttcagtgacagtgatgacaccatggtggccaagaggcacccagccctgaatgccatcgtgaagagcaagcagcacagctggcatgaaagtgacagcttcacagaaaatgccccctgccggcccctgcggcggcggaggaaggtgaagagggtgaccagcgaggtggccgccagcctgcagcagaagctgaaggtgtctgactggagctatgaaagaggctgccgcttcaagagcgccaagaagcagaggctgagccgctggaaggagaacaccccctggaccagcagcggccacggcctgtgtgagagcgcagaaaatagaaccttcctgagcaagacaggcaggaaggagaggatggagtgtgaaacagatgagcagaagcagggcagtgatgagaacatgtctgaatgtgagaccagctctgtgtgcagcagcagtgacaccggcctcttcaccaatgatgagggccggcagggagatgatgagcagagcgactggttctatgaaggagaatgtgtgcccggcttcaccgtgcccaacctgctgcccaagtgggccccagaccactgcagcgaggtggagaggatggacagcggcctggacaagttcagtgacagcaccttcctgctgcccagcaggcctgcccagaggggctaccacacccggctgaaccggctgcctggagctgctgcccgctgcctgaggaagggcagaagaaggctggtgggcaaggagaccagcatcaacaccctgggcacagagcgcatcagccacatcatcagtgacccccggcagaaggagaagaacaaggccctggccagtgacttcccccacatcagcgcctgtgcccacgagttcaaccccctgagccccctgtacagcctggatgtgctggctgatgccagccaccggcgctgcagccctgcccactgcagcgcccggcaggccaacgtgcactggggccccccctgcagccgggacatcaagaggaagaggaagcctgtggccacagccagcctgagcagccccagcgctgtgcacatggatgctgtggagcccaccaccccagccagccaggcccccaagagccccagcagcgagtggctggtgaggaccagcgctgctgagaaggccacagatgccaccacagccaccttcttcaagatgccccaggagaagagccctggctacagctag

SEQ ID NO: 36360 - DNA, 1434 bp, Artificial Sequence
  Description of Artificial Sequence: Synthetic coding sequence
atggatgagctggtgcatgacctggccagcgccctggagcagaccagcgagcagaacaagctgggggagctgtgggaggagatggccctgagcccccggcagcagaggcggcagctgaggaagaggcggggcaggaagagaagaagtgacttcacccacctggccgagcacacctgctgctacagcgaggccagcgagagcagcctggatgaggccaccaaggactgccgggaggtggcccctgtgaccaacttcagtgacagtgatgacaccatggtggccaagaggcacccagccctgaatgccatcgtgaagagcaagcagcacagctggcatgaaagtgacagcttcacagaaaatgccccctgccggcccctgcggcggcggaggaaggtgaagagggtgaccagcgaggtggccgccagcctgcagcagaagctgaaggtgtctgactggagctatgaaagaggctgccgcttcaagagcgccaagaagcagaggctgagccgctggaaggagaacaccccctggaccagcagcggccacggcctgtgtgagagcgcagaaaatagaaccttcctgagcaagacaggcaggaaggagaggatggagtgtgaaacagatgagcagaagcagggcagtgatgagaacatgtctgaatgtgagaccagctctgtgtgcagcagcagtgacaccggcctcttcaccaatgatgagggccggcagggagatgatgagcagagcgactggttctatgaaggagaatgtgtgcccggcttcaccgtgcccaacctgctgcccaagtgggccccagaccactgcagcgaggtggagaggatggacagcggcctggacaagttcagtgacagcaccttcctgctgcccagcaggcctgcccagaggggctaccacacccggctgaaccggctgcctggagctgctgcccgctgcctgaggaagggcagaagaaggctggtgggcaaggagaccagcatcaacaccctgggcacagagcgcatcagccacatcatcagtgacccccggcagaaggacttctggctgcccagcgctgggaagcgggagaggaaccagttcaaccccctgagccccctgtacagcctggatgtgctggctgatgccagccaccggcgctgcagccctgcccactgcagcgcccggcaggccaacgtgcactggggccccccctgcagccgggacatcaagaggaagaggaagcctgtggccacagccagcctgagcagccccagcgctgtgcacatggatgctgtggagcccaccaccccagccagccaggcccccaagagccccagcagcgagtggctggtgaggaccagcgctgctgagaaggccacagatgccaccacagccaccttcttcaagatgccccaggagaagagccctggctacagctag

SEQ ID NO: 36361 - DNA, 1344 bp, Artificial Sequence
  Description of Artificial Sequence: Synthetic coding sequence
atggatgagctggtgcatgacctggccagcgccctggagcagaccagcgagcagaacaagctgggggagctgtgggaggagatggccctgagcccccggcagcagaggcggcagctgaggaagaggcggggcaggaagagaagaagtgacttcacccacctggccgagcacacctgctgctacagcgaggccagcgagagcagcctggatgaggccaccaaggactgccgggaggtggcccctgtgaccaacttcagtgacagtgatgacaccatggtggccaagaggcacccagccctgaatgccatcgtgaagagcaagcagcacagctggcatgaaagtgacagcttcacagaaaatgccccctgccggcccctgcggcggcggaggaaggtgaagagggtgaccagcgaggtggccgccagcctgcagcagaagctgaaggtgtctgactggagctatgaaagaggctgccgcttcaagagcgccaagaagcagaggctgagccgctggaaggagaacaccccctggaccagcagcggccacggcctgtgtgagagcgcagaaaatagaaccttcctgagcaagacaggcaggaaggagaggatggagtgtgaaacagatgagcagaagcagggcagtgatgagaacatgtctgaatgtgagaccagctctgtgtgcagcagcagtgacaccggcctcttcaccaatgatgagggccggcagggagatgatgagcagagcgactggttctatgaaggagaatgtgtgcccggcttcaccgtgcccaacctgctgcccaagtgggccccagaccactgcagcgaggtggagaggatggacagcggcctggacaagttcagtgacagcaccttcctgctgcccagcaggcctgcccagaggggctaccacacccggctgaaccggctgcctggagctgctgcccgctgcctgaggaagggcagaagaaggctggtgggcaaggagaccagcatcaacaccctgggcacagagcgcatcagccacatcatcaccctgggcaggaagatcagcggctaccaccagctgggcaaggaaaatgagatcagcagcatcccctgcctgcccttcaccccctggatgttcctgcccatgctgctgacagaaggagtgcaccagcacacagccctgcctgaccggcagatgtacacaggagaccaccacgtgcacgtgaccagccggggcagcggcaaccagtggccccagcacctgtgcctggcccctgtgcagttcacctggatgcagtggagccagccccaccagcaccacaagccacccaaccacccagccctgagcggctggtag

SEQ ID NO: 36362 - DNA, 1056 bp, Artificial Sequence
  Description of Artificial Sequence: Synthetic coding sequence
atggatgagctggtgcatgacctggccagcgccctggagcagaccagcgagcagaacaagctgggggagctgtgggaggagatggccctgagcccccggcagcagaggcggcagctgaggaagaggcggggcaggaagagaagaagtgacttcacccacctggccgagcacacctgctgctacagcgaggccagcgagagcagcctggatgaggccaccaaggactgccgggaggtggcccctgtgaccaacttcagtgacagtgatgacaccatggtggccaagaggcacccagccctgaatgccatcgtgaagagcaagcagcacagctggcatgaaagtgacagcttcacagaaaatgccccctgccggcccctgcggcggcggaggaaggtgaagagggtgaccagcgaggtggccgccagcctgcagcagaagctgaaggtgtctgactggagctatgaaagaggctgccgcttcaagagcgccaagaagcagaggctgagccgctggaaggagaacaccccctggaccagcagcggccacggcctgtgtgagagcgcagaaaatagaaccttcctgagcaagacaggcaggaaggagaggatggagtgtgaaacagatgagcagaagcagggcagtgatgagaacatgtctgaatgtgagaccagctctgtgtgcagcagcagtgacaccggcctcttcaccaatgatgagggccggcagggagatgatgagcagagcgactggttctatgaaggagaatgtgtgcccggcttcaccgtgcccaacctgctgcccaagtgggccccagaccactgcagcgaggtggagaggatggacagcggcctggacaagttcagtgacagcaccttcctgctgcccagcaggcctgcccagaggggctaccacacccggctgaaccggctgcctggagctgctgcccgctgcctgaggaagggcagaagaaggctggtgggcaaggtgatccccctgactgtgtccctggcccagtggggagacaacatcccctacggcagctgtgtgtcctactag

SEQ ID NO: 36363 - DNA, 1056 bp, Artificial Sequence; identical to SEQ ID NO: 36362
  Description of Artificial Sequence: Synthetic coding sequence

SEQ ID NO: 36364 - DNA, 423 bp, Artificial Sequence
  Description of Artificial Sequence: Synthetic coding sequence
atgcccctggagagcagcagctccatgcccctgtccttccccagcctgctgcccagcgtgccccacaacaccaaccccagcccccccctgatgagctacatcaccagccaggagatgaagtgcatcctgcactggtttgccaactggagcggcccccagcgggagcgcttcctggaggacctggtggccaaggctgtgcctgagaagctgcagcccctgctggacagcctggagcagctgtctgtgtctggagctgaccggccccccagcatctttgagtgccagctgcacctgtgggaccagtggttccggggctgggccgagcaggagagaaatgaatttgtgcggcagctggagttcagcgagccagactttgtggccaagttctaccaggccgtggccgccacagctgggaaggactag

SEQ ID NO: 36365 - DNA, 423 bp, Artificial Sequence; identical to SEQ ID NO: 36364
  Description of Artificial Sequence: Synthetic coding sequence

SEQ ID NO: 36366 - DNA, 303 bp, Artificial Sequence
  Description of Artificial Sequence: Synthetic coding sequence
atggagctgctgggggagtatgtgggccaggagggcaagccccagaagctgcgggtgtcctgtgaggcccctggagatggagaccccttccagggcctgctgtctggagtggcccagatgaaggacatggtgacagagctgtttgaccccctggtgcagggcgaggtgcagcaccgggtggccgccgccccagatgaggacctggatggagatgatgaagatgatgctgaagatgagaacaacatcgacaacagaaccaactttgatggccccagcgccaagaggcccaagacccccagctag

SEQ ID NO: 36367 - DNA, 1065 bp, Artificial Sequence
  Description of Artificial Sequence: Synthetic coding sequence
atggagagcgccctggccgtgccccggctgccccctcatgaccccggcacccctgtgctgtctgtggtggacatgcacactggaggagagcccctgcgcatcgtgctggccggctgcccagaggtgtctggccccaccctgctggccaagaggcgctacatgaggcagcacctggaccacgtgagaagaaggctgatgtttgagccccggggccaccgggacatgtacggggctgtgctggtgcccagcgagctgcctgatgcccacctgggcgtgctcttcctgcacaatgaaggctacagctccatgtgtggccatgctgtgctggccctgggccgctttgccctggactttggcctggtgcctgcccccccagctggcacccgggaggcccgggtgaacatccactgcccctgtggcctggtgacagcctttgtggcctgtgaagatggccgcagccacggccctgtgcgcttccacagcgtgcctgcctttgtgctggccacagacctgatggtggatgtgcccggccacggcaaggtgatggtggacatcgcctatggaggagccttctacgcctttgtgacagctgagaagctgggcctggacatctgcagcgccaagacccgggacctggtggatgctgccagcgctgtgacagaggccgtgaaggcccagttcaagatcaaccacccagacagcgaggacctggccttcctgtatggcaccatcctgacagatggcaaggatgcctacaccaaggagcccaccaccaacatctgtgtgtttgctgatgagcaggtggacaggagccccactggaagtggagtgacagccagaattgccctgcagtaccacaagggcctgctggagctgaaccagatgagggccttcaagagcagcgccactggatctgtgttcaccgggaaggctgtgcgggaggccaagtgtggggacttcaaggccgtcatcgtggaggtgtctggccaggcccactacacaggaacagccagcttcatcattgaagatgatgaccccctgagagatggcttcctgctgaagtag

SEQ ID NO: 36368 - DNA, 267 bp, Artificial Sequence
  Description of Artificial Sequence: Synthetic coding sequence
atggccagctgcaccaacagaggaggcctgcctgagaagcacagcagcagcaaggtgagcagccacgcccagatgatccagaaggctgtggacttcctggacctgctgattggccacctgagcaagttcagccctgtgctgattgtgttccagttcagccccctgggcttcctggtgcggcagagcagcgctgacaacgtgcagttcctgagctttgcccccagcctcatcctgcccagcggcaccggcaactggctggtgtggtag

SEQ ID NO: 36369 - DNA, 903 bp, Artificial Sequence
  Description of Artificial Sequence: Synthetic coding sequence
atggactggttccactgcaaccagtgcttcaggaaggatggagcccacttctttgtgaccagctgtggccacatcttctgcaagaagtgtgtgaccctggagaagtgtgctgtgtgtggcacagcctgcaagcacctggccctgagtgacaacctgaagccccaggagaagatgttcttcaagagccctgtggagacagccctgcagtacttcagccacatcagccaggtgtggagcttccagaagaagcagacagacctgctgattgccttctacaagcaccgcatcaccaagctggagacagccatgcaggaggcccagcaggccctggtgtcccaggacaaggagctgtctgtgctgaggaaagaaaatggagagctgaagaagttcctggccatcctgaaggagagccccagccgctaccagggcagccgcagcatcacccccaggcctgtgggcatcaccagccccagccagagcgtgaccccccggcccagcttccagcacagcagccaggtggtgagccgcagcagcagcgctgagagcatcccctaccgggaggccggcttcggcagcctgggccagggcggccggggcctgcagggccgccgcaccccccgggacagctacaatgagacccccagccctgccagcacccacagcctgagctaccgcaccagcagcgccagcagcggccagggcatcttctccttccggcccagccccaacggccacagcggccacaccagggtgctgacccccaacaactttgcccagcgggagagcaccaccaccctggagagcctgcccagcttccagctgcctgtgctgcagaccctgtaccagcagaggaggcacatgggcctgcccagcggccgggaggcctggaccaccagcaggtag

SEQ ID NO: 36370 - DNA, 567 bp, Artificial Sequence
  Description of Artificial Sequence: Synthetic coding sequence
atggaggatgagaggagcttcagtgacatctgtggcggccgcctggccctgcagaggcgctactacagccccagctgccgggagttctgcctgagctgcccccggctgagcctgcggagcctgacagctgtgacctgcaccgtgtggctggccgcctacggcctcttcaccctgtgtgagaacagcatgatcctgtctgctgccatcttcatcaccctgctgggcctgctgggctacctgcactttgtgaagattgaccaggagaccctgctgatcatcgacagcctgggcatccagatgaccagcagctatgccagcggcaaggagagcaccaccttcatcgagatgggcaaggtgaaggacatcgtcatcaatgaggccatctacatgcagaaggtgatctactacctgtgcatcctgctgaaggaccctgtggagccccacggcatcagccaggtggtgcctgtgttccagagcgccaagccccggctggactgcctgattgaggtgtaccgcagctgccaggagatcctggcccaccagaaggccaccagcaccagcccctag

SEQ ID NO: 36371 - DNA, 1467 bp, Artificial Sequence
  Description of Artificial Sequence: Synthetic coding sequence
atgcacatccagttccccagcaagcccaccctgccccgggcctgctgggagggccgcatcacagctggcagccctggcatgcccccagatgaaattgaaattgagcctgtgcggcagagcagtgacaagatgctgtactgtgaggccgagagcccccccaccgtggagaaggtgaagccagccagagaaaattctgaaacagacctggagattgaagatgatgagaagttcttcaccaccggccagaaggagctgtacctggaggcctgcaagctgatgggcgtggtgcctgtgtcctacttcatccggaacatggaggagagctatgtgaacctgaaccaccacggcctgggcccccggggcaccaaggccatcgccatcgccctggtgagcaacatggctgtgaccaagctggagctggaggacaactgcatcatggaggagggcgtgctgagcctggtggagatgctgcaggagaactactacctgcaggagatgaacatcagcaacaaccacctgggcctggagggcgcccgcatcatcagtgacttctttgaaagaaacagcagcagcatctggagcctggagctgtctggaaatgacttcaaggaggacagcgctgccctgctgtgccaggccctgagcaccaactaccagatcaagaagctggacctgagccacaaccagttcagtgatgtgggcggggagcacctgggccagatgctggccatcaacgtgggcctgaccagcctggacctgtcctggaacaacttccacaccagaggagctgtggccctgtgcaatggcctgcggggaaatgtgaccctgaccaagctggacctgtccatgaatggatttggaaatgaggtggccctggccctgggggaggtgctgcggctgaaccgctgcctggtgtacctggacattggaggaaatgacattggaaatgaaggagccagcaagatcagcaagggcctggagagcaatgaaagcctgcgggtgctgaagctgttcctgaaccccatcaacatggatggagccatcctgctgatcctggccatcaagaggaaccccaagagcaggatggaggagctggacatcagcaatgtgctggtgtctgagcagttcatgaagaccctggatggagtgtatgctgtgcacccccagctggatgtggtgttcaaggctgtgcagggcctgagccccaagaagaccatcttcctgctgaccaaccccatgaagctgatccagagctatgctgaccagcacaagatcaccatcgtggacttcttcaagagcctgaaccccaccggcaccatgaagatgtctgtggatgagttccagaaggtgatgattgagcagaacaaggtgcccctgaaccagtaccaggtgcgggaggtgatcaagaagctggatgagaagacaggcatggtgaacttctccttcctgaacaccatgaagccctag

SEQ ID NO: 36372 - DNA, 561 bp, Artificial Sequence
  Description of Artificial Sequence: Synthetic coding sequence
atggacaatgacaagcccctgcagcctgagacagaagatgaaattgaaattgagcctgtgcggcagagcagtgacaagatgctgtactgtgaggccgagagccccccaacagtggagaaggtgaagccagcccgggagaacagcgagacagacctggagattgaagatgatgagaagttcttcaccaccggccagaaggagctgtacctggaggcctgcaagctgatgggcgtggtgcctgtgtcctacttcatccggaacatggaggagagctatgtgaacctgaaccaccacggcctgggcccccggggcaccaaggccatcgccatcgccctggtgagcaacatggctgtgaccaagctggagctggaggacaactgcatcatggaggagggcgtgctgagcctggtggagatgctgcaggagaactactacctgcaggagatgaacatcagcaacaaccacctgggcctggagggcgcccgcatcatcagtgacttctttgagaggaacagcagcagcatctggagcctggagctgagtgaccagctgcccaactag

SEQ ID NO: 36373 - DNA, 654 bp, Artificial Sequence
  Description of Artificial Sequence: Synthetic coding sequence
atggaggacagagctggggagcaggagcaggagcggcacagcctgcggctggagaagctgcagcactgggcccggcaccggcagagcggccacctgctggtgctggccgtgtcccagctgtggctggccgtggtggtggtgcccctggccgtgtctgtggcctgcctgaacagcgactgccacatggccacagccctgcccctgggccctggggccagcggcctgctgactggaacagtgaccctggagctgcggcgggccccccggctgtggaaggtgcgggccatgatgatcttcaacaccttcaacctgatcctgggcttcatcgtggtggtggtggaggtgatgaagacagccctgggccctgcccccacagccagcagccagcacgccggcctgctggtgctggagctgtctgctgaggccttcaccctgggcggcgtgctggtgtctgtgcacgccctcttcctgctgagccagaggaagccaggctgctgccgcagccagagcctgcactaccaggagctgcaggagggcttcagcgagctggaggaggtgcccggcctggagaatggccccaccgtggccagcactggagccaatgaaagagtgggccagcgggagcagacccgggccgccctgctgcccccatag

SEQ ID NO: 36374 - DNA, 654 bp, Artificial Sequence; identical to SEQ ID NO: 36373
  Description of Artificial Sequence: Synthetic coding sequence

SEQ ID NO: 36375 - DNA, 378 bp, Artificial Sequence
  Description of Artificial Sequence: Synthetic coding sequence
atgcacaggaaggagcccggggcccggctggaggccaccaggggggccgcccggccccacaagcagggcaccaagcccatgatcacccggcccagcgtgtcccagctgggggagggcaagtgccccagcagccagcacctgcagagcctgcggcacaacaagcagcacgccctgaccctgaccaaggcccgctgctgcggggagtgcagcacctgcttctgcacagaggagaagtctgagtgccagagacatgaggagaccagccctggcagctgcaaccaccagatcatgtctgccagcaccatcagcgccttctgtgccaccccccgcttcaagcagctgttcaagggcaccgtggagcagatgagccagatgtag

SEQ ID NO: 36376 - DNA, 228 bp, Artificial Sequence
  Description of Artificial Sequence: Synthetic coding sequence
atgcacaggaaggagcccggggcccggctggaggccaccaggggggccgcccggccccacaagcagggcaccaagcccatgatcacccggcccagcgtgtcccagctgggggagggcaagtgccccagcagccagcacctgcagagcctgcggcacaacaagcagcacgccctgaccctgaccaaggcccgctgctgcggggagtgcagcacctgcttctgcacctag

SEQ ID NO: 36377 - DNA, 369 bp, Artificial Sequence
  Description of Artificial Sequence: Synthetic coding sequence
atgggccgggagatgaagaagacaggcaccccccggcccttcagaattgaggaccccaaccagcagcccacctggcatgaccagcctgagatgggcagccactactttgcccaggccggcctggagctgctgggcagcagcaaccccccagccagcgccagccagagcgctggcatcaccggggtgagccactgtgcccggcctggagaacatgacctgaaccacacagtgttccaggtgaaggacagcaccttcctgcggcacctggagagtgacaggcctgagttcaagagctgcctgcccccccacttcacagagcccagcgtgtccctgagcaccagcgagggctgtgaagatgccatgggctag

SEQ ID NO: 36378 - DNA, 279 bp, Artificial Sequence
  Description of Artificial Sequence: Synthetic coding sequence
atgggcagccactactttgcccaggccggcctggagctgctgggcagcagcaaccccccagccagcgccagccagagcgctggcatcaccggggtgagccactgtgcccggcctggagaacatgacctgaaccacacagtgttccaggtgaaggacagcaccttcctgcggcacctggagagtgacaggcctgagttcaagagctgcctgcccccccacttcacagagcccagcgtgtccctgagcaccagcgagggctgtgaagatgccatgggctag

SEQ ID NO: 36379 - DNA, 114 bp, Artificial Sequence
  Description of Artificial Sequence: Synthetic coding sequence
atgggccgggagatgaagaagacaggcaccccccggcccttcagaattgaggaccccaaccagcagcccacctggcatgaccagcctggaacagaatctgtgttctggctgtag

SEQ ID NO: 36380 - DNA, 324 bp, Artificial Sequence
  Description of Artificial Sequence: Synthetic coding sequence
atgacaggccgcatggccaccctggagaagagccacagcagcgcctgctggaggaagaggagcagcaggacctgtgtggagccagacaggacccaggatgccatccacgagccccggggcctgagccgcagccacacagtgctgcggcaccgccactttgtgttcctgcccctgagcagcggggcccaccccagcgtgccccccaggaggaagaactgtgccatgaagaatggcaagctgctgcggagctgcagctctgtgcggcgggctgctgacaagctggactggggccgcttcttcctgcaggacctgcagagcgtgtag

SEQ ID NO: 36381 - DNA, 1911 bp, Artificial Sequence
  Description of Artificial Sequence: Synthetic coding sequence
atgggccagggccccaggagcccccacaaggtgggccgccgcttccctgctgggggcaagaggggccgcggggccaagggcagcggccggcccctgcccggcaggaagaggcagccctggcccccaccagatggccgctctgagcccgccccagacagccacccccacctgagccctgaggccctgggctacttccggcgggccctgagcgccctgaaggaggcccctgagaccggggaggagcgggacctgatggtgcacaacatcatgaaggaggtggagacccaggccctggccctgagcaccaacagaactggaagtgagatgctgcaggagctgctgggcttcagccccctgaagcccctgtgccgggtgtgggccgccctgcggagcaacctgaggacagtggcctgccaccgctgtggggtgcacgtgctgcagagcgccctgctgcagctgccccggctgctgggcagcgctgctgaggaggaggaggaggaggaggaggatggcaaggatggccccacagagaccctggaggagctggtgctgggcctggccgctgaggtgtgtgatgacttcctggtgtactgtggggacacccacggcagctttgtggtgaggaccctgctgcaggtgctgggcggcaccatcctggagagcgagcgggcccggccccggggcagccagagcagcgaggcccagaagaccccagcccaggagtgcaagccagctgactttgaggtgcctgagaccttcctgaaccggctgcaggacctgagcagcagcttcctgaaggacattgctgtgttcatcacagacaagatcagcagcttctgcctgcaggtggccctgcaggtgctgcacaggaagctgccccagttctgtgcccacctgtgcaatgctgtgattggctacctgagcacccggggcagctctgtggatggcagccccctgctgctcttcctgcgggaccagaccagcagccggctgctggagcaggtgctgctggtgctggagcccccccggctgcagagcctgtttgaggagcacctgcagggccagctgcagaccctggccgcccaccccatcgccaacttccccctgcagaggctgctggatgctgtgaccaccccagagctgctgagccctgtgtttgaggagctgagccctgtgctggaggccgtgctggcccagggccaccctggggtggtgattgccctggtgggcgcctgcagaagagtgggcgcctaccaggccaaggtgctgcagctgctgctggaggccttccactgtgccgagcccagcagccggcaggtggcctgtgtgcccctgtttgccaccctgatggcctatgaggtgtactacggcctgacagaggaggagggcgctgtgcctgctgagcaccaggtggccatggctgctgcccgggccctgggagatgtgacagtgctgggcagcctgctgctgcagcacctgctgcacttcagcaccccaggcctggtgctgcggagcctgggcgccctgaccggcccccagctgctgagcctggcccagagccctgctggcagccacgtgctggatgccatcctgaccagccccagcgtgaccaggaagctgcggcggcgggtgctgcagaacctgaagggccagtatgtggccctggcctgcagccgccacggcagccgggtgctggatgccatctggagcggggccgccctgcgggccaggaaggagattgctgctgagctgggggagcagaaccaggagctgatccgggaccccttcggccaccacgtggccagaaatgtggccctgaccaccttcctgaagaggcgggaggcctgggagcagcagcagggcgctgtggccaagagaagaagagccctgaacagcatcctggaggactag

SEQ ID NO: 36382 - DNA, 564 bp, Artificial Sequence
  Description of Artificial Sequence: Synthetic coding sequence
atggcctatgaggtgtactacggcctgacagaggaggagggcgctgtgcctgctgagcaccaggtggccatggccgccgcccgggccctgggagatgtgacagtgctgggcagcctgctgctgcagcacctgctgcacttcagcaccccaggcctggtgctgcggagcctgggcgccctgaccggcccccagctgctgagcctggcccagagccctgctggcagccacgtgctggatgccatcctgaccagccccagcgtgaccaggaagctgcggaggagagtgctgcagaacctgaagggccagtatgtggccctggcctgcagcagacatggcagccgggtgctggatgccatctggagcggggccgccctgcgggccaggaaggagattgctgctgagctgggggagcagaaccaggagctgatccgggaccccttcggccaccacgtggccagaaatgtggccctgaccaccttcctgaagagaagagaggcctgggagcagcagcagggcgctgtggccaagagaagaagagccctgaacagcatcctggaggactag

SEQ ID NO: 36383 - DNA, 504 bp, Artificial Sequence
  Description of Artificial Sequence: Synthetic coding sequence
atggagctgagctccatgaagatctgtgccgccatccccaccagccgggccctgcctgaggtggtgcggaggatgcccaggaagaggatcagcggcctggagtggctgctgcagcaggaccccggcttcagcctggtgaacacagtgaaggccggcatgatcatctccttccccagcaacaacatctacagctctgtgtgctgctgccagagcgagatcttcaagtatgagttcagcaacagcaagaagagctcctggatccaggaggagcggcacctgggcaagaacaacgtgctgtacagcgcccatgatgtgtccccagagaaggtgaccagcgccctgaagaagaccaacaagcagaccaccaccatcaacaacttccccctgcagtacctgcccggcagcaagctgctggaccgcttcctgagcctgagccgcagcctgctgtgcctgaacagctggagcagcagcctgcccctggccccccaggtgaagaagaagtag

SEQ ID NO: 36384 - DNA, 933 bp, Artificial Sequence
  Description of Artificial Sequence: Synthetic coding sequence
atgaagaccctgtttgaggagatcaaggccagcatcaagaacaactacaaccaggaccgctccttctgcaggcctgtgctgccctggggcggcgtcttcaccatcaaggccggcaggaaggctgtgtcctgcacccccctgtatgtggagatccggctgaagaacacctgcaccattgatggcttcctgatgctgctgtatgtgatcctgaatgaaaatgaaaacttcccccgggagctgagcctgcacttcggccgggagtttgtggactgcttcctgtacctgatggacacctacagcttcaccaccgtgaagctgctgtggatctgggacaagatggagaagcagcagtacaagtctgaggtgcacaaggccagcctcatcatcgacctgtttggaaatgaacatgacaacttcaccaagaacctggagaacctgatgagcaccatccaggagagctactgcagcaactggcgctgccccaccagggtgcaggaggaccagcagaggaccatcaacatcaaccccccccaggagatcccccacggcaacctgatccggctggccgtgaatgaactcttctgcagcaagattgagctgtgtgaggagcacggctgcggcggcctgcgggagttcagccagaggatcttctgccacggggcccccccatttgtggtgctgaacatgcagcactggaagtctgaggacctggcctacgtgccctactacctggacctgagtgaccacaagtacctgctggagggcgccaccctcttcaacaaggaggagcaccactacagcgctgccttccagatcggcggccactggatgcactatgatggcctgagaaatgtgaacctgatcctgctgaacaagcccccagagttcctgctgctgagcagcctggtgtacatccgggccacagagaagtag

SEQ ID NO: 36385 - DNA, 2487 bp, Artificial Sequence
  Description of Artificial Sequence: Synthetic coding sequence
atggccctgagcccctggaccccaggcctgggcgctggggagaagctggtgcaggccgctgctgtgtccacaggccccagcctggagctgtgcaccctgcccagcaccctgggcagctctgtggccgtggaggccctggagcagctgtttgtggtggagcagagcctgcagagcgactacttcaagtgcaatgaggaggccaagatcttcctgaaggacattgctgtggccgtgaagaagctggaggagatgaggaaggccaccatcgacctgctggagattgagagcatggagctgaacaagctgtactacctgctggagaccctgcccaacagcatcaagcgggagctggaggagtgtgtgagagatgcccggcggctgaacctgtttgagatcaacaccatcaagatgaggatcaccaggacagaaaatgaaattgagctgctgaagaagaagatcacagacctgaccaagtacaatgaggccctgggggagaagcaggaggagctggccaggaagcacgccaggtttgtgctgagcctgaaccagaccatggagaagaaggccaccaccaccgtgtacatcaatgagacctacaccaagatcaacctgaagagagaagatattgccctgcagaagaagtgcatccaggaggccgaggagctgatggagaaggagcgggcagagtacctgatcaggaagcaggagctgacagcccagatcaatgaatttgagaacacccgggaggtgaagaggatggagacctaccagaagaagaaggagctggacaagctgcagaccaagatgagcaagatcaaggagaccgtgacagtgtctgctgctgtgctgagtgaccacaacctggagatcgcccggctgcacgagagcatccgctactgggagcaggaggtgtctgagctgaagaaggacctggccatcctggaggccaagctgtgcttcttcacagacaacaaggagaagctggatgacatcagcaatgatgagaagaatgagttcctgaacaagatcaagcagctggtggagaccctgcacgccgccaggatggagtacaaggacctgcgggagaagatgaagaccctggcccggcagtacaagatcgtgctgtctgaggaggagaaggccttcctgcagaagcagaagatccatgatgagaaccagaagcagctgaccttcatcagccagaaggagtacttcctgagccagaagagggtggacatcaagaacatggaggagggcctcatcaccctgcaggagctgcagcaggccaccaagacagtgtaccagcagcagatcaagatcctgagcgccaacctggagcgggagagccagcgctgcgtcatcacccagtggaagatggcctgcctgaggaagaagcacgcccgctggacagccaagatcaaggccgagatccaggccatcacagagaagatccagaatgctgaggtgcggcgcatcgagctgctgaatgagaccagcttccggcagcaggagatcagcggctttgtggcccagatcgagaagctgaccacagagctgaaggaggaggagaaggcctttgtgaacaaggagaagatgctgatgaaggagctgagcaaatatgaggagatctttgtgaaggagacccagatcaacaaggagaaggaggaggagctggtggagtacctgccccagctgcaggtggccgagcaggagtacaaggagaagaggaggaagctggaggagctgagcaacatcatcacagcccagaggcaggaggaggacctgctgaacaaccacatcttcctgttcacccgggacttcagccgctacatcagcaacatggaggatgtgaagcaggagctgcagcagctgcgggaccaggagagcaagaagaacaaggaccactttgagaccctgaagaacctggagaatggcttctacatcaatgaccagaaggctgacctgctgctgctggagaacaagaagctgaaggagtacatcctgtacctgaagaacaacatcgagaagtaccgggagggccaggaggccctgatgcacaccagcagtgacctgagccggcagctgattgcccaggaggcccagtacaaggacctgtgggccgagttccagaccaccgtgaagatcctggtggacaatggagaggagaccctgcaggacatcaacaacctgacagacaagctgcgggagagagatgagaagatgcagcacgtgtccacctggctgcggggcagcctggagggcctgcggctgctggtggagcaggagagccccatggacctgctgagcaagcagcagctgcgggccctgctggtgaccagcaaggaggagaagacctgccagctgagtgacctggtgatccccaactatgccaccaacatccagctgaacatcgacacctacctgggcctgaacaccctggtggtgctgagcaacagcgccttccacctgcgggagttcagcaggtag

SEQ ID NO: 36386 - DNA, 2382 bp, Artificial Sequence
  Description of Artificial Sequence: Synthetic coding sequence
atggccctgagcccctggaccccaggcctgggcgctggggagaagctggtgcaggccgctgctgtgtccacaggccccagcctggagctgtgcaccctgcccagcaccctgggcagctctgtggccgtggaggccctggagcagctgtttgtggtggagcagagcctgcagagcgactacttcaagtgcaatgaggaggccaagatcttcctgaaggacattgctgtggccgtgaagaagctggaggagatgaggaaggccaccatcgacctgctggagattgagagcatggagctgaacaagctgtactacctgctggagaccctgcccaacagcatcaagcgggagctggaggagtgtgtgagagatgcccggcggctgaacctgtttgagatcaacaccatcaagatgaggatcaccaggacagaaaatgaaattgagctgctgaagaagaagatcacagacctgaccaagtacaatgaggccctgggggagaagcaggaggagctggccaggaagcacgccaggtttgtgctgagcctgaaccagaccatggagaagaaggccaccaccaccgtgtacatcaatgagacctacaccaagatcaacctgaagagagaagatattgccctgcagaagaagtgcatccaggaggccgaggagctgatggagaaggagcgggcagagtacctgatcaggaagcaggagctgacagcccagatcaatgaatttgagaacacccgggaggtgaagaggatggagacctaccagaagaagaaggagctggacaagctgcagaccaagatgagcaagatcaaggagaccgtgacagtgtctgctgctgtgctgagtgaccacaacctggagatcgcccggctgcacgagagcatccgctactgggagcaggaggtgtctgagctgaagaaggacctggccatcctggaggccaagctgtgcttcttcacagacaacaaggagaagctggatgacatcagcaatgatgagaagaatgagttcctgaacaagatcaagcagctggtggagaccctgcacgccgccaggatggagtacaaggacctgcgggagaagatgaagaccctggcccggcagtacaagatcgtgctgtctgaggaggagaaggccttcctgcagaagcagaagatccatgatgagaaccagaagcagctgaccttcatcagccagaaggagtacttcctgagccagaagagggtggacatcaagaacatggaggagggcctcatcaccctgcaggagctgcagcaggccaccaagacagtgtaccagcagcagatcaagatcctgagcgccaacctggagcgggagagccagcgctgcgtcatcacccagtggaagatggcctgcctgaggaagaagcacgcccgctggacagccaagatcaaggccgagatccaggccatcacagagaagatccagaatgctgaggtgcggcgcatcgagctgctgaatgagaccagcttccggcagcaggagatcagcggctttgtggcccagatcgagaagctgaccacagagctgaaggaggaggagaaggcctttgtgaacaaggagaagatgctgatgaaggagctgagcaaatatgaggagatctttgtgaaggagacccagatcaacaaggagaaggaggaggagctggtggagtacctgccccagctgcaggtggccgagcaggagtacaaggagaagaggaggaagctggaggagctgagcaacatcatcacagcccagaggcaggaggaggacctgctgaacaaccacatcttcctgttcacccgggacttcagccgctacatcagcaacatggaggatgtgaagcaggagctgcagcagctgcgggaccaggagagcaagaagaacaaggaccactttgagaccctgaagaacctggagaatggcttctacatcaatgaccagaaggctgacctgctgctgctggagaacaagaagctgaaggagtacatcctgtacctgaagaacaacatcgagaagtaccgggagggccaggaggccctgatgcacaccagcagtgacctgagccggcagctgattgcccaggaggcccagtacaaggacctgtgggccgagttccagaccaccgtgaagatcctggtggacaatggagaggagaccctgcaggacatcaacaacctgacagacaagctgcgggagagagatgagaagatgcagcacgtgtccacctggctgcggggcagcctggagggcctgcggctgctggtggagcaggagagccccatggacctgctgaagaagaagaagcacatccgcaccagggtgcacttccctgtggtgaagtgcacagagaagaacaccctgaccaagtag

SEQ ID NO: 36387 - DNA, 1764 bp, Artificial Sequence
  Description of Artificial Sequence: Synthetic coding sequence
atgaatgacagcctgtttgtgtccctggaccggctgctgctggagtttgtgttccagtatgagcaggacatcagcaccaaggaggagatgatccagaggatcaacaagtgctgtgaggacatcaaggagaacaaggtgaccatctgccgcatccacgagaccatcaatgccacagatgaggagattgaccactactgcaagcacagcgaggagatcaaggacaactgcaggaactggaagcccacctgtgatgtgttcaggaagcatgaggactacatgcaggaccagttcaccgtgtaccagggcaccgtggagaaggacaaggagatgtaccatgactacatctgccagtacaaggaggtgctgaagcagtaccagctgaagtacagcgagacccccttcagccgggagtactatgagaagaagcgggagcacgaggagatccagagccgggtgctggcctgcacagagcagctgaagatgaatgagaccatcttcatgaagttccgggtgcctgcccccttccccagcctgaccaagtggaccctgaacatcgtgaacctgcgctgtgagacccaggacatcctgaagcacgccagcaacctgaccaagagcagcagcgagctgaagaaggaggtggatgagatggagattgagatcaactacctgaaccagcagatcagccgccacaatgagaccaaggccctgtctgagaccctggaggagaagaacaagaacacagagaacaggaaggagctgaaggagcgcatctttgggaaggatgaacatgtgctgaccctgaacaagacccagagcagccagctgttcctgccctatgagagccagaagctggtgcggcccatcaagatgcacagcagcgagccccgggtggccgacatcaaggaggagagcagcgccaagcagagcaagctggccaacatcgacttccggcagaaggaaaatgacacccagatcttcaatgattctgctgtggacaaccacagcaagtgcagccacatcaccaccatcaccagcagccagaagttcatgcaggtgcggctgctgaccccccagaagcagagcaacagcaaccagtggagcgagaagggggacaaggatgctgaatatggagacaagggcaccgtgcggcaggtgcgggagagcaagtgcaccagccaggccatctacacagagcactttgggaagtctgtggagaatgacagtgatgaggtggaggagagagctgagaacttccccaggaccagcgagatccccatcttcctgggcacccccaaggctgtgaaggcccctgagagcctggagaagatcaagttccccaagaccccaccatttgagatcaacagaaacagaaatgctgtgcctgaggtgcagacagagaaggagagccctggcctgtccttcctgatgagctacaccagccgcagccctggcctgaacctgtttgacagctctgtgtttgacacagagatcagcagtgaccagttcaatgagcactacagcgccaggaacctgaaccccctgagcagcgagcaggagatcggcaacctgctggagaagccagagggggaggatggcttcaccttctccttccccagcgacaccagcacccacaccttcggggccggcaaggatgacttctccttccccttctcctttggccagggccagaacagcatccccagcagcagcctgaagggcttcagcagcagcagccagaacaccacccagttcaccttcttctag

SEQ ID NO: 36388 - DNA, 267 bp, Artificial Sequence
  Description of Artificial Sequence: Synthetic coding sequence
atgaatgacagcctgtttgtgtccctggaccggctgctgctggagtttgtgttccagtatgagcaggacatcagcaccaaggaggagatgatccagaggatcaacaagtgctgtgaggacatcaaggagaacaaggtgaccatctgccgcatccacgagaccatcaatgccacagatgaggagattgaccactactgcaagcacagcgaggagatcaaggacaactgcaggaactggaagcccacctgtgatgtgttcaggaagtag

SEQ ID NO: 36389 - DNA, 1590 bp, Artificial Sequence
  Description of Artificial Sequence: Synthetic coding sequence
atgcccagcaagggcaaggacaagaagaagggcaagagcaagggcaaggacaccaagaagctgatcaagacagatgaatctgtggtggaccgggccaaggccaatgccagcctgtgggaggcccggctggaggtgacagagctgagccgcatcaagtacagagacaccagccgcatcctggccaagagcaatgaagacctgaagaagaagcagtgcaagatggagaaggacatcatgtctgtgctgagctacctgaagaagcaggaccaggagaaggacaacatgattgagaagctgaagcagcagctgaatgagaccaaggagaaggcccaggaggagaaggacaagctggagcagaagtacacccggcagatcaatgagctggagggccagttccaccagaaggccaaggagatcggcatgatccacacagagctgaaggctgtgcggcagttccagaagaggaagatccaggtggagcgggagctggatgacctgaaggagaacctgaggaacacagagcgcatccaccaggagaccctgcggcggctggagagccgcttctttgaggagaagcaccggctggagcaggaggccgagaagaagatcatcatgctggccgagcgggcccaccacgaggccatcgtgcagctgaatgatgctggaagaaatgtgttcaaggaaaatgactacctgcagaaggccctggcctaccacctgaaggagacagatgccctgcagaagaacagccagaagctgcaggagagccacaccctgctgctgcaccagaaggagatcaatgacctgctggtgaaggagaagatcatgcagctggtgcagcagaggagccagatccagaccctgcagaagaaggtggtgaacctggagacagccctgagctacatgaccaaggagtttgagagcgaggtgctgaagctgcagcagcacgccatgattgagaaccaggccggccaggtggagattgacaagctgcagcacctgctgcagatgaaggaccgggagatgaacagagtgaagaagctggccaagaacatcctggatgagaggacagaggtggagcgcttcttcctggatgccctgcaccaggtgaagcagcagatcctgatcagcaggaagcactacaagcagatcgcccaggccgccttcaacctgaagatgagagctgcctgcaccggccgcacagagtaccccaagatccgcacctttgatggccgggagcacagcaccaacagcgtgaaccaggacctgctggaggccgagaagtggacccacatcgagggcaatgtggacatcggggacctgacctgggagcagaaggagaaggtgctgcggctgctgtttgccaagatgaatggctgccccagcaggaagtacaaccagagcagcaggcctcctgtgcctgactatgtggtgtctgattctggagagaccaaggagtttggagatgagagcaagctgcaggacaagatcttcatcacccagcagatcgccatcagtgacagcagtggagaggtggtgctgcccaccatccccaaggagccccaggagagtgacaccggcaccttctag

SEQ ID NO: 36390 - DNA, 798 bp, Artificial Sequence
  Description of Artificial Sequence: Synthetic coding sequence
atgcagctggtgcagcagaggagccagatccagaccctgcagaagaaggtggtgaacctggagacagccctgagctacatgaccaaggagtttgaaagtgaggtgctgaagctgcagcagcacgccatgattgagaaccaggccggccaggtggagattgacaagctgcagcacctgctgcagatgaaggaccgggagatgaacagagtgaagaagctggccaagaacatcctggatgagaggacagaggtggagcgcttcttcctggatgccctgcaccaggtgaagcagcagatcctgatcagcaggaagcactacaagcagatcgcccaggccgccttcaacctgaagatgagagctgcctgcaccggccgcacagagtaccccaagatccgcacctttgatggccgggagcacagcaccaacagcgtgaaccaggacctgctggaggccgagaagtggacccacatcgagggcaatgtggacattggagacctgacctgggagcagaaggagaaggtgctgcggctgctgtttgccaagatgaatggctgccccagcaggaagtacaaccagagcagccggccccctgtgcctgactatgtggtgtctgacagcggggagaccaaggagtttggagatgagagcaagctgcaggacaagatcttcatcacccagcagatcgccatcagtgacagcagcggggaggtggtgctgcccaccatccccaaggagccccaggagagtgacaccagcacccagaagcccagtgatgagaacttcagcaccagctactag

SEQ ID NO: 36391 - DNA, 384 bp, Artificial Sequence
  Description of Artificial Sequence: Synthetic coding sequence
atgcccaccatgtggaggatgctgcaccaggccctgaagctgcggcggaggacagtgctggccggccaggagatctcctatgtgctgcctgtgatgtttgtggtgtctgaggaggacagcaacagagatgtgttcctggtggccggctaccgccacctggagtttggagagagaattgccatctggggcagctccatgcagcacgtggagcggcggcgctggcccctggacagcatccagaagaggatgggccagagcttcaccggctgggccgaggaggccgcccctggcatgaagaccaagaaggagtatgcagaaattggagtgaagccccggcagaatgcctgtgagatgtgccccggcatgatcctgagcaccacctag

SEQ ID NO: 36392 - DNA, 978 bp, Artificial Sequence
  Description of Artificial Sequence: Synthetic coding sequence
atgcagggccggcgggagctgggcggggagcccctgagtgacctgcaggaggaggccgccagcgccagcctgcgggtggcccctgagcggctgagtgatgacagcctggagtggaggaggacctgcccagacctgctgctgagtgatggcaaggccagcatctccatgccccgggagggcggcagcacctgcacagcccgctgcccagaccctggagagcacagcagcacctggggcgagtttgagggcttccgggagagcagcgccaagagcggccagttcagccagagcctggagctgctggagggccccacagagccccagccccccaggaccaccagcgcccccaaggagtgcagcagccaccagccctgccagggcggcccctgggtgacaggcaccagcgctgtgccccccagcgagcccatcctgtcctatgagaacatcctgaagtgtgccttccaggagatcaccgtgcagcaggccgcagaagatgtgtccaccatcgaccacttcctggagatcagcagcgaggagaagccaggagtggagcgggtgcacaagctgtgcaatgaaagcaggaagctgtggagggccctgcagagcatccacaccaccagcaccagccagaggctgtggagcgagagccgctgccaggagaacttcttcctggtgctgggcattgatgctgcccagaagaacctgagcggcggccagggccacatcatggaggactgtgacctgaaggagcctgagggcctgctgactgtgtcctccttctgcctgcagcactgcaaggccctgatccagaccaagctgagcggccccccaggcagcaagcagggccgcctgatgacctgcagccgcttcctgaagacccccagctgtggcggcggccagcacatcaccatccccaggaagaggatgttcacccccaggaagctgaagctgaccctcttcaacagtgatgtgtgctag

SEQ ID NO: 36393 - DNA, 1065 bp, Artificial Sequence
  Description of Artificial Sequence: Synthetic coding sequence
atgagcggccagagaggagactgggtgcagaccagcgccctgtggcagctgctcttccgggtgctgagccccctgcctgctggaaatgccctggccagcctggccctggaggtgcaggcccggctggtgaagagcgccctgtgcagccagggctacccccggctggccctggcccagctgcctgaagatggcagccagggcagccgggagctgctgctggccctgtcctggctgctggcccggggccctgtgcctgagcagatgctggcccaggcccgggtgcccctgggagatgagatgacagtgtgccagtgtgaggccctggccagccctggccccccagccccccacatggaggccgagggccctgtggatgtgcgccacgtgcagtggctgatgggcaagctgcgcttccgctggaggcagctggtgagcagccagcaggagcagtgtgccctgctgagcaagctgctgcggaccctggagcgggagaaccagaggctggaggccgtgctggcctggaggagaagtgagctggtgttctggcgctggatggacacagtgctgggcacctgtgcccctgaggtgcctgctgctgccagccagcccaccttcctgccctgggtgcctgagcggggcggcggggagctggacctggtggtgcgggagctgcaggccctggaggaggagctgcgggaggccgctgagcggcggcgggccgcctgggaggccaaggccggcggctgcggccggggccctgagtggagcgctgcccggcgggccagccgggaggccgtggagaaggagctgggcgccctgcagcagtgctgggagagagatggcggccctgcccagccccacggcccccaccggctggtgcggcgggaggatggagctgctggggaccgggacctgcgggctgctgtggtgatccgcaccctgcggagccaggaggcctgcctggaggccgtgctgcggcggctgcagggccagtgccggcaggagctggcccggctggtgggcgcccggcccggcctcatctggatccccccacctggccgctag

SEQ ID NO: 36394 - DNA, 1059 bp, Artificial Sequence
  Description of Artificial Sequence: Synthetic coding sequence
atgagcggccagagaggagactggaccagcgccctgtggcagctgctcttccgggtgctgagccccctgcctgctggaaatgccctggccagcctggccctggaggtgcaggcccggctggtgaagagcgccctgtgcagccagggctacccccggctggccctggcccagctgcctgaagatggcagccagggcagccgggagctgctgctggccctgtcctggctgctggcccggggccctgtgcctgagcagatgctggcccaggcccgggtgcccctgggagatgagatgacagtgtgccagtgtgaggccctggccagccctggccccccagccccccacatggaggccgagggccctgtggatgtgcgccacgtgcagtggctgatgggcaagctgcgcttccgctggaggcagctggtgagcagccagcaggagcagtgtgccctgctgagcaagctgctgcggaccctggagcgggagaaccagaggctggaggccgtgctggcctggaggagaagtgagctggtgttctggcgctggatggacacagtgctgggcacctgtgcccctgaggtgcctgctgctgccagccagcccaccttcctgccctgggtgcctgagcggggcggcggggagctggacctggtggtgcgggagctgcaggccctggaggaggagctgcgggaggccgctgagcggcggcgggccgcctgggaggccaaggccggcggctgcggccggggccctgagtggagcgctgcccggcgggccagccgggaggccgtggagaaggagctgggcgccctgcagcagtgctgggagagagatggcggccctgcccagccccacggcccccaccggctggtgcggcgggaggatggagctgctggggaccgggacctgcgggctgctgtggtgatccgcaccctgcggagccaggaggcctgcctggaggccgtgctgcggcggctgcagggccagtgccggcaggagctggcccggctggtgggcgcccggcccggcctcatctggatccccccacctggccgctag

SEQ ID NO: 36395 - DNA, 1182 bp, Artificial Sequence
  Description of Artificial Sequence: Synthetic coding sequence
atgggcagaagacggcagagggtggaccctgctgctggggcccgggccggggccctgcctgaggccatcgccgccctgagccgcagcctgcccagcggccccagccctgagatcttccggcgggccaagtttgacaggcctgaggccaccagcgccctgtggcagctgctcttccgggtgctgagccccctgcctgctggaaatgccctggccagcctggccctggaggtgcaggcccggctggtgaagagcgccctgtgcagccagggctacccccggctggccctggcccagctgcctgaagatggcagccagggcagccgggagctgctgctggccctgtcctggctgctggcccggggccctgtgcctgagcagatgctggcccaggcccgggtgcccctgggagatgagatgacagtgtgccagtgtgaggccctggccagccctggccccccagccccccacatggaggccgagggccctgtggatgtgagacatgtgcagtggctgatgggcaagctgcgcttccgctggaggcagctggtgagcagccagcaggagcagtgtgccctgctgagcaagctgctgcggaccctggagcgggagaaccagaggctggaggccgtgctggcctggaggagaagtgagctggtgttctggcgctggatggacacagtgctgggcacctgtgcccctgaggtgcctgctgctgccagccagcccaccttcctgccctgggtgcctgagcggggcggcggggagctggacctggtggtgcgggagctgcaggccctggaggaggagctgcgggaggccgctgagaggagaagagctgcctgggaggccaaggccggcggctgcggccggggccctgagtggagcgctgcccggcgggccagccgggaggccgtggagaaggagctgggcgccctgcagcagtgctgggagagagatggcggccctgcccagccccacggcccccaccggctggtgagaagagaagatggagctgctggggaccgggacctgcgggctgctgtggtgatccgcaccctgcggagccaggaggcctgcctggaggccgtgctgcggcggctgcagggccagtgccggcaggagctggcccggctggtgggcgcccggcccggcctcatctggatccccccacctggaagatag

SEQ ID NO: 36396 - DNA, 1281 bp, Artificial Sequence
  Description of Artificial Sequence: Synthetic coding sequence
atgggcagaagacggcagagggtggaccctgctgctggggcccgggccggggccctgcctgaggccatcgccgccctgagccgcagcctgcccagcggccccagccctgagatcttccggcgggccaagtttgacaggcctgaggccaccagcgccctgtggcagctgctcttccgggtgctgagccccctgcctgctggaaatgccctggccagcctggccctggaggtgcaggcccggctggtgaagagcgccctgtgcagccagggctacccccggctggccctggcccagctgcctgaagatggcagccagggcagccgggagctgctgctggccctgtcctggctgctggcccggggccctgtgcctgagcagatgctggcccaggcccgggtgcccctgggagatgagatgacagtgtgccagtgtgaggccctggccagccctggccccccagccccccacatggaggccgagggccctgtggatgtgagacatgtgcagtggctgatgggcaagctgcgcttccgctggaggcagctggtgagcagccagcaggagcagtgtgccctgctgagcaagatccacctgtacacccggggctgccacagcgaccagagcctgagccacctgtctgtgacagaagctgagatgctgcgggaccctgagggcggccagcagctgctgcggaccctggagcgggagaaccagaggctggaggccgtgctggcctggaggagaagtgagctggtgttctggcgctggatggacacagtgctgggcacctgtgcccctgaggtgcctgctgctgccagccagcccaccttcctgccctgggtgcctgagcggggcggcggggagctggacctggtggtgcgggagctgcaggccctggaggaggagctgcgggaggccgctgagcggcggcgggccgcctgggaggccaaggccggcggctgcggccggggccctgagtggagcgctgcccggcgggccagccgggaggccgtggagaaggagctgggcgccctgcagcagtgctgggagagagatggcggccctgcccagccccacggcccccaccggctggtgcggcgggaggatggagctgctggggaccgggacctgcgggctgctgtggtgatccgcaccctgcggagccaggaggcctgcctggaggccgtgctgcggcggctgcagggccagtgccggcaggagctggcccggctggtgggcgcccggcccggcctcatctggatccccccacctggccgctag

SEQ ID NO: 36397 - DNA, 1488 bp, Artificial Sequence
  Description of Artificial Sequence: Synthetic coding sequence
atgggcagaagacggcagagggtggaccctgctgctggggcccgggccggggccctgcctgaggccatcgccgccctgagccgcagcctgcccagcggccccagccctgagatcttccggcgggccaagtttgacaggcctgaggccaccagcgccctgtggcagctgctcttccgggtgctgagccccctgcctgctggaaatgccctggccagcctggccctggaggtgcaggcccggctggtgaagagcgccctgtgcagccagggctacccccggctggccctggcccagctgcctgaagatggcagccagggcagccgggagctgctgctggccctgtcctggctgctggcccggggccctgtgcctgagcagatgctggcccaggcccgggtgcccctgggagatgagatgacagtgtgccagtgtgaggccctggccagccctggccccccagccccccacatggaggccgagggccctgtggatgtgagacatgtgcagtggctgatgggcaagctgcgcttccgctggaggcagctggtgagcagccagcaggagcagtgtgccctgctgagcaagatccacctgtacacccggggctgccacagcgaccagagcctgagccacctgtctgtgacagaagctgagatgctgcgggaccctgagggcggccagcaggtgtctggggccggggccgcccagaacctggacctggcctaccccaagtgcctgcacagcttctgcaccccaggcatgggccccaggaccttctggaatgacctgtggctggtgtgtgagcagcccggcctgctgcccggggactgggccgcccccctggaccctggaggagccagcgcctgcagcctgctgagccccttccgggccctgctgcggaccctggagcgggagaaccagaggctggaggccgtgctggcctggaggagaagtgagctggtgttctggcgctggatggacacagtgctgggcacctgtgcccctgaggtgcctgctgctgccagccagcccaccttcctgccctgggtgcctgagcggggcggcggggagctggacctggtggtgcgggagctgcaggccctggaggaggagctgcgggaggccgctgagaggagaagagctgcctgggaggccaaggccggcggctgcggccggggccctgagtggagcgctgcccggcgggccagccgggaggccgtggagaaggagctgggcgccctgcagcagtgctgggagagagatggcggccctgcccagccccacggcccccaccggctggtgagaagagaagatggagctgctggggaccgggacctgcgggctgctgtggtgatccgcaccctgcggagccaggaggcctgcctggaggccgtgctgcggcggctgcagggccagtgccggcaggagctggcccggctggtgggcgcccggcccggcctcatctggatccccccacctggaagatag

SEQ ID NO: 36398 - DNA, 1059 bp, Artificial Sequence; identical to SEQ ID NO: 36394
  Description of Artificial Sequence: Synthetic coding sequence

SEQ ID NO: 36399 - DNA, 474 bp, Artificial Sequence
  Description of Artificial Sequence: Synthetic coding sequence
atgctggcccaggcccgggtgcccctgggagatgagatgacagtgtgccagtgtgaggccctggccagccctggccccccagccccccacatggaggccgagggccctgtggatgtgagacatgtgcagtggctgatgggcaagctgcgcttccgctggaggcagctggtgagcagccagcaggagcagtgtgccctgctgagcaagatccacctgtacacccggggctgccacagcgaccagagcctgagccacctgtctgtgacagaagctgagatgctgcgggaccctgagggcggccagcagctgctgcggaccctggagcgggagaaccagaggctggaggccgtgctggcctggaggagaagtgagctggtgttctggcgctggatggacacagtgctgggcacctgtgcccctgaggtgcctgctgctgccagccagcccaccttcctgccctgggtgcctgagtag

SEQ ID NO: 36400 - DNA, 243 bp, Artificial Sequence
  Description of Artificial Sequence: Synthetic coding sequence
atgagcggccagagaggagactggaccagcgccctgtggcagctgctcttccgggtgctgagccccctgcctgctggaaatgccctggccagcctggccctggaggtgcaggcccggctggtgaagagcgccctgtgcagccagggctacccccggctggccctggcccagctgcctgaagatggcagccagggcagccgggagctgctgctggccctgtcctggctgctggcccggggctag

SEQ ID NO: 36401 - DNA, 333 bp, Artificial Sequence
  Description of Artificial Sequence: Synthetic coding sequence
atgagcggccagagaggagactggaccagcgccctgtggcagctgctcttccgggtgctgagccccctgcctgctggaaatgccctggccagcctggccctggaggtgcaggcccggctggtgaagagcgccctgtgcagccagggctacccccggctggccctggcccagctgcctgaagatggcagccagggcagccgggagctgctgctggccctgtcctggctgctggcccggggccctgtgcctgagcagatgctggcccaggcccgggtgcccctgggagatgagatgacagtgtgccagtgtgaggccctggccagccctggatag

SEQ ID NO: 36402 - DNA, 747 bp, Artificial Sequence
  Description of Artificial Sequence: Synthetic coding sequence
atgctggcccaggcccgggtgcccctgggagatgagatgacagtgtgccagatccacctgtacacccggggctgccacagcgaccagagcctgagccacctgtctgtgacagaagctgagatgctgcgggaccctgagggcggccagcagctgctgcggaccctggagcgggagaaccagaggctggaggccgtgctggcctggaggagaagtgagctggtgttctggcgctggatggacacagtgctgggcacctgtgcccctgaggtgcctgctgctgccagccagcccaccttcctgccctgggtgcctgagcggggcggcggggagctggacctggtggtgcgggagctgcaggccctggaggaggagctgcgggaggccgctgagcggcggcgggccgcctgggaggccaaggccggcggctgcggccggggccctgagtggagcgctgcccggcgggccagccgggaggccgtggagaaggagctgggcgccctgcagcagtgctgggagagagatggcggccctgcccagccccacggcccccaccggctggtgcggcgggaggatggagctgctggggaccgggacctgcgggctgctgtggtgatccgcaccctgcggagccaggaggcctgcctggaggccgtgctgcggcggctgcagggccagtgccggcaggagctggcccggctggtgggcgcccggcccggcctcatctggatccccccacctggccgctag

SEQ ID NO: 36403 - DNA, 165 bp, Artificial Sequence
  Description of Artificial Sequence: Synthetic coding sequence
atgctggcccaggcccgggtgcccctgggagatgagatgacagtgtgccagtgtgaggccctggccagccctggccccccagccccccacatggaggccgagggccctgtggatgtgagacatgtgcagtggctgatgggcaagctgcgcttccgctggaggtag

SEQ ID NO: 36404 - DNA, 597 bp, Artificial Sequence
  Description of Artificial Sequence: Synthetic coding sequence
atggccacagctgagcccagcggccgggccctgcggctgagcaccccaggcccccggcccagcggggcccgggaccgggcccctggagctgctggccccccatctggccagatcggcaacagagccctgcggctgggggagaggaccccagctgctgtggagaagaggggcccctacatggtgacccgggcccccagcatccaggccaagctgcagaagcaccgggacctggccaaggctgtgctgcggaggaagggcatgctgggcgccagccccaacagaccagacagcagcggcaagaggtctgtgaagttcaacaagggctacacagccctgagccagagcccagatgagaacctggtgtccctggacagcgacagtgatggagagctgggcagccgctacagcagcggctacagcagcgctgagcaggtgaaccaggatgtgtcccggcagctgctgcaggacggctaccacctggatgagatcccagatgatgaggacctggacctgatcccccccaagcccatggccagcagcacctgcagctgctgctggtgctgcctgggggacagcagcagctgcaccctgcagtag

SEQ ID NO: 36405 - DNA, 447 bp, Artificial Sequence
  Description of Artificial Sequence: Synthetic coding sequence
atggccacagctgagcccagcggccgggccctgcggctgagcaccccaggcccccggcccagcggggcccgggaccgggcccctggagctgctggccccccatctggccagatcggcaacagagccctgcggctgggggagaggaccccagctgctgtggagaagaggggcccctacatggtgacccgggcccccagcatccaggccaagctgcagaagcaccgggacctggccaaggctgtgctgcggaggaagggcatgctgggcgccagccccaacagaccagacagcagcggcaagaggtctgtgaagttcaacaagggctacacagccctgagccagagcccagatgagaacctggtgtccctggacagcgaccggcccttcatgtacatccctggccccttcagcagcgagcagtaccccttccctggctggctgggctag

SEQ ID NO: 36406 - DNA, 906 bp, Artificial Sequence
  Description of Artificial Sequence: Synthetic coding sequence
atggcccagaatgtgtatggccctggggtgcgcatcggcaactggaatgaagatgtgtacctggaggaggagctgatgaaggacttcctggagaagagggacaagggcaagctgctgatccagaggagccggcggctgaagcagaacctgctgcggcccatgcagctgtctgtgacagaagatggctacatccactacggggacaaggtgatgctggtgaacccagatgatcctgacacagaagcagatgtgttcctgcggggggacctgagcctgtgcatgaccccagatgagatccagagccacctgaaggatgagctggaggtgccctgtggcctgtctgctgtgcaggccaagacccccatcggcaggaacaccttcatcatcctgtctgtgcacagagatgccaccggccaggtgctgcgctatggccaggacttctgcctgggcatcaccggcggctttgacaacaagatgctgtacctgagcagtgaccacaggaccctgctgaagagcagcaagaggtcctggctgcaggaggtgtacctgacagatgaggtgagccacgtgaactgctggcaggccgccttcccagacccccagctgcggctggagtatgagggcttccctgtgcctgccaatgccaagatcctgatcaaccactgccacaccaacagaggcctggccgcccaccgccacctgttcctgagcacctactttgggaaggaggccgaggtggtggcccacacctacctggacagccaccgggtggagaagcccaggaaccactggatgctggtgacaggcaaccccagagatgccagcagctccatgctggacctgcccaagccacccacagaggacacccgggccatggagcaggccatgggcctggacacccagtag

SEQ ID NO: 36407 - DNA, 600 bp, Artificial Sequence
  Description of Artificial Sequence: Synthetic coding sequence
atgaaggacttcctggagaagagggacaagggcaagctgctgatccagaggagccggcggctgaagcagaacctgctgcggcccatgcagctgtctgtgacagaagatggctacatccactatggagacaaggtgatgctggtgaacccagatgatcctgacacagaagcagatgtgttcctgcggggggacctgagcctgtgcatgaccccagatgagatccagagccacctgaaggatgagctggaggtgccctgtggcctgtctgctgtgcaggccaagacccccatcggcaggaacaccttcatcatcctgtctgtgcacagagatgccaccggccaggtgctgcgctatggccaggacttctgcctgggcatcactggaggctttgacaacaagatgctgtacctgagcagtgaccacaggaccctgctgaagagcagcaagaggtcctggctgcaggaggtgtacctgacagatgaggtgagccacgtgaactgctggaacatgaaggccagccccagccggcagatgctgaagttcagcagcatcaccgtgacccagattggagactggcagcccaccggcatcttctcctag

SEQ ID NO: 36408 - DNA, 537 bp, Artificial Sequence
  Description of Artificial Sequence: Synthetic coding sequence
atgaacaagaggacctctgtggatgccagcaaggaggacctgcaccctgctgacccccagagcggggagggcgtgccccccaacaggaagaacaccaagaccagccccagaggagagggcacagccccacccttcagcgcccggccctgtgtgtggaccctgtgtgagatgctgagcatcctggccctggtgggcgtgctgcaccccttctaccgcagcaacaaccaggtgtaccagaagctgaagacccacctgcgctgccagagcagccgggtggatggcctgatgctgaagcccaccctgctgacccccagccagctgaagagccctgagggccacctgatcctgcccaccttcaaccacctggtgatccgccacatcctggaccccaagcagatcttctgtgtggctgatgtgtgcacagactgcaagttcaactgtggcagcattgaaagacaccagaagaggcacctgatgagggtgtcccaggactgggagcacctgatccgctacagaaaccagatctgcctgtcctag

SEQ ID NO: 36409 - DNA, 1527 bp, Artificial Sequence
  Description of Artificial Sequence: Synthetic coding sequence
atggccggccagaggacctgccagaggaggagcagccgggccggccctgggaagatgcaggagccccccaagagcattgaggagttcctgaagttccagaactgggactactggccccgggagatccacttcagagatgatgacaagtggagctgcaccctgaagaagatcaaggaggacagcagctttgtgtccatctacacccacctgtgggagaatgtgccccgcatctttgaggccctgctgatcatggagagcaagctgaaggagtacagcctcatcctgcagaaccacaccagcgagatcttcaagtggaagtccatgatcagcgagaccagcagctacaggaagctggagagatatggagagttcctgaagaagtaccacaagaagaagaagatcatgctgagtgatgagatggagacagagaagaacatcgagggctgcagcttcaccggcttcaaggccaatgagctgacccagctgcccaggcacctggatgctgagcagatctacctgttcatcctgaaggcccacaactttgatgagagggtcttcaagatctggaagacccacttcctgtctgaggccagcatcgccctgctgcatgacagcttctggtggtggttcctgcacaagttccggccagaccgggagaaccaggactgcctgtttgaccgcatcagcgagagctatgtgaccctcttcatgagcatccccctgagcaggaaggatgccttcttccagatctacccagactgcctggcccaggccatctatgccaccttccacgaggccttccctgagagcagctacctgttcaatgatgagttcaaggaggacctgggcaacaacatcttcctgtggtgcagcggcctgaagccccagaagggcttctggatccactggaagctgaaggagctgagcaccaccaccatccacggcagcaagaaggccccagccaagtctgtgaaggagagaattgctgacagccaggagcacatcagcaccagcattgacttcaacatcatcaagatcctgaacaacccccgggcctacaccctgcccatcagcaaggaggagagccggctgagccggctggccaccaagagccactacagcagcacaggccctgagttcaacagagtgctcttcaactttggaggccagagccccctcatcctgtactacctgaagatgcatgagctggccggcatcagcaaggcccccaagaagaccaagatcaagctgaccaagatcttccaggagcccctgcctgcccccacctacagagatgtgatcaaggaggccaagaggcagtttgccaggaaccagaaggacttccgcatcctgcaggccaaggccaccaagaagccccatgaggtgaagcaggactttgagaagttcctgcacaagctgcggtctgaggccgagattgagcgggagtgtgtggccagcctgagcagcagcagcagcagcagccccagcagcacagacaactacaactttgaggaggaggagtactag

SEQ ID NO: 36410 - DNA, 912 bp, Artificial Sequence
  Description of Artificial Sequence: Synthetic coding sequence
atggccggccagaggacctgccagaggaggagcagccgggccggccctgggaagatgcaggagccccccaagagcattgaggagttcctgaagttccagaactgggactactggccccgggagatccacttcagagatgatgacaagtggagctgcaccctgaagaagatcaaggaggacagcagctttgtgtccatctacacccacctgtgggagaatgtgccccgcatctttgaggccctgctgatcatggagagcaagctgaaggagtacagcctcatcctgcagaaccacaccagcgagatcttcaagtggaagtccatgatcagcgagaccagcagctacaggaagctggagagatatggagagttcctgaagaagtaccacaagaagaagaagatcatgctgagtgatgagatggagacagagaagaacatcgagggctgcagcttcaccggcttcaaggccaatgagctgacccagctgcccaggcacctggatgctgagcagatctacctgttcatcctgaaggcccacaactttgatgagagggtcttcaagatctggaagacccacttcctgtctgaggccagcatcgccctgctgcatgacagcttctggtggtggttcctgcacaagttccgcatctacccagactgcctggcccaggccatctatgccaccttccacgaggccttccctgagagcagctacctgttcaatgatgagttcaaggaggacctgggcaacaacatcttcctgtggtgcagcggcctgaagccccagaagggcttctggatccactggaagctgaaggagctgagcaccaccaccatccacggcagcaagaaggccccagccaagtctgtgaaggagagaattgctgacagccaggagcacatcagcacctag

SEQ ID NO: 36411 - DNA, 549 bp, Artificial Sequence
  Description of Artificial Sequence: Synthetic coding sequence
atggccggccagaggacctgccagaggaggagcagccgggccggccctgggaagatgcaggagccccccaagagcattgaggagttcctgaagttccagaactgggactactggccccgggagatccacttcagagatgatgacaagtggagctgcaccctgaagaagatcaaggaggacagcagctttgtgtccatctacacccacctgtgggagaatgtgccccgcatctttgaggccctgctgatcatggagagcaagctgaaggagtacagcctcatcctgcagaaccacaccagcgagatcttcaagtggaagtccatgatcagcgagaccagcagctacaggaagctggagagatatggagagttcctgaagaagtaccacaagaagaagaagatcatgctgagtgatgagatggagacagagaagaacatcgagggctgcagcttcaccggcttcaaggccaatgagctgacccagctgcccaggcacctggatgctgagcagatctacctgttcatcctgaaggcccacaactttgattag

SEQ ID NO: 36412 - DNA, 915 bp, Artificial Sequence
  Description of Artificial Sequence: Synthetic coding sequence
atggccggccagaggacctgccagaggaggagcagccgggccggccctgggaagatgcaggagccccccaagagcattgaggagttcctgaagttccagaactgggactactggccccgggagatccacttcagagatgatgacaagtggagctgcaccctgaagaagatcaaggaggacagcagctttgtgtccatctacacccacctgtgggagaatgtgccccgcatctttgaggccctgctgatcatggagagcaagctgaaggagtacagcctcatcctgcagaaccacaccagcgagatcttcaagtggaagtccatgatcagcgagaccagcagctacaggaagctggagagatatggagagttcctgaagaagtaccacaagaagaagaagatcatgctgagtgatgagatggagacagagaagaacatcgagggctgcagcttcaccggcttcaaggccaatgagctgacccagctgcccaggcacctggatgctgagcagatctacctgttcatcctgaaggcccacaactttgatgagagggtcttcaagatctggaagacccacttcctgtctgaggccagcatcgccctgctgcatgacagcttctggtggtggttcctgcacaagttccgcatctacccagactgcctggcccaggccatctatgccaccttccacgaggccttccctgagagcagctacctgttcaatgatgagttcaaggaggacctgggcaacaacatcttcctgtggtgcagcggcctgaagccccagaagggcttctggatccactggaagctgaaggagctgagcaccaccaccatccacggcagcaagaaggccccagccaagtctgtgaaggagagaattgctgacagccaggagcacatcagcaccagctag

SEQ ID NO: 36413 - DNA, 393 bp, Artificial Sequence
  Description of Artificial Sequence: Synthetic coding sequence
atgcccaggcctgccagcgagagctggagccccatccagagccgcatcccagcctacaaggctgtgagccacctgcggctgctgcccacagccaacagccccagcggcagcaaccagcccaccaaccccaacagagcccagcaccctgagggcccccagagccgggagggcgccaccagccctgtgctggccagcctggagccccccacccccacagacctgcccagcgcccgggcccggccccgggtgcctgctgagagcggccctggctggctgcacaaggcccggcggcccacccggggcatcctgagagatgtgctgcggcacagaggagtgcctgcccagcccaggcctgcccctggggcccaccagctgagcagccccagcagctag

SEQ ID NO: 36414 - DNA, 681 bp, Artificial Sequence
  Description of Artificial Sequence: Synthetic coding sequence
atgagccgcatctaccatgatggagccctgaggaacaaggctgtgcagagcgtgcggctgcccggggcctgggaccctgctgcccaccagggcggcaatggagtgctgctggagggggagctgattgatgtgagccgccacagcatcctggacacccacggcaggaaggagcgctactacgtgctgtacatccggcccagccacatccacaggaggaagtttgatgccaagggaaatgaaattgagcccaacttcagcgccaccaggaaggtgaacacaggcttcctgatgagcagctacaaggtggaggccaagggggacacagaccggctgaccccagaggccctgaagggcctggtgaacaagccagagctgctggccctgacagagagcctgaccccagaccacacagtggccttctggatgcctgagagcgagatggaggtgatggagctggagctgggcgctggggtgcggctgaagaccagaggagatggccccttcctggacagcctggccaagctggaggccggcaccgtgaccaagtgcaacttcaccggagatggcaagacaggagcctcctggacagacaacatcatggcccagaagtgcagcaaaggagctgctgctgagatccgggagcagggagatggagcagaagatgaggagtgggatgactag

SEQ ID NO: 36415 - DNA, 3144 bp, Artificial Sequence
  Description of Artificial Sequence: Synthetic coding sequence
atggccgagaagaggcccctgcggaccctgggccctgtgatgtatggcaagctgccccggctggagacagattctggcctggagcacagcctgccccacagcgtgggcaaccaggacccctgcacctacaagggcagctacttcagctgccccatggccggcacccccaaggccgagagcgagcagctggcctcctggaccccctacccacccctgtacagcacaggcatggccggcccccccctgcaggccgacaacctgctgaccaactgcctcttctaccgcagccctgctgagggccctgagaagatgcaggacagcagccctgtggagctgctgcccttcagcccccaggcccacagctacccaggcccccccctggccgcccccaagcctgtgtacagaaaccccctgtgctacggcctgagcacctgcctgggggagggcgctgtgaagaggcccctggatgtggactggaccctggccaccggccccctgctgcccagcgctgaccccccctgcagcctggccccagcccccagcaagggccagaccctggatggcaccttcctgcggggcgtgcctgctgagggcagcagcaaggacagcagcggcagcttcagcccctgccagcccttcctggagaagtaccagaccatccacagcacaggcttcctggccagccgctacacaggcccctaccccaggaacagcaagcaggccatgtctgagggccccagcagcccctggacccagctggcccagcccctgggccccccctgccaggacaccggccccacccactaccccccaccccaccaccccccaccccaccccccccaggccctgccctgccccccagcctgccgccaccctgagaagcagggcagctacagccctgccctgcccctgcagcccctgggcggccacaagggcaccggctaccaggccggcggcctgggcagcccctacctgcggcagcaggccgcccaggccccctacatcccccccctgggcctggatgcctacccctaccccagcgcccccctgcctgcccccagccctggcctgaagctggagccccccctgaccccccgctgccccctggactttgccccccagaccctgtccttcccctatgccagagatgacctgagcctgtatggagccagccctggcctgggcggcaccccacccagccagaacaacgtgcgggctgtgccccagcccggggccttccagagggcctgccagcccctgcctgccagccagccctgcagcgagcctgtgcggcctgcccaggaggccgaggagaagacctggctgcccagctgcaggaaggagaagctgcagccccggctgtctgagcacagcggcccccccatcgtcatccgggacagccctgtgccctgcaccccaccagccctgcccccctgtgcccgggagtgccagagcctgccccagaaggagggcgcccggccccccagcagcccccccatgcctgtgattgacaacgtgttcagcctggccccctacagagactacctggatgtgcctgcccctgaggccaccacagagccagattctgccacagctgagccagacagcgccccagccaccagcgagggccaggacaagggctgccggggcaccctgcctgcccaggagggccccagcggcagcaagcccctgcggggcagcctgaaggaggaggtggccctggacctgtctgtgaggaagcccacagctgaggccagccctgtgaaggccagccgctctgtggagcacgccaagcccacagctgccatggatgtgcctgatgtgggcaacatggtgtctgacctgcccggcctgaagaagattgacacagaggcccctggcctgcccggggtgcctgtgaccacagatgccatgcccaggaccaacttccacagctctgtggccttcatgttcaggaagttcaagatcctgcggcctgcccccctgcctgctgctgtggtgcccagcacccccaccagcgccccagcccccacccagcctgcccccacccccaccagcggccccatcggcctgcgcatcctggcccagcagcccctgtctgtgacctgcttcagcctggccctgcccagccccccagctgtggccgtggccagccctgccccagccccagcccccagccctgccccagcccgggcccaggccccagccagcgcccgggaccctgccccagccccagcccctgtggccggccctgccccagccagcaccagcgcccctggggacagcctggagcagcacttcaccggcctgcacgccagcctgtgtgatgccatcagcggctctgtggcccacagccccccagagaagctgcgggagtggctggagacagctggcccctggggccaggccgcctggcaggactgccagggcgtgcagggcctgctggccaagctgctgagccagctgcagagatttgacaggacccaccgctgccccttcccccacgtggtgcgggccggggccatctttgtgcccatccacctggtgaaggagcggctcttcccccggctgcccccagcctctgtggaccacgtgctgcaggagcaccgggtggagctgcggcccaccaccctgtctgaggagcgggccctgcgggagctggccctgcccggctgcaccagcaggatgctgaagctgctggccctgcggcagctgcctgacatctacccagacctgctgggcctgcagtggagggactgtgtgcggcggcagctgggggactttgacacagaggccggggctgtgagcagcagcgagcccaccgtggcccggggggagcctgagagcctggccctggcccagaagagccctgcccccaaggtgaggaagccaggcaggaagccacccaccccaggccctgagaaggccgaggccgccgccggggaggagagctgtggggccagccccaccccagccaccagcgccagccccccaggccccaccctgaaggcccgcttccgcagcctgctggagacagcctggctgaatggcctggccctgcccacctggggccacaagagcagcaggccagaccagcccagcccctgcccccagctgctggacagccagagccaccacctgtag

SEQ ID NO: 36416 - DNA, 3144 bp, Artificial Sequence; identical to SEQ ID NO: 36415
  Description of Artificial Sequence: Synthetic coding sequence

SEQ ID NO: 36417 - DNA, 1338 bp, Artificial Sequence
  Description of Artificial Sequence: Synthetic coding sequence
atggatgtgcctgatgtgggcaacatggtgtctgacctgcccggcctgaagaagattgacacagaggcccctggcctgcccggggtgcctgtgaccacagatgccatgcccaggaccaacttccacagctctgtggccttcatgttcaggaagttcaagatcctgcggcctgcccccctgcctgctgctgtggtgcccagcacccccaccagcgccccagcccccacccagcctgcccccacccccaccagcggccccatcggcctgcgcatcctggcccagcagcccctgtctgtgacctgcttcagcctggccctgcccagccccccagctgtggccgtggccagccctgccccagccccagcccccagccctgccccagcccgggcccaggccccagccagcgcccgggaccctgccccagccccagcccctgtggccggccctgccccagccagcaccagcgcccctggggacagcctggagcagcacttcaccggcctgcacgccagcctgtgtgatgccatcagcggctctgtggcccacagccccccagagaagctgcgggagtggctggagacagctggcccctggggccaggccgcctggcaggactgccagggcgtgcagggcctgctggccaagctgctgagccagctgcagagatttgacaggacccaccgctgccccttcccccacgtggtgcgggccggggccatctttgtgcccatccacctggtgaaggagcggctcttcccccggctgcccccagcctctgtggaccacgtgctgcaggagcaccgggtggagctgcggcccaccaccctgtctgaggagcgggccctgcgggagctggccctgcccggctgcaccagcaggatgctgaagctgctggccctgcggcagctgcctgacatctacccagacctgctgggcctgcagtggagggactgtgtgcggcggcagctgggggactttgacacagaggccggggctgtgagcagcagcgagcccaccgtggcccggggggagcctgagagcctggccctggcccagaagagccctgcccccaaggtgaggaagccaggcaggaagccacccaccccaggccctgagaaggccgaggccgccgccggggaggagagctgtggggccagccccaccccagccaccagcgccagccccccaggccccaccctgaaggcccgcttccgcagcctgctggagacagcctggctgaatggcctggccctgcccacctggggccacaagagcagcaggccagaccagcccagcccctgcccccagctgctggacagccagagccaccacctgtag

SEQ ID NO: 36418 - DNA, 381 bp, Artificial Sequence
  Description of Artificial Sequence: Synthetic coding sequence
atgcccaagaaggccggggccaccaccaagggcaagagccagagcaaggagcctgagcggcccctgccccccctgggccctgtggccgtggaccccaagggctgtgtgaccatcgccatccacgccaagccaggcagcaagcagaatgctgtgacagacctgacagctgaggccgtgaatgtggccatcgccgccccacccagcgagggggaggccaatgctgagctgtgccgctacctgagcaaggtgctggagctgaggaagagtgatgtggtgctggacaagggcggcaagagccgggagaaggtggtgaagctgctggccagcaccaccccagaggagatcctggagaagctgaagaaggaggccaagaagacctag

SEQ ID NO: 36419 - DNA, 504 bp, Artificial Sequence
  Description of Artificial Sequence: Synthetic coding sequence
atgctgcggctgcggagcggcctgcggcacctgcgggccacccccaacacccggggcagcgcccggctgctgtgtgccgagatgcccaagaaggccggggccaccaccaagggcaagagccagagcaaggagcctgagcggcccctgccccccctgggccctgtggccgtggaccccaagggctgtgtgaccatcgccatccacgccaagccaggcagcaagcagaatgctgtgacagacctgacagctgaggccgtgaatgtggccatcgccgcccctccttctgagggggaggccaatgctgagctgtgccgctacctgagcaaggtgctggagctgaggaagagtgatgtggtgctggacaagacaggcagctgctacatcgcccaggccggcctggagctgctggccagcagtgacctgcctgccagcgccagccagagcgctggcatcaccggggtgagccaccacacccagcctgccctgctgctgatcagcctgtag

SEQ ID NO: 36420 - DNA, 462 bp, Artificial Sequence
  Description of Artificial Sequence: Synthetic coding sequence
atgctgcggctgcggagcggcctgcggcacctgcgggccacccccaacacccggggcagcgcccggctgctgtgtgccgagatgcccaagaaggccggggccaccaccaagggcaagagccagagcaaggagcctgagcggcccctgccccccctgggccctgtggccgtggaccccaagggctgtgtgaccatcgccatccacgccaagccaggcagcaagcagaatgctgtgacagacctgacagctgaggccgtgaatgtggccatcgccgcccctccttctgagggggaggccaatgctgagctgtgccgctacctgagcaaggtgctggagctgaggaagagtgatgtggtgctggacaagggcggcaagagccgggagaaggtggtgaagctgctggccagcaccaccccagaggagatcctggagaagctgaagaaggaggccaagaagacctag

SEQ ID NO: 36421 - DNA, 450 bp, Artificial Sequence
  Description of Artificial Sequence: Synthetic coding sequence
atgctgcggctgcggagcggcctgcggcacctgcgggccacccccaacacccggggcagcgcccggctgctgtgtgccgagatgcccaagaaggccggggccaccaccaagggcaagagccagagcaaggagcctgagcggcccctgccccccctgggccctgtggccgtggaccccaagggctgtgtgaccatcgccatccacgccaagccaggcagcaagcagaatgctgtgacagacctgacagctgaggccgtgaatgtggccatcgccgcccctccttctgagggggaggccaatgctgagctgtgccgctacctgagcaaggtgctggagctgaggaagagtgatgtggtgctggacaagctgtgctacagcatcccccagcagctggaggagacccaggagggcgtgtctggcatcccagacaccccctgccacttcctgtag

SEQ ID NO: 36422 - DNA, 552 bp, Artificial Sequence
  Description of Artificial Sequence: Synthetic coding sequence
atggcccggctcatcctggagcgcttcctgcaggagcacgaggagaccccacccagcaagagcatcatcaacagcatgctgcgggaccccagccagatcccagatggagtgctggccaaccaggtgtaccagtgcatcgtgaatgactgctgctacggccccctggtggactgcatcaagcacgccatcggccatgaacatgaggtgctgctgcgggacctgctgctggagaagaacctgtccttcctggatgaggaccagctgcgggccaagggctatgacaagaccccagacttcatcctgcaggtgcctgtggccgtggagggccacatcatccactggattgagagcaaggccagctttggagatgagtgcagccaccacgcctacctgcatgaccagttctggagctactggaaccgcttcggccctggcctggtgatctactggtacggcttcatccaggagctggactgcaaccgggagcggggcatcctgctgaaggcctgcttccccaccaacatcgtgaccctgtgccacagcatcgcctag

SEQ ID NO: 36423 - DNA, 846 bp, Artificial Sequence
  Description of Artificial Sequence: Synthetic coding sequence
atgatcctgaccaaggcccagtatgatgaaattgcccagtgcctggtgtctgtgccccccacccggcagagcctgaggaagctgaagcagcgcttccccagccagagccaggccaccctgctgagcatcttcagccaggagtaccagaagcacatcaagaggacccacgccaagcaccacaccagcgaggccatcgagagctactaccagcgctacctgaatggagtggtgaagaatggagctgcccctgtgctgctggacctggccaatgaggtggactatgcccccagcctgatggcccggctcatcctggagcgcttcctgcaggagcacgaggagaccccacccagcaagagcatcatcaacagcatgctgcgggaccccagccagatcccagatggagtgctggccaaccaggtgtaccagtgcatcgtgaatgactgctgctacggccccctggtggactgcatcaagcacgccatcggccatgaacatgaggtgctgctgcgggacctgctgctggagaagaacctgtccttcctggatgaggaccagctgcgggccaagggctatgacaagaccccagacttcatcctgcaggtgcctgtggccgtggagggccacatcatccactggattgagagcaaggccagctttggagatgagtgcagccaccacgcctacctgcatgaccagttctggagctactggaaccgcttcggccctggcctggtgatctactggtacggcttcatccaggagctggactgcaaccgggagcggggcatcctgctgaaggcctgcttccccaccaacatcgtgaccctgtgccacagcatcgcctag

SEQ ID NO: 36424 - DNA, 552 bp, Artificial Sequence; identical to SEQ ID NO: 36422
  Description of Artificial Sequence: Synthetic coding sequence

SEQ ID NO: 36425 - DNA, 663 bp, Artificial Sequence
  Description of Artificial Sequence: Synthetic coding sequence
atgttccagggccagaggggctggttctgtggctctgtgtcccaggacctgcggcagttctgggtggccgagggcggcaccatcagtgaccccagggctgctgacttcctgttcagctgtgatgccagccacccagacaccctgcgcatctaccagagcctggactacatcgaggacaatgccaccgtcttccacgcctactacctgtctgctgtggccaatgccaagatcaagaacagcgtggccctgggccacttcatcctgcccccagcctgcctgcagaaggagatccggaggaagattggcagcttcatctgggagcaggaccagcacttcctgattgagaagcatgatgaggtgaccccaaatgagatcaagaccctgcgggagaacagcgagctggccacagagcacaagaaggagctgagcaagagccctgagaagcacttcatccgcacccctgtggtggagaagcagatgtacttccccctgcagaactaccctgtgaacaacatggtgacaggctacatcagcattgatgccatgaagaagttcctgggggagctgcatgacttcatccctggcaccagcggctacctggcctaccacgtgcagaatgagatcaacatgtctgccatcaagaacaagctgaagaggaagtag

SEQ ID NO: 36426 - DNA, 1557 bp, Artificial Sequence
  Description of Artificial Sequence: Synthetic coding sequence
atgcccaccgtggtggtgatggatgtgtccctgtccatgaccaggcctgtgtccattgagggcagcgaggagtaccagaggaagcacctggccgcccacggcctgaccatgctgtttgagcacatggccaccaactacaagctggagttcaccgccctggtggtgttcagcagcctgtgggagctgatggtgcccttcacccgggactacaacaccctgcaggaggccctgagcaacatggatgattatgacaagacctgcctggagagcgccctggtgggcgtgtgcaacatcgtgcagcaggagtggggcggggccatcccctgccaggtggtgctggtgacagatggctgcctgggcatcggccggggcagcctgcggcacagcctggccacccagaaccagaggtctgagagcaaccgcttccccctgcccttccccttccccagcaagctgtacatcatgtgcatggccaacctggaggagctgcagagcacagacagcctggagtgcctggagcggctgattgacctgaacaacggggagggccagatcttcaccattgatggccccctgtgcctgaagaatgtgcagagcatgtttgggaagctgattgacctggcctacacccccttccacgctgtgctgaagtgtggccacctgacagcagatgtgcaggtgttccccaggcctgagccctttgtggtggatgaggagattgaccccatccccaaggtgatcaacacagacctggagatcgtgggcttcattgatattgctgacatcagcagcccccctgtgctgagccgccacctggtgctgcccatcgccctgaacaaggagggagatgaggtgggcaccggcatcacagatgacaatgaagatgagaacagcgccaaccagattgctgggaagatccccaacttctgtgtgctgctgcacggcagcctgaaggtggagggcatggtggccatcgtgcagctgggccctgagtggcacggcatgctgtacagccaggccgacagcaagaagaagagcaacctgatgatgagcctgtttgagcccggccctgagcccctgccctggctgggcaagatggcccagctgggccccatcagtgatgccaaggagaacccctacggggaggatgacaacaagagccccttccccctgcagcccaagaacaagaggagctatgcccagaatgtgacagtgtggatcaagcccagcggcctgcagacagatgtgcagaagatcctgagaaatgccaggaagctgcctgagaagacccagaccttctacaaggagctgaaccggctgaggaaggccgccctggccttcggcttcctggacctgctgaagggcgtggccgacatgctggagagagaatgtaccctgctgcctgagacagcccacccagatgctgccttccagctgacccacgccgcccagcagctgaagctggccagcacaggcaccagtgaatatgctgcctatgaccagaacatcacccccctgcacacagacttcagcggcagcagcacagagcgcatctag

SEQ ID NO: 36427 - DNA, 1557 bp, Artificial Sequence; identical to SEQ ID NO: 36426
  Description of Artificial Sequence: Synthetic coding sequence

SEQ ID NO: 36428 - DNA, 1386 bp, Artificial Sequence
  Description of Artificial Sequence: Synthetic coding sequence
atgcccacagagagcctgtgcagaagaacagtgtctggagatggccacggggaggccctgagcaacatggatgattatgacaagacctgcctggagagcgccctggtgggcgtgtgcaacatcgtgcagcaggagtggggcggggccatcccctgccaggtggtgctggtgacagatggctgcctgggcatcggccggggcagcctgcggcacagcctggccacccagaaccagaggtctgagagcaaccgcttccccctgcccttccccttccccagcaagctgtacatcatgtgcatggccaacctggaggagctgcagagcacagacagcctggagtgcctggagcggctgattgacctgaacaatggagagggccagatcttcaccattgatggccccctgtgcctgaagaatgtgcagagcatgtttgggaagctgattgacctggcctacacccccttccacgctgtgctgaagtgtggccacctgacagcagatgtgcaggtgttccccaggcctgagccctttgtggtggatgaggagattgaccccatccccaaggtgatcaacacagacctggagatcgtgggcttcatcgacattgctgacatcagcagcccccctgtgctgagccgccacctggtgctgcccatcgccctgaacaaggagggagatgaggtgggcaccggcatcacagatgacaatgaagatgaaaattctgccaaccagattgctgggaagatccccaacttctgtgtgctgctgcacggcagcctgaaggtggagggcatggtggccatcgtgcagctgggccctgagtggcacggcatgctgtacagccaggccgacagcaagaagaagagcaacctgatgatgagcctgtttgagcccggccctgagcccctgccctggctgggcaagatggcccagctgggccccatcagtgatgccaaggagaacccctatggagaagatgacaacaagagccccttccccctgcagcccaagaacaagaggagctatgcccagaatgtgacagtgtggatcaagcccagcggcctgcagacagatgtgcagaagatcctgagaaatgccaggaagctgcctgagaagacccagaccttctacaaggagctgaaccggctgaggaaggccgccctggccttcggcttcctggacctgctgaagggcgtggccgacatgctggagcgggagtgcaccctgctgcctgagacagcccacccagatgctgccttccagctgacccatgctgcccagcagctgaagctggccagcacaggcaccagtgaatatgctgcctatgaccagaacatcacccccctgcacacagacttcagcggcagcagcacagagcgcatctag

SEQ ID NO: 36429 - DNA, 1320 bp, Artificial Sequence
  Description of Artificial Sequence: Synthetic coding sequence
atggatgattatgacaagacctgcctggagagcgccctggtgggcgtgtgcaacatcgtgcagcaggagtggggcggggccatcccctgccaggtggtgctggtgacagatggctgcctgggcatcggccggggcagcctgcggcacagcctggccacccagaaccagaggtctgagagcaaccgcttccccctgcccttccccttccccagcaagctgtacatcatgtgcatggccaacctggaggagctgcagagcacagacagcctggagtgcctggagcggctgattgacctgaacaatggagagggccagatcttcaccattgatggccccctgtgcctgaagaatgtgcagagcatgtttgggaagctgattgacctggcctacacccccttccacgctgtgctgaagtgtggccacctgacagcagatgtgcaggtgttccccaggcctgagccctttgtggtggatgaggagattgaccccatccccaaggtgatcaacacagacctggagatcgtgggcttcatcgacattgctgacatcagcagcccccctgtgctgagccgccacctggtgctgcccatcgccctgaacaaggagggagatgaggtgggcaccggcatcacagatgacaatgaagatgaaaattctgccaaccagattgctgggaagatccccaacttctgtgtgctgctgcacggcagcctgaaggtggagggcatggtggccatcgtgcagctgggccctgagtggcacggcatgctgtacagccaggccgacagcaagaagaagagcaacctgatgatgagcctgtttgagcccggccctgagcccctgccctggctgggcaagatggcccagctgggccccatcagtgatgccaaggagaacccctatggagaagatgacaacaagagccccttccccctgcagcccaagaacaagaggagctatgcccagaatgtgacagtgtggatcaagcccagcggcctgcagacagatgtgcagaagatcctgagaaatgccaggaagctgcctgagaagacccagaccttctacaaggagctgaaccggctgaggaaggccgccctggccttcggcttcctggacctgctgaagggcgtggccgacatgctggagcgggagtgcaccctgctgcctgagacagcccacccagatgctgccttccagctgacccatgctgcccagcagctgaagctggccagcacaggcaccagtgaatatgctgcctatgaccagaacatcacccccctgcacacagacttcagcggcagcagcacagagcgcatctag

SEQ ID NO: 36430 - DNA, 1449 bp, Artificial Sequence
  Description of Artificial Sequence: Synthetic coding sequence
atgcccaccgtggtggtgatggatgtgtccctgtccatgaccaggcctgtgtccattgagggcagcgaggagtaccagaggaagcacctggccgcccacggcctgaccatgctgtttgagcacatggccaccaactacaagctggagttcaccgccctggtggtgttcagcagcctgtgggagctgatggtgcccttcacccgggactacaacaccctgcaggtggtgctggtgacagatggctgcctgggcatcggccggggcagcctgcggcacagcctggccacccagaaccagaggtctgagagcaaccgcttccccctgcccttccccttccccagcaagctgtacatcatgtgcatggccaacctggaggagctgcagagcacagacagcctggagtgcctggagcggctgattgacctgaacaacggggagggccagatcttcaccattgatggccccctgtgcctgaagaatgtgcagagcatgtttgggaagctgattgacctggcctacacccccttccacgctgtgctgaagtgtggccacctgacagcagatgtgcaggtgttccccaggcctgagccctttgtggtggatgaggagattgaccccatccccaaggtgatcaacacagacctggagatcgtgggcttcattgatattgctgacatcagcagcccccctgtgctgagccgccacctggtgctgcccatcgccctgaacaaggagggagatgaggtgggcaccggcatcacagatgacaatgaagatgagaacagcgccaaccagattgctgggaagatccccaacttctgtgtgctgctgcacggcagcctgaaggtggagggcatggtggccatcgtgcagctgggccctgagtggcacggcatgctgtacagccaggccgacagcaagaagaagagcaacctgatgatgagcctgtttgagcccggccctgagcccctgccctggctgggcaagatggcccagctgggccccatcagtgatgccaaggagaacccctacggggaggatgacaacaagagccccttccccctgcagcccaagaacaagaggagctatgcccagaatgtgacagtgtggatcaagcccagcggcctgcagacagatgtgcagaagatcctgagaaatgccaggaagctgcctgagaagacccagaccttctacaaggagctgaaccggctgaggaaggccgccctggccttcggcttcctggacctgctgaagggcgtggccgacatgctggagagagaatgtaccctgctgcctgagacagcccacccagatgctgccttccagctgacccacgccgcccagcagctgaagctggccagcacaggcaccagtgaatatgctgcctatgaccagaacatcacccccctgcacacagacttcagcggcagcagcacagagcgcatctag

SEQ ID NO: 36431 - DNA, 774 bp, Artificial Sequence
  Description of Artificial Sequence: Synthetic coding sequence
atgcccctggcctgtgagcaccctgtgggcgtgagcagctctgtgggcaatgccggccgggccggcgtgggcacccaggcctggggcaccacagagaggacccagcaccctggccctgcccagcactgcccctgtggcctgcgggtgtttgtgctgcaggagaagagggtggtgtccaggaactgggcccggggcacctgtggcccccgggtgaccaatgagatgctggaggatgaagatgctgaggaccacggcggcaccttctgcctgggggagctggtggagctggccgtgaccatggagaacaaggccgagggcaagagaattgtgtctgagaagcccacccgggccaggaaccagggcatcgagggcagccctgggggccgggtgaccaggagcccccccacccaggtggccatcagcagtgacagcgccaggaagggctcctgggagccctggagcaggcctgtgggggagcccccagaggccggctgggactatgcccagtggaagcaggagcgggagcagattgacctggcccggctggcccggcacagagatgcccagggcgactggaggcggccctgggacctggacaaggccaagagcaccctgcaggactgcagccagctgcggggggagggccctgcccgggccggcagccggcggggggagcccacccccaccagcagcctgcccagcctggccctcttcatcttccaccccctggtgctgtccttcctgtgcctgctggtgtcctacttccagagctag

SEQ ID NO: 36432 - DNA, 975 bp, Artificial Sequence
  Description of Artificial Sequence: Synthetic coding sequence
atgaggcaccgggagggctcctgggagccctggagcaggcctgtgggggagcccccagaggccggctgggactatgcccagtggaagcaggagcgggagcagattgacctggcccggctggcccggcacagagatgcccagggcgactggaggcggccctgggacctggacaaggccaagagcaccctgcaggactgcagccagctgcggggggagggccctgcccgggccggcagccggcggggccccaggagccaccagaagctgcagcccccacccctgctgcctgatggcaagggccggggcggccaggccagccggcccagcgtggccccagccaccggcagcaaggcccggggcaaggagcggctgaccggccgggcccggcgctgggacatgaaggaggacaaggaggagctggagggccaggagggcagccagagcacccgggagacccccagcgaggaggagcaggcccagaagcagagcggcatggagcagggccgcctgggcagcgccccagctgccagccctgccctggccagccctgagggccccaagggggagagcgtggccagcacagccagctctgtgccctgcagcccccaggagccagacctggcccccctggacctgagcctgggcggggccggcatccctggcccccgggagagcggctgtgtgctgggcctgcggcctggggcccaggagagccctgtgtcctggccagagggcagcaagcagcagcccctgggctggagcaaccaccaggccgagctggaggtgcagacctgcccagagccccagagaggagctggcctgcctgagcctggagaagatagaagtggcaagagcggggcccagcagggcctggcccccaggagccggcccacccggggcggcagccagaggagccggggcacagctggggtgagaagaagaacaggccggcccggccctgctggccgctgctag

SEQ ID NO: 36433 - DNA, 1605 bp, Artificial Sequence
  Description of Artificial Sequence: Synthetic coding sequence
atgatcagctgtgccgagcagaggagccggcagggcgaggccggccggggccctgcccctgtggccccagccttcctgcccctgtggctgccccggggctgcagcggcatcctgtctgtgcctgctgtggccatgcacagcgctggcacccccagggctgagagccccatgagccggcaggagaaggatgctgagctggaccggcgcatcgtggccctgaggaagaagaaccaggccctgctgcggcgctaccaggagatccaggaggaccggcggcaggccgagcagggcggcatggctgtgaccaccccagccctgctgcagccagatggcctgactgtgaccatcagccaggtgcctggagagaagagggtggtgtccaggaactgggcccggggcacctgtggcccccgggtgaccaatgagatgctggaggatgaagatgctgaggaccacggcggcaccttctgcctgggggagctggtggagctggccgtgaccatggagaacaaggccgagggcaagagaattgtgtctgagaagcccacccgggccaggaaccagggcatcgagggcagccctgggggccgggtgaccaggagcccccccacccaggtggccatcagcagtgacagcgccaggaagggctcctgggagccctggagcaggcctgtgggggagcccccagaggccggctgggactatgcccagtggaagcaggagcgggagcagattgacctggcccggctggcccggcacagagatgcccagggcgactggaggcggccctgggacctggacaaggccaagagcaccctgcaggactgcagccagctgcggggggagggccctgcccgggccggcagccggcggggccccaggagccaccagaagctgcagcccccacccctgctgcctgatggcaagggccggggcggccaggccagccggcccagcgtggccccagccaccggcagcaaggcccggggcaaggagcggctgaccggccgggcccggcgctgggacatgaaggaggacaaggaggagctggagggccaggagggcagccagagcacccgggagacccccagcgaggaggagcaggcccagaagcagagcggcatggagcagggccgcctgggcagcgccccagctgccagccctgccctggccagccctgagggccccaagggggagagcgtggccagcacagccagctctgtgccctgcagcccccaggagccagacctggcccccctggacctgagcctgggcggggccggcatccctggcccccgggagagcggctgtgtgctgggcctgcggcctggggcccaggagagccctgtgtcctggccagagggcagcaagcagcagcccctgggctggagcaaccaccaggccgagctggaggtgcagacctgcccagagccccagagaggagctggcctgcctgagcctggagaagatagaagtggcaagagcggggcccagcagggcctggcccccaggagccggcccacccggggcggcagccagaggagccggggcacagctggggtgagaagaagaacaggccggcccggccctgctggccgctgctag

SEQ ID NO: 36434 - DNA, 540 bp, Artificial Sequence
  Description of Artificial Sequence: Synthetic coding sequence
atggagctgcagggcgcccaggaggacctgggcatcagcctgagcagccccaggagaaatcatgagaccaggcctggcagcaaggccaagggccgcagcagcatctgcctgcaggcctctgtgtggatggccggcggcaagctgcggctgcgggccagcgagcacctgacccagggccaccagcaggagctgcgggactggaacctgggagaagatgccagcctgctcttcagcaagagcccctttggagctgggaagctgatccaggccccagcccacgtgttccggcagtgctgggtgcagggcaatgcctggatcagctgcatcaccaagtttgacagcaagaggagccctgaggtggccagcagccccagctacctgactgtgcccaggaggagccccctgcccgtcttcctgcggcccagcgacagatgtgtgtgtggcggctgctacctgggcaagagcacccggcggcgggcctgccagagcctgctgagtgaccccctgggcgtgaccttccccacccagacccggccctag

SEQ ID NO: 36435 - DNA, 552 bp, Artificial Sequence
  Description of Artificial Sequence: Synthetic coding sequence
atggaggtgaagttcatcaccgggaagcacggcggcagaagaccccagagagctgagccccagaggatctgccgggccctgtggctgaccccctggcccagcctcatcctgaagctgctgtcctggatcatcctgagcaacctcttcctgcacctgcgggccacccaccacatgacagagctgcccctgcgcttcctgtacatcgccctgtctgagatgaccttccgggagcagaccagccaccagatcatccagcagatgagcctgagcaacaagctggagcagaaccagctgtatggagaggtgatcaacaaggagacagacaaccctgtgatcagcagcggcctgaccctgctgtttgcccagaagccccagagccctggctggaagaacatgagcagcaccaagagggtgtgcaccatcctggccgacagctgccgggcccaggcccacgccgctgacagaggagagcggggccactttggagtgcagatcctgcaccacttcatcgaggtgttcaacgtgatggctgtgcgcagcaaccccttctag

SEQ ID NO: 36436 - DNA, 552 bp, Artificial Sequence; identical to SEQ ID NO: 36435
  Description of Artificial Sequence: Synthetic coding sequence

SEQ ID NO: 36437 - DNA, 486 bp, Artificial Sequence
  Description of Artificial Sequence: Synthetic coding sequence
atgccccgggccggccgggccccagctgagggcggccctgcccctggcaccaggagcagccgctgcctgcggccccggcccctggcctggaggcggctggtgcccaactttggagcctgggcccccaggaagggggccgcccgggtgggccggcctgtgctgagccccaggaccagcggggccgccggggagcccacctgtggggccggcagccctggcaccctggaggagggcgtggccagcggccgcaccaggaggaggacccagagcgctggggaggtggccaagtgccgctggggcctgggccaggagcccctgtgccccagaggagctgtgctgctgaacagcttcagccccccagcctggccccagttccccccagccctgcggctgcgggccctggcctggccccagccccggggccctgcctgtggcagcacagcccagtggccacccaggggggaccccacctggaggatctcctag

SEQ ID NO: 36438 - DNA, 558 bp, Artificial Sequence
  Description of Artificial Sequence: Synthetic coding sequence
atgaagatgtttgagagcgctgacagcacagccaccaggagcggccaggacctgtgggccgagatctgcagctgcctgcccaaccctgagcaggaggatggagccaacaatgccttcagtgacagctttgtggacagctgcccagagggggagggccagcgggaggtggccgactttgctgtgcagcctgctgtgaagccctgggcccccctgcaggacagcgaggtgtacctggccagcctggagaagaagctgcggcgcatcaagggcctgaaccaggaggtgaccagcaaggacatgctgcggaccctggcccaggccaagaaggagtgctgggaccgcttcctgcaggagaagctggccagcgagttctttgtggatggcctggacagtgatgagagcaccctggagcacttcaagcgctggctgcagcctgacaaggtggccgtgtccacagaggaggtgcagtacctgatccccccagagagccaggtggagaagcctgtggctgaagatgagcctgctgctggggacaagccagctgctgctgagcagtag

SEQ ID NO: 36439 - DNA, 558 bp, Artificial Sequence; identical to SEQ ID NO: 36438
  Description of Artificial Sequence: Synthetic coding sequence

SEQ ID NO: 36440 - DNA, 585 bp, Artificial Sequence
  Description of Artificial Sequence: Synthetic coding sequence
atgaggggcagcggcctgcgcttccagatgaagatgtttgaatctgctgacagcacagccaccaggagcggccaggacctgtgggccgagatctgcagctgcctgcccaaccctgagcaggaggatggagccaacaatgccttcagtgacagctttgtggacagctgcccagagggggagggccagcgggaggtggccgactttgctgtgcagcctgctgtgaagccctgggcccccctgcaggacagcgaggtgtacctggccagcctggagaagaagctgcggcgcatcaagggcctgaaccaggaggtgaccagcaaggacatgctgcggaccctggcccaggccaagaaggagtgctgggaccgcttcctgcaggagaagctggccagcgagttctttgtggatggcctggacagtgatgagagcaccctggagcacttcaagcgctggctgcagcctgacaaggtggccgtgtccacagaggaggtgcagtacctgatccccccagagagccaggtggagaagcctgtggccgaggatgagcctgctgctggggacaagccagctgctgctgagcagtag

SEQ ID NO: 36441 - DNA, 405 bp, Artificial Sequence
  Description of Artificial Sequence: Synthetic coding sequence
atgaagatgtttgagagcgctgacagcacagccaccaggagcggccaggacctgtgggccgagatctgcagctgcctgcccaaccctgagcaggaggatggagccaacaatgccttcagtgacagctttgtggacagctgcccagagggggagggccagcgggaggtggccgactttgctgtgcagcctgctgtgaagccctgggcccccctgcaggacagcgaggtgtacctggccagcctggagaagaagctgcggcgcatcaagggcctgaaccaggaggtgaccagcaaggacatgctgcggaccctggcccaggccaagaaggagtgctgggaccgcttcctgcaggagaagctggccagcgagttctttgtggatggcctggacagtgatgagaggtag

SEQ ID NO: 36442 - DNA, 513 bp, Artificial Sequence
  Description of Artificial Sequence: Synthetic coding sequence
atgaagatgtttgagagcgctgacagcacagccaccaggagcggccaggacctgtgggccgagatctgcagctgcctgcccaaccctgagcaggaggatggagccaacaatgccttcagtgacagctttgtggacagctgcccagagggggagggccagcgggaggtggccgactttgctgtgcagcctgctgtgaagccctgggcccccctgcaggacagcgaggtgtacctggccagcctggagaagaagctgcggcgcatcaagggcctgaaccaggaggtgaccagcaaggacatgctgcggaccctggcccaggccaagaaggagtgctgggaccgcttcctgcaggagaagctggccagcgagttctttgtggatggcctggacagtgatgagagcaccctggagcacttcaagcgctggctgcagcctgacaaggtggccgtgtccacagaggaggtgcagtacctgatccccccagagagccaggtggagaagcctgtggcctag

SEQ ID NO: 36443 - DNA, 882 bp, Artificial Sequence
  Description of Artificial Sequence: Synthetic coding sequence
atgaacatccggggggccccagacctgggccagcccagtgatgaccccagcagcggcggggagcgggagcgcatccggcagaggatgaagatggtgattggccagctggagggcatcctgcgggagctgaaggaggtggccaaggagctgcgggaggtggtgtcccagattgacaagctgaccagtgactttgattttgagctggagccagatgactggaccacagccaccgtgagcagcaccagcagcagtgacaaggccggcatgggcggcccctttgacctgggccacctggacttcatgacagctgacatcctgagtgacagctgggagttctgcagcttcctggatgtgtccacccccagcgacagcgtggatggccctgagagcaccaggcctggagctggccctgactaccgcctgatgaatggaggcacccccatccccaacggcccccgggtggagaccccagacagcagcagcgaggaggcctttggagctggccccaccgtgaagagccagctgccccagaggaccccaggcacccgggagcgggtgcgcttcagtgacaaggtgctgtaccacgccctgtgctgtgatgatgaggagggagatggagagcaggaggtggaggaggaggaggtgggcctgcccccagagcccgcccacacagaggcccacgccggcccccacaagcccagccctgccccctacaagagcagaagaagccccctgaccagccgccacagcggcagcaccctggcccctgagcagacccggcgggtgaccaggaacagcagcacccagacagtgtctgacaagagcacccagacagtgctgccctacacagccacccggcagaaggcccggggcaagaactag

SEQ ID NO: 36444 - DNA, 882 bp, Artificial Sequence; identical to SEQ ID NO: 36443
  Description of Artificial Sequence: Synthetic coding sequence

SEQ ID NO: 36445 - DNA, 801 bp, Artificial Sequence
  Description of Artificial Sequence: Synthetic coding sequence
atggccgaggccggcaaggtgcccctgagcctgggcctgaccggcggggaggccgctgagtggcccctgcagagatatgcccgctgcatccccagcaacacccgggaccccccaggcccctgcctggaggccggcacagccccctgccccacctggaaggtgtttgacagcaatgaggagagcggctacctggtgctgaccatcgtcatcagcggccacttcttcatcttccagggccagaccctgctggagggcttcagcctgattggcagcaaggactggctgaagatcgtgagaagagtggactgcctgctgtttggcaccaccatcaaggacaagagccgcctcttccgggtgcagttcagcggggagagcaaggagcaggccctggagcactgctgcagctgtgtgcagaagctggcccagtacatcaccgtgcaggtgcctgatggcaacatccaggagctgcagctgatccctggccccccccgggccacagagagccagggcaaggacagcgccaagtctgtgccccggcagcccggcagccaccagcacagcgagcagcagcaggtgtgtgtgacagctggcaccggggccccagatggccgcaccagcctgacccagctggcccagaccctgctggccagcgaggagctgccccacgtgtatgagcagagcgcctggggcgctgaggagctgggccccttcctgcggctgtgcctgatggaccagaacttccctgcctttgtggaggaggtggagaaggagctgaagaagctggccggcctgagaaattag

SEQ ID NO: 36446 - DNA, 390 bp, Artificial Sequence
  Description of Artificial Sequence: Synthetic coding sequence
atgagaagaagaggagaaattgacatggccacagaaggagatgtggagctggagctggagacagagaccagcggccctgagaggcctcctgagaagcccaggaagcatgacagcggggctgctgacctggagcgggtgacagattatgcagaggagaaggagatccagagcagcaacctggagacagccatgtctgtgattggagaccggcgcagccgggagcagaaggccaagcaggagcgggagaaggagctggccaaggtgaccatcaagaaggaggacctggagctgatcatgacagagatggagatcagcagagctgctgctgagaggagcctgcgggagcacatgggaaatgtggtggaggccctgattgccctgaccaactag

SEQ ID NO: 36447 - DNA, 390 bp, Artificial Sequence; identical to SEQ ID NO: 36446
  Description of Artificial Sequence: Synthetic coding sequence

SEQ ID NO: 36448 - DNA, 1716 bp, Artificial Sequence
  Description of Artificial Sequence: Synthetic coding sequence
atgagccgggaggccggcagctgccgggtgggcaccggggcccgggcccggagcaggaagcccaagaagccccactacatcccccggccctggggcaagccctacaactacaagtgcttccagtgccccttcacctgcctggagaagagccacctgtacaaccacatgaagtacagcctgtgcaaggacagcctgagcctgctgctggacagcccagactgggcctgcagaagaggcagcaccaccccccggccccacgcccccaccccagacaggcctggagagagtgaccccggccggcagccccagggcgcccggcccaccggggccgccccagccccagacctggtggtggccgacatccacagcctgcactgcggcggcggccccaagagccgggccaagggcagccctggccccccacctcctgtggcccgggccaccaggaagggccctggccccagcggcctgctgcctgagagctggaagccaggcatgggcggggacccccggggcgtgggcgctggggacatggccagcgctggccctgagggctctgtgccctgctacccacctccagcccctggagagttccctgaggcccacagcctgcacctgagcctgctgggcgtgaactaccccctgagccctggcctcttctcctacctgggccccagcctggccgccgccgcccacgtgcccttcctggccagcgccagccccctgctgcccccagccacagccttccctgctgtgcagcccccccagaggcccaccccagccccccggctgtactaccccctgctgctggagcacaccctgggcctgcctgctgggaaggccgccctggccaaggcccctgtgagccccaggagccccagcggcaccccagcccctggcctgctgaaggtgcctgtgcccggcctgggcccctggccccgggtgaccccccgggaccccggccaggagggggagctggagagagctgcccagagcgacccccggcggcggctgagcctgggcagccggctggagctgcccaaggccagccccagcctgacccgcttctgcagccgcagcagcctgcccaccggcagctctgtgatgctgtggccagaagatggagaccccggcggccctgagaccccaggccctgagggccccctgcccctgcagccccggggccctgtgcccggcagccctgagcacgtgggggaggacctgacccgggccctgggggactatgcccgggtggagcagaggctgggccagctgggccctgctgggggcctggccccccggcccctgcgggagcagctgggcaagatccggctggagctgctgaccatccaccaggccctggagcaggccgtgcggcccccagatgcccccctggacctgtctgtgaagagggccccagccaagggcccccaggccctgggggaggcctggggccggcctgagctgggccctgtgctgaccggcggcaccccagagcccccaggcatgctgggccctgctgccccccagcccttcagcggccacaccaccaagtgtgaggccgacagctctgtgcccccacctggcctgcccctggccgccccagatgaccccgtcatccctggcagcggctggggcacctgtgtggccaccaggagcagccagaccccagaggccgtgtgtggcctgcagagcccccagggcgctgaggtgtag

SEQ ID NO: 36449 - DNA, 615 bp, Artificial Sequence
  Description of Artificial Sequence: Synthetic coding sequence
atgctggtggccgctgctgctgagaggaacaaggaccccatcctgcacgtgctgcggcagtacctggaccctgcccagaggggcgtgcgggtgctggaggtggccagcggcagcggccagcacgccgcccactttgcccgggccttccccctggccgagtggcagcccagtgatgtggaccagcgctgcctggacagcattgctgccaccacccaggcccagggcctgaccaacgtgaaggcccccctgcacctggatgtgacctggggctgggagcactggggcggcatcctgccccagagcctggacctgctgctgtgcatcaacatggcccacgtgagccccctgcgctgcacagagggcctcttccgggccgccggccacctgctgaagccccgggccctgctgatcacctacggcccctatgccatcaatggcaagatcagcccccagagcaatgtggactttgacctgatgctgcgctgcagaaatcctgagtggggcctgcgggacacagccctgctggaggacctgggcaaggccagcggcctgctgctggagaggatggtggacatgcctgccaacaacaagtgcctgatcttcaggaagaactag

SEQ ID NO: 36450 - DNA, 324 bp, Artificial Sequence
  Description of Artificial Sequence: Synthetic coding sequence
atgctggtggccgctgctgctgagaggaacaaggaccccatcctgcacgtgctgcggcagtacctggaccctgcccagaggggcgtgcgggtgctggaggtggccagcggcagcggccagcacgccgcccactttgcccgggccttccccctggccgagtggcagcccagtgatgtggaccagcgctgcctggacaggaaccctgagtggggcctgcgggacacagccctgctggaggacctgggcaaggccagcggcctgctgctggagaggatggtggacatgcctgccaacaacaagtgcctgatcttcaggaagaactag

SEQ ID NO: 36451 - DNA, 384 bp, Artificial Sequence
  Description of Artificial Sequence: Synthetic coding sequence
atgctggtggccgctgctgctgagaggaacaaggaccccatcctgcacgtgctgcggcagtacctggaccctgcccagaggggcgtgcgggtgctggaggtggccagcggcagcggccagcacgccgcccactttgcccgggccttccccctggccgagtggcagcccagtgatgtggaccagcgctgcctggaccggggcagcagcgagcagcaggacacctgcagcaaccctggcccctgcagcagccccactggaaatcctgagtggggcctgcgggacacagccctgctggaggacctgggcaaggccagcggcctgctgctggagaggatggtggacatgcctgccaacaacaagtgcctgatcttcaggaagaactag

SEQ ID NO: 36452 - DNA, 558 bp, Artificial Sequence
  Description of Artificial Sequence: Synthetic coding sequence
atgctggtggccgctgctgctgagaggaacaaggaccccatcctgcacgtgctgcggcagtacctggaccctgcccagaggggcgtgcgggtgctggaggtggccagcggcagcggccagcacgccgcccactttgcccgggccttccccctggccgagtggcagcccagtgatgtggaccagcgctgcctggacagcattgctgccaccacccaggcccagggcctgaccaacgtgaaggcccccctgcacctggatgtgacctggggctgggagcactggggcggcatcctgccccagagcctggacctgctgctgtgcatcaacatggcccacgtgagccccctgcgctgcacagaggagcccaggatgggcgccagcggccacagccccccaggcggccctgggaagggccagtggccagcccctggagaagatggcggccacgccagccagcagcagatgccagacctgcctgagaagctgagccccagcttcaccccagcccacctgcacccctgccggcggctgtgtgaggcccggaccctgcccccatag

SEQ ID NO: 36453 - DNA, 618 bp, Artificial Sequence
  Description of Artificial Sequence: Synthetic coding sequence
atgctggtggccgctgctgctgagaggaacaaggaccccatcctgcacgtgctgcggcagtacctggaccctgcccagaggggcgtgcgggtgctggaggtggccagcggcagcggccagcacgccgcccactttgcccgggccttccccctggccgagtggcagcccagtgatgtggaccagcgctgcctggacagcattgctgccaccacccaggcccagggcctgaccaacgtgaaggcccccctgcacctggatgtgacctggggctgggagcactggggcggcatcctgccccagagcctggacctgctgctgtgcatcaacatggcccacgtgagccccctgcgctgcacagagggcctcttccgggccgccggccacctgctgaagccccgggccctgctgatcacctatggagagcccaggatgggcgccagcggccacagccccccaggcggccctgggaagggccagtggccagcccctggagaagatggcggccacgccagccagcagcagatgccagacctgcctgagaagctgagccccagcttcaccccagcccacctgcacccctgccggcggctgtgtgaggcccggaccctgcccccatag

SEQ ID NO: 36454 - DNA, 939 bp, Artificial Sequence
  Description of Artificial Sequence: Synthetic coding sequence
atgggcagaagaagagctgcccggggccctggagctgagggcggccggcccaggcacctgcccaccaggagcctggaggcctttgctgaggaggtgggcgccgccctgcaggcctctgtggagcccggggctgctgatggagagggcggccctggccctgctgccctgccctgcaccctggccatgtgggagctgggccactgtgacccccggcgctgcaccggcaggaagctggcccggctgggcctggtgcgctgcctgcggctgggccacagatttggaggcctggtgctgagccctgtgggcaagcagtatgccagccctgctgaccggcagctggtggcccagagcggcgtggccgtcatcgactgctcctgggcccggctggatgagaccccatttgggaagatgaggggcagccacctgcggctgctgccctacctggtggccgccaaccctgtgaactacggccggccctaccgcctgagctgtgtggaggcctttgctgccaccttctgcatcgtgggcttcccagacctggccgtcatcctgctgaggaagttcaagtggggcaagggcttcctggacctgaaccggcagctgctggacaagtatgctgcctgtggcagccctgaggaggtgctgcaggccgagcaggagttcctggccaatgccaaggagagcccccaggaggaggagattgacccctttgatgtggacagcggccgggagtttggaaaccccaacagacctgtggccagcacccggctgcccagcgacacagatgacagtgatgccagcgaggaccccggccctggagctgagcggggcggggccagcagcagctgctgtgaggaggagcagacccagggccgcggggctgaggcccgggccccagctgaggtgtggaagggcatcaagaagaggcagagggactag

SEQ ID NO: 36455 - DNA, 615 bp, Artificial Sequence
  Description of Artificial Sequence: Synthetic coding sequence
atggagctgaagcagagcctgagcacccacctggaggccgagaagcccctgcggcgctacggggctgtggaggagacagcctggaagacagagcggctgggcaggaaccagctggacatcatctccatggccgagaccaccatgatgcctgaggagattgagctggagatggccaagatccagaggctgcgggaggtgctggtgagaagagagagcgagctgcgcttcatgatggatgacatccagctgtgcaaggacatcatggacctgaagcaggagctgcagaacctggtggccatccctgagaaggagaagaccaagctgcagaagcagagagaagatgagctgatccagaagatccacaagctggtgcagaagagggacttcctggtggatgatgctgaggtggagcggctgcgggagcaggaggaggacaaggagatggctgacttcctgcgcatcaagctgaagcccctggacaaggtgaccaagagccctgccagcagcagagctgagaagaaggccgagcccccacccagcaagcccaccgtggccaagacaggcctggccctgatcaaggactgctgcggggccacccagtgcaacatcatgtag

SEQ ID NO: 36456 - DNA, 564 bp, Artificial Sequence
  Description of Artificial Sequence: Synthetic coding sequence
atgtggggagacctgacagagaccggctgcatgggcagaagaagtgccaagaaggaccagctggacatcatctccatggccgagaccaccatgatgcctgaggagattgagctggagatggccaagatccagaggctgcgggaggtgctggtgcggcgggagagcgagctgcgcttcatgatggatgacatccagctgtgcaaggacatcatggacctgaagcaggagctgcagaacctggtggccatccctgagaaggagaagaccaagctgcagaagcagcgggaggatgagctgatccagaagatccacaagctggtgcagaagagggacttcctggtggatgatgctgaggtggagcggctgcgggagcaggaggaggacaaggagatggctgacttcctgcgcatcaagctgaagcccctggacaaggtgaccaagagccctgccagcagcagagctgagaagaaggccgagcccccacccagcaagcccaccgtggccaagacaggcctggccctgatcaaggactgctgcggggccacccagtgcaacatcatgtag

SEQ ID NO: 36457 - DNA, 1188 bp, Artificial Sequence
  Description of Artificial Sequence: Synthetic coding sequence
atggacctgtgccagaagaatgaaacagacctggagaatgcagaaaataatgagatccagttcacagaggagacagagcccacctacacctgcccagatggcaagtctgagaagaaccacgtgtactgcctgctggatgtgtctgacatcaccctggagcaggatgagaaggccaaggagttcatcattggaacaggctgggaggaggccgtgcagggctggggccgcaccagccctgctgcctgcatctggcccaggaagatccccaagaaggcccgggtgggggagggcgcctgcagcgactgcctggtgtgtgtgaacctgagccactggagcctgcagaccaagcccccaacagaaggaggccctgagaaggaccagagcagccccagccagacccaggccgccccccagggccccagcacagccagccgggccatcagtgacatctgcttccccacctacttccgggcagagaagaagagcctgcagatcaaggagttcatctggtgcaacaaggactgggccatccctggcaccaacagaggcaaggccagcggcaaccccagcggcggggcccaccggggcctgagcatccctggccccctgaccagccgggccctgctggtgctgccccccctgaaggccagcctgagcaatgccctggatgtgctgggcaagaagagcaagaacagcttcctgcagagcgaggagaaggtgctggatgtggagaaggatggctgtgtggcctatgcctacggcctgaagacagcagatggaaaaggagagaagagggccagcgagctggccaagcaccccatggtgaatgacacccccagcagccccagccctgctgcccagatcagcctgctgacagatcctgagcagcgctgcctgcactggagcctgctgtctgagaagaacctggcctgccccccagaccccagcaatgtgcgctacctggccgccctgcagctgctgcagaagaggggcgtgcagagctacaagagcaagttcaaggccaaggagcccaggagccctgtgatcaccaggaagcacgtgctgcccaaggccaagcaggagaaccggccccagatgctggagaccaaggtgttccccaggcctgtgctgcccagcctgactgtgtccagggtcatcatccctgtgtccacccaccgcatcctgtag

SEQ ID NO: 36458 - DNA, 1167 bp, Artificial Sequence
  Description of Artificial Sequence: Synthetic coding sequence
atggacctgtgccagaagaatgaaacagacctggagaatgcagaaaataatgagatccagttcacagaggagacagagcccacctacacctgcccagatggcaagtctgagaagaaccacgtgtactgcctgctggatgtgtctgacatcaccctggagcaggatgagaaggccaaggagttcatcattggaacaggctgggaggaggccgtgcagggctggggccgcaccagccctgctgcctgcatctggcccaggaagatccccaagaaggcccgggtgggggagggcgcctgcagcgactgcctggtgtgtgtgaacctgagccactggagcctgcagaccaagcccccaacagaaggaggccctgagaaggaccagagcagccccagccagacccaggccgccccccagggccccagcacagccagccgggccatcagtgacatctgcttccccacctacttccgggcagagaagaagagcctgcagatcaaggagttcatctggtgcaacaaggactgggccatccctggcaccaacagaggcaaggccagcggcaaccccagcggcggggcccaccggggcctgagcatccctggccccctgaccagccgggccctgctggtgctgccccccctgaaggccagcctgagcaatgccctggatgtgctgggcaagaagagcaagaacagcttcctgcagagcgaggagaaggtgctggatgtggagaaggatggctgtgtggcctatgcctacggcctgaagacagcagatggaaaaggagagaagagggccagcgagctggccaagcaccccatggtgaatgacacccccagcagccccagccctgctgcccagatcagcctgctgacagatcctgagcagcgctgcctgcactggagcctgctgtctgagaagaacctggcctgccccccagaccccagcaatgtgcgctacctggccgccctgcagctgctgcagaagaggggcgtgcagagctacaagagcaagttcaaggccaaggagcccaggagccctgtgatcaccaggaagcacgtgctgcccaaggccaagcaggagaaccggccccagatgctggagaccaaggtgttccccaggcctgtgctgcccagcctgacccacaggaagaagaagatcaagtag

SEQ ID NO: 36459 - DNA, 369 bp, Artificial Sequence
  Description of Artificial Sequence: Synthetic coding sequence
atggtgaatgacacccccagcagccccagccctgctgcccagatcagcctgctgacagatcctgagcagcgctgcctgcactggagcctgctgtctgagaagaacctggcctgccccccagaccccagcaatgtgcgctacctggccgccctgcagctgctgcagaagaggggcgtgcagagctacaagagcaagttcaaggccaaggagcccaggagccctgtgatcaccaggaagcacgtgctgcccaaggccaagcaggagaaccggccccagatgctggagaccaaggtgttccccaggcctgtgctgcccagcctgactgtgtccagggtcatcatccctgtgtccacccaccgcatcctgtag

SEQ ID NO: 36460 - DNA, 504 bp, Artificial Sequence
  Description of Artificial Sequence: Synthetic coding sequence
atggacaagctgaccatcatcagcggctgcctcttcctggccgctgacatctttgccatcgccagcatcgccaacccagactggatcaacacaggagagagcgctggggccctgactgtgggcctggtgcggcagtgccagaccatccacggccgggacaggacctgcatccccccccggctgcccccagagtgggtgaccaccctcttcttcatcatcatgggcatcatcagcctgactgtgacctgtggcctgctggtggccagccactggaggcgggaggccaccaagtatgcccgctggatcgccttcaccggcatgatcctcttctgcatggccgccctgatcttccccatcggcttctacatcaatgaggtgggcggccagccctacaagctgcccaacaacacagtggtgggcagcagctatgtgctgtttgtgctgagcatcttcttcaccatcgtgggcctgctgtttgctgggaaggtgtgcctgcccggctag

SEQ ID NO: 36461 - DNA, 420 bp, Artificial Sequence
  Description of Artificial Sequence: Synthetic coding sequence
atggtgacccatgctgctggggcccggaccttctgtgaggagcagaagaagggcagcacctacagcgtgcccaagagcaaggagaagctgatggagaagcacagccaggaggcccggcaggccgaccgggagagcgagaagcctgtggacagcctgcaccctggggccggcacagccaagcaccccccacctgctgccagcctggaggagaagccagatgtgaagcagaagagcagcaggaagaaggtggtggtgccccagatcatcatcacccgggccagcaatgagaccctggtgtcctgcagcagcagcggcagtgaccagcagaggaccatccgggagcctgaggactggggcccctaccgccgccacaggaaccccagcacagcagatgcctacaacagccacctgaaggagtag

SEQ ID NO: 36462 - DNA, 423 bp, Artificial Sequence
  Description of Artificial Sequence: Synthetic coding sequence
atgggcctgagcaagagcaaggagaagcccaggaagggggaggagcagaagaagggcagcacctacagcgtgcccaagagcaaggagaagctgatggagaagcacagccaggaggcccggcaggccgaccgggagagcgagaagcctgtggacagcctgcaccctggagctggaacagccaagcaccccccacctgctgccagcctggaggagaagccagatgtgaagcagaagagcagcaggaagaaggtggtggtgccccagatcatcatcacccgggccagcaatgagaccctggtgtcctgcagcagcagcggcagtgaccagcagaggaccatccgggagcctgaggactggggcccctacagaagacacaggaaccccagcacagcagatgcctacaacagccacctgaaggagtag

SEQ ID NO: 36463 - DNA, 1302 bp, Artificial Sequence
  Description of Artificial Sequence: Synthetic coding sequence
atgctgcctgctggctgcagccggcggctggtggccgagctgcagggcgccctggatgcctgtgcccagaggcagctgcagctggagcagagcctgcgggtgtgccggcggctgctgcacgcctgggagcccaccggcacccgggccctgaagcccccacctggccctgagaccaatggagaggaccccctgcctgcctgcacccccagcccccaggacctgaaggagctggagttcctgacccaggccctggagaaggctgtgcgggtgagaagaggcatcaccaaggccggggagcgggacaaggcccccagcctgaagagccgcagcatcgtgaccagcagcggcaccacagccagcgccccaccccacagccctggccaggccggcggccacgccagtgacacccggcccaccaagggcctgcggcagaccaccgtgcctgccaagggccaccctgagcggcggctgctgtctgtgggagatggcaccagggtgggcatgggcgcccggacccccaggcctggagctggcctgcgggaccagcagatggcccccagcgctgccccccaggcccctgaggccttcaccctgaaggagaagggccacctgctgcggctgcctgctgccttcaggaaggccgccagccagaacagcagcctgtgggcccagctgagcagcacccagaccagtgacagcacagatgctgctgctgccaagacccagttcctgcagaacatgcagacagccagcggcggcccccagccccggctgtctgctgtggaggtggaggccgaggccggccgcctgaggaaggcctgcagcctgctgcggctgaggatgagggaggagctgtctgctgcccccatggactggatgcaggagtaccgctgcctgctgaccctggagggcctgcaggccatggtgggccagtgcctgcaccggctgcaggagctgcgggctgctgtggccgagcagcccccccggccctgccctgtgggccggcccccaggggccagccccagctgtggcggccgggcagagcccgcctggagcccccagctgctggtgtacagcagcacccaggagctgcagaccctggccgccctgaagctgcgggtggccgtgctggaccagcagatccacctggagaaggtgctgatggccgagctgctgcccctggtgtctgctgcccagccccagggccccccctggctggccctgtgcagagctgtgcacagcctgctgtgtgagggcggggcccgggtgctgaccatcctgagagatgagcctgctgtgtag

SEQ ID NO: 36464 - DNA, 1119 bp, Artificial Sequence
  Description of Artificial Sequence: Synthetic coding sequence
atggccccagcccctcctcctgctgccagcttcagccccagcgaggtgcagaggcggctggccgccggggcctgctgggtgcggcggggggcccggctgtatgacctgagcagctttgtgcgccaccaccctggaggagagcagctgctgcgggcccgggccggccaggacatctctgctgacctggatggccccccccaccgccacagcgccaatgcccggcgctggctggagcagtactacgtgggggagctgcggggggagcagcagggctccatggagaatgaacctgtggccctggaggagacccagaagacagatcctgccatggagccccgcttcaaggtggtggactgggacaaggacctggtggactggaggaagcccctgctgtggcaggtgggccacctgggggagaagtatgatgagtgggtgcaccagcctgtgacccggcccatccgcctcttccacagcgacctgattgagggcctgagcaagacagtgtggtacagcgtgcccatcatctgggtgcccctggtgctgtacctgtcctggagctactaccgcacctttgcccagggcaatgtgcggctcttcaccagcttcaccacagagtacacagtggccgtgcccaagtccatgtttcctggcctcttcatgctgggcaccttcctgtggagcctgattgagtacctgatccaccgcttcctgttccacatgaagccacccagcgacagctactacctgatcatgctgcactttgtgatgcacggccagcaccacaaggccccctttgatggcagccggctggtgtttcctcctgtgcctgccagcctggtgattggagtcttctacctgtgcatgcagctgatcctgcctgaggccgtgggcggcaccgtgtttgctgggggcctgctgggctacgtgctgtatgacatgacccactactacctgcacttcggcagcccccacaagggcagctacctgtacagcctgaaggcccaccacgtgaagcaccactttgcccaccagaagagcggcttcggcatcagcaccaagctgtgggactactgcttccacaccctgaccccagagaagccccacctgaagacccagtag

SEQ ID NO: 36465 - DNA, 1317 bp, Artificial Sequence
  Description of Artificial Sequence: Synthetic coding sequence
atgctgctgtgcccagcccagaagacagtgttccggctgcagctgaccacagctgcccagtgcctgtgggtgtacctgcgggacaagcaggtggtggtgttcctggcctaccccacccgggcccctggcaggaacaacggggtgaccagcctgcactggccagaccccaccctgagcctgtcctggacccaggaggcctacacagagtacctgcggagcatccactacatcagccaggtgctgctggaggaggtggagaccaccaaggaggccggggagaccgtgcccccagacaccagcaagatgctgaagctggcccagcagtgcctggagcgggcccagagcacagctgccaagctgggcaagacccggctgaagcccaccatgcctgctgctgcccccatcccccagcctgctggccgccacagaagagtgtacagtgatgagggcggcaagctgagccccttcctgcccccagagatcttccagaagctgcagggcgctgagagccagagctgcaagaaggagctgacccccctggaggaggccagcctgcagaaccagaagctgaaggccgcctatgaggccaggatggcccggctggaccccagccaggccatgcagaagaccagcctgaccctgagcctgcagaggcagatgatggagaacctggtgattgccaaggcccgggaggagaccctgcagaggaagatggaggagcggcggctgcggctgcaggaggccgccaacagacgcttctgcagccaggtggccctgaccccagaggagcgggagcagagggccctgtatgctgccatcctggagtatgagcaggaccatgactggcccaagcactggaaggccaagctgaagaggaaccctggggacctgagcctggtgaccagcctggtgagccacctgctgagcctgcctgaccaccccatcgcccagctgctgcggcggctgcagtgcagcgtgtacagcgccctgtacccagctgtgtccagagctgctgccccagcccctggctgctgcccccccacccccaaccctggcagccggcggctgcggcccagccagagcctgcactgcatgctgagccccccagagcccagcgctgccccccggccccaggacagcccccccaccccacccctgcagcccggcccctggggcctgccccacccctggggcaccccccacctggactgccagaccaggacagcccggagcaggacctggagcagctcctggggccgcctgagcggccgggccggggctgtgggctacagccgcagccccagctgcagcagctag

SEQ ID NO: 36466 - DNA, 1896 bp, Artificial Sequence
  Description of Artificial Sequence: Synthetic coding sequence
atggctgctgctgctggagatggcaccgtgaagcccctgcagagcgccatgaagctggccaatggagccatcgagctggacaccggcaaccggccccgggaggcctacacagagtacctgcggagcatccactacatcagccaggtgctgctggaggaggtggagaccaccaaggaggccggggagaccgtgcccccagacaccagcaagatgctgaagctggcccagcagtgcctggagcgggcccagagcacagctgccaagctgggcaagacccggctgaagcccaccatgcctgctgctgcccccatcccccagcctgctggccgccaccggcgggtgtacagtgatgaaggaggcaagctgagccccttcctgcccccagagatcttccagaagctgcagggcgctgagagccagagctgcaagaaggagctgacccccctggaggaggccagcctgcagaaccagaagctgaaggccgcctatgaggccaggatggcccggctggaccccagccaggccatgcagaagaccagcctgaccctgagcctgcagaggcagatgatggagaacctggtgattgccaaggcccgggaggagaccctgcagaggaagatggaggagcggcggctgcggctgcaggaggccgccaacagacgcttctgcagccaggtggccctgaccccagaggagcgggagcagagggccctgtatgctgccatcctggagtatgagcaggaccatgactggcccaagcactggaaggccaagctgaagagaaatcctggggacctgagcctggtgaccagcctggtgagccacctgctgagcctgcctgaccaccccatcgcccagctgctgcggcggctgcagtgcagcgtgtacagcgccctgtacccagctgtgtccagagctgctgccccagcccctggctgctgcccccccacccccaaccctggcagccggcggctgcggcccagccagagcctgcactgcatgctgagccccccagagcccagcgctgccccccggccccaggacagcccccccaccccacccctgcagcccggccctgtgggcagccccagccccctgggggacacagccagcggcctgcctgacaaggacagcagctttgaggacctggagcagttcctgggcaccagcgagcggcagggccggggccggggcgtgcagcctgagccccagctgcagcagctgaagacagctgtggaggagatccacaatgctgtggaccggctgctgagcctgaccctgctggcctttgagggcctgaacacagctgccagcaaggaccgctgcctggcctgcatcgaggagcccttcttcagccccctgtggcccctgctgctggccctgtacagatctgtgcaccgggcccgggaggccgccctgagccgctccatggagctgtacagaaatgccccacccacagccatcggcatccccaccaagctgctgccccagaaccctgaggccaagggggccaccggctacccctactgtgccgccgcccaggagctgggcctgctggtgctggagagctgcccccagaagaagctggagtgcatcgtgaggaccctgcgcatcatctgtgtgtgtgccgaggactactgccccaccccagaggccaccccccaggccggccccccacccatcgctgctgctgccatcggggctgatgacctgctgcccatcctgagctttgtggtgctgcggagcggcctgccccagctggtgtctgaatgtgccgccctggaggagttcatccacgagggctacctgattggagaggagggctactgcctgaccagcctgcagagcgccctgtcctatgtggagctgctgccccggggcggcctggccaagtag

SEQ ID NO: 36467 - DNA, 1563 bp, Artificial Sequence
  Description of Artificial Sequence: Synthetic coding sequence
atggccagcaatgacaagggcatggcccccagcctgggcagcccctgggccagccagatgggcccctgggatgccatcctgaaggctgtgaaggaccagctgcccagcctggacagcgacagccccctgagtgactatggagaggaggagctgttcatcttccagaggaaccagaccagcctcatcccagacctgtctgaggagctggctgaagatcctgcagatggagacaagagccgggcctgggtggccgctgctgaggagagcctgcctgagcctgtgctggtgcctgctgagctggccacagagcccggctgccggcagaacaccaggaccaaggatgccagcagccaggagggccgggaccccggccggccctttgagagcagcggggaggtgtctgccctgctgggcatggccgaggagcccccacgctggctggagggggacctgggcagcctgtccttcaacaccaagggcagccagggccccccctgggacccccaggccgaggccaccctgagctgccatgaaggagaccccaaggccgagcccctgagcacagccagccaggagagcgtgaacagaagagccctgcggcaggagaggaggaagatgattgaaacagacatcctgcagaaggtgaccagagatgcctgtggccccaccagcagtgacaagggcggcgtgaaggaggccccctgccacgccgctgagagcgcccccaggagcaagatgcccctggtggagcccccagagggcccccctgtgctgagcctgcagcagctggaggcctgggacctggatgacatcctgcagagcctggccggccaggaggacaaccagggcaacagagcccctggcaccgtgtggtgggccgctgaccaccggcaggtgcaggacaggatggtgcccagcgcccacaaccggctgatggagcagctggccctgctgtgcaccacccagagcaaggccagcgcctgtgccaggaaggtgcctgctgacaccccccaggacaccaaggaggccgacagcggcagccgctgtgccagcaggaagcagggcagccaggccggccctggcccccagctggcccagggcatgaggctgaatgctgagagccccaccatcttcatcgacctgcggcagatggagctgcctgaccacctgagccctgagagcagcagccacagcagcagtgacagcgaggaggaggaggaggaggagatggccgccctgggagatgctgagggcgccagccccagcagcctgggcctgcggacctgcaccgggaagagccagctgctgcagcagctgcgggccttccagaagggcacagcccagcctgagctgcctgccagcaaaggacctgctgggggccgggcccaggcccctgaggacacagctggcagcaggactggaaggaagcagcacatgaagctgtgtgccaagggccagagcgcccaggcccggctgccccggggccggccccgggccctgggagatgtgcctgagcccggggccgcccgggaggccctgatgccacccctggagcagctgtag

SEQ ID NO: 36468 - DNA, 828 bp, Artificial Sequence
  Description of Artificial Sequence: Synthetic coding sequence
atgcccctggtggagcccccagagggcccccctgtgctgagcctgcagcagctggaggcctgggacctggatgacatcctgcagagcctggccggccaggaggacaaccagggcaacagagcccctggcaccgtgtggtgggccgctgaccaccggcaggtgcaggacaggatggtgcccagcgcccacaaccggctgatggagcagctggccctgctgtgcaccacccagagcaaggccagcgcctgtgccaggaaggtgcctgctgacaccccccaggacaccaaggaggccgacagcggcagccgctgtgccagcaggaagcagggcagccaggccggccctggcccccagctggcccagggcatgaggctgaatgctgagagccccaccatcttcatcgacctgcggcagatggagctgcctgaccacctgagccctgagagcagcagccacagcagcagtgacagcgaggaggaggaggaggaggagatggccgccctgggagatgctgagggcgccagccccagcagcctgggcctgcggacctgcaccgggaagagccagctgctgcagcagctgcgggccttccagaagggcacagcccagcctgagctgcctgccagcaagggccctgctgggggccgggcccaggcccctgaggacacagctggcagcaggacaggcaggaagcagcacatgaagctgtgtgccaagggccagagcgcccaggcccggctgccccggggccggccccgggccctgggagatgtgcctgagcctggagctgcccgggaggccctgatgccacccctggagcagctgtag

SEQ ID NO: 36469 - DNA, 828 bp, Artificial Sequence
  Description of Artificial Sequence: Synthetic coding sequence
atggaggagaggaaggaggagggggaggccgagatccaggagcacggccctgagcactggttcagcaagtgggagcggcagtgcctggccgaggccgagcaggatgagcagctgcccccagagctgcaggaggaggccgctgctgctgcccagcctgagcacaagcagcagaagctgtggcacctgttccagaacagcgccacagctgtggcccagctgtacaaggacagagtgtgccagcagcccggcctgagcctgtgggtgcccttccagaatgctgccacagctgtgaccaacctgtacaaggagagcgtggacacccaccagaggagctttgacatcggcatccagatcggctaccagaggaggaacaaggatgtgctggcctgggtgaagaagagaagaaggaccatcagaagagaagatctcatctccttcctgtgtgggaaggtgcccccaccaagaaacagccgggccccaccccggctgactgtggtgagccccaacagagccaccagcacagagaccagcagctctgtggagacagacctgcagcccttccgggaggccatcgccctgcacggcctgagcggggccatggccagcatctctgtgcgcagcagcaccccaggcagccccacccacgtgagcagcggcagcaatgccagcagaagaagaaatggcctgcatgatgtggacctgaacaccttcatcagcgaggagatggccctgcacctggacaatggaggcaccaggaagaggaccagcgcccagtgtggagatgtgatcacagacagccccacccacaagaggaacaggatgatctag

SEQ ID NO: 36470 - DNA, 798 bp, Artificial Sequence
  Description of Artificial Sequence: Synthetic coding sequence
atgtctgagcagcagatggacctgaaggacctgatgcccaccaagaggaagtacatgtggaagacagctgaggacaggaggatgtctgacctgacctgtgtgctggagtggctggagcggcggcagggcaagaagaagcaggcccctgagaagcagaagcccaaggtggtgacagtgctgaagaggaacaagaagaaggaggagaagaagggcaagggcctgatgacagcccggggcggcaacagaagagacacagagaccagccagcaggccctgggcaagcgcttcaggaaggatgctgccagctaccgcagcctgtatggagtggagcagaagggcaagcacctgtccatggtgcccggcagctacatcaaggatggccccaagaagagtgacacagacatcaaggatgctgtggaccctgagagcacccagaggcccaaccccttccggcggcagagcatcgtgctggaccccatgctgcaggagggcaccttcaacagccagagggccaccttcatccgggactggagcaacaagatgccagacatggcctatgaaaggaagctgaagagcctgatggagaagagcacagagcccaagatggagaccatgaggatgctgaagccagaggaggtgctgagctgccgctacctgcggctgagcaaggagaacatccgcaccctgctgaagctgtgcaaggatgctggcatgaatgtggacatccacccccacatggtggaggaggacattgatgccaagaaggtgttcaccggcatccccagcatggccctgtag

SEQ ID NO: 36471 - DNA, 687 bp, Artificial Sequence
  Description of Artificial Sequence: Synthetic coding sequence
atggagcccgccagctgctgtgccgagcggcccaagccaggccccaccggggtgaagaccaagcccagctgtggcggctggagggctgtgtccctgctgctgctgctgctgctgctggtgctggccgctgtgggcgtggtggccggcggcctgctgggcagcgcccagggcccccccaagccccggctgcagaccctgaggatgaccctgcccagcccccacatgccccggcccaaccagaccatcctggtggatgtggccagaaatgctgccaccatcaccgtgaccccaccccagagcaaccacagctgggccgtgctgtttgatggccagagcggctgcatctgctacagacctgaggagcaccaggtgtgcttcctgcggctgatggaggacagcgaccgggagaccctgcggctgctggtggacaccagcaaggtgcaggaggcctgggtgcccagccaggacacccaccacacccaggagctgctggccgtgcagggcagcctggaggtggaccctgcccaggccggggccctggtgcagaggctgtgcatgaggacccccatctactgggcccggcgggcagagggcccccggcggcagaggctcatctacctgtgcatcgacatctgcttccccagcaacatctgtgtgtctgtgtgcttctactacctgcctgactag

SEQ ID NO: 36472 - DNA, 582 bp, Artificial Sequence
  Description of Artificial Sequence: Synthetic coding sequence
atgttcaagaacaccttccagagcggcttcctgagcatcctgtacagcatcggcagcaagcccctgcagatctgggacaagaaggtgagaaatggccacatcaagaggatcacagacaatgacatccagagcctggtgctggagattgagggcaccaacgtgtccaccacctacatcacctgcccagctgaccccaagaagaccctgggcatcaagctgcccttcctggtgatgatcatcaagaacctgaagaagtacttcacctttgaggtgcaggtgctggatgacaagaatgtgagaagacgcttccgggccagcaactaccagagcaccaccagggtgaagcccttcatctgcaccatgcccatgaggctggatgatggctggaaccagatccagttcaacctgctggacttcacccggcgggcctacggcaccaactacatcgagaccctgcgggtgcagatccacgccaactgccgcatcagaagagtgtacttcagtgaccggctgtacagtgaagatgagctgcctgctgagttcaagctgtacctgcctgtgcagaacaaggccaagcagtag

SEQ ID NO: 36473 - DNA, 444 bp, Artificial Sequence
  Description of Artificial Sequence: Synthetic coding sequence
atgattgtgagccgctatggcctggtgggctgtgatgctggccaggtgcggcccaaggtggagctgagcctgcctgccttcctggccctgcccaagaaggagttcaaggacaagccagaggtggaggagaacaacctgattgaggaggccgtgtggcagaccagcctgaagatccccctgccccaggcccaggtgcgggagcggggcggcggcagcgctggcatctctgctgcccaccccagccagctgtgcacagctggggtgcggcccagcagcgccctgcgggccagcaggcctggctggagcctgcagacagctgccctgcaggagcccaccggggctgacagcttcctgcccaggagccacaagacagctgtggacctgcacagcgcccgcatccccctgtacatccacaccaagtgcctgctgatggagagcgtgtag

SEQ ID NO: 36474 - DNA, 954 bp, Artificial Sequence
  Description of Artificial Sequence: Synthetic coding sequence
atggccagcgctggagctgagcggcggcctggggtgcaggaggccaccgtggtgggccagggccagctgacagaggagcccggcagcgcccagaccagcgagtgccctgtggccggggaccagttcctggtgcctgcccacgaggcccggggcacccagagcgaggaccagaggcctgctggggccgccagcgagagcgagctgcaggaggagggccccaagctgggggaggagcggcccaagccccacgccggggccctggaggagcggggccccaggcctgtggtgtccatcgtgcggcccaggcatggccccaagaggaagcctgtgaagagcctgagcctgcccggcctgcgggcccacctgaaggccgaggccgagctgccccccaagctgcccctgcaggaggaggagcctgaggacagccagagcgagcccagccccagcgccaagcagcacaagaaggccaagaagaggaagagcctgggcgcccctgtgctgcatgctgtggcctccatggtgtctgcccccctggagaccctgcggctggagaggaaggcccagaggctgcggcccctgtaccagtatgtgaactactgcaaccctgagctgaaccaggccgggaaaggagatggagaggccgaggtggaggccgaggccgagctggcccctgtgcctgaggagggcggcgtggagcagctgcaggccctgctgcccctggccggggagctgggccctggcctggccctgccctgccccagccccctggtgacccccacccacgccctggcccccctgggggaggaggccggggaggagcccggcggcctgcccagcctgggcgtgtctgaccacaaggccgaggtggacaagagcacccaggtggacatcgacaagatgctgtctgtgtgcacagcccccctggtgccccccctgagcccccagtacaagtag

SEQ ID NO: 36475 - DNA, 465 bp, Artificial Sequence
  Description of Artificial Sequence: Synthetic coding sequence
atgtctgccacccgggccaagaaggtgaagatggccaccaagagctgcccagaatgtgaccagcaggtgcctgtggcctgcaagagctgcccctgtggctacatcttcatcagcaggaagctgctgaatgccaagcacagcgagaagagcccccccagcacagagaacaagcatgaggccaagagaagaagaacagagcgggtgagaagagagaagatcaacagcacagtgaacaaggacctggagaacaggaagaggagccgcagcaacagccacagcgaccacatcagaagaggccggggccggcccaagagcgccagcgccaagaagcatgaggaggagcgggagaagcaggagaaggagattgacatctatgccaacctgagtgatgagaaggcctttgtgttttctgtggccctggccgagatcaacaggaagatcatcaaccagaggctcatcctgtag

SEQ ID NO: 36476 - DNA, 282 bp, Artificial Sequence
  Description of Artificial Sequence: Synthetic coding sequence
atgtctgccacccgggccaagaaggtgaagatggccaccaagagctgcccagaatgtgaccagcaggtgcctgtggcctgcaagagctgcccctgtggctacatcttcatcagcaggaagctgctgaatgccaagcacagcgagaagagcccccccagcacagagaagcaggagaaggagattgacatctatgccaacctgagtgatgagaaggcctttgtgttttctgtggccctggccgagatcaacaggaagatcatcaaccagaggctcatcctgtag

SEQ ID NO: 36477 - DNA, 576 bp, Artificial Sequence
  Description of Artificial Sequence: Synthetic coding sequence
tgagagcagggccctgctgcccccaagtcctggctgctgctgcccaccaccctggccctgcacggcagcctggatgctgtgtcccaggcccagggccggcccggccacccagatgccccacccaacatctatgagggcggcctgggcagcccccagccccagtgccccagcgcccagggcagcaagcccaagaacttccggctgcggcacctgcggggcctgggcctgtacctggagagccaccccccacccaccggccagtgtgagagccactggctgggccgcctgatggccggcggctgcctgccccagcctgagggcacagcctgggccctggacctgccccagggcaccctgggccccaggaacagcctgtgcagcgccctgctggaggcccggctgccccgggacagcctgggcagcagcgccagcagcagctccatggaccctgacaagggggccctgccccagcccagccccagccggctgcggcccaagaggtcctggggcacctgggaggaggccatgtgccccctgtgcaagaggaccaggtctggggccctggagcggccctag

SEQ ID NO: 36478 - DNA, 996 bp, Artificial Sequence
  Description of Artificial Sequence: Synthetic coding sequence
atgctgaacaggaagaccagccacttcctgggcatgagggtgcagagcgagctggagcacctgtctgagctgcggcgggaggccggcaaggacaggagctctgtgcacggcagcgctgcccggacccgggcctctgtgaggacccagtggaccacagctgctgctgccaaggcagatgaggaccccggggccaacctcttccccccacccctgccccggccccgcatctgcatgtggaagtacctggatgtgcacagcatgcaccagctggagaagaccaccaatgctgagatgagggaggtgctggccgagctgctggagctgggctgcccagagcagagcctgagagatgccatcaccctggacctcttctgccacgccctgatcttctgccggcagcagggcttcagcctggagcagaccagcgctgcctgtgccctgctgcaggacctgcacaaggcctgcatcgccacccccctgggcaatgtggaggagtgctaccgctacttcacctctgtgctcttctgccacggcgtgcggcggccccccttcagcattgacctcttcaaggaggagcagctgctggccctggaggactatgtggtgaacacctacttccgccacttcaagctgtacaagtatgtgttcaccccccaggtgcggctggacctgagcctgacctacatgggcctgcagccccccaagctgtggccagagagcgagacagagaaggaggagagcaaggagatggaggagcaggccgtgaccccccagaaggaggagctggagaccgtggcccctcctgagcctgagcccagccacatccacgtgctgcgggcctacatcaagacccaggtgaacaaggagctggagcagctgcagggcctggtggaggagcggctgaaggccagcgaggagcggctgagcagcaagctgacagccctggagcggcccttccagctgcccccaggcaagggcaagagcaagaccaagtag

SEQ ID NO: 36479 - DNA, 534 bp, Artificial Sequence
  Description of Artificial Sequence: Synthetic coding sequence
atgctgaacaggaagaccagccacttcctgggcatgagggtgcagagcgagctggagcacctgtctgagctgcggcgggaggccggcaaggacaggagctctgtgcacggcagcgctgcccggacccgggcctctgtgaggacccagtggaccacagctgctgctgccaaggcagatgaggaccccggggccaacctcttccccccacccctgccccggccccgcatctgcatgtggaagtacctggatgtgcacagcatgcaccagctggagaagaccaccaatgctgagatgagggaggtgctggccgagctgctggagctgggctgcccagagcagagcctgagagatgccatcaccctggacctcttctgccacgccctgatcttctgccggcagcagggcttcagcctggagcagaccagcgctgcctgtgccctgctgcaggacctgcacaaggcctgcatcggggagcggggccagctgcccggcctgagcccccgggagaagaggaacagagcctggcacaagtag

SEQ ID NO: 36480 - DNA, 720 bp, Artificial Sequence
  Description of Artificial Sequence: Synthetic coding sequence
atgagggccagccgcagcccccccagcccccggcgctgccaccaccaccacgaggccaccggggccgccagcggggctgctgctgggggccctggagctggctgtgtgggcctgtgccgcctggccctgacccccagcgcccaggatggaagaaacagcaccttccagacctacaagaaggaggtgtgcctgcccaggcacagcatgcaccctggcccctgggccatctgctgtgagtgccagaccaggtttggaggccgcctgcctgtgtcccgggtggaggccgccctgccctactgggtgcccctgagcctgcggcccaggaagcagagccagaagacagtgcagttccccatcccccagacagccaagatgtgcccctgcctgtgccacagatttggaggccgcctgcccatgccccgggaccaggccgtgatgccctactgggtgccccaggtgctgcggagccagcagcagatcgtgcggcggcagcagagcctgaagggcatccaggcccccctgctggatgcctgctgctggcacaactgctggaggatctgtggagatgagtgcctgctgagcaagttccagcagctgcaggccccctaccaggaccagctgcctgccccagctgcccggctgctgcccctgggcctgctgaccctgctgcaggccatccccagggtcatcatggccatccggcagtgctttggagtgtag

SEQ ID NO: 36481 - DNA, 3426 bp, Artificial Sequence
  Description of Artificial Sequence: Synthetic coding sequence
atgtccttcagcctgaccttcacagagctggccaacatcgccatcccccagtgtggggtgctgaacttcaaggccctgcacctgctgctgcacggcatcctggagcacatccacatggccgagctgaagaaggtgctgtctggagatgaggacttcctgcagaccagccaggtggtgatcatgccccgggagggagatgcccagcccatcctgaaccccatgaagaggctgagcaatgtgtttgaccacgtggtgtcccggctggacaagctggagaaccagctggccctgctgcaggacctgcccagcacagcccagctgctggaggccagccagggcacagcccggcctgtgcaggacctgtggcacctgatcaagctgaggaagatggtggagggccatgatgaggtgatggccaagtccatgcagaccctgcaggacctgctgacagacctgcacgccctgcaggtgaccatcacagccctgaggaaggaggtggacatgctgaagaacatgctggacaaggtgcaccctgagaggatggacatctttgctgaggacttcaagatccagaactggaagatggtggccctgcagcgggaggtggccagcctgcagaacaagttcaagaccatccccaagacagaggacatggtgctgtggagcggcctgcatgatgccatgttcaccagcgagatcggcagcagccccctggacctgtggcagagcgtggagcagctgcctgaggccgccctggcccagaccaccaagtacctggaggccacccgggccatccaggtgtctgagcctgtgcagaacccccagctgctgcagacagtgtggcactatgaggtgcctgagctgctgcctgagggcagcagcgcccaggccgtgtccctgagccgggcccaggagcccgcccagcccccagccctgaccccagagagcgcccctggctgcaccacagaatttgcccctggccctgcccctggaacagagcctgtgcccggcctggagctgggcctggagctggagcctgtgcctgccctgggccctgtgcccggccccagcgtgaccccaggcagcctgcctgccccctggcctgtgctgggccctgtgcctgcccctggggcccagcccccacccctgggggactggccagccctgccccggcgctggcccctgccccagggctggccccgggtgggctcctggcccctgtgggacctgggcgtgctgcggcccacccagccccagcccagccgggcccctcctccagccacagaatttggcagcctgtggccccggcccctgcagccctaccagagccggcagggcgaggccctgcagctggccgctgtgcaggtgaagggggaggagaatgatgtgcccagcctgcggggcctgcgggagcgggccaggaaggatggagcccccaaggacaggaccaggaaggatggagtgcccaaggacagaggaggcaaggatgtggaccccaaggaccgggcccacaaggatgatgtgcccaaggacagaggaggcaaggatgtggaccccaaggaccgggcccacaaggatgatgtgcccaaggacagaggaggcaaggatggagaccccaaggacagagtgggcaaggatggagcccccaaggaggcccagcccaaggccccccagagcgccctgcaccggctgaagaccacagctgccatcgctgctgctgctgctgctgcctatgctgctgccaccagcagcgctgcccaggccgccaaggtggccgccaagtttgtgaaggatgccccagccaccaagatggccgccatcgccacagacacagctgctgctggccccctgggcgtgtttgctgatgtgctgggcgccggccccagcagaggagccacagagagccagatcctgggagatgacagcgagatctatgagatcctgagccccagctacagcgctgccagcattggaccagaccctgccctgagccaggccatggtggccaccaagcaggccatgagccctgaggacaagaagagagctgtgaagtacagcatgagccacatcgcccagatccctgtgaagcatgacagcctgaaggaggagtttgcccagctgagctgcaacctgaaccagaggctgagctacctggccaacatgggcggccccagcagcctgggcaccaccgtggacatcctgcagaagaagattggcagcctgcagaagagccggctgaaggaggaggagctggagcgcatctggggcaaccagatcgagatgatgaaggaccgctacatcaccctggacaaggctgtggagaacctgcagatccgcatggatgagttcaagaccctgcaggcccagatcaagaggctggagatgaacaaggtgaacaagagcaccatggaggaggagctgcgggagaaggctgacagaagtgccctggccggcaaggccagccgggtggacctggagaccgtggccctggagctgaatgagatgatccagggcatcctcttcaaggtgaccatccatgaagattcctggaagaaggccatggaggagctgagcaaggatgtgaacaccaagctggtgcacagcgacctggaccccctgaagaaggagatggaggaggtgtggaagatcgtgaggaagctgctgattgagggcctgcggctggaccctgacagcgctgctggcttccggaggaagctgttcaagagggtgaagtgcatcagctgtgacaggcctgtggagatgatgacaggcccccagctgatcaccatcaggaaggcccacctgctgagccggctgcggcctgccagcgccaacagctgtgagtacctgcagaggcagcagatgagggagcagcagtggctgcagctgcaggacctgggcatccaggaggactgccagcaggactggggagatggcccccagaatgccaccagcctgaagtgcaagagctgcaacctgctgaccctgtacccctatggagacccccacgtgattgattatgattctgctgaggtggacatcctgggcgtggatggcatcctgtacaagggccgggtgaacagccagagaggagcccagcccctggccgtggccaaggagctggccgctgtgaaggcccccagcccccccagccagagcctgtatgacagagtgcacagcagcgccctgtttggagccatctgcccccccctgtgccccaggagcagcgcctgcagcgctgccagcggcccccacctgaccatgcctgcccggccccccagcctgccccccctgctgctgctgcccccactcatccccagcctgcgggacccccagcaggcccctggcagcacccggctgagccgggccccccacatcgagagccgggtgggcaggaagcccccagaggagcccgccaacccctag

SEQ ID NO: 36482 - DNA, 495 bp, Artificial Sequence
  Description of Artificial Sequence: Synthetic coding sequence
atggccagcgcccggggggccaagcagagcagcccccgggtgggcaccacccgctacacagagaccagcacagtgcgggtggagaccagcagccaccgggtggagaccagcagcagaagagtggagaccagccagaggagaagtgagggccccagcctgagccccagcggcaagaggctgccccgcatcctggaggccagcagccgccacgtggagagcagcagccagaggacagagaccaccagccgccacgtgcgggccagcagcctgcgggtggagaccagcctgcactgtgccgagagccccaccccccggcccagccggcccccagcccggaccaagaagaggccagatgagatgctgctgcccaagggccaccagggcgcccgggccctgagccaggacaggaaggccagcagctgccagcctgccagccagctgcccggcggccccatcatcttcggcttcatggagaccaaccacaagtccatgtag

SEQ ID NO: 36483 - DNA, 504 bp, Artificial Sequence
  Description of Artificial Sequence: Synthetic coding sequence
atgtttgacttctccttccccaccccagccagcgctggcaccaggatgggccctgccagctgtggcggccgcagcctgcacctgccccagctgcgcttcagccgggtggatgccacagctgtgacagatgtgcccttccagaggatgcacgccccccaccgggcccctgaggtgttctgcagccgcagcagcagaggagctggccggggccaccccacccccaccccccgggtgcgctgggccctggccggcaaccagccccgctgctgtgcccagctgctgagcggccggggcggcagcggggcccagctgcgggccggctgggtgagaggagctgctgtgggcaacctcttcatcctgctgctgggcaaggaggatggagaggaggagggcaccgtgctgagctacagctccatggtgcacatcagcaacatcaccggcatcgtgggcaccaccgtgtccaggaccaagccagccctggtgctgatggagctgaccttctag

SEQ ID NO: 36484 - DNA, 339 bp, Artificial Sequence
  Description of Artificial Sequence: Synthetic coding sequence
atggcccacagcgctgctgctgtgcccctgggcgccctggagcagtgccccatccgggtggagcatgacagaagaagacggcagttcaccgtgcggctgaatggctgccacgacagagctgtgctgctgtatgaatatgtgggcaagagaattgtggacctgcagcacacagaggtgcctgatgcctaccggggccggggcatcgccaagcacctggccaaggccgccctggactttgtggtggaggaggacctgaaggcccacctgacctgctggtacatccagaagtatgtgaaggagaaccccctgccccagtacctggagcggctgcagccctag

SEQ ID NO: 36485 - DNA, 2478 bp, Artificial Sequence
  Description of Artificial Sequence: Synthetic coding sequence
atggaggtgcggcggggggacacctgcccccggccccaccccagcggcctgcgggaggagggcctggagcccaaggtggccttccctggaggagccaaccgctgctggaacctgggcgcagatgctggcagccggctgacagatgtgtttggatctgtgatgctgaccggcagcgccagcttctatgactgctacaccagccagagcgaggacaacgtggacctgcggcagacctacacccccttcagcagcacagagtacagcagctctgtggacagcagcctcttctgtgccccctggagcacctatggagatgacatcaagcagcccagcaacagccagatcagcatcaagaaccgcatccagacagaaagaaatgactatggcagcgagacagacctgtatggcctggtgagcaacatcctggaggagcaggacaagagccagccctactttgctgagggcacctgcagcagcaacctgaagtctgtgtggcccatgaacaccagcagatttgctgaccaccacgacctgctgacagagaccaagaggcccatcgacaccgtcatcagccagcaggccttctacagtgatgagagcgtgtctgccatggagaagcagtacctgaggaacagcaacctgaccccccagcagaagattgatgagctgcaccacggcttcaccggcctggacctggaggagcagtggatgtaccccagcagaagtgaccacagcaactgccacaacatccagaccaatgacacagccaagaccaccttccaggagtaccccctcatcaagaactgcttcaccccccagacaggcctgagtgacatcatgaaggagagcggcgtggacatctaccactacggccgggaccgcatctgcaccaagggcctggaggcccccctgcagcagaagagagctgagatgttcctgagccagttcaaccgctacaatgaaaatgtggactactgccgctacccagaatatgtgcaccccaacaaggccaagctgaacaagtgcagcaacttctctgtgcaggacagcaagaagctggccaacggcaccccagagacccccaccgtggaggccgacacctacaccaagctgttccaggtgaagccagccaaccagaagaagatggaggagaccatcccagaccagcagaacttcaccttccccaagaccaccccccacctgacagagaagcagtttgccaaggaggccgtgttcaccgctgactttggcctgaccagtgaatatggcctgaagccccacacagcctgcccagccaatgactttgccaacgtgacagagaagcagcagtttgccaagccagaccccccccacagcgagtacttcaagtctgtgaacctgctgagcaacagcgccaccagcagcggcggcatcaacctgaaccggcccacctggatgaatgtgcagaccaagaacaacacccccatcccctacagaaaccagggcaacctgatgaagctgaacagccacctgtctgctgccagcaagggcagcaaccacagcagtgacttcccccagctgagcagcaccaacctgacccccaacagcaacctcttccagaagtactgccaggagaaccccagcgccttcagcagctttgacttctcctacagcggggctgagcgcatccagagcgtgaaccacatcgagggcctgaccaagccaggagaagaaaatctcttcaagctggtgacagacaagaagatcaagcagcccaacggcttctgtgacaactacagcgcccagaagtatggcatcattgaaaatgtgaacaagcacaacttccaggccaagccccagagcggccactatgaccctgaggagggccccaagcacctggatggcctgagccagaacacctaccaggacctgctggagagccagggccacagcaacagccacaggacccggggcggggacaacagccgggtgaacagaacccaggtgtcctgcttcagcaacaactacatgatgggagacctgcggcacaaccagtgcttccagcagctgggcagcaatggcttccccctgcggagcacccaccccttcggccacagcgtggtgcccctgctggacagctatgacctgctgtcctatgatgacctgagccacctgtacccctacttcaacatgatgtacggggacaacagcttcagcggcctgatgcccaccttcggcttccagaggcccatcaagaccaggagcggccctgccagcgagctgcacatccggctggaggagtgctgtgagcagtggagggccctggagaaggagaggaagaagacagagctggccctggccaagaactacccaggcaagaaggtgagcagcaccaacaacacccctgtgccccggctgaccagcaaccccagccgggtggacaggctcatcgtggatgagctgcgggagctggcccgggtgtcctgcaagaacagatag

SEQ ID NO: 36486 - DNA, 2859 bp, Artificial Sequence
  Description of Artificial Sequence: Synthetic coding sequence
atggaggtgcggcggggggacacctgcccccggccccaccccagcggcctgcgggaggagggcctggagcccaaggtggccttccctggaggagccaaccgctgctggaacctgggcgcagatgctggcagccggctgacagatgtgtttggatctgtgatgctgaccggcagcgccagcttctatgactgctacaccagccagagcgaggacaacgtggacctgcggcagacctacacccccttcagcagcacagagtacagcagctctgtggacagcagcctcttctgtgccccctggagcacctatggagatgacatcaagcagcccagcaacagccagatcagcatcaagaaccgcatccagacagaaagaaatgactatggcagcgagacagacctgtatggcctggtgagcaacatcctggaggagcaggacaagagccagccctactttgctgagggcacctgcagcagcaacctgaagtctgtgtggcccatgaacaccagcagatttgctgaccaccacgacctgctgacagagaccaagaggcccatcgacaccgtcatcagccagcaggccttctacagtgatgagagcgtgtctgccatggagaagcagtacctgaggaacagcaacctgaccccccagcagaagattgatgagctgcaccacggcttcaccggcctggacctggaggagcagtggatgtaccccagcagaagtgaccacagcaactgccacaacatccagaccaatgacacagccaagaccaccttccaggagtaccccctcatcaagaactgcttcaccccccagacaggcctgagtgacatcatgaaggagagcggcgtggacatctaccactacggccgggaccgcatctgcaccaagggcctggaggcccccctgcagcagaagagagctgagatgttcctgagccagttcaaccgctacaatgaaaatgtggactactgccgctacccagaatatgtgcaccccaacaaggccaagctgaacaagtgcagcaacttctctgtgcaggacagcaagaagctggccaacggcaccccagagacccccaccgtggaggccgacacctacaccaagctgttccaggtgaagccagccaaccagaagaagatggaggagaccatcccagaccagcagaacttcaccttccccaagaccaccccccacctgacagagaagcagtttgccaaggaggccgtgttcaccgctgactttggcctgaccagtgaatatggcctgaagccccacacagcctgcccagccaatgactttgccaacgtgacagagaagcagcagtttgccaagccagaccccccccacagcgagtacttcaagtctgtgaacctgctgagcaacagcgccaccagcagcggcggcatcaacctgaaccggcccacctggatgaatgtgcagaccaagaacaacacccccatcccctacagaaaccagggcaacctgatgaagctgaacagccacctgtctgctgccagcaagggcagcaaccacagcagtgacttcccccagctgagcagcaccaacctgacccccaacagcaacctcttccagaagtactgccaggagaaccccagcgccttcagcagctttgacttctcctacagcggggctgagcgcatccagagcgtgaaccacatcgagggcctgaccaagccaggagaagaaaatctcttcaagctggtgacagacaagaagatcaagcagcccaacggcttctgtgacaactacagcgcccagaagtatggcatcattgaaaatgtgaacaagcacaacttccaggccaagccccagagcggccactatgaccctgaggagggccccaagcacctggatggcctgagccagaacacctaccaggacctgctggagagccagggccacagcaacagccacaggacccggggcggggacaacagccgggtgaacagaacccaggtgtcctgcttcagcaacaactacatgatgggagacctgcggcacaaccagtgcttccagcagctgggcagcaatggcttccccctgcggagcacccaccccttcggccacagcgtggtgcccctgctggacagctatgacctgctgtcctatgatgacctgagccacctgtacccctacttcaacatgatgtacggggacaacagcttcagcggcctgatgcccaccttcggcttccagaggcccatcaagaccaggagcggccctgccagcgagctgcacatccggctggaggagtgctgtgagcagtggagggccctggagaaggagaggaagaagacagagctggccctggccaagaactacccaggcaagaaggtgagcagcaccaacaacacccctgtgccccggctgaccagcaaccccagccgggtggacaggctcatcgtggatgagctgcgggagctggcccgggtggtgaccctgctgggcaagatggagcggctgcggagcagcctgctgcacgccagcatcagcacagccctggacagacacctggagagcatccacatcgtgcagagcaggaggaaggatgaaattgtgaatgccagcaaccggcagaggcagggcgtgccccgctgccaggatgacagagatgtgtttgccctggccagcgccatcaaggagatgtgtgtggccaccaggaagaccaggacagccctgtggtgtgccctgcagatgaccctgcccaagacagccagcacagcagatgtggtgaagcccctgcaggacacagtgaactgtgaggacaaggtgcatgagagcatcaacagcagcaaccccatgaaccagagaggagagaccaacaagcactag

SEQ ID NO: 36487 - DNA, 1980 bp, Artificial Sequence
  Description of Artificial Sequence: Synthetic coding sequence
atgaacaccagcagatttgctgaccaccacgacctgctgacagagaccaagaggcccatcgacaccgtcatcagccagcaggccttctacagtgatgagagcgtgtctgccatggagaagcagtacctgaggaacagcaacctgaccccccagcagaagattgatgagctgcaccacggcttcaccggcctggacctggaggagcagtggatgtaccccagcagaagtgaccacagcaactgccacaacatccagaccaatgacacagccaagaccaccttccaggagtaccccctcatcaagaactgcttcaccccccagacaggcctgagtgacatcatgaaggagagcggcgtggacatctaccactacggccgggaccgcatctgcaccaagggcctggaggcccccctgcagcagaagagagctgagatgttcctgagccagttcaaccgctacaatgaaaatgtggactactgccgctacccagaatatgtgcaccccaacaaggccaagctgaacaagtgcagcaacttctctgtgcaggacagcaagaagctggccaacggcaccccagagacccccaccgtggaggccgacacctacaccaagctgttccaggtgaagccagccaaccagaagaagatggaggagaccatcccagaccagcagaacttcaccttccccaagaccaccccccacctgacagagaagcagtttgccaaggaggccgtgttcaccgctgactttggcctgaccagtgaatatggcctgaagccccacacagcctgcccagccaatgactttgccaacgtgacagagaagcagcagtttgccaagccagaccccccccacagcgagtacttcaagtctgtgaacctgctgagcaacagcgccaccagcagcggcggcatcaacctgaaccggcccacctggatgaatgtgcagaccaagaacaacacccccatcccctacagaaaccagggcaacctgatgaagctgaacagccacctgtctgctgccagcaagggcagcaaccacagcagtgacttcccccagctgagcagcaccaacctgacccccaacagcaacctcttccagaagtactgccaggagaaccccagcgccttcagcagctttgacttctcctacagcggggctgagcgcatccagagcgtgaaccacatcgagggcctgaccaagccaggagaagaaaatctcttcaagctggtgacagacaagaagatcaagcagcccaacggcttctgtgacaactacagcgcccagaagtatggcatcattgaaaatgtgaacaagcacaacttccaggccaagccccagagcggccactatgaccctgaggagggccccaagcacctggatggcctgagccagaacacctaccaggacctgctggagagccagggccacagcaacagccacaggacccggggcggggacaacagccgggtgaacagaacccaggtgtcctgcttcagcaacaactacatgatgggagacctgcggcacaaccagtgcttccagcagctgggcagcaatggcttccccctgcggagcacccaccccttcggccacagcgtggtgcccctgctggacagctatgacctgctgtcctatgatgacctgagccacctgtacccctacttcaacatgatgtacggggacaacagcttcagcggcctgatgcccaccttcggcttccagaggcccatcaagaccaggagcggccctgccagcgagctgcacatccggctggaggagtgctgtgagcagtggagggccctggagaaggagaggaagaagacagagctggccctggccaagaactacccaggcaagaaggtgagcagcaccaacaacacccctgtgccccggctgaccagcaaccccagccgggtggacaggctcatcgtggatgagctgcgggagctggcccgggtgtcctgcaagaacagatag

SEQ ID NO: 36488 - DNA, 492 bp, Artificial Sequence
  Description of Artificial Sequence: Synthetic coding sequence
atgaacaccagcagatttgctgaccaccacgacctgctgacagagaccaagaggcccatcgacaccgtcatcagccagcaggccttctacagtgatgagagcgtgtctgccatggagaagcagtacctgaggaacagcaacctgaccccccagcagaagattgatgagctgcaccacggcttcaccggcctggacctggaggagcagtggatgtaccccagcagaagtgaccacagcaactgccacaacatccagaccaatgacacagccaagaccaccttccaggagtaccccctcatcaagaactgcttcaccccccagacaggcctgagtgacatcatgaaggagagcggcgtggacatctaccactacggccgggaccgcatctgcaccaagggcctggaggcccccctgcagcagaagagagctgagatgttcctgagccagttcaaccgctacaatgaaaatgtggactactgccgctacccctag

SEQ ID NO: 36489 - DNA, 390 bp, Artificial Sequence
  Description of Artificial Sequence: Synthetic coding sequence
atgaacaccagcagatttgctgaccaccacgacctgctgacagagaccaagaggcccatcgacaccgtcatcagccagcaggccttctacagtgatgagagcgtgtctgccatggagaagcagtacctgaggaacagcaacctgaccccccagcagaagattgatgagctgcaccacggcttcaccggcctggacctggaggagcagtggatgtaccccagcagaagtgaccacagcaactgccacaacatccagaccaatgacacagccaagaccaccttccaggagtaccccctcatcaagaactgcttcaccccccagacaggcctgagtgacatcatgaaggagagcggcgtggacatctaccactacggccgggaccgcatctag

SEQ ID NO: 36490 - DNA, 495 bp, Artificial Sequence
  Description of Artificial Sequence: Synthetic coding sequence
atgaacaacagcctggactacctggcctaccctgtgattgtgagcaaccaccggcagagcaccaccttcaggaagaagctggactttggccactacgtgagccacaagaaccgcatccagatcgccaagcccaccgtggacaccaagccccctgtggcccacaccaaccacatcctgaagctgagcaagctgcagggcgagcagaagaagatcaacaagattgaatatgagaacaagcagctgtgccagaagatcgccaatgcccaccggggccctgccaaggtggactgctggaatgagtacttcagcaagagcctgaaccgggagaccaggaaccgggagctggtgcgcatcaccatggagaaccagggcatcctgaagaggctggtggacaggaagccccactatgaccggcgggccagcgagattgactggcagaacagccgccgctacatccggaacaccacccgctacctgctgagccagaatgaatag

SEQ ID NO: 36491 - DNA, 573 bp, Artificial Sequence
  Description of Artificial Sequence: Synthetic coding sequence
atgaagggcacccccagcagcctggacaccctgatgtggatctaccacttccacagcagcacagaggtggccctgcagccccccctgctgagcagcctggagctgtctgtggccgccgcccacgagtacctggagcagcgcttccgggagctgaagagcctggagcccccagagcccaagatgcagggcatgctgcctgcccccaagcccaccctgggcctggtgctgcgggaggccacagccagcctggtgtcctttggcaccaccctgctggagatcagcgccctgtggctgcagcaggaggcccggcggctggatggcagcgctggccctgccccagatggccgggaccccggggccgccctgagccgggtggcccaggccgccggccagggcgtgcggcaggccggggctgctgtgggcgccagcgcccggctgctggtgcagggcgcctggctgtgcctgtgtggccggggcctgcagggcagcgccagcttcctgcggcagagccagcagcagctgggcctgggcatccctggagagcctgtgagcagcggccatggagtgtcctag

SEQ ID NO: 36492 - DNA, 237 bp, Artificial Sequence
  Description of Artificial Sequence: Synthetic coding sequence
atggcccccctgcctggagctgagctggtgagaagacccctgcagctgtaccgctacctgctgcgctgctgccagcagctgcccaccaagggcatccagcagcactacaagcatgctgtgcggcagagcttccgggtgcacagtgatgaggacaaccctgagcgcatccagcagatcatcaagagggccattgaagatgctgactggatcatgaacaagtacaagaagcagaactag

SEQ ID NO: 36493 - DNA, 189 bp, Artificial Sequence
  Description of Artificial Sequence: Synthetic coding sequence
atggaccagctggtgttcaaggagaccatctggaatgatgccttctggcagaacccctgggaccagggcggcctggccgtcatcatcctcttcatcacagctgtgctgctgctgatcctgtttgccatcgtgtttggcctgctgaccagcacagagaacacccagtgtgaggccggggaggaggagtag

SEQ ID NO: 36494 - DNA, 903 bp, Artificial Sequence
  Description of Artificial Sequence: Synthetic coding sequence
atgtgtgcccggggccaggtgggccggggcacccagctgaggacaggccggccctgcagccaggtgcccggcagccgctggaggcctgagcggctgctgcggcggcagagagctgggggccggcccagccggccccacccagcccgggcccggcccggcctgagcctgcctgccaccctgctgggcagcagagctgctgctgctgtgcccctgcccctgcccccagccctggcccctggggaccctgccatgcctgtgaggacagaatgtcctcctcctgctggggccagcgctgccagcgctgccagcctcatccccccaccacccatcaacacccagcagcccggggtggccaccagcctgctgtacagcggcagcaagttccggggccaccagaagagcaaaggaaacagctatgatgtggaggtggtgctgcagcacgtggacaccggcaacagctacctgtgtggctacctgaagatcaagggcctgacagaggagtaccccaccctgaccaccttctttgaaggagagatcatcagcaagaagcaccccttcctgaccaggaagtgggatgctgatgaagatgtggacaggaagcactggggcaagttcctggccttctaccagtatgccaagagcttcaacagtgatgactttgattatgaggagctgaagaatggagactatgtgttcatgcgctggaaggagcagttcctggtgcctgaccacaccatcaaggacatcagcggggccagctttgctggcttctactacatctgcttccagaagtctgctgccagcattgagggctactactaccacaggagcagcgagtggtaccagagcctgaacctgacccacgtgcctgagcacagcgcccccatctatgagttcagatag

SEQ ID NO: 36495 - DNA, 681 bp, Artificial Sequence
  Description of Artificial Sequence: Synthetic coding sequence
atgcctgtgaggacagagtgccccccacctgctggggccagcgctgccagcgctgccagcctcatccccccaccacccatcaacacccagcagcccggggtggccaccagcctgctgtacagcggcagcaagttccggggccaccagaagagcaagggcaacagctatgatgtggaggtggtgctgcagcacgtggacaccggcaacagctacctgtgtggctacctgaagatcaagggcctgacagaggagtaccccaccctgaccaccttctttgaaggagagatcatcagcaagaagcaccccttcctgaccaggaagtgggatgctgatgaagatgtggacaggaagcactggaacatcggccgctacctggacctgcagaccctgctggactggacagagaccttctgggtgcgggaggagctgcggcggccccccctggtgctggcctgtgaggtgtggctgagccagggcgctgagcccatggagtgcttcctgctgcagcagtttgtggccgcctttgtggtgctgagcatcagccccaacttccaccacagctggaggaccccccgcttcccccggggcacccctggggccctgtactgcacctgggtgtgcctgcgcttcaccatgagcaacaccctgcacctgggctgccacttcttcatcatcaactag

SEQ ID NO: 36496 - DNA, 1155 bp, Artificial Sequence
  Description of Artificial Sequence: Synthetic coding sequence
atgggcgtgactggagcccacggcttcccctgctgcggcaagggctctgtggaggtggccgagatgagagatgacctgagccagcaccagatccaggaggagcaggagctggaggccgacatgctggagcagaagccccagctgcaggtggacctggacctggaccctgaccctgaccctgaccctgagctggagatcggccaggtgcctgccctgctggagagcgagctgtacccagccctgaagctggaggccgagctggacacagaggccaacagcaatgaggagagtgactttgaggagcccatgcagctggtgtgcaagattgaatctgtgcacagcaacatgggcctgcccaccccccagaccttccggccctggagcctgaacagcaactgccgctccttcacagaagaaaatcatgtgtctgcctgccaccacagcatcagcgcccagaccagcaagcacctgttctgggccaacaagctgatccaggccagcgagcacagcctgcagagggccatcaacatgcagctgaacaatggatctgctggccagcccatccgcagccccctgcgggaggccatccccaccaatgccctgtgcagcgaggagcagctgcagatcccagatgcccacagcgccccacccaccaccagcagccaggcccccagccccctgctgagcagtgacctgcccccacccatcgacctgacagagctgatcacctttgccagcagcctggccatggccagcagcagcaggatggacctgcccagcctggagcacatgatgaaggccccaccccaggaggccctggagcccagcacagagcccctgctgaccaccgtggaggagcgggagcctgagaaccacgccgagaccctgcctgagaagccccgggaggcccgggcccccctgaagtcctggagccaggaggacaagaactttgcccagagctactttgacttcagcaagccaggcatcaagagggccaccatcaagggccagatccagctgctgcagcccccagccaccagccccctgctgcagggcagcaaagaagattctgtgcccccaggcaaggagaaggagaaccccctgctggtgaagatccacttcaagctgagcgcccccaccatccctgagaagtag

SEQ ID NO: 36497 - DNA, 1092 bp, Artificial Sequence
  Description of Artificial Sequence: Synthetic coding sequence
atgagagatgacctgagccagcaccagatccaggaggagcaggagctggaggccgacatgctggagcagaagccccagctgcaggtggacctggacctggaccctgaccctgaccctgaccctgagctggagatcggccaggtgcctgccctgctggagagcgagctgtacccagccctgaagctggaggccgagctggacacagaggccaacagcaatgaggagagtgactttgaggagcccatgcagctggtgtgcaagattgagagcgtgcacagcaacatgggcctgcccaccccccagaccttccggccctggagcctgaacagcaactgccgctccttcacagaggagaaccacgtgtctgcctgccaccacagcatcagcgcccagaccagcaagcacctgttctgggccaacaagctgatccaggccagcgagcacagcctgcagagggccatcaacatgcagctgaacaacggcagcgctggccagcccatccgcagccccctgcgggaggccatccccaccaatgccctgtgcagcgaggagcagctgcagatcccagatgcccacagcgccccacccaccaccagcagccaggcccccagccccctgctgagcagtgacctgcccccacccatcgacctgacagagctgatcacctttgccagcagcctggccatggccagcagcagcaggatggacctgcccagcctggagcacatgatgaaggccccaccccaggaggccctggagcccagcacagagcccctgctgaccaccgtggaggagcgggagccagaaaatcatgctgagaccctgcctgagaagccccgggaggcccgggcccccctgaagtcctggagccaggaggacaagaactttgcccagagctactttgacttcagcaagccaggcatcaagagggccaccatcaagggccagatccagctgctgcagcccccagccaccagccccctgctgcagggcagcaaggaggacagcgtgcccccaggcaaggagaaggagaaccccctgctggtgaagatccacttcaagctgagcgcccccaccatccctgagaagtag

SEQ ID NO: 36498 - DNA, 1713 bp, Artificial Sequence
  Description of Artificial Sequence: Synthetic coding sequence
atggtgaagaccaacaagccaggggccaaggtggccgtgtctgcccagaggggcagcgaggtgaccaccaacaccagcccccagcagggccacggctacgtgctggccagcagccacaggtctgctgctgtgtccctgaaccccagccacagaagaagtgaagctgcccaccccaccaccccccacagcgccagtgactaccccaggtctgtgtccctgcagagcggccctggccactatgctgtgcccaccccccggggccctgagaccggccccaggacagagagcagccgccacagcagcccccacctgaagagccagaagacccagaccctggccagccacgccagcagccggcagtggaaggtgtccccaccccgggaggaggccgcccggcggggcagcgagagcaagagcggccgggaggtgggccaccacgccagcagcatcccagatgccaagagcacccaccagctgtccttccaggaccagaagaacaacctgcagagccagatcctggaggatgatcctcccagcaaggtgcagaacccccagggcgtgcgggtgccccggcgcatcctgagctaccccaaggatgaagctgtgcagacagagcccatccagaggatcaccaccaccagcgagatccgcagccccaggagccccagcctgctggagcacggcagcagctgtgtgtctgctgactaccagacagcccagaggagagtgcctgtggaggagagcgagaccggcccctacggccccatccccagcaagcccaaggccctgtacagaaacatgaacctggacagcctgctgaagctgtctgtgctgaaggacagtgatggagtgcaccgggtgtctgcccgggtggaccctgagagcctgcacaagtacagcgcctacccagagaccaagcccagcgccaaggtgctggtgagcagccaggtggagagcaatgtgaggacccccatccggggcaacagcgaggtgggcagaagagtgaccatcagccctggggtgcagagcgtggagcccacccaccacgtgacagtgcccagcgtgtctgagggcagccacaagagctccatgtttgtgaccccagagcccatctacaagcagcagacccagaagcccccagagatcacctacatgagccagggccccaccccccgctacccagagctgagccagaagcccagcatccacgccgagctggagctgaccccccggcccctgccccccaggagcctgcccaggtatggccctgacagctcctggtggcccctgctgaaccctgaggtggagaccccccagagccagctgaccaccccagactttgagcccaagtgcagccccagcctggacctgctgctgagcggcttcaagattgacagcagccccttctgtgaggacctgaagttccagcgggagaaggccagcctgagcccccccagcccccccaaggagttccccagctgggcccccctgtctgaggtgccccagacccccaagcacacctgcaagcagcccatccagcgcttcaccgccttcttcctggatgtgtctgaggagatgtacaacagagtcatctggtggctgaagggcctgtgcttcagcctgctgtgggcccactgcggcagcctgggagatggccgcactggagaggagtggcacctgtgcatctacagagctggcagcttcagaagatag

SEQ ID NO: 36499 - DNA, 1029 bp, Artificial Sequence
  Description of Artificial Sequence: Synthetic coding sequence
atggatgacaagcccaaccctgaggccctgagtgacagcagcgagcggctcttctcctttggagtgattgctgatgtgcagtttgctgacctggaggatggcttcaacttccagggcacccggcggcgctactaccgccacagcctgctgcacctgcagggcgccatcgaggactggaacaatgaaagctccatgccctgctgcgtgctgcagctgggggacatcattgatggctacaatgcccagtacaatgccagcaagaagagcctggagctggtgatggacatgttcaagaggctgaaggtgcctgtgcaccacacctggggcaaccacgagttctacaacttcagccgggagtacctgacccacagcaagctgaacaccaagttcctggaggaccagatcgtgcaccaccctgagaccatgcccagcgaggactactatgcctaccactttgtgcccttccccaagttccgcttcatcctgctggatgcctatgacctgtctgtgctgggcgtggaccagagcagccccaagtatgagcagtgcatgaagatcctgcgggagcacaaccccaacacagagctgaacagcccccagggcctgtctgagccccagtttgtgcagttcaatggaggcttcagccaggagcagctgaactggctgaatgaggtgctgaccttcagtgacaccaaccaggagaaggtggtgattgtgagccacctgcccatctacccagatgccagtgacaacgtgtgcctggcctggaactacagagatgccctggccgtcatctggagccatgaatgtgtggtgtgcttctttgctggccacacccatgatggcggctacagcgaggacccctttggagtgtaccacgtgaacctggagggcgtcatcgagacagccccagacagccaggcctttggaacagtgcacgtgtacccagacaagatgatgctgaagggccggggccgggtgcctgaccgcatcatgaactacaagaaggagcgggccttccactgctag

SEQ ID NO: 36500 - DNA, 525 bp, Artificial Sequence
  Description of Artificial Sequence: Synthetic coding sequence
atggacaagcacggcgtgaagacccccctgtggaagaaggagacagaggagctgcgggcagaagatgctgagcaggaggagggcaaggagggctctgaagatgaagatgaggacaaccagaggcccctggaggacagcgccacagaaggagaggagcccccccgggtggccgaggagggggagggccgggagaggagatctgtgtcctactgccccctgcggcaggagagcagcacccagcaggtggccctgctgcggcgggctgacagcggcttctggggctggctgggccccctggccctgctgggcggcctgacagcccccacagacaggaagaggagcctgcctgaggagccctgtgtgctggagatcagaagaagaccaccccggcggggcggctgtgcctgctgtgagctgctcttctgcaagaagtgccgcagcctgcacagccacccagcctacgtggcccactgtgtgctggaccacccagacctgggcaaggccggggctgctggcaacagctag

SEQ ID NO: 36501 - DNA, 666 bp, Artificial Sequence
  Description of Artificial Sequence: Synthetic coding sequence
atgggagagaagagcaggaggaagggccctgcccccaggcatgctgatggcaagctgggccgcacctgtgaccacccctatgccccctggagcttcacccccagcagccgggcccccacagcctgggtgcggcccccctgccctgtgtgggccagccggctgcaggagcacagccctgagccccggcgggcccgggccccacccacccggcgggcccaggccgccctgtatgccccagccctgcggctgcgggaccacctggaccgcttcagcatcctgatgaccagctgcacctcctggctgcaggccccccaggcccctggcctgtgcagagatgagcagagcagccgcatctctgtgccccagctgagcggggcccccatcctgctgcctgacctggagggcaccaagctgagcaacttccaggagagcagccccctgccccacaagcatgagaggaaggacaagaggagcaccccagaggaggagggccgcagcgcccctgagaagatcatccagagcctgaagctgtgccctgggggccacaggcctgccagcctgagcagcggctgcccagctggctgccgcctgtccttcaacctgccccccagcatgctgctgtctgtgcagaagtgctgcatgcccagcagcctgaagacctgctag

SEQ ID NO: 36502 - DNA, 1566 bp, Artificial Sequence
  Description of Artificial Sequence: Synthetic coding sequence
atggcctgcagcctgcagaagctgtttgctgtggaggaggagtttgaagatgaggacttcctgtctgctgtggaggatgctgagaaccgcttcaccggcagcctgcctgtgaatgccggccgcctgcggcctgtgagcagccggccccaggagaccgtgcaggcccagagcagccggctgctgctgctgcaccccacagcccccagcgaggccctgggcctgcctgacctggacctgtgcctgcctgccagcagcacccccagcgctgacagccggcccagctgcatcggggccgcccccctgcggcctgtgtccaccagcagctcctggattggcaaccagaggagagtgacagtgacagaggtgctgcgggagacagcccggccccagagcagcgccctgcaccccctgctgacctttgagagccagcagcagcaggtgggcggctttgagggccctgagcaggatgaatttgacaaggtgctggcctccatggagctggaggagcccggcatggagctggagtgtggggtgagcagcgaggccatccccatcctgcctgcccagcagcgggagggctctgtgctggccaagaaggcccgggtggtggacctgagcggcagctgccagaagggccctgtgcctgccatccacaaggccggcatcatgtctgcccaggatgagagcctggaccccgtcatccagtgcaggacccccaggcctcccctgcggcctggagctgtgggccacctgcctgtgcccacagccctgactgtgcccacccagcagctgcactgggaggtgtgcccccagaggagccctgtgcaggccctgcagcccctgcaggccgcccggggcaccatccagagcagcccccagaaccgcttcccctgccagcccttccagagccccagctcctggctgagcggcaaggcccacctgccccggcccaggacccccaacagcagctgcagcacccccagcaggaccagcagcggcctcttcccccgcatccccctgcagccccaggcccctgtgagcagcatcggcagccctgtgggcacccccaagggcccccagggcgccctgcagacccccatcgtgaccaaccacctggtgcagctggtgacagctgccagcaggaccccccagcagcccacccaccccagcacccgggccaagacccggcgcttccctggccctgctggcatcctgccccaccaggccgccctgaagcagctgcccaggaacaaggtgcccaacatggctgtgatgatcaagagcctgaccaggagcaccatggatgcctctgtggtgttcaaggaccccaccggggagatgcagggcaccgtgcaccggctgctgctggagacctgccagaatgagctgaagccaggctctgtgctgctgctgaagcagatcggggtcttcagccccagcctgaggaaccactacctgaatgtgacccccaacaacctggtgcacatctacagcccagattctggagatggcagcttcctgaagcccagccagcccttccccaagatgacctggatggacagctag

SEQ ID NO: 36503 - DNA, 414 bp, Artificial Sequence
  Description of Artificial Sequence: Synthetic coding sequence
atggcctgcagcctgcagaagctgtttgctgtggaggaggagtttgaagatgaggacttcctgtctgctgtggaggatgctgagaaccgcttcaccggcagcctgcctgtgaatgccggccgcctgcggcctgtgagcagccggccccaggagaccgtgcaggcccagagcagccggctgctgctgctgcaccccacagcccccagcgaggccctgggcctgcctgacctggacctgtgcctgcctgccagcagcacccccagcgctgacagccggcccagctgcatcggggccgcccccctgcggcctgtgtccaccagcaactgcctgaacagcagccacagcgccacccccctgggcagcctgagcgccaccctgccctgcagcagcaccagcgccagccccagctgctag

SEQ ID NO: 36504 - DNA, 1944 bp, Artificial Sequence
  Description of Artificial Sequence: Synthetic coding sequence
atggcctgcagcctgcagaagctgtttgctgtggaggaggagtttgaagatgaggacttcctgtctgctgtggaggatgctgagaaccgcttcaccggcagcctgcctgtgaatgccggccgcctgcggcctgtgagcagccggccccaggagaccgtgcaggcccagagcagccggctgctgctgctgcaccccacagcccccagcgaggccctgggcctgcctgacctggacctgtgcctgcctgccagcagcacccccagcgctgacagccggcccagctgcatcggggccgcccccctgcggcctgtgtccaccagcagctcctggattggcaaccagaggagagtgacagtgacagaggtgctgcgggagacagcccggccccagagcagcgccctgcaccccctgctgacctttgagagccagcagcagcaggtgggcggctttgagggccctgagcaggatgaatttgacaaggtgctggcctccatggagctggaggagcccggcatggagctggagtgtggggtgagcagcgaggccatccccatcctgcctgcccagcagcgggagggctctgtgctggccaagaaggcccgggtggtggacctgagcggcagctgccagaagggccctgtgcctgccatccacaaggccggcatcatgtctgcccaggatgagagcctggaccccgtcatccagtgcaggacccccaggcctcccctgcggcctggagctgtgggccacctgcctgtgcccacagccctgactgtgcccacccagcagctgcactgggaggtgtgcccccagaggagccctgtgcaggccctgcagcccctgcaggccgcccggggcaccatccagagcagcccccagaaccgcttcccctgccagcccttccagagccccagctcctggctgagcggcaaggcccacctgccccggcccaggacccccaacagcagctgcagcacccccagcaggaccagcagcggcctcttcccccgcatccccctgcagccccaggcccctgtgagcagcatcggcagccctgtgggcacccccaagggcccccagggcgccctgcagacccccatcgtgaccaaccacctggtgcagctggtgacagctgccagcaggaccccccagcagcccacccaccccagcacccgggccaagacccggcgcttccctggccctgctggcatcctgccccaccagcagagcggccgcagcctggaggacatcatggtgtctgccccccagacccccacccatggagccctggccaagttccagacagaaattgtggccagcagccaggcctctgtggaggaggactttggccggggcccctggctgaccatgaagagcaccctgggcctggatgagcgggaccccagctgcttcctgtgcacctacagcatcgtgatggtgctgaggaagcaggccgccctgaagcagctgcccaggaacaaggtgcccaacatggctgtgatgatcaagagcctgaccaggagcaccatggatgcctctgtggtgttcaaggaccccaccggggagatgcagggcaccgtgcaccggctgctgctggagacctgccagaatgagctgaagccaggctctgtgctgctgctgaagcagatcggggtcttcagccccagcctgaggaaccactacctgaatgtgacccccaacaacctggtgcacatctacagcccagattctggagatggcagcttcctgaagcccagccagcccttccccaaggacagcggcagcttccagcatgatgtggccgccaagccagaggagggcttcagaacagcccagaacctggaggccgaggccagccctgaggaggagctgcctgaggctgatgacctggatggcctgctgtctgagctgcctgaggacttcttctgtggcaccagcagctag

SEQ ID NO: 36505 - DNA, 2922 bp, Artificial Sequence
  Description of Artificial Sequence: Synthetic coding sequence
atggagaccaaggtgcacctgttctgccaggccgaggagaacatcgacctgctggatgatggcagcaacagctttgccacagacctgagcagcggcaccatcaaccacaagaagtacatcaagttcagcaagaccatcgagaaggagatcagccctgagatccgcagcctgagccctgagtacaagaagatctttgagaccagcatcatcttctgtggggaggagaagagcagtgacttctctggagagaagaaggtgggcaggaagagcctgcaggtgcagcagcacagcaagaggacagagatcatcccccccttcctgaagctgagcaaggagaaggtgaccaggaaggagaacagcctgtgcaagctgcccaaccagtacagcgtgcacaagaccagcagccccctgtgcaccagcagcgccatcacccgggagaaggagatgctgagcaacctgtacatgaccctgtatgatgaggtgacccacggctacctgcacagcaaggagctgagcgccctgcacaaggcctgcaagatcttcagcaagatccgcagcggcaagatctacgtgaatgacctgcctgtgatcctgtgcatcctgcgcatcagcatcagtgacctggagatgaggcaggccctgaagacagtggacattgatgccttccaggatgccctgaagatcttctgccgcatcaagggcggccgggtgtccacagatgatgtgtttgctgtgctggacagcatgggcatccccatcaaccgggagatcctggaggaggtgaccaagcacacctacatcgacagcaaccacatggtggacattggagacatcatcttcaccctgaatgagctgcaggagcagtatgaagatgtgtccatcacagagggcagccccctgaatgagatcaccagtgacaggaagctgagctctgtggccggctgctacctgaagtacaagaagaagaacagcctgagcagcaagctgcctgagcccagcatcagcaagaagctgaacaagaagagcaaccagtactacagcaagatcatggagaatgatgacctggagagcaagaggcccaagaacacctggcagatcaggaagttcctgggcggcgtgggcagcagcaatgtgggcgtgcaggagccctacagcaagaatggcatcaacttcaagaagcacagcgagaagggggagatccatgacagcaagagcaagccccagagcctgaagagcagcaccagcctgagcaagagcctggacaagagtgacatcagcagcatccccaagctgcagaagccagctgtgaggaagcacagcagcctgcagaagcaggtgagcagcacagagaagacagccatcagcaccctggagaacttctgtgaggccatcagcaagctgcaggagaactacatcgctgctgaggagctgcagagcatcctgcccagcacaggcatcaacctgctggatgaggagttccagaagatcgtgacagacaccagcagaaatgaaaatggcatggtggagctggatgactttgtgaatgccctggccaaggagaggagcttcccagaatgtaatgccctgcccggggtcatcaaggccatcgacaagatcaaggacaagaatgtggactatgaggacctgaacacctgcctgcagaactttggcatctacctgagcaagccagagttcaagaagatcacagagctgacagaggccggggagaccaagaaggtgaacttcaaggagttcatcgacaccatgatgagcaacacagagtgcttcagcgagaagctggtgctgcctgatgccatcgagaccctggatgacctgaggaaggagaccatgtctgtgtctgacctgtggaacaccctgagcagcctgaacagcaacctgaagaaggatgagttcctggccgccctggagctggtgacagtggatgaaggagacaaggtgcagtttgaggagtttgccaaggtggtgaggaacatgagagatgctgcccggctggaggagctgcaggaggtggtgctggccgctgacctgctggagggggacatgattgctgggaagaacctggaggacttcctgagaaatgtgggcatcaagagccccaaggaggaggtggagaagatcctgcagagcgactttgtgtctgaggacaacatggtgaacatcaaggactgcatgagggccctgcgggacacccagaagttcagcaactacatcgacttcaggaaggaggccagcaacctgaagctgcccaaggtgaatgagatcaaggaggccgccaacatcctgagccacgtggacaatggcaagattggcatcccagacctggagcacgccctgaagtgcctgaatgtgaacctgacagaggaggacttcaatgaggccctgaactgctgcaatgtgtctgacaacatggaggtggacctgaaggacttcctgatgaagatgaaggagagcccccacttccagaagagcaaggccacccagatcctgctggccaccacccagatcctgcagaatgacctggtggatgtgtctgacctgaagaccctgctgatggacaaggacctgcacacagccaatgccatcctgactgtgatgctgcggcacgtgcctgagcatgaaagtggcaaggtgtccatccaggagttcatgaccaagctgagtgacatcctgaccatccccaaggctgctgggaagttctacctgatctgcacctactgcccagacctggagcggcaggccgtggtgtacatgctgaagaccatccaggacagcatcgtgaaggcccaggtgtccaagaagcagtacaacatgaacatcaagcagcacaagatcagcctgcacaacttctgcctgaacagcaaggccaacatcgccaagctgaaccccaacagcaagttctag

SEQ ID NO: 36506 - DNA, 1596 bp, Artificial Sequence
  Description of Artificial Sequence: Synthetic coding sequence
atggagaccaaggtgcacctgttctgccaggccgaggagaacatcgacctgctggatgatggcagcaacagctttgccacagacctgagcagcggcaccatcaaccacaagaagtacatcaagttcagcaagaccatcgagaaggagatcagccctgagatccgcagcctgagccctgagtacaagaagatctttgagaccagcatcatcttctgtggggaggagaagagcagtgacttctctggagagaagaaggtgggcaggaagagcctgcaggtgcagcagcacagcaagaggacagagatcatcccccccttcctgaagctgagcaaggagaaggtgaccaggaaggagaacagcctgtgcaagctgcccaaccagtacagcgtgcacaagaccagcagccccctgtgcaccagcagcgccatcacccgggagaaggagatgctgagcaacctgtacatgaccctgtatgatgaggtgacccacggctacctgcacagcaaggagctgagcgccttccaggatgccctgaagatcttctgccgcatcaagggcggccgggtgtccacagatgatgtgtttgctgtgctggacagcatgggcatccccatcaaccgggagatcctggaggaggtgaccaagcacacctacatcgacagcaaccacatggtggacattggagacatcatcttcaccctgaatgagctgcaggagcagtatgaagatgtgtccatcacagagggcagccccctgaatgagatcaccagtgacaggaagctgagctctgtggccggctgctacctgaagtacaagaagaagaacagcctgagcagcaagctgcctgagcccagcatcagcaagaagctgaacaagaagagcaaccagtactacagcaagatcatggagaatgatgacctggagagcaagaggcccaagaacacctggcagatcaggaagttcctgggcggcgtgggcagcagcaatgtgggcgtgcaggagccctacagcaagaatggcatcaacttcaagaagcacagcgagaagggggagatccatgacagcaagagcaagccccagagcctgaagagcagcaccagcctgagcaagagcctggacaagagtgacatcagcagcatccccaagctgcagaagccagctgtgaggaagcacagcagcctgcagaagcaggtgagcagcacagagaagacagccatcagcaccctggagaacttctgtgaggccatcagcaagctgcaggagaactacatcgctgctgaggagctgcagagcatcctgcccagcacaggcatcaacctgctggatgaggagttccagaagatcgtgacagacaccagcagaaatgaaaatggcatggtggagctggatgactttgtgaatgccctggccaaggagaggagcttcccagaatgtaatgccctgcccggggtcatcaaggccatcgacaagatcaaggacaagaatgtggactatgaggacctgaacacctgcctgcagaactttggcatctacctgagcaagccagagttcaagaagatcacagagctgacagaggccggggagaccaagaagtag

SEQ ID NO: 36507 - DNA, 162 bp, Artificial Sequence
  Description of Artificial Sequence: Synthetic coding sequence
atggagaccaaggtgcacctgttctgccaggccgaggagaacatcgacctgctggatgatggcagcaacagctttgccacagacctgagcagcggcaccatcaaccacaagaagtacatcaagttcagcaagaccatcgagaaggagatcagccctgagtag

SEQ ID NO: 36508 - DNA, 114 bp, Artificial Sequence
  Description of Artificial Sequence: Synthetic coding sequence
atggagaccaaggtgcacctgttctgccaggccgaggagaacatcgacctgctggatgatggcagcaacagctttgccacagacctgagcagcggcaccatcaaccacaagtag

SEQ ID NO: 36509 - DNA, 228 bp, Artificial Sequence
  Description of Artificial Sequence: Synthetic coding sequence
atgaaccggctgtacctgaccccagatggcttcttcttccgggtgcacatgctggccctggacagcagcagctgcaacaagccctgcccagagttcaagccaggcatcgagacagacctgaatgatgctgcctacgtgctgtacaccaccgtgtgcaatgtgggcgccacagcccgggctgtgggccggcctgccttcttctgggagcgctgggagaccatgacctag

SEQ ID NO: 36510 - DNA, 294 bp, Artificial Sequence
  Description of Artificial Sequence: Synthetic coding sequence
atgaaccggctgtacctgaccccagatggcttcttcttccgggtgcacatgctggccctggacagcagcagctgcaacaagccctgcccagagttcaagccaggcagccgctacatcgtgatgggccacatctaccacaagaggcggcagctgcccacagccctgctgcaggtgctgcggggccgcctgcggcctggagatggcctgctgcggagcagcagcagctatgtgaagcgcttcaacaggaagcgggagggccagatccagggcgccatccacacccagtgcatctag

SEQ ID NO: 36511 - DNA, 228 bp, Artificial Sequence; identical to SEQ ID NO: 36509
  Description of Artificial Sequence: Synthetic coding sequence

SEQ ID NO: 36512 - DNA, 228 bp, Artificial Sequence; identical to SEQ ID NO: 36509
  Description of Artificial Sequence: Synthetic coding sequence

SEQ ID NO: 36513 - DNA, 1689 bp, Artificial Sequence
  Description of Artificial Sequence: Synthetic coding sequence
atgctggcctgcctgcccggccctggggacctgtccttccagctgctgagccacacccagatgaacacaggcctgcagaagtgggacaccacccagaagatgaggacagcccactaccccaccccagctgagctggatgcctatgccaagaaggtggccaacaaccccctgaccatcaagatcttccccaacagcgtgaaggtgccccagaggaagcacgtgagaagaacagtgaatggcctggacaccagcgcccagcgctacagcccctaccccacccaggccgccaccaaggccggcctgctggccatcgtgaaggtgcctgccaagagcatcctgaaggactttgatggcacccgggcccggctgctgcctgaggccatcatgaacccccctgtggccccctatgccaccgtggcccccagcaccctggcccacccccaggcccaggccctggcccggcagcaggccctgcagcacgcccagaccctggcccacgccccaccccagaccctgcagcacccccagggcatccccccaccccaggccctgagccacccccagagcctgcagcagccccagggcctgggccacccccagcccatggcccagacccagggcctggtgcacccccaggccctggcccaccagggcctgcagcacccccacaaccccctgctgcacggcggcaggaagatgccagacagtgatgcccccccaaatgtgacagtgtccaccagcaccatccccctgtccatggccgccaccctgcagcacagccagcccccagacctgagcagcatcgtgcaccagatcaaccagttctgccagacccgggccggcatcagcaccacctctgtgtgtgagggccagatcgccaaccccagccccatcagccgcagcctgctgatcaatgccagcaccagggtgtccacccacagcgtgcccacccccatgcccagctgtgtggtgaaccccatggagcacacccacgccgccacagctgccctgcctgctgctggccctgtgaacctgcccaccggcatcagccgggtgcccaccggctaccccagcgacctgaagcctgtgacctggaaccagcaccagctggcccacctgcagcagatgtgcagcgaggccagcggcaccccagcccctggcctgaccgggaagcatgctgctggccgggagctggccggccctggctttgtgggcaaggccccagcctacccccaggagctgtgcctggcccagagcttccacctgaagccacccctggagaagcccacccccagcccccctgtgaatggcatggccgcccccctggcctaccccaacggccactacttccagcccctgtggaacaacatcctgcccacccccaacagcgacagcagcggcagccaggacctggccatgcccttccacggcggccagcccactggagcccccctggactgtgccgccgcccctggggcccactacagagctggcactggaggcggccctgtggccagccagaacagcctgatgcagacagtggactacctgagcggggacttccagcaggcctgcttccgggagcagagcctggccatgctgagcaaggcccaccgggcccctggcaacagagccccagaccccacagagagccgcagcctgcacatccagcaccctggctacagatag

SEQ ID NO: 36514 - DNA, 1689 bp, Artificial Sequence; identical to SEQ ID NO: 36513
  Description of Artificial Sequence: Synthetic coding sequence

SEQ ID NO: 36515 - DNA, 711 bp, Artificial Sequence
  Description of Artificial Sequence: Synthetic coding sequence
atggaggccagtgatggccagggcggggagggggacaagcccctggagcaggtgaccaacgtgtcctgcctggagaccagcagcagcgccagccctgcccgggacagcctgatgagacatgccaagggcctggaccaggacaccttcaagacctgcaaggagtacctgcggcccctgaagaagttcctgaggaagctgcacctgccccgggacctgccccagaagaagaagctgaagtacatgaagcagagcctggtggtgctgggggaccacatcaacaccttcctgcagcactactgccaggcctgggagatcaagcactggaggaagatgctgtggaggttcatcagcctcttcagcgagctggaggccaagcagctgcggcggctgtacaagtacaccaagagcagccagcctgccaagttcctggtgaccttctgtgccagtgatgcccctgagaggagcctgctggccgaccgggaggacagcctgcccaagctgtgccacgcctggggcctgcacagcaacatcagcggcatgaaggagcggctgagcaacatgcagaccccaggccagggcagccccctgcccggccagcccaggagccaggaccacgtgaagaaggacagcctgcgggagctgagccagaagcccaagctgaagaggaagaggatcaaggaggcccctgagaccccagagacagagccctag

SEQ ID NO: 36516 - DNA, 582 bp, Artificial Sequence
  Description of Artificial Sequence: Synthetic coding sequence
atgagcggcccccccagcgccccccagggcgccctggccgcccccaggagccctgctgtgcggaggaagggcctgcaggcccccagctggggcagccctggccggcctgctgcccacagcccctgggcctgtggccccccccactggggcccccagaggggccccagaaatgctgctgctgcccggcccggccccaggagccgctggcacaagagatgtgccgccgcctgtggggcctgtgcccggcccccaggccaccagctgcagcccccaggagctggggccccccagcccggggtggcctgcagctacctgggcccccggccccagaggaccccctgcagcgcccagagccggcccggctggtgtgccggccccaggagaagacatgcccctggaacagagccccacgtggcccctggccgggcccccccaccccgggccggggccagccctggcagccggctgctgcccggcagccccagcctgctgctgcctgctgccacctggaggacctggggccaggagagcaaggtgctgaggaagatcctgaaggcctgggaccccttcagcctgctgtag

SEQ ID NO: 36517 - DNA, 1713 bp, Artificial Sequence
  Description of Artificial Sequence: Synthetic coding sequence
atggcctatgagaagagcacagacatcagtgatgtgagccgctccatgttcctgtacccctggctggagtacccagacaagaccaaggagctgaggaaggccatggcccctgtgcacctgcccctgagctgctaccagatgcccaaggaggagttcccccccagccctgagtgctggaggcagcaccccagcaagcccaacagcgtgccctactgctacttcaagaagccagagatctacacccactggcatgacctgtatgaccagcgggaggagcgggaggccgagaagatgctgaggaagatgagagatgactgccgctacatcaaggaggtgcaccagacccacatcaagatgttccacctgcccatgagcaagctgaccatcaagtctgagatgaggagccggcccctggagcccacccaggaccccctgaagtggcagaggctgcgggagctgaccaagagcctggagagcccccgggaggatgagcagttctacgccgcccaggccctgggctgcctgcgcatcagtgacaagtttgtgatggaggccctgcagcaggtggcccagacaggccctgagaaggtgaagtatgaggcctaccgcaccctggccatcctgggctgcctgaacaagcacgtgatccgggccctgatcaagcagctgaaggagaagaatgaaggccagaggatggagaccctgaccggcctgaggatggccctgaacagctgggccgctgtgtccaaggacaagaggacccaggtgggagatgagggcaagctggtgcctgtgctgcagaccctcatcaagaagagcagcagcgaggccagcctggaggccgccctgtgcctgggcttcctgcggccctgcagcaacatggtgcaggagttcctgctgcagtgcctgtgccagggcctgaagacccagaggatgaaggccctgaggatgctggtgaaggtgatgcacgtgcacagcgcccctgtgatcaaggccatcctggaccagctgtgcagcagctctgtgctggaggacagatttgaggccacccagatgctgaagaccatcggcctggagcagatccaggcccagggcctggaggagctgaccttcaacctgctgcggaggaagacccacaatgagcccttcctggccgtgcggcaggccgtggcccagacagtggaggagctgaagctgaagcccaccatgatgaacctggtggaggcccagctgatgaacccagatgccacagcccggcaggaggccgtcatcagcctgggcgtgctgggcatccgcagcccccaggtgttccacctgctgctggacctgctggatgctgagaaccaccaggccgtgaagaagagcctgcaggagaccctcatcctgtgtgccagcattgacccctggatccagaacaagctgaagaacaaggtgctgtctgtgtatgaggcccccaagaccaacgtgaaggccgagcccacccgcttccagaaggagccagaaaatcctgaggagctgaccatccaggacttccggctggccaagctgaaccccctcttcatcgccaagagcatcaccaaggtgggccagaagaagaccccagccttccccccctgctgcagcaagcccaggaagcaccggccccaggtgattggcccctggcagccccgcatcaagaagcagctgcgggtgctggccgagatcgccaagtag

SEQ ID NO: 36518 - DNA, 1422 bp, Artificial Sequence
  Description of Artificial Sequence: Synthetic coding sequence
atgctgcccggccctgccctgcggggccctggccctgcccagtaccagaggcctggcatgagccctggcaacaggatgcccatggccctggccggcggcaccccctgctggctgcccatctggtgcagcagcagcgccagcacctggcacgccacccaccatgatggcagcatccccaagaccccagcctgtgccccccagccccccatgcctgcccagaggcggggcctgaagaggaggaagatggctgacaaggtgctgccccagaggatccgggagctggtgcctgagagccaggcctacatggacctgctggcctttgagaggaagctggaccagaccatcgccaggaagaggatggagatccaggaggccatcaagaagcccctgacccagaagaggaagctgcgcatctacatcagcaacaccttcagccccagcaaggccgagggggacagcgctggaacagctggcacccctgggggcaccccagctggggacaaggtggcctcctgggagctgcgggtggagggcaagctgctggatgaccccagcaagcagaagaggaagttcagcagcttcttcaagagcctggtgattgagctggacaaggagctgtatggccctgacaaccacctggtggagtggcacaggatgcccaccacccaggagacagatggcttccaggtgaagaggcctggggacctgaatgtgaagtgcaccctgctgctgatgctggaccaccagcccccccagtacaagctggacccccggctggcccggctgctgggcgtgcacacccagaccagggctgccatcatgcaggccctgtggctgtacatcaagcacaaccagctgcaggacggccacgagcgggagtacatcaactgcaaccgctacttccggcagatcttcagctgtggccgcctgcgcttcagcgagatccccatgaagctggccggcctgctgcagcacccagaccccatcgtcatcaaccacgtgatctctgtggaccccaatgaccagaagaagacagcctgctatgacattgatgtggaggtggatgaccccctgaaggcccagatgagcaacttcctggccagcaccaccaaccagcaggagatcgccagcctggatgtgaagatccacgagaccatcgagagcatcaaccagctgaagacccagagggacttcatgctgtccttcagcacagacccccaggacttcatccaggagtggctgcggagccagaggcgggacctgaagatcatcacagatgtgattggcaaccctgaggaggagaggagagctgccttctaccaccagccctgggcccaggaggccgtgggccgccacatctttgccaaggtgcagcagaggcggcaggagctggagcaggtgctgggcatccggctgacctag

SEQ ID NO: 36519 - DNA, 570 bp, Artificial Sequence
  Description of Artificial Sequence: Synthetic coding sequence
atggccagcggggccggcggctcctggggccgcagccccccccagagcgctgtgcccaccccctgggtgaccttcctgcagcccctgtcctgggccgtgcccccagccccaccccagcccggccgggtgaaggaggacctgctggagctgatgatgctgcagaatgcccagatgcaccagctgctgctgagccggctggtggccggggccctgcagcccaggcctgccagcccctgcccccaggtgtacctggaggtgccccaggaggagcctgaggaggaggaggaggagatggatgtgcgggagaagggccccctggtgttccaccaccactacctgccctacctgatgcccagccctggggccctgctgccctggccagcccccttcttccccaccccagcctgccagccctacctgcaggatgtgccccgcatccagcactgcccagccagccgggagcgggaggtgcgggctgtgcccccacctcctcctccttctgccactggaacagtgggcgcagatgtgcccccagccagtgactactatgatgctgagagcctgctgtag

SEQ ID NO: 36520 - DNA, 711 bp, Artificial Sequence
  Description of Artificial Sequence: Synthetic coding sequence
atggccagcggggccggcggctcctggggccgcagccccccccagagcgctgtgcccaccccctgggtgaccttcctgcagcccctgtcctgggccgtgcccccagccccaccccagcccggccgggtgaaggaggacctgctggagctgatgatgctgcagaatgcccagatgcaccagctgctgctgagccggctggtggccggggccctgcagcccaggcctgccagcccctgcccccaggtgtacctggaggtgccccaggaggagcctgaggaggaggaggaggagatggatgtgcgggagaagggccccctggtgttccaccaccactacctgccctacctgatgcccagccctggggccctgctgccctggccagcccccttcttccccaccccagcctgccagccctacctgcaggatgtgccccgcatccagcactgcccagccagccgggagcgggagaccaccatgatgccccgggccagctatgaggaccggccccggccctgggagctgcaccagctgcctgccctggacacagcccctgagcccccaccagcccccctgctgagcaccccccgctgcccctggctggccgtgctgctgacccccagcaccagcgcccggcccagcagccctggagagatcagcccctgccccacccccatgagctcctggacaggccgcatctgtgctgtggtgtag

SEQ ID NO: 36521 - DNA, 420 bp, Artificial Sequence
  Description of Artificial Sequence: Synthetic coding sequence
atgatgctgcagaatgcccagatgcaccagctgctgctgagccggctggtggccggggccctgcagcccaggcctgccagcccctgcccccaggtgtacctggaggtgccccaggaggagcctgaggaggaggaggaggagatggatgtgcgggagaagggccccctggtgttccaccaccactacctgccctacctgatgcccagccctggggccctgctgccctggccagcccccttcttccccaccccagcctgccagccctacctgcaggatgtgccccgcatccagcactgcccagccagccgggagcgggaggtgcgggctgtgcccccacctcctcctccttctgccactggaacagtgggcgcagatgtgcccccagccagtgactactatgatgctgagagcctgctgtag

SEQ ID NO: 36522 - DNA, 297 bp, Artificial Sequence
  Description of Artificial Sequence: Synthetic coding sequence
atggccagcggggccggcggctcctggggccgcagccccccccagagcgctgtgcccaccccctgggtgaccttcctgcagcccctgtcctgggccgtgcccccagccccaccccagcccggccgggtgaaggaggacctgctggagctgatgatgctgcagaatgcccagatgcaccagctgctgctgagccggctggtggccggggccctgcagcccaggcctgccagcccctgcccccaggagagctgtgcccccacccccaccccccagtgccaccgggactgtggctgctag

SEQ ID NO: 36523 - DNA, 1506 bp, Artificial Sequence
  Description of Artificial Sequence: Synthetic coding sequence
atggagaaccagctgtggcacaacacagtgcgctgctgcaaccagtaccaggagagcccccatgatgctgaggacatcctgctgctgctgctgggcctcatcgtgctggtgaacatcggcatcaacgtggccaccatgatgtggcacggcctgcagaatgccctggacaagatgattgactgggccacccagaagaatgagatccaggccagcgagagcccccccagcggccccccagacaaggcccaggatgtgcacatccactgcatcctggaccctgtgcaggtgaagatgagccggcccacccagtacagcagcttcagctgccaccacttcagcaaccaccacagcagcagcctgctgcgctgtgtgagaagaagaagaagaagacaccggcgctgcagaagacgctgctgcaaccaccagcagaggccccagaactaccggcagatcccccacagccacagcgtcttcaggaacccccacaggagccagaagatgagccagctgcaccgggtgcccttctttgaccaggaggaccctgacagctacctggaggaggaggacaacctgcccttcccctaccccaagtacccccggcggggctggggcggcttctaccagagagctggcctgcccagcaatgtgggcctgtggggccaccagggcggcatcctggccagcctgcccccacccagcctgtacctgagccctgagctgcgctgcatgcccaagagggtggaggcccggtctgagctgcggctgcagagctatggaagacatggcagccagagccggctgtggggcaatgtggaggccgagcagtgggccagcagccccccaccaccccaccggctgccccccaaccccagctgggtgcctgtgggccacagcccctaccccagcgtgggctggatgctgtatgacagctgggaccagaggagaagaggaacagagggctttgagcggcccccagcctctgtgtccagaaatgcccggcctgaggcccagggctgccgggagcaccacagcccccagagccaccagcagagcctgctgggccacgcctacggccagagccacaggagcccccaccccagcacagagcccctgggctacagcagccaggacccccgggaggtgagaagaagagctgctgactgggccgaggccctgcctgcctggaggcccctgaccaccagcgccagcctgactgtgctggatgaggccagccaccagaggaccccagcccccagctctgtgctggtgccccacagcagccagccctggcccaaggtgcaggccgctgaccctgcccccccacccaccatgtttgtgcccctgagcaggaaccctggaggaaatgccaactaccaggtgtatgacagcctggagctgaagaggcaggtgcagaagagccgggcccggagcagcagcctgcccccagccagcaccagcaccctgcggcccagcctgcacaggagccagacagagaagctgaactag

SEQ ID NO: 36524 - DNA, 1812 bp, Artificial Sequence
  Description of Artificial Sequence: Synthetic coding sequence
atgagcggctacagcagtgaccgggaccggggccgggaccggggctttggagcccccaggtttggaggcagccgggccggccccctgagcggcaagaagtttggaaatcctggagagaagctggtgaagaagaagaacttctaccaggagcacccagacctggcccggaggacagcccaggaggtggagacctaccgccgcagcaaggagatcaccgtgcggggccacaactgccccaagcctgtgctgaacttctatgaggccaacttccctgccaacgtgatggatgtgattgcccggcagaacttcacagagcccacagccatccaggcccagggctggcctgtggccctgagcggcctggacatggtgggcgtggcccagacaggcagcggcaagaccctgagctacctgctgcctgccatcgtgcacatcaaccaccagcccttcctggagagaggagatggccccatctgcctggtgctggcccccacccgggagctggcccagcaggtgcagcaggtggccgctgagtactgccgggcctgccgcctgaagagcacctgcatctatggaggagcccccaagggcccccagatccgggacctggagcggggcgtggagatctgcatcgccaccccaggccgcctgattgacttcctggagtgtgggaagaccaacctgcggaggaccacctacctggtgctggatgaagctgacaggatgctggacatgggctttgagccccagatcaggaagatcgtggaccagatccggccagaccggcagaccctgatgtggagcgccacctggcccaaggaggtgcggcagctggccgaggacttcctgaaggactacatccacatcaacattggagccctggagctgagcgccaaccacaacatcctgcagatcgtggatgtgtgccatgatgtggagaaggatgagaagctgatccggctgatggaggagatcatgtctgagaaggagaacaagaccatcgtgtttgtggagaccaagagaagatgtgatgagctgaccaggaagatgagaagagatggctggccagccatgggcatccatggagacaagagccagcaggagcgggactgggtgctgaatgagttcaagcacggcaaggcccccatcctgattgccacagatgtggccagccggggcctggatgtggaggatgtgaagtttgtgatcaactatgactaccccaacagcagcgaggactacatccaccgcatcggccgcacagcccggagcaccaagacaggaacagcctacaccttcttcacccccaacaacatcaagcaggtgtctgacctgatctctgtgctgcgggaggccaaccaggccatcaaccccaagctgctgcagctggtggaggaccggggcagcggccgcagccggggccggggcggcatgaaggatgaccggcgggaccgctacagcgctgggaagaggggcggcttcaacaccttccgggacagagaaaattatgaccggggctacagcagcctgctgaagagggactttggagccaagacccagaatggagtgtacagcgctgccaactacaccaacggcagctttggcagcaactttgtgtctgctggcatccagaccagcttcagaactggaaaccccaccggcacctaccagaatggctatgacagcacccagcagtatggcagcaatgtgcccaacatgcacaacggcatgaaccagcaggcctatgcctacccagccacagctgctgcccccatgattggctaccccatgcccaccggctacagccagtag

SEQ ID NO: 36525 - DNA, 1191 bp, Artificial Sequence
  Description of Artificial Sequence: Synthetic coding sequence
atgctgcccagcctgcaggagagcatggatggagatgagaaggagctggagagcagcgaggagggcggcagcgctgaggagcggcggctggagccccccagcagcagccactactgcctgtacagctaccggggcagccggctggcccagcagagaggagacagtgaagatggcagccccagcggcaccaatgctgagaccccatctggagatgacttcagcctgagcctggccgacaccaacctgcccagcgaggtggagcctgagctgcggagcttcatcgccaagaggctgagcagaggagctgtgtttgagggcctgggcaatgtggcctctgtggagctgaagatccctggctacagagtgggctgctactactgcctcttccagaatgagaagctgctgcctgagaccgtgaccattgattctgaaagaaaccccagtgaatatgtggtgtgcttcctgggcggcagcgagaagggcctggagctgttccggctggagctggacaagtacatccagggcctgaagaacaacatgaactgtgaggcccggggcctggagagccacatcaagagctacctgagctcctggtttgaagatgtggtgtgccccatccagagggtggtgctgctcttccaggagaagctgaccttcctgctgcatgctgccctgagctacacccctgtggaggtgaaggagagtgatgagaagaccaagagggacatcaaccgcttcctgtctgtggccagcctgcagggcctcatccacgagggcaccatgaccagcctgtgcatggccatgacagaggagcagcacaagtctgtggtgattgactgcagcagcagccagccccagttctgcaatgccggcagcaaccgcttctgtgaggactggatgcaggccttcctgaatggagccaagggcggcaaccccttcctgttccggcaggtgctggagaacttcaagctgaaggccatccaggacaccaacaacctgaagcgcttcatccggcaggccgagatgaaccactacgccctcttcaagtgctacatgttcctgaagaactgtggcagcggggacatcctgctgaagatcgtgaaggtggagcacgaggagatgcctgaggccaagaatgtgattgctgtgctggaggagttcatgaaggaggccctggaccagagcttctag

SEQ ID NO: 36526 - DNA, 732 bp, Artificial Sequence
  Description of Artificial Sequence: Synthetic coding sequence
atggatgagctggccctgtccttcagcctgacctgcctgctgcctgagaacagagccagcctgagccccagccagcccctgtccttccagtgcctgaaggccccagccaccctgacctgggaggatgagaagcagcagcgctggggccagccccacggccctgtgagcagccccctgctgggggaccaccgctgcctggtgcccttccgggacctgaaccccagcagcgaggtgaacacagccaacctgctggagagccccagcagcctgctgctgaccagctgctacatctgcagctacttctccttctacatcctgggggagaagcgctgccacagcctgaagaggctgcgctacagcgtgtgctgcaaggtgtgccccaacttctgtgcctgtgggaaggaaaatgtgtctggcaccggccaggtgtgcacaggagtgcacgtgggcgccaaggagcaggaggagcccggcggcacccaggccctgcggagctgtggcatctactgcctggaggagaggacagacaaggccagccatgaggagtgccgggagaggagcaccctgggccggccccagtgcaccggcctgacccccagcctggccggggagagcccctgcccccggctgctgcccggcagccccaccgtgcgccacctgattgccagcagctgccccggcctgagtgaccccctgcccctgcccccaggcaccctgcccctgggcagctag

SEQ ID NO: 36527 - DNA, 732 bp, Artificial Sequence; identical to SEQ ID NO: 36526
  Description of Artificial Sequence: Synthetic coding sequence

SEQ ID NO: 36528 - DNA, 117 bp, Artificial Sequence
  Description of Artificial Sequence: Synthetic coding sequence
atggatgagctggccctgtccttcagcctgacctgcctgctgcctgagaacagagccagcctgagccccagccagcccctgtccttccagtgcctgaaggccccagccaccctgtag

SEQ ID NO: 36529 - DNA, 756 bp, Artificial Sequence
  Description of Artificial Sequence: Synthetic coding sequence
atgggccggcccctggagggccagcccctgcgggccctggacctgtacccagagcccgccttcctgcggagcggcaaggaccccaagagcagccctgccagcagccccagctttgctgtgctgggccctgaggtgcgcagcactggaggccaggccggcagcagaagaagaccttctgccccctgcagccaggacagagctgctgctgagggcgccccagccctgctgggcggcagccccagcagcggcagccctggccaccccccaggcagcgcctttggagtggaggccggctgccgggccctgaatgtgtctgaacatgcccggggcggctttgccctgggcctgcccttcggcctgtctggaggagcctacctgttcctgctgctggatggagctggggaccccaagcccaccccagaggcccccatcagcagcgcagatggccgggcctggttccccagcgagagctcctggcagctgccccagctgcctgctggcagcaccagcggcagcgagccccgggcccggcccggcctgggcccccggcagctgctgaccggccccagagatggagctgctggccagggccctggccggggcctgacagcccggctgggccgggagcgggagattgactgtggcccccggcaggccggccatggaggaacagccacagacaccggccgggccggcagcggggcccggcacaggcctccccgggaccggggcaccccaggcctgcggacccactag

SEQ ID NO: 36530 - DNA, 435 bp, Artificial Sequence
  Description of Artificial Sequence: Synthetic coding sequence
atgaccaggatgacccggcccctgaagagccacgtgcaggtggtgcccagcaccctgatgtggcagagccaggcccggacccagcctgcccccctgtgctgcaagctgctgaccccccgctggctgcccctgctgctgcccacccacccccacagccactgcctggccggccacctgttcttccctgcccgctacagctgcagcagcgagtggaagcagcagctgacctgccacctgtgtgtgacagacagcgccccacccaggcacactggagtggtggtgtctgagcacctgcggaggacagagaagctgttcttcaccatcctgagccccaaccagagcaagcccttcaagacctggaagatgctgaaggccaccatccccatctttgtgtgcttcctgctgaacctggcccagaacccccggcccctgtag

SEQ ID NO: 36531 - DNA, 1023 bp, Artificial Sequence
  Description of Artificial Sequence: Synthetic coding sequence
atgaagtatggcaaccccaactacggcggcatgaagggcatcctgagcaacagctggaagaggcgctaccacagccgccgcatccagagagatgtgatcaagaagagggccctgattggagatgatgtgggcctgaccagctacaagcaccgccacagcggcctggtgaatgtgcctgaggagcccatcgaggaggaggaggaggaggaggaggaggaggaggaggaggaggaggaggaccaggacatggatgctgatgacagagtggtggtggagtaccacgaggagctgcctgccctgaagcagccccgggagaggtctgccagccgccgcagcagcgccagcagcagtgacagtgatgagatggactatgacctggagctgaagatgatcagcacccccagccccaagaagtccatgaagatgaccatgtatgcagatgaggtggagagccagctgaagaacatcagaaattccatgagagctgacagcgtgagcagcagcaacatcaagaaccgcatcggcaacaagctgcccccagagaagtttgctgatgtgcgccacctgctggatgagaagaggcagcacagccggcccaggcctcctgtgagcagcaccaagagtgacatccggcagaggctgggcaagaggccccacagccctgagaaggccttcagcagcaaccctgtggtgcggcgggagcccagcagtgatgtgcacagccggctgggcgtgccccggcaggacagcaagggcctgtatgctgacacccgggagaagaagagcggcaacctgtggacccggctgggcagcgcccccaagaccaaggagaagaacaccaagaaggtggaccaccgggcccctggagctgaggaggatgattctgagctgcagagggcctggggcgccctgatcaaggagaaggagcagagccggcagaagaagagccggctggacaacctgcccagcctgcagatcgaggtgtcccgggagagcagcagcggcagcgaggccgagagctag

SEQ ID NO: 36532 - DNA, 1863 bp, Artificial Sequence
  Description of Artificial Sequence: Synthetic coding sequence
atggctgctgtgcggggcctgcgggtgtctgtgaaggccgaggccccagctggccctgccctgggcctgcccagccctgaggccgagagcggcgtggacagaggagagcctgagcccatggaggtggaggagggggagctggagatcgtgcctgtgagaagaagcctgaaggagctgatcccagacaccagcagaagatatgagaacaaggccggcagcttcatcaccggcattgatgtgaccagcaaggaggccatcgagaagaaggagcagagggccaagcgcttccacttccgctctgaggtgaacctggcccagagaaatgtggccctggaccgggacatgatgaagaaggccatccccaaggtgcggctggagaccatctacatctgtggggtggatgagatgagcacccaggatgtgttctcctacttcaaggagtaccccccagcccacatcgagtggctggatgacaccagctgcaatgtggtgtggctggatgagatgacagccacccgggccctgatcaacatgagcagcctgcctgcccaggacaagatccgcagcagagatgccagcgaggacaagtctgctgagaagaggaagaaggacaagcaggaggacagcagtgatgatgatgaagctgaggagggggaggtggaggatgagaacagcagtgatgtggagctggacaccctgagccaggtggaggaggagagcctgctgagaaatgacctgcggcctgccaacaagctggccaagggcaacagactcttcatgagatttgccaccaaggatgacaagaaggagctgggcgccgcccggcgcagccagtactacatgaagtatggcaaccccaactacggcggcatgaagggcatcctgagcaacagctggaagaggcgctaccacagccgccgcatccagagagatgtgatcaagaagagggccctgattggagatgatgtgggcctgaccagctacaagcaccgccacagcggcctggtgaatgtgcctgaggagcccatcgaggaggaggaggaggaggaggaggaggaggaggaggaggaggaggaggaccaggacatggatgctgatgacagagtggtggtggagtaccacgaggagctgcctgccctgaagcagccccgggagaggtctgccagccgccgcagcagcgccagcagcagtgacagtgatgagatggactatgacctggagctgaagatgatcagcacccccagccccaagaagtccatgaagatgaccatgtatgcagatgaggtggagagccagctgaagaacatcagaaattccatgagagctgacagcgtgagcagcagcaacatcaagaaccgcatcggcaacaagctgcccccagagaagtttgctgatgtgcgccacctgctggatgagaagaggcagcacagccggcccaggcctcctgtgagcagcaccaagagtgacatccggcagaggctgggcaagaggccccacagccctgagaaggccttcagcagcaaccctgtggtgcggcgggagcccagcagtgatgtgcacagccggctgggcgtgccccggcaggacagcaagggcctgtatgctgacacccgggagaagaagagcggcaacctgtggacccggctgggcagcgcccccaagaccaaggagaagaacaccaagaaggtggaccaccgggcccctggagctgaggaggatgattctgagctgcagagggcctggggcgccctgatcaaggagaaggagcagagccggcagaagaagagccggctggacaacctgcccagcctgcagatcgaggtgtcccgggagagcagcagcggcagcgaggccgagagctag

SEQ ID NO: 36533 - DNA, 1140 bp, Artificial Sequence
  Description of Artificial Sequence: Synthetic coding sequence
atggagaccctgtgcccagccccccggctggccgtgcctgccagcccccggggcagcccctgcagccccacccccaggaagccctgccggggcacccaggagttcagccccctgtgcctgcgggccctggccttctgtgccctggccaagccccgggccagcagcctgggccctggccctggagagctggccgcccggagccctgtgctgcggggcccccaggcccccctgcggcctgggggctgggccccagatggcctgaagcacctgtgggcccccaccggccggcctggggtgcccaacacagctgctggggaggatgctgatgtggccgcctgccccaggagaggagaggaggaggagggcggcggcggcttcccccactttggagtgcgcagctgtgcccctcctggccgctgcccagccccaccccacccccgggagagcaccaccagctttgccagcgccccacccaggcctgcccctggcctggagccccagaggggccctgctgccagccccccccaggagcccagcagccggccccccagccccccagctggcctgagcacagagcccgccggccctggaacagccccccggcccttcctgcccggccagcctgctgaggtggatggcaaccccccacctgctgcccctgaggccccagctgccagccccagcacagccagccctgccccagctgcccctggggacctgcggcaggagcactttgacaggctcatccgccgcagcaagctgtggtgctacgccaagggctttgccctggacacccccagcctgcggcggggccctgagcggcccccagccaagggccctgcccggggggccgccaagaagaggcggctgcctgcccccccacccaggacagcccagcccaggaggcctgcccccaccctgcccaccaccagcaccttcagcctgctgaactgcttcccctgccccccagccctggtggtgggagaagatggagacctgaagccagccagcagcctgcggctgcagggcgacagcaagcccccaccagcccaccccctgtggcgctggcagatgggcggccctgctgtgcctgagcccccaggcctgaagttctggggcatcaacatggatgagagctag

SEQ ID NO: 36534 - DNA, 1272 bp, Artificial Sequence
  Description of Artificial Sequence: Synthetic coding sequence
atggagacccggggccctggcctggccgtgcgggcagagagccggcggctggtgggcatcggcccccgggcccctcctggccgggtgggcctgcagcccagcggccgcctggacagaagaggaggagctggcaccatgggctacaaggacaatgatggagaggaggaggagcgggagggcggcgctgctggcccccggggcagccggctgccccccatcaccggcggggccagcgagctggccaagaggaaggtgaagaagaagaagaggaagaagaagaccaagggcagcgggaaaggagatgacaagcaccagagccagagcctgaagagccagcccctgagcagcagcttccatgacatcctgagcccctgcaaggagcggggccccaagccagagcaccggcagagcaaggtggagaagaagcacctgcccagcgacagcagcacagtgtccctgcctgactttgctgagattgagaacctggccaaccgcatcaatgaaagcctgcgctgggatggcatcctggccgaccctgaggccgagaaggagcgcatccgcatctacaagctgaacagaaggaagcgctaccgctgcctggccctgaagggcttccacccagaccctgaggccctgaagggcttccacccagaccctgatgccctgaagggcttccacccagaccctgaggccctgaagggcttccacccagaccctgaggccctgaagggcatccacccagaccctgaggccctgaagggcttccacccagaccctgaggccctgaagggcttccacccagaccctgaggccctgaagggcttccacacagatcctgaggccctgaagggcttccacattgatcctgaggccctgaagggcttccacccagaccccaaggccctgaagggcttccacccagaccccaaggccctgaagggcttccacacagatcctgaggccctgaagggcttccacccagaccccaaggccctgaagggcttccacccagaccctgaggccctgaagggcttccacccagaccctgaggccctgaagggcttccacccagaccctgaggccctgaagggcttccacacagaccccaatgctgaggaggcccctgagaacctgccctacctgagtgacaaggatggcagcagcagccaccggcagcccaccagcaaggccgagtgccccaacctgtgctttgagggcaacctgacccccaagctgctgcacagcgacctggcccccaccctgctggagtag

SEQ ID NO: 36535 - DNA, 465 bp, Artificial Sequence
  Description of Artificial Sequence: Synthetic coding sequence
atggcctacctgtctgagtgccgcctgcggctggagaagggcttcatcctggatggagtggccgtgtccacagctgcccgggcctacggccgcagccggcccaagctgtggagcgccatccccccctacaatgcccagcaggactaccacgcccggagctacttccagagccacgtggtgccccccctgctgaggaagacagaccaggaccatggaggcaccggcagagatggctggatcgtggactacatccacatcttcggccagggccagcgctacctgaacagaagaaactgggccggcaccggccacagcctgcagcaggtgacaggccatgaccactacaatgctgacctgaagcccattgatggcttcaacggccgcttcggctacagaagaaacaccccagccctgcggcagagcacctctgtgtttggagaggtgacccacttccccctcttctag

SEQ ID NO: 36536 - DNA, 798 bp, Artificial Sequence
  Description of Artificial Sequence: Synthetic coding sequence
atgggcctgcccggcctcttctgcctggccgtgctggccgccagcagcttcagcaaggcccgggaggaggagatcacccctgtggtgtccatcgcctacaaggtgctggaggtgttccccaagggccgctgggtgctgatcacctgctgtgccccccagcccccaccacccatcacctacagcctgtgtggcaccaagaacatcaaggtggccaagaaggtggtgaagacccatgagcccgccagcttcaacctgaatgtgaccctgaagagcagcccagacctgctgacctacttctgctgggccagcagcaccagcggggcccacgtggacagcgcccggctgcagatgcactgggagctgtggagcaagcctgtgtctgagctgcgggccaacttcaccctgcaggacagaggagctggcccccgggtggagatgatctgccaggccagcagcggcagcccccccatcaccaacagcctcatcggcaaggatggccaggtgcacctgcagcagaggccctgccaccggcagcctgccaacttctccttcctgcccagccagaccagtgactggttctggtgccaggccgccaacaatgccaacgtgcagcacagcgccctgactgtggtgcccccaggaggagaccagaagatggaggactggcagggccccctggagagccccatcctggccctgcccctgtaccgcagcacccggcggctgtctgaggaggagtttggaggcttcagaattggaaatggagaggtgcggggcaggaaggctgctgccatgtag

SEQ ID NO: 36537 - DNA, 903 bp, Artificial Sequence
  Description of Artificial Sequence: Synthetic coding sequence
atgagccggcccggcatcgtggagagctatgagatcacccctgtggtgtccatcgcctacaaggtgctggaggtgttccccaagggccgctgggtgctgatcacctgctgtgccccccagcccccaccacccatcacctacagcctgtgtggcaccaagaacatcaaggtggccaagaaggtggtgaagacccatgagcccgccagcttcaacctgaatgtgaccctgaagagcagcccagacctgctgacctacttctgctgggccagcagcaccagcggggcccacgtggacagcgcccggctgcagatgcactgggagctgtggagcaagcctgtgtctgagctgcgggccaacttcaccctgcaggacagaggagctggcccccgggtggagatgatctgccaggccagcagcggcagcccccccatcaccaacagcctgattggcaaggatggccaggtgcacctgcagcagaggccctgccaccggcagcctgccaacttctccttcctgcccagccagaccagtgactggttctggtgccaggccgccaacaatgccaacgtgcagcacagcgccctgactgtggtgcccccaggagagcgggccctgggcttccctgagggccagctggccctgctgtgccgggagggcgcctctgtgcaggacaccggccgctgggaggtgggccagctgtacccagccacagctgagagccgggagggcaccggcggcaaccacgcccaccctggcccctgcctgaaggaggcccagcccagctgcctgcggcccctgcccggcggcctgccccgggcccccaccatcgtgctggtgggcagcctggccagcacagctgccatcaccagcaggatgctgggctggaccacctgggccaggtag

SEQ ID NO: 36538 - DNA, 399 bp, Artificial Sequence
  Description of Artificial Sequence: Synthetic coding sequence
atggtgaagaagttcaaggacagcaagtctgtgctgctgatcacctgcaagacctgcaacagaacagtgaagcaccacggcaagagccgcagctttgtgtccaccctgaagagcaacccagccacccccaccagcaagctgagcctgaagaccccagagaggagaacagccaaccccaaccacgacatgagcggcagcaagggcaagagccctgcctctgtgttccgcacccccaccagcggccagagcgtgtccacctgcagcagcaagaacaccagcaagaccaagaagcacttcagccagctgaagatgctgctgagccagaatgaaagccagaagatccccaaggtggacttcaggaacttcctgagcagcctgaagggcggcctgctgaagtag

SEQ ID NO: 36539 - DNA, 663 bp, Artificial Sequence
  Description of Artificial Sequence: Synthetic coding sequence
atgaggcagaagcactacctggaggccgccgcccggggcctgcatgacagctgccccggccaggcccgctacctgctgtgggcctacaccagcagccatgatgacaagagcacctttgaggagacctgcccctactgcttccagctgctggtgctggacaacagccgggtgcggctgaagcccaaggcccggctgacccccaagatccagaagctgctgaaccgggaggccaggaactacaccctgtccttcaaggaggccaagatggtgaagaagttcaaggacagcaagtctgtgctgctgatcacctgcaagacctgcaacagaacagtgaagcaccacggcaagagccgcagctttgtgtccaccctgaagagcaacccagccacccccaccagcaagctgagcctgaagaccccagagaggagaacagccaaccccaaccacgacatgagcggcagcaagggcaagagccctgcctctgtgttccgcacccccaccagcggccagagcgtgtccacctgcagcagcaagaacaccagcaagaccaagaagcacttcagccagctgaagatgctgctgagccagaatgaaagccagaagatccccaaggtggacttcaggaacttcctgagcagcctgaagggcggcctgctgaagtag

SEQ ID NO: 36540 - DNA, 663 bp, Artificial Sequence; identical to SEQ ID NO: 36539
  Description of Artificial Sequence: Synthetic coding sequence

SEQ ID NO: 36541 - DNA, 1212 bp, Artificial Sequence
  Description of Artificial Sequence: Synthetic coding sequence
atgaagatggaggaggccgtgggcaaggtggaggagctgattgagagcgaggccccacccaaggccagcgagcaggagacagccaaggaggaggatggctctgtggagctggagagccaggtgcagaaggatggagtggccgacagcaccgtcatcagctccatgccctgcctgctgatggagctgcggcgggacagcagcgagagccagctggccagcacagaaagtgacaagcccaccaccggccgggtgtatgaaagtgacagcagcaaccactgcatgctgagccccagcagcagcggccacctggccgacagcgacaccctgagcagcgctgaggagaatgagcccagccaggccgagacagctgtggagggggaccccagcggcgtgtctggggccaccgtgggcaggaagagcagaagaagccgctctgagagcgagaccagcaccatggccgccaagaagaaccggcagagcagtgacaagcagaatggccgggtggccaaggtgaagggccacaggagccagaagcacaaggagcgcatccggctgctgcggcagaagcgggaggccgccgccaggaagaagtacaacctgctgcaggacagcagcaccagtgacagcgacctgacctgtgacagcagcaccagcagcagtgatgatgatgaggaggtgtctggcagcagcaagaccatcacagctgagatcccagatggcccccctgtggtggcccactatgacatgtctgacaccaacagcgaccctgaggtggtgaatgtggacaacctgctggccgctgctgtggtgcaggagcacagcaacagcgtgggcggccaggacaccggggccacctggaggaccagcggcctgctggaggagctgaatgctgaggccggccacctggaccccggcttcctggccagtgacaagaccagcggaaatgcccccctgaatgaggagatcaacatcgccagcagtgacagcgaggtggagatcgtgggcgtgcaggagcacgcccgctgtgtgcacccccggggcggcgtcatccagagcgtgtcctcctggaagcacggcagcggcacccagtatgtgtccacccggcagacccagagctggacagctgtgaccccccagcagacctgggccagccctgctgaggtggtggacctgaccctggatgaggacagcaggaggaagtacctgctgtag

SEQ ID NO: 36542 - DNA, 1029 bp, Artificial Sequence
  Description of Artificial Sequence: Synthetic coding sequence
atgaagatggaggaggccgtgggcaaggtggaggagctgattgagagcgaggccccacccaaggccagcgagcaggagacagccaaggaggaggatggctctgtggagctggagagccaggtgcagaaggatggagtggccgacagcaccgtcatcagctccatgccctgcctgctgatggagctgcggcgggacagcagcgagagccagctggccagcacagaaagtgacaagcccaccaccggccgggtgtatgaaagtgacagcagcaaccactgcatgctgagccccagcagcagcggccacctggccgacagcgacaccctgagcagcgctgaggagaatgagcccagccaggccgagacagctgtggagggggaccccagcggcgtgtctggggccaccgtgggcaggaagagcagaagaagccgctctgagagcgagaccagcaccatggccgccaagaagaaccggcagagcagtgacaagcagaatggccgggtggccaaggtgaagggccacaggagccagaagcacaaggagcgcatccggctgctgcggcagaagcgggaggccgccgccaggaagaagtacaacctgctgcaggacagcagcaccagtgacagcgacctgacctgtgacagcagcaccagcagcagtgatgatgatgaggaggtgtctggcagcagcaagaccatcacagctgagatccctggccacctggaccccggcttcctggccagtgacaagaccagcggaaatgcccccctgaatgaggagatcaacatcgccagcagtgacagcgaggtggagatcgtgggcgtgcaggagcacgcccgctgtgtgcacccccggggcggcgtcatccagagcgtgtcctcctggaagcacggcagcggcacccagtatgtgtccacccggcagacccagagctggacagctgtgaccccccagcagacctgggccagccctgctgaggtggtggacctgaccctggatgaggacagcaggaggaagtacctgctgtag

SEQ ID NO: 36543 - DNA, 231 bp, Artificial Sequence
  Description of Artificial Sequence: Synthetic coding sequence
atggtgtgcatcccctgcatcgtcatccctgtgctgctgtggatctacaagaagttcctggagccctacatctaccccctggtgagcccctttgtgagccgcatctggcccaagaaggccatccaggagagcaatgacaccaacaagggcaaggtgaacttcaagggagctgacatgaatggcctgcccaccaagggccccacagagatctgtgacaagaagaaggactag

SEQ ID NO: 36544 - DNA, 231 bp, Artificial Sequence; identical to SEQ ID NO: 36543
  Description of Artificial Sequence: Synthetic coding sequence

SEQ ID NO: 36545 - DNA, 2490 bp, Artificial Sequence
  Description of Artificial Sequence: Synthetic coding sequence
atgacagagaacaagacagtgagcagcagcagcaccagagatgaccagaccaacatcggcctgacctgccaggaggtgaaggccctgcgggagaaggcctggagcaggaccaatgaaggaaatgccatgagccagagcctggtgctgtatggagccagcaaagaaaattctgagggcttccacgagagcaagatgaccaacacagagggcgtgaacaagggcatctacttctcctacccctgccgccgccacagctgtgctgtggtgaacatcccagccccctgtgtgaacaagatgatcagccacatccaggatgtggagagcaagatccaggagcacctgaagagatttgagaccagctttgaggagtggagcaggaccagcagcaccaaggacctgaaggaggactggagcgtgaccacccctgtgaaggaggtgaagccaggagagaagagagatgagaagtgcccagagctgaagcaggagatggagaccctgctgtctgaggccatccgcctcatcaagagcctggagacagacagagcagatgctgaggaggccctgaagcagcagaggagcaggaagaacatgatcaacatgaagattgacagctggagcgtgtggaagctgcaggagctgcccctggccgtgcagaaggagcacgaggcctacctgagtgatgtgattgagctgcagtggcacctggaggacaaggccaaccagctgcagcactttgagaagcagaagacagagctggaggaggccaatgccaagatccaggccgacatcgactacatgaatgaacatggccccctgctggacagcaagcagaaccaggagctgcaggacctgaagaaccactacaagaagaagatggaggtgatggacctgcacaggaaggtgaatgaggagctggaggaggccctggaggcctgtgaaaatgcccggctgaaggcccagcagatcaaggaggagattgacaaggacatctaccaggatgagaagaccatcgaggcctacaagcgggagatctaccagctgaacagcctgtttgaccactacagcagcagcgtcatcaacgtgaacaccaacatcgaggagaaggaggaggaggtgacagaggccatccgggagaccaagagcagcaagaatgagctgcacagcctgagcaagatgctggaggacctgcggcgggtgtatgaccagctgacctggaagcagaagagccatgagaaccagtacctggaggccgtgaatgacttctatgctgccaagaagacctgggacatcgagctgagtgatgtggccaaggacttcagcgccatcagcctggcctgcaccaagctgacagaggacaacaagaagctggagattgacatcaacaagatcaccgtgaagaccaatgaaagcatcaggaagaagagcaaatatgaaagtgagatcaagtacctgaccatcatgaagctgaagaatgacaagcacctgaagaacatctacaaggaggcctacagaattggcaccctcttccacctgaccaagcacaagacagatgagatggaggacaagattgctgaggtgcggaggaagttcaagggccgggaggagttcctgaagaagctgacccagggcgaggtggccgccggcatggtgctgcagaagaagctgtacagcatctatgaggtgcaggccctggagaggaaggagctgatcaagaacagagccatctgtgccatgagcctggccgagctgcaggagcccctgctgcagctggaggatgaggccgagcgcatccgcagcctggacaaggagcacagcgtgtccaagaggtctgccatcttcaaggacctggaggccaccaagagcaagaccatgatcttctacgccaagatcaatgagctgaatgaggagctgaaggccaaggaggaggagaagaagagctttgaccagaccctggagatcctgaagaacaagttcatcaccatgaggttcaagcgggagcacgcccagacagtgtttgaccactacatgcaggagaagaaggactgtgaggagcgcatctttgaggaggaccagcgcttccgggtgctgctggccgtgcggcagaagaccctgcaggacacccagaagatcatcgctgacagcctggaggagaacctgcggctggcccaggagtaccagcagctgcagatcaccttcctgaaggagaaggacaactacttcaacatctatgacaagcagctgagcctggacaccagcatccgggacaagaagcagctgtgccagctgcagaggaggatgcacaccctgtggcaggagcacttcaagctggtggtgctcttcagccagatgaggctggccaacttccagacagacagccaggagagcatccagaagatcctggccgtgcaggaggagagcagcaacctgatgcagcacatcctgggcttcttccagaccctgacagatggcacctgtgaaaatgatggatag

SEQ ID NO: 36546 - DNA, 2604 bp, Artificial Sequence
  Description of Artificial Sequence: Synthetic coding sequence
atgacagagaacaagacagtgagcagcagcagcaccagagatgaccagaccaacatcggcctgacctgccaggaggtgaaggccctgcgggagaaggcctggagcaggaccaatgaaggaaatgccatgagccagagcctggtgctgtatggagccagcaaagaaaattctgagggcttccacgagagcaagatgaccaacacagagggcgtgaacaagggcatctacttctcctacccctgccgccgccacagctgtgctgtggtgaacatcccagccccctgtgtgaacaagatgatcagccacatccaggatgtggagagcaagatccaggagcacctgaagagatttgagaccagctttgaggagtggagcaggaccagcagcaccaaggacctgaaggaggactggagcgtgaccacccctgtgaaggaggtgaagccaggagagaagagagatgagaagtgcccagagctgaagcaggagatggagaccctgctgtctgaggccatccgcctcatcaagagcctggagacagacagagcagatgctgaggaggccctgaagcagcagaggagcaggaagaacatgatcaacatgaagattgacagctggagcgtgtggaagctgcaggagctgcccctggccgtgcagaaggagcacgaggcctacctgagtgatgtgattgagctgcagtggcacctggaggacaaggccaaccagctgcagcactttgagaagcagaagacagagctggaggaggccaatgccaagatccaggccgacatcgactacatgaatgaacatggccccctgctggacagcaagcagaaccaggagctgcaggacctgaagaaccactacaagaagaagatggaggtgatggacctgcacaggaaggtgaatgaggagctggaggaggccctggaggcctgtgaaaatgcccggctgaaggcccagcagatcaaggaggagattgacaaggacatctaccaggatgagaagaccatcgaggcctacaagcgggagatctaccagctgaacagcctgtttgaccactacagcagcagcgtcatcaacgtgaacaccaacatcgaggagaaggaggaggaggtgacagaggccatccgggagaccaagagcagcaagaatgagctgcacagcctgagcaagatgctggaggacctgcggcgggtgtatgaccagctgacctggaagcagaagagccatgagaaccagtacctggaggccgtgaatgacttctatgctgccaagaagacctgggacatcgagctgagtgatgtggccaaggacttcagcgccatcagcctggcctgcaccaagctgacagaggacaacaagaagctggagattgacatcaacaagatcaccgtgaagaccaatgaaagcatcaggaagaagagcaaatatgaaagtgagatcaagtacctgaccatcatgaagctgaagaatgacaagcacctgaagaacatctacaaggaggcctacagaattggcaccctcttccacctgaccaagcacaagacagatgagatggaggacaagattgctgaggtgcggaggaagttcaagggccgggaggagttcctgaagaagctgacccagggcgaggtggccgccggcatggtgctgcagaagaagctgtacagcatctatgaggtgcaggccctggagaggaaggagctgatcaagaacagagccatctgtgccatgagcctggccgagctgcaggagcccctgctgcagctggaggatgaggccgagcgcatccgcagcctggacaaggagcacagcgtgatgctgaacaacatcatcgaccagaaggacctgatccggaggaaggtgggcaaggtgaagaagaagctgaggaagaagggcaagaagaccctggatgccctgattgaaacagagagcaagaggtctgccatcttcaaggacctggaggccaccaagagcaagaccatgatcttctacgccaagatcaatgagctgaatgaggagctgaaggccaaggaggaggagaagaagagctttgaccagaccctggagatcctgaagaacaagttcatcaccatgaggttcaagcgggagcacgcccagacagtgtttgaccactacatgcaggagaagaaggactgtgaggagcgcatctttgaggaggaccagcgcttccgggtgctgctggccgtgcggcagaagaccctgcaggacacccagaagatcatcgctgacagcctggaggagaacctgcggctggcccaggagtaccagcagctgcagatcaccttcctgaaggagaaggacaactacttcaacatctatgacaagcagctgagcctggacaccagcatccgggacaagaagcagctgtgccagctgcagaggaggatgcacaccctgtggcaggagcacttcaagctggtggtgctcttcagccagatgaggctggccaacttccagacagacagccaggagagcatccagaagatcctggccgtgcaggaggagagcagcaacctgatgcagcacatcctgggcttcttccagaccctgacagatggcacctgtgaaaatgatggatag

SEQ ID NO: 36547 - DNA, 894 bp, Artificial Sequence
  Description of Artificial Sequence: Synthetic coding sequence
atgacagagaacaagacagtgagcagcagcagcaccagagatgaccagaccaacatcggcctgacctgccaggaggtgaaggccctgcgggagaaggcctggagcaggaccaatgaaggaaatgccatgagccagagcctggtgctgtatggagccagcaaagaaaattctgagggcttccacgagagcaagatgaccaacacagagggcgtgaacaagggcatctacttctcctacccctgccgccgccacagctgtgctgtggtgaacatcccagccccctgtgtgaacaagatgatcagccacatccaggatgtggagagcaagatccaggagcacctgaagagatttgagaccagctttgaggagtggagcaggaccagcagcaccaaggacctgaaggaggactggagcgtgaccacccctgtgaaggaggtgaagccaggagagaagagagatgagaagtgcccagagctgaagcaggagatggagaccctgctgtctgaggccatccgcctcatcaagagcctggagacagacagagcagatgctgaggaggccctgaagcagcagaggagcaggaagaacatgatcaacatgaagattgacagctggagcgtgtggaagctgcaggagctgcccctggccgtgcagaaggagcacgaggcctacctgagtgatgtgattgagctgcagtggcacctggaggacaaggccaaccagctgcagcactttgagaagcagaagacagagctggaggaggccaatgccaagatccaggccgacatcgactacatgaatgaacatggccccctgctggacagcaagcagaaccaggagctgcaggacctgaagaaccactacaagaagaagatcaagaagaagaagaagtag

SEQ ID NO: 36548 - DNA, 2454 bp, Artificial Sequence
  Description of Artificial Sequence: Synthetic coding sequence
atgacagagaacaagacagtgagcagcagcagcaccagagatgaccagaccaacatcggcctgacctgccaggaggtgaaggccctgcgggagaaggcctggagcaggaccaatgaaggaaatgccatgagccagagcctggtgctgtatggagccagcaaagaaaattctgagggcttccacgagagcaagatgaccaacacagagggcgtgaacaagggcatctacttctcctacccctgccgccgccacagctgtgctgtggtgaacatcccagccccctgtgtgaacaagatgatcagccacatccaggatgtggagagcaagatccaggagcacctgaagagatttgagaccagctttgaggagtggagcaggaccagcagcaccaaggacctgaaggaggactggagcgtgaccacccctgtgaaggaggtgaagccaggagagaagagagatgagaagtgcccagagctgaagcaggagatggagaccctgctgtctgaggccatccgcctcatcaagagcctggagacagacagagcagatgctgaggaggccctgaagcagcagaggagcaggaagaacatgatcaacatgaagattgacagctggagcgtgtggaagctgcaggagctgcccctggccgtgcagaaggagcacgaggcctacctgagtgatgtgattgagctgcagtggcacctggaggacaaggccaaccagctgcagcactttgagaagcagaagacagagctggaggaggccaatgccaagatccaggccgacatcgactacatgaatgaacatggccccctgctggacagcaagcagaaccaggagctgcaggacctgaagaaccactacaagaagaagatggaggtgatggacctgcacaggaaggtgaatgaggagctggaggaggccctggaggcctgtgaaaatgcccggctgaaggcccagcagatcaaggaggagattgacaaggacatctaccaggatgagaagaccatcgaggcctacaagcgggagatctaccagctgaacagcctgtttgaccactacagcagcagcgtcatcaacgtgaacaccaacatcgaggagaaggaggaggaggtgacagaggccatccgggagaccaagagcagcaagaatgagctgcacagcctgagcaagatgctggaggacctgcggcgggtgtatgaccagctgacctggaagcagaagagccatgagaaccagtacctggaggccgtgaatgacttctatgctgccaagaagacctgggacatcgagctgagtgatgtggccaaggacttcagcgccatcagcctggcctgcaccaagctgacagaggacaacaagaagctggagattgacatcaacaagatcaccgtgaagaccaatgaaagcatcaggaagaagagcaaatatgaaagtgagatcaagtacctgaccatcatgaagctgaagaatgacaagcacctgaagaacatctacaaggaggcctacagaattggcaccctcttccacctgaccaagcacaagacagatgagatggaggacaagattgctgaggtgcggaggaagttcaagggccgggaggagttcctgaagaagctgacccagggcgaggtggccgccggcatggtgctgcagaagaagctgtacagcatctatgaggtgcaggccctggagaggaaggagctgatcaagaacagagccatctgtgccatgagcctggccgagctgcaggagcccctgctgcagctggaggatgaggccgagcgcatccgcagcctggacaaggagcacagcgtgatgctgaacaacatcatcgaccagaaggacctgatccggaggaaggtgggcaaggtgaagaagaagctgaggaagaagggcaagaagaccctggatgccctgattgaaacagagagcaagaggtctgccatcttcaaggacctggaggccaccaagagcaagaccatgatcttctacgccaagatcaatgagctgaatgaggagctgaaggccaaggaggaggagaagaagagctttgaccagaccctggagatcctgaagaacaagttcatcaccatgaggttcaagcgggagcacgcccagacagtgtttgaccactacatgcaggagaagaaggactgtgaggagcgcatctttgaggaggaccagcgcttccgggtgctgctggccgtgcggcagaagaccctgcaggacacccagctgtgccagctgcagaggaggatgcacaccctgtggcaggagcacttcaagctggtggtgctcttcagccagatgaggctggccaacttccagacagacagccaggagagcatccagaagatcctggccgtgcaggaggagagcagcaacctgatgcagcacatcctgggcttcttccagaccctgacagatggcacctgtgaaaatgatggatag

SEQ ID NO: 36549 - DNA, 2604 bp, Artificial Sequence; identical to SEQ ID NO: 36546
  Description of Artificial Sequence: Synthetic coding sequence

SEQ ID NO: 36550 - DNA, 2676 bp, Artificial Sequence
  Description of Artificial Sequence: Synthetic coding sequence
atgacagagaacaagacagtgagcagcagcagcaccagagatgaccagaccaacatcggcctgacctgccaggaggtgaaggccctgcgggagaaggcctggagcaggaccaatgaaggaaatgccatgagccagagcctggtgctgtatggagccagcaaagaaaattctgagggcttccacgagagcaagatgaccaacacagagggcgtgaacaagggcatctacttctcctacccctgccgccgccacagctgtgctgtggtgaacatcccagccccctgtgtgaacaagatgatcagccacatccaggatgtggagagcaagatccaggagcacctgaagagatttgagaccagctttgaggagtggagcaggaccagcagcaccaaggacctgaaggaggactggagcgtgaccacccctgtgaaggaggtgaagccaggagagaagagagatgagaagtgcccagagctgaagcaggagatggagaccctgctgtctgaggccatccgcctcatcaagagcctggagacagacagagcagatgctgaggaggccctgaagcagcagaggagcaggaagaacatgatcaacatgaagattgacagctggagcgtgtggaagctgcaggagctgcccctggccgtgcagaaggagcacgaggcctacctgagtgatgtgattgagctgcagtggcacctggaggacaaggccaaccagctgcagcactttgagaagcagaagacagagctggaggaggccaatgccaagatccaggccgacatcgactacatgaatgaacatggccccctgctggacagcaagcagaaccaggagctgcaggacctgaagaaccactacaagaagaagatggaggtgatggacctgcacaggaaggtgaatgaggagctggaggaggccctggaggcctgtgaaaatgcccggctgaaggcccagcagatcaaggaggagattgacaaggacatctaccaggatgagaagaccatcgaggcctacaagcgggagatctaccagctgaacagcctgtttgaccactacagcagcagcgtcatcaacgtgaacaccaacatcgaggagaaggaggaggaggtgacagaggccatccgggagaccaagagcagcaagaatgagctgcacagcctgagcaagatgctggaggacctgcggcgggtgtatgaccagctgacctggaagcagaagagccatgagaaccagtacctggaggccgtgaatgacttctatgctgccaagaagacctgggacatcgagctgagtgatgtggccaaggacttcagcgccatcagcctggcctgcaccaagctgacagaggacaacaagaagctggagattgacatcaacaagatcaccgtgaagaccaatgaaagcatcaggaagaagagcaaatatgaaagtgagatcaagtacctgaccatcatgaagctgaagaatgacaagcacctgaagaacatctacaaggaggcctacagaattggcaccctcttccacctgaccaagcacaagacagatgagatggaggacaagattgctgaggtgcggaggaagttcaagggccgggaggagttcctgaagaagctgacccagggcgaggtggccgccggcatggtgctgcagaagaagctgtacagcatctatgaggtgcaggccctggagaggaaggagctgatcaagaacagagccatctgtgccatgagcctggccgagctgcaggagcccctgctgcagctggaggatgaggccgagcgcatccgcagcctggacaaggagcacagcgtgatgctgaacaacatcatcgaccagaaggacctgatccggaggaaggtgggcaaggtgaagaagaagctgaggaagaagggcaagaagaccctggatgccctgattgaaacagagagcaagaggtctgccatcttcaaggacctggaggccaccaagagcaagaccatgatcttctacgccaagatcaatgagctgaatgaggagctgaaggccaaggaggaggagaagaagagctttgaccagaccctggagatcctgaagaacaagttcatcaccatgaggttcaagcgggagcacgcccagacagtgtttgaccactacatgcaggagaagaaggactgtgaggagcgcatctttgaggaggaccagcgcttccgggtgctgctggccgtgcggcagaagaccctgcaggacacccagaagatcatcgctgacagcctggaggagaacctgcggctggcccaggagtaccagcagctgcagatcaccttcctgaaggagaaggacaactacttcaacatctatgacaagcagctgagcctggacaccagcatccgggacaagaagcaggtggccggcttcctgcccaagaagctgcccaacagcctgcccatcatcagtgatgagctgagcaacttccagctgtgccagctgcagaggaggatgcacaccctgtggcaggagcacttcaagctggtggtgctcttcagccagatgaggctggccaacttccagacagacagccaggagagcatccagaagatcctggccgtgcaggaggagagcagcaacctgatgcagcacatcctgggcttcttccagaccctgacagatggcacctgtgaaaatgatggatag

SEQ ID NO: 36551 - DNA, 210 bp, Artificial Sequence
  Description of Artificial Sequence: Synthetic coding sequence
atggtgtttgcccctggagagaagccaggaaatgaacctgaggaggtgaagctgcagaatgccagcaagcagatcgtgcagaatgccatcctgcaggccgtgcagcaggtgtcccaggagagccagaggcgggaggagcgcatcagtgacaacagagaccacatccagctgggcgtgggggagctgaccaagaagcatgagaagaagtag

SEQ ID NO: 36552 - DNA, 372 bp, Artificial Sequence
  Description of Artificial Sequence: Synthetic coding sequence
atgaccccagccagcggggccacagccagcctgggccgcctgcgggcccggcccaggagccgctgggatgctgcctacctgcctgctgtggccgctgtgtgtgtggcccgggccagccacgtgcccaacggcaccctgcgcttcggcgtgtgcaaggcccggaggaccatgaggcccctgccccggcgcatcgaggtgaggaccaagaggggcccccagaggcctgctgcccctgagaggagcccccagccccggctgccccccagccgccaccccagccggcggggcccccggcggcacctgagcggctgcagcgccccagcctgccgcatccccaccggctgccgctgcccctgtggccggcccagctag

SEQ ID NO: 36553 - DNA, 2058 bp, Artificial Sequence
  Description of Artificial Sequence: Synthetic coding sequence
atgaatgacagccggcagcagagcctcttcttcatcaccctgcctgacctgaacaagctgtgtgctgtgcgcatcatcctgagcaacaaggtggccgacacagagatccgcaccatccagatgaagatgtgccggcagctgctcttcctgcaccaggacatcctgaccagccctgtgtctggcatcctgaaccagatctgggtggtgatggccatccccttctacaaggccaggaagctgaatgcctacgtggagaagtatggagccaagatggaggccccccagagggtcatccctgtgatcctgcagaactgcctgagctacagcttcatggcccggctggccccagcctggaacagaacaggccacctgctgatccagggccgggacttcctgagccagatgggcaagcagagcgctgtggtgctgaacatcaacgtgacagagacccaggtgtgcctgagcattgaggcctgcaccatccggctgcctgcccctgagctgaaggagtttgagatcagccagagcatcatcaaggacttccacgccaacaagcatgctgtgattgagcggcacagcatcctgagcaactggtgctacgtgctgcccagcatgaagatgggccagatcatcaacatcttccacgccatcccagctgcctgccccttccacagctatggagacttccagaggcactgggatgccctgtatggctacaagctgcccggggactgtgggaagatcaagatctactgcaacatctacttcaagatgctgggggagaggaccttcacctaccccctgagctgcatccgcagccagcccatgcagttcttcccccgggtggacagcgaggtggtgctgaagagcttcctgagtgacctgaagagcaagctgccccacatctgtggcttccccatcaagatgaccagcaagccctgctactacacccaggagctgaccaagcccaacatccaggagcacaaggtgaagccacccaacctgaccaccaagaagatgctgcgggccagcctgacccaggccaccagcaggaagccagcctgtgcccagagcctgctgccctgcagcgtggccgtggaccacaaggtggagctgtctgtgtcccagcccaccagcggcatcttcagcgccctgcacctgcagcctgagagcgtgcagggcaggaagaagagcctgagcatccgggccccccaggtgcacagcgaggtgctgatgcccaacagaggcaacacccaggtgcagcacaccaacctgagcagccagagcaacatcacccccaagtttgtgcctgtgttcaagaaccggctgctgcagatgaacaagaacacctctgtgctgggcagccccaagaggaagcagcatgatgtgacccagagcaagctgttcagcctgaagacctccatgatccagcacgacaagctgaacctgggccctgccatcaagaaccgctacagcagcaacatccagatgcaggccgccaacaacctgaaccaggagaacagccggcccctgcaggagaagaacacagagagcagcgagaacatgaccaagttccccagcagccggggcaagagcacagtgtccctgaacaagaacaagcagctgagcaacagcgctgtgtttgtggtgagcaacaacaacctgggcgtggtgaagtctgctgtggacttccagatgaagggcaaggagaacctgaccgggaagggcatcacccagatcctgggcaagagccacggcagcctgaagctgaagaggcagccccacatctttgaaagtgatggagaaacagaggacccccggctgctgcagcagcagagcgagaaccaggccaaggaggtgggcaccagtgaccacaggctcatcgtgtccaagatcgcccacaggagcaagaggaagctgtgcccagagagcagcaagaccagcaagaagcaccacagcgacacagtgcactacggccagagcagcagcagcaagaagcagatcctggacagcgacaagagcaagctgaagaagagcctcatcatccacaatgcctag

SEQ ID NO: 36554 - DNA, 1974 bp, Artificial Sequence
  Description of Artificial Sequence: Synthetic coding sequence
atgggagaggaggactactacctggagctgtgtgagaggcctgtgcagtttgagaaggccaaccctgtgaactgtgtgttctttgatgaggccaacaagcaggtgtttgctgtgcgcagcggcggggccaccggggtggtggtgaagggcccagatgacaggaaccccatctccttcaggatggatgacaagggggaggtgaagtgcatcaagttcagcctggagaacaagatcctggccgtgcagaggaccagcaagacagtggacttctgcaacttcatcccagacaacagccagctggagtacacccaggagtgcaagaccaagaatgccaacatcctgggcttctgctggaccagcagcacagagatcgtgttcatcacagaccagggcatcgagttctaccaggtgctgcctgagaagaggagcctgaagctgctgaagagccacaacctgaatgtgaactggtacatgtactgcccagagagcgctgtgatcctgctgagcaccaccgtgctggagaatgtgctgcagcccttccacttccgggccggcaccatgagcaagctgcccaagtttgaaattgagctgcctgctgcccccaagagcaccaagcccagcctgtctgagcgggacatcgccatggccaccatctacggccagctgtatgtgctcttcctgcggcaccacagcaggaccagcaacagcactggagctgaggtggtgctgtaccacctgccccgggagggcgcctgcaagaagatgcacatcctgaagctgaacagaacaggcaagtttgccctgaatgtggtggacaacctggtggtggtgcaccaccaggacacagagaccagcgtcatctttgacatcaagctgcggggggagtttgatggctctgtgaccttccaccaccctgtgctgcctgcccggagcatccagccctaccagatccccatcaccggccctgctgctgtgaccagccagagccctgtgccctgcaagctgtacagcagctcctggatcgtgttccagcctgacatcatcatcagcgccagccagggctacctgtggaacctgcaggtgaagctggagcccatcgtgaacctgctgcctgacaagggccgcctgatggacttcctgctgcagaggaaagaatgcaagatggtgatcctgtctgtgtgcagccagatgctgtctgagagtgaccgggccagcctgcctgtgattgccaccgtgtttgacaagctgaaccacgagtacaagaagtacctggatgctgagcagagctatgccatggctgtggaggccggccagagccgcagcagccccctgctgaagaggcctgtgaggacccaggccgtgctggaccagagtgatgtgtacacccacgtgctgagcgcctttgtggagaagaaggagatgccccacaagtttgtgattgctgtgctgatggagtacatccgcagcctgaaccagttccagattgctgtgcagcactacctgcacgagctggtgatcaagaccctggtgcagcacaacctcttctacatgctgcaccagttcctgcagtaccacgtgctgagtgacagcaagcccctggcctgcctgctgctgagcctggagagcttctaccccccagcccaccagctgagcctggacatgctgaagaggctgagcacagccaatgatgaaattgtggaggtgctgctgagcaagcaccaggtgctggccgccctgcgcttcatccggggcattggaggccatgacaacatcagcgccaggaagttcctggatgctgccaagcagacagaggacaacatgctgttctacaccatcttccgcttctttgagcagaggaaccagaggctgcggggcagccccaacttcaccccaggagagcactgtgaggagcacgtggccttcttcaagcagatctttggagaccaggccctgatgaggcccaccaccttctag

SEQ ID NO: 36555 - DNA, 1830 bp, Artificial Sequence
  Description of Artificial Sequence: Synthetic coding sequence
atgggagaggaggactactacctggagctgtgtgagaggcctgtgcagtttgagaaggccaaccctgtgaactgtgtgttctttgatgaggccaacaagcaggtgtttgctgtgcgcagcggcggggccaccggggtggtggtgaagggcccagatgacaggaaccccatctccttcaggatggatgacaagggggaggtgaagtgcatcaagttcagcctggagaacaagatcctggccgtgcagaggaccagcaagacagtggtgctgcctgagaagaggagcctgaagctgctgaagagccacaacctgaatgtgaactggtacatgtactgcccagagagcgctgtgatcctgctgagcaccaccgtgctggagaatgtgctgcagcccttccacttccgggccggcaccatgagcaagctgcccaagtttgaaattgagctgcctgctgcccccaagagcaccaagcccagcctgtctgagcgggacatcgccatggccaccatctacggccagctgtatgtgctcttcctgcggcaccacagcaggaccagcaacagcactggagctgaggtggtgctgtaccacctgccccgggagggcgcctgcaagaagatgcacatcctgaagctgaacagaacaggcaagtttgccctgaatgtggtggacaacctggtggtggtgcaccaccaggacacagagaccagcgtcatctttgacatcaagctgcggggggagtttgatggctctgtgaccttccaccaccctgtgctgcctgcccggagcatccagccctaccagatccccatcaccggccctgctgctgtgaccagccagagccctgtgccctgcaagctgtacagcagctcctggatcgtgttccagcctgacatcatcatcagcgccagccagggctacctgtggaacctgcaggtgaagctggagcccatcgtgaacctgctgcctgacaagggccgcctgatggacttcctgctgcagaggaaagaatgcaagatggtgatcctgtctgtgtgcagccagatgctgtctgagagtgaccgggccagcctgcctgtgattgccaccgtgtttgacaagctgaaccacgagtacaagaagtacctggatgctgagcagagctatgccatggctgtggaggccggccagagccgcagcagccccctgctgaagaggcctgtgaggacccaggccgtgctggaccagagtgatgtgtacacccacgtgctgagcgcctttgtggagaagaaggagatgccccacaagtttgtgattgctgtgctgatggagtacatccgcagcctgaaccagttccagattgctgtgcagcactacctgcacgagctggtgatcaagaccctggtgcagcacaacctcttctacatgctgcaccagttcctgcagtaccacgtgctgagtgacagcaagcccctggcctgcctgctgctgagcctggagagcttctaccccccagcccaccagctgagcctggacatgctgaagaggctgagcacagccaatgatgaaattgtggaggtgctgctgagcaagcaccaggtgctggccgccctgcgcttcatccggggcattggaggccatgacaacatcagcgccaggaagttcctggatgctgccaagcagacagaggacaacatgctgttctacaccatcttccgcttctttgagcagaggaaccagaggctgcggggcagccccaacttcaccccaggagagcactgtgaggagcacgtggccttcttcaagcagatctttggagaccaggccctgatgaggcccaccaccttctag

SEQ ID NO: 36556 - DNA, 1503 bp, Artificial Sequence
  Description of Artificial Sequence: Synthetic coding sequence
atgtactgcccagagagcgctgtgatcctgctgagcaccaccgtgctggagaatgtgctgcagcccttccacttccgggccggcaccatgagcaagctgcccaagtttgaaattgagctgcctgctgcccccaagagcaccaagcccagcctgtctgagcgggacatcgccatggccaccatctacggccagctgtatgtgctcttcctgcggcaccacagcaggaccagcaacagcactggagctgaggtggtgctgtaccacctgccccgggagggcgcctgcaagaagatgcacatcctgaagctgaacagaacaggcaagtttgccctgaatgtggtggacaacctggtggtggtgcaccaccaggacacagagaccagcgtcatctttgacatcaagctgcggggggagtttgatggctctgtgaccttccaccaccctgtgctgcctgcccggagcatccagccctaccagatccccatcactggacctgctgctgtgaccagccagagccctgtgccctgcaagctgtacagcagctcctggatcgtgttccagcctgacatcatcatcagcgccagccagggctacctgtggaacctgcaggtgaagctggagcccatcgtgaacctgctgcctgacaagggccgcctgatggacttcctgctgcagaggaaggagtgcaagatggtgatcctgtctgtgtgcagccagatgctgtctgagagtgaccgggccagcctgcccgtcatcgccaccgtgtttgacaagctgaaccacgagtacaagaagtacctggatgctgagcagagctatgccatggctgtggaggccggccagagccgcagcagccccctgctgaagaggcctgtgaggacccaggccgtgctggaccagagtgatgtgtacacccacgtgctgagcgcctttgtggagaagaaggagatgccccacaagtttgtgattgctgtgctgatggagtacatccgcagcctgaaccagttccagattgctgtgcagcactacctgcacgagctggtgatcaagaccctggtgcagcacaacctcttctacatgctgcaccagttcctgcagtaccacgtgctgagtgacagcaagcccctggcctgcctgctgctgagcctggagagcttctaccccccagcccaccagctgagcctggacatgctgaagaggctgagcacagccaatgatgagatcgtggaggtgctgctgagcaagcaccaggtgctggccgccctgcgcttcatccggggcatcggcggccatgacaacatcagcgccaggaagttcctggatgctgccaagcagacagaggacaacatgctgttctacaccatcttccgcttctttgagcagaggaaccagaggctgcggggcagccccaacttcaccccaggagagcactgtgaggagcacgtggccttcttcaagcagatctttggagaccaggccctgatgaggcccaccaccttctag

SEQ ID NO: 36557 - DNA, 1359 bp, Artificial Sequence
  Description of Artificial Sequence: Synthetic coding sequence
atgtactgcccagagagcgctgtgatcctgctgagcaccaccgtgctggagaatgtgctgcagcccttccacttccgggccggcaccatgagcaagctgcccaagtttgaaattgagctgcctgctgcccccaagagcaccaagcccagcctgtctgagcgggacatcgccatggccaccatctacggccagctgtatgtgctcttcctgcggcaccacagcaggaccagcaacagcactggagctgaggtggtgctgtaccacctgccccgggagggcgcctgcaagaagatgcacatcctgaagctgaacagaacaggcaagtttgccctgaatgtggtggacaacctggtggtggtgcaccaccaggacacagagaccagcgtcatctttgacatcaagctgcggggggagtttgatggctctgtgaccttccaccaccctgtgctgcctgcccggagcatccagccctaccagatccccatcactggacctgctgctgtgaccagccagagccctgtgccctgcaagctgtacagcagctcctggatcgtgttccagcctgacatcatcatcagcgccagccagggctacctgtggaacctgcaggtgaagctggagcccatcgtgaacctgctgcctgacaagggccgcctgatggacttcctgctgcagaggaaggagtgcaagatggtgatcctgtctgtgtgcagccagatgctgtctgagagtgaccgggccagcctgcccgtcatcgccaccgtgtttgacaagctgaaccacgagtacaagaagtacctggatgctgagcagagctatgccatggctgtggaggccggccagagccgcagcagccccctgctgaagaggcctgtgaggacccaggccgtgctggaccagagtgatgtgtacacccacgtgctgagcgcctttgtggagaagaaggagatgccccacaagtttgtgattgctgtgctgatggagtacatccgcagcctgaaccagttccagattgctgtgcagcactacctgcacgagctggtgatcaagaccctggtgcagcacaacctcttctacatgctgcaccagttcctgcagtaccacgtgctgagtgacagcaagcccctggcctgcctgctgctgagcctggagagcttctaccccccagcccaccagctgagcctggacatgctgaagatgctgcagagccggctgaagaccacctgcttcagcatccagtacagcgccttcctgaacagcgagacctctgtgtgtgagggcgcccccatcagccaccagggcaacacagtgaagaacatgctgctcttcagcaaccgcttcctggagaccaagctgtag

SEQ ID NO: 36558 - DNA, 711 bp, Artificial Sequence
  Description of Artificial Sequence: Synthetic coding sequence
atggcccggcccctggtgcccagcagccagaaggccctgctgctggagctgaagggcctgcaggaggagcctgtggagggcttccgggtgaccctggtggatgaaggagacctgtacaactgggaggtggccatcttcggcccccccaacacctactatgaaggaggctacttcaaggcccggctgaagttccccatcgactacccctacagccccccagccttccgcttcctgaccaagatgtggcaccccaacatctatgaaacaggagatgtgtgcatcagcatcctgcacccccctgtggatgacccccagagcggggagctgcccagcgagcgctggaaccccacccagaatgtgaggaccatcctgctgagcgtcatcagcctgctgaatgagcccaacaccttctccccagccaacgtggatgcctctgtgatgtacaggaagtggaaggagagcaagggcaaggaccgggagtacacagacatcatcaggaagcaggtgctgggcaccaaggtggatgctgagagagatggagtgaaggtgcccaccaccctggccgagtactgtgtgaagaccaaggccccagccccagatgagggcagtgacctcttctatgatgactactatgaagatggagaggtggaggaggaggccgacagctgctttggagatgatgaagatgattctggaacagaggagagctag

SEQ ID NO: 36559 - DNA, 486 bp, Artificial Sequence
  Description of Artificial Sequence: Synthetic coding sequence
atgggcagcaaggccaagaagagggtgctgctgcccaccaggcctgcccccccaacagtggagcagatcctggaggatgtgcggggggccccagcagaagatcctgtgttcaccatcctggccccagaagatcctcctgtgcccttcaggatgatggaggatgctgaggcccctggagagcagctgtaccagcagagccgggcctacgtggccgccaaccagaggctgcagcaggccggaaatgtgccccggctgcccccccaggccgacctgagcggccctgctggcctgggcagcgcccagggcggcctgcaccctggcttcccctggggctctgtgggcccccggctggccttcaccggcagccagcccacctgggtgctgacccaggcccccctgctgatgctgggcctgcgcttcatccggcggctcatccatgctgagctggtgggccccacccagctggcccccagctgtgtgacctag

SEQ ID NO: 36560 - DNA, 477 bp, Artificial Sequence
  Description of Artificial Sequence: Synthetic coding sequence
atgggcagcaaggccaagaagagggtgctgctgcccaccaggcctgcccccccaacagtggagcagatcctggaggatgtgcggggggccccagcagaagatcctgtgttcaccatcctggcccctgagggccggggcagccctgtgcctgggaagagcggccctgagaccccagctgcccggggccgggagaggagcacccccctgaccccagaccccaccccctgggagcccccccagcacggccatgacccccctgtgcccttcaggatgatggaggatgctgaggcccctggagagcagctgtaccagcagagccgggcctacgtggccgccaaccagaggctgcagcaggccggaaatgtgctgcggcagagatgtgagctgctgcagagagctggggaggacctggagcgggaggtggcccagatgaagcaggccgccctgcctgctgctgaggccgccagcagtggatag

SEQ ID NO: 36561 - DNA, 357 bp, Artificial Sequence
  Description of Artificial Sequence: Synthetic coding sequence
atgggcagcaaggccaagaagagggtgctgctgcccaccaggcctgcccccccaacagtggagcagatcctggaggatgtgcggggggccccagcagaagatcctgtgttcaccatcctggccccagaagatcctcctgtgcccttcaggatgatggaggatgctgaggcccctggagagcagctgtaccagcagagccgggcctacgtggccgccaaccagaggctgcagcaggccggaaatgtgctgcggcagagatgtgagctgctgcagagagctggggaggacctggagcgggaggtggcccagatgaagcaggccgccctgcctgctgctgaggccgccagcagtggatag

SEQ ID NO: 36562 - DNA, 507 bp, Artificial Sequence
  Description of Artificial Sequence: Synthetic coding sequence
atgctgcctgctgccctgctgcggcggcccggcctgggccgcctggtgagacatgcccgggcctatgcagaggccgctgctgccccagctgctgccagcggccccaaccagatgtccttcacctttgccagccccacccaggtgttcttcaatggagccaacgtgcggcaggtggatgtgcccaccctgaccggggccttcggcatcctggccgcccacgtgcccaccctgcaggtgctgcggcccggcctggtggtggtgcatgctgaagatggcaccaccagcaagtactttgtgagcagcggcagcattgctgtgaatgctgacagctctgtgcagctgctggccgaggaggccgtgaccctggacatgctggacctgggcgccgccaaggccaacctggagaaggcccaggccgagctggtgggcacagcagatgaggccaccagggctgagatccagatcagaattgaggccaatgaggccctggtgaaggccctggagtag

SEQ ID NO: 36563 - DNA, 1422 bp, Artificial Sequence
  Description of Artificial Sequence: Synthetic coding sequence
atgagcagccctgagcccccaacagagcccccagagccagacaaccccacctggagcacccagcccacctacagcaacctgggccagatccgggcccacctgctgcccagcaaggcctgccgcctgcggaccccaggcagcctgagcaccaaccctgagcccctgcccccacccctgcccaagaagatcctgaccaggacccagagcctgcccaccaggaggaccctgcaccccagcagcatccaggtgcagcccccaagaagacccttcctgggcagccacagcgtggacaagagccaggccgctgtgggccctgcctgcctgcctgctgagctgaccttcggccctgcagatgcccccctgggcctgagcctgcgggacctgcacagccctgaggccgtgcacacagccctggccgcccggcagctgcagggcctgcggaccatctatgcccggctgcgggcccggctgatgggcggccaccctggcccctgccaccctggccacagcttccggctgctggacagcagcccctgtgccgagagcggagatgccctgtactacagagtggtgcgggcccatgaagatgcctggcacatcctggtggccaaggtgcccaagccaggagcagatgtgccccacccctggggcctggagctgcaggccagcctgagcccccacttcaacctgcagggcctgtgtggcctggtgcctgagggcaccctgcccggggccccctggagaggagctgtggccctggccgctgaggtgcctgagaggacagtggcccagtggctggccgaggcctgcacccagcccccagaggagtttgtgtgggccgtggccctgctgctgctgcagctgtctgctgccctgaagttcctggaggcctggggcgccgccctggtggagctgcggcctgagaacctgctgctggtggccccccggggctgtgccaccactggaccaccccggctgctgctgacagactttggccgggtgtgcctgcagcccccaggccccccaggcagccctggcccccacgccccccagctgggcagcctgctgcgggccctgctgagcctggccgcccccagcaccacccccctggccgccggcctggagctgctggccgcccagctgacccggctgcggcccagcgccagcaggaccaggggggccctgcaggccctgctgtggggccctggccctgagctgcggggccgcggggcccccctgggcccctggctgcgggccctgggcccctggctgcgggtgagaagaggcctgctggtgctgcggctggccgagagagctgctggaggagaggcccccagcctggaggactggctgtgctgtgagtacctggccgaggccacagagagctccatgggccaggccctggccctgctgtgggactag

SEQ ID NO: 36564 - DNA, 228 bp, Artificial Sequence
  Description of Artificial Sequence: Synthetic coding sequence
atgattggagacatcctgctgtttggcaccctgctgatgaatgctggagctgtgctgaacttcaagctgaagaagaaggacacccagggctttggagaggagagccgggagcccagcactggagacaacatccgggagttcctgctgagcctgcgctacttccgcatcttcatcgccctgtggaacatcttcatgatgttctgcatgattgtgctgtttggcagctag

SEQ ID NO: 36565 - DNA, 531 bp, Artificial Sequence
  Description of Artificial Sequence: Synthetic coding sequence
atggccgcccggggccggcgggcagagccccagggccgggaggcccctggccctgctgggggcggcggcggcggcagccgctgggccgagagcggcagcggcaccagccctgagagcggagatgaggaggtgtctggagctggcagcagccctgtgtctggaggagtgaacctgtttgccaatgatggcagcttcctggagctgttcaagaggaagatggaggaggagcagaggcagaggcaggaggagcccccacctggcccccagaggccagaccagagcgctgctgctgctggccctggggaccccaagaggaagggcggccctggcagcaccctgagctttgtgggcaagagaagaggaggcaacaagctggccctgaagacaggaattgtggccaagaagcagaagacagaagatgaggtgctgaccagcaaaggagatgcctgggccaagtacatggccgaggtgaagaagtacaaggcccaccagtgtggagatgatgacaagacccggcccctggtgaagtag

SEQ ID NO: 36566 - DNA, 1518 bp, Artificial Sequence
  Description of Artificial Sequence: Synthetic coding sequence
atggccactggagccctgctgccctgcagccggccctgccccatgagccggctggacttcctgaaggccagccacttcagcctgggccctgacctgcggctgcacgagggcaccatgaggaccaccagccaccgggactttgcctacccagctgccacccgggagccccccagcctgcagcccccaccagccctgctcttccccatggacccccgctgggaccgggaggagcgggtgtctgaggcccaccgggccttccccccacccagcaccccaccctgggagctgctgcaggcccaggcccgggagaggaccctggccatgcaggccggcaacctgcacctgcatgaagatgcccatgctggcatcggcctgagcaatgcccacgccgcctacggctggccagagctgcctgcccggacccgggagcgcatccggggggcccggctcatctttgaccgggacagcctgcccccaggggaccgggacaagctgcgcatcccccccaccacccaccaggccctcttcccccctcatgatgcccggccccagccccgggcccccagctgccacctgggcggccccaacaccctgaagtgggactacacccggcaggacggcaccagctaccagaggcagttccaggccctgcccggccccccagccctgcgctgcaagagggccagcagcggcgtggagctgggggactgcaagatctcctatggcagcacctgcagcgagcagaagcaggcctaccggccccaggacctgcctgaagatagatatgacaaggcccaggccacagcccacatccactgtgtgaacatccggcctggagatggcctcttccgggacaggaccaccaaggccgagcacttctacgcccgggagcctgagccctttgtgctgcaccacgaccagaccccagagagccacatcctgaagggcaactggtgccccggccctggcagcctggacaccttcatgcagtacttctacggccagcccccaccacccacccagccccccagccgccacgtgccccatgagaagctgcagagccacgtgaccctgggggagcccaagctgctgaagcgcttcttcaagaccaccatgggcagtgactactgccccagcgagtggaggcaggtgcagaaggcccccaacctgcacctgcagcagagctacctgccccggggcactggagaatttgacttcctgaccatgaaccagaagatgctgaagccccacaggaccccaccagcccctgtgacagaggagatgctgcagcgctgcaagtacagccacatggagccccccctgggcggcctgcgcttcttcagcacccagtacaaggatgagttccccttcaagtaccagggccctgctgccctgcggctgaagaacccccaggagggctttgtgcccctgggcaccccccaccagaggggctgccgggagaagattgaccccctggtgccccagccccccatgtacctgtgccccagccagcagtag

SEQ ID NO: 36567 - DNA, 672 bp, Artificial Sequence
  Description of Artificial Sequence: Synthetic coding sequence
atggccactggagccctgctgccctgcagccggccctgccccatgagccggctggacttcctgaaggccagccacttcagcctgggccctgacctgcggctgcacgagggcaccatgaggaccaccagccaccgggactttgcctacccagctgccacccgggagccccccagcctgcagcccccaccagccctgctcttccccatggacccccgctgggaccgggaggagcgggtgtctgaggcccaccgggccttccccccacccagcaccccaccctgggagctgctgcaggcccaggcccgggagaggaccctggccatgcaggccggcaacctgcacctgcatgaagatgcccatgctggcatcggcctgagcaatgcccacgccgcctacggctggccagagctgcctgcccggacccgggagcgcatccggggggcccggctcatctttgaccgggacagcctgcccccaggggaccgggacaagctgcgcatcccccccaccacccaccaggccctcttcccccctcatgatgcccggccccagccccgggcccccagctgccacctgggcggccccaacaccctgaagtgggactacacccggcaggacggcaccagctaccagaggcagttccaggccctgcccggccccccagccctgtag

SEQ ID NO: 36568 - DNA, 579 bp, Artificial Sequence
  Description of Artificial Sequence: Synthetic coding sequence
atggccactggagccctgctgccctgcagccggccctgccccatgagccggctggacttcctgaaggccagccacttcagcctgggccctgacctgcggctgcacgagggcaccatgaggaccaccagccaccgggactttgcctacccagctgccacccgggagccccccagcctgcagcccccaccagccctgctcttccccatggacccccgctgggaccgggaggagcgggtgtctgaggcccaccgggccttccccccacccagcaccccaccctgggagctgctgcaggcccaggcccgggagaggaccctggccatgcaggccggcaacctgcacctgcatgaagatgcccatgctggcatcggcctgagcaatgcccacgccgcctacggctggccagagctgcctgcccggacccgggagcgcatccggggggcccggctcatctttgaccgggacagcctgcccccaggggaccgggacaagctgcgcatcccccccaccacccaccaggccctcttcccccctcatgatgcccggccccagccccgggcccccagctgccacctgtag

SEQ ID NO: 36569 - DNA, 1269 bp, Artificial Sequence
  Description of Artificial Sequence: Synthetic coding sequence
atggtgatggccgccctgagcctggtggccgcctgctggggccgggctgctgctgatgaatctgtgcagctgcctgctgcccctggcagctctgtgcgggcccgggagaccatggtgtctgtgaccatggccaccagcgagtggatccagttcttcaaggaggccggcatccccccaggccctgctgtgaactatgctgtgatgtttgtggacaaccgcatccagaagtccatgctgctggacctgaacaaggagatcatgaatgagctgggcgtgacagtggtgggggacatcatcgccatcctgaagcacgccaaggtggtgcaccggcaggacatgtgcaaggccgccacagagagcgtgccctgcagccccagccccctggccggggagatcagaagaggcaccagcgctgccagcaggatgatcaccaacagcctgaaccacgacagcccccccagcaccccaccccggcggccagacaccagcaccagcaagatctctgtgacagtgagcaacaagatggccgccaagagcgccaaggccacagctgccctggcccggcgggaggaggagagcctggccgtgcctgccaagagaagaagagtgacagctgagatggagggcaagtatgtgatcaacatgcccaagggcaccacccccaggaccaggaagatcctggagcagcagcaggccgccaagggcctgcacaggacctctgtgtttgaccggctgggcgctgagaccaaggctgacaccaccaccggcagcaagcccaccggggtcttcagccggctgggcgccaccccagagacagatgaggacctggcctgggacagcgacaatgacagcagcagctctgtgctgcagtatgctggggtgctgaagaagctgggccggggccctgccaaggccagcccccagcctgccctgactgtgaaggccaaggccaccagcagcgccaccacagctgctgcccccaccctgcggcggctggccctgagcagccgcagcggcctggagaggaagccagagagcctgagcaaggtgtccatcatcaagaggctgggcgctgctgccctggtgcctgaggcccaggacagccaggtgaccagcaccaagagcaagagcagcgctgaggtgaaggtgaccatcaagaggaccctggtgggcccccggggcagcagcagcagcgagggcctgggcgcccagatggaccacgccggcaccgtgtctgtgttcaagaggctgggccgccgcaccttctag

SEQ ID NO: 36570 - DNA, 1068 bp, Artificial Sequence
  Description of Artificial Sequence: Synthetic coding sequence
atgtttgtggacaaccgcatccagaagtccatgctgctggacctgaacaaggagatcatgaatgagctgggcgtgacagtggtgggggacatcatcgccatcctgaagcacgccaaggtggtgcaccggcaggacatgtgcaaggccgccacagaatctgtgccctgcagccccagccccctggccggggagatccggcggggcaccagcgctgccagcaggatgatcaccaacagcctgaaccacgacagcccccccagcaccccaccaagaagaccagacaccagcaccagcaagatctctgtgacagtgagcaacaagatggccgccaagagcgccaaggccacagctgccctggcccggcgggaggaggagagcctggccgtgcctgccaagagaagaagagtgacagctgagatggagggcaagtatgtgatcaacatgcccaagggcaccacccccaggaccaggaagatcctggagcagcagcaggccgccaagggcctgcacaggacctctgtgtttgaccggctgggcgctgagaccaaggctgacaccaccaccggcagcaagcccactggagtcttcagccggctgggcgccaccccagagacagatgaggacctggcctgggacagcgacaatgacagcagcagctctgtgctgcagtatgccggcgtgctgaagaagctgggccggggccctgccaaggccagcccccagcctgccctgactgtgaaggccaaggccaccagcagcgccaccacagctgctgcccccaccctgcggcggctggccctgagcagccgcagcggcctggagaggaagccagagagcctgagcaaggtgtccatcatcaagaggctgggcgccgccgccctggtgcctgaggcccaggacagccaggtgaccagcaccaagagcaagagcagcgctgaggtgaaggtgaccatcaagaggaccctggtgggcccccggggcagcagcagcagcgagggcctgggcgcccagatggaccatgctggcaccgtgtctgtgttcaagaggctgggccgccgcaccttctag

SEQ ID NO: 36571 - DNA, 1269 bp, Artificial Sequence; identical to SEQ ID NO: 36569
  Description of Artificial Sequence: Synthetic coding sequence

SEQ ID NO: 36572 - DNA, 354 bp, Artificial Sequence
  Description of Artificial Sequence: Synthetic coding sequence
atgacagtgctggaggccgtgctggagatccaggccatcaccggcagccggctgctgtccatggtgcccggccctgcccggcccccaggcagctgctgggaccccacccagtgcaccaggacctggctgctgagccacaccccaagaagacgctggatcagcggcctgccccgggccagctgccgcctgggggaggagcccccacccctgccctactgtgaccaggcctatggagaggagctgagcatccgccaccgggagacctgggcctggctgagcaggacagacacagcctggccaggggcccctggggtgaagcaggcccgcatcctgggggagctgctgctggtgtag

SEQ ID NO: 36573 - DNA, 354 bp, Artificial Sequence; identical to SEQ ID NO: 36572
  Description of Artificial Sequence: Synthetic coding sequence

SEQ ID NO: 36574 - DNA, 1827 bp, Artificial Sequence
  Description of Artificial Sequence: Synthetic coding sequence
atgctgcccctgctggacagcagcaagagagctggcaccctgggcagcggctgcggcgtgccccgggtgcacagcgctgccctgagccgggaggagggcgccagccgggacatctggaggatcaaggtgtgggcccgggtgatgaccaccccagctggcagcggcagcggcttcggctctgtgtcctggtggggcctgagccctgccctggacctgcaggccgagagagatgccaccgtggatgccctgcccaccaccatggtgccccagcctgctgtgatcctgcccggcccccctgtggaccctgacagccaggccgacacagtgcacagcaaccctgagctggatgtgctgctgctgggctctgtggatggccgccacctgctgcggaccctgagccgggccaagttctggccccggcggcgcttcaacttctttgtgctggagaacaacctggaggccgtggcccggcacatgctgatcttcagcctggccctggaggagcctgagaagatgggcctgcaggagaggtctgagaccttcctggaggtgtggggcaatgccctgctgcggccccctgtggccgcctttgtgcgggcccaggccgacctgctggcccacctggtgcctgagccagaccggctggaggagcagctgccctggctgagcctgcgggccctgaagttccgggagagagatgccctggaggccgtgttccgcttctgggccggcggggagaagggcccccaggccttccccatgagccggctgtgggacagccggctgcggcactacctgggcagccgctatgatgccaggagaggagtgtctgactgggacctgaggatgaagctgcatgacagaggagcccaggtgatccacccccaggagttccgccgctggagggacaccggggtggcctttgagctgcgggacagcagcgcctaccacgtgcccaacagaaccctggccagcggccgcctgctgagctacagaggagagcgggtggccgcccggggctactggggagacatcgccaccggcccctttgtggcctttggaattgaagcagatgatgagagcctgctgcggaccagcaatggccagcctgtgaagacagctggggagatcacccagcacaacgtgacagagctgctgagagatgtggccgcctggggccgggcccgggccaccggcggggacctggaggagcagcagcacgccgagggcagccctgagcccggcaccccagcccccaccccagagagcttcaccgtgcacttcctgcccctggacagcgcccagaccctgcaccacaagagctgctacaacggccgcttccagctgctgtatgtggcctgtggcatggtgcacctgctgatccctgagctgggcgcctgtgtggcccctgggggcaacctgattgtggagctggcccgctacctggtggatgtgcggcaggagcagctgcagggcttcaacaccagggtgcgggagctggcccaggccgccggctttgccccccagacaggagcccggcccagcgagacctttgcccgcttctgcaagagccaggagagcgccctgggcaacacagtgcctgctgtggagcccggcaccccacccctggacatcctggcccagcccctggaggccagcaacccagccctggagggcctgacccagcccctgcagggcggcaccccccactgtgagccctgccagctgcccagcgagagccctggcagcctgtctgaggtgctggcccagccccagggcgccctggccccacccaactgtgagagtgacagcaagacaggagtgtag

SEQ ID NO: 36575 - DNA, 1767 bp, Artificial Sequence
  Description of Artificial Sequence: Synthetic coding sequence
atgctgcccctgctggacagcagcaagagagctggcaccctgggcagcggctgcggcgtgccccgggtgcacagcgctgccctgagccgggaggagggcgccagccgggacatctggaggatcaaggtgtgggcccgggtgatgaccaccccagctggcagcggcagcggcttcggctctgtgtcctggtggggcctgagccctgccctggacctgcaggccgagagcccccctgtggaccctgacagccaggccgacacagtgcacagcaaccctgagctggatgtgctgctgctgggctctgtggatggccgccacctgctgcggaccctgagccgggccaagttctggccccggcggcgcttcaacttctttgtgctggagaacaacctggaggccgtggcccggcacatgctgatcttcagcctggccctggaggagcctgagaagatgggcctgcaggagaggtctgagaccttcctggaggtgtggggcaatgccctgctgcggccccctgtggccgcctttgtgcgggcccaggccgacctgctggcccacctggtgcctgagccagaccggctggaggagcagctgccctggctgagcctgcgggccctgaagttccgggagagagatgccctggaggccgtgttccgcttctgggccggcggggagaagggcccccaggccttccccatgagccggctgtgggacagccggctgcggcactacctgggcagccgctatgatgcccggcggggcgtgtctgactgggacctgaggatgaagctgcatgacagaggagcccaggtgatccacccccaggagttccgccgctggagggacacaggagtggcctttgagctgcgggacagcagcgcctaccacgtgcccaacagaaccctggccagcggccgcctgctgagctacagaggagagcgggtggccgcccggggctactggggagacatcgccaccggcccctttgtggccttcggcatcgaggctgatgatgagagcctgctgcggaccagcaatggccagcctgtgaagacagctggggagatcacccagcacaacgtgacagagctgctgagagatgtggccgcctggggccgggcccgggccactggaggagacctggaggagcagcagcacgccgagggcagccctgagcccggcaccccagctgcccccaccccagagagcttcaccgtgcacttcctgcccctggacagcgcccagaccctgcaccacaagagctgctacaacggccgcttccagctgctgtatgtggcctgtggcatggtgcacctgctgatccctgagctgggcgcctgtgtggcccctgggggcaacctgattgtggagctggcccgctacctggtggatgtgcggcaggagcagctgcagggcttcaacaccagggtgcgggagctggcccaggccgccggctttgccccccagacaggagcccggcccagcgagacctttgcccgcttctgcaagagccaggagagcgccctgggcaacacagtgcctgctgtggagcccggcaccccacccctggacatcctggcccagcccctggaggccagcaacccagccctggagggcctgacccagcccctgcagggcggcaccccccactgtgagccctgccagctgcccagcgagagccctggcagcctgtctgaggtgctggcccagccccagggcgccctggccccacccaactgtgagagtgacagcaagacaggagtgtag

SEQ ID NO: 36576 - DNA, 1464 bp, Artificial Sequence
  Description of Artificial Sequence: Synthetic coding sequence
atgaagatgagggcccagatccctgagagcctgcgggaggagggcatcgagatcctgaagccccagttctttgtgctggagaacaacctggaggccgtggcccggcacatgctgatcttcagcctggccctggaggagcctgagaagatgggcctgcaggagaggtctgagaccttcctggaggtgtggggcaatgccctgctgcggccccctgtggccgcctttgtgcgggcccaggccgacctgctggcccacctggtgcctgagccagaccggctggaggagcagctgccctggctgagcctgcgggccctgaagttccgggagagagatgccctggaggccgtgttccgcttctgggccggcggggagaagggcccccaggccttccccatgagccggctgtgggacagccggctgcggcactacctgggcagccgctatgatgccaggagaggagtgtctgactgggacctgaggatgaagctgcatgacagaggagcccaggtgatccacccccaggagttccgccgctggagggacaccggggtggcctttgagctgcgggacagcagcgcctaccacgtgcccaacagaaccctggccagcggccgcctgctgagctacagaggagagcgggtggccgcccggggctactggggagacatcgccaccggcccctttgtggcctttggaattgaagcagatgatgagagcctgctgcggaccagcaatggccagcctgtgaagacagctggggagatcacccagcacaacgtgacagagctgctgagagatgtggccgcctggggccgggcccgggccaccggcggggacctggaggagcagcagcacgccgagggcagccctgagcccggcaccccagctgcccccaccccagagagcttcaccgtgcacttcctgcccctggacagcgcccagaccctgcaccacaagagctgctacaacggccgcttccagctgctgtatgtggcctgtggcatggtgcacctgctgatccctgagctgggcgcctgtgtggcccctgggggcaacctgattgtggagctggcccgctacctggtggatgtgcggcaggagcagctgcagggcttcaacaccagggtgcgggagctggcccaggccgccggctttgccccccagacaggagcccggcccagcgagacctttgcccgcttctgcaagagccaggagagcgccctgggcaacacagtgcctgctgtggagcccggcaccccacccctggacatcctggcccagcccctggaggccagcaacccagccctggagggcctgacccagcccctgcagggcggcaccccccactgtgagccctgccagctgcccagcgagagccctggcagcctgtctgaggtgctggcccagccccagggcgccctggccccacccaactgtgagagtgacagcaagacaggagtgtag

SEQ ID NO: 36577 - DNA, 783 bp, Artificial Sequence
  Description of Artificial Sequence: Synthetic coding sequence
atggctgctgctgccctgcggcgcttctggagcagaagaagagctgaggccggagatgctgtggtggccaagccaggagtgtgggcccggctgggctcctgggcccgggccctgctgcgggactatgcagaggcctgcagagatgccagcgctgaggcccgggcccggcccggccgggctgctgtgtatgtgggcctgctgggcggcgctgctgcctgcttcaccctggcccccagcgagggcgcctttgaggaggccctgctggaggccagcggcaccctgctgctgctggccccagccaccaggaaccgggagagcgaggcctttgtgcagaggctgctgtggctgcggggccggggccgcctgcgctacgtgaacctgggcctgtgcagcctggtgtatgaggccccctttgatgcccaggccagcctgtaccaggcccgctgccgctacctgcagccccgctggacagacttccctggccgggtgctggatgtgggctttgtgggccgctggtgggtgctgggcgcctggatgagggactgtgacatcaatgatgatgagttcctgcacctgcctgcccacctgcgggtggtgggcccccagcagctgcacagcgagaccaatgaaaggctgtttgatgagaagtacaagcctgtggtgctgacagatgaccaggtggaccaggccctgtgggaggagcaggtgctgcagaaggagaagaaggaccggctggccctgagccaggcccacagcctggtgcaggccgaggcccccaggtag

SEQ ID NO: 36578 - DNA, 1005 bp, Artificial Sequence
  Description of Artificial Sequence: Synthetic coding sequence
atgaagcccccacccaggagaagagctgccccagcccgctacctgggggaggtgactggacctgccacctggagcgcccgggagaagaggcagctggtgcggctgctgcaggcccggcagggccagcctgagccagatgccacagagctggcccgggagctgcggggccgctctgaggccgagatccgggtcttcctgcagcagctgaagggccgggtggcccgggaggccatccagaaggtgcaccctgggggcctgcagggccccaggagaagagaggcccagcccccagcccccatcgaggtgtggacagacctggccgagaagatcaccggccccctggaggaggccctggccgtggccttcagccaggtgctgaccatcgccgccacagagcctgtgaccctgctgcacagcaagccacccaagcccacccaggcccggggcaagcccctgctgctgagcgcccctgggggccaggaggaccctgcccctgagatccccagcagcgccccagctgcccccagcagcgcccccaggaccccagaccctgcccctgagaagcccagcgagagcagcgctggccccagcacagaggaggactttgctgtggactttgagaagatctacaagtacctgagctctgtgagccgcagcggccgcagccctgagctgtctgctgctgagagcgctgtggtgctggacctgctgatgagcctgcctgaggagctgcccctgctgccctgcacagccctggtggagcacatgacagagacctacctgcggctgacagccccccagcccatcccagctgggggcagcctgggccctgctgctgaaggagatggagctggcagcaaggcccctgaggagaccccaccagccacagagaaggccgagcacagcgagctgaagagcccctggcaggccgccggcatctgccccctgaaccccttcctggtgcccctggagctgctgggccgggccgccaccccagccaggtag

SEQ ID NO: 36579 - DNA, 300 bp, Artificial Sequence
  Description of Artificial Sequence: Synthetic coding sequence
atggcccagggccagaggaagttccaggcccacaagccagccaagagcaagacagctgctgctgccagcgagaagaacagaggccccaggaaaggaggccgggtcatcgcccccaagaaggcccgggtggtgcagcagcagaagctgaagaagaacctggaggtgggcatcaggaagaagattgaacatgatgtggtgatgaaggccagcagcagcctgcccaagaagctggccctgctgaaggccccagccaagaagaagggagctgctgctgccaccagcagcaagacccccagctag

SEQ ID NO: 36580 - DNA, 420 bp, Artificial Sequence
  Description of Artificial Sequence: Synthetic coding sequence
atgagagctgggggcctggtggatggccgctacagccctgtggccccccagtggaggcctcctggagagacccacactggaggccacggcaagaggctgcacggccctggaagagatgtgctgagcaccagctatgatgaggacttcaaccacgagccctgccagaggaagggccacaaggcccactgggccgtgtctgctggggtgctgctgggcgtgcgggctgtgcccagcctgggctacacagaagatcctgagctgcccggcctcttccaccctgtgctgggcaccccctgccagccccccagcctgcctgaggagggcagccctggagctgtgtacctgctgagcaagcagggcaagtcctggcactaccagctgtgggactatgaccagggcccccccctgagcagccactag

SEQ ID NO: 36581 - DNA, 1056 bp, Artificial Sequence
  Description of Artificial Sequence: Synthetic coding sequence
atgaccagcccctgcagcccccccctgaagccacccatcagcccccccaagacccctgtgccccaggccagcagcatccccagcccccccctgccccccagccccctggacttcagcgccctgcccagccccccctggagccagcagacccctgtgcccccacccctgcccctgcccccacctcctgctgccactggacctgcccccaggcatgtgtttggcctggagaagagccagctgctgaaggaggcctttgacaaggccggccctgtgcccaagggccgggaggatgtgaagaggctgctgaagctgcacaaggaccgcttccggggggacctgcgctggatcctcttctgtgccgacctgcccagcctcatccaggagggcccccagtgtggcctggtggccctgtggatggccggcaccctgctgagcccccccagcggcgtgcccctggagcggctcatccgggtggccacagagcggggctacacagcccagggcgagatgttttctgtggccgacatgggccgcctggcccaggaggtgctgggctgccaggccaagctgctgagcggcggcctgggcggccccaacagagacctggtgctgcagcacctggtgacaggccaccccctgctgatcccctatgatgaggacttcaaccacgagccctgccagaggaagggccacaaggcccactgggccgtgtctgctggggtgctgctgggcgtgcgggctgtgcccagcctgggctacacagaagatcctgagctgcccggcctcttccaccctgtgctgggcaccccctgccagccccccagcctgcctgaggagggcagccctggagctgtgtacctgctgagcaagcagggcaagtcctggcactaccagctgtgggactatgaccaggtgcgggagagcaacctgcagctgacagacttcagccccagccgggccacagatggccgggtgtatgtggtgcctgtgggcggcgtgcgggccggcctgtgtggccaggccctgctgctgaccccccaggactgcagccactag

SEQ ID NO: 36582 - DNA, 1440 bp, Artificial Sequence
  Description of Artificial Sequence: Synthetic coding sequence
atggacaggagcctgcccgtcttcagcatccaggacagcccctttggagatgcccccctgggccgcagccactactggcccagccagagccagacctggtgccccaagaccctgagccccagccgcagccagaggagccggctgccccaggcccccaaggccctggccaccggccccaacagccctgagctgtttgaggagagctggcccagcagcagcggcacccccagcctgcccagcaccacagagggccagatgtgggccagccctgcccccaccctgattgattctggggacagcgtggtggccaagtacatcaaccgcttccggcaggcccagcccaccagccgggaggagcggcagcctgctggccccaccccagctgacttctggtggctgcagagcgacagcccagaccccagcagccagagcgctgctgctggggccaacaagccagagggccggccccacacagctgtgcccacagctgtgaatgtgaccagcgccagccatgctgtggcccccctgcaggagatcaagcagaacctgcacacctggaacagcagcctgctggacctggagaccctgagcctgcagagccgggccgcccggctgctgaagaggagcaaggccagcatcagcagcagcagcagcctgagccccagtgatgccagcaccagcagcttccccaccagcagtgatggcctgagccccttcagcgagaccttcatcccagacagcagcaagggcctgggcccccgggccccagccagccctgccccagcccaggcccagacccccaccccagccccagccccagccagcagccaggcccccctgcggccagaagatgacatcctgtaccagtggaggcagaggaggaagctggagcaggcccagggcagcaaaggagaccgggcctgggtgccccccctgaccccagccctgcggaccctggccgagagcctgaaggccaaggccctgcccccagctgctggcagcgtcatcaggaagtctgaggccacccccagccctggggcctgcctgcagcctgaggtgcccctgagccctgctgagcaggccaccaccgtgaaggccagccccccagccttccaggtgggcagccctgaggccctggcccctcctcctcctgctgctgaccacgcccccagcgaggccctgctggcccaggccctgctgctgcaggccgcagaagattctgatggcagcgagttccaggatgatcctgtgctgcaggtgctgcgggcccacagagctgagctgagccggcagaagcgggaggctgatgcccggctgtccttcctgctggaccaggccgaggacctgggctcctggagccccccagctggcagccccccaagaagcccccggcggctgctgcggcgggagggggacagcctggaggcccggcggctgtag

SEQ ID NO: 36583 - DNA, 330 bp, Artificial Sequence
  Description of Artificial Sequence: Synthetic coding sequence
atgtgggccagccctgcccccaccctgattgacagcggggacagcgtggtggccaagtacatcaaccgcttccggcaggcccagcccaccagccgggaggagcggcagcctgctggccccaccccagctgacttctggtggctgcagagcgacagcccagaccccagcagccagagcgctgctgctggggccaacaagccagagggccggccccacacagctgtgcccacagctgtgaatgtgaccagcgccagccatgctgtggcccccctgcaggagatcaagcaggtgaccagccccttcacccccagcctgggctgcctgaactag

SEQ ID NO: 36584 - DNA, 1914 bp, Artificial Sequence
  Description of Artificial Sequence: Synthetic coding sequence
atgaccaagaggaagaagctgcggaccagcggggagggcctgtgcccccccaagcccctgaagaacccccggctgggggacttctatggagacccccagagctccatgctgggctgcctgcaccaccctgaggagcctgagggcaagctgggccctgtgcccagcacccagcagcacggggaggagcccgggaaggctgtgagcagcagcccagatgaggagaccggcagcccctgccgcctgctgcggcagcctgagaaggagcccgcccccctgccccccagccagaacagctttggccgctttgtgccccagtttgccaagagcaggaagacagtgaccaggaaggaggagatgaaggatgaggaccggggcagcggggccttcagcctggagaccatcgccgagagcagcgcccagagccctggctgccagctgctggtggagaccctgggcgtgcccctgcaggaggccacagagctgggggaccccacccaggccgacagcgcccggcctgagcagagcagccagagccctgtgcaggccgtgcccggcagcggggacagccagccagatgaccccccagaccggggcaccggcctgagcgccagccagagggccagccaggaccacctgtctgagcagggcgcagatgacagcaagccagagacagacagagtgcctggagatggcggccagaaggagcacctgcccagcattgacagcgagggggagaagccagacagaggagccccccaggagggcggggcccagaggacagctggagctggcctgcccggcggcccccaggaggagggagatggagtgccctgcaccccagccagcgcccccaccagcggccctgcccctggcctgggccctgcctcctggtgcctggagcccggctctgtggcccagggcagcccagacccccagcagacccccagcaggatgggccgggagggggagggcacccacagcagcctgggctgcagcagcctgggcatggtggtgattgctgacctgagcacagaccccacagagctggaggagcgggccctggaggtggccggcccagatggccaggccagcgccatcagccctgccagccccaggaggaaggccgcagatggcggccacagaagagccctgcccggctgcaccagcctgactggagagaccactggagagagcggggaggccggccaggacggcaagcccccaggagatgtgctggtgggccccacagccagcctggccctggcccctggcagcggggagagcatgatgggcgctggggacagcggccacgccagcccagacaccggcccctgtgtgaaccagaagcaggagcccggccctgcccaggaggaggccgagctgggcggccagaacctggagcgggacctggagggcttccgggtgagcccccaggcctctgtggtgctggagcaccgggagattgctgatgaccccctgcaggagcccggggcccagcagggcatcccagacaccaccagcgagctggccggccagagggaccacctgccccacagcgctgaccagggcacctgggccgacagcctggccgtggagctggacttcctgctggacagccagatccaggatgccctggatgccagtgactttgaggcccctcctgagcagctgttccccagcggcaacaagccaggcccctgctggccaggccccagcagccacgccaacggggaccctgtggccgtggccaaggcccagcccagccgcctcatcatgggcacccaccgggacctggaggccttcaagaggctgaactacaggaagaccaagctgggcggcaaggcccccctgccctaccccagcaagggccctggcaacatccccaggggggaccccccctggagggagctgtag

SEQ ID NO: 36585 - DNA, 2007 bp, Artificial Sequence
  Description of Artificial Sequence: Synthetic coding sequence
atgaccaagaggaagaagctgcggaccagcggggagggcctgtgcccccccaagcccctgaagaacccccggctgggggacttctatggagacccccagagctccatgctgggctgcctgcaccaccctgaggagcctgagggcaagctgggccctgtgcccagcacccagcagcacggggaggagcccgggaaggctgtgagcagcagcccagatgaggagaccggcagcccctgccgcctgctgcggcagcctgagaaggagcccgcccccctgccccccagccagaacagctttggccgctttgtgccccagtttgccaagagcaggaagacagtgaccaggaaggaggagatgaaggatgaggaccggggcagcggggccttcagcctggagaccatcgccgagagcagcgcccagagccctggctgccagctgctggtggagaccctgggcgtgcccctgcaggaggccacagagctgggggaccccacccaggccgacagcgcccggcctgagcagagcagccagagccctgtgcaggccgtgcccggcagcggggacagccagccagatgaccccccagaccggggcaccggcctgagcgccagccagagggccagccaggaccacctgtctgagcagggcgcagatgacagcaagccagagacagacagagtgcctggagatggcggccagaaggagcacctgcccagcattgacagcgagggggagaagccagacagaggagccccccaggagggcggggcccagaggacagctggagctggcctgcccggcggcccccaggaggagggagatggagtgccctgcaccccagccagcgcccccaccagcggccctgcccctggcctgggccctgcctcctggtgcctggagcccggctctgtggcccagggcagcccagacccccagcagacccccagcaggatgggccgggagggggagggcacccacagcagcctgggctgcagcagcctgggcatggtggtgattgctgacctgagcacagaccccacagagctggaggagcgggccctggaggtggccggcccagatggccaggccagcgccatcagccctgccagccccaggaggaaggccgcagatggcggccacagaagagccctgcccggctgcaccagcctgactggagagaccactggagagagcggggaggccggccaggacggcaagcccccaggagatgtgctggtgggccccacagccagcctggccctggcccctggcagcggggagagcatgatgggcgctggggacagcggccacgccagcccagacaccggcccctgtgtgaaccagaagcaggagcccggccctgcccaggaggaggccgagctgggcggccagaacctggagcgggacctggagggcttccgggtgagcccccaggcctctgtggtgctggagcaccgggagattgctgatgaccccctgcaggagcccggggcccagcagggcatcccagacaccaccagcgagctggccggccagagggaccacctgccccacagcgctgaccagggcacctgggccgacagcctggccgtggagctggacttcctgctggacagccagatccaggatgccctggatgccagtgactttgaggcccctcctgagcagctgttccccagcggcaacaagccaggcccctgctggccaggccccagcagccacgccaacggggaccctgtggccgtggccaaggcccagcccaggacctttgtgggcatccaggccagcgaggccagcaggatggaggatgccaccaacgtggtgcggggcctcatcgtggagctgagcaacctgaacagactcatcatgggcacccaccgggacctggaggccttcaagaggctgaactacaggaagaccaagctgggcggcaaggcccccctgccctaccccagcaaaggacctggcaacatccccaggggggaccccccctggagggagctgtag

SEQ ID NO: 36586 - DNA, 606 bp, Artificial Sequence
  Description of Artificial Sequence: Synthetic coding sequence
atgatcacagaaacagctgctgagcccaccgtgcctgctgtgcctgctgctgaggaggccacagaggcccggggccgggaggagcccgcctggccctggaaggatgcccccatccgcaccctggtgcagaggatccaccagctgcaggccgagcgggcccagggcttccggcggctggaggagtggctggcccctgtgcagggcctgcgggcctggggccggggcctgcgggtgcccacctgccggcggggccaccggcagtacctgcggagcggccctgactatgactttgcccgctaccgcagcacagtgcatggagtgacccaggcctttgctgctgccagccgggaggtgctggccgtggaggccgagctgggcggcccccggcggcagcccctgctggccggccacgtgcgcagcctgcaggagctggagcagacccggctgggcaccgtggccctgctgcagctgatggagaccccagagctggccggccaggaggatgctgtgaggatgcagcagctgaagatgaaggtgatcaagaccatggaggccatcagcgaggtgctgcaggacctgcgctttgatgctgagagcgctgagtag

SEQ ID NO: 36587 - DNA, 540 bp, Artificial Sequence
  Description of Artificial Sequence: Synthetic coding sequence
atgatcacagaaacagctgctgagcccaccgtgcctgctgtgcctgctgctgaggaggccacagaggcccggggccgggaggagcccgcctggccctggaaggatgcccccatccgcaccctggtgcagaggatccaccagctgcaggccgagcgggcccagggcttccggcggctggaggagggccaccggcagtacctgcggagcggccctgactatgactttgcccgctaccgcagcacagtgcatggagtgacccaggcctttgctgctgccagccgggaggtgctggccgtggaggccgagctgggcggcccccggcggcagcccctgctggccggccacgtgcgcagcctgcaggagctggagcagacccggctgggcaccgtggccctgctgcagctgatggagaccccagagctggccggccaggaggatgctgtgaggatgcagcagctgaagatgaaggtgatcaagaccatggaggccatcagcgaggtgctgcaggacctgcgctttgatgctgagagcgctgagtag

SEQ ID NO: 36588 - DNA, 876 bp, Artificial Sequence
  Description of Artificial Sequence: Synthetic coding sequence
atgagccaggagggcgtggagctggagaagtctgtgcggcggctgcgggagaagttccacggcaaggtgagcagcaagaaggccggggccctgatgaggaagtttggaagtgaccacactggagtgggccgcagcatcgtgtatggagtgaagcagaaggatggccaggagctgagcaatgacctggatgcccaggaccccccagaggacatgaagcaggaccgggacatccaggccgtggccaccagcctgctgcccctgacagaggccaacctgaggatgttccagagggcccaggatgacctgatcccagctgtggaccggcagtttgcctgcagcagctgtgaccacgtgtggtggaggagagtgccccagaggaaggaggtgagccgctgcaggaagtgcaggaagagatatgagcctgtgcctgctgacaagatgtggggcctggccgagttccactgccccaagtgccgccacaacttccggggctgggcccagatgggcagccccagcccctgctacggctgcggcttccctgtgtaccccacccgcatcctgcccccacgctgggaccgggaccctgacagaagaagcacccacacccacagctgcagcgctgctgactgctacaacagaagagagccccacgtgcccggcaccagctgtgcccaccccaagagcaggaagcagaaccacctgcccaaggtgctgcaccccagcaacccccacatcagcagcggcagcacagtggccacctgcctgagccagggcggcctgctggaggacctggacaacctgatcctggaggacctgaaggaggaggaggaggaggaggaggaggtggaggatgaggagggcggcccccgggagtag

SEQ ID NO: 36589 - DNA, 723 bp, Artificial Sequence
  Description of Artificial Sequence: Synthetic coding sequence
atgagccagcaccagcaggcctgtggcatctgccggcaggaggaccccccagaggacatgaagcaggaccgggacatccaggccgtggccaccagcctgctgcccctgacagaggccaacctgaggatgttccagagggcccaggatgacctgatcccagctgtggaccggcagtttgcctgcagcagctgtgaccacgtgtggtggaggagagtgccccagaggaaggaggtgagccgctgcaggaaatgtaggaagagatatgagcctgtgcctgctgacaagatgtggggcctggccgagttccactgccccaagtgccgccacaacttccggggctgggcccagatgggcagccccagcccctgctacggctgcggcttccctgtgtaccccacccgcatcctgcccccacgctgggaccgggaccctgaccggcgcagcacccacacccacagctgcagcgctgctgactgctacaacagaagagagccccacgtgcccggcaccagctgtgcccaccccaagagcaggaagcagaaccacctgcccaaggtgctgcaccccagcaacccccacatcagcagcggcagcacagtggccacctgcctgagccagggcggcctgctggaggacctggacaacctgatcctggaggacctgaaggaggaggaggaggaggaggaggaggtggaggatgaggagggcggcccccgggagtag

SEQ ID NO: 36590 - DNA, 1884 bp, Artificial Sequence
  Description of Artificial Sequence: Synthetic coding sequence
atggagaggcctgagcccccacctggaacagctgctggccaggaggagcaggagctgcgggagcgggccttcttctcctgggccgagttcagccgcttctttgatgcctggtgccagcagaggctggccctcttctttgtgaagagctccatgcacctggcccgctgccgctgggccagcgccccacccctgtacaccctgattgatgtgctgaagtacagctatgtgcggctggtgtgcaaggatgtgcgggcccccagcaggcctgctgtgggccccccccagcccggctgcccagccttcatcatcgtgaagctgagccccctgcgggaccggctggtggtgacagagtgccagctgacccacagccacccagcctgccccctggagtttgcctactacttccggcccggccacctgctggccaatgcctgcctgcctgtgaggaccaccaacaagatcagcaagcagtttgtggccccagcagatgtgcggcggctgctgagctactgcaagggccgggaccacggcgtgctggatgccctgcacgtgctggagggcctcttcagaacagatcctgaggccaaggtgaagctggtgtttgtggaggaccaggccgtggtggagaccgtcttcttcctgaccagcaggacccgggccctgctgcggcgcttccccaggatgctgctggtggaccggctgcccggcctgcagggcgccctggacctgctggccgtgctgtgtgtggatggcagcggccgggcccggcaggccgcctgctgcgtggcccggcccggcacccccagcctgctgcgctttgccctggccagcctgctgcagagcgccccagatgtgaagggccgggtgcgctgcctgacagctggccctgaggtggccgcccagctgcctgctgtgcggcagctgctgccctgtgcccgggtgcagatctgccgggcccagggcctggagaccctcttcagcaaggcccaggagctgggcggggccggccgggaggaccccggcctgtggagccggctgtgccgcctggccggggccagcagccctgctgcctatgatgaggccctggccgagctgcacgcccacggccctgctgcctttgtggactactttgaaagaaactgggagccccggcgggacatgtgggtgcgcttccgggcctttgaggccgcccgggacctggatgcctgtgccctggtgcggggccacagaagaaggctgctgcggcggctgagccccagccggggcgtggcccagtgcctgcgggacctggtggccatgcagtgggcagatgctgctggggaggccgtgcctgagggcccagatggcggcggcccctggctggaggatgagcccggccgcggggcccagggagaaaatgaaagagtgcggggcctggagaccggggactggggcggggcccccaaggagggcagcatctggaggggggcccagatggagaaggagtgggcccgggccctggagacccgggactggggcggggcccagtttgaaggagagaagggccgggccctgcagatccgggactggaggggcggccgcctggagaaccagaagccccggggcctggagggcggcgtgctgcggggcagcaagctggagaagggccacctgcggggccctgagatccgggactggaggggcccccagctggagggggagaaggactggggcctggagggctacgtgtggaggggcagccagctggaggaccaggccctgcggggcctggagggctacacctggagggtggcccagctggaggacagaagaagcaccacagacctgcggggcacccagtttgattatgaaagaggcaagggggagagcacagaagatagatag

SEQ ID NO: 36591 - DNA, 393 bp, Artificial Sequence
  Description of Artificial Sequence: Synthetic coding sequence
atggagctgtggaggcagctgaaccaggccggcctggtgcccccaggcctgggccccccaccccaggccctgcgggaggtgtcccctgtggagatccctggccagaccctgaggacagctggagctgacaccggcggggcctgtgacagcctgctgtggatccgggaggagctgggcaacctgcggcgggtggatgtgcagctgctgggccagctgtgcagcctgggcctggagatgggcgccctgcgggaggagctggtgaccatcctggaggaggaggaggagagcagcaaggaggaggaggaggaccaggagccccagaggaagcaggaggaggagcacctggaggcctgcccagccccccaccccccagactttgagatgatgatctag

SEQ ID NO: 36592 - DNA, 630 bp, Artificial Sequence
  Description of Artificial Sequence: Synthetic coding sequence
atgcagaccctgcggcaggaggccgcccggccctgcatccccagcggcaccctggaggccagcttccctgcccccctgtacagtgatgactacctgagcctggagggcagccgctggcccccagccatccggcaggccacccgctggaagtacacccccatgggcagagatgctgctggccagctgtggtacacaggcctgaccaacagtgatgcctgggaggcctggtacaacctgccccgggccccagccagccccttccgggaggcctacaaccgctggcacagctgctaccagcaccgggagtgcagcatgcccagcgcctacacccagcacctgcgggagacagcctggcatgaccccatcgtgcctgcccagtaccaggcccccagcacccgctggggcagcgccctgtggaaggaccggcccatccggggcaaggagtatgtgctgaacagaaacagatatggagtggagcccctgtggagggccagtgactatgtgcccagcctgagcgccccccagaggcctcctggcaccacccagaactaccgggagtgggtgctggagccctactgccccagcacctgccagaggagcccccccagcctgacccccaccccaagatag

SEQ ID NO: 36593 - DNA, 390 bp, Artificial Sequence
  Description of Artificial Sequence: Synthetic coding sequence
atgaggctgaaggtgggcttccagggcggcggctgcttcaggaaggatgccctgtgcctggagggcggcgtgtctgcccgctgggcccgggccccccacagcgcccccctgcggcccccccgggagctgcatgctgcccctcctccagccacccccacccagacagtggtgcggcctgctggcttccccaggaggacccggctgatggtgcgcagcgccccacccacccagaggcccccaactggaagtggctgtgtgtctggcctgtggaggaagggcctgggcctgcggccccagaccctgctgcgggtgggctctgtggtgctgagcagcgccccagccctgcggccccggctgggcccctgcctgcggcccccacccagcgactag

SEQ ID NO: 36594 - DNA, 222 bp, Artificial Sequence
  Description of Artificial Sequence: Synthetic coding sequence
atgggcgtgaagctggagatcttcaggatgatcatctacctgaccttccctgtggccatgttctgggtgagcaaccaggccgagtggtttgaagatgatgtgatccagaggaagcgggagctgtggcccccagagaagctgcaggagattgaggagttcaaggagcggctgaggaagaggcgggaggagaagctgctgagagatgcccagcagaacagctag

SEQ ID NO: 36595 - DNA, 5955 bp, Artificial Sequence
  Description of Artificial Sequence: Synthetic coding sequence
atggagctgacccctggggcccagcagcagggcatcaactaccaggagctgaccagcggctggcaggatgtgaagtccatgatgctggtgcctgagcccaccaggaagttccccagcggccccctgctgacctctgtgcgcttcagcaacctgagccctgagagccagcagcaggatgtgaagagcctggagttcaccgtggagcccaagctgcagagcgtgaagcacgtgaagctgagctctgtgtccctgcagcagaccatcaagtctgtggagctggcccctggcagcctgccccagagggtgaagtacggggagcagacccccaggaccaactaccagatcatggagagcagcgagctgatccccaggcctggccaccagtttgccaagtatgcagagatgatcccccagcccaagtaccagatccccaagagcgccaacctgatcagcatccccatctaccacgccacagagagcagcgagatggcccagggcctggcctacaagggcatcgacacagtggagaagtctgtgggcctgacccccaagctgaccggccgggccaaggagagcctgggcatgctgctgcagcctgacctgcaggtgcccaagtttgtggacctgacccccatggtgcgggaccagggcagcaagttcctgggcctgaccccagagaagagctaccagatcctggagaccatggagctgctgagccagagccggccccgggtgaaggatgtgggggagctgtacatgaagcccctgcagcagacagtggagtatgagggcatcaccccagagctgaagcactacttcacagaggccatgggcctgacagctgaggcccgcatccaggccaatgagttcttcggcatgacccccaagcccaccagccaggccaccggctttgctgagaggagcccccggctgtgcccccagaacctggagtgtgtggaggtgatcagcgagaagaggctgcagggcgaggagagcgtggtgctgatccccaagagcctgcaccacgtgcctgacagcgccagcggcatgaccccaggcctgggccaccgggtgcctgagagcgtggagctgaccagcaagagcggcgtgcaggtggagaagaccctgcagctgacccccaagccccagcaccacgtgggcagccctggcatcatcagcggcctgggccaccaggtgcctgagagcgtgaacctgacctgcaagcagtggctgcagatggaggagagcctggaggtgcccctgaagcagaccagccaggtgattggccacgaggagagcgtggagctgaccagcgaggcccggcagcaccgggaggtgtccatgggcctgaccaagagcaagaaccagagcatgaagagccctggcaccaccccaggccccctgggcagaattgtggagttcatgaggatcagccctgagcccctggaccaggtgacagagagcgcccggacccagctgcaggtggcccagagcgaggaggtgatcctgattgatgtgcccaaggtggtgcagagcgtgaaggtgaccccaggcccccccttccagatcgtgaagtctgtgaccatcccccggcccaccccccagatggtggagtacatcgagctgacccccaagctgcagtatgtgcggcccagcgagcaccacacaggcccctgcctgcaggatgtgaagagcaccaagctgatcaccaagcccaagcaccagatcctggagaccgtggagctgaccggcttccagatcgtgaagaccatgctgatccctggccccagcctgcagatcgtgaagtctgaggagctggcccctggccccatcccccaggtggtggagcccatcggcgtggccctggagagcggcatcgaggccatcaactgtgtggacctgctgccccggccccacctgcaggagctgattgtgcctgctgagctgacccccagcccctgcacccaggtgaagtctgctgagctgaccagcccccagaccagcccctttgaggagcacaccatcctgacccacaagcagggcctgcaggccgtgaagagcaccgtcatcaagacagagccccccaaggtgatggagacagaggacctgaacctgggccacgtgtgccagaacagagactgccagaagctgaccagcgaggagctgcaggtgggcacagacttcagccgcttcctgcagagcagcagcaccaccctcatcagcagctctgtgaggacagccagcgagctgggcggcctgtgggacagcggcatccaggaggtgtcccgggccctggacatcaagaaccctggaacagacatcctgcagcctgaggagacctacatcgaccccaccatgatccagagcctgaccttccccctggccctgcacaaccagagcagtgacaagacagccaacatcgtggagaacccctgcccagagatcctgggcgtggatgtgatcagcaaggagaccaccaagaggaagcagatggaggagctggagaacagcctgcagaggcacctgccccagagctggaggagccgcagcaggaccttccaggccgagagcggcgtgcagaagggcctcatcaagagcttccctggccggcagcacaacgtgtgggagagccacgcctggaggcagaggctgcccaggaagtacctgagcaccatgctgatgctgggcaacatcctgggcaccaccatggagaggaagctgtgcagccagaccagcctggccgagcgggccacagctgacacctgccagagcatccagaacctgtttggcatcccagctgagctgatggagcccagccagagcctgcctgagaagggccctgtgaccatcagccagcccagcgtggtgaagaactacatccagaggcacaccttctaccacggccacaagaagaggatggccctgcgcatctggacccggggcagcaccagcagcatcatccagcagtacagcggcaccagggtgcgcatcaagaagaccaacagcaccttcaacggcatcagccaggaggtgatccagcacatgcctgtgtcctgtgccggcggccagctgcctgtgctggtgaagtctgagagcagcctgagcatcttctatgaccgggaggacctggtgcccatggaggagagcgaggacagccagagcgacagccagacccgcatcagcgagagccagcacagcctgaagcccaactacctgagccaggccaagacagacttcagcgagcagttccagctgctggaggacctgcagctgaagattgctgccaagctgctgcggagccagatccccccagatgtgcccccacccctggccagcggcctggtgctgaagtaccccatctgcctgcagtgtggccgctgcagcggcctgaactgccaccacaagctgcagaccaccagcggcccctacctgctgatctacccccagctgcacctggtgaggaccccagagggccatggagaggtgcggctgcacctgggcttccggctgcgcatcggcaagaggagccagatcagcaagtaccgggagcgggacaggcctgtgatccgccgcagccccatcagccccagccagaggaaggccaagatctacacccaggccagcaagagccccaccagcaccatcgacctgcagagcggccccagccagagccctgcccctgtgcaggtgtacatcagaagaggccagaggagcaggccagacctggtggagaagaccaagacccgggcccctggccactatgagttcacccaggtgcacaacctgcctgagagtgacagcgagagcacccagaatgagaagagggccaaggtgaggaccaagaagaccagtgacagcaagtaccccatgaagaggatcaccaagaggctgaggaagcacaggaagttctacaccaacagcaggaccaccatcgagagccccagccgggagctggccgcccacctgcggaggaagagaattggagccacccagaccagcacagccagcctgaagaggcagcccaagaagcccagccagcccaagttcatgcagctgctcttccagagcctgaagagggccttccagacagcccacagggtcatcgcctctgtgggcaggaagcctgtggatggcaccaggccagacaacctgtgggccagcaagaactactaccccaagcagaatgcccgggactactgcctgcccagcagcatcaagagggacaagaggtctgctgacaagctgaccccagctggcagcaccatcaagcaggaggacatcctgtggggcggcaccgtgcagtgccgcagcgcccagcagccccggcgggcctacagcttccagccccggcccctgcggctgcccaagcccacagacagccagagcggcatcgccttccagacagcctctgtgggccagcccctgaggacagtgcagaaggacagcagcagccgcagcaagaagaacttctacagaaatgagaccagcagccaggagagcaagaacctgagcaccccaggcaccagggtgcaggcccggggccgcatcctgcccggcagccctgtgaagaggacctggcaccgccacctgaaggacaagctgacccacaaggagcacaaccaccccagcttctaccgggagaggaccccccggggccccagcgagaggaccaggcacaaccccagctggaggaaccacaggagccccagcgagaggagccagaggagcagcctggagcggcggcaccacagccccagccagaggagccactgcagccccagcaggaagaaccacagcagccccagcgagaggtcctggaggagccccagccagaggaaccactgcagccccccagagaggagctgccacagcctgtctgagcggggcctgcacagccccagccagaggagccaccggggccccagccagaggaggcaccacagccccagcgagaggagccacaggagccccagcgagaggagccacaggagcagcagcgagcggcggcacaggagccccagccagaggagccaccggggccccagcgagaggagccactgcagccccagcgagcggcggcacaggagccccagccagaggagccaccggggccccagcgagcggcggcaccacagccccagcaagaggagccacaggagccctgcccggcgcagccacaggagccccagcgagaggagccaccacagccccagcgagaggagccaccacagccccagcgagcggcggcaccacagccccagcgagaggagccactgcagccccagcgagaggagccactgcagccccagcgagcggcggcacaggagccccagcgagcggcggcaccacagccccagcgagaagagccaccacagccccagcgagaggagccaccacagccccagcgagaggagaagacacagccccctggagaggagccgccacagcctgctggagaggagccacaggagccccagcgagcggcgcagccacaggagctttgagaggagccaccggcgcatcagcgagaggagccacagccccagcgagaagagccacctgagccccctggagaggagccgctgcagccccagcgagcggcggggccacagcagcagcggcaagacctgccacagccccagcgagaggagccacaggagccccagcggcatgaggcagggccgcaccagcgagaggagccacaggagcagctgtgagaggaccaggcacagccccagcgagatgaggcctggccggcccagcggcaggaaccactgcagccccagcgagaggagcagaagaagccccctgaaggagggcctgaagtacagcttccctggagagcggcccagccacagcctgagccgggacttcaagaaccagaccaccctgctgggcaccacccacaagaaccccaaggccggccaggtgtggaggcctgaggccaccaggtag

SEQ ID NO: 36596 - DNA, 612 bp, Artificial Sequence
  Description of Artificial Sequence: Synthetic coding sequence
atgacagtgaagtggaagcagctgagcgccccagccagcggggctgagatccagcgcttccctgtgcctgctgtggagcctgtgcctgcccctggagctgacagccccccaggcacagccctggagctggaggaggcccctgagcccagctgccgctgccccggcacagcccaggaccagcccagcgaggagctgcctgacttcatggcccctcctgtggagcccccagccagcgccctggagctgaaggtgtggctggagctggaggtggccgagcggggcggccagcacagcagcagccagcagctgccccactgcagccagagctgggcccagtggaagctgtggaggcagaggcctggctttgccatctgggcccccctgccccactggaggggcaccagcctcatccagcagagcagcagccctgctgctgagggccctgctgccacagctgctggagctgtgtgcctgcctgctgggggcgctggggagcaggagaaggagcctgtgtcccggggcagcagccgcagcagctgcagccagaggaggcctcctcctcctggcatggaggtgtgcccccagctgggcatctgggccatctgcccctag

SEQ ID NO: 36597 - DNA, 630 bp, Artificial Sequence
  Description of Artificial Sequence: Synthetic coding sequence
atgtttgtgcggcctgagagcggggagcagggccctgagaccctggccccagccagcggggctgagatccagcgcttccctgtgcctgctgtggagcctgtgcctgcccctggagctgacagccccccaggcacagccctggagctggaggaggcccctgagcccagctgccgctgccccggcacagcccaggaccagcccagcgaggagctgcctgacttcatggcccctcctgtggagcccccagccagcgccctggagctgaaggtgtggctggagctggaggtggccgagcggggcggccagcacagcagcagccagcagctgccccactgcagccagagctgggcccagtggaagctgtggaggcagaggcctggctttgccatctgggcccccctgccccactggaggggcaccagcctcatccagcagagcagcagccctgctgctgagggccctgctgccacagctgctggagctgtgtgcctgcctgctgggggcgctggggagcaggagaaggagcctgtgtcccggggcagcagccgcagcagctgcagccagaggaggcctcctcctcctggcatggaggtgtgcccccagctgggcatctgggccatctgcccctag

SEQ ID NO: 36598 - DNA, 1725 bp, Artificial Sequence
  Description of Artificial Sequence: Synthetic coding sequence
atggagcccaacagcctgcggaccaaggtgcctgccttcctgagtgacctgggcaaggccaccctgcggggcatcagaaaatgtccccgctgtggcacctacaacggcacccggggcctgagctgcaagaacaagacctgtggcaccatcttccgctatggagccaggaagcagcccagcgtggaggccgtgaagatcatcaccggcagtgacctgcaggtgtacagcgtgcggcagagggaccggggccctgactaccgctgctttgtggagctgggcgtgtctgagaccaccatccagacagtggatggcaccatcatcacccagctgagcagcggccgctgctacgtgcccagctgcctgaaggccgccacccagggcgtggtggagaaccagtgccagcacatcaagctggccgtgaactgccaggccgaggccacccccctgaccctgaagagctctgtgctgaatgccatgcaggccagccctgagaccaagcagaccatctggcagctggccacagagcccaccggccccctggtgcagaggatcaccaagaacatcctggtggtgaagtgcaaggccagccagaagcacagcctgggctacctgcacaccagctttgtgcagaaggtgtctgggaagagcctgcctgagcggcgcttcttctgcagctgccagaccctgaagagccacaagagcaatgccagcaaggatgaaacagcccagcgctgcatccacttctttgcctgcatctgtgcctttgccagtgatgagaccctggcccaggagttcagtgacttcctgaactttgacagcagcggcctgaaggagatcatcgtgccccagctgggctgccacagcgagagcacagtgtctgcctgtgagagcacagccagcaagagcaagaagaggaggaaggatgaggtgtctggggcccagatgaacagcagcctgctgccccaggatgctgtgagcagcaacctgaggaagagcggcctgaagaagcctgtggtggccagcagcctgaagaggcaggcctgtggccagctgctggatgaggcccaggtgaccctgtccttccaggactggctggcctctgtgacagagcgcatccaccagaccatgcactaccagtttgatggcaagccagagcccctggtgttccacatcccccagagcttctttgatgccctgcagcagaggatcagcatcggcagcgccaagaagaggctgcccaacagcaccacagcctttgtgaggaaggatgccctgcccctgggcaccttcagcaagtacacctggcacatcaccaacatcctgcaggtgaagcagatcctggacaccccagagatgcccctggagatcaccaggagcttcatccagaacagagatggcacctatgagctgttcaagtgccccaaggtggaggtggagagcattgctgagacctacggccgcatcgagaagcagcctgtgctgcggcccctggagctgaagaccttcctgaaggtgggcaacaccagcccagaccagaaggagcccacccccttcatcatcgagtggatcccagacatcctgccccagagcaagatcggggagctgcgcatcaagtttgaatatggccaccacagaaatggccacgtggccgagtaccaggaccagaggcctcccctggaccagcccctggagctggcccccctgaccaccatcaccttcccctag

SEQ ID NO: 36599 - DNA, 69 bp, Artificial Sequence
  Description of Artificial Sequence: Synthetic coding sequence
atggagcccaacagcctgcggaccaaggtgcctgccttcctgagtgacctgggcaaggccaccctgtag

SEQ ID NO: 36600 - DNA, 480 bp, Artificial Sequence
  Description of Artificial Sequence: Synthetic coding sequence
atggagcccaacagcctgcggaccaaggtgcctgccttcctgagtgacctgggcaaggccaccctgcggggcatcagaaaatgtccccgctgtggcacctacaacggcacccggggcctgagctgcaagaacaagacctgtggcaccatcttccgctatggagccaggaagcagcccagcgtggaggccgtgaagatcatcaccggcagtgacctgcaggtgtacagcgtgcggcagagggaccggggccctgactaccgctgctttgtggagctgggcgtgtctgagaccaccatccagacagtggatggcaccatcatcacccagctgagcagcggccgctgctacgtgcccagctgcctgaaggccgccacccagggcgtggtggagaaccagtgccagcacatcaagctggccgtgaactgccaggccgaggccacccccctgaccctgaagagctctgtgctgaatgccatgtag

SEQ ID NO: 36601 - DNA, 387 bp, Artificial Sequence
  Description of Artificial Sequence: Synthetic coding sequence
atggagcccaacagcctgcggaccaaggtgcctgccttcctgagtgacctgggcaaggccaccctgcggggcatcagaaaatgtccccgctgtggcacctacaacggcacccggggcctgagctgcaagaacaagacctgtggcaccatcttccgctatggagccaggaagcagcccagcgtggaggccgtgaagatcatcaccggcagtgacctgcaggtgtacagcgtgcggcagagggaccggggccctgactaccgctgctttgtggagctgggcgtgtctgagaccaccatccagacagtggatggcaccatcatcacccagctgagcagcggccgctgctacgtgcccagctgcctgaaggccgccacccagggcgtgtag

SEQ ID NO: 36602 - DNA, 1725 bp, Artificial Sequence; identical to SEQ ID NO: 36598
  Description of Artificial Sequence: Synthetic coding sequence

SEQ ID NO: 36603 - DNA, 180 bp, Artificial Sequence
  Description of Artificial Sequence: Synthetic coding sequence
atggagcccaacagcctgcggaccaaggtgcctgccttcctgagtgacctgggcaaggccaccctgcggggcatcagaaaatgtccccgctgtggcacctacaacggcacccggggcctgagctgcaagaacaagacctgtggcaccatcttccgctatggagccaggaagcagccctag

SEQ ID NO: 36604 - DNA, 183 bp, Artificial Sequence
  Description of Artificial Sequence: Synthetic coding sequence
atggagcccaacagcctgcggaccaaggtgcctgccttcctgagtgacctgggcaaggccaccctgcggggcatcagaaaatgtccccgctgtggcacctacaacggcacccggggcctgagctgcaagaacaagacctgtggcaccatcttccgctatggagccaggaagcagcccagctag

SEQ ID NO: 36605 - DNA, 96 bp, Artificial Sequence
  Description of Artificial Sequence: Synthetic coding sequence
atggagcccaacagcctgcggaccaaggtgcctgccttcctgagtgacctgggcaaggccaccctgcggggcatcagaaaatgtccccgctgctag

SEQ ID NO: 36606 - DNA, 507 bp, Artificial Sequence
  Description of Artificial Sequence: Synthetic coding sequence
atggagcccaacagcctgcggaccaaggtgcctgccttcctgagtgacctgggcaaggccaccctgcggggcatcagaaaatgtccccgctgtggcacctacaacggcacccggggcctgagctgcaagaacaagacctgtggcaccatcttccgctatggagccaggaagcagcccagcgtggaggccgtgaagatcatcaccggcagtgacctgcaggtgtacagcgtgcggcagagggaccggggccctgactaccgctgctttgtggagctgggcgtgtctgagaccaccatccagacagtggatggcaccatcatcacccagctgagcagcggccgctgctacgtgcccagctgcctgaaggccgccacccagggcgtggtggagaaccagtgccagcacatcaagctggccgtgaactgccaggccgaggccacccccctgaccctgaagagctctgtgctgaatgccatgcaggccagccctgagaccaagcagacctag

SEQ ID NO: 36607 - DNA, 339 bp, Artificial Sequence
  Description of Artificial Sequence: Synthetic coding sequence
atggagcccaacagcctgcggaccaaggtgcctgccttcctgagtgacctgggcaaggccaccctgcggggcatcagaaaatgtccccgctgtggcacctacaacggcacccggggcctgagctgcaagaacaagacctgtggcaccatcttccgctatggagccaggaagcagcccagcgtggaggccgtgaagatcatcaccggcagtgacctgcaggtgtacagcgtgcggcagagggaccggggccctgactaccgctgctttgtggagctgggcgtgtctgagaccaccatccagacagtggatggcaccatcatcacccagctgagcagctag

SEQ ID NO: 36608 - DNA, 978 bp, Artificial Sequence
  Description of Artificial Sequence: Synthetic coding sequence
atggattctgagctgaaggaggagatccctgtgcatgaggagttcatcctgtgtggcggcgctgagacccaggtgctgaagtgtggcccctggacagacctcttccatgaccagagcgtgaagaggcccaagctgctgatcttcatcatccctggcaaccctggcttcagcgccttctacgtgccctttgccaaggccctgtacagcctgaccaacagacgcttccctgtgtggaccatcagccatgctggccacgccctggcccccaaggacaagaagatcctgaccaccagcgaggacagcaatgcccaggagatcaaggacatctacggcctgaatggccagatcgagcacaagctggccttcctgcggacccacgtgcccaaggacatgaagctggtgctgattggccacagcatcggcagctacttcaccctgcagatgctgaagagggtgcctgagctgcccgtcatccgggccttcctgctcttccccaccattgaaagaatgtctgagagccccaacggccgcatcgccacccccctgctgtgctggttccgctacgtgctgtatgtgacaggctacctgctgctgaagccctgcccagagaccatcaagagcctgctgatcagaagaggcctgcaggtgatgaacctggagaatgagttcagccccctgaacatcctggagcccttctgcctggccaatgctgcctacctgggcggccaggagatgatggaggtggtgaagagagatgatgagaccatcaaggagcacctgtgcaagctgaccttctactacggcaccatcgacccctggtgccccaaggagtactatgaggacatcaagaaggacttccctgagggggacatccggctgtgtgagaagaacatcccccacgccttcatcacccacttcaaccaggagatggctgacatgattgctgacagcctgaaggatgacctgagcaagatgtag

SEQ ID NO: 36609 - DNA, 834 bp, Artificial Sequence
  Description of Artificial Sequence: Synthetic coding sequence
atggattctgagctgaaggaggagatccctgtgcatgaggagttcatcctgtgtggcggcgctgagacccaggtgctgaagtgtggcccctggacagacctcttccatgaccagagcgtgaagaggcccaagctgctgatcttcatcatcccagacagcaatgcccaggagatcaaggacatctacggcctgaatggccagatcgagcacaagctggccttcctgcggacccacgtgcccaaggacatgaagctggtgctgattggccacagcatcggcagctacttcaccctgcagatgctgaagagggtgcctgagctgcccgtcatccgggccttcctgctcttccccaccattgaaagaatgtctgagagccccaacggccgcatcgccacccccctgctgtgctggttccgctacgtgctgtatgtgacaggctacctgctgctgaagccctgcccagagaccatcaagagcctgctgatcagaagaggcctgcaggtgatgaacctggagaatgagttcagccccctgaacatcctggagcccttctgcctggccaatgctgcctacctgggcggccaggagatgatggaggtggtgaagagagatgatgagaccatcaaggagcacctgtgcaagctgaccttctactacggcaccatcgacccctggtgccccaaggagtactatgaggacatcaagaaggacttccctgagggggacatccggctgtgtgagaagaacatcccccacgccttcatcacccacttcaaccaggagatggctgacatgattgctgacagcctgaaggatgacctgagcaagatgtag

SEQ ID NO: 36610 - DNA, 501 bp, Artificial Sequence
  Description of Artificial Sequence: Synthetic coding sequence
atggattctgagctgaaggaggagatccctgtgcatgaggagttcatcctgtgtggcggcgctgagacccaggtgctgaagtgtggcccctggacagacctcttccatgaccagagcgtgaagaggcccaagctgctgatcttcatcatccctggcaaccctggcttcagcgccttctacgtgccctttgccaaggccctgtacagcctgaccaacagacgcttccctgtgtggaccatcagccatgctggccacgccctggcccccaaggacaagaagatcctgaccaccagcgaggacagcaatgcccaggagatcaaggacatctacggcctgaatggccagatcgagcacaagctggccttcctgcggacccacgtgcccaaggacatgaagctggtgctgattggccacagcatcggcagctacttcaccctgcagatgctgaagagggtgcctgagctgcccctgatgctgcccaccctgggcgccaagaagtag

SEQ ID NO: 36611 - DNA, 588 bp, Artificial Sequence
  Description of Artificial Sequence: Synthetic coding sequence
atgaagctggtgctgattggccacagcatcggcagctacttcaccctgcagatgctgaagagggtgcctgagctgcccgtcatccgggccttcctgctcttccccaccattgaaagaatgtctgagagccccaacggccgcatcgccacccccctgctgtgctggttccgctacgtgctgtatgtgacaggctacctgctgctgaagccctgcccagagaccatcaagagcctgctgatcagaagaggcctgcaggtgatgaacctggagaatgagttcagccccctgaacatcctggagcccttctgcctggccaatgctgcctacctgggcggccaggagatgatggaggtggtgaagagagatgatgagaccatcaaggagcacctgtgcaagctgaccttctactacggcaccatcgacccctggtgccccaaggagtactatgaggacatcaagaaggacttccctgagggggacatccggctgtgtgagaagaacatcccccacgccttcatcacccacttcaaccaggagatggctgacatgattgctgacagcctgaaggatgacctgagcaagatgtag

SEQ ID NO: 36612 - DNA, 2166 bp, Artificial Sequence
  Description of Artificial Sequence: Synthetic coding sequence
atggagctgggcaagggcaagctgctgaggacaggcctgaatgccctgcaccaggccgtgcaccccatccacggcctggcctggacagatggcaaccaggtggtgctgacagacctgcggctgcacagcggggaggtgaagtttggagacagcaaggtgattggccagtttgaatgtgtgtgtggcctgtcctgggcccctcctgtggctgatgacacccctgtgctgctggccgtgcagcacgagaagcacgtgacagtgtggcagctgtgccccagccccatggagagcagcaagtggctgaccagccagacctgtgagatccggggcagcctgcccatcctgccccagggctgtgtgtggcaccccaagtgtgccatcctgactgtgctgacagcccaggatgtgtccatcttccccaacgtgcacagtgatgacagccaggtgaaggctgacatcaacacccagggccgcatccactgtgcctgctggacccaggacggcctgcggctggtggtggccgtgggcagcagcctgcacagctacatctgggacagcgcccagaagaccctgcaccgctgcagcagctgcctggtgtttgatgtggacagccacgtgtgcagcatcacagccaccgtggacagccaggtggccatcgccacagagctgcccctggacaagatctgtggcctgaatgccagcgagaccttcaacatcccccccaacagcaaggacatgaccccctatgccctgcccgtcatcggggaggtgcgctccatggacaaggaggccacagattctgagaccaacagcgaggtgtctgtgagcagcagctacctggagcccctggacctgacccacatccacttcaaccagcacaagtctgagggcaacagcctcatctgcctgaggaagaaggactacctgaccggcaccggccaggacagcagccacctggtgctggtgaccttcaagaaggctgtgaccatgaccaggaaggtgaccatccctggcatcctggtgcctgacctgattgccttcaacctgaaggcccacgtggtggccgtggccagcaacacctgcaacatcatcctgatctacagcgtcatccccagctctgtgcccaacatccagcagatccggctggagaacacagagcggcccaagggcatctgcttcctgacagaccagctgctgctgatcctggtgggcaagcagaagctgacagacaccaccttcctgcccagcagcaagagtgaccagtatgccatcagcctgattgtgcgggagatcatgctggaggaggagcccagcatcaccagcggggagagccagaccacctacagcaccttcagcgcccccctgaacaaggccaacaggaagaagctgattgagagcctgagcccagacttctgccaccagaacaagggcctgctgctgactgtgaacaccagcagccagaatggccggcccggccgcaccctcatcaaggagatccagagccccctgagcagcatctgtgatggcagcatcgccctggatgctgagcctgtgacccagcctgccagcctgcccaggcacagcagcaccccagaccacaccagcaccctggagcccccccggctgccccagaggaagaacctgcagagcgagaaggagacctaccagctgagcaaggaggtggagatcctgagcaggaacctggtggagatgcagcgctgcctgtctgagctgaccaaccggctgcacaacgggaagaagagcagctctgtgtaccccctgagccaggacctgccctacgtgcacatcatctaccagaagccctactacctgggccctgtggtggagaagagagctgtgctgctgtgtgatggcaagctgcggctgagcacagtgcagcagaccttcggcctgagcctgattgagatgctgcatgacagccactggatcctgctgtctgctgacagcgagggcttcatccccctgaccttcaccgccacccaggagatcatcatcagagatggcagcctgagcagaagtgatgtgttccgggacagcttcagccacagccctggagctgtgagcagcctgaaggtgttcaccggcctggccgcccccagcctggacaccaccggctgctgcaaccacgtggatggcatggcctag

SEQ ID NO: 36613 - DNA, 525 bp, Artificial Sequence
  Description of Artificial Sequence: Synthetic coding sequence
atggagctgggcaagggcaagctgctgaggacaggcctgaatgccctgcaccaggccgtgcaccccatccacggcctggcctggacagatggcaaccaggtggtgctgacagacctgcggctgcacagcggggaggtgaagtttggagacagcaaggtgattggccagtttgaatgtgtgtgtggcctgtcctgggcccctcctgtggctgatgacacccctgtgctgctggccgtgcagcacgagaagcacgtgacagtgtggcagctgtgccccagccccatggagagcagcaagtggctgaccagccagacctgtgagatccggggcagcctgcccatcctgccccagggctgtgtgtggcaccccaagtgtgccatcctgactgtgctgacagcccaggatgtgtccatcttccccaacgtgcacagtgatgacagccaggtgaaggctgacatcaacacccagggccgcatccactgtgcctgctggacccaggacggcctgcggctggtggtggcctag

SEQ ID NO: 36614 - DNA, 1869 bp, Artificial Sequence
  Description of Artificial Sequence: Synthetic coding sequence
atggagctgggcaagggcaagctgctgaggacaggcctgaatgccctgcaccaggccgtgcaccccatccacggcctggcctggacagatggcaaccaggtggtgctgacagacctgcggctgcacagcggggaggtgaagtttggagacagcaaggtgattggccagtttgaatgtgtgtgtggcctgtcctgggcccctcctgtggctgatgacacccctgtgctgctggccgtgcagcacgagaagcacgtgacagtgtggcagctgtgccccagccccatggagagcagcaagtggctgaccagccagacctgtgagatccggggcagcctgcccatcctgccccagggctgtgtgtggcaccccaagtgtgccatcctgactgtgctgacagcccaggatgtgtccatcttccccaacgtgcacagtgatgacagccaggtgaaggctgacatcaacacccagggccgcatccactgtgcctgctggacccaggacggcctgcggctggtggtggccgtgggcagcagcctgcacagctacatctgggacagcgcccagaagaccctgcaccgctgcagcagctgcctggtgtttgatgtggacagccacgtgtgcagcatcacagccaccgtggacagccaggtggccatcgccacagagctgcccctggacaagatctgtggcctgaatgccagcgagaccttcaacatcccccccaacagcaaggacatgaccccctatgccctgcccgtcatcggggaggtgcgctccatggacaaggaggccacagattctgagaccaacagcgaggtgtctgtgagcagcagctacctggagcccctggacctgacccacatccacttcaaccagcacaagtctgagggcaacagcctcatctgcctgaggaagaaggactacctgaccggcaccggccaggacagcagccacctggtgctggtgaccttcaagaaggctgtgaccatgaccaggaaggtgaccatccctggcatcctggtgcctgacctgattgccttcaacctgaaggcccacgtggtggccgtggccagcaacacctgcaacatcatcctgatctacagcgtcatccccagctctgtgcccaacatccagcagatccggctggagaacacagagcggcccaagggcatctgcttcctgacagaccagctgctgctgatcctggtgggcaagcagaagctgacagacaccaccttcctgcccagcagcaagagtgaccagtatgccatcagcctgattgtgcgggagatcatgctggaggaggagcccagcatcaccagcggggagagccagaccacctacagcaccttcagcgcccccctgaacaaggccaacaggaagaagctgattgagagcctgagcccagacttctgccaccagaacaagggcctgctgctgactgtgaacaccagcagccagaatggccggcccggccgcaccctcatcaaggagatccagagccccctgagcagcatctgtgatggcagcatcgccctggatgctgagcctgtgacccagcctgccagcctgcccaggcacagcagcaccccagaccacaccagcaccctggagcccccccggctgccccagaggaagaacctgcagagcgagaaggagacctaccagctgagcaaggaggtggagatcctgagcaggaacctggtggagatgcagcgctgcctgtctgagctgaccaaccggctgcacaacgggaagaagagcagctctgtgtaccccctgagccaggacctgccctacgtgcacatcatctaccagatccccaccggcttcttcagcctgctgactgtgcgggccctgagcaggtag

SEQ ID NO: 36615 - DNA, 480 bp, Artificial Sequence
  Description of Artificial Sequence: Synthetic coding sequence
atggagagccggcccagcggccggcagcacgcctctgaaggagatggagaccagagccccacccagtgtgccggcatgaggagcagcggccgcagtgaccagccctacgtgctgaagggcaaccccctgctgctgcgggtgcgctgctacagcggctgtgccagcggcagcggccggcagctgcagctgagcgtcttccaggacctgaaccagttcagccactgccgggtgtggaggagccctgccctgattgtgaagggggagcccccctggtgcagccagcaggacacccagagccccttccagacaggcacccccctggagcggccctgcttcaggatgaagctgagcggctgggagctgaccaagaatgcccagagggccctgggcagcaagctgcagcacatcctgagcctggacagcacccaggcctgtggggccggcggccccaccatcctgcggcccccccgggccccctag

SEQ ID NO: 36616 - DNA, 699 bp, Artificial Sequence
  Description of Artificial Sequence: Synthetic coding sequence
atggctggagatgtgggcggccgcagctgcacagattctgagctgctgctgcaccctgagctgctgagccaggagttcctgctgctgaccctggagcagaagaacattgctgtggagacagatgtgcgggtgaacaaggacagcctgacagacctgtatgtgcagcacgccatccccctgccccagagggacctgcccaagaaccgctggggcaagatgatggagaagaagcgggagcagcacgagatcaagaatgagaccaagaggagcagcacagtggatggcctgaggaagaggcccctcatcgtgtttgatggcagcagcaccagcaccagcatcaaggtgaagaagacagaaaatggagacaatgaccggctgaagcccccaccccaggccagcttcaccagcaatgccttcaggaagctgagcaacagcagcagctctgtgagccccctcatcctgagcagcaacctgcctgtgaacaacaagacagagcacaacaacaatgatgccaagcagaaccacgacctgacccacaggaagagccccagcggccctgtgaagagcccccccctgagccctgtgggcaccacccctgtgaagctgaagagagctgcccccaaggaggaggccgaggccatgaacaacctgaagccaccccaggccaagaggaagatccagcacgtgacctggccctag

SEQ ID NO: 36617 - DNA, 687 bp, Artificial Sequence
  Description of Artificial Sequence: Synthetic coding sequence
atgaggcggctgcgggtgaccacccacgccagcctgcggcccagcaccagcctgccccagcgcttcctgcggggggccctgtgggtggccgactggggcctgctggccaccaccatggctggagatgtgggcggccgcagctgcacagattctgagctgctgctgcaccctgagctgctgagccaggagttcctgctgctgaccctggagcagaagaacattgctgtggagacagatgtgcgggtgaacaaggacagcctgacagacctgtatgtgcagcacgccatccccctgccccagagggacctgcccaagaaccgctggggcaagatgatggagaagaagcgggagcagcacgagatcaagaatgagaccaagaggagcagcacagtggatggcctgaggaagaggcccctcatcgtgtttgatggcagcagcaccagcaccagcatcaaggtgaagaagacagaaaatggagacaatgaccggctgaagcccccaccccagaaccacgacctgacccacaggaagagccccagcggccctgtgaagagcccccccctgagccctgtgggcaccacccctgtgaagctgaagagagctgcccccaaggaggaggccgaggccatgaacaacctgaagccaccccaggccaagaggaagatccagcacgtgacctggccctag

SEQ ID NO: 36618 - DNA, 489 bp, Artificial Sequence
  Description of Artificial Sequence: Synthetic coding sequence
atgggcagccaccccaccccaggcctgcagaggaccaccagcgctggctaccgcctgccccccacccggcccccagcctctgtgtccccagctgcccggggcggccccatggccagccggggcctggccggcggctgccaggccccccaggccctgaaggcccagagggtggcccagggcgccgcctgtgatggagtgcagcaggaccagctgtggagggagctgctggaggccgagcggcggggccagcagcgctggatccagaactggagcttcctgaaggactatgaccccatgggcaacaagaaggagcctgagaagctgcctgaccacgtgcccctcttcagtgacacagtgcccagcagcaccaaccaggtggtgggcagccggctggacacccccctgggccagaccctcatccgcatggacttcttcttcacagaaggagccaggaagaagaagctggaggaccagatgcagcccatctag

SEQ ID NO: 36619 - DNA, 489 bp, Artificial Sequence; identical to SEQ ID NO: 36618
  Description of Artificial Sequence: Synthetic coding sequence

SEQ ID NO: 36620 - DNA, 1239 bp, Artificial Sequence
  Description of Artificial Sequence: Synthetic coding sequence
atgctgccccagaacaaggaccaggtgctgccccagacctctgtgctgcccggccggcccacctggggcttcagccagctggtggacagcagcccccacaacctgcagcccctgagcccccaccagggcctgccccccagccagccccccttcagcagcacccagagcagaagacccagcagccccccaccagccagccccagccctggcttccagtttggcagctgtgacagcaacagcgactttgccccccacccctacagccccagcctgcccagcagccccaccttcttccaccagaactacctgagcctgccccggccccgggccagcagccccagcaaccactggctgtaccccagcccccccctgacccccagcttcagccccagccagccccagaacagcagcctgccccacagcccctgccagagccccagccaccctgaggagctgcacagcagcaccctgaccagccctggccccagcccccccagccaccggctgcacagcaaccggcagacctggcgctggcaccagtacagagacaccggcagcggcagccctggggtggtggagcgctgtgtgcccagcgagaaggaccctgcccagttccgggaccccggggccctggcccaggccctggtggtgcagctgggccaccggcgcatcgcccatgacctgcggctgctgctgctgcagcacctgtggctgggccgcacaggccaggcccctgtggtggagtaccccatctgcctggtgtgcctgcggcccaggagccccagctgccccctgccccgctacagaacaggcccccggctgctggccttcccccagctgctgccctgtgtgcagggccaggagagcggccccctgcgcatcggcatcggcttcggcctgcggctgccccagggccaggcccgggccctgcacctgctgcctgagaagaggcccaaggaggccggcccccagggcaaggccacccaggcctgtggccaccagctgcctgccagccagcccccagctgcccaggcccgggctgaccctgtgcccggcacccccagccagaccaggagcttccgctctgctggcctgcagagccccaacagcccccgctgcttcagcggccccccaccccgggcccccaagcaggtgaccaccagcctgaagccccggccctgccccggccccaagaggcctgtgtccctggagctgatcctgcagaagagctctgtgtag

SEQ ID NO: 36621 - DNA, 897 bp, Artificial Sequence
  Description of Artificial Sequence: Synthetic coding sequence
atggacacaggagtgtggggctggggcgctgctgcctgccgctggggccctgctgagagagctgctggcagcctgaatgctgccagcctgcgggaggagcagctgcacctgagcctgctggtgagcagcggctggaggaccatctccttccacgtggtgcctgtggtgcggaggaagctgggcgccccagccctggagggcgtgcagcagatgcctggcttccctgagggcagcctgcggcgcatcctgagccagggcgtggacctggtgcctgccagcgcccagctgtggaggaccagcacagactacctgctgacccggctgctgggggagctgggcagcctgcagggccaccggctggacagcctgagcatcctggacagagtgaaccacgagagctggagggacagcggccagacagatggcctgaccttcggccacctgaagatggtgctgctgtgggcctctgtgctcttcctggcccctgaggactgggccgagctgcagggcgctgtgtaccgcctgctggtggtgctgctgtgctgcctggccaccaggaagctgccccacttcctgcacccccagaggaacctgctgcagggcagcggcctggacctgggcgccatctaccagagggtggagggctttgccagccagcctgaggccgccctgcgcatccacgccacccacctgggccgcagccccccaccaagaattggcagcggcctgaaggccctgctgcagctgcctgccagtgaccccacctactgggccacagcctactttgatgtgctgctggacaagttccaggtgttcaacatccaggacaaggaccgcatcagcgccatgcagagcatcttccagaagaccaggaccctgggcggggaggagagctag

SEQ ID NO: 36622 - DNA, 1344 bp, Artificial Sequence
  Description of Artificial Sequence: Synthetic coding sequence
atgcctgccccagccctgcccaccagcgccatggctgtgcaggtgcccctgtggcaccactacctgcaggccatccgcagccgggaggccccccgggcccaggacttccagagagcagaaaatgtgctgctgactgtgctggagcgggtgcacgccctggacccccgcttcatcgtggactacagccggggcctggaggccttccagtttgccctgcggagcagcgaggaccccatggacatggaggtgcccctgtgggtggatgctgaggccctgctgattgaggagcctgaggccacccagccagaagatggcctggagctgtgccacctgggcgtgccccgggagggcgccggcctggagcgctggaccacagaggacaccttcaccgccagcagtgaaggagatgccaagtgccggggccacatcgtgcccagcaaggtgctgtgtgtgctgaaggacctgctggtggccgccatcgtgcactgcaagcaccacagcctgattgcccctggcagcctgaatgctgccagcctgcgggaggagcagctgcacctgagcctgctggtgagcagcggctggaggaccatctccttccacgtggtgcctgtggtgcggaggaagctgggcgccccagccctggagggcgtgcagcagatgcctggcttccctgagggcagcctgcggcgcatcctgagccagggcgtggacctggtgcctgccagcgcccagctgtggaggaccagcacagactacctgctgacccggctgctgggggagctgggcagcctgcagggccaccggctggacagcctgagcatcctggacagagtgaaccacgagagctggagggacagcggccagacagatggcctgaccttcggccacctgaagatggtgctgctgtgggcctctgtgctcttcctggcccctgaggactgggccgagctgcagggcgctgtgtaccgcctgctggtggtgctgctgtgctgcctggccaccaggaagctgccccacttcctgcacccccagaggaacctgctgcagggcagcggcctggacctgggcgccatctaccagagggtggagggctttgccagccagcctgaggccgccctgcgcatccacgccacccacctgggccgcagccccccaccccgcatcggcagcggcctgaaggccctgctgcagctgcctgccagtgaccccacctactgggccacagcctactttgatgtgctgctggacaagttccaggtgttcaacatccaggacaaggaccgcatcagcgccatgcagagcatcttccagaagaccaggaccctgggcggggaggagagctag

SEQ ID NO: 36623 - DNA, 840 bp, Artificial Sequence
  Description of Artificial Sequence: Synthetic coding sequence
atggacaccggcagcctgaatgctgccagcctgcgggaggagcagctgcacctgagcctgctggtgagcagcggctggaggaccatctccttccacgtggtgcctgtggtgcggaggaagctgggcgccccagccctggagggcgtgcagcagatgcctggcttccctgagggcagcctgcggcgcatcctgagccagggcgtggacctggtgcctgccagcgcccagctgtggaggaccagcacagactacctgctgacccggctgctgggggagctgggcagcctgcagggccaccggctggacagcctgagcatcctggacagagtgaaccacgagagctggagggacagcggccagacagatggcctgaccttcggccacctgaagatggtgctgctgtgggcctctgtgctcttcctggcccctgaggactgggccgagctgcagggcgctgtgtaccgcctgctggtggtgctgctgtgctgcctggccaccaggaagctgccccacttcctgcacccccagaggaacctgctgcagggcagcggcctggacctgggcgccatctaccagagggtggagggctttgccagccagcctgaggccgccctgcgcatccacgccacccacctgggccgcagccccccaccccgcatcggcagcggcctgaaggccctgctgcagctgcctgccagtgaccccacctactgggccacagcctactttgatgtgctgctggacaagttccaggtgttcaacatccaggacaaggaccgcatcagcgccatgcagagcatcttccagaagaccaggaccctgggcggggaggagagctag

SEQ ID NO: 36624 - DNA, 402 bp, Artificial Sequence
  Description of Artificial Sequence: Synthetic coding sequence
atgcctgccccagccctgcccaccagcgccatggctgtgcaggtgcccctgtggcaccactacctgcaggccatccgcagccgggaggccccccgggcccaggacttccagagagcagaaaatgtgctgctgactgtgctggagcgggtgcacgccctggacccccgcttcatcgtggactacagccggggcctggaggccttccagtttgccctgcggagcagcgaggaccccatggacatggaggtgcccctgtgggtggatgctgaggccctgctgattgaggagcctgaggccacccagccagaagatggcctggagctgtgccacctgggcgtgccccgggagggcgccggcctggagcgctggaccacagaggacaccttcaccgccagcagctag

SEQ ID NO: 36625 - DNA, 2889 bp, Artificial Sequence
  Description of Artificial Sequence: Synthetic coding sequence
atgatcagcaccagggtgatggacatcaagctgcgggaggccgctgagggcctgggggaggacagcacaggcaagaagaagagcaagttcaagaccttcaagaagttcttcggcaagaagaagaggaaggagagccccagcagcacaggcagcagcacctggaagcagagccagaccagaaatgaagtcatcgccatcgagagcggccctgtgggctatgattctgaagatgagctggaggagagccggggcaccctgggcagccgggccctgagccatgacagcatcttcatccctgagagcggccaggatgccaccaggcctgtgcgggtcttcagccaggagaatgtgtgtgaccgcatcaaggccctgcagctgaagatccagtgcaatgtgaagatgggccccccacctcctcctgggggcctgcctgccaagagaggagaagatgctggcatgagcagtgaagatgatggcctgcccaggagccccccagagatgagcctgctgcatgatgtgggccctggcaccaccatcaaggtgtctgtggtgtccccagaccacgtgtctgacagcacagtgtctgcccgcatcagtgacaacagcctggcccctgtggccgacttctcctacccagctgagagcagcagctgcctggacaacagcgctgccaagcacaagctgcaggtgaagcccaggaaccagaggagcagcaagatgaggcggctgagcagccgggcccagagcgagagcctgagtgacctgacctgcaccccagaggaggaggagaatgaggagaagcccctgctggaggtgtccccagaggagcggcccagcagcggccagcaggatgtggccccagaccggggccctgagcccggccccccagcccccctgcccccacctgggggcgcccgggcccggcgggcccggctgcagcacagcagcgccctgacagcctctgtggaggagggcggcgtgcctggagaggaccccagcagcaggcctgccaccccagagctggccgagcctgagagcgcccccaccctgcgggtggagccccccagccccccagagggcccccccaaccctggcccagatggcggcaagcaggatggagaggcccccccagctggcccctgtgccccagccacagacaaggccgaggaggtggtgtgtgccccagaagatgtggccagccccttccccacagccatccctgagggggacaccaccccacctgagacagatcctgctgccaccagcgaggcccccagcgccagagatggccctgagaggtctgtgcccaaggaggccgagcccaccccacctgtgctgcctgatgaggagaagggccccccaggccctgcccctgagcctgagcgggaggccgagacagagcctgagcggggggccggcacagagcctgagagaattggaacagagcccagcacagccccagcccccagccccccagcccccaagagctgcctgaagcacaggcctgctgctgccagcgagggccctgctgccagcccccccctggccgctgctgagagcccccctgtggagcccggccctggcagcctggatgctgaggccgccgcccctgagcggcccaaggccgagagagctgaggcccccccagctggagctgagagagctgcccctgagaggaaggccgagcggggcggcgctgagctgcggggggccaagaagttctctgtgagcagctgccgggcccggcccaggcctggggtgtcccggcccctggagcgggccagcggccgcctgcccctggcccggagcggccctgtgtggaggtctgaggccgccctggatgacctgcagggcctgcctgagccccagcacgccaagccaggccccaggaagctggccgagcggggcccccaggacagcggggaccgggccgccagccctgctggccccaggaagagcccccaggaggccgctgctgcccctggcacccgggagccctgcccagctgcccaggagcccgcccccagtgaagatagaaaccccttccctgtgaagctgcggagcaccagcctgagcctgaagtacagagatggagccagccaggaggtgaagggcgtgaagcgctacagcgctgaggtgcggctggagaggagcctgactgtgctgcccaaggaggagaagtgccccctgggcacagccccagccctgcggggcacccgggcccccagcgaccagggcaagggcaaggcccggcccccagagcccctgagcagcaagccacccctgcccaggaagcccctgctgcagagcttcaccctgccccaccagcctgcccccccagatgctggccctggagagcgggagcccaggaaggagcccaggacagctgagaagaggcccctgcggagaggagctgagaagagcctgcccccagctgccaccggccctggagcagatggccagcctgccccaccctggatcaccgtgacccggcagaagaggcggggcaccctggaccagccccccaaccaggaggacaagccaggggcccggaccctgaagtctgagcccgggaagcaggccaaggtgcctgagcggggccaggagcctgtgaagcaggccgactttgtgcgcagcaagagcttcctgatcacccctgtgaagccagctgtggacaggaagcagggcgccaagctgaacttcaaggagggcctgcagaggggcatcagcctgagccaccagaacctggcccagagcgctgtgatgatggagaaggagctgcaccagctgaagagggccagctatgccagcacagaccagcccagctggatggagctggccaggaagaagagccaggcctggagcgacatgccccagatcatcaagtag

SEQ ID NO: 36626 - DNA, 1188 bp, Artificial Sequence
  Description of Artificial Sequence: Synthetic coding sequence
atggccctgcccggctaccccctgggcaatgtggatgacagccgcagcaaggacagccctgctggggagccccagggccaggtgcccctgacagcagatgtgctggccgtgagcagctctgtggccagcacagactggcaggacatcgaccaggccagcttcaagacagccaccccccgggccatcagcaccagcggggacaaggacaagtctgctgtggtgcctgagcacggccagaagacccccaggaagatcacccccctgctgcccagccagaaccccagccccctgcaggtgtccatgagcctgcagaacccagcctgggaccggcaggtgcaggatgcccggaccagccagagcctggtggtgttccccagccacctgctgggcaaggacaagatgagccagatggcctctgtgcctgagcgggagcctgagagcgcccccagcgcccccagcgctgagctgcagagcacccagcacatggaggcccagcctgtggagagtgatgctgaccacgtgacagctggggccaacggccagcacggcccccaggccgccagcaccaccaagtctgctgaggagaaggccgagcaccccaaggccccccaccctgaggccgaggccctgcccagtgatgagagccctgtggccatgggcgccaacgtggtggacagcctgggggacctgcagacctggttcttccccccacctcctgctggctctgtgagccccagccctggcccccatgaggtggccctgggccggcggcccctggacagcagcctgtacacagcctctgaagaaaattcctacatgaggtccatgaccagcctgctggacagaggagagggcagcatcagcagcctggccgacatcctggtgtggagcgagaccaccatgggcatggccatcgccaccggcttcctggacagcggccacagcacagtggccgacctgctgcacagcagcggccccagcctgcggtctgtgcccagcctggtgggctctgtgagcagcgccttcagcagcggcctggtgtctggcaccagcagcgccctgcggaccatcaccagggtgctggagaccgtggagcagaggacagtggagggcatccgcagcgccatgagatacctgaccagccacctgaccccccggcaggcccaggccgaccccaactatgactag

SEQ ID NO: 36627 - DNA, 534 bp, Artificial Sequence
  Description of Artificial Sequence: Synthetic coding sequence
atggaccagcctgctgtggccacagccagcaccagcatccgggaggacctggtgggcggggagagcttcatcacagccagcaagccagcccagaagaccagcagctttgagcgggagggctggtggagaattgccctgacagacacccccatccctggcacctaccacctgaagaccttcatcgaggagagcctgctgaaccctgtgattgccacctacaacttcaagaatgaaggaaggaagaagccacccctggtgcagaggaacaaccctgtgctgaatgacctgccccagtacatgcccccagacttcctggacctgctgaagaagcaggtggccacctacagcttcaaggacaagccccggcccagccccagcaccctggtggacaaggaccagagcctgcagctgagccctggccagtacaacgtgctgcctgcccctgtgcccaagtatgccagccgcagctgtgtgttccgcagcacagtgcagcgcttccccaccacctacttcatccctgtgtccatcatgtag

SEQ ID NO: 36628 - DNA, 747 bp, Artificial Sequence
  Description of Artificial Sequence: Synthetic coding sequence
atggaccagcctgctgtggccacagccagcaccagcatccgggaggacctggtgggcggggagagcttcatcacagccagcaagccagcccagaagaccagcagctttgagcgggagggctggtggagaattgccctgacagacacccccatccctggcacctaccacctgaagaccttcatcgaggagagcctgctgaaccctgtgattgccacctacaacttcaagaatgaaggaaggaagaagccacccctggtgcagaggaacaaccctgtgctgaatgacctgccccagtacatgcccccagacttcctggacctgctgaagaagcaggtggccacctacagcttcaaggacaagccccggcccagccccagcaccctggtggacaaggaccagagcctgcagctgagccctggccagtacaacgtgctgcctgcccctgtgcccaagtatgccagccgcagctgtgtgttccgcagcacagtgcagcgcttccccaccacctacttcatcccccatgagggccctggccctggccactacaacgtgaagatgccacccaccagctctgtgaccagctgcttccagagccgggtgccccgcttcctgcccagctgcagcaagaccccaggccctggggcctacaccaccctgcggcagttccccaagcagagccccaccatcgccaagatgggccaggagcacagcctcttcttcaacaacaacaactggctgctgaagtag

SEQ ID NO: 36629 - DNA, 1164 bp, Artificial Sequence
  Description of Artificial Sequence: Synthetic coding sequence
atgagcagcaaggtgtacagcacaggcagccgggccaaggaccaccagcccagcggcccagaatgtctgcccctgcctgaggccaatgctgaggccatcgacttcctgagcagcctgcacaaggaggagctgcagatgctgttcttcagcgagaccctggccatggtgtctgacacaggagagccccagggcgagctgaccatcgaggtgcagaggggcaagtaccaggagaagctgggcatgctgacctactgcctgtttgtgcacgccagcagccggggcttcctggacaagatgctgtgtggcaacagcctgctgggctacctgtctgagaagctggagctgatggagcagcacagccaggacttcatcaagttcctgatcctgcccatggagaggaagatgagcctgctgaagcaggatgaccagctggccgtgaccaggagcatcaaggagggggaggaggtgaagacaggagtgaccagcttcccctggagcagcatcaagggcttcatcagcgaggccgccaacctggtgctgctgcgggtgatggcctggaggaggatggtgcccagcaatgcccgcttcctgaccctggacacagagggcaagctgtgctacctgacctaccagaacctgggcttccagaccatccaggtggaccaccagcaggccgaggtgttcatcgtggagcagacagtgcacgccgaggagggcatccccatgagctgccagtactacctgctgagtgatggccacctggccaagaggatccaggtgggcagccctggctgctgcatcatcaccaagatgcccatcctgcgggaggaggatgaaattgagcccaggcctgtgtttgagaagaagcccctggtgtgggaggaggacatggagctgtacagcaagttcctggacaggaaggaggagctgcggctgggccacgccagctacctgcggcagcaccctgaggcccacgccctgatcagtgacttcctgctcttcctgctgctgcggcagccagaagatgtggtgacctttgctgctgagttcttcggcccctttgacccctggaggcccagcagccctgccctgggcagcagccaccggcccaaccccttccgcagcctggagccagaaggagatgcccggagcggggccgcctag

SEQ ID NO: 36630 - DNA, 1761 bp, Artificial Sequence
  Description of Artificial Sequence: Synthetic coding sequence
atgtctgtgcaccagatcaggaagcatgctgtgctgccccccatcatctgccgcagtgacaaggagttcctggagagcgtgcagcgctacatcatcacagaaacagagcggctgggctgcagcgaggagggccctgcagatgagtactacatcatctacagaaatgtgtttgacaaggtgattgagcacatcacagcctacaagagcatcctgaccagcatcaagaaggagtatgatgccttcatcgagaccatcaagaaggacaggaggaccaccttctgcctgcacggcaagctgaagggcctggccgctgagcccacagccctggtgtactacaggaagaggaccatccagctggaggccaagatgaggatcatcgagagcaacagcagcaagatccagagccagattgaccacatcaagcagtgcagagcagaatatgacaccaaggaggtgaagtactgcaccttcagcaaggaccccagcaagcccatccctggcatgaccctgcaggagagcatgaacctggatgccctgaccaagtacatgaagcacctggaggacaagtatgcagagatcaagcaggccatgctgatcaagtatgtgcctgcccagaggaaggctgacctggatgaggagatgattgtgctgctgaagagaagagatgtggccgagaacctgaacaagaagctgcagttctgccaccagaggctgcagatcatcagccaggccctgagctcctgggtgaagagtgacatgagcagccccttccaggactttgtggagcagatccagaagaccaagtacctgcagggcgaccagggcatcgtggaggagctgatggaggatgacccccggcgggccaaggaggccgagatcatgctgcactacatcgagcgcttcaatgagctgatcagcctgggggagtatgagaaggccgcctgctatgctgccaacagcccccggcgcatcctgaggaacatcggcaccatgaacaccttcaaggctgtgggcaagatccggggcaagcccctgcccctgctgctcttctttgaggccctcttcatcaccagccacgccttcccctgccctgtggatgctgccctgaccctggagggcatcaagtgtggcctgtctgagaagaggctggacctggtgaccaactgggtgacccaggagcggctgaccttcagcgaggaggccggagatgtgatctgtgactatggagagcaggacacctacaacaaggccaagtgcctggccctggcccagatcgtgtacagtgaatgtggcctgcacaagaaggccatcctgtgcctgtgcaagcagggccagacccaccgggtgatggagtacatccagcagctgaaggacttcaccacagatgacctgctgcagctgctgatgagctgcccccaggtggagctgatccagtgcctgaccaaggagctgaatgagaagcagcccagcctgagctttggcctggccatcctgcacctgttctctgctgacatgaagaaggtgggcatcaagctgctgcaggagatcaacaagggcggcattgatgctgtggagagcctgatgatcaatgacagcttctgcagcattgagaagtggcaggaggtggccaacatctgcagccagaatggatttgacaagctgagcaatgacatcaccagcatcctgcggagccaggccgctgtgacagagatcagcgaggaggatgatgctgtgaacctgatggagcacgtgttctggtag

SEQ ID NO: 36631 - DNA, 141 bp, Artificial Sequence
  Description of Artificial Sequence: Synthetic coding sequence
atgtctgtgcaccagatcaggaagcatgctgtgctgccccccatcatctgccgcagtgacaaggagttcctggagagcgtgcagcgctacatcatcacagaaacagagcggctgggctgcagcgaggagggccctgcctag

SEQ ID NO: 36632 - DNA, 414 bp, Artificial Sequence
  Description of Artificial Sequence: Synthetic coding sequence
atggagtacatccagcagctgaaggacttcaccacagatgacctgctgcagctgctgatgagctgcccccaggtggagctgatccagtgcctgaccaaggagctgaatgagaagcagcccagcctgagctttggcctggccatcctgcacctgttctctgctgacatgaagaaggtgggcatcaagctgctgcaggagatcaacaagggcggcattgatgctgtggagagcctgatgatcaatgacagcttctgcagcattgagaagtggcaggaggtggccaacatctgcagccagaatggatttgacaagctgagcaatgacatcaccagcatcctgcggagccaggccgctgtgacagagatcagtgaagaagatgatgctgtgaacctgatggagcacgtgttctggtag

SEQ ID NO: 36633 - DNA, 1761 bp, Artificial Sequence; identical to SEQ ID NO: 36630
  Description of Artificial Sequence: Synthetic coding sequence

SEQ ID NO: 36634 - DNA, 54 bp, Artificial Sequence
  Description of Artificial Sequence: Synthetic coding sequence
atgtctgtgcaccagatcaggaagcatgctgtgctgccccccatcatctgctag

SEQ ID NO: 36635 - DNA, 243 bp, Artificial Sequence
  Description of Artificial Sequence: Synthetic coding sequence
atgtctgtgcaccagatcaggaagcatgctgtgctgccccccatcatctgccgcagtgacaaggagttcctggagagcgtgcagcgctacatcatcacagaaacagagcggctgggctgcagcgaggagggccctgcagatgagtactacatcatctacagaaatgtgtttgacaaggtgattgagcacatcacagcctacaagagcatcctgaccagcatcaagaaggagtatgatgcctag

SEQ ID NO: 36636 - DNA, 501 bp, Artificial Sequence
  Description of Artificial Sequence: Synthetic coding sequence
atggaggccggcccccaccccaggcctggccactgctgcaagccaggcggccgcctggacatgaaccacggctttgtgcaccacatcagaagaaaccagatcgccagagatgattatgacaagaaggtgaagcaggccgccaaggagaaggtgagaagaagacacaccccagcccccacccggcccaggaagccagacctgcaggtgtacctgcccaggcacagagatgtgtctgcccaccccaggaacccagactatgaggagagcggggagagcagcagcagcggcggcagcgagctggagcccagcggccaccagctgttctgcctggagtatgaggccgacagcggggaggtgacctctgtgattgtgtaccagggagatgaccccgggaaggtgtctgagaaggtgtctgcccacacccccctggacccccccatgagggaggccctgaagctgcgcatccaggaggagatcgccaagaggcagagccagcactag

SEQ ID NO: 36637 - DNA, 384 bp, Artificial Sequence
  Description of Artificial Sequence: Synthetic coding sequence
atggaggccggcccccaccccaggcctggccactgctgcaagccaggcggccgcctggacatgaaccacggctttgtgcaccacatcagaagaaaccagatcgccagagatgattatgacaagaaggtgaagcaggccgccaaggagaaggtgagaagaagacacaccccagcccccacccggcccaggaagccagacctgcaggtgtacctgcccaggcacagaggagaggccgcccggcctgcctgcctgcagcctgcccggagcagctgcaatgccctgcccttcagcatcggcaagaaccacttcctgctgctgcgcttcagcagcagccgcctcttccctgagcccccaccccagaggagccagatctctgctgagtag

SEQ ID NO: 36638 - DNA, 606 bp, Artificial Sequence
  Description of Artificial Sequence: Synthetic coding sequence
atggccagccgctctgctggcaccctgctgacagagttcaatgctgcctacgtgcccccaggcctgatgcctggctaccagggccacgtgcccaccgtggccttctcctttggagccccctacggcaccaccaccctgaagtacttccaggaccacaggaacagagccatggagaagagccacacccccttcagccagggcggccacttccccaccatcttcagcaccaaccccaacctgctgctgatggagcgggccagcacccgggaccgctggctgcacaagcccagctacacccgcttcaacctggacagccacaggagcacagagctgaccaacttctaccagatggtgcagcagcacaggaagtactaccaggacaagacaggaacagtgccccgggtgccctactttgccatgcctgtgcgggagcctgagcgctaccccctgcccaccgtgctgccccccctgtgccccaagaagaagtggcacctgctgcggctggcccctgagaacctgaagacctaccagaccttccccagcggcaagagggtgagcccccaggagaggaagaagagggactgctactttgagttccgggcctag

SEQ ID NO: 36639 - DNA, 348 bp, Artificial Sequence
  Description of Artificial Sequence: Synthetic coding sequence
atgcaggtgatgaacctgaatgtgcccatgaggcctggcatcctggtgcagaggcagagcaaggaggtgctggccacccccctggagaacagaagagacatggaggccgaggaggagaaccagatcaatgagaagcaggagccagaaaatgctggggagaccggccaggaggaggatgatggcctgcagaagatccacacctctgtgaccaggacccccagcgtggtggagagccagaagaggcccctgaagggcgtgaccttcagccgggaggtgattgtggtggacctgggcaatgagtaccccacccccaggagctacacccgggagcacaaggagaggaagtag

SEQ ID NO: 36640 - DNA, 585 bp, Artificial Sequence
  Description of Artificial Sequence: Synthetic coding sequence
atgagcctgctggccaagcccatgagctttgagaccacagccatcaccttcttcatcatcctgctgatctgcctgatctgcatcctgctgctgctggtggtgttcctgtacaagtgcttccagggcaggaagggcaaggagaccaagaaggtgccctgcacagatgccaatggaggagtggactgtgccgccgccaaggtggtgaccagcaacccagaagatcatgagcgcatcctgatgcaggtgatgaacctgaatgtgcccatgaggcctggcatcctggtgcagaggcagagcaaggaggtgctggccacccccctggagaacagaagagacatggaggccgaggaggagaaccagatcaatgagaagcaggagccagaaaatgctggggagaccggccaggaggaggatgatggcctgcagaagatccacacctctgtgaccaggaccccatctgtggtggagagccagaagaggcccctgaagggcgtgaccttcagccgggaggtgattgtggtggacctgggcaatgagtaccccacccccaggagctacacccgggagcacaaggagaggaagtag

SEQ ID NO: 36641 - DNA, 381 bp, Artificial Sequence
  Description of Artificial Sequence: Synthetic coding sequence
atggcccctggagaggtgaccatcaccgtgcggctcatccgcagctttgagcacaggaacttcaagcctgtggtgtaccatggagtgaacctggaccagacagtgaaggagttcatcgtgttcctgaagcaggacatccccctgcggaccaacctgcccccacccttcaggaactacaagtatgatgccctgaagatcatccaccaggcccacaagagcaagaccaatgagctggtgctgagcctggaggatgatgagcggctgctgctgaaggaggacagcaccctgaaggctgctggcatcgccagcgagacagaaattgccttcttctgtgaggaggactacaagaactacaaggccaaccccatcagctcctggtag

SEQ ID NO: 36642 - DNA, 381 bp, Artificial Sequence; identical to SEQ ID NO: 36641
  Description of Artificial Sequence: Synthetic coding sequence

SEQ ID NO: 36643 - DNA, 381 bp, Artificial Sequence; identical to SEQ ID NO: 36641
  Description of Artificial Sequence: Synthetic coding sequence

SEQ ID NO: 36644 - DNA, 381 bp, Artificial Sequence; identical to SEQ ID NO: 36641
  Description of Artificial Sequence: Synthetic coding sequence

SEQ ID NO: 36645 - DNA, 1659 bp, Artificial Sequence
  Description of Artificial Sequence: Synthetic coding sequence
atggacaccagcagcgagatgctggtgcgctttggaagaagatgtggccgggccaaggagagcacagagatcagaaattctgaggaggaccaggtgctgtacctgcccctgctgcccagcaaggtggacctgcagcaggtgaccatcatcccccatgatgagtggaagaggatccaggacagcctggaccggctgacccgggaggccgcctgcctgcgggcagagaggaaggccaagaaggagatgcacctgcggagccaggaggtggtgaagcactggaccaacacctacgccggcatgaaggagcagaagctggaggccaagaagaagagagatgaggagattgaagctgagcggcagatcctggacctggaggaggagatctacaagcagggcaagaggaagaaggccattgaaaatgccaagcagtaccagttctaccagacagagcgggtgaagaacttccacagcggcctgctgctgagccgggtgatgaaggagagagatgcccagatcgagttcaggaagagcaagatcaagagtgacaagaagtgggaggagcagctgaagctgaacatcgagaaggccttcaaggaggagcaggagaaggccgagaagaggcaccgggagcgggtggccctggccaaggaccacctgaagcagatcaaggagcacgaggaggaggaggagaggaggaagaagtatgaggagaaggatgctgaggagatcaagaggcagaatgccctgtatgaaattgagatgaggaagaagctggagaagaagcgggaggagatgcatgagagcagaagacgcttcctggagcacatgcaggacaagcacatcatcaaggctgtggagcagcagcagcaggaggaggaggatgagaagatgaggaagttcatcaaggccaagaagaggctcatccagatgggcaaggagaaggaggccgagacccaccggctgatggagaagagaagagagcgcatccacaacttcctgtctgagctgctgaaggagaagctggacaatgaagacatgatcatcgcccgggacattgctgaggccgaggccgagtgggagaagcgggagcgggagaaggatgagaagaacaaggccgagctgaagaccatcgccgagtaccgggccatcgtgatgaagaacaaggaggaggaggagcggcagaggaagattgaggccaaggagcagctgctggccgtgatgaaggctgaccagatcttctgggagcacgagaaggagaagaagtgcaaggctgacaaggagcaccaggaggtgcaggatgcccacatccagcagatggccaagaacaagttcaatgccaagcaggccaagcaggccgagctggactactgccgcctgacagaggccctggtggccgagaaggagaaggagttccaggactatgcccgggaggtgattgagctggagagcgagaccaccaacaagtacatctaccccctggtgaaggctgtgcaggagggccctgggggcggccggggccctgtgtttgtggacagaggaggcctgcggcccagctaccaggccaatgatgtgactggagtgcagctgcccttctacaacagccagggccccaagtacaacttccagaagagcaagaggcggctgggcttcacctggtag

SEQ ID NO: 36646 - DNA, 2679 bp, Artificial Sequence
  Description of Artificial Sequence: Synthetic coding sequence
atgcactggctggccagcgccacccagaccagcgccagcatcgtgagcagcagcctgctgtctgctgtggatgtgagcagcagcctgaccatgtctgagtacttccagaacaccagcctgcctggaacagccaacagccggcagttcagcctgcctgtggtgtccaatgctgccttcctgaccggcagcatcagcaacttcagccgggccagcgccccagccatcagcagcgcctggctgcagcccagcgccagcggcaccagcttccagcccctgatgggcagcgcctacctgtaccagcacagcagcaccaccatgctgagcggcgtgacaggccagagccacatctgcaccagcgctgccagctacccaggagtgtttgagtgggacagcacagccagcacagtgaagaagagcagcagcctgcgggacttcaccgtgaccgtcatcgaccagaacacagctgtgtcctccatgtccatgacagcccagtactacaagaccagtgacaccaacaccatggtgcccctgtaccccagcctgagcgccagcctggtgcagggcaccctgacccagatccccaaccagcagggccacaacctgagcctgccctgccagatcggcagccaggtgtactactacaaccagggcaccctgggcccccagctgagctgcctgcagagctatggctctgtgtcctacacaggctaccgggccagcgcccaccagcctgagatggtgatggtgctgaaggaggtgcagcccaccaacgtgctgccccctgtgtccaccagcggcatgtactacagcgtgagcagccagcccatcacagagacctctgtgcaggtgatggagaccagcctgggcatggacaccagcctgggcctgcagagccccagccagaccttctgcctgccccagaccccagagttcagcaagagcttcagcagcaggaacacccagaccctggagagcaaccccagccctgagctgggggacatcagcatcacccctgtgcagagccccaccaacctgctgaccctgagccctgcccccagccaggagaagaatgaaaatgaaaacctggatgagatcaagaccaacctgagcaggaaccaggacccccccctgctgcctgtggagatcccagacatccaccccctgctggcctgcatcgaccccctgggccaggaggagcagcccggctctgaaaatgccaacctgaggaacaagagcctgagcctggaggaccagggcatctttgaaaatggaattgagagcagcagtgacctggccgacatcaccacctgggtggaggacacctacctgccccccatcttcagcagcctgcaggacctggaccagcctgagaagagctgtgtgatcaagggccacagcgaccaggtgaggaagaacaagcacaaggccagcgagcccatccagggcgcccccaaggccaagatccagcccaagaaccctgagtgcctgctggagcgggaggtggtggtgggcagcgccaccgtgagcaacagcgcctctgtgaacaaggccaagcacagcagcaacaagccccacaaggccgccagcagccgcatcagcaagaccaagagccacggccaggagaagaccaagggcaacaggaagaacagcagcaagaagtctgaggagagcaagcagagcggcaagaaggtgaaggtggaggagaagcagaccatccccaacatgaagaggaagaagaaccagcctgagctgagccagaagaccctgaagaagcccaggagcagcctgggcatgcacatgctggagagcgtgcaggtgttccacgccctgggcaagaagattgacatgaagacaggcttcagcagcagcaggaccctgggcagcagcagcaacacccagaaccggcagcccttccctgccctgaagccctggctggacatccagcacgagggcaagggccctgagaagatccaggtgaaggcccagaagctggatggcagcgctgagaaggaatgtaccagccccagccacagcgagctgcccccacctgggaaggtgaagctgatccccctgcccttcctgaccctggaccagccccaggcccggcacgtgtcccggcggcccaaccccctggccagccggcggcctgctgtggcctacccagcccggccagacagcaccaacagcgcccagagcaatgctgtgaaccccagcaggcctgcccccaccaacaccagcctgaccggccctgccaccccagcccagcccatcagcgccaaggccacccagcccagcagcgccaaccccacccagcccaccgtgccccagagcgctgccagccggcccagcgcctacaagaccagcagctgcagcagcctgcagcgggagcctgtgtccacagctgtgaccagcctgcggagcctgcccaagccccagaaccagttcctgatccaggacttcagcctgcagccccggccctggaggaagcccaccgtgcctgagcctgtgatgagcacccccatcacagaggagcagaggcctgagcgggaggccatgaagaggaaggcccagcaggagagagaaaatgctgccaagtacaccagcctgggcaaggtgcagttcttcatcgagcgggagcgggacatggagattgctgagtactacggctacaccatctag

SEQ ID NO: 36647 - DNA, 2769 bp, Artificial Sequence
  Description of Artificial Sequence: Synthetic coding sequence
atgcactggctggccagcgccacccagaccagcgccagcatcgtgagcagcagcctgctgtctgctgtggatgtgagcagcagcctgaccatgtctgagtacttccagaacaccagcctgcctggaacagccaacagccggcagttcagcctgcctgtggtgtccaatgctgccttcctgaccggcagcatcagcaacttcagccgggccagcgccccagccatcagcagcgcctggctgcagcccagcgccagcggcaccagcttccagcccctgatgggcagcgcctacctgtaccagcacagcagcaccaccatgctgagcggcgtgacaggccagagccacatctgcaccagcgctgccagctacccaggagtgtttgagtgggacagcacagccagcacagtgaagaagagcagcagcctgcgggacttcaccgtgaccgtcatcgaccagaacacagctgtgtcctccatgtccatgacagcccagtactacaagaccagtgacaccaacaccatggtgcccctgtaccccagcctgagcgccagcctggtgcagggcaccctgacccagatccccaaccagcagggccacaacctgagcctgccctgccagatcggcagccaggtgtactactacaaccagggcaccctgggcccccagctgagctgcctgcagagctatggctctgtgtcctacacaggctaccgggccagcgcccaccagcctgagatggtgatggtgctgaaggaggtgcagcccaccaacgtgctgccccctgtgtccaccagcggcatgtactacagcgtgagcagccagcccatcacagagacctctgtgcaggtgatggagaccagcctgggcatggacaccagcctgggcctgcagagccccagccagaccttctgcctgccccagaccccagagttcagcaagagcttcagcagcaggaacacccagaccctggagagcaaccccagccctgagctgggggacatcagcatcacccctgtgcagagccccaccaacctgctgaccctgagccctgcccccagccaggagaagaatgaaaatgaaaacctggatgagatcaagaccaacctgagcaagcccctggatgtgcaccagatcctgattggcaaccaggacccccccctgctgcctgtggagatcccagacatccaccccctgctggcctgcatcgaccccctgggccaggaggagcagcccggctctgaaaatgccaacctgaggaacaagagcctgagcctggaggaccagggcatctttgaaaatggaattgagagcagcagtgacctggccgacatcaccacctgggtggaggacacctacctgccccccatcttcagcagcctgcaggacctggaccagcctgagagccccagcgccaagaaggccaaggacaccagcgccatcaaggtgaaccaggtgcaggagaagagctgtgtgatcaagggccacagcgaccaggtgaggaagaacaagcacaaggccagcgagcccatccagggcgcccccaaggccaagatccagcccaagaaccctgagtgcctgctggagcgggaggtggtggtgggcagcgccaccgtgagcaacagcgcctctgtgaacaaggccaagcacagcagcaacaagccccacaaggccgccagcagccgcatcagcaagaccaagagccacggccaggagaagaccaagggcaacaggaagaacagcagcaagaagtctgaggagagcaagcagagcggcaagaaggtgaaggtggaggagaagcagaccatccccaacatgaagaggaagaagaaccagcctgagctgagccagaagaccctgaagaagcccaggagcagcctgggcatgcacatgctggagagcgtgcaggtgttccacgccctgggcaagaagattgacatgaagacaggcttcagcagcagcaggaccctgggcagcagcagcaacacccagaaccggcagcccttccctgccctgaagccctggctggacatccagcacgagggcaagggccctgagaagatccaggtgaaggcccagaagctggatggcagcgctgagaaggaatgtaccagccccagccacagcgagctgcccccacctgggaaggtgaagctgatccccctgcccttcctgaccctggaccagccccaggcccggcacgtgtcccggcggcccaaccccctggccagccggcggcctgctgtggcctacccagcccggccagacagcaccaacagcgcccagagcaatgctgtgaaccccagcaggcctgcccccaccaacaccagcctgaccggccctgccaccccagcccagcccatcagcgccaaggccacccagcccagcagcgccaaccccacccagcccaccgtgccccagagcgctgccagccggcccagcgcctacaagaccagcagctgcagcagcctgcagcgggagcctgtgtccacagctgtgaccagcctgcggagcctgcccaagccccagaaccagttcctgatccaggacttcagcctgcagccccggccctggaggaagcccaccgtgcctgagcctgtgatgagcacccccatcacagaggagcagaggcctgagcgggaggccatgaagaggaaggcccagcaggagagagaaaatgctgccaagtacaccagcctgggcaaggtgcagttcttcatcgagcgggagcgggacatggagattgctgagtactacggctacaccatctag

SEQ ID NO: 36648 - DNA, 582 bp, Artificial Sequence
  Description of Artificial Sequence: Synthetic coding sequence
atggagaggaggctcatcaagaaggagatgaagaagctgctgggggactacatcggcatccggctgcgggagaatgaatttgaccccaagggccggcggcagctgaccttcctggatgacatggcccactatgacctggccatctctgtggccctgcagtggctggaccccagcgaggacctgacctggctggagtgggaggagctgaagatccccctgcacggccggcccatctaccccaacagaagagagcgggaggccatgatcctgagcagctatgccggcatcctgatgaacagcatccccatcgaggaggtgttcaagatctacggggctgacagcagcgctgacagcggcaccatcaaggtgccccgggtgagcagcctgtgcctgagcctgcacccctttgccatgctgacagcccccaaggctgctgcctatgccaggaagcagagcgtgaagagcaggaaggtgaccaccaacaagaatgccaccagcatcagcgccaaggaggccaatgccacagagtggaagagcagccagcgcttcagtgacacccagcccaagcacaaggtgacctag

SEQ ID NO: 36649 - DNA, 201 bp, Artificial Sequence
  Description of Artificial Sequence: Synthetic coding sequence
atggagaggaggctcatcaagaaggagatgaagaagctgctgggggactacatcggcatccggctgcgggagaatgaatttgaccccaagggccggcggcagctgaccttcctggatgacatggcccactatgacctggccatctctgtggccctgcagtggctggaccccagcgaggacctgacctggctggagtggtag

SEQ ID NO: 36650 - DNA, 1767 bp, Artificial Sequence
  Description of Artificial Sequence: Synthetic coding sequence
atggagatgcagagccccatcgtgcagaggcaggagcggcaggtgcgggacagaggagtgaccaggagcaaggccgagaaggtgcggccccccaccgtgcctgtgccccaggtggacatcgtgcccggccgcctgtctgaggccgagtggatggccctgacagccctggaggagggggaggatgtggtgggggacatcctggccgacctgctggcccgggtgatggattctgccttcaaggtgtacctgacccagcagtgcatccccttcaccatcagccaggcccgggaggccatgctgcagatcacagagtggaggttcctggccagagatgaaggagagagcgctgtggccgaggaccccacctggggagaagatgaggagcccagcgcctgcaccacagacagctgggcccagggctctgtgcctgtgctgcacgccagcaccagcgagggcctggagaacttccagggagaagatcctggaggagtggaccgcatccccctgggccgctcctggatgggccggggcagccaggagcagatggagagctgggagcccagcccccagctgcgggtgaccagcgcccccccacccaccagcgagctgttccaggaggccggccctgggggccctgtggaggaggctgatggccagagccggggcctgagcagcgctggcagcctgagcgccagcttccagctgtctgtggaggaggccccagcagatgatgctgaccccagcctggacccctacctggtggccagcccccaggccagcacaggccggggccaccccctgggcttccacctgagcctggaggacctgtactgctgcatgccccagctggatgctgctggggaccggctggagctgcggtctgagggcgtgccctgcatcgccagcggcgtgctggtgtcctaccccagcgtgggcggggccacccggcccagcgccagctgccagcagcagagagctggccacagtgatgtgcggctgagcgcccaccaccacaggatgaggaggaaggctgctgtgaagaggctggaccctgcccggctgccctgccactgggtgcggcccctggccgaggtgctggtgcctgacagccagacccggcccctggaggcctaccggggccggcagagaggagagaagaccaaggcccgggcagagccccaggccctgggccctggcaccagggtgtccccagctgccttcttccccctgcggcccggcatccccttccgggacctggacagcggccctgccctgctcttccccaccctgaacctgggcctgagcagccccagcctggagagcaagctgcccctgcccaacagccgcatccgcttcctgaccacccaccctgtgctgcctgatgtggcccggagccgcagccccaagctgtggcccagcgtgcgctggcccagcggctgggagggcaaggccgagctgctgggggagctgtgggccggccgcaccagggtgcccccccagggcctggagctggccgaccgggagggccaggaccccggccgctggcccaggaccaccccacctgtgctggaggccaccagccaggtgatgtggaagcctgtgctgctgcctgaggccctgaagctggcccctggggtgtccatgtggaacagaagcacccaggtgctgctgagcagtggagtgcctgagcaggaggacaaggagggcagcaccttcccccctgtggagcagcaccccatccagacaggagcccccaagcccaggtag

SEQ ID NO: 36651 - DNA, 63 bp, Artificial Sequence
  Description of Artificial Sequence: Synthetic coding sequence
atggccagctgcctggccctgaggatggccctgctgctggtgtctggagtgctggccccctag

SEQ ID NO: 36652 - DNA, 453 bp, Artificial Sequence
  Description of Artificial Sequence: Synthetic coding sequence
atggaggactatgccctgaccttcggcatcaaccccttcatcgccctgatgatccagcccatcgtgaccatgacagtggtggacaaccagggcctgggcctgcctgtggacatccagcacaaggccaagcccagccccaaggccagccagatgctgcccccagacctgggcccccccagcttccagaacctgctgagccccagcgagaagctggagccctgggaccccggcatgaggaagctgactgtgcagacctgtggcctgaccttcatccaccctgctggccacggcctgtgccaccccacagctgaggccagcgctgagaccctgagcagcacagccctgaaccggcccagcgtgcgggagggcgcctgcaatgagaagagcacagagaacaagaagccccaggacagcgtgctgtggagccacagccgctggttccagggcaactag

SEQ ID NO: 36653 - DNA, 291 bp, Artificial Sequence
  Description of Artificial Sequence: Synthetic coding sequence
atggaggactatgccctgaccttcggcatcaaccccttcatcgccctgatgatccagcccatcgtgaccatgacagtggtggacaaccagggcctgggcctgcctgtggacatccagcacaaggccaagcccagccccaaggccagccagatgctgcccccagacctgggcccccccagcttccagaactgcttcacctgcaggacagcccccagcctggtgatggtgctgtcctggaagtctggagtgcggcgggaggtgcctgtgcaccccagctatgccaagtactag

SEQ ID NO: 36654 - DNA, 621 bp, Artificial Sequence
  Description of Artificial Sequence: Synthetic coding sequence
atggccgccaccaagacagccagctatgatgagcacttccggcctgagaagctgcgggagtggccagagcctgagagcgtgtccctgatggaggtgctggcccgggaggacattgatgaagctgtgtgtgccatcctcttcaaggaaaattccatcgtgaaggtgacagtgcccccatttgtggaccccctcttccagaggcagcaggaggtggatgaggagaggagaacaggcctgcagtgtgaaacaggcaagaggcacagcatcaaggagctggaggagattgagaaggcccggctgcacgccagcagcccctacttcaccttcaccagccactgtgtgatccccaaggagtggcacaaggccagcgcccgggcccggagcaagacctacaagtacagccctgagaagctgatctatgctgacaagaagcagaagaggaaggagaagaagacagctgacctgagccaggccgcctttgagcggcagttcctgagcagcaagctgagccagaagaacaaggtgggggagaggaagggcctggtgtcccggggcctgggccggggctggcacgccggcctgtgcagcacccatgagcagcacatcctggtgcctgagtag

SEQ ID NO: 36655 - DNA, 288 bp, Artificial Sequence
  Description of Artificial Sequence: Synthetic coding sequence
atgggctgcatgaagagcaagcagaccttccccttccccaccatctatgaaggagagaagcagcacgagagcgaggagcccttcatgcctgaggagcgctgcctgcccaggatggccagccctgtgaatgtgaaggaggaggtgaaggagcccccaggcaccaacacagtcatcctggagtatgcccaccggctgagccaggacatcctgtgtgatgccctgcagcagtgggcctgcaacaacatcaagtaccatgacatcccctacatcgagagcgagggcccctag

SEQ ID NO: 36656 - DNA, 288 bp, Artificial Sequence; identical to SEQ ID NO: 36655
  Description of Artificial Sequence: Synthetic coding sequence

SEQ ID NO: 36657 - DNA, 204 bp, Artificial Sequence
  Description of Artificial Sequence: Synthetic coding sequence
atgggctgcatgaagagcaagcagaccttccccttccccaccatctatgaaggagagaagcagcacgagagcgaggagcccttcatgcctgaggagcgctgcctgcccaggatggccagccctgtgaatgtgaaggaggaggtgaaggagcccccaggcaccaacacagtcatcctggagtatgcccaccggctgagccagtag

SEQ ID NO: 36658 - DNA, 288 bp, Artificial Sequence; identical to SEQ ID NO: 36655
  Description of Artificial Sequence: Synthetic coding sequence

SEQ ID NO: 36659 - DNA, 288 bp, Artificial Sequence; identical to SEQ ID NO: 36655
  Description of Artificial Sequence: Synthetic coding sequence

SEQ ID NO: 36660 - DNA, 93 bp, Artificial Sequence
  Description of Artificial Sequence: Synthetic coding sequence
atgggctgcatgaagagcaagcagaccttccccttccccaccatctatgaaggagagaagcagcacgagagcgaggagcccttcatgccctag

SEQ ID NO: 36661 - DNA, 396 bp, Artificial Sequence
  Description of Artificial Sequence: Synthetic coding sequence
atggtgaggatgagccggcccctcttcctggactgggcctggaggcccctgtgcagccccagccagagcctgcccctgacctacggccctgagggctggatcctgcagtggaagggcacctgccggcagcagacagccctgcactgcccctttgacttcccccaggcccccctgcggggccgccacaccctgagccaggtgcccaacaagggccacgagaaggccagcgctgtgcagctgcctgagaagcagggcacagaccagagccggcggggccccaccagcgctgtgaccaaggcccggaccagctacccagagagcgagaccttcatcgtgtacctgtgcagctacttctggaacagcagcaaaggagtgtacatgagcggcagcacctag

SEQ ID NO: 36662 - DNA, 879 bp, Artificial Sequence
  Description of Artificial Sequence: Synthetic coding sequence
atgaagtctgaggccaaggatggagaggaggagagcctgcagacagccttcaagaagctgcgggtggatgccagcggctctgtggccagcctgtctgtgggggagggcactggagtgcgggcccctgtgaggacagccacagatgacaccaagcccaagaccacctgtgccagcaaggacagctggcacggcagcaccaggaagagcagcagaggagctgtgaggacccagaggagaagaagaagcaagagccctgtgctgcacccccccaagttcatccactgcagcaccatcgccagcagcagcagcagccagctgaagcacaagagccagacagacagcccagatggcagcagcggcctgggcatcagcagccccaaggagttctctgctggggagagcagcaccagcctggatgccaaccacactggagctgtggtggagcccctgcggacctctgtgccccggctgcccagcgagagcaagaaggaggacagcagtgatgccacccaggtgccccaggccagcctgaaggccagtgacctgagtgacttccagagcgtgtccaagctgaaccagggcaagccctgcacctgcatcggcaaggagtgccagtgcaagcgctggcatgacatggaggtgtacagcttcagcggcctgcagagcgtgccccccctggcccctgagcggcgcagcaccctggaggactacagccagagcctgcacgcccggaccctgagcggcagccccaggagctgcagcgagcaggcccgggtgtttgtggatgatgtgaccatcgaggacctgagcggctacatggagtactacctgtacatccccaagaagatgagccacatggccgagatgatgtacacctag

SEQ ID NO: 36663 - DNA, 879 bp, Artificial Sequence; identical to SEQ ID NO: 36662
  Description of Artificial Sequence: Synthetic coding sequence

SEQ ID NO: 36664 - DNA, 528 bp, Artificial Sequence
  Description of Artificial Sequence: Synthetic coding sequence
atgggccaggtggtgtatgtgcctgtgaagacaggcagcggggctgatggcctgtctgagcctgagggcatcagcctgaagagggtggccgtggtggaggacttctttgacatcatctacagcatgcacgtggagagcagcgctgagcccgggaaggcccccaagcatgctggccagaagaagacctaccgggccatcgccgagacctacgccttcctgccccgggaggccgtgacccgcttcctgatgagctgcacagagtgccagaagaggatgcacttcaacagcaatggcctggagcccaaggaaaatgagccccccagccccctggtgtctggcatcatcgactacaacatgcccctgaccagcacctacctgaagcagatgaagctgcgggtgatgaacagccaggagcagtgcctgcccagcggggctgaggacatcatgtctgggggccccaccctggaggccgctgagtttgatgacctgattggcaagtgcctgcctgaccggcccatcgccgagtag

SEQ ID NO: 36665 - DNA, 276 bp, Artificial Sequence
  Description of Artificial Sequence: Synthetic coding sequence
atgtctgacagcacctggatgtctgctgacccccacctggccagcagcctgagccccagccaggatgagaggatgaggagcccccagaacctgcacagccaggaggatggcccccaccggctgagccacctgagccagggcctgaacatcatctgcagcctggacaccagcctgcgggccaggaacccccgggtgtctgctgagagaaatgacttctccttccggggccgcagccgctgtgtgaccagcaacagcctggccaaggatggctactag

SEQ ID NO: 36666 - DNA, 1311 bp, Artificial Sequence
  Description of Artificial Sequence: Synthetic coding sequence
atgtctgacagcacctggatgtctgctgacccccacctggccagcagcctgagccccagccaggatgagaggatgaggagcccccagaacctgcacagccaggaggatgatgacagcagcagcgagagcggcagcggaaatggcagcagcaccctgaaccccagcaccagcagcagcacccagggcgaccctgccttccctgagatgaatggaaatggagctgtggcccccatggacttcaccacagctgctgaggaccagcccatcaacctgtgtgacaagctgcccccagccacagccctgggcacagccagctaccccagtgatggctgtggggctgatggcctgcggagccgggtgaagtatggagtgaagaccaccccagagagccccccctacagcagcggcagctatgacagcatcaagacagaggtgtctggctgcccagaggacctgactgtgggccgggcccccacagcagatgatgatgatgatgaccatgatgaccatgaagataatgacaagatgaatgattctgagggcatggaccctgagcggctgaaggccttcaacatgtttgtgcggctgtttgtggatgagaacctggacaggatggtgcccatcagcaagcagcccaaggagaagatccaggccatcatcgagagctgcagccggcagtttcctgagttccaggagcgggccaggaagaggatccgcacctacctgaagagctgcaggaggatgaagaagaatggcatggagatgacccggcccaccccaccccacctgaccagcgccatggccgagaacatcctggccgccgcctgtgagagcgagaccaggaaggccgccaagaggatgaggctggagatctaccagagcagccaggatgagcccatcgccctggacaagcagcacagccgggacagcgctgccatcacccacagcacctacagcctgcctgccagcagctacagccaggaccctgtgtatgccaatggaggcctgaactacagctaccggggctatggagccctgagcagcaacctgcagcccccagccagcctgcagacaggcaaccacagcaatggccccacagacctgtccatgaagggcggggccagcaccaccagcaccacccccacccccacccccagcagcaccagcaccagcaggcctgtgcccacagcccagctgagccccacagagatctctgctgtgcggcagctgattgctggctaccgggagagcgctgccttcctgctgcggtctgcagatgagctggagaacctgatcctgcagcagaactag

SEQ ID NO: 36667 - DNA, 246 bp, Artificial Sequence
  Description of Artificial Sequence: Synthetic coding sequence
atgagctgcacagagtgccagaagaggatgcacttcaacagcaatggcctggagcccaaggaaaatgagccccccagccccctggtgtctggcatcatcgactacaacatgcccctgaccagcacctacctgaagcagatgaagctgcgggtgatgaacagccaggagcagcccagcagcctgagccctgcccctggctttgtgaacacagtcatcaccgtgctgatctgtgcccacgaggagtag

SEQ ID NO: 36668 - DNA, 342 bp, Artificial Sequence
  Description of Artificial Sequence: Synthetic coding sequence
atgaagctgcgggtgatgaacagccaggagcaggatgagacctctgtgtccagtgaagattttgacatgtctgacagcacctggatgtctgctgacccccacctggccagcagcctgagccccagccaggatgagaggatgaggagcccccagaacctgcacagccaggaggatggcccccaccggctgagccacctgagccagggcctgaacatcatctgcagcctggacaccagcctgcgggccaggaacccccgggtgtctgctgagagaaatgacttctccttccggggccgcagccgctgtgtgaccagcaacagcctggccaaggatggctactag

SEQ ID NO: 36669 - DNA, 468 bp, Artificial Sequence
  Description of Artificial Sequence: Synthetic coding sequence
atgcacgtggagagcagcgctgagcccgggaaggcccccaagcacgccggccagaagaagacctaccgggccatcgccgagacctacgccttcctgccccgggaggccgtgacccgcttcctgatgagctgcacagagtgccagaagaggatgcacttcaacagcaatggcctggagcccaaggaaaatgaaccacccagccccctggtgtctggcatcatcgactacaacatgcccctgaccagcacctacctgaagcagatgaagctgcgggtgatgaacagccaggagcaggatgagacctctgtgtcctctgaggactttgacatgtctgacagcacctggatgtctgctgacccccacctggccagcagcctgagccccagccaggatgagaggatgaggagcccccagaacctgcacagccaggaggatggaggagtgtgcctgcagggccccacagcctag

SEQ ID NO: 36670 - DNA, 1197 bp, Artificial Sequence
  Description of Artificial Sequence: Synthetic coding sequence
atgtctgacagcacctggatgtctgctgacccccacctggccagcagcctgagccccagccaggatgagaggatgaggagcccccagaacctgcacagccaggaggatgatgacagcagcagcgagagcggcagcggaaatggcagcagcaccctgaaccccagcaccagcagcagcacccagggcgaccctgccttccctgagatgaatggaaatggagctgtggcccccatggacttcaccacagctgctgaggaccagcccatcaacctgtgtgacaagctgcccccagccacagccctgggcacagccagctaccccagtgatggctgtggggctgatggcctgcggagccgggtgaagtatggagtgaagaccaccccagagagccccccctacagcagcggcagctatgacagcatcaagacagaggtgtctggctgcccagaggacctgactgtgggccgggcccccacagcagatgatgatgatgatgaccatgatgaccatgaagataatgacaagatgaatgattctgagggcatggaccctgagcggctgaaggccttcaacatgtttgtgcggctgtttgtggatgagaacctggacaggatggtgcccatcagcaagcagcccaaggagaagatccaggccatcatcgagagctgcagccggcagtttcctgagttccaggagcgggccaggaagaggatccgcacctacctgaagagctgcaggaggatgaagaagaatggcatggagatgacccggcccaccccaccccacctgaccagcgccatggccgagaacatcctggccgccgcctgtgagagcgagaccaggaaggccgccaagaggatgaggctggagatctaccagagcagccaggatgagcccatcgccctggacaagcagcacagccgggacagcgctgccatcacccacagcacctacagcctgcctgccagcagctacagccaggaccctgtgtatgccaatggaggcctgaactacagctaccggggctatggagccctgagcagcaacctgcagcccccagccagcctgcagacaggcaaccacagcaatggccccacagacctgtccatgaagggcggggccagcaccaccagcaccacccccaccccccggctgggcgcccccctgacccggcgctggggctgcagctctgtgtag

SEQ ID NO: 36671 - DNA, 231 bp, Artificial Sequence
  Description of Artificial Sequence: Synthetic coding sequence
tgacagaagaggatgcacttcaacagcaatggcctggagcccaaggaaaatgaaccacccagccccctggtgtctggcatcatcgactacaacatgcccctgaccagcacctacctgaagcagatgaagctgcgggtgatgaacagccaggagcagcccagcagcctgagccctgcccctggctttgtgaacacagtcatcaccgtgctgatctgtgcccacgaggagtag

SEQ ID NO: 36672 - DNA, 648 bp, Artificial Sequence
  Description of Artificial Sequence: Synthetic coding sequence
atgaggggcctgcgctggagatacacccggctgcccagccaggtggaggacaccctgagcggggaggagggcaatgaggaggaggaggaggaggaggccgccccagaccctgctgctgcccctgaggaccccaccgtgccccagctgacagaggccagccaggtgctgagcgccagcgagatccggcagctgtccttccacttccccccccgggtgacaggccacccctggagcctggtgttctgcaccagcagagatggcttcagcctgcagagcctgtacagaaggatggagggctgcagcggccctgtgctgctggtgctgcgggaccaggacggccagatctttggagccttcagcagcagcgccatccggctgagcaagggcttctatggaactggagagaccttcctgttctccttcagcccccagctgaaggtgttcaagtggacaggcagcaacagcttctttgtgaagggggacctggacagcctgatgatgggcagcggcagcggccgcttcggcctgtggctggatggagacctcttccggggcggcagcagcccctgccccaccttcaacaatgaggtgctggcccggcaggagcagttctgcatccaggagctggaggcctggctgctgtcctag

SEQ ID NO: 36673 - DNA, 3210 bp, Artificial Sequence
  Description of Artificial Sequence: Synthetic coding sequence
tgagtggccggcacccccaccagcagccagcccagctttggccccagcatccgggagcggcccagccagagcctgtgcccctgcccctgcccagctggggagggggaccctgcctggccagccctggagcggcggctggtgaccagccggggccggcagcccagcccccagagccacgcccagctgctgacccggcggcggcacagcagcgagcaggtgcccccagagagcgagcccagggctgacttccgcagcggcaagtggctgcaggagcccgccactggagatgcccgggacagccggcaggccctgcgggccaggatgagcagcaagcaccgcatctgcagccaggaggaggtggtgatcccctgtgcctatgacagcgacagcgagagcgtggacctggagctgagcaacctggagatcatcaagaagggcagcagcagcattgagctgacagacctggacatcccagacatccctggcctgcactgtgagcccctgagccacagccccaggcacctgacccagcaggaccccctgtctgaggccatcgtggagaagctgatccagagcatccagaaggtgttcaacggggagctgaagggggagctggagaagctgaagttcctgggggacctgagcagcctgagccaggccctgccctatgatgaaacagccaagagcttcatccacagccacatcgctgacatcgtgcacaccctgaatgtgctggtgcaggaggagcggccccacagcctgagcagctccatgaggcaggaggtgtttgtgaccatcgctgacctgagctaccaggatgtgcacctgctgctgggctctgaagatagagctgagctgttcagcctgaccatcaagagcatcatcaccctgcccagcgtgaggaccctgacccagatccaggagatcatgcccaacggcacctgcaacacagagtgcctgtaccggcagaccttccaggccttcagcgagatgctgcagagcctggtggtgaaggacccccacctggagaacctggacaccatcatcaagcacctggtgccctggctgcagagcgtgaaggaccacgagcgggagcgggccacagcctccatggcccaggtgctgaagtgcctgagcaagcacctgaacctgaagctgcccctgcgcttccagaggctgggccacctggtggccctgatggccctgctgtgtggggacccccaggagaaggtggccgaggaggccgctgagggcatccacagcctgctgcacatcaccctgcggctgaagtacatcacccatgacaagaaggaccagcagaacctgaagagggccctgaccaagtgccgggagttcctggagctgcacagcagcgctgccaagtgcttctacaactgccccttccgcatcgcccaggtgtttgagggcttcctggacagcaatgagctgtgccagttcatcatgaccacctttgacaccctgaagaccctgaagcacccctgcatccagaggtctgctggggagctgctgctgaccctggccaagaacacagagagccagtttgagaaggtgcctgagatcatgggcgtcatctgtgcccagctgagcatcatcagccagccccgggtgcggcagcagatcatcaacacagtgtccctcttcatcagccggcccaagtacacagacatcgtgctgtccttcctgctgtgccaccctgtgccctacaacagacacctggccgaggtgtggaggatgctgtctgtggagctgcccagcaccacctggatcctgtggaggctgctgaggaagctgcagaagtgccacaatgaaccagcccaggagaagatggcctacgtggccgtggccgccacagatgccctgtatgaggtgttcctgggcaaccggctgcgggccgccaccttccgcctcttcccccagctgctgatgaccctgctgatccagatccaccacagcatcggcctgaccatgtctgatgtggacatccccagcggcctgtacacagagcaggaggtgcccagcgaggtgacccccctgtgctttgccatgcaggccaccaagaccctgctgctgcggacctgctgcctgcaggagttcaacatcatggagaagaacaagggctgggccctgctgggcggcaaggatggccacctgcagggcctcttcctgctggccaatgccctgctggagaggaaccagctgctggcccagaaggtgatgtacctgctggtgcccctgctgaacagaggaaatgacaagcacaagctgaccagcgctggcttctttgtggagctgctgcggagccctgtggccaagaggctgcccagcatctacagcgtggcccgcttcaaggactggctgcaggacggcaaccacctgttccgcatcctgggcctgcggggcctgtacaacctggtgggccaccaggagatgagggaggacatcaagagcctgctgccctacatcgtggacagcctgcgggagacagatgagaagatcgtgctgagcgccatccagatcctgctgcagctggtgaggaccatggacttcaccaccctggccgccatgatgaggaccctcttcagcctgtttggagatgtgcggagtgatgtgcaccgcttctctgtgaccctgtttggagctgccatcaagtctgtgaagaacccagacaagaagagcattgagaaccaggtgctggacagcctggtgcccctgctgctgtacagccaggatgaaaatgatgctgtggccgaggagagccggcaggtgctgaccatctgtgcccagttcctgaagtggaagctgccccaggaggtgtacagcaaggacccctggcacatcaagcccacagaggccggcaccatctgccgcttctttgagaagaagtgcaagggcaagatcaacatcctggagcagaccctgatgtacagcaagaaccccaagctgcccatcagaagatctgctgtgctgtttgtgggcctgctgagcaagtacatggaccacaatgagctgcggaggatgggcacagactggattgaagatgacctgcgggacctgctgtgtgaccctgagcccagcctgtgcatcatcgccagccagaccctgctgctggtgcagatggcccgggcagagcccaagcccaagcagagggtgaactggctgcagaagctgatgggccgcagcagcgcctag

SEQ ID NO: 36674 - DNA, 1890 bp, Artificial Sequence
  Description of Artificial Sequence: Synthetic coding sequence
tgacagccccggcaggtggccggcacccccaccagcagccagcccagctttggccccagcatccgggagcggcccagccagagcctgtgcccctgcccctgcccagctggggagggggaccctgcctggccagccctggagcggcggctggtgaccagccggggccggcagcccagcccccagagccacgcccagctgctgacccggcggcggcacagcagcgagcaggtgcccccagagagcgagcccagggctgacttccgcagcggcaagtggctgcaggagcccgccactggagatgcccgggacagccggcaggccctgcgggccaggatgagcagcaagcaccgcatctgcagccaggaggaggtggtgatcccctgtgcctatgacagcgacagcgagagcgtggacctggagctgagcaacctggagatcatcaagaagggcagcagcagcattgagctgacagacctggacatcccagacatccctggcctgcactgtgagcccctgagccacagccccaggcacctgacccagcaggaccccctgtctgaggccatcgtggagaagctgatccagagcatccagaaggtgttcaacggggagctgaagggggagctggagaagctgaagttcctgggggacctgagcagcctgagccaggccctgccctatgatgaaacagccaagagcttcatccacagccacatcgctgacatcgtgcacaccctgaatgtgctggtgcaggaggagcggccccacagcctgagcagctccatgaggcaggaggtgtttgtgaccatcgctgacctgagctaccaggatgtgcacctgctgctgggctctgaagatagagctgagctgttcagcctgaccatcaagagcatcatcaccctgcccagcgtgaggaccctgacccagatccaggagatcatgcccaacggcacctgcaacacagagtgcctgtaccggcagaccttccaggccttcagcgagatgctgcagagcctggtggtgaaggacccccacctggagaacctggacaccatcatcaagcacctggtgccctggctgcagagcgtgaaggaccacgagcgggagcgggccacagcctccatggcccaggtgctgaagtgcctgagcaagcacctgaacctgaagctgcccctgcgcttccagaggctgggccacctggtggccctgatggccctgctgtgtggggacccccaggagaaggtggccgaggaggccgctgagggcatccacagcctgctgcacatcaccctgcggctgaagtacatcacccatgacaagaaggaccagcagaacctgaagagggccctgaccaagtgccgggagttcctggagctgcacagcagcgctgccaagtgcttctacaactgccccttccgcatcgcccaggtgtttgagggcttcctggacagcaatgagctgtgccagttcatcatgaccacctttgacaccctgaagaccctgaagcacccctgcatccagaggtctgctggggagctgctgctgaccctggccaagaacacagagagccagtttgagaaggtgcctgagatcatgggcgtcatctgtgcccagctgagcatcatcagccagccccgggtgcggcagcagatcatcaacacagtgtccctcttcatcagccggcccaagtacacagacatcgtgctgtccttcctgctgtgccaccctgtgccctacaacagacacctggccgaggtgtggaggatgctgtctgtggagctgcccagcaccacctggatcctgtggaggctgctgaggaagctgcagaagtgccacaatgaaccagcccaggagaagatggcctacgtggccgtggccgtgagcccctag

SEQ ID NO: 36675 - DNA, 3129 bp, Artificial Sequence
  Description of Artificial Sequence: Synthetic coding sequence
atgcccctgagcagaagaggccggggcagccggctggccggcagcagagctgccaccagcaacctgccccgggccacagccctgagccccaagcacgcccagctgctgaccaggagaagacacagcagcgagcaggtgcccccagagagcgagcccagggctgacttccgcagcggcaagtggctgcaggagcccgccactggagatgcccgggacagccggcaggccctgcgggccaggatgagcagcaagcaccgcatctgcagccaggaggaggtggtgatcccctgtgcctatgacagcgacagcgagagcgtggacctggagctgagcaacctggagatcatcaagaagggcagcagcagcattgagctgacagacctggacatcccagacatccctggcctgcactgtgagcccctgagccacagccccaggcacctgacccagcaggaccccctgtctgaggccatcgtggagaagctgatccagagcatccagaaggtgttcaatggagagctgaagggggagctggagaagctgaagttcctgggggacctgagcagcctgagccaggccctgccctatgatgaaacagccaagagcttcatccacagccacatcgctgacatcgtgcacaccctgaatgtgctggtgcaggaggagcggccccacagcctgagcagctccatgaggcaggaggtgtttgtgaccatcgctgacctgagctaccaggatgtgcacctgctgctgggcagcgaggacagagctgagctgttcagcctgaccatcaagagcatcatcaccctgcccagcgtgaggaccctgacccagatccaggagatcatgcccaacggcacctgcaacacagaatgtctgtaccggcagaccttccaggccttcagcgagatgctgcagagcctggtggtgaaggacccccacctggagaacctggacaccatcatcaagcacctggtgccctggctgcagagcgtgaaggaccacgagcgggagcgggccacagcctccatggcccaggtgctgaagtgcctgagcaagcacctgaacctgaagctgcccctgcgcttccagaggctgggccacctggtggccctgatggccctgctgtgtggggacccccaggagaaggtggccgaggaggccgctgagggcatccacagcctgctgcacatcaccctgcggctgaagtacatcacccatgacaagaaggaccagcagaacctgaagagggccctgaccaagtgccgggagttcctggagctgcacagcagcgctgccaagtgcttctacaactgccccttcagaattgcccaggtgtttgagggcttcctggacagcaatgagctgtgccagttcatcatgaccacctttgacaccctgaagaccctgaagcacccctgcatccagaggtctgctggggagctgctgctgaccctggccaagaacacagagagccagtttgagaaggtgcctgagatcatgggcgtcatctgtgcccagctgagcatcatcagccagccccgggtgcggcagcagatcatcaacacagtgtccctcttcatcagccggcccaagtacacagacatcgtgctgtccttcctgctgtgccaccctgtgccctacaacagacacctggccgaggtgtggaggatgctgtctgtggagctgcccagcaccacctggatcctgtggaggctgctgaggaagctgcagaagtgccacaatgagcccgcccaggagaagatggcctacgtggccgtggccgccacagatgccctgtatgaggtgttcctgggcaaccggctgcgggccgccaccttccgcctcttcccccagctgctgatgaccctgctgatccagatccaccacagcatcggcctgaccatgtctgatgtggacatccccagcggcctgtacacagagcaggaggtgcccagcgaggtgacccccctgtgctttgccatgcaggccaccaagaccctgctgctgcggacctgctgcctgcaggagttcaacatcatggagaagaacaagggctgggccctgctgggcggcaaggatggccacctgcagggcctcttcctgctggccaatgccctgctggagaggaaccagctgctggcccagaaggtgatgtacctgctggtgcccctgctgaacagaggaaatgacaagcacaagctgaccagcgctggcttctttgtggagctgctgcggagccctgtggccaagaggctgcccagcatctacagcgtggcccgcttcaaggactggctgcaggacggcaaccacctgttccgcatcctgggcctgcggggcctgtacaacctggtgggccaccaggagatgagggaggacatcaagagcctgctgccctacatcgtggacagcctgcgggagacagatgagaagatcgtgctgagcgccatccagatcctgctgcagctggtgaggaccatggacttcaccaccctggccgccatgatgaggaccctcttcagcctgtttggagatgtgcggagtgatgtgcaccgcttctctgtgaccctgtttggagctgccatcaagtctgtgaagaacccagacaagaagagcattgagaaccaggtgctggacagcctggtgcccctgctgctgtacagccaggatgaaaatgatgctgtggccgaggagagccggcaggtgctgaccatctgtgcccagttcctgaagtggaagctgccccaggaggtgtacagcaaggacccctggcacatcaagcccacagaagctggcaccatctgccgcttctttgagaagaagtgcaagggcaagatcaacatcctggagcagaccctgatgtacagcaagaaccccaagctgcccatccgccgctctgctgtgctgtttgtgggcctgctgagcaagtacatggaccacaatgagctgcggaggatgggcacagactggattgaagatgacctgcgggacctgctgtgtgaccctgagcccagcctgtgcatcatcgccagccagaccctgctgctggtgcagatggcccgggcagagcccaagcccaagcagagggtgaactggctgcagaagctgatgggccgcagcagcgcctag

SEQ ID NO: 36676 - DNA, 2013 bp, Artificial Sequence
  Description of Artificial Sequence: Synthetic coding sequence
tgatgcaacacagaatgtctgtaccggcagaccttccaggccttcagcgagatgctgcagagcctggtggtgaaggacccccacctggagaacctggacaccatcatcaagctgcccctgcgcttccagaggctgggccacctggtggccctgatggccctgctgtgtggggacccccaggagaaggtggccgaggaggccgctgagggcatccacagcctgctgcacatcaccctgcggctgaagtacatcacccatgacaagaaggaccagcagaacctgaagagggccctgaccaagtgccgggagttcctggagctgcacagcagcgctgccaagtgcttctacaactgccccttccgcatcgcccaggtgcctgagatcatgggcgtcatctgtgcccagctgagcatcatcagccagccccgggtgcggcagcagatcatcaacacagtgtccctcttcatcagccggcccaagtacacagacatcgtgctgtccttcctgctgtgccaccctgtgccctacaacagacacctggccgaggtgtggaggatgctgtctgtggagctgcccagcaccacctggatcctgtggaggctgctgaggaagctgcagaagtgccacaatgagcccgcccaggagaagatggcctacgtggccgtggccgccacagatgccctgtatgaggtgttcctgggcaaccggctgcgggccgccaccttccgcctcttcccccagctgctgatgaccctgctgatccagatccaccacagcatcggcctgaccatgtctgatgtggacatccccagcggcctgtacacagagcaggaggtgcccagcgaggtgacccccctgtgctttgccatgcaggccaccaagaccctgctgctgcggacctgctgcctgcaggagttcaacatcatggagaagaacaagggctgggccctgctgggcggcaaggatggccacctgcagggcctcttcctgctggccaatgccctgctggagaggaaccagctgctggcccagaaggtgatgtacctgctggtgcccctgctgaacagaggaaatgacaagcacaagctgaccagcgctggcttctttgtggagctgctgcggagccctgtggccaagaggctgcccagcatctacagcgtggcccgcttcaaggactggctgcaggacggcaaccacctgttccgcatcctgggcctgcggggcctgtacaacctggtgggccaccaggagatgagggaggacatcaagagcctgctgccctacatcgtggacagcctgcgggagacagatgagaagatcgtgctgagcgccatccagatcctgctgcagctggtgaggaccatggacttcaccaccctggccgccatgatgaggaccctcttcagcctgtttggagatgtgcggagtgatgtgcaccgcttctctgtgaccctgtttggagctgccatcaagtctgtgaagaacccagacaagaagagcattgagaaccaggtgctggacagcctggtgcccctgctgctgtacagccaggatgaaaatgatgctgtggccgaggagagccggcaggtgctgaccatctgtgcccagttcctgaagtggaagctgccccaggaggtgtacagcaaggacccctggcacatcaagcccacagaagctggcaccatctgccgcttctttgagaagaagtgcaagggcaagatcaacatcctggagcagaccctgatgtacagcaagaaccccaagctgcccatccgccgctctgctgtgctgtttgtgggcctgctgagcaagtacatggaccacaatgagctgcggaggatgggcacagactggattgaagatgacctgcgggacctgctgtgtgaccctgagcccagcctgtgcatcatcgccagccagaccctgctgctggtgcagatggcccgggcagagcccaagcccaagcagagggtgaactggctgcagaagctgatgggccgcagcagcgcctag

SEQ ID NO: 36677 - DNA, 1803 bp, Artificial Sequence
  Description of Artificial Sequence: Synthetic coding sequence
tgacaccccagccccaggcaccagccccggcaggtggccggcacccccaccagcagccagcccagctttggccccagcatccgggagcggcccagccagagcctgtgcccctgcccctgcccagctggggagggggaccctgcctggccagccctggagcggcggctggtgaccagccggggccggcagcccagcccccagagccacgcccagctgctgacccggcggcggcacagcagcgagcaggtgcccccagagagcgagcccagggctgacttccgcagcggcaagtggctgcaggagcccgccactggagatgcccgggacagccggcaggccctgcgggccaggatgagcagcaagcaccgcatctgcagccaggaggaggtggtgatcccctgtgcctatgacagcgacagcgagagcgtggacctggagctgagcaacctggagatcatcaagaagggcagcagcagcattgagctgacagacctggacatcccagacatccctggcctgcactgtgagcccctgagccacagccccaggcacctgacccagcaggaccccctgtctgaggccatcgtggagaagctgatccagagcatccagaaggtgttcaacggggagctgaagggggagctggagaagctgaagttcctgggggacctgagcagcctgagccaggccctgccctatgatgaaacagccaagagcttcatccacagccacatcgctgacatcgtgcacaccctgaatgtgctggtgcaggaggagcggccccacagcctgagcagctccatgaggcaggaggtgtttgtgaccatcgctgacctgagctaccaggatgtgcacctgctgctgggctctgaagatagagctgagctgttcagcctgaccatcaagagcatcatcaccctgcccagcgtgaggaccctgacccagatccaggagatcatgcccaacggcacctgcaacacagagtgcctgtaccggcagaccttccaggccttcagcgagatgctgcagagcctggtggtgaaggacccccacctggagaacctggacaccatcatcaagctgcccctgcgcttccagaggctgggccacctggtggccctgatggccctgctgtgtggggacccccaggagaaggtggccgaggaggccgctgagggcatccacagcctgctgcacatcaccctgcggctgaagtacatcacccatgacaagaaggaccagcagaacctgaagagggccctgaccaagtgccgggagttcctggagctgcacagcagcgctgccaagtgcttctacaactgccccttcagaattgcccaggtgtttgagggcttcctggacagcaatgagctgtgccagttcatcatgaccacctttgacaccctgaagaccctgaagcacccctgcatccagaggtctgctggggagctgctgctgaccctggccaagaacacagagagccagtttgagaaggtgcctgagatcatgggcgtcatctgtgcccagctgagcatcatcagccagccccgggtgcggcagcagatcatcaacacagtgtccctcttcatcagccggcccaagtacacagacatcgtgctgtccttcctgctgtgccaccctgtgccctacaacagacacctggccgaggtgtggaggatgctgtctgtggagctgcccagcaccacctggatcctgtggaggctgctgaggaagctgcagaagtgccacaatgagcccgcccaggagaagatggcctacgtggccgtggccgtgagcccctag

SEQ ID NO: 36678 - DNA, 75 bp, Artificial Sequence
  Description of Artificial Sequence: Synthetic coding sequence
atgaggcaggaggtgtttgtgaccatcgctgacctgagctaccaggatgtgcacctgctgctgggcagcgagtag

SEQ ID NO: 36679 - DNA, 105 bp, Artificial Sequence
  Description of Artificial Sequence: Synthetic coding sequence
atgaggcaggaggtgtttgtgaccatcgctgacctgagctaccaggatgtgcacctgctgctgggcagcgaggacagagctgagctgttcagcctgaccatctag

SEQ ID NO: 36680 - DNA, 2799 bp, Artificial Sequence
  Description of Artificial Sequence: Synthetic coding sequence
gctggcagcagagctgccaccagcaccagcagaggagccctgagccagagccacgcccagctgctgaccaggagaagacacagcagcgagcaggtgcccccagagagcgagcccagggctgacttccgcagcggcaagtggctgcaggagcccgccactggagatgcccgggacagccggcaggccctgcgggccaggatgagcagcaagcaccgcatctgcagccaggaggaggtggtgatcccctgtgcctatgacagcgacagcgagagcgtggacctggagctgagcaacctggagatcatcaagaagggcagcagcagcattgagctgacagacctggacatcccagacatccctggcctgcactgtgagcccctgagccacagccccaggcacctgacccagcaggaccccctgtctgaggccatcgtggagaagctgatccagagcatccagaaggtgttcaatggagagctgaagggggagctggagaagctgaagttcctgggggacctgagcagcctgagccaggccctgccctatgatgaaacagccaagagcttcatccacagccacatcgctgacatcgtgcacaccctgaatgtgctggtgcaggaggagcggccccacagcctgagcagctccatgaggcaggaggtgtttgtgaccatcgctgacctgagctaccaggatgtgcacctgctgctgggcagcgaggacagagctgagctgttcagcctgaccatcaagagcatcatcaccctgcccagcgtgaggaccctgacccagatccaggagatcatgcccaacggcacctgcaacacagaatgtctgtaccggcagaccttccaggccttcagcgagatgctgcagagcctggtggtgaaggacccccacctggagaacctggacaccatcatcaagcacctggtgccctggctgcagagcgtgaaggaccacgagcgggagcgggccacagcctccatggcccaggtgctgaagtgcctgagcaagcacctgaacctgaagctgcccctgcgcttccagaggctgggccacctggtggccctgatggccctgctgtgtggggacccccaggagaaggtggccgaggaggccgctgagggcatccacagcctgctgcacatcaccctgcggctgaagtacatcacccatgacaagaaggaccagcagaacctgaagagggccctgaccaagtgccgggagttcctggagctgcacagcagcgctgccaagtgcttctacaactgccccttcagaattgcccaggtgtttgagggcttcctggacagcaatgagctgtgccagttcatcatgaccacctttgacaccctgaagaccctgaagcacccctgcatccagaggtctgctggggagctgctgctgaccctggccaagaacacagagagccagtttgagaaggtgcctgagatcatgggcgtcatctgtgcccagctgagcatcatcagccagccccgggtgcggcagcagatcatcaacacagtgtccctcttcatcagccggcccaagtacacagacatcgtgctgtccttcctgctgtgccaccctgtgccctacaacagacacctggccgaggtgtggaggatgctgtctgtggagctgcccagcaccacctggatcctgtggaggctgctgaggaagctgcagaagtgccacaatgagcccgcccaggagaagatggcctacgtggccgtggccgccacagatgccctgtatgaggtgttcctgggcaaccggctgcgggccgccaccttccgcctcttcccccagctgctgatgaccctgctgatccagatccaccacagcatcggcctgaccatgtctgatgtggacatccccagcggcctgtacacagagcaggaggtgcccagcgaggtgacccccctgtgctttgccatgcaggccaccaagaccctgctgctgcggacctgctgcctgcaggagttcaacatcatggagaagaacaagggctgggccctgctgggcggcaaggatggccacctgcagggcctcttcctgctggccaatgccctgctggagaggaaccagctgctggcccagaaggtgatgtacctgctggtgcccctgctgaacagaggaaatgacaagcacaagctgaccagcgctggcttctttgtggagctgctgcggagccctgtggccaagaggctgcccagcatctacagcgtggcccgcttcaaggactggctgcaggacggcaaccacctgttccgcatcctgggcctgcggggcctgtacaacctggtgggccaccaggagatgagggaggacatcaagagcctgctgccctacatcgtggacagcctgcgggagacagatgagaagatcgtgctgagcgccatccagatcctgctgcagctggtgaggaccatggacttcaccaccctggccgccatgatgaggaccctcttcagcctgtttggagatgtgcggagtgatgtgcaccgcttctctgtgaccctgtttggagctgccatcaagtctgtgaagaacccagacaagaagagcattgagaaccaggtgctggacagcctggtgcccctgctgctgtacagccaggatgaaaatgatgctgtggccgaggagagccggcaggtgctgaccatctgtgcccagttcctgaagtggaagctgccccaggaggtgtacagcaaggacccctggcacatcaagcccacagaagctggcaccatctgccgcttcttcggcaagaaggtgcagggagaaaattag

SEQ ID NO: 36681 - DNA, 462 bp, Artificial Sequence
  Description of Artificial Sequence: Synthetic coding sequence
atgggcaactacagcagccacaagaggaccaaggcccccaagcaggccaggaaggagaggcctgctgacatggacaaggcctggtggaagagcttcctgaaccacctgaccaggaagaagccagccaccagaattgtgctgatcctgcccctggacaagaggcagcccctggccaatgccggccagagaattgattatgccagcggggccggcctgggcagccctgctgccccccggctgcggggagctggggagggcagcgagcgggagcccaggatgcctgtgctgctgctgctgcggcggcaggaggcccggcggcctgaggagggcggggcccgggccgccctgtcctggccccggctgctgagccgcttccgcagccctgggaaggccccccgggaggccggccctgctgaggagcagcccaggaagcgctgccgctgcccccggccccagctgtag

SEQ ID NO: 36682 - DNA, 1995 bp, Artificial Sequence
  Description of Artificial Sequence: Synthetic coding sequence
atggagagcttcatggagagcctgaaccggctgaaggagatccacgagaaggaggtgctgggcctgcagaacaagctgctggagctgaacagcgagcgctgcagagatgcccagagaattgaggagctgttcagcaagaaccaccagctgcgggagcagcagaagaccctgaaggagaacctgcgggtgctggagaaccggctgcgggccggcctgtgtgaccgctgcatggtgacccaggagctggccaggaagaggcagcaggagtttgagagcagccacctgcagaacctgcagaggatcttcatcctgaccaatgagatgaatggcctgaaggaggagaatgagaccctgaaggaggaggtgaagaggctgcggggcctgggggaccggcccaagccccgggccaaggagggcaccagtgacccccccagccccctgctgctgcccagccctgggggctggaaggccatcacagagaagcccccaggcggccacgaggaggccgaggaggaccaccagggcgtgggcctgcggggggaggagaagccagctggccacaggaccagccctgtggccaagatcagccctggggccaccctgcctgagagccgggccccagacatgagcccccagaggatcagcaaccagctgcacggcaccatcgctgtggtgcggcccggcagccaggcctgcccagctgaccggggccctgccaacggcaccccaccacccctgcctgcccggagcagcccccccagccctgcctatgagcggggcctgagcctggacagcttcctgcgggccagccggcccagcgccatgacccatgaggcccccaagctgagccccaaggtggaccggctgtgcctgctgaaccggcccctgagcctgcacctgcagagcccccacagcagccccctggccccagctgctgcccccagcgacccccggctgcaggacctgaaggcccgggaggccgaggcctgggaggagcccacagagctgctgggcctgcccagcgccctggccggcatgcaggacctgcggctggagggcgccctgcacctgctgctggcccagcagcagctgcgggcccgggcccgggccggctctgtgcggccccggggccagcccaccccaggagagatgctgcccagcctgcctgtgggcagtgacagcgagggcccagaaaatgaaggcacccgggccgccctggccgctgctggcctgagcggcggccgccacacccagcctgctggccctggccgggcccagaggacagaggccgccgccacccaggactgtgccctggacaagcccctggacctgtctgagtggggccgggcccggggccaggacacccccaagccagctggccagcacggcagcctgagccctgctgctgcccacacagccagccctgagccccccacccagagcggccccctgaccaggagcccccaggccctgagcaatggcaccaagggcaccagggtgcctgagcaggaggaggccagcacccccatggaccccagccggcccctgcccggcagccagctgagcctgagcagccctggcagcacagaagatgaggacaccggccggcccctgcccccaccccacccccagcccccaccccacccccagcccccagacctggatggccaccctgagcccagcaaggccgaggtgctgcggcctgagagtgatgagctggatgaaacagacaccccaggcagcgaggtgggcctgagcagccaggccgaggccaccaccagcaccaccggggagggccctgagtgcatctgcacccaggagcacggccagggcccccccaggaagaggaagagggccagcgagcccggggacaaggccagcaagaagcccagccggggccgcaggaagctgacagccacagagggccctggcagccccagagatgctgaggaccacagccccagccccaacagcagcccctgggaggagacctag

SEQ ID NO: 36683 - DNA, 1719 bp, Artificial Sequence
  Description of Artificial Sequence: Synthetic coding sequence
atgaggaggcacatggtgacctacgcctggcagctgctgaagaaggagctgggcctgtaccagctggccatggacatcatcatcatgatccgggtgtgcaagatgttccggcagggcctgcggggcttccgggagtaccagatcattgaaacagcccactggaagcaccccatcttctccttctgggacaagaagatgcagagccgggtgacctttgacaccatggacttcatcgccgaggagggccacttcccccccaaggccatccagatcatgcagaagaagcccagctggaggacagaagatgagatccaggccgtgtgcaacatcctgcaggtgctggacagctacagaaattatgcagagcccctgcagctgctgctggccaaggtgatgagatttgaaagatttggaagaagaagagtcatcatcaagaagggccagaagggcaacagcttctacttcatctacctgggcaccgtggccatcaccaaggatgaagatggcagcagcgccttcctggacccccaccccaagctgctgcacaagggcagctgctttggagagatggatgtgctgcacgcctctgtgcggcgcagcaccatcgtgtgcatggaggagacagagttcctggtggtggaccgggaggacttctttgccaacaagctggaccaggaggtgcagaaggatgcccagtacagatttgagttcttcaggaagatggagctgtttgcctcctggagcgatgagaagctgtggcagctggtggccatggccaagattgagcgcttctcctatggccagctgatcagcaaggactttggagagagccccttcatcatgttcatcagcaagggcagctgtgaggtgctgcggctgctggacctgggcgccagccccagctaccgccgctggatctggcagcacctggagctgattgatggccggcccctgaagacccacctgtctgagtacagccccatggagcgcttcaaggagttccagatcaagagctaccccctgcaggacttcagcagcctgaagctgccccacctgaagaaggcctggggcctgcagggcaccagcttcagcaggaagatccgcaccagcggggacaccctgcccaagatgctgggccccaagatccagagcaggcctgcccagagcatcaagtgtgccatgatcaacatcaagccaggagagctgcccaaggaggccgctgtgggcgcctacgtgaaggtgcacacagtggagcagggcgagatcctggccttcctgcctgagggggagtgtgacacccggcccctcatcctgatgagcctgggcaatgaactcatccgcatcaggaaggagatcttctatgagctgattgacaatgatgatgagatgatcaagaagctgctgaagctgaacatcgccttccccagtgatgaggacatgtgccagaagttcctgcagcagaacagctggaacatcttcaggaaggacctgctgcagctgctggtggagccctgccagagccagctgttcacccccaaccggcccaagaagcgggagatctacaaccccaagtctgtggtgctggacctgtgcagcatcaacaagaccaccaagccccgctaccccatcttcatggccccccagaagtacctgccccccctgcgcatcgtgcaggccatcaaggccccccgctacaagatccgggagctgctggcctag

SEQ ID NO: 36684 - DNA, 1731 bp, Artificial Sequence
  Description of Artificial Sequence: Synthetic coding sequence
atgaggaggcacatggtgacctacgcctggcagctgctgaagaaggagctgggcctgtaccagctggccatggacatcatcatcatgatccgggtgtgcaagatgttccggcagggcctgcggggcttccgggagtaccagatcattgaaacagcccactggaagcaccccatcttctccttctgggacaagaagatgcagagccgggtgacctttgacaccatggacttcatcgccgaggagggccacttcccccccaaggccatccagatcatgcagaagaagcccagctggaggacagaagatgagatccaggccgtgtgcaacatcctgcaggtgctggacagctacagaaattatgcagagcccctgcagctgctgctggccaaggtgatgagatttgaaagatttggaagaagaagagtcatcatcaagaagggccagaagggcaacagcttctacttcatctacctgggcaccgtggccatcaccaaggatgaagatggcagcagcgccttcctggacccccaccccaagctgctgcacaagggcagctgctttggagagatggatgtgctgcacgcctctgtgcggcgcagcaccatcgtgtgcatggaggagacagagttcctggtggtggaccgggaggacttctttgccaacaagctggaccaggaggtgcagaaggatgcccagtacagatttgagttcttcaggaagatggagctgtttgcctcctggagcgatgagaagctgtggcagctggtggccatggccaagattgagcgcttctcctatggccagctgatcagcaaggactttggagagagccccttcatcatgttcatcagcaagggcagctgtgaggtgctgcggctgctggacctgggcgccagccccagctaccgccgctggatctggcagcacctggagctgattgatggccggcccctgaagacccacctgtctgagtacagccccatggagcgcttcaaggagttccagatcaagagctaccccctgcaggacttcagcagcctgaagctgccccacctgaagaaggcctggggcctgcagggcaccagcttcagcaggaagatccgcaccagcggggacaccctgcccaagatgctgggccccaagatccagagcaggcctgcccagagcatcaagtgtgccatgatcaacatcaagccaggagagctgcccaaggaggccgctgtgggcgcctacgtgaaggtgcacacagtggagcagggcgagatcctgggcctgcaccaggccttcctgcctgagggggagtgtgacacccggcccctcatcctgatgagcctgggcaatgaactcatccgcatcaggaaggagatcttctatgagctgattgacaatgatgatgagatgatcaagaagctgctgaagctgaacatcgccttccccagtgatgaggacatgtgccagaagttcctgcagcagaacagctggaacatcttcaggaaggacctgctgcagctgctggtggagccctgccagagccagctgttcacccccaaccggcccaagaagcgggagatctacaaccccaagtctgtggtgctggacctgtgcagcatcaacaagaccaccaagccccgctaccccatcttcatggccccccagaagtacctgccccccctgcgcatcgtgcaggccatcaaggccccccgctacaagatccgggagctgctggcctag

SEQ ID NO: 36685 - DNA, 1272 bp, Artificial Sequence
  Description of Artificial Sequence: Synthetic coding sequence
atgaggaggcacatggtgacctacgcctggcagctgctgaagaaggagctgggcctgtaccagctggccatggacatcatcatcatgatccgggtgtgcaagatgttccggcagggcctgcggggcttccgggagtaccagatcattgaaacagcccactggaagcaccccatcttctccttctgggacaagaagatgcagagccgggtgacctttgacaccatggacttcatcgccgaggagggccacttcccccccaaggccatccagatcatgcagaagaagcccagctggaggacagaagatgagatccaggccgtgtgcaacatcctgcaggtgctggacagctacagaaattatgcagagcccctgcagctgctgctggccaaggtgatgagatttgaaagatttggaagaagaagagtcatcatcaagaagggccagaagggcaacagcttctacttcatctacctgggcaccgtggccatcaccaaggatgaagatggcagcagcgccttcctggacccccaccccaagctgctgcacaagggcagctgctttggagagatggatgtgctgcacgcctctgtgcggcgcagcaccatcgtgtgcatggaggagacagagttcctggtggtggaccgggaggacttctttgccaacaagctggaccaggaggtgcagaaggatgcccagtacagatttgagttcttcaggaagatggagctgtttgcctcctggagcgatgagaagctgtggcagctggtggccatggccaagattgagcgcttctcctatggccagctgatcagcaaggactttggagagagccccttcatcatgttcatcagcaagggcagctgtgaggtgctgcggctgctggacctgggcgccagccccagctaccgccgctggatctggcagcacctggagctgattgatggccggcccctgaagacccacctgtctgagtacagccccatggagcgcttcaaggagttccagatcaagagctaccccctgcaggacttcagcagcctgaagctgccccacctgaagaaggcctggggcctgcagggcaccagcttcagcaggaagatccgcaccagcggggacaccctgcccaagatgctgggccccaagatccagagcaggcctgcccagagcatcaagtgtgccatgatcaacatcaagccaggagagctgcccaaggaggccgctgtgggcgcctacgtgaaggtgcacacagtggagcagggcgagatcctgtag

SEQ ID NO: 36686 - DNA, 1302 bp, Artificial Sequence
  Description of Artificial Sequence: Synthetic coding sequence
atggagtatgaggtgaagaagggcaagaagggctttgtgagccccatccggcggctggtgttccccaaggccggccggcgggccgcctgccgcagctctgtgtcccggcggcccctgcacagcatgcccctgtaccccccagactacctgattgacccccagatcctgctgtgtgactacctggagaaggaggtgaagttcctgggccacctgacctgggtgaccagcagcctgaaccccagcagcagagatgagctgctgcagctgctggacacagcccggcagctgaaggagctgcccctgaagaccacagctgagcaggacagcatcctgagcctgagcgcccgctgcctgctgctgacctggagggacaatgaggagctgatcctgcgcatccccacccatgaaattgctgctgccagctacctgcaggatgatgccctgcacctgctggtgctgaagacaggcctgggcgtggaccctgtgcctgctggggtggatgccagccctgggggcgccggccgggaccccggccccccaggaggagcccctgagaagagaagagtgggcacagctgagcggcggcacaccatctgcagcctggactggaggatgggctggggcggcggcgctgctgaggcccgggccggcggcggcggcggcggcagcctggagcggcagagagctggggcccgggccagcggctcctgggagcggcggcagaccttcagcggctcctgggagaggagacatggaggcggcggcggcggcggcggggccggcaagccaggcggctcctgggagcggcggcaggccggcagcggcggcggcggctcctgggagcggcggcaccctggccccaaccccctggacccccaggaccccagcccagatgcctactgcaacctggtgatcctggccgtggccaacagagatgctgctgaggagagctgtgccctgatctgccaggtgttccagatcatctatggagaccagagcattgaatgtgtggaccgggccggctaccactacaccagcaccccagagcggccctggctgtgcagccgcatcatggcccccaggacccccctgaagcacgtgacagctgcccggccccacctgctgtccatggcccccacagctgctgctgccaccacagctgtgtgggcctggagcagctaccgcatcacctggagccgctgtggggtgtcctggggccccagccgcagcagcagcctgcgctgctgctgcggcagcacaggctggggctgccccagcaggaccatcgcccaggcctgctag

SEQ ID NO: 36687 - DNA, 1716 bp, Artificial Sequence
  Description of Artificial Sequence: Synthetic coding sequence
atggagtatgaggtgaagaagggcaagaagggctttgtgagccccatccggcggctggtgttccccaaggccggccggcgggccgcctgccgcagctctgtgtcccggcggcccctgcacagcatgcccctgtaccccccagactacctgattgacccccagatcctgctgtgtgactacctggagaaggaggtgaagttcctgggccacctgacctgggtgaccagcagcctgaaccccagcagcagagatgagctgctgcagctgctggacacagcccggcagctgaaggagctgcccctgaagaccacagctgagcaggacagcatcctgagcctgagcgcccgctgcctgctgctgacctggagggacaatgaggagctgatcctgcgcatccccacccatgaaattgctgctgccagctacctgcaggatgatgccctgcacctgctggtgctgaagacaggcctgggcgtggaccctgtgcctgctggggtggatgccagccctgggggcgccggccgggaccccggccccccaggaggagcccctgagaagagaagagtgggcacagctgagcggcggcacaccatctgcagcctggactggaggatgggctggggcggcggcgctgctgaggcccgggccggcggcggcggcggcggcagcctggagcggcagagagctggggcccgggccagcggctcctgggagcggcggcagaccttcagcggctcctgggagaggagacatggaggcggcggcggcggcggcggggccggcaagccaggcggctcctgggagcggcggcaggccggcagcggcggcggcggctcctgggagcggcggcaccctggccccaaccccctggacccccaggaccccagcccagatgcctactgcaacctggtgatcctggccgtggccaacagagatgctgctgaggagagctgtgccctgatctgccaggtgttccagatcatctatggagaccagagcattgaatgtgtggaccgggccggctaccactacaccagcaccccagagcggccctggctgtgcagccgctctgagagctgccacacagatggcacctacgcctatgatgctgacttcagctgctgcagcagcttcaacggcagccaggacacctttgaggcctgctacagcggcaccagcacccccagcttccacggcagccactgcagcggcagtgaccacagcagcctgggcctggagcagctgcaggactacatggtgaccctgcggagcaagctgggccccctggagatccagcagtttgccatgctgctgcgggagtaccgcctgggcctgcccatccaggactactgcaccggcctgctgaagctgtatggagacaggaggaagttcctgctgctgggcatgaggcccttcatcccagaccaggacatcggctactttgagggcttcctggagggcgtgggcatccgggagggcggcatcctgacagacagctttggccgcatcaagaggtccatgagcagcaccagcgccagcgctgtgcgctcctatgatggagctgcccagaggcctgaggcccaggccttccaccggctgctggccgacatcacccatgacatcgaggccctggccccagatgatgatgatgatgatgaagatgagccccggggcagcagaggaggcagtgatgctgctgaggacaactacctgtag

SEQ ID NO: 36688 - DNA, 708 bp, Artificial Sequence
  Description of Artificial Sequence: Synthetic coding sequence
atggagtatgaggtgaagaagggcaagaagggctttgtgagccccatccggcggctggtgttccccaaggccggccggcgggccgcctgccgcagctctgtgtcccggcggcccctgcacagcatgcccctgtaccccccagactacctgattgacccccagatcctgctgtgtgactacctggagaaggaggtgaagttcctgggccacctgacctgggtgaccagcagcctgaaccccagcagcagagatgagctgctgcagctgctggacacagcccggcagctgaaggagctgcccctgaagaccacagctgagcaggacagcatcctgagcctgagcgcccgctgcctgctgctgacctggagggacaatgaggagctgatcctgcgcatccccacccatgaaattgctgctgccagctacctgcaggatgatgccctgcacctgctggtgctgaagacaggcctgggcgtggaccctgtgcctgctggggtggatgccagccctgggggcgccggccgggaccccggccccccaggaggagcccctgagaagagaagagtgggcacagctgagcggcggcacaccatctgcagcctggactggaggatgggctggggcggcggcgctgctgaggcccccaccaggagcaccaggaggaccccagcccccacccccacagccacctggagctcctggctgtag

SEQ ID NO: 36689 - DNA, 975 bp, Artificial Sequence
  Description of Artificial Sequence: Synthetic coding sequence
gagcggcggcacggcggcggcggcggcggcggcggggccggcaagccaggcggctcctgggagcggcggcaggccggcagcggcggcggcggctcctgggagaggaggcaccctggccccaaccccctggacccccaggaccccagcccagatgcctactgcaacctggtgatcctggccgtggccaacagagatgctgctgaggagagctgtgccctgatctgccaggtgttccagatcatctacggggaccagagcattgaatgtgtggacagagctggctaccactacaccagcaccccagagcggccctggctgtgcagccgctctgagagctgccacacagatggcacctacgcctatgatgctgacttcagctgctgcagcagcttcaacggcagccaggacacctttgaggcctgctacagcggcaccagcacccccagcttccacggcagccactgcagcggcagtgaccacagcagcctgggcctggagcagctgcaggactacatggtgaccctgcggagcaagctgggccccctggagatccagcagtttgccatgctgctgcgggagtaccgcctgggcctgcccatccaggactactgcaccggcctgctgaagctgtatggagacaggaggaagttcctgctgctgggcatgaggcccttcatcccagaccaggacatcggctactttgagggcttcctggagggcgtgggcatccgggagggcggcatcctgacagacagctttggccgcatcaagaggtccatgagcagcaccagcgccagcgctgtgcgctcctatgatggagctgcccagaggcctgaggcccaggccttccaccggctgctggccgacatcacccatgacatcgaggccctggccccagatgatgatgatgatgatgaagatgagccccggggcagccggggcggcagtgatgctgctgaggacaactacctgtag

SEQ ID NO: 36690 - DNA, 300 bp, Artificial Sequence
  Description of Artificial Sequence: Synthetic coding sequence
atggacaccggcagccgggaggccgccttcacccgggacctgcccaggaagccagcagatgcccaggtgtccccagagatgagcatcacccacaaggagaaggaaaatgcccacctgaaggagatcctgctgtttgtgaatgctgaggccttcagccagccccagccccacagcgcccctgtgtgtgagggccagcagctgaccgggaagttcagcacctctgtgctgaccagggctggaggagatgccagcccctgctcctgggagcggctgctgtgctacggctggagccactgctag

SEQ ID NO: 36691 - DNA, 300 bp, Artificial Sequence; identical to SEQ ID NO: 36690
  Description of Artificial Sequence: Synthetic coding sequence

SEQ ID NO: 36692 - DNA, 354 bp, Artificial Sequence
  Description of Artificial Sequence: Synthetic coding sequence
atgcccagctgcagctgtgccctgatggccccctgtggccctgctgctggccctgctgctgtggagaggacccagcaggtggcccggggggagcccggcagcgcccggggccagctgcaggtgtccccagagatgagcatcacccacaaggagaaggaaaatgcccacctgaaggagatcctgctgtttgtgaatgctgaggccttcagccagccccagccccacagcgcccctgtgtgtgagggccagcagctgaccgggaagttcagcacctctgtgctgaccagggctggaggagatgccagcccctgctcctgggagcggctgctgtgctacggctggagccactgctag

SEQ ID NO: 36693 - DNA, 450 bp, Artificial Sequence
  Description of Artificial Sequence: Synthetic coding sequence
atgctgagcggcccccaccccagccccaccttccggcccaacccctgcccctggccctgcctgcacagcctgtggatggagatcagccccacccagctgtgcttcctgagccctggccccagcccccagagccccagctgctgcttccagggcatgaacagcggcagcgagctgggcaagctgtggaggaagctgttcaagggcatcccccggctgtctgtgagccactttgacttctactgcggcacctgtgtgctgctgggccggccccagatcccccagggcagcagcctgggcaatgacatcgaccagtaccctgtggtgttcagaaatgccagtgaccagggctcctggatgcagctggagatgctgctgaggaagctgagtgacctggtgtggaccagtgatgccctgagtgacaagatcctggaggatggcctggtgccctag

SEQ ID NO: 36694 - DNA, 609 bp, Artificial Sequence
  Description of Artificial Sequence: Synthetic coding sequence
atgaagcgctggcagatctttgtgctgtgggtgttctgggtgctgatcctgtggctgatgaccccctacctggacctgaccccagagagcgccccccaggagaagaggatgtacctggtgccccagcactgtgactgcccctggttcagcagtggaaaatgtggctgccccagcgagaccctgaactgcagcagctgccaccacacagcagatgagtggaactggctggatgcctgcagcaggaagaccatgggctacctgatgaggacccgggagagcatgaccagtgacacagtgctgtggtggctgggcatgaacagcggcagcgagctgggcaagctgtggaggaagctgttcaagggcatcccccggctgtctgtgagccactttgacttctactgcggcacctgtgtgctgctgggccggccccagatcccccagggcagcagcctgggcaatgacatcgaccagtaccctgtggtgttcagaaatgccagtgaccagggctcctggatgcagctggagatgctgctgaggaagctgagtgacctggtgtggaccagtgatgccctgagtgacaagatcctggaggatggcctggtgccctag

SEQ ID NO: 36695 - DNA, 1152 bp, Artificial Sequence
  Description of Artificial Sequence: Synthetic coding sequence
atgaatgccggccccagctggaacaaggtgcagcacagcaagaacagcagcggcaagaggcagagcaagagccaggtgccccacgccagcagccagcccaggagcagcctgacagctgtgacccagcccacagaggagaagctgaaggagagcatcagccctgaggcccggaggaagaggaaccccctgggcagccgctgccagggcgccagcggcaacaagctgttcctggacttccagagcatgaagatcatcaaggaaaatgctgatgaagattctgccagtgacctgagtgacagcgagcgcatccccatcccccccagccccctgaccccaccagacctgaacctgcgggcagaggagattgatcctgtgtactttgacctgcaccctggccagggccacaccaagccagagtactactaccccaacttcctgcccagccccttcagctcctgggacctgcgggacatggccctgctgctgaatgctgagaacaagacagaggccgtgccccgggtgggcggcctgctgggcaagtacatcgacaggctcatccagctggagtggctgcaggtgcagacagtgcagtgtgagaaggccaagggcggcaaggcccggcccccaacagcccctggcaccagcggggccctgaagagccctggccgcagcaagctgattgccagcgccctgagcaagcccctgccccaccaggagggcgccagcaagagcggccccagcaggaagaaggccttccaccacgaggagatccaccccagccactacgcctttgagaccagcccccggcccattgatgtgctgggcggcacccgcttctgcagccagaggcagaccctggagatgaggacagaggagaagaagaagaagagcagcaagagcaccaagctgcagcgctgggacctgagcggcagcggcagcagcagcaaggtggagaccagcggccacatccgggtgcccaagcaggccgccgtcatcctggacagcgctgacagctgcaaggccagcaagacccaggcccacgcccaccccaggaagaagggcaaggccgagagctgtggccacgccaccgtgagcagcgagaagaagctgaagaccaatggagtgaagcagaacacctacaagctgaagtag

SEQ ID NO: 36696 - DNA, 1152 bp, Artificial Sequence; identical to SEQ ID NO: 36695
  Description of Artificial Sequence: Synthetic coding sequence

SEQ ID NO: 36697 - DNA, 147 bp, Artificial Sequence
  Description of Artificial Sequence: Synthetic coding sequence
atgaatgccggccccagctggaacaaggtgcagcacagcaagaacagcagcggcaagaggcagagcaagagccaggtgccccacgccagcagccagcccaggagcagcctgacagctgtgacccagcccacagaggagaagctgtag

SEQ ID NO: 36698 - DNA, 153 bp, Artificial Sequence
  Description of Artificial Sequence: Synthetic coding sequence
atggacatcctgctggacctgggctggcacttcagcaactgtgatgaggacaccttctacagccctgtgcagaacacagaaggagacctgctcttctttgaccacaacctgaagacagaccggggccacgtggagaggtctgtgatggactag

SEQ ID NO: 36699 - DNA, 126 bp, Artificial Sequence
  Description of Artificial Sequence: Synthetic coding sequence
gacctgggctggcacttcagcaactgtgatgaggacaccttctacagccctgtgcagaacacagaaggagacctgctcttctttgaccacaacctgaagacagaccggggccacgtggagaggtag

SEQ ID NO: 36700 - DNA, 957 bp, Artificial Sequence
  Description of Artificial Sequence: Synthetic coding sequence
atgagcacccacgtggccggcctgggcctggacaagatgaagctgggcaacccccagagcttcctggaccaggaggaggctgatgaccagcagctgctggagcctgaggcctggaagacctacacagagaggagaaatgccctgcgggagttcctgaccagtgacctgagcccccacctgctgaagaggcaccacgccaggatgcagctgctgaggaaatgttcctactacatcgaggtgctgcccaagcacctggccctgggggaccagaaccccctggtgctgcccagcgccctcttccagctgattgacccctggaagttccagaggatgaagaaggtgggcacagcccagaccaagatccagctgctgctgctgggggacctgctggagcagctggaccacggccgggcagagctggatgccctgctgcggagcccagacccccggcccttcctggccgactgggccctggtggagcggcggctggctgatgtgtctgctgtgatggacagcttcctgaccatgatggtgcccggccgcctgcacgtgaagcaccggctggtgtctgatgtgtctgccaccaagatcccccacatctggctgatgctgagcaccaagatgcctgtggtgtttgacaggaaggccagcgctgcccaccaggactgggcccggctgcgctggtttgtgaccatccagcctgccaccagcgagcagtatgagctgcgcttccggctgctggaccccaggacccagcaggagtgtgcccagtgtggggtcatccctgtggccgcctgcacctttgatgtgaggaacctgctgcccaacagaagctacaagttcaccatcaagagagctgagaccagcaccctggtgtatgagccctggagggacagcctgaccctgcacaccaagccagagcccctggagggccctgccctgagccacagcgtgtag

SEQ ID NO: 36701 - DNA, 957 bp, Artificial Sequence; identical to SEQ ID NO: 36700
  Description of Artificial Sequence: Synthetic coding sequence

SEQ ID NO: 36702 - DNA, 618 bp, Artificial Sequence
  Description of Artificial Sequence: Synthetic coding sequence
atggccgccagagatgccaccagcggcagcctgtctgaggagagcagcgccctggacctgcccagcgcctgtgacatccgggactatgtgctgcagggccccagccaggaggccaacagcgaggccttcagcagcctggagttccacagcttcccctacagcagtgatgtggaccctgacaccagcaacctgaacatcgagcagaacaacagctggacagctgagaacttctggctggaccctgctgtgaagggccagagcgagaaggaggaggatgatggcctgaggaagagcctggaccgcttctatgagatgtttggccacccccagcccggcagcgccaacagcctgagcgcctctgtgtgcaagtgcctgagccagaagatcacccagctgcggggccaggagagccagaagtatgccctgcggagcttccagatggcccgggtcatcttcaacagagatggctgcagcgtgctgcagaggcacagccgggacacccacttctaccccctggaggagggcagcaccagcctggatgatgagaagcccaaccctggcctgagcaaggacatcacccacttcctgctgcagcagaatgtgatgaaggacctgtag

SEQ ID NO: 36703 - DNA, 456 bp, Artificial Sequence
  Description of Artificial Sequence: Synthetic coding sequence
atggccgccagagatgccaccagcggcagcctgtctgaggagagcagcgccctggacctgcccagcgcctgtgacatccgggactatgtgctgcagggccccagccaggaggccaacagcgaggccttcagcagcctggagttccacagcttcccctacagcagtgatgtggaccctgacaccagcaacctgaacatcgagcagaacaacagctggacagctgagaacttctggctggaccctgctgtgaagggccagagcgagaaggaggaggatgatggcctgaggaagagcctggaccgcttctatgagatgtttggccacccccagcccggcagcgccaacagcctgagcgcctctgtgtgcaagtgcctgagccagaagatcacccagctgcggggccaggagagccagaagtatgccctgcggcagcagaatgtgatgaaggacctgtag

SEQ ID NO: 36704 - DNA, 189 bp, Artificial Sequence
  Description of Artificial Sequence: Synthetic coding sequence
atggccgccagagatgccaccagcggcagcctgtctgaggagagcagcgccctggacctgcccagcgcctgtgacatccgggactatgtgctgcagggccccagccaggaggccaacagcgaggccttcagcagcctggagttccacagcttcccctacagcagtgatgtggaccctgctgacctgtag

SEQ ID NO: 36705 - DNA, 603 bp, Artificial Sequence
  Description of Artificial Sequence: Synthetic coding sequence
atggagagccacagctgcagccccagctggagcaccatgaccatcagcgcccactgcaacctgcggctgcccagcgccagccagagcgtgggcatcactggagtgagccaccacatctggccccgcatcttctacatgaccatggccgccagagatgccaccagcggcagcctgtctgaggagagcagcgccctggacctgcccagcgcctgtgacatccgggactatgtgctgcagggccccagccaggaggccaacagcgaggccttcagcagcctggagttccacagcttcccctacagcagtgatgtggaccctgacaccagcaacctgaacatcgagcagaacaacagctggacagctgagaacttctggctggaccctgctgtgaagggccagagcgagaaggaggaggatgatggcctgaggaagagcctggaccgcttctatgagatgtttggccacccccagcccggcagcgccaacagcctgagcgcctctgtgtgcaagtgcctgagccagaagatcacccagctgcggggccaggagagccagaagtatgccctgcgctccttccagatggcccgggtcatcttcaactag

SEQ ID NO: 36706 - DNA, 366 bp, Artificial Sequence
  Description of Artificial Sequence: Synthetic coding sequence
atggccgccagagatgccaccagcggcagcctgtctgaggagagcagcgccctggacctgcccagcgcctgtgacatccgggactatgtgctgcagggccccagccaggaggccaacagcgaggccttcagcagcctggagttccacagcttcccctacagcagtgatgtggaccctgacaccagcaacctgaacatcgagcagaacaacagctggacagctgagaacttctggctggaccctgctgtgaagggccagagcgagaaggaggaggatgatggcctgaggaagagcctggaccgcttctatgagatgtttggccacccccagcccggcagcgccaacagcctgagcgcctctgtgtag

SEQ ID NO: 36707 - DNA, 321 bp, Artificial Sequence
  Description of Artificial Sequence: Synthetic coding sequence
atggaggtgtgcagctgctgccccggctggagcgccaccgtgtctgcccactgcaacctgcgctttgccagcagcaccagccagagcgctggcatcaccggcatgagccagtgtgcctggcccaccttcaccttcctgaccatggccgccagagatgccaccagcggcagcctgtctgaggagagcagcgccctggacctgcccagcgcctgtgacatccgggactatgtgctgcagggccccagccaggaggccaacagcgaggccttcagcagcctggagttccacagcttcccctacagcagtgatgtggacccctag

SEQ ID NO: 36708 - DNA, 381 bp, Artificial Sequence
  Description of Artificial Sequence: Synthetic coding sequence
atggtggccctcttccagcacagcccctactggcaggctgatggctacggccacagccaccggctgaagtgccagcacttcaagcagcaccggcagtacaatgacaagctggagatcagcagcaacctgggcccccagttcaatgccctgctgaacatcctgctgaacatcgtgcaccccaccctgagccatgacaccaggaggagcaagggcctgaagattgagggcctgctgcagagccgggagctgggcaacagctggacagtgaccatgtgcatctgggtgctgaaggccctgcagagcagcgcccccaacaagcccctggactggctggaccccatgccctgcttccagaacctgctggcccggggcaccccctag

SEQ ID NO: 36709 - DNA, 723 bp, Artificial Sequence
  Description of Artificial Sequence: Synthetic coding sequence
atgcctcctccagccaaggagggcggcaggaagggcccccgggagaggtctgggaagagcgcccctggaacagcccagggcgaggagcgggccaagggggccccagccacagagccccccaagccaggctgggccctgaccccccagggcctggccgccatgctgcctgcccagaggcaccgccacctgctgtttggagacctgctggaggatgtgggcgctgctgccagcaccttcccctgtggctctgtggagcccggctacaggatgccagacccccggccctggacccagagcctggagctgcctgctgagcggcagaaccggctgctgggcgtgctgaaggctgctgaggcccggggccgggtgcgggccctgcggctgcgctacaccaggatgagagctgaggagatcgccctgctgatccagaggcagaagagcgcccgggccgccatccggctggagctgttcctgcccccccagctgaagccagcccgcatcccagaccccctggaccggcaggaggtgcagaccagccctggccggggcggggagcggggcggggccctgcctgccagcgcccacgccggcccccagcccctgagccctgctgctgaggcccggggggaccaccctggaggagagcggggctggcaccacctgcctgctgtgacagccacagaatctgtgagaagagccccagccagccacatcaagctgtag

SEQ ID NO: 36710 - DNA, 369 bp, Artificial Sequence
  Description of Artificial Sequence: Synthetic coding sequence
atgtacaagagcaagatcccccgggcccagaaccaggtgtctgtgaaggtgacccccaagaacacagagatgaagattgctgaggagcccagccccagcctgggccagaccctggagtggctgaggaaggagctgtctgagatgcagatccaggaccagagcctgctgctgaccctgcggcacctgcacagcgtgctggaggagctgcgggctgacagcgcccactgggaggatgcccggagcagcggcggcaccagccccatccgggcccgggccggcagcgagggccggggctgccagcctgtgtgcagccggggcctggcccagctgctgcggggggaggacagcagaagaagcagcctgccctag

SEQ ID NO: 36711 - DNA, 3714 bp, Artificial Sequence
  Description of Artificial Sequence: Synthetic coding sequence
atgtctgtgctgaccagcccccggggcaaggtggaggtggtgcactgcagaagaacagagagccaggatgtgtactgcatcaagagcctcatcaggaagttcacctgcaagctgtttgggaagctgaacatcatctacctgctggagaaggccaacctggccgtgaccctgtgcaatgacaaggaggagatcatggcccaggccaccttcctggactaccccaactggaatgtggccaagcaggatgactgggtgtctgtgttccgggagctggacagcgacatcccctgcacccccctgaacaccctcttcatgcacctgtttgtggccgtggatgagtacagcgtgggctgctgcaaggagatcctgaggacagtgtacaaggctgtgcctgagctgcacttcatcttcctgattgtgcccagctacatgagcctgggcagcaccctcatcaccgtgtttgaccaggtgggcaacatcccctgcctgacctatgaagaagattttgctgtgcacatctgccaccgccacagccactacccccagctgcacgtgaggaaggcccgggtggaggaccatgatgacctgatgcccatcttcatgagatatgacaccatcctgaaggagacctatggagagtacttcctggccgagctgattgaggcccaggatgaggagaaccacgctgtggtgtgtgaggtggagggcacagctgtgggcttcatgtctgtgtgcagccgggtgaacatgcagctgctgcatgaatgttttgacctgggccccttccacggcctgtgcttcccccacccagatgatgtgctggagagcccccaggacctgtctgtgagaagaagccaggatgctgagctgcggagcagcagccagggcagccagaagatcgtggaggagctgcaggagcctgtgtccccagacaccatggagaacatccagggcaacatcgcccgggaggccgccagcgaggaggccctgacagctgtgcagagcggaaatgtgtctgagcctgaggacatcgagaagctgagtgacatcagcacaggctacgcccagtaccaccacgtgagcagccgcagcctggccagcctggtgctgcctgaggagcctgtgcacttccggcccatctacagaggagccagcgctgccttctgcatccagctgttctgcattgatgagaagtatgaggcccggagcctggacttcatgaactttgtgttcagcctcttcagtgacaagaacttctgtgtgatcagcctgccccacctgaccccagagttcttcctgatccagaactttgtgaagatggtgcccttcaacacctgcaccctggagcaggacctgtatgtgttccaccgggccggcctgctgaagagcatcaacatccgctttgccaccctgctggacaccccaggagtggagaacctggtgtccaccctgatgctgaacaagagcatcctggaggacctggaccgctacaacaaggccaggaaggaccctgatggcaccctgctgcaggcctttgtggccgaggtggccgagcagatcgtgggcattgctgtgatcagaaatgagatggacatcgagtacatccgcagccactacaacatcgaggacttcatctacttcagccaccaccagcgggaggagcacggccacatgcaccactttgccctgaaccccatcttccgccactacaccaagttcttcctgaaggagatcctgcggctgggcttcaagagctgcctgtactacagagtgtaccccaagagccgggagggcaagttccagaacccctatgcccacagcctgaccagcgccctgcactacctggtgcctgtgcggccccggcggcagatcgtgtaccccctggagaagctgggcatcaatgcccccagcaaggctgtgtccaaggaccccatgtcctatgccctgaaccacaccaacaggaagctgaccctggagcccaagatcaccgtgaatgccaagatcatcgtggtgggcgccagctctgtgggcatctccttcctggagaccctggtgttctgcagccacatgaagttcaacaacctgaccctcatcagcacccacggcctgcccgggaagaagctgctggacacagagcagaggaagttcctggccagtgaccactgcttcaatgacaaggactatgccctgatgagcctgtgctcctgggtgaatgtggtggtgggccgcatgactggaattgaccgggccgccaagcacgtggtgctgagcacagatgaaattgtgccctatgaccacctgatcctgtgcaccggccagcagtaccaggtgccctgccccacagaagctgacatcagccagcacctgaccaaccgggaggtgcccaacagcagccagaggcgctacacaggcaaggtgccctgcaaccacttcaccctgaatgaggaggaggactgcttcaaggccctgatctggatccggaacaacagcatcaccacagagggcaacatcatcgtgtatggcaacaccatcgacacctacaccaccgtggagaccctgctgaacctgggcgtgtctggcagccgcatccacctggtgcagcccccaccagccagcaccatcacctgcatcaacaactacagcgtggagagcgctgtggctgatgccctgggcgctgctggggtgaccatgtacagagatgccatcctggcccagtggaatgatggcctgcacccagaccccatctacagcgccagcttcaccacccccaccaagcccttccggctgcagtgcagcatgttcttctccttctgtgagaagaatgtggactatgagaccttcaaggccctgaatgatgcctgcctggtgtatgacagccggctggtgattgacaccaacttccacaccaatgacatcgccatccgggctgctggcagcctgaccaagttcagcaaccgctactacagcaatgagtggacccacagcaacttcagcagcaaggagatcggcttccagctggccgccgccatgctgcacctgtttgaccccaccctggagcctgtgacagagcccccagccaacctggacaggctcatccccatgtacaagggggccaagatccagggcggcatcctgcccggcagctaccactacctgcacatcgccaagccagccatccccacccccctggaggtgcagatggcccagcccaactacggcctggagctggtgacaggcagcgccaagaatggcacctacttccgcatccacatcaacaagtacaagatggtggagaccatcacctgcctgagccgggagcccttccctgccagcaactacatccggctgtttggccagcacgagcagctgctgaacaacctgtgtgcccgctatgatgaaaatctcatcacagacctgtacagctacttcacagagccctggtgcctggccctcttccatgaccgcttcatcgacctgaggaaggagctgcggcagatcctggccagcaaggaggaggaggacctgcccagcattgagcagctggcccaccagattgaagatgaggagatcaaccccacagagaagccccggcagtacctgaagagggtgtttgaggagagcatctacaagaccctggtggagaggagcaccctggactacctgcactacaaccgctaccacctgcccatgtatgcctggccaggcatcgtgtag

SEQ ID NO: 36712 - DNA, 765 bp, Artificial Sequence
  Description of Artificial Sequence: Synthetic coding sequence
atgaactttgtgttcagcctcttcagtgacaagaacttctgtgtgatcagcctgccccacctgaccccagagttcttcctgatccagaactttgtgaagatggtgcccttcaacacctgcaccctggagcaggacctgtatgtgttccaccgggccggcctgctgaagagcatcaacatccgctttgccaccctgctggacaccccaggagtggagaacctggtgtccaccctgatgctgaacaagagcatcctggaggacctggaccgctacaacaaggccaggaaggaccctgacatcgagtacatccgcagccactacaacatcgaggacttcatctacttcagccaccaccagcgggaggagcacggccacatgcaccactttgccctgaaccccatcttccgccactacaccaagttcttcctgaaggagatcctgcggctgggcttcaagagctgcctgtactacagagtgtaccccaagagccgggagggcaagttccagaacccctatgcccacagcctgaccagcgccctgcactacctggtgcctgtgcggccccggcggcagatcgtgtaccccctggagaagctgggcatcaatgcccccagcaaggctgtgtccaaggaccccatgtcctatgccctgaaccacaccaacaggaagctgaccctggagcccaagatcaccgtgaatgccaagatcatcgtggtgggcgccagctctgtgggcatctccttcctggagaccctggtgttctag

SEQ ID NO: 36713 - DNA, 3534 bp, Artificial Sequence
  Description of Artificial Sequence: Synthetic coding sequence
atgtctgtgctgaccagcccccggggcaaggtggaggtggtgcactgcagaagaacagagagccaggatgtgtactgcatcaagagcctcatcaggaagttcacctgcaagctgtttgggaagctgaacatcatctacctgctggagaaggccaacctggccgtgaccctgtgcaatgacaaggaggagatcatggcccaggccaccttcctggactaccccaactggaatgtggccaagcaggatgactgggtgtctgtgttccgggagctggacagcgacatcccctgcacccccctgaacaccctcttcatgcacctgtttgtggccgtggatgagtacagcgtgggctgctgcaaggagatcctgaggacagtgtacaaggctgtgcctgagctgcacttcatcttcctgattgtgcccagctacatgagcctgggcagcaccctcatcaccgtgtttgaccaggtgggcaacatcccctgcctgacctatgaagaagattttgctgtgcacatctgccaccgccacagccactacccccagctgcacgtgaggaaggcccgggtggaggaccatgatgacctgatgcccatcttcatgagatatgacaccatcctgaaggagacctatggagagtacttcctggccgagctgattgaggcccaggatgaggagaaccacgctgtggtgtgtgaggtggagggcacagctgtgggcttcatgtctgtgtgcagccgggtgaacatgcagctgctgcatgaatgttttgacctgggccccttccacggcctgtgcttcccccacccagatgatgtgctggagagcccccaggacctgtctgtgagaagaagccaggatgctgagctgcggagcagcagccagggcagccagaagatcgtggaggagctgcaggagcctgtgtccccagacaccatggagaacatccagggcaacatcgcccgggaggccgccagcgaggaggccctgacagctgtgcagagcggaaatgtgtctgagcctgagagcctggacttcatgaactttgtgttcagcctcttcagtgacaagaacttctgtgtgatcagcctgccccacctgaccccagagttcttcctgatccagaactttgtgaagatggtgcccttcaacacctgcaccctggagcaggacctgtatgtgttccaccgggccggcctgctgaagagcatcaacatccgctttgccaccctgctggacaccccaggagtggagaacctggtgtccaccctgatgctgaacaagagcatcctggaggacctggaccgctacaacaaggccaggaaggaccctgatggcaccctgctgcaggcctttgtggccgaggtggccgagcagatcgtgggcattgctgtgatcagaaatgagatggacatcgagtacatccgcagccactacaacatcgaggacttcatctacttcagccaccaccagcgggaggagcacggccacatgcaccactttgccctgaaccccatcttccgccactacaccaagttcttcctgaaggagatcctgcggctgggcttcaagagctgcctgtactacagagtgtaccccaagagccgggagggcaagttccagaacccctatgcccacagcctgaccagcgccctgcactacctggtgcctgtgcggccccggcggcagatcgtgtaccccctggagaagctgggcatcaatgcccccagcaaggctgtgtccaaggaccccatgtcctatgccctgaaccacaccaacaggaagctgaccctggagcccaagatcaccgtgaatgccaagatcatcgtggtgggcgccagctctgtgggcatctccttcctggagaccctggtgttctgcagccacatgaagttcaacaacctgaccctcatcagcacccacggcctgcccgggaagaagctgctggacacagagcagaggaagttcctggccagtgaccactgcttcaatgacaaggactatgccctgatgagcctgtgctcctgggtgaatgtggtggtgggccgcatgactggaattgaccgggccgccaagcacgtggtgctgagcacagatgaaattgtgccctatgaccacctgatcctgtgcaccggccagcagtaccaggtgccctgccccacagaagctgacatcagccagcacctgaccaaccgggaggtgcccaacagcagccagaggcgctacacaggcaaggtgccctgcaaccacttcaccctgaatgaggaggaggactgcttcaaggccctgatctggatccggaacaacagcatcaccacagagggcaacatcatcgtgtatggcaacaccatcgacacctacaccaccgtggagaccctgctgaacctgggcgtgtctggcagccgcatccacctggtgcagcccccaccagccagcaccatcacctgcatcaacaactacagcgtggagagcgctgtggctgatgccctgggcgctgctggggtgaccatgtacagagatgccatcctggcccagtggaatgatggcctgcacccagaccccatctacagcgccagcttcaccacccccaccaagcccttccggctgcagtgcagcatgttcttctccttctgtgagaagaatgtggactatgagaccttcaaggccctgaatgatgcctgcctggtgtatgacagccggctggtgattgacaccaacttccacaccaatgacatcgccatccgggctgctggcagcctgaccaagttcagcaaccgctactacagcaatgagtggacccacagcaacttcagcagcaaggagatcggcttccagctggccgccgccatgctgcacctgtttgaccccaccctggagcctgtgacagagcccccagccaacctggacaggctcatccccatgtacaagggggccaagatccagggcggcatcctgcccggcagctaccactacctgcacatcgccaagccagccatccccacccccctggaggtgcagatggcccagcccaactacggcctggagctggtgacaggcagcgccaagaatggcacctacttccgcatccacatcaacaagtacaagatggtggagaccatcacctgcctgagccgggagcccttccctgccagcaactacatccggctgtttggccagcacgagcagctgctgaacaacctgtgtgcccgctatgatgaaaatctcatcacagacctgtacagctacttcacagagccctggtgcctggccctcttccatgaccgcttcatcgacctgaggaaggagctgcggcagatcctggccagcaaggaggaggaggacctgcccagcattgagcagctggcccaccagattgaagatgaggagatcaaccccacagagaagccccggcagtacctgaagagggtgtttgaggagagcatctacaagaccctggtggagaggagcaccctggactacctgcactacaaccgctaccacctgcccatgtatgcctggccaggcatcgtgtag

SEQ ID NO: 36714 - DNA, 603 bp, Artificial Sequence
  Description of Artificial Sequence: Synthetic coding sequence
atgtcctatgccctgaaccacaccaacaggaagctgaccctggagcccaagatcaccgtgaatgccaagatcatcgtggtgggcgccagctctgtgggcatctccttcctggagaccctggtgttctgcagccacatgaagttcaacaacctgaccctcatcagcacccacggcctgcccgggaagaagctgctggacacagagcagaggaagttcctggccagtgaccactgcttcaatgacaaggactatgccctgatgagcctgtgctcctgggtgaatgtggtggtgggccgcatgactggaattgaccgggccgccaagcacgtggtgctgagcacagatgaaattgtgccctatgaccacctgatcctgtgcaccggccagcagtaccaggtgccctgccccacagaagctgacatcagccagcacctgaccaaccgggaggtgcccaacagcagccagaggcgctacacaggcaaggtgccctgcaaccacttcaccctgaatgaggaggaggactgcttcaaggccctgatctggatccggaacaacagcatcaccacagaagatggcggccgggcctctgtgctcttctgctag

SEQ ID NO: 36715 - DNA, 438 bp, Artificial Sequence
  Description of Artificial Sequence: Synthetic coding sequence
ggcctgcgggagagcctcttccgcaccccccgcttcggctgcttcagcatcttcccccggcgcatccgggtggaggtggagggcacagctgtgggcttcatgtctgtgtgcagccgggtgaacatgcagctgctgcatgaatgttttgacctgggccccttccacggcctgtgcttcccccacccagatgatgtgctggagagcccccaggacctgtctgtgagaagaagccaggatgctgagctgcggagcagcagccagggcagccagaagatcgtggaggagctgcaggagcctgtgtccccagacaccatggagaacatccagggcaacatcgcccgggaggccgccagcgaggaggccctgacagctgtgcagagcggaaatgtgtctgagcctgaggtggccggcttctatgagttctgcttccagagctag

SEQ ID NO: 36716 - DNA, 570 bp, Artificial Sequence
  Description of Artificial Sequence: Synthetic coding sequence
atgtctgtgctgaccagcccccggggcaaggtggaggtggtgcactgcagaagaacagagagccaggatgtgtactgcatcaagagcctcatcaggaagttcacctgcaagctgtttgggaagctgaacatcatctacctgctggagaaggccaacctggccgtgaccctgtgcaatgacaaggaggagatcatggcccaggccaccttcctggactaccccaactggaatgtggccaagcaggatgactgggtgtctgtgttccgggagctggacagcgacatcccctgcacccccctgaacaccctcttcatgcacctgtttgtggccgtggatgagtacagcgtgggctgctgcaaggagatcctgaggacagtgtacaaggctgtgcctgagctgcacttcatcttcctgattgtgcccagctacatgagcctgggcagcaccctcatcaccgtgtttgaccaggtgggcaacatcccctgcctgacctatgaagaagattttgctgtgcacatctgccaccgccacagccactacccccagctgcacgtgaggaaggccaggtag

SEQ ID NO: 36717 - DNA, 1413 bp, Artificial Sequence
  Description of Artificial Sequence: Synthetic coding sequence
atgtctgtgctgaccagcccccggggcaaggtggaggtggtgcactgcagaagaacagagagccaggatgtgtactgcatcaagagcctcatcaggaagttcacctgcaagctgtttgggaagctgaacatcatctacctgctggagaaggccaacctggccgtgaccctgtgcaatgacaaggaggagatcatggcccaggccaccttcctggactaccccaactggaatgtggccaagcaggatgactgggtgtctgtgttccgggagctggacagcgacatcccctgcacccccctgaacaccctcttcatgcacctgtttgtggccgtggatgagtacagcgtgggctgctgcaaggagatcctgaggacagtgtacaaggctgtgcctgagctgcacttcatcttcctgattgtgcccagctacatgagcctgggcagcaccctcatcaccgtgtttgaccaggtgggcaacatcccctgcctgacctatgaagaagattttgctgtgcacatctgccaccgccacagccactacccccagctgcacgtgaggaaggcccgggtggaggaccatgatgacctgatgcccatcttcatgagatatgacaccatcctgaaggagacctatggagagtacttcctggccgagctgattgaggcccaggatgaggagaaccacgctgtggtgtgtgaggtggagggcacagctgtgggcttcatgtctgtgtgcagccgggtgaacatgcagctgctgcatgaatgttttgacctgggccccttccacggcctgtgcttcccccacccagatgatgtgctggagagcccccaggacctgtctgtgagaagaagccaggatgctgagctgcggagcagcagccagggcagccagaagatcgtggaggagctgcaggagcctgtgtccccagacaccatggagaacatccagggcaacatcgcccgggaggccgccagcgaggaggccctgacagctgtgcagagcggaaatgtgtctgagcctgaggacatcgagaagctgagtgacatcagcacaggctacgcccagtaccaccacgtgagcagccgcagcctggccagcctggtgctgcctgaggagcctgtgcacttccggcccatctacagaggagccagcgctgccttctgcatccagctgttctgcattgatgagaagtatgaggcccggagcctggacttcatgaactttgtgttcagcctcttcagtgacaagaacttctgtgtgatcagcctgccccacctgaccccagagttcttcctgatccagaactttgtgaagatggtgcccttcaacacctgcaccctggagcaggacctgtatgtgttccaccgggccggcctgctgaagaacatctgcctgggccgcagcagctag

SEQ ID NO: 36718 - DNA, 963 bp, Artificial Sequence
  Description of Artificial Sequence: Synthetic coding sequence
atgtcctatgccctgaaccacaccaacaggaagctgaccctggagcccaagatcaccgtgaatgccaagatcatcgtggtgggcgccagctctgtgggcatctccttcctggagaccctggtgttctgcagccacatgaagttcaacaacctgaccctcatcagcacccacggcctgcccgggaagaagctgctggacacagagcagaggaagttcctggccagtgaccactgcttcaatgacaaggactatgccctgatgagcctgtgctcctgggtgaatgtggtggtgggccgcatgactggaattgaccgggccgccaagcacgtggtgctgagcacagatgaaattgtgccctatgaccacctgatcctgtgcaccggccagcagtaccaggtgccctgccccacagaagctgacatcagccagcacctgaccaaccgggaggtgcccaacagcagccagaggcgctacacaggcaaggtgccctgcaaccacttcaccctgaatgaggaggaggactgcttcaaggccctgatctggatccggaacaacagcatcaccacagagggcaacatcatcgtgtatggcaacaccatcgacacctacaccaccgtggagaccctgctgaacctgggcgtgtctggcagccgcatccacctggtgcagcccccaccagccagcaccatcacctgcatcaacaactacagcgtggagagcgctgtggctgatgccctgggcgctgctggggtgaccatgtacagagatgccatcctggcccagtggaatgatggcctgcacccagaccccatctacagcgccagcttcaccacccccaccaagcccttccggctgcagtgcagcggggccttcttcctgggcctgaccatcatctgcatcctgcccagcctgcccttccagctgccctggagatacaagtggcacagcctcatcatggtgtag

SEQ ID NO: 36719 - DNA, 3612 bp, Artificial Sequence
  Description of Artificial Sequence: Synthetic coding sequence
atgtctgtgctgaccagcccccggggcaaggtggaggtggtgcactgcagaagaacagagagccaggatgtgtactgcatcaagagcctcatcaggaagttcacctgcaagctgtttgggaagctgaacatcatctacctgctggagaaggccaacctggccgtgaccctgtgcaatgacaaggaggagatcatggcccaggccaccttcctggactaccccaactggaatgtggccaagcaggatgactgggtgtctgtgttccgggagctggacagcgacatcccctgcacccccctgaacaccctcttcatgcacctgtttgtggccgtggatgagtacagcgtgggctgctgcaaggagatcctgaggacagtgtacaaggctgtgcctgagctgcacttcatcttcctgattgtgcccagctacatgagcctgggcagcaccctcatcaccgtgtttgaccaggtgggcaacatcccctgcctgacctatgaagaagattttgctgtgcacatctgccaccgccacagccactacccccagctgcacgtgaggaaggcccgggtggaggaccatgatgacctgatgcccatcttcatgagatatgacaccatcctgaaggagacctatggagagtacttcctggccgagctgattgaggcccaggatgaggagaaccacgctgtggtgtgtgaggtggagggcacagctgtgggcttcatgtctgtgtgcagccgggtgaacatgcagctgctgcatgaatgttttgacctgggccccttccacggcctgtgcttcccccacccagatgatgtgctggagagcccccaggacctgtctgtgagaagaagccaggatgctgagctgcggagcagcagccagggcagccagaagatcgtggaggagctgcaggagcctgtgtccccagacaccatggagaacatccagggcaacatcgcccgggaggccgccagcgaggaggccctgacagctgtgcagagcggaaatgtgtctgagcctgaggacatcgagaagctgagtgacatcagcacaggctacgcccagtaccaccacgtgagcagccgcagcctggccagcctggtgctgcctgaggagcctgtgcacttccggcccatctacagaggagccagcgctgccttctgcatccagctgttctgcattgatgagaagtatgaggcccggagcctggacttcatgaactttgtgttcagcctcttcagcaactttgtgaagatggtgcccttcaacacctgcaccctggagcaggacctgtatgtgttccaccgggccggcctgctgaagagcatcaacatccgctttgccaccctgctggacaccccaggagtggagaacctggtgtccaccctgatgctgaacaagagcatcctggaggacctggaccgctacaacaaggccaggaaggaccctgatggcaccctgctgcaggcctttgtggccgaggtggccgagcagatcgtgggcattgctgtgatcagaaatgagatggacatcgagtacatccgcagccactacaacatcgaggacttcatctacttcagccaccaccagcgggaggagcacggccacatgcaccactttgccctgaaccccatcttccgccactacaccaagttcttcctgaaggagatcctgcggctgggcttcaagagctgcctgtactacagagtgtaccccaagagccgggagggcaagttccagaacccctatgcccacagcctgaccagcgccctgcactacctggtgcctgtgcggccccggcggcagatcgtgtaccccctggagaagctgggcatcaatgcccccagcaaggctgtgtccaaggaccccatgtcctatgccctgaaccacaccaacaggaagctgaccctggagcccaagatcaccgtgaatgccaagatcatcgtggtgggcgccagctctgtgggcatctccttcctggagaccctggtgttctgcagccacatgaagttcaacaacctgaccctcatcagcacccacggcctgcccgggaagaagctgctggacacagagcagaggaagttcctggccagtgaccactgcttcaatgacaaggactatgccctgatgagcctgtgctcctgggtgaatgtggtggtgggccgcatgactggaattgaccgggccgccaagcacgtggtgctgagcacagatgaaattgtgccctatgaccacctgatcctgtgcaccggccagcagtaccaggtgccctgccccacagaagctgacatcagccagcacctgaccaaccgggaggtgcccaacagcagccagaggcgctacacaggcaaggtgccctgcaaccacttcaccctgaatgaggaggaggactgcttcaaggccctgatctggatccggaacaacagcatcaccacagagggcaacatcatcgtgtatggcaacaccatcgacacctacaccaccgtggagaccctgctgaacctgggcgtgtctggcagccgcatcaacaactacagcgtggagagcgctgtggctgatgccctgggcgctgctggggtgaccatgtacagagatgccatcctggcccagtggaatgatggcctgcacccagaccccatctacagcgccagcttcaccacccccaccaagcccttccggctgcagtgcagcatgttcttctccttctgtgagaagaatgtggactatgagaccttcaaggccctgaatgatgcctgcctggtgtatgacagccggctggtgattgacaccaacttccacaccaatgacatcgccatccgggctgctggcagcctgaccaagttcagcaaccgctactacagcaatgagtggacccacagcaacttcagcagcaaggagatcggcttccagctggccgccgccatgctgcacctgtttgaccccaccctggagcctgtgacagagcccccagccaacctggacaggctcatccccatgtacaagggggccaagatccagggcggcatcctgcccggcagctaccactacctgcacatcgccaagccagccatccccacccccctggaggtgcagatggcccagcccaactacggcctggagctggtgacaggcagcgccaagaatggcacctacttccgcatccacatcaacaagtacaagatggtggagaccatcacctgcctgagccgggagcccttccctgccagcaactacatccggctgtttggccagcacgagcagctgctgaacaacctgtgtgcccgctatgatgaaaatctcatcacagacctgtacagctacttcacagagccctggtgcctggccctcttccatgaccgcttcatcgacctgaggaaggagctgcggcagatcctggccagcaaggaggaggaggacctgcccagcattgagcagctggcccaccagattgaagatgaggagatcaaccccacagagaagccccggcagtacctgaagagggtgtttgaggagagcatctacaagaccctggtggagaggagcaccctggactacctgcactacaaccgctaccacctgcccatgtatgcctggccaggcatcgtgtag

SEQ ID NO: 36720 - DNA, 603 bp, Artificial Sequence; identical to SEQ ID NO: 36714
  Description of Artificial Sequence: Synthetic coding sequence

SEQ ID NO: 36721 - DNA, 1413 bp, Artificial Sequence; identical to SEQ ID NO: 36717
  Description of Artificial Sequence: Synthetic coding sequence

SEQ ID NO: 36722 - DNA, 408 bp, Artificial Sequence
  Description of Artificial Sequence: Synthetic coding sequence
atgtctgtgctgaccagcccccggggcaaggtggaggtggtgcactgcagaagaacagagagccaggatgtgtactgcatcaagagcctcatcaggaagttcacctgcaagctgtttgggaagctgaacatcatctacctgctggagaaggccaacctggccgtgaccctgtgcaatgacaaggaggagatcatggcccaggccaccttcctggactaccccaactggaatgtggccaagcaggatgactgggtgtctgtgttccgggagctggacagcgacatcccctgcacccccctgaacaccctcttcatgcacctgtttgtggccgtggatgagtacagcgtgggctgctgcaaggagatcctgaggacagtgtacaaggctgtgcctgagctgcacttctag

SEQ ID NO: 36723 - DNA, 1467 bp, Artificial Sequence
  Description of Artificial Sequence: Synthetic coding sequence
atggagcccttcctgcggcggcggctggccttcctgtccttcttctgggacaagatctggccagctggaggagagccagaccacggcaccccaggcagcctggaccccaacacagatcctgtgcccaccctgcctgctgagccctgcagccccttcccccagctgttcctggccctgtatgacttcaccgcccgctgtggcggggagctgtctgtgagaagaggagaccggctgtgtgccctggaggagggcggcggctacatctttgcccggcggctgagcggccagcccagcgctggcctggtgcccatcacccacgtggccaaggccagccctgagaccctgagtgaccagccctggtacttctctggagtgtccaggacccaggcccagcagctgctgctgagccccccaaatgaacctggggccttcctgatccggcccagcgagagcagcctgggcggctacagcctgtctgtgcgggcccaggccaaggtgtgccactacagagtgtccatggctgctgatggcagcctgtacctgcagaagggccgcctcttccctggcctggaggagctgctgacctactacaaggccaactggaagctgatccagaaccccctgctgcagccctgcatgccccagaaggccccccggcaggatgtgtgggagcggccccacagcgagtttgccctgggcaggaagctgggggagggctactttggagaggtgtgggagggcctgtggctgggcagcctgcctgtggccatcaaggtgatcaagagcgccaacatgaagctgacagacctggccaaggagatccagaccctgaagggcctgcggcatgagcggctcatccggctgcatgctgtgtgcagcggcggggagcctgtgtacatcgtgacagagctgatgaggaaaggaaacctgcaggccttcctgggcaccccagagggccgggccctgcggctgccccccctgctgggctttgcctgccaggtggccgagggcatgagctacctggaggagcagagggtggtgcaccgggacctggccgccagaaatgtgctggtggatgatggcctggcctgcaaggtggccgactttggcctggcccggctgctgaaggatgacatctacagccccagcagcagcagcaagatccctgtgaagtggacagcccctgaggccgccaactacagagtcttcagccagaagagtgatgtgtggagctttggagtgctgctgcacgaggtgttcacctacggccagtgcccctatgagggcatgaccaaccacgagaccctgcagcagatcatgaggggctaccgcctgcccaggcctgctgcctgcccagctgaggtgtatgtgctgatgctggagtgctggaggagcagccctgaggagcggcccagctttgccaccctgcgggagaagctgcacgccatccaccgctgccacccctag

SEQ ID NO: 36724 - DNA, 402 bp, Artificial Sequence
  Description of Artificial Sequence: Synthetic coding sequence
atggctgctgccaacaagggcaacaagccccgggtgcgcagcatccgctttgctgctggccatgatgctgagggcagccacagccacgtgcactttgatgagaagctgcatgattctgtggtgatggtgacccaggagagtgacagcagcttcctggtgaaggtgggcttcctgaagatcctgcacagatatgagatcaccttcaccctgccccctgtgcaccggctgagcaaggatgtgcgggaggcccctgtgcccagcctgcacctgaagctgctgtctgtggtgcctgtgcctgaggacagacaccacggcacccccatgctgctggatggagtgaagtgtgtgggcgctgagctggagtatgacagcgagcacagcgactggcacggctttgattag

SEQ ID NO: 36725 - DNA, 525 bp, Artificial Sequence
  Description of Artificial Sequence: Synthetic coding sequence
atggctgctgccaacaagggcaacaagccccgggtgcgcagcatccgctttgctgctggccatgatgctgagggcagccacagccacgtgcactttgatgagaagctgcatgattctgtggtgatggtgacccaggagagtgacagcagcttcctggtgaaggtgggcttcctgaagatcctgcacagatatgagatcaccttcaccctgccccctgtgcaccggctgagcaaggatgtgcgggaggcccctgtgcccagcctgcacctgaagctgctgtctgtggtgcctgtgcctgagggctacagcgtgaagtgtgagtacagcgcccacaaggagggcgtgctgaaggaggagatcctgctggcctgtgagggcggcaccggcacctgtgtgcgggtgacagtgcaggcccgggtgatggacagacaccacggcacccccatgctgctggatggagtgaagtgtgtgggcgctgagctggagtatgattctgagcacagcgactggcacggctttgattag

SEQ ID NO: 36726 - DNA, 525 bp, Artificial Sequence; identical to SEQ ID NO: 36725
  Description of Artificial Sequence: Synthetic coding sequence

SEQ ID NO: 36727 - DNA, 384 bp, Artificial Sequence
  Description of Artificial Sequence: Synthetic coding sequence
tgaaacaagccccgggtgcgcagcatccgctttgctgctggccatgatgctgagggcagccacagccacgtgcactttgatgagaagctgcatgattctgtggtgatggtgacccaggagagtgacagcagcttcctggtgaaggtgggcttcctgaagatcctgcacagatatgagatcaccttcaccctgccccctgtgcaccggctgagcaaggatgtgcgggaggcccctgtgcccagcctgcacctgaagctgctgtctgtggtgcctgtgcctgaggacagacaccacggcacccccatgctgctggatggagtgaagtgtgtgggcgctgagctggagtatgacagcgagcacagcgactggcacggctttgattag

SEQ ID NO: 36728 - DNA, 603 bp, Artificial Sequence
  Description of Artificial Sequence: Synthetic coding sequence
atggtgcacgccttcctgatccacaccctgcgggcccccaacacagaggacaccggcctgtgccgggtgctgtacagctgtgtgtttggagctgagaagagcccagatgacccccggccccatggagctgagcgggaccggctgctgaggaaggagcagatcctggccgtggcccggcaggtggagagcatgtgccgcctgcagcagcaggccagcggccggccccccatggacctgcagccccagagcagtgatgagcaggtgcccctgcacgaggcccccaggggggccttccggctggccgctgagaaccccttccaggagcccaggacagtggtgtggctgggcgtgctgagcctgggctttgccctggtgctggatgcccacgagaacctgctgctggccgagggcaccctgcggctgctgacccggctgctgctggaccacctgcggctgctggcccccagcaccagcctgctgctgcgggctgaccgcatcgagggcatcctgacccgcttcctgccccacggccagctgctcttcctgaatgaccagtttgtgcagggcctggagaaggagttctctgctgcctggcccaggtag

SEQ ID NO: 36729 - DNA, 603 bp, Artificial Sequence; identical to SEQ ID NO: 36728
  Description of Artificial Sequence: Synthetic coding sequence

SEQ ID NO: 36730 - DNA, 180 bp, Artificial Sequence
  Description of Artificial Sequence: Synthetic coding sequence
atggtgcacgccttcctgatccacaccctgcgggcccccaacacagaggacaccggcctgtgccgggtgctgtacagctgtgtgtttggagctgagaagagcccagatgacccccggccccatggagctgagcgggaccggctgctgaggaaggagcagatcctggccgtggccaggtag

SEQ ID NO: 36731 - DNA, 261 bp, Artificial Sequence
  Description of Artificial Sequence: Synthetic coding sequence
atggtgcacgccttcctgatccacaccctgcgggcccccaacacagaggacaccggcctgtgccgggtgctgtacagctgtgtgtttggagctgagaagagcccagatgacccccggccccatggagctgagcgggaccggctgctgaggaaggagcagatcctggccgtggcccggcaggtggagagcatgtgccgcctgcagcagcaggccagcggccggccccccatggacctgcagccccagagcagtgatgaatag

SEQ ID NO: 36732 - DNA, 1155 bp, Artificial Sequence
  Description of Artificial Sequence: Synthetic coding sequence
atggctgctgtgcagatggaccctgagctggccaagaggctcttctttgagggcgccaccgtggtgatcctgaacatgcccaagggcacagaatttggcatcgactacaacagctgggaggtgggccccaagttccggggcgtgaagatgatccccccaggcatccacttcctgcactacagctctgtggacaaggccaaccccaaggaggtgggccccaggatgggcttcttcctgagcctgcaccagaggggcctgactgtgctgcgctggagcaccctgcgggaggaggtggacctgagccctgcccctgagagcgaggtggaggccatgagggccaacctgcaggagctggaccagttcctgggcccctacccctatgccaccctgaagaagtggatcagcctgaccaacttcatcagcgaggccaccgtggagaagctgcagccagaaaatcggcagatctgtgccttcagtgatgtgctgcctgtgctgtccatgaagcacaccaaggacagagtgggccagaacctgccccgctgtggcatcgagtgcaagagctaccaggagggcctggcccggctgcctgagatgaagccccgggccggcacagagatccgcttcagcgagctgcccacccagatgtttcctgagggcgccaccccagctgagatcaccaagcacagcatggacctgtcctatgccctggagaccgtgctgaacaagcagttccccagcagcccccaggatgtgctgggggagctgcagtttgcctttgtgtgcttcctgctgggcaatgtgtatgaggcctttgagcactggaagaggctgctgaacctgctgtgccgctctgaggccgccatgatgaagcaccacaccctgtacatcaacctgatcagcatcctgtaccaccagctgggggagatcccagctgacttctttgtggacatcgtgtcccaggacaacttcctgaccagcaccctgcaggtgttcttcagcagcgcctgcagcattgctgtggatgccaccctgaggaagaaggccgagaagttccaggcccacctgaccaagaagttccgctgggactttgctgctgagcctgaggactgtgcccctgtggtggtggagctgcctgagggcatcgagatgggctag

SEQ ID NO: 36733 - DNA, 1155 bp, Artificial Sequence; identical to SEQ ID NO: 36732
  Description of Artificial Sequence: Synthetic coding sequence

SEQ ID NO: 36734 - DNA, 921 bp, Artificial Sequence
  Description of Artificial Sequence: Synthetic coding sequence
atgggctgtgatggcggcaccatccccaagagacatgagctggtgaagggccccaagaaggtggagaaggtggacaaggatgctgagctggtggcccagtggaactactgcaccctgagccaggagatcctgcggcggcccatcgtggcctgtgagctgggccgcctgtacaacaaggatgctgtgattgagttcctgctggacaagtctgctgagaaggccctgggcaaggccgccagccacatcaagagcatcaagaatgtgacagagctgaagctgagtgacaacccagcctgggagggggacaagggcaacaccaagggggacaagcatgatgacctgcagagggcccgcttcatctgccctgtggtgggcctggagatgaatggccgccaccgcttctgcttcctgcgctgctgcggctgtgtgttttctgagcgggccctgaaggagatcaaggccgaggtgtgccacacctgtggggccgccttccaggaggatgatgtgatcatgctgaatggcaccaaggaggatgtggatgtgctgaagaccaggatggaggagcggcggctgcgggccaagctggagaagaagaccaagaagcccaaggctgctgagagcgtgtccaagccagatgtgtctgaggaggcccctggccccagcaaggtgaagacaggcaagccagaggaggccagcctggacagccgggagaagaagaccaacctggcccccaagagcacagccatgaatgaaagcagcagcggcaaggccggcaagccaccctgtggggccaccaagaggagcattgctgacagcgaggagagcgaggcctacaagagcctcttcaccacccacagcagcgccaagaggagcaaggaggagagcgcccactgggtgacccacaccagctactgcttctag

SEQ ID NO: 36735 - DNA, 1011 bp, Artificial Sequence
  Description of Artificial Sequence: Synthetic coding sequence
atgggctgtgatggcggcaccatccccaagagacatgagctggtgaagggccccaagaaggtggagaagatctggcacctgaagaatggcaaggagtggtgcagcctgcacagcgagggcaagaacaagaatggcaaggagtgggacatggagtatgatgtggacaaggatgctgagctggtggcccagtggaactactgcaccctgagccaggagatcctgcggcggcccatcgtggcctgtgagctgggccgcctgtacaacaaggatgctgtgattgagttcctgctggacaagtctgctgagaaggccctgggcaaggccgccagccacatcaagagcatcaagaatgtgacagagctgaagctgagtgacaacccagcctgggagggggacaagggcaacaccaagggggacaagcatgatgacctgcagagggcccgcttcatctgccctgtggtgggcctggagatgaatggccgccaccgcttctgcttcctgcgctgctgcggctgtgtgttttctgagcgggccctgaaggagatcaaggccgaggtgtgccacacctgtggggccgccttccaggaggatgatgtgatcatgctgaatggcaccaaggaggatgtggatgtgctgaagaccaggatggaggagcggcggctgcgggccaagctggagaagaagaccaagaagcccaaggctgctgagagcgtgtccaagccagatgtgtctgaggaggcccctggccccagcaaggtgaagacaggcaagccagaggaggccagcctggacagccgggagaagaagaccaacctggcccccaagagcacagccatgaatgaaagcagcagcggcaaggccggcaagccaccctgtggggccaccaagaggagcattgctgacagcgaggagagcgaggcctacaagagcctcttcaccacccacagcagcgccaagaggagcaaggaggagagcgcccactgggtgacccacaccagctactgcttctag

SEQ ID NO: 36736 - DNA, 129 bp, Artificial Sequence
  Description of Artificial Sequence: Synthetic coding sequence
atgggctgtgatggcggcaccatccccaagagacatgagctggtgaagggccccaagaaggtggagaaggccatcatcggcggcctgctggatggagcctggagccctgagacccccagccaggactag

SEQ ID NO: 36737 - DNA, 456 bp, Artificial Sequence
  Description of Artificial Sequence: Synthetic coding sequence
atgttccaggtgttcaagccccatgctggggaggactacaagtacccccgggagacagagaccatctggagccacccctacgtggtggagggcagccacaagagccccctggagagcctgagcctgcacggctgcctggccgccatggcccccagcatcaccagcagcgaggacagcagccccagccagagggacaagaaggacctgagcctggacctgctgctgaccaggaagaagaggagccagggcctgcactggagccactggcagggcctgaaccacatgagcatccgcatccacaccccagagcagggcagccccagcctgggccagaactggagctggggcaacaggaaggagaagggcgtggcccagaggcaggtgcccaccaccggcacccacagcttcttccactgcaccagcgagggcaacaaggagaagccccaccacttctag

SEQ ID NO: 36738 - DNA, 471 bp, Artificial Sequence
  Description of Artificial Sequence: Synthetic coding sequence
atgtggaagagaagtgaccaccagcccaagatcaaggccgaggatggccccctggtgggccagtttgaggtgctgggctctgtgcctgagcccgccatgccccaccccctggagctgtctgaatttgagagcttccctgtgttccaggacatccggctgcacatccgggaggtgggcgcccagctggtgaagaaggtgaatgctgtgttccagctggacatcaccaagaatggcaagaccatcctgcgctggaccatcgacctgaagaatggcagcggggacatgtacccaggccctgcccggctgcctgctgacaccgtcttcaccatccctgagagcgtcttcatggagctggtgctgggcaagatgaacccccagaaggccttcctggccggcaagttcaaggtgtctgggaaggtgctgctgtcctggaagctggagagggtcttcaaggactgggccaagttctag

SEQ ID NO: 36739 - DNA, 414 bp, Artificial Sequence
  Description of Artificial Sequence: Synthetic coding sequence
atggcccagaagcccctgagcacagctgctgctgagaggatgaacctggtgggccaggatgagatctggaagtaccgcctgaaggccgagagcgaggcccggcagaactggccccagaactggggcttcctgaccaccccatttgaggagctgatcaagtgtgaggaggacctgcccacccccaagcccaagattgagctgcctgagcgcttccgcatccggcctgtgacccctgtggagaagtacatcaaggtgttccccagcccccctgtgccccagaccacccagggcttcatcggctggaggtctgctgtgcccggcctgaacaagtgcctggagctggatgatgccatccgcagctgcaagggggcctttgcccgggagctgtgctggcccaagcagggcgtgcactag

SEQ ID NO: 36740 - DNA, 1227 bp, Artificial Sequence
  Description of Artificial Sequence: Synthetic coding sequence
atggccagcaagaagtttgctgtgaagtgtggcaactttgctgtgctggtggacctgcacatcctgccccagggcagcaacaaggacacctcctggttcagcgagcagaagaaggaggaggtgtgcctgctgctgaaggagaccatcgacagccgggtgcaggagtacctggaggtgaggaagcagcaccggcccagcaatgctgagttcaccaggagcaaccccctgagcctgaagggctacggcttccagatcacagcctacttcctgaagaggggcatccggctgcgctgcatccgcagcacccagaatgctgagctgtgtgtgtttcctgacagatttgtggtgtgtgtgtcccagctggccttcagccgggacctgctggccagccagaatgaagacctgacagagcgggtgctgcatggagtgtctgactactttgctgaatgtgccgagagcagcctgccccccagcgccaagctgcggagaaatgccctgaaggagatcgtgaagaggacagagaccaagagctctgtgaccagcaagagccagacccggcgggacacagtggagaccagcagtgacagcgtgattgctgagatcgccaggagaagaaatgatggccaggccagcagcagcccccccagcgagagcatgggccaggccaaggacagcatcaaggctgctgagagccactggggcctgcctgtgcagaagctggagaaggtgaaccagacccagcctgaggacaccagcggccagcagaagccccaccctggagagcggctgaagacaggcctgctgagccgcagccctgtgtgcagctgtgagagcgccagcccctgccccaagcagagcccccgggtggccaagacccagcagaagagaagaaactgcagcagcgcagaagattttgaccaccacggccgggtgtccctgggcagtgaccggctggtgccccgggagatcatcgtggagaagagcaaggctgtgcgggtgctgcctgccagcgagctgagtgaccccggcctgctgctgaagcaggacctggccaagaccaccagcaaggaggagctgcacgtgctggagagcctgagcagccgccacctgatgaagaacaaccctggccaggcccagcagacaggcctggccaccaacacagagcggctgagcaccatccagaacagccccaccaagaagaggaagaagtatgaaagaggccactag

SEQ ID NO: 36741 - DNA, 1092 bp, Artificial Sequence
  Description of Artificial Sequence: Synthetic coding sequence
atggcccacgtgctgcagaagcccaagcacagcggcacccacagcatcgtgcaggagttccaggtgcctgactatgtgccctggcagcagagcaagcaggagaccaagcccagcaccctgccccctgtgcagcaggccaacagcctgcacaccagcaagatgaagaccctgaccagggtgcagcccgtcttccacttcaagcccaccaccgtggtgaccagctgccagcccaagaacccccgggagctgcacagaagaaggaagctggaccccgggaagatgcacgccaagatctggctgatgaagaccagcctgcggagcggccgggccgccctgcgggagctgcggagccgggagaacttcctgagcaagctgaaccgggagctgattgagaccatccaggagatggagaacagcaccaccctgcacgtgcgggccctgctgcagcagcaggacaccctggccaccatcatcgacatcctggagtacagcaacaagaagaggctgcagcagctgaagtctgagctgcaggagtgggaggagaagaagaagtgcaagatgagctacctggagcagcaggccgagcagctgaatgccaagattgagaagacccaggaggaggtgaacttcctgagcacctacatggaccacgagtacagcatcaagtctgtgcagatcagcaccctgatgaggcagctgcagcaggtgaaggacagccagcaggatgagctggatgacctgggggagatgaggaggaaggtgctggagagcctgagtgacaagatccagaagaagaagaagaagatcctgagctctgtggtggccgagacccagaggccctatgaggaggccctgctgcagaagatgtgggagagccaggacttcctgaagtgcatgcagcgcttccgggagatcatcgaccagtttgaggagaacatgcctgtgctgcgggcagaggtggaggagctgcaggcccagacccgggagccccgggaggtgatctttgaagatgtgctgctgcggcggcccaagtgcaccccagacatggatgtgatcctgaacatccctgtggaggagcccctgcccttctag

SEQ ID NO: 36742 - DNA, 987 bp, Artificial Sequence
  Description of Artificial Sequence: Synthetic coding sequence
atggaggtgctgagcctgcccaacagcttccagacccaggccctgtgggacagcctgcacagccctggggtgcccggctctgtgttccacttcaagcccaccaccgtggtgaccagctgccagcccaagaacccccgggagctgcacagaagaaggaagctggaccccgggaagatgcacgccaagatctggctgatgaagaccagcctgcggagcggccgggccgccctgcgggagctgcggagccgggagaacttcctgagcaagctgaaccgggagctgattgagaccatccaggagatggagaacagcaccaccctgcacgtgcgggccctgctgcagcagcaggacaccctggccaccatcatcgacatcctggagtacagcaacaagaagaggctgcagcagctgaagtctgagctgcaggagtgggaggagaagaagaagtgcaagatgagctacctggagcagcaggccgagcagctgaatgccaagattgagaagacccaggaggaggtgaacttcctgagcacctacatggaccacgagtacagcatcaagtctgtgcagatcagcaccctgatgaggcagctgcagcaggtgaaggacagccagcaggatgagctggatgacctgggggagatgaggaggaaggtgctggagagcctgagtgacaagatccagaagaagaagaagaagatcctgagctctgtggtggccgagacccagaggccctatgaggaggccctgctgcagaagatgtgggagagccaggacttcctgaagtgcatgcagcgcttccgggagatcatcgaccagtttgaggagaacatgcctgtgctgcgggcagaggtggaggagctgcaggcccagacccgggagccccgggaggtgatctttgaagatgtgctgctgcggcggcccaagtgcaccccagacatggatgtgatcctgaacatccctgtggaggagcccctgcccttctag

SEQ ID NO: 36743 - DNA, 771 bp, Artificial Sequence
  Description of Artificial Sequence: Synthetic coding sequence
atgagctacaagatgttccacttcaagcccaccaccgtggtgaccagctgccagcccaagaacccccgggagctgcacagaagaaggaagctggaccccgggaagatgcacgccaagatctggctgatgaagaccagcctgcggagcggccgggccgccctgcgggagctgcggagccgggagaacttcctgagcaagctgaaccgggagctgattgagaccatccaggagatggagaacagcaccaccctgcacgtgcgggccctgctgcagcagcaggacaccctggccaccatcatcgacatcctggagtacagcaacaagaagaggctgcagcagctgaagtctgagctgcaggagtgggaggagaagaagaagtgcaagatgagctacctggagcagcaggccgagcagctgaatgccaagattgagaagacccaggaggaggtgaacttcctgagcacctacatggaccacgagtacagcatcaagtctgtgcagatcagcaccctgatgaggcagctgcagcaggtgaaggacagccagcaggatgagctggatgacctgggggagatgaggaggaaggtgctggagagcctgagtgacaagatccagaagaagaagaagaagatcctgagctctgtggtggccgagacccagaggccctatgaggaggccctgctgcagaagatgtgggagagccaggacttcctgaagtgcatgcagcgcttccgggaggtgcggggccagggccgctggtggagcctgtag

SEQ ID NO: 36744 - DNA, 186 bp, Artificial Sequence
  Description of Artificial Sequence: Synthetic coding sequence
atgggccgggctgacacccccaggcaccccccacctcctgctgctggctttggagtgcacagaggagccttcctgatccctgtggccctgcgggtgctgctggccggccgcaccccccggcccttcaccccaggcctggccgacccccggcggctgggccccaggagagtgcaggccgcccagtag

SEQ ID NO: 36745 - DNA, 225 bp, Artificial Sequence
  Description of Artificial Sequence: Synthetic coding sequence
atggagcgggcccagtgcctgaggaagggcatcctgagctttgagaggagcctggagcagaggagcctcatcctgagcccccggctggagtacagcggggccatcacagcccactgcagcctggacctgctggacagcaccaaccccccagccagcgccttctgggtggtggagaccacagacacagaagatgagcgggagaagaagcgggagatcacagaatag

SEQ ID NO: 36746 - DNA, 240 bp, Artificial Sequence
  Description of Artificial Sequence: Synthetic coding sequence
atgcaccacgtgcggcagctgatgatgcccatctgccccatggccctgaacagcaccaccagcagcagcaccaccttcggggccttccgcatcatgaccctgaatgtggaggagtgggccacagcctggaaggtgctgatcctgctggaggccgctgtggaggaggagaagaggtctgaggagaagaggatcctggtgtgtggcacctgtggcaccaggagcagccagaagaacctgtag

SEQ ID NO: 36747 - DNA, 240 bp, Artificial Sequence; identical to SEQ ID NO: 36746
  Description of Artificial Sequence: Synthetic coding sequence

SEQ ID NO: 36748 - DNA, 327 bp, Artificial Sequence
  Description of Artificial Sequence: Synthetic coding sequence
atgctggccaagggagctgaggagggccgcagcggcggccccaggcctgccatcaccctgcccggcagcctgcacttcacctgtgacctgaagaccagcccctactgcctgaccagggctgagctgatggagcacctgcccctgcgggtggccgtgcacagcatgagcccctgccacaggagctgcttctgtggggagctgaagaggggccacccctggaacaccccccaggtgagcagcttccccagcagcaccaccagcctgagccacagctgcaccaccagccacctggactgcagccagcaggtggagagcggcagcaagtag

SEQ ID NO: 36749 - DNA, 327 bp, Artificial Sequence; identical to SEQ ID NO: 36748
  Description of Artificial Sequence: Synthetic coding sequence

SEQ ID NO: 36750 - DNA, 969 bp, Artificial Sequence
  Description of Artificial Sequence: Synthetic coding sequence
atggcccggagccggctgcctgccaccagcctgaggaagccctggaagctggaccggcagaagctgcccagcccagattctggccacagcctgctgtgtggctggagccctgggggcaaggcccggcctgctggcaacacaggagcctgggccccagctgagcagttcttccctgccagcaacagaacccgggagggcggcggcctgtggccacccctgcccctgcagagcagccctgctgcccccaccatgctggacagcagcgctgctgagcaggtgacccggctgaccctgaagctgctgggccagaagctggagcaggagcggcagaatgtggagggcggccctgagggcctgcacctggagcctggaaatgaagatagaccagatgatgccctgcagacagccctgaagagaagaagagacctgctgcagaggctgcgggagcagcacctgctggatgagctgagccgggcccaggcctggagcggccccagcagaggagccctgggcagcgccctgcccccagagctgcccccaacaggcatcctgcccacagccagccccagccccctggccccagaccccccacgcatcatcctgcccaccgtgccccagcccccagccaccatcatccagcagctgccccagcagcccctgattgcccagatccccccaccccaggccttccccacccagaggagcggcagcatcaaggaggacatggtggagctgctgctgctgcagaatgcccaggtgcaccagctggtgctgcagaactggatgctgaaggccctgcccccagccctgcaggacccccctcatgtgcccccccgggtgcccagggctgcccggccccggctgcctgctgtgcaccaccaccaccaccaccaccacgctgtgtggcccccaggggccgccaccgtgctgcagcctgcccccagcctgtggaccccaggccccccatag

SEQ ID NO: 36751 - DNA, 288 bp, Artificial Sequence
  Description of Artificial Sequence: Synthetic coding sequence
atgctggacagcagcgctgctgagcaggtgacccggctgaccctgaagctgctgggccagaagctggagcaggagcggcagaatgtggagggcggccctgagggcctgcacctggagcctggaaatgaagatagaccagatgatgccctgcagacagccctgaagagaagaagagacctgctgcagaggctgcgggaggccaccctgatgcacatcaccctggagggcagcagcagccacggccacccagccaggagaggagcctgcacctggccccggctggcctag

SEQ ID NO: 36752 - DNA, 855 bp, Artificial Sequence
  Description of Artificial Sequence: Synthetic coding sequence
gggaaggcccggcctgctggcaacacaggagcctgggccccagctgagcagttcttccctgccagcaacagaacccgggagggcggcggcctgtggccacccctgcccctgcagagcagccctgctgcccccaccatgctggacagcagcgctgctgagcaggtgacccggctgaccctgaagctgctgggccagaagctggagcaggagcggcagaatgtggagggcggccctgagggcctgcacctggagcctggaaatgaagatagaccagatgatgccctgcagacagccctgaagagaagaagagacctgctgcagaggctgcgggagcagcacctgctggatgagctgagccgggcccaggcctggagcggccccagcagaggagccctgggcagcgccctgcccccagagctgcccccaacaggcatcctgcccacagccagccccagccccctggccccagaccccccacgcatcatcctgcccaccgtgccccagcccccagccaccatcatccagcagctgccccagcagcccctgattgcccagatccccccaccccaggccttccccacccagaggagcggcagcatcaaggaggacatggtggagctgctgctgctgcagaatgcccaggtgcaccagctggtgctgcagaactggatgctgaaggccctgcccccagccctgcaggacccccctcatgtgcccccccgggtgcccagggctgcccggccccggctgcctgctgtgcaccaccaccaccaccaccaccacgctgtgtggcccccaggggccgccaccgtgctgcagcctgcccccagcctgtggaccccaggccccccatag

SEQ ID NO: 36753 - DNA, 660 bp, Artificial Sequence
  Description of Artificial Sequence: Synthetic coding sequence
atggccccacccagccgccactgcctgctgctgatcagcaccctgggcgtgtttgccctgaactgcttcaccaagggccagaagaacagcaccctcatcttcacccgggagaacaccatccggaactgcagctgcagcgctgacatccgggactgtgactacagcctggccaacctgatgtgcaactgcaagacagtgctgcccctggccgtggagaggaccagctacaacggccacctgaccatctggttcacagacaccagcgccctgggccacctgctgaacttcaccctggtgcaggacctgaagctgagcctgtgcagcaccaacaccctgcccacagagtacctggccatctgtggcctgaagaggctgcgcatcaacatggaggccaagcaccccttccctgagcagagcctgctgatccacagcggcggggacagcgacagccgggagaagcccatgtggctgcacaagggctggcagccctgcatgtacatctccttcctggacatggccctcttcaacagagattctgccttcaagagctacagcattgaaaatgtgaccagcatcgccaacaacttcccagacttctcctacttccgcaccttccccatgcccagcaacaagagctatgtggtgaccttcatctactag

SEQ ID NO: 36754 - DNA, 660 bp, Artificial Sequence; identical to SEQ ID NO: 36753
  Description of Artificial Sequence: Synthetic coding sequence

SEQ ID NO: 36755 - DNA, 660 bp, Artificial Sequence; identical to SEQ ID NO: 36753
  Description of Artificial Sequence: Synthetic coding sequence

SEQ ID NO: 36756 - DNA, 660 bp, Artificial Sequence; identical to SEQ ID NO: 36753
  Description of Artificial Sequence: Synthetic coding sequence

SEQ ID NO: 36757 - DNA, 198 bp, Artificial Sequence
  Description of Artificial Sequence: Synthetic coding sequence
atgggcaacccccggctgccccggctgctgtgtgccctgaagttcagcggcttcctgagcaacatccggggccccctggccggagaagatggcatgggagacacccagctggcccgggtgcgggacagcgccctgaagaccccctggaggcctgccccctgccccccaccagcccacagcctggatgactggaagtag

SEQ ID NO: 36758 - DNA, 894 bp, Artificial Sequence
  Description of Artificial Sequence: Synthetic coding sequence
atgaatgaggaggagcagtttgtgaacatcgacctgaatgatgacaacatctgcagcgtgtgcaagctgggcacagacaaggagaccctgtccttctgccacatctgctttgagctgaacattgaaggagtgcccaagagtgacctgctgcacaccaagagcctgcggggccacaaggactgctttgagaagtaccacctgattgccaaccagggctgccccaggagcaagctgagcaagagcacctatgaggaggtgaagaccatcctgagcaagaagatcaactggatcgtgcagtatgcccagaacaaggacctggacagcgacagtgaatgttccaagaacccccagcaccacctgttcaacttccgccacaagccagaggagaagctgctgccccagtttgacagccaggtgcccaagtacagcgccaagtggattgatggcagcgctgggggcatcagcaactgcacccagaggatcctggagcagcgggagaacacagactttggcctgtccatgctgcaggacagcggggccaccctgtgcaggaacagcgtgctgtggccccacagccacaaccaggcccagaagaaggaggagaccatcagcagccctgaggccaacgtgcagacccagcacccccactacagccgggaggagctgaacagcatgaccctgggggaggtggagcagctgaatgccaagctgctgcagcagatccaggaggtgtttgaggagctgacccaccaggtgcaggagaaggacagcctggccagccagctgcacgtgcgccacgtggccatcgagcagctgctgaagaactgcagcaagctgccctgcctgcaggtgggccgcacaggcatgaagagccacctgcccatcaacaactag

SEQ ID NO: 36759 - DNA, 891 bp, Artificial Sequence
  Description of Artificial Sequence: Synthetic coding sequence
atgaatgaggaggagcagtttgtgaacatcgacctgaatgatgacaacatctgcagcgtgtgcaagctgggcacagacaaggagaccctgtccttctgccacatctgctttgagctgaacattgaaggagtgcccaagagtgacctgctgcacaccaagagcctgcggggccacaaggactgctttgagaagtaccacctgattgccaaccagggctgccccaggagcaagctgagcaagagcacctatgaggaggtgaagaccatcctgagcaagaagatcaactggatcgtgcagtatgcccagaacaaggacctggacagcgacagtgaatgttccaagaacccccagcaccacctgttcaacttccgccacaagccagaggagaagctgctgccccagtttgacagccaggtgcccaagtacagcgccaagtggattgatggcagcgctgggggcatcagcaactgcacccagaggatcctggagcagcgggagaacacagactttggcctgtccatgctgcaggacagcggggccaccctgtgcaggaacagcgtgctgtggccccacagccacaaccaggcccagaagaaggaggagaccatcagcagccctgaggccaacgtgcagacccagcacccccactacagccgggaggagctgaacagcatgaccctgggggaggtggagcagctgaatgccaagctgctgcagcagatccaggtgtttgaggagctgacccaccaggtgcaggagaaggacagcctggccagccagctgcacgtgagacatgtggccatcgagcagctgctgaagaactgcagcaagctgccctgcctgcaggtgggccgcacaggcatgaagagccacctgcccatcaacaactag

SEQ ID NO: 36760 - DNA, 729 bp, Artificial Sequence
  Description of Artificial Sequence: Synthetic coding sequence
atgaatgaggaggagcagtttgtgaacatcgacctgaatgatgacaacatctgcagcgtgtgcaagctgggcacagacaaggagaccctgtccttctgccacatctgctttgagctgaacattgaaggagtgcccaagagtgacctgctgcacaccaagagcctgcggggccacaaggactgctttgagaagtaccacctgattgccaaccagggctgccccaggagcaagctgagcaagagcacctatgaggaggtgaagaccatcctgagcaagaagatcaactggatcgtgcagtatgcccagaacaaggacctggacagcgacagtgaatgttccaagaacccccagcaccacctgttcaacttccgccacaagccagaggagaagctgctgccccagtttgacagccaggtgcccaagtacagcgccaagtggattgatggcagcgctgggggcatcagcaactgcacccagaggatcctggagcagcgggagaacacagactttggcctgtccatgctgcaggacagcggggccaccctgtgcaggaacagcgtgctgtggccccacagccacaaccaggcccagaagaaggaggagaccatcagcagccctgaggccaacgtgcagacccagcacccccactacagccgggaggagctgaacagcatgaccctgggggaggtggagcagctgaatgccaagctgctgcagcagatccagtag

SEQ ID NO: 36761 - DNA, 666 bp, Artificial Sequence
  Description of Artificial Sequence: Synthetic coding sequence
atgaatgaggaggagcagtttgtgaacatcgacctgaatgatgacaacatctgcagcgtgtgcaagctgggcacagacaaggagaccctgtccttctgccacatctgctttgagctgaacattgaaggagtgcccaagagtgacctgctgcacaccaagagcctgcggggccacaaggactgctttgagaagtaccacctgattgccaaccagggctgccccaggagcaagctgagcaagagcacctatgaggaggtgaagaccatcctgagcaagaagatcaactggatcgtgcagtatgcccagaacaaggacctggacagcgacagtgaatgttccaagaacccccagcaccacctgttcaacttccgccacaagccagaggagaagctgctgccccagtttgacagccaggtgcccaagtacagcgccaagtggattgatggcagcgctgggggcatcagcaactgcacccagaggatcctggagcagcgggagaacacagactttggcctgtccatgctgcaggacagcggggccaccctgtgcaggaacagcgtgctgtggccccacagccacaaccaggcccagaagaaggaggagaccatcagcagccctgaggccaacgtgcagacccagcacccccactacagccgggaggagtag

SEQ ID NO: 36762 - DNA, 723 bp, Artificial Sequence
  Description of Artificial Sequence: Synthetic coding sequence
atgaggacagaagctgaggccgccggcccccccctggagcccggggactttgtgcagctgcctgtgcctgtgatccagcagctgtaccactgggactgtggcctggcctgcagcaggatggtgctgcgctacctgggccagctggatgattctgaatttgagcgggccctgcagaagctgcagctgaccaggagcatctggaccatcgacctggcctacctgatgcaccactttggagtgcgccaccgcttctgcacccagaccctgggcgtggacaagggctacaagaaccagagcttctacaggaagcactttgacacagaggagaccagggtgaaccagctgtttgcccaggccaaggcctgcaaggtgctggtggagaagtgcaccgtgtctgtgaaggacatccaggcccacctggcccagggccacgtggccatcgtgctggtgaacagcggcgtgctgcactgtgacctgtgcagcagccctgtgaagtactgctgcttcacccccagcggccaccactgcttctgcaggaccccagactaccagggccacttcatcgtgctgcggggctacaacagagccaccggctgcatcttctacaacaacccagcctatgctgaccccggcatgtgcagcaccagcatcagcaactttgaggaggcccggaccagctatggaacagatgaggacatcctgtttgtgtacctggacagctag

SEQ ID NO: 36763 - DNA, 384 bp, Artificial Sequence
  Description of Artificial Sequence: Synthetic coding sequence
atgaggacagaagctgaggccgccggcccccccctggagcccggggactttgtgcagctgcctgtgcctgtgatccagcagctgtaccactgggactgtggcctggcctgcagcaggatggtgctgcgctacctgggccagctggatgattctgaatttgagcgggccctgcagaagctgcagctgaccaggagcatctggaccatcgacctggcctacctgatgcaccactttggagtgcgccaccgcttctgcacccagaccctgggcgtggacaagggctacaagaaccagagcttctacaggaagcactttgacacagaggagaccagggtgaaccagctgtttgcccaggccaaggcctgcaaggtgctggtggagtag

SEQ ID NO: 36764 - DNA, 429 bp, Artificial Sequence
  Description of Artificial Sequence: Synthetic coding sequence
atgttcatcaaggtgatgtttggagctggctgcagcgtgctggtgaacaccagctgccgcctggtgaacctgacagcccacctgcggcagaaggccggcctgcccccagatgccaccatcgccctgctggctgaagatggcaacctggtgtccctggaggaggacctgaaggagggcgccagccgggcccagaccatgggcaacagcctgctgaaggagcgggccatctacgtgctggtgcgcatcatcagcaaggtggcccaggagggggaggacatggccagcaccaggtatgagagcctgctggagaacctggatgaccactacccagagctggccggggccaaccggcagcagcccagcaggacccccctggccgagagcggcattgctgagaagctgcaccagcaggagggccagggccagtag

SEQ ID NO: 36765 - DNA, 429 bp, Artificial Sequence
  Description of Artificial Sequence: Synthetic coding sequence
atgttcatcaaggtgatgtttggagctggctgcagcgtgctggtgaacaccagctgccgcctggtgaacctgacagcccacctgcggcagaaggccggcctgcccccagatgccaccatcgccctgctggctgaagatggcaacctggtgtccctggaggaggacctgaaggagggcgccagccgggcccagaccatgggcaacagcctgctgaaggagcgggccatctacgtgctggtgcgcatcatcagcaaggtggcccaggagggggaggacatggccagcaccaggtatgagagcctgctggagaacctggatgaccactacccagagctggccggggccaaccggcagcagcccagcaggacccccctggccgagagcggcattgctgagaagctgcaccagcaggagggccagggcccctag

SEQ ID NO: 36766 - DNA, 447 bp, Artificial Sequence
  Description of Artificial Sequence: Synthetic coding sequence
atgttcatcaaggtgatgtttggagctggctgcagcgtgctggtgaacaccagctgccgcctggtgaacctgacagcccacctgcggcagaaggccggcctgcccccagatgccaccatcgccctgctggctgaagatggcaacctggtgtccctggaggaggacctgaaggagggcgccagccgggcccagaccatgggcaacagcctgctgaaggagcgggccatctacgtgctggtgcgcatcatcaagggggaggacatggccagcaccaggtatgagagcctgctggagaacctggatgaccactacccagagctggccgaggagctgcggcggctgagcggcctgagctctgtgggccacaactggaggaagaggatgggcacccggcggggcagacatgagcagagccccaccagccggcccaggaaaggaccagactag

SEQ ID NO: 36767 - DNA, 654 bp, Artificial Sequence
  Description of Artificial Sequence: Synthetic coding sequence
atggccagccagaagcagatggaggtggtgaccaagggcaccggcttcagaagaagacccaagaccatcacctacaccccaggcacctgtgagctgctgcgggtgatgatgaaggagagcaagctgaccaacatccagcagaggcacatcatggacatcatgaagagaggagatgccctgcccctgcagtgcagccccaccagcagccagagggtgctgcccagcaagcagatcgccagccccatctacctgccccccatcctggccgcccggccccacctgcggcctgccaacatgtgccaggccaatggagcctacagccgggagcagttcaagccccaggccacccgggacctggagaaggagaagcagaggctgcagaacatctttgccaccgggaaggacatggaggagaggaagaggaaggcccccccagcccggcagaaggccccagcccctgagctggacagatttgaggagctggtgaaggagatccaggagaggaaggagttcctggccgacatggaggccctgggccagggcaagcagtaccggggcatcatcctggccgagatcagccagaagctgcgggagatggaggacatcgaccacagaagaagtgaggagctgaggaagggcctggccaccacctag

SEQ ID NO: 36768 - DNA, 654 bp, Artificial Sequence; identical to SEQ ID NO: 36767
  Description of Artificial Sequence: Synthetic coding sequence

SEQ ID NO: 36769 - DNA, 654 bp, Artificial Sequence; identical to SEQ ID NO: 36767
  Description of Artificial Sequence: Synthetic coding sequence

SEQ ID NO: 36770 - DNA, 489 bp, Artificial Sequence
  Description of Artificial Sequence: Synthetic coding sequence
atggccagccagaagcagatggaggtggtgaccaagggcaccggcttcagaagaagacccaagaccatcacctacaccccaggcacctgtgagctgctgcgggtgatgatgaaggagagcaagctgaccaacatccagcagaggcacatcatggacatcatgaagagaggagatgccctgcccctgcagtgcagccccaccagcagccagagggtgctgcccagcaagcagatcgccagccccatctacctgccccccatcctggccgcccggccccacctgcggcctgccaacatgtgccaggccaatggagcctacagccgggagcagttcaagccccaggccacccgggacctggagaaggagaagcagaggctgcagaacatctttgccaccgggaaggacatggaggagaggaagaggaaggcccccccagcccggcagaaggccccagcccctgagctggacagatttgaggagctggtgtag

SEQ ID NO: 36771 - DNA, 363 bp, Artificial Sequence
  Description of Artificial Sequence: Synthetic coding sequence
atggccagccagaagcagatggaggtggtgaccaagggcaccggcttcagaagaagacccaagaccatcacctacaccccaggcacctgtgagctgctgcgggtgatgatgaaggagagcaagctgaccaacatccagcagaggcacatcatggacatcatgaagagaggagatgccctgcccctgcagtgcagccccaccagcagccagagggtgctgcccagcaagcagatcgccagccccatctacctgccccccatcctggccgcccggccccacctgcggcctgccaacatgtgccaggccaatggagcctacagccgggagcagttcaagccccaggccacccgggacctggagtag

SEQ ID NO: 36772 - DNA, 417 bp, Artificial Sequence
  Description of Artificial Sequence: Synthetic coding sequence
atgcctgccagcgccacagctgcctggcactgcccccccctgtgcctgccccccctgcctgccagcgcccccaccagcccccccaacccagccaccaggcctgcccctggccctggccggcgggcccgctgcccccagagcgcccacccagcccccaccaggggggccctgaccttctgggcccctggctcctggccccgggtgctgctggtgcccaggagccctggccctgtgctgcgggccccccggctgccccaccctgctgcccgggccaggagaagagcctggcatggagcccggctgcccggcagccctgcccgggccggccgcaccttccagaggggcctggtgagcaacagctgggcccacgccatcttcctgccccggccccccaacgtgctggagctgcaggtgtag

SEQ ID NO: 36773 - DNA, 417 bp, Artificial Sequence; identical to SEQ ID NO: 36772
  Description of Artificial Sequence: Synthetic coding sequence

SEQ ID NO: 36774 - DNA, 1095 bp, Artificial Sequence
  Description of Artificial Sequence: Synthetic coding sequence
atgccccggggccgctgccggcagcagggcccccgcatccccatctgggccgccgccaactatgccaatgcccacccctggcagcagatggacaaggccagccctggggtggcctacacccccctggtggacccctggattgagcggccctgctgcggggacacagtgtgtgtgaggaccaccatggagcagaagagcacagccagcggcacctgtggcggcaagccagctgagcggggccccctggccggccacatgcccagcagccggccccaccgggtggacttctgctgggtgcccggcagtgaccccggcacctttgatggcagcccctggctgctggaccgcttcctggcccagctgggggactacatgtccttccactttgagcactaccaggacaacatcagccgggtgtgtgagatcctgcggcggctgaccggccgggcccaggcctgggccgccccctacctggatggagacctgcccctgcctgatgattatgagctgttctgccaggacctgaaggaggtggtgcaggaccccaacagctttgctgagtaccacgctgtggtgacctgccccctgcccctggccagcagccagctgcctgtggccccccagctgcctgtggtgcggcagtacctggcccgcttcctggagggcctggccctggacatgggcacagcccccaggagcctgcctgctgccatggccaccccagctgtgtctggcagcaacagcgtgagccgcagcgccctgtttgagcagcagctgaccaaggagagcaccccaggccccaaggagccccctgtgctgcccagcagcacctgcagcagcaagccaggccctgtggagcccgccagcagccagcctgaggaggccgcccccacccctgtgccccggctgtctgagagcgccaaccccccagcccagaggccagaccctgcccaccctgggggccccaagccccagaagacagaggaggaggtgctggagacagaaggagaccaggaggtgtccctgggcaccccccaggaggtggtggaggcccctgagaccccaggagagccccccctgagccctggcttctag

SEQ ID NO: 36775 - DNA, 1095 bp, Artificial Sequence; identical to SEQ ID NO: 36774
  Description of Artificial Sequence: Synthetic coding sequence

SEQ ID NO: 36776 - DNA, 1095 bp, Artificial Sequence; identical to SEQ ID NO: 36774
  Description of Artificial Sequence: Synthetic coding sequence

SEQ ID NO: 36777 - DNA, 318 bp, Artificial Sequence
  Description of Artificial Sequence: Synthetic coding sequence
atgggagaaacagagggcaagaaggatgaagctgactacaagaggctgcagaccttccccctggtgcgccacagcgacatgcctgaggagatgagggtggagaccatggagctgtgtgtgacagcctgtgagaagttcagcaacaacaatgaatctgctgccaagatgatcaaggagaccatggacaagaagtttggcagctcctggcacgtggtgattggagagggctttggatttgagatcacccatgaggtgaagaacctgctgtacctgtactttggaggcaccctggccgtgtgtgtgtggaagtgcagctag

SEQ ID NO: 36778 - DNA, 843 bp, Artificial Sequence
  Description of Artificial Sequence: Synthetic coding sequence
atggagctgggccatggagctggcaccaccaccttcacccgggcccacctgaatgacaaggagggccagcaggacctggacccctggaaggccgcctacagcagcctggacaccagcaagttcaagaaccagggcctgagcagcccccagcccctgcccctgggcgccagcgcccagggcagcagcctgggccagtgccacctgaaggagatccccccacctccacccacagctgccagccgggacagcctgggcatggacccccagagccgcagcctgaagaatgccggcagccgcagcagcagccgggagaacagagccaccagcggggagggcgcccagccctgccagggcacagatgatggccccagcctgggcgcccaggaccagaggagcacccccaccaaccagaagggcagcatcatccccaacaacatccgccacaagtttggcagcaatgtggtggaccagctggtgtctgaggagcaggcccagaaggccattgatgaggtgtttgagggccagaagagggccagctcctggcccagcaggacccagaaccctgtggagatcagctctgtgttcagtgactactatgacctgggctacaacatgaggagcaacctcttcagaggagctgctgaggagaccaagagcctgatgaaggccagctacaccccagaggtgattgagaagtctgtgcgggacctggagcactggcacggcaggaagacagatgacctgggccgctggcaccagaagaatgccatgaacctgaacctgcagaaggccctggaggagaagtatggagagaacagcaagagcaagagcagcaagtactag

SEQ ID NO: 36779 - DNA, 588 bp, Artificial Sequence
  Description of Artificial Sequence: Synthetic coding sequence
atggacccccagagccgcagcctgaagaatgccggcagccgcagcagcagcagagaaaatagagccaccagcggggagggcgcccagccctgccagggcacagatgatggccccagcctgggcgcccaggaccagaggagcacccccaccaaccagaagggcagcatcatccccaacaacatccgccacaagtttggcagcaatgtggtggaccagctggtgtctgaggagcaggcccagaaggccattgatgaggtgtttgagggccagaagagggccagctcctggcccagcaggacccagaaccctgtggagatcagcagcgtcttcagtgactactatgacctgggctacaacatgaggagcaacctcttcagaggagctgctgaggagaccaagagcctgatgaaggccagctacaccccagaggtgattgagaagtctgtgcgggacctggagcactggcacggcaggaagacagatgacctgggccgctggcaccagaagaatgccatgaacctgaacctgcagaaggccctggaggagaagtacggggagaacagcaagagcaagagcagcaagtactag

SEQ ID NO: 36780 - DNA, 843 bp, Artificial Sequence; identical to SEQ ID NO: 36778
  Description of Artificial Sequence: Synthetic coding sequence

SEQ ID NO: 36781 - DNA, 552 bp, Artificial Sequence
  Description of Artificial Sequence: Synthetic coding sequence
atgattgtgtttcctgagaccagccagccccgcttcctgtacagcctgcagaactatgctgtgagagatggcctgggcaccatcctgcggggcggcgctgaggagggcagctatgacaactggccccacaccaggaagtcctggggccccctgagccctggccaccagcgggagctgtggacccagcctgacccctggacagaggtgctgagcggccacaagggagatgctggggcctgtggctgctgctgcttctgcagccagttcatcaatgcccgctgtgcccaccccctgtgcctggcccggggcctggaccggcgggccagcgaggagatgcccatcctgcaggccctgtgcctgctgcccaaggagaacctgcatgatgccagcagaagagtgcaccggggccgcggggaggagaatgtggagtggacaggagacctgcacccagcccagctgggccggggcggccggcctgagatctgccacagcctggaggccatcgccctggtgaccaaggcccggcacaggaagaccaacaccaccttctag

SEQ ID NO: 36782 - DNA, 1089 bp, Artificial Sequence
  Description of Artificial Sequence: Synthetic coding sequence
atgtgcaccgtggatgtggagggctttgatgatgtgggggagaccctgagtgatgctgtgagagatggcctgggcaccatcctgcggggcggcgctgaggagggcagctatgacaactggccccacaccaggaagtcctggggccccctgagccctggccaccagcgggagctgtggacccagcctgacccctggacagaggtgctgagcggccacaagggagatgctggggcctgtggctgctgctgcttctgcagccagttcatcaatgcccgctgtgcccaccccctgtgcctggcccggggcctggacagaagagccagcgaggagatgcccatcctgcaggccctgtgcctgctgcccaaggtgtccacccccagcatcaccgtgctgagcccccagaggtctgctgcccccagcatcaccgtgcccagcccccagaggtctgctgcccccagcatcaccgtgcccagcccccagaggtctgccccccgggccagcctgtgccccccccacaagggccagcaccctgagcaccactgtgccctgccccccaagggccagcaccctgagcaccactgtgccctgcccaccaaggtgtccacccccagcatcaccgtgcccagcccccagaggagcccccagatgagcctgagcagcgctgcccggggcagcaacacagatgtggccggcctgtctgtgggggagtggccaggctggcagctgtggggcgagggccaggatggagcccagcagaggccccacctgcccagcggcggcagcggggccggcgtggccccccagaggctgcccaagagccgggcctgcatcctgtgcagccgccacggggcccagggcccctgggtgacaggccgctctgtgagccacagccactgccccatccagggcctgctggacctgcagaggccagacctgggcacagactggggccgcacccggcccctgtgcaccccccaggacctgtgtggcggccggcccctgcccagcacctggggcgtgaccatgcacctgatccactgcctgtctgtgtccctgagcctgtgcctgagcctgagccactgtgtgtag

SEQ ID NO: 36783 - DNA, 429 bp, Artificial Sequence
  Description of Artificial Sequence: Synthetic coding sequence
atgtgccgctgcagcctggtgctgctgtctgtggaccacgaggtgcccttcagcagcttcttcatcggctggaggacagagggccgggcctggagggctggccgcccagacatggctgatggcagcggctggcagcccccccggccctgtgaggcctacagagctgagtggaagctgtgccgcagcgcccggcacttcctgcaccactactacgtgcatggagagaggcctgcctgtgagcagtggcagagggacctggccagctgccgggactgggaggagaggagaaatgctgaggcccagcagagcctgtgtgagagcgagcgggcccgggtgcgggccgccaggaagcacatcctggtgtgggccccccggcagagccccccaccagactggcacctgcccctgccccaggagaaggatgaatag

SEQ ID NO: 36784 - DNA, 318 bp, Artificial Sequence
  Description of Artificial Sequence: Synthetic coding sequence
atggctgatggcagcggctggcagcccccccggccctgtgaggcctacagagctgagtggaagctgtgccgcagcgcccggcacttcctgcaccactactacgtgcacggggagaggcctgcctgtgagcagtggcagagggacctggccagctgccgggactgggaggagaggagaaatgctgaggcccagcagagcctgtgtgagagcgagcgggcccgggtgcgggccgccaggaagcacatcctggtgtgggccccccggcagagccccccaccagactggcacctgcccctgccccaggagaaggatgaatag

SEQ ID NO: 36785 - DNA, 354 bp, Artificial Sequence
  Description of Artificial Sequence: Synthetic coding sequence
atgtgccgctgcagcctggtgctgctgtctgtggaccacgaggtgcccttcagcagcttcttcatcggctggaggacagagggccgggcctggagggctggccgcccagacatggctgatggcagcggctggcagcccccccggccctgtgaggcctacagagctgagtggaagctgtgccgcagcgcccggcacttcctgcaccactactacgtgcatggagagaggcctgcctgtgagcagtggcagagggacctggccagctgccgggactgggaggagaggagaaatgctgaggcccaggtgctgtctgtggtggcccacacctgcaacctgagctacctgggcggctag

SEQ ID NO: 36786 - DNA, 756 bp, Artificial Sequence
  Description of Artificial Sequence: Synthetic coding sequence
atgggcagcaagctgacctgctgcctgggccccagcggcggcctgaactgtgactgctgcaggccagatgtgggcccctgccatgaatgtgagatccctgagaccgtggccgccacagccccagccagcaccacagccaagccagccaagctggacctgaaggccaagaaggcccagctgatgcagtacctgagcctgcccaagacccccaagatgctgaagatgagcaagggcctggatgcccggagcaagcgctggctgaagatcatctggaggagacatggcatctggcccctggagaacatcggccccacagaagatgtgcaggccagcgcccatggaggagtggaggagaacatgaccagtgacatcgagatccctgaggccaagcatgaccaccggcccacagaagatgtgcaggtgtctgcccacggcggcgtggaggagaacatcaccagtgacatcgagatcagcgaggccaagcatgaccaccacctggtggaggacctgtctgagagcctgtctgtgtgcctggaggacttcatgaccagtgacctgtctgagagcctgtctgtgtccctggaggacttcatgaccagcggcctgtctgagagcctgtctgtgtccctggaggacctgatgaccccagagatggccaaggagagatatgaggactacctgtgctgggtgaagatggcccggagccggctgaatgagcccatcagcagccaggtgctgggcctgctgcggctgtag

SEQ ID NO: 36787 - DNA, 690 bp, Artificial Sequence
  Description of Artificial Sequence: Synthetic coding sequence
atgggcaacatcctgacctgctgcatcaacagccactgcggctggccccggggcaaggatgccccctgctatgaaagtgacacagacatctatgaaacagtggccgccgccaccagcgagagcaccaccgtggagcccgggaagctggatgtgggcgccacagagggccaggacctgcagcacatcagcaaccagaagatgcccactggacctccagaagatcggctgagcctgaagttcctgcccagcagcgaggaggacaatgatgatgccaagatcctgcccagccctgtgcagggcagcagcgaggacaacctgagcctggtgtgcctgcccaggagtgaagatgatgactgtgatgatgatgatgatgatgatgcccagatcctgcccagccgggtgcagggcggctgctacagatttgacagcagcagctgcagcagcgaggacaacctgagcctggtgtgcctgcccaggagtgaagatgatgactgtgatgatgatgatgatgatgcccagatcctgcccagccctgtgcaggcctgcagcgaggacagcctcttcctgcgctgcagcctgcggcacaaggatgaggaggaggaggatgatgatgacatccacatcacagcccgcatcgagagtgacctgaccctggagagcctgagtgatgaggagatccaccctggatag

SEQ ID NO: 36788 - DNA, 480 bp, Artificial Sequence
  Description of Artificial Sequence: Synthetic coding sequence
atggagcaggactggcagcctggagaggaggtgaccccaggccctgagccctgcagcaagggccaggcccccctgtaccccatcgtgcacgtgacagagctgaagcacacagaccccaacttccccagcaacagcaatgctgtgggcaccagcagcggctggaacagaattggaacaggctgcagccacacctgggactggaggttcagctgcacccagcaggccctgctgcccctgctgggcgcctgggagtggagcattgacacagaagctgggggcggcagaagagagcagagccagaagccctgcagcaatggaggccctgctgctgctggggagggccgggtgctgcccagcccctgcttcccctggagcacctgccaggccgccatccacaaggtgtgccgctggcagggctgcaccaggcctgccctgctggcccccagcctggccaccctgaaggagcacagctacccctag

SEQ ID NO: 36789 - DNA, 480 bp, Artificial Sequence; identical to SEQ ID NO: 36788
  Description of Artificial Sequence: Synthetic coding sequence

SEQ ID NO: 36790 - DNA, 669 bp, Artificial Sequence
  Description of Artificial Sequence: Synthetic coding sequence
atggccctgtctgctgagacagagagccacatctaccgggccctgaggacagccagcggggccgccgcccacctggtggccctgggcttcaccatctttgtggccgtgctggcccggcccggcagcagcctcttctcctggcaccctgtgctgatgagcctggccttctccttcctgatgacagaggccctgctggtgttcagccctgagagcagcctgctgcacagcctgagcaggaagggccgggcccgctgccactgggtgctgcagctgctggccctgctgtgtgccctgctgggcctgggcctggtgatcctgcacaaggagcagctgggcaaggcccacctggtgaccaggcatggccaggccggcctgctggccgtgctgtgggccggcctgcagtgcagcggcggcgtgggcctgctgtaccccaagctgctgccccgctggcccctggccaagctgaagctgtaccacgccaccagcggcctggtgggctacctgctgggcagcgccagcctgctgctgggcatgtgcagcctgtggttcaccgcctctgtgactggagctgcctggtacctggccgtgctgtgccctgtgctgaccagcctggtgatcatgaaccaggtgtccaatgcctacctgtacaggaagaggatccagccctag

SEQ ID NO: 36791 - DNA, 387 bp, Artificial Sequence
  Description of Artificial Sequence: Synthetic coding sequence
atgaccagcctgtttgcccaggagatccggctgagcaagagacatgaggagatcgtgtcccagaggctgatgctgctgcagcagatggagaacaagctgggggaccagcacacagagaaggccagccagctgcagacagtggagacagccttcaagaggaacctgagcctgctgaaggacattgaagctgctgagaagagcctgcagacccgcatccaccccctgcccaggcctgaggtggtgtccctggagacccgctactgggcctctgtggaggagtacatccccaagtgggagcagttcctgctgggccgggccccctacccctttgctgtggagaaccagaatgaagctgagaacaccatccagaatgaggcccagaggtag

SEQ ID NO: 36792 - DNA, 192 bp, Artificial Sequence
  Description of Artificial Sequence: Synthetic coding sequence
atgaccagcctgtttgcccaggagatccggctgagcaagagacatgaggagatcgtgtcccagaggctgatgctgctgcagcagatggagaacaagctgggggaccagcacacagagaaggccagccagctgcagacagtggagacagccttcaagaggaacctgagcctgctgaaggacatcgaggcctag

SEQ ID NO: 36793 - DNA, 387 bp, Artificial Sequence; identical to SEQ ID NO: 36791
  Description of Artificial Sequence: Synthetic coding sequence

SEQ ID NO: 36794 - DNA, 387 bp, Artificial Sequence; identical to SEQ ID NO: 36791
  Description of Artificial Sequence: Synthetic coding sequence

SEQ ID NO: 36795 - DNA, 885 bp, Artificial Sequence
  Description of Artificial Sequence: Synthetic coding sequence
atgaccaagggggacttcattgatgaggaggtggaggacatgtacctggtggacttcacccagaagatcatcgacaagaggaaggagatggaggccagcggggcccaccgggacagccagaaggccggggagggcaccaccatgaggaagaccttcctgcgggagaggagcctgctgcccaagacccctgtgaagaatggctggatcacctggaccctgtggggcgtgcccggcctgtatgagaaggacctgcctgacctgctggagatggacaagaacctgcagggccgcctcttcatcagcctgctgatgaagaccctgctgtctgaggacatgaggaaggagctgcagaggcagcagtgggaggaggaggagcgggaggccctgaagaggcccatgggccctgtgcactatgaggacatcagagaaaatgatggagatgtgattggccccctgcccccagagcctgaggccgtgcccacccccaggcctgctgcccagagcagcaaggtggaggtgattgtgcaggagaggaaggacaccaagccaggagtgccccacatccgggagtgggaccggggcaaggagttctcctttggctactggagcaagaggcagagcgacctgcgggcagagcgggaccctgagtttgcccccccaagtgactactttgtgggccagaagaggacaggcttcagcagcagccaggcctggagcaggcctggccctgcccagagcgaccccggccagtgcccagaccagagccacggccccagccctgagcacaccagccccaccccagccccagacaaccccccccaggcccccaccgtgaccttcaagaccctggatgacatgatctcctactacaagcaggtgacctag

SEQ ID NO: 36796 - DNA, 1404 bp, Artificial Sequence
  Description of Artificial Sequence: Synthetic coding sequence
atggacaggaggaagaagcccctggatgtgacagccagcagcctggtggacctgaaggccgagctgttcaggaagcaggaggagttcaagcaggagaagctgctgaaggacagcggcgtgtttgggaagcccaagaccaccaacaagaagcccagcatctggagcaagcagaatgtgggcgtgagcaacagagctgagaaggatgctgagcagaagattgaggagcagaagaccctggacaaggcccgggagaagctggaggagaaggccaagctgtatgagaagatgaccaagggggacttcattgatgaggaggtggaggacatgtacctggtggacttcacccagaagatcatcgacaagaggaaggagatggaggccagcggggcccaccgggacagccagaaggccggggagagagatgatgatgaggagaacctgcctgagggggagatccccccaccccaggaccccagcgaggagtgggtggactatgtggacagcctgggccgcagccgccgctgcatgaggaaggacctgcctgacctgctggagatggacaagaacctgcagggccgcctcttcatcagccctgccaatgagaagaccctgctgtctgaggacatgaggaaggagctgcagaggcagcagtgggaggaggaggagcgggaggccctgaagaggcccatgggccctgtgcactatgaggacatccgggagaatgaggcccggcagctgggcgtgggctactttgcctttgcccgggacaaggagctgaggaacaagcagatgaagaccctggagatgctgcgggagcagaccacagaccagaggaccaagcgggagaacatcaaggagaagaggaaggccatcctggaggcccggctggccaagctgcggcagaagaagatgaagaagagcaaggagggcggcacagaggaggagaacagagatggagatgtgattggccccctgcccccagagcctgaggccgtgcccacccccaggcctgctgcccagagcagcaaggtggaggtgattgtgcaggagaggaaggacaccaagccaggagtgccccacatccgggagtgggaccggggcaaggagttctcctttggctactggagcaagaggcagagcgacctgcgggcagagcgggaccctgagtttgccccacccagcgactactttgtgggccagaagaggacaggcttcagcagcagccaggcctggagccggcccggccctgcccagagcgaccccggccagtgcccagaccagagccacggccccagccctgagcacaccagccccaccccagccccagacaaccccccccaggcccccaccgtgaccttcaagaccctggatgacatgatctcctactacaagcaggtgacctag

SEQ ID NO: 36797 - DNA, 426 bp, Artificial Sequence
  Description of Artificial Sequence: Synthetic coding sequence
atggacagcagcgcctgcaagaagagccaccagagcaagaagtggaggatccaggcccaggagaactttgccaagaagttcccctaccgcctgtcctggctgacagagccagaccctgagcccctgcagccctgggaggtgaccaatgacagcaacacagtgcagctgcccctgcagaagaggctggtgcccaccaggagcatccctgtgcggggcctgggcgccccagacttcaccagccccagcggcagctgcccagcccccctgcctgcccccagccccccacccctgtgcaacctgtgggagctgaagctgctgagccgccgcttcccccggcagctggccttcctgctgagcaccaggcacacagaagctgcctgcccccagaccagcaaggccgccggcctgagccggggcctgtcctag

SEQ ID NO: 36798 - DNA, 534 bp, Artificial Sequence
  Description of Artificial Sequence: Synthetic coding sequence
atggccggctaccagctgtggagcccctggacccccctggatgagagcttccagtggctgcggcacaccacccccacccccagcagcaagcaccccttcaaggccagcccctgcttcccccacacccccagcgacctggaggtgcagctgtgcttccaggaggtgaccctggtgctggacagccccttcctggagagcggcgtgagccccaagctgccctgccacaccagcgagctgcggaccatgaacaacaagggcctggtgaggaagccccagcccatccggctgtctggagtggacagcgtgtttggccgggtcatcacagcccagccccccaagtggacaggcaccttccgggtgtctgacaagagcgccttctgcaagatcatcagccgggagcaccagtggcccatcggcctgaaggagccccagatccagatgacagtgaccatgtgcaagcagatgctgcggagcatcctgctgctgtatgccacctacaagaagtgcacctttgccctgcagcacagcaagtag

SEQ ID NO: 36799 - DNA, 534 bp, Artificial Sequence; identical to SEQ ID NO: 36798
  Description of Artificial Sequence: Synthetic coding sequence

SEQ ID NO: 36800 - DNA, 1719 bp, Artificial Sequence
  Description of Artificial Sequence: Synthetic coding sequence
atggatgatgattatgaggcctaccacagcctcttcctgagcctgctgggcctgtgccccagcaagacccccatcaatgaaaatgcccctgtgtttgatcctgagcccgtcatcgcccactgcttcaagcagttccagcagaaggacttccggctgccccagacccggcggcgcatcatcatggtgcccaggaaggaggaccagacccccctgaacccagccagccagccccaggccccacccaagcccatccccagcttcaaggtgctggaggcccgggacatccaggagcagcctgaggacaggaagacctggctgagccagaggagcaagctgcggcaggagctggagagctttggagatgtgaagcgctggctggagaacaagcccagcatcaccccatctgaggccaaggtgctgcacatgatccacgaggagcagagcgcccagcccaatgccagccaggccaccaccaggaccaccaggaagaaggccccccggctgagccggctgagccggcagatggtgccccagctgcagctgcctgagcccccagccctgtctgtgatgtacagctacctgcacagcaggaagatcaagatcctggagatcttccacaaggtgggccagggcgagaaccagaggatcacccgggaggagttcatcgctgctgtgaaggctgtgggcgtgcccctgaagaaccaggaggtggaggacatcgtcatctacctgagcagcctgggcaagcacaacaccatcaccatggacatcctggccaacacctacaagcagtggagcatggcccagcagaggagcagcctggccacagcccgggagcactacatcctggccaagcaccgggacagcctgaagggccccctgaagaagcaggaggtggacagcgccccccagctgcccaaggtggacctgctgactgtgcctgctgtggacacccagatggagacccggcccatgaccctggaggagatggaggaggtgggcaagcgctaccgggagcggcagaggcagcacaagctgaccatccccagcatccagtacacagagcagtgccacctggtgcgctgtggcaacagacactttgatgagcactgcctgcccagcaccatccatggagacatgagggagctgattgacagcgcccggcggcacaacttcctggtgtacctgcagtgctggaagctgtgcaagagctatggcctgcccctgacagaggacatcctgatgaaggccctgctgtacccaggggacaagatcatcttccagatggacaaggtgtgccccatccggcagcccggcggctactacagcgactggaaggtgttcagccccaacctggccctgctgcggagccagggccctgggaagagcaagaggacagacaagaagacccccaagaagagcaagaagatgaggttcaaggagtttgaggagttcaccaggaagctgaaggtgaagaggagcagcggcctgcagcagacccaccccaacagcttctggccaggccacctgctggacaagctgcagctgtacctgcccaccgtggccacagacaggagcctggccctcttcagctgtgtgcagcaccagccccacgtgtacccagccacctaccacccagaccactggtggcccctgaggaacaagaactacatgacccacgcccactatgatgctgccaaggtgtactacatcaactag

SEQ ID NO: 36801 - DNA, 1719 bp, Artificial Sequence; identical to SEQ ID NO: 36800
  Description of Artificial Sequence: Synthetic coding sequence

SEQ ID NO: 36802 - DNA, 840 bp, Artificial Sequence
  Description of Artificial Sequence: Synthetic coding sequence
atggctgatgacctgggagatgagtggtgggagaaccagcccactggagctggcagcagccctgaggccagtgatggagagggggagggggacacagaggtgatgcagcaggagaccgtgcctgtgcctgtgcccagcgagaagaccaagcagcccaaggagtgcttcctgatccagcccaaggagaggaaagaaaacaccaccaagaccaggaagaggaggaagaagaagatcacagatgtgctggccaagtctgagcccaagccaggcctgcctgaggacctgcagaagctgatgaaggactactacagcagccggcggctggtgattgagctggaggagctgaacctgcctgacagctgcttcctgaaggccaatgacctgacccacagcctgagcagctacctgaaggagatctgccccaagtgggtgaagctgaggaagaaccacagcgagaagaagtctgtgctgatgctgatcatctgcagcagcgctgtgcgggccctggagctgatccgctccatgacagccttcagaggagatggcaaggtgatcaagctgtttgccaagcacatcaaggtgcaggcccaggtgaagctgctggagaagagggtggtgcacctgggcgtgggcaccccaggccgcatcaaggagctggtgaagcagggcggcctgaacctgagccccctgaagttcctggtgtttgactggaactggagggaccagaagctgcggaggatgatggacatccctgagatcaggaaggaggtgtttgagctgctggagatgggcgtgctgagcctgtgcaagtctgagagcctgaagctgggcctcttctag

SEQ ID NO: 36803 - DNA, 450 bp, Artificial Sequence
  Description of Artificial Sequence: Synthetic coding sequence
atgaaggaggccctgcaccagatcgtggtgcgctgcagcgagctggtgagcagcaccagcctgccccggctgtctgtgtcccggctgcagggccccccagacagccagcccctgggcaccctgggccagggcggctggaagctgctgggcatcgtgggcagcctggcccctgagaccctgggcggcctgggcacagaatttggcccctgcacccaccccctgccctttgacatggtgcgggagcgggagagagatgatgagctgcggcagggctggctgctgcagtgcccccagtgtgcccggaccctgctgtgccactgcggccccttcctgaccccacccagccagaccagcagcagcggcttccagctgtgcagcctgaagcccagcggcagcctggtgacagccacagagcccctgagcaactttgccttctcctacttcccctag

SEQ ID NO: 36804 - DNA, 1611 bp, Artificial Sequence
  Description of Artificial Sequence: Synthetic coding sequence
atggaggagcccccccaggaggccctggccgagcccctgaagcatgagagccctgctgcccccagcagcgctggccacaccaagggccaggaggaggatgaccagaagaaccaggccgagaggaaggctgacaaccacacagcccacagaattgctgaccagacagccctgcgggtgcccagccaggccgagagcagcatcttcagccaggccaccaatggagtggccgagcagaatggccacagcaccccaggccaggccggcagaagagccagcaacccagcagatgtgtctgacctgcgggcagatgaccaggtgaaccagaccccatctgagcagaccaagggcaaggccagcagccaggccaacaacgtgcagcacgagcagagtgatggccaggtgtctggcctgacagaggagaggacagctgagcagacagagcggcggctgcccacccaggccgagaggaggaccagcggccagattgatggccgcctggccatgcccagcgaccagaggggcagccggcagacagaccacaggatggccggccagagcgagcggcgggccagcgagcagatggacaggaggatgtctggagaggccgagaggaggaccagcgagcagatcacccaccggctgagcaagctgtctgagcggcggcccagcgtgcagattgacagcggcagctctgtgcccagcgaccagagccccagcgtgcagattgacagcggcagctctgtgcccagcgaccagaggccttctgtgcagattgacaggaggatgtctgggaaggtgagaagaagaagcagcgagaagacagactaccgcctggccggcctggccgaccccggcaccagcgagcagacagacctgcggctgtatggcctggtggaccacaagacctctgtgaagacccaccaccaggtgtatggccaggccacagagctggccgagcaccaggccatcgaccaggcccacagcaatgctgaccagccccctgtggacaatgcccactacacagaaagtgaccagacagaccacctggccgaccggcaggccaaccacaaggaccagctgagctactatgagacccggggccagagcgaggaccgcatcttcccccagctgggcaacagcaaggaggacaaggaggccgactacagagtgcagccctgcaagtttgaggacagccaggtggacctgaacagcaagcccagcgtggagatggagacccagaatgccaccaccatccccccctacaaccctgtggatgcccgcttcaccagcaacttccaggccaaggaccaggccctcttcccccggctgcccagcatcagcagcaagctgaactacaccagcagccaggagaagacccaggccatcgtgaccaagagtgatgagttcagcgagattgaccagggcaagggctaccacatccggaaccagacctaccgccgcttccccagcatcgtgtatgaggacccctaccaggtgtccctgcagtacatggagaagcaccacatcctgcagatcttccagcagatcacagagaacctggtgtatgagaagccagaggaccccctgaacttcatgctgtgccaggtgtag

SEQ ID NO: 36805 - DNA, 1062 bp, Artificial Sequence
  Description of Artificial Sequence: Synthetic coding sequence
atgcccagccctgtgggcctgctgcgggccctgcccctgccctggccccagttcctggcctgcaccctgcggcggctggccggcccccgggagagcacaggccccagccagaagcccccacccctgtgcagcgtgccctgccgggtgcctgccatgacagaggaggtggcccgggaggccctgctgagctttgtggacagcaagtgctgctacagcagcacagtggccggggacctggtgatccaggagctgaagaggcagaccctgtgccgctaccgcctggagaccttcagcgagagccgcatcagcgagtggaccttccagcccttcaccaaccacagcgtggatggcccccagagaggagccagcccccggctgtgggacatcaaggtgcagggcccccccatgttccaggaggacaccaggaagttccaggtgccccacagcagcctggtgaaggagtgccacaagtgccacggccggggccgctacaagtgcagcggctgccacggggccggcaccgtgcgctgccccagctgctgcggggccaagaggaaggccaagcagagccgccgctgccagctgtgtgccggcagcggcagaagacgctgcagcacctgcagcggccggggcaacaagacctgtgccacctgcaagggggagaagaagctgctgcacttcatccagctggtgatcatgtggaagaacagcctgtttgaatttgtgtctgagcaccggctgaactgcccccgggagctgctggccaaggccaagggggagaacctcttcaaggatgagaacagcgtggtgtaccccatcgtggacttccccctgcgggacatcagcctggccagccagaggggcattgctgagcacagcgctgccctggccagccgggcccgggtgctgcagcagaggcagaccatcgagctgatccccctgacagaggtgcactactggtaccagggcaagacctacgtgtactacatctatggaacagaccaccaggtgtatgctgtggactacccagagcgctactgctgcggctgcaccatcgtgtag

SEQ ID NO: 36806 - DNA, 1062 bp, Artificial Sequence; identical to SEQ ID NO: 36805
  Description of Artificial Sequence: Synthetic coding sequence

SEQ ID NO: 36807 - DNA, 948 bp, Artificial Sequence
  Description of Artificial Sequence: Synthetic coding sequence
atgcccagccctgtgggcctgctgcgggccctgcccctgccctggccccagttcctggcctgcaccctgcggcggctggccggcccccgggagagcacaggccccagccagaagcccccacccctgtgcagcgtgccctgccgggtgcctgccatgacagaggaggtggcccgggaggccctgctgagctttgtggacagcaagtgctgctacagcagcacagtggccggggacctggtgatccaggagctgaagaggcagaccctgtgccgctaccgcctggagaccttcagcgagagccgcatcagcgagtggaccttccagcccttcaccaaccacagcgtggatggcccccagagaggagccagcccccggctgtgggacatcaaggtgcagggcccccccatgttccaggaggacaccaggaagttccaggtgccccacagcagcctggtgaaggagtgccacaagtgccacggccggggccgctacaagtgcagcggctgccacggggccggcaccgtgcgctgccccagctgctgcggggccaagaggaaggccaagcagagccgccgctgccagctgtgtgccggcagcggcagaagacgctgcagcacctgcagcggccggggcaacaagacctgtgccacctgcaagggggagaagaagctgctgcacttcatccagctggtgatcatgtggaagaacagcctgtttgaatttgtgtctgagcaccggctgaactgcccccgggagctgctggccaaggccaagggggagaacctcttcaaggatgagaacagcgtggtgtaccccatcgtggacttccccctgcgggacatcagcctggccagccagaggggcattgctgagcacagcgctgccctggccagccgggcccgggtgctgcagcaggtgtcccagggcggcggggccatctggctgtag

SEQ ID NO: 36808 - DNA, 1128 bp, Artificial Sequence
  Description of Artificial Sequence: Synthetic coding sequence
atggaccgggacctgaatgaagatgacagcgtggtggacctgagctttgaggccgagagccccctggccccacccacagagctgctggagcggctgcccagctatgactggctgctgcagggcggccggggccagatcttcttcccccccctggaggcccctggccggccccaggagcagaggtcctggcccagcttcctggagcaccgggtgcctgccatgacagaggaggtggcccgggaggccctgctgagctttgtggacagcaagtgctgctacagcagcacagtggccggggacctggtgatccaggagctgaagaggcagaccctgtgccgctaccgcctggagaccttcagcgagagccgcatcagcgagtggaccttccagcccttcaccaaccacagcgtggatggcccccagagaggagccagcccccggctgtgggacatcaaggtgcagggcccccccatgttccaggaggacaccaggaagttccaggtgccccacagcagcctggtgaaggagtgccacaagtgccacggccggggccgctacaagtgcagcggctgccacggggccggcaccgtgcgctgccccagctgctgcggggccaagaggaaggccaagcagagccgccgctgccagctgtgtgccggcagcggcagaagacgctgcagcacctgcagcggccggggcaacaagacctgtgccacctgcaagggggagaagaagctgctgcacttcatccagctggtgatcatgtggaagaacagcctgtttgaatttgtgtctgagcaccggctgaactgcccccgggagctgctggccaaggccaagggggagaacctcttcaaggatgagaacagcgtggtgtaccccatcgtggacttccccctgcgggacatcagcctggccagccagaggggcattgctgagcacagcgctgccctggccagccgggcccgggtgctgcagcagaggcagaccatcgagctgatccccctgacagaggtgcactactggtaccagggcaagacctacgtgtactacatctatggaacagaccaccaggtgtatgctgtggactacccagagcgctactgctgcggctgcaccatcgtgtag

SEQ ID NO: 36809 - DNA, 498 bp, Artificial Sequence
  Description of Artificial Sequence: Synthetic coding sequence
atgcaggccgagaccatcctggagggcctggaggccggcctgccccaggccgtgagcagcggcctgagcctggtgcctgcccctggcctggtgctgacctgcctgagcgcccccagcggccctgggggcatggccctggagcccccacccaccaccctgaggaaggccttcctggcccagagcaccctgctggagagcaccctggagggcgcccctgagtgggccgccccccaccctgaggagcagaggaggagccccccagcctgcagccagcacaccccacccctgcccagcacccccactggacctccaccctgcagccctgggggcaaccaccccctgtgtgccctgagcggccggggcggcggccgctgcagcatccccagcctgagcagcagcagcaccttcagcctcttcagcagcggctgctggaacccccgggtgaagctgcgggtgaggaagagccagagccagggccgggccggccagctgatctag

SEQ ID NO: 36810 - DNA, 1065 bp, Artificial Sequence
  Description of Artificial Sequence: Synthetic coding sequence
atgtgtggccgcaccagctgccacctgcccagagatgtgctgacccgggcctgtgcctaccaggacagaagaggccagcagaggctgcctgagtggagggaccctgacaagtactgccccagctacaacaagagcccccagagcaacagccctgtgctgctgagccggctgcactttgagaaggatgctgacagcagcgagcgcatcatcgcccccatgcgctggggcctggtgcccagctggttcaaggagagtgaccccagcaagctgcagttcaacaccaccaactgccgcagtgacacagtgatggagaagaggagcttcaaggtgcccctgggcaagggccgccgctgtgtggtgctggctgatggcttctatgagtggcagcgctgccagggcaccaaccagaggcagccctacttcatctacttcccccagatcaagacagagaagagcggcagcattggagctgctgacagccctgagaactgggagaaggtgtgggacaactggaggctgctgaccatggccggcatctttgactgctgggagcccccagagggcggagatgtgctgtacagctacaccatcatcaccgtggacagctgcaagggcctgagtgacatccaccacaggatgcctgccatcctggatggagaggaggccgtgtccaagtggctggactttggagaggtgtccacccaggaggccctgaagctgatccaccccacagagaacatcaccttccacgctgtgtcctctgtggtgaacaacagcaggaacaacaccccagaatgtctggcccctgtggacctggtggtgaagaaggagctgcgggccagcggcagcagccagaggatgctgcagtggctggccaccaagagccccaagaaggaggacagcaagaccccccagaaggaggagagtgatgtgccccagtggagcagccagttcctgcagaagagccccctgcccaccaagaggggcacagctggcctgctggagcagtggctgaagcgggagaaggaggaggagcctgtggccaagaggccctacagccagtag

SEQ ID NO: 36811 - DNA, 1065 bp, Artificial Sequence; identical to SEQ ID NO: 36810
  Description of Artificial Sequence: Synthetic coding sequence

SEQ ID NO: 36812 - DNA, 1065 bp, Artificial Sequence; identical to SEQ ID NO: 36810
  Description of Artificial Sequence: Synthetic coding sequence

SEQ ID NO: 36813 - DNA, 990 bp, Artificial Sequence
  Description of Artificial Sequence: Synthetic coding sequence
atggagatgagcggcctgtccttcagcgagatggagggctgcaggaacctgctgggcctgctggacaatgatgagatcatggccctgtgtgacacagtgaccaaccggctggtgcagccccaggaccggcaggatgctgtgcacgccatcctggcctacagccagagcgctgaggagctgctgcggcggaggaaggtgcaccgggaggtgatcttcaagtacctggccacccagggcatcgtcatccccccagccacagagaagcacaacctgatccagcacgccaaggactactggcagaagcagccccagctgaagctgaaggagaccccagagcctgtgaccaagacagaggacatccacctgttccagcagcaggtgaaggaggacaagaaggccgagaaggtggacttccggcggctgggggaggagttctgccactggttcttcggcctgctgaacagccagaaccccttcctgggccccccccaggatgagtggggcccccagcacttctggcatgatgtgaagctgcgcttctactacaacaccagcgagcagaatgtgatggactaccatggagctgagatcgtgtccctgcggctgctgagcctggtgaaggaggagttcctgttcctgagccccaacctggacagccacggcctgaagtgtgccagcagcccccacggcctggtgatggtgggcgtggccggcaccgtgcaccggggcaacacctgcctgggcatctttgagcagatcttcggcctcatccgctgcccctttgtggagaacacctggaagatcaagttcatcaacctgaagatcatgggagagagcagcctggcccctggcaccctgcccaagcccagcgtgaagtttgagcagagcgacctggaggccttctacaacgtcatcaccgtgtgtggcaccaatgaggtgcgccacaacgtgaagcaggccagtgacagcggcactggagaccaggtgtag

SEQ ID NO: 36814 - DNA, 879 bp, Artificial Sequence
  Description of Artificial Sequence: Synthetic coding sequence
atggcccagccccagctgtacctgcctgagcccttcaagatcgcctacaggaaggtgggccagtgccgccgcttccagcagctgaagaagaagaatggcagcttcaagaggaagggcatcgagcgctggcacagagctgtgtccaccaacctgctgaagcagaatgtgctggtgcccaaggaggagagcagcagtgacagcgacatgggcttccacgagagccagcagaaccagaagagcaacctgaagaccaaggtgaagacagccttcggccgcatgctgagctacaagtaccgcagcaagccagcctgtgccagccaggagggcagcacagaccacaaggaggccctgctgagcaacacccagagcctgctgccccgcatcgtgaaggagttcagcagccccaagctgttcaccgccaagatgaggaagctgtctgaaaatgccaccatccagctggatgtggtggaggccgagacagaggagatcacccagggcaacaccctgctgcgggcccggaggaccaccaagaggctgtctgtgaccagcctgcccagcggcctgcagaagggcccctacagccccaagaagaggccccacttccctgccctgaagaagaagaagaggggcatggagaacatcctgaggaagagtgacctgactgtgggcaagctgcagatgcaggtggatgacctgattgaaacagtgacagacaagtccatgaagctgctggcccagagacatgctgagctgcagcagtgtgagttcctgggagatgagatcctgcagagcagcaagcagttccagaggatcagcaagaggaccatgaggaagtacaagctgaagaacatgaccaccaagggccctggggacagctag

SEQ ID NO: 36815 - DNA, 357 bp, Artificial Sequence
  Description of Artificial Sequence: Synthetic coding sequence
atgaaggtggtgggcaactacagagtgaacacagccaacagcagcacagacaccagcggggagcacctgacctgcctgcggagccagctgtttgtggcctacagaaatggccgggtggatgaggccgtgtccctgggcttcctggactgctggattggaggagacctgaccaacttcaagggctgctacctgaccaaccagctgcccatccagatcttcaccgccatctttgacatgaacacagatgtgatcatcctgagccagttcatgtactaccgcctgaagaaccagaagaagaagatcagcgaggaggacctgaggaaggagctgcacttctgctgcctgcactggccctag

SEQ ID NO: 36816 - DNA, 402 bp, Artificial Sequence
  Description of Artificial Sequence: Synthetic coding sequence
atgaaggtggtgggcaactacagagtgaacacagccaacagcagcacagacaccagcggggagcacctgacctgcctgcggagccagctgtttgtggcctacagaaatggccgggtggatgaggccgtgtccctgggcttcctggactgctggattggaggagacctgaccaacttcaagggctgctacctgaccaaccagctgcccatccaggacatccccaccagcgtcatccagaggctgcaccaccagcgggagagccagatcgtgaccctgggcagccccctgccctgcatctaccccatcttcttccagatcagcgagatctccatgcctggctactacagctgcctgtgccacaccaccatcaacaccagcaagaggcgcttcatcctgacctag

SEQ ID NO: 36817 - DNA, 408 bp, Artificial Sequence
  Description of Artificial Sequence: Synthetic coding sequence
atgaaggtggtgggcaactacagagtgaacacagccaacagcagcacagacaccagcggggagcacctgacctgcctgcggagccagctgtttgtggcctacagaaatggccgggtggatgaggccgtgtccctgggcttcctggactgctggattggaggagacctgaccaacttcaagggctgctacctgaccaaccagctgcccatccagatcttcaccgccatctttgacatgaacacagatgtgatcatcctgagccagttcatgtactaccgcctgaagaaccagaagaagaagatgatcttccagccccagctgttcaaggacagcatcacccgggagaaggtgcggctgagcctgtggggcgtgctgtgccctgtgtacatcccctacagcttcagatag

SEQ ID NO: 36818 - DNA, 729 bp, Artificial Sequence
  Description of Artificial Sequence: Synthetic coding sequence
atgggcactggagccagcgagaagcaggccgagcagaaggtgagaagagcctttgaggccagcgaggaggcccacggcaccctggccgccagcaccccctgggtggccatgggcagcgcctacggcagctgcacctgcctgggcgcccagcctgtgacagacctggccctgtggcctgtgatctacagctgcatgggcttcagcccccaggcctacccagccttctgggcctacccctgggtgctgtatggaggctacctgtggatgggctacccacctcctgctgccctggtgcccagcgtgtggctgtactggaggggggccagcagctttgaccccctgattggcagcccctacctggccgccctggcccccaacctcttccccttccccatgaagtttcctcccacctacagcctggccagccccaccctgggcggggccaccagcagccactgcccccaggtgggctgctggaccccagccagcagcgcccccagggctgctgtggagggccccagcagaggagccccctacctgaagacctgcaaggccccacccagcgagtgggccagccgcttcggcatctgggcccccctgccctgctgcagcagcgagctgcggcccctgccccccagccccatcgaggacagccagctggaccccggctgcagccgcagcagcagccgcagcccctgccgggccaggagaagactctttgaatgttag

SEQ ID NO: 36819 - DNA, 804 bp, Artificial Sequence
  Description of Artificial Sequence: Synthetic coding sequence
atgcactacatcaagacctggagcctgctgggggagatgtctgagaagctgcggcgctgcaggaaggagctgacagctgccatcgaccgggcctttgagggcgtgtcctacagccaggagtgcaccggccagcagaggctggagctgtctgctgcccccctgtccttcagcctgcctgtgcaccggctgctgtgccgccgccaccccctggccgcctgcagcagcgctgccccctttgctgctgtgccctgtgccccagaaaatgaaaatcctgcctttgccaccaaccacgcccctgtgaatgccaagccccacgccctgtgcccagagaggaagcccctgaccagcaaagaaaatgtgctgatgcacagcagcatcctggcccctgagcgggagagctggaggacagctggggagggggagaactggaggaaggagaacctgaggaaggacatggagcgggacctgaaggctgacagcaacatgcccctgaacaacagcagccaggaggtgaccaaggacctgctggacatgattgaccacaccagcatccgcaccatcgaggagctggccggcaagattgaatttgaaaatgagctgaaccacatgtgtggccactgccaggacagccccttcaaggaggaggcctgggccctgctgatggacaagagcccccagaaggccacagatgctgaccccggcagcctgaagcaggcctttgatgaccacaacatcgtggagaccgtgctggacctggaggaggactacaacgtgatgaccagcttcaagtaccagatcgagtag

SEQ ID NO: 36820 - DNA, 432 bp, Artificial Sequence
  Description of Artificial Sequence: Synthetic coding sequence
atggccacccccctggacaactgcctgcggcccttcccagaccccatggtgaaggtgacagctgagaccaagaagatcagcgaggtgtcctcctatgtgtctgccaacaacaagaagaacagcttctggggcagcggcctgctgtaccctgtggccctgctgcgctgccaggactgctgggccggccaccagacccacgtgctgagcaaggagttcaccagctacttcagcagcggggccggccgggaggcccagcaccagcccagcgctgtgctgggcagcctcatctggctgcggcgggtgtacctgctgcgggccatggtggtgcacggcggcagccagccctgccagcgctggctggtgatccgcatggaggtgggcggccaccccagcttccctggccacgcctggctgaccttccacctgaactag

SEQ ID NO: 36821 - DNA, 1692 bp, Artificial Sequence
  Description of Artificial Sequence: Synthetic coding sequence
atgatcaagaggaagatctggtgcaacctgtgcatcgacctggtggccttcaccagcgagatcttcaagggagctgtgttccagagcctggatggcatcgtggtgtctgccaactgcaagctgaggaagatcttcaccctgaagagcaagccccaggacacagctgacaaggatgctgtgtatggagtgcccttcagcacagatgagcccacagacatcatccccaggagctgccagctgatgacagatgtgccccacgtgacccagctgctgaacatgaccaagctgcggcagacagagatcaagtttggaggccaccccctgcggtctgctgagagtgaccagttcatcaacagaggcaccagcatcaccaggaacagcaagaaccaggatgtgtgccacatcgccttcggcagcaaggtgctgggccccccacccctgagcggcagaagaaacaacatgaagatcagcagcgagaccgtgcgctctgtgggcagcaagaacaacagaagctgccagcccagcacagtggagaagtgtgtgaatggaacagagatgtctgccctgctgatccctgagagcgaggagcagggcaacaaggagaacatccaccagatcaagcagacagtgcccatccacgccgccaacctgcacatcatgcacccccaccccccccaggagcccagcgctgacaagaacaacaacagaagaaggctgcggctgaagagcaccagccgggagaggacagagaccccatctggcagcagcagcggcaacaacagaattgaggacaaggccagcaccatcctgaccaccgtgtcccagcagggcgctgagctgctgaacagcggcaccctgggcccccagagcccagaccagagtgatgagtggatcttcccagaaaatgctgaccacatctcctacctggccagcagccggcagagcctgctgctgggagatgacagctgcaaccccagccacctgtggctggaggccagcaaggagagcgagcatgaccagcaggccgaggagagccagagcgtgcccaaggacatcttcaccttcagcagccggcccaggtctgccccccacggcaagacccagaccatgagccctgaggagctgtccttcatcctggacctgaaggaggacaacagcgtgaccagccgggacacccagagtgaagatgacttctatggaggagacagcagcgaggaggagtatgactggaggaactaccagcccagccagatgtctgagagcgagctgcagatgctggccagcctgcgctggcagcagaatgaggagctggaggatgctggcaccagccacggcctgagcgccagccaggtggacaactgcaatgtgtccatcagcaccagcagtgatgacaccaccacctggaacagctgcctgcccccacctgtgaaccagggccgccactaccagaaggagatgaacccccccagccccagcaacccccgggactggctgaacatgctgagcccccccatcgtgccccccagccagcagcctgctgagcagaggccagacagctgtgagagcctgtctgtgcagggcgaggaggacctgtctgtggaggaggatgaggaggtgctgaccctgctgtatgacccctgcctgaactgctactttgacccccagacaggcaagtactatgagctggtgtag

SEQ ID NO: 36822 - DNA, 717 bp, Artificial Sequence
  Description of Artificial Sequence: Synthetic coding sequence
atgagcggcttcccagaaaatgctgaccacatctcctacctggccagcagccggcagagcctgctgctgggagatgacagctgcaaccccagccacctgtggctggaggccagcaaggagagcgagcatgaccagcaggccgaggagagccagagcgtgcccaaggacatcttcaccttcagcagccggcccaggtctgcccctcatggcaagacccagaccatgagccctgaggagctgtccttcatcctggacctgaaggaggacaacagcgtgaccagccgggacacccagagtgaagatgacttctacggcggggacagcagcgaggagggcaaccacagcatccagggcagccggggccccaccaccggccccagcgagctgacccagctgaccctggagagcctgctgggcaaggccgccaagaggaccagcaaggagtacctgcggagcgcctacacagaagctggggccacagagagccaggacagctccatggagcagattgacaggaacaactttgagatgagcctgctgcccaccacctgcctgagccccaccggccgccgctgtggcagctgccagaagaccccagagcctgtgatcaaggccaaggacctgagcgcccagcaggtgcctgccagcctgaacaagaccagcctgaaggagatcagcggggagcggctgagcagcatccctgaggccagcgagtag

SEQ ID NO: 36823 - DNA, 2070 bp, Artificial Sequence
  Description of Artificial Sequence: Synthetic coding sequence
atgatcaagaggaagatctggtgcaacctgtgcatcgacctggtggccttcaccagcgagatcttcaagggagctgtgttccagagcctggatggcatcgtggtgtctgccaactgcaagctgaggaagatcttcaccctgaagagcaagccccaggacacagctgacaaggatgctgtgtatggagtgcccttcagcacagatgagcccacagacatcatccccaggagctgccagctgatgacagatgtgccccacgtgacccagctgctgaacatgaccaagctgcggcagacagagatcaagtttggaggccaccccctgcggtctgctgagagtgaccagttcatcaacagaggcaccagcatcaccaggaacagcaagaaccaggatgtgtgccacatcgccttcggcagcaaggtgctgggccccccacccctgagcggcagaagaaacaacatgaagatcagcagcgagaccgtgcgctctgtgggcagcaagaacaacagaagctgccagcccagcacagtggagaagtgtgtgaatggaacagagatgtctgccctgctgatccctgagagcgaggagcagggcaacaaggagaacatccaccagatcaagcagacagtgcccatccacgccgccaacctgcacatcatgcacccccaccccccccaggagcccagcgctgacaagaacaacaacagaagaaggctgcggctgaagagcaccagccgggagaggacagagaccccatctggcagcagcagcggcaacaacagaattgaggacaaggccagcaccatcctgaccaccgtgtcccagcagggcgctgagctgctgaacagcggcaccctgggcccccagagcccagaccagagtgatgagtggatcttcccagaaaatgctgaccacatctcctacctggccagcagccggcagagcctgctgctgggagatgacagctgcaaccccagccacctgtggctggaggccagcaaggagagcgagcatgaccagcaggccgaggagagccagagcgtgcccaaggacatcttcaccttcagcagccggcccaggtctgccccccacggcaagacccagaccatgagccctgaggagctgtccttcatcctggacctgaaggaggacaacagcgtgaccagccgggacacccagagtgaagatgacttctatggaggagacagcagcgaggagggcaaccacagcatccagggcagccggggccccaccaccggccccagcgagctgacccagctgaccctggagagcctgctgggcaaggccgccaagaggaccagcaaggagtacctgcggagcgcctacacagaggccggggccacagagagccaggacagctccatggagcagattgacaggaacaactttgagatgagcctgctgcccaccacctgcctgagccccactggaagaagatgtggcagctgccagaagaccccagagcccgtcatcaaggccaaggacctgagcgcccagcaggtgcctgccagcctgaacaagaccagcctgaaggagatctctggagagcggctgagcagcatccctgaggcctctgaatatgactggaggaactaccagcccagccagatgtctgagagcgagctgcagatgctggccagcctgcgctggcagcagaatgaggagctggaggatgctggcaccagccacggcctgagcgccagccaggtggacaactgcaatgtgtccatcagcaccagcagtgatgacaccaccacctggaacagctgcctgcccccacctgtgaaccagggccgccactaccagaaggagatgaacccccccagccccagcaacccccgggactggctgaacatgctgagcccccccatcgtgccccccagccagcagcctgctgagcagaggccagacagctgtgagagcctgtctgtgcagggcgaggaggacctgtctgtggaggaggatgaggaggtgctgaccctgctgtatgacccctgcctgaactgctactttgacccccagacaggcaagtactatgagctggtgtag

SEQ ID NO: 36824 - DNA, 753 bp, Artificial Sequence
  Description of Artificial Sequence: Synthetic coding sequence
atgtctgctgctgccagccctgccagcgagcggggctggaagtctgagaagctggatgaggcccaggccctggcccggagctgtgccgcccggcggccagacttccagccctgtgatggcctgagcatctgtgccacccacagccacggcaagtgcttcaagctgcactggtgctgccacctgggctggtgccactgcaagtacatgtaccagcccatgacccctgtggagcagctgcccagcacagagatcccagcccggccccgggagcccaccaacaccatccagatctctgtgtccctgacagagcacttcctgaagtttgccagcgtcttccagccccccctgcccccagacagcccccgctactgcatgatcagtgacctcttcatcgacaactaccaggtgaagtgcatcaacgggaagatgtgctacgtgcagaagcagcctgccccccacagccacaggatgagccctgaggaggtgtctgcccatgatgccctgatcagcaaggagagcaacacccccaagattgaccactgcagcagccccagcagcagcgaggacagcggcatcaatgccatcggggcccactacgtggagagctgtgatgaggacacagaggagggcgctgagctgagcagcgaggaggactacagccctgagagctcctgggagccagatgaatgtaccctgctgagccccagccagagcgacctggaggtgattgagaccatcgagaccaccgtgtag

SEQ ID NO: 36825 - DNA, 528 bp, Artificial Sequence
  Description of Artificial Sequence: Synthetic coding sequence
atgaccaggacccctgtgggcagcgcccggacccggcccaagcccaggaagctgggcccccagaggggcaaggccctgcaggccagcagccggctgtctgagagccctgccctggtgaagaagaggatgccagatgcctgcaccctgggccgggccggcatcggcctgcccaagatgtgcctgcacatggctgtgcgccacagcaaggcccagaagacaggccctggcatcctgcagcagaggcagaagcccccagccccccgggccagcggcggccctgccctgctgggcaagagaagaggctgcagcgaggccggcagcgccagcctggagcccctgagcagcagcagagctgctgctggctgcctgaaccaggtgcccctgagccccttcctggccggccccaggaacacccggcggctgcctgcccctgagcgggagagaattgagctggccgccaccctgtgcctggagggctggcccctgcgctgcctggccagcaagggcaagctgcactgtgtgtactag

SEQ ID NO: 36826 - DNA, 492 bp, Artificial Sequence
  Description of Artificial Sequence: Synthetic coding sequence
atgcagagcgtggacagcatgctgggcaccgtgggcggctgcggcggcggggaggccgccagcaccttcagcaaggaccccagcggctgctgcgtgggcaatgactgcagagatggcggccggggcctggagaggagacatggccgctggagcagaggagagggcggggagagcggcctgtgcagcggcggccagatggccagcgagattgagtactgggatggcctggccatctctgtgatggaggtggagaaggccttcggcagcaccaacgtgctgtggaagacagagcccttcagcctgtgggcctgcacagctgcctgcccccccagcctgagccccaccctgctggccctgggcctgcccagagatggcaaggagctggccgagcagggcagcctgtggacagtgctggagcccggcggggactggagccacagccagagccagctgggcaccccaggccggggcaagggggccctgggcttctag

SEQ ID NO: 36827 - DNA, 801 bp, Artificial Sequence
  Description of Artificial Sequence: Synthetic coding sequence
atgtttgtggagctgaacaacctgctgaacaccaccccagacagagctgagcagggcaagctgaccctgctgtgtgatgccaagacagatggcagcttcctggtgcaccacttcctgtccttctacctgaaggccaactgcaaggtgtgctttgtggccctgatccagagcttcagccactacagcatcgtgggccagaagctgggcgtgtccctgaccatggcccgggagcggggccagctggtgttcctggagggcctgaagtctgctgtggatgtggtgttccaggcccagaaggagccccaccccctgcagttcctgcgggaggccaatgccggcaacctgaagcccctgtttgaatttgtgcgggaggccctgaagcctgtggacagcggggaggcccgctggacctaccctgtgctgctggtggatgacctgtctgtgctgctgagcctgggcatgggcgctgtggccgtgctggacttcatccactactgccgggccaccgtgtgctgggagctgaagggcaacatggtggtgctggtgcatgattctggagatgctgaagatgaggagaatgacatcctgctgaatggcctgagccaccagagccacctgatcctgcgggcagagggcctggccaccggcttctgcagagatgtgcacggccagctgcgcatcctgtggaggcggcccagccagcctgctgtgcaccgggaccagagcttcacctaccagtacaagatccaggacaagtctgtgtccttctttgccaagggcatgagccctgctgtgctgtag

SEQ ID NO: 36828 - DNA, 729 bp, Artificial Sequence
  Description of Artificial Sequence: Synthetic coding sequence
atgtttgtggagctgaacaacctgctgaacaccaccccagacagagctgagcagggcaagctgaccctgctgtgtgatgccaagacagatggcagcttcctggtgcaccacttcctgtccttctacctgaagggcgtgtccctgaccatggcccgggagcggggccagctggtgttcctggagggcctgaagtctgctgtggatgtggtgttccaggcccagaaggagccccaccccctgcagttcctgcgggaggccaatgccggcaacctgaagcccctgtttgaatttgtgcgggaggccctgaagcctgtggacagcggggaggcccgctggacctaccctgtgctgctggtggatgacctgtctgtgctgctgagcctgggcatgggcgctgtggccgtgctggacttcatccactactgccgggccaccgtgtgctgggagctgaagggcaacatggtggtgctggtgcatgattctggagatgctgaagatgaggagaatgacatcctgctgaatggcctgagccaccagagccacctgatcctgcgggcagagggcctggccaccggcttctgcagagatgtgcacggccagctgcgcatcctgtggaggcggcccagccagcctgctgtgcaccgggaccagagcttcacctaccagtacaagatccaggacaagtctgtgtccttctttgccaagggcatgagccctgctgtgctgtag

SEQ ID NO: 36829 - DNA, 303 bp, Artificial Sequence
  Description of Artificial Sequence: Synthetic coding sequence
atgcacgtgtgtgacctgcagaagctggtgcgcatccagctggccttcaccaccttcccctggatgttcagctgccacctgctgcccaccccagagctgagcagcaagaggaaccagtgcctgctgtacaagaccagcggctgcctgacccagatgcccatcctgtatggccacccagccaccctgctgaaggactacatcctgcaggccatcctgcagcccgggaagaagatccagggcggcacagagatccagaggggcagctttgccaaccagtaccagacagatgccagccacctgtag

SEQ ID NO: 36830 - DNA, 744 bp, Artificial Sequence
  Description of Artificial Sequence: Synthetic coding sequence
atgtggggccctggggtgacagctgagggcctgtctgtggccccagcccccccacccctgctgcccctgctgctgctgctggccctggccctggtggcccccagcagaggaggcggcggctgtgccgagctggcctgtggggagcgggagcgctgctgtgatgccaccaatgccacagctgtgcgctgctgcaagctgcccctgcacgccttcctggacaacgtgggctggtttgtgaggaagctgagcggcctgctgatcctgctggtgctgtttgccatcggctacttcctgcagaggatcatctgccccagcccccggcgctacccccggggccaggcccggcccggccagaggcctggccccccaggaggagctggccccctgggcggggccggccccccagatgatgatgatgacagccctgccctgctgagagatgaagctgctgctggcagccaggacagcctgctggacagcggcggcggcggccggggccggggcggcggcggccgcagtgaccccagctgtgccagcgagcacgagatgagggtggtgtcccctgtgttcctgcagctgcccagctatgaggaggtgaagtacctgcccacctatgaggagagcatgaggctgcagcagctgagccctggagaggtggtgctgcctgtgtctgtgctgggccggccccggggcggcgtggccgctgagccagatggaggagagggccgctaccccctcatctag

SEQ ID NO: 36831 - DNA, 1080 bp, Artificial Sequence
  Description of Artificial Sequence: Synthetic coding sequence
atgaacctgaacccccccaccagcgccctgcagatcgagggcaagggcagccacatcatggccagaaatgtgtcctgcttcctggtgcgccacaccccccacccccggcgggtgtgccacatcaagggcctgaacaacatccccatctgcaccgtgaatgatgatgaaaatgccttcggcaccctgtggggcgtgggccagagcaactacctggagaagaaccgcatcccctttgccaactgcagctaccccagcagcacagctgtgcaggagagccctgtgcggggcatgagccctgcccccaacggggccaaggtgcccccccggccccacagcgagcccagcaggaagatcaaggagtgcttcaagaccagcagcgagaaccccctggtgatcaagaaggaggagatcaaggccaagaggcctcccagcccccccaaggcctgcagcaccccaggcagctgcagcagcggcatgaccagcaccaagaatgatgtgaaggccaacaccatctgcatccccaactacctggaccaggagatcaagatcctggccaagctgtgcagcatcctgcacacagacagcctggccgaggtgctgcagtggctgctgcacgccaccagcaaggagaaggagtgggtgtctgccctgatccacagcgagctggccgagatcaacctgctgacccaccacagaagaaacacctccatggagcctgctgctgagaccgggaagccacccaccgtgaagagcccccccaccgtgaagctgccccccaacttcaccgccaagagcaaggtgctgacccgggacacagaaggagaccagcccaccagggtgagcagccagggcagcgaggagaacaaggaggtgcccaaggaggccgagcacaagccacccctgctgatcagaagaaacaacatgaagatccctgtggccgagtacttcagcaagcccaacagccccccccggcccaacacccaggagagcggcagcgccaagcctgtgtctgcccggagcatccaggagtacaacctgtgcccccagagggcctgctaccccagcacccacagaagatag

SEQ ID NO: 36832 - DNA, 945 bp, Artificial Sequence
  Description of Artificial Sequence: Synthetic coding sequence
atgggctgccgctgctgcaagatcatccagagctacctgtttgatcctgtgcaggtgcccagccctggctacgtgaatgaggtgaacagctgcaagctggatgaagatgacacagacaagctgaagggcaagtggagcagcgaggtgctggtgcagaagaatgacccccagaggcagggcagcaagaagacagagagcagcagcaggacagctgacccctgggagccctgctggccccaccagggccccctgccccagggagatgctggaggagagcaccacgcctgtggggtgaatggaattggccctgctgccaccccccagcccaccggcaacagcagccccacccaggatgaccggggctcctgggccagcacagccaacacagtgccccccacccagcccttcctggagggcggcggcaccaggaagcaggactgtgtgctgctggccagcgagggcacccaggtgatgagaaatggagacagccgggcccccagcgaggccgagagctttgccctggaggtgcaggaccacgtgttccagatcccagccccagactacctgcagcactggggccctgctggggacaacgtggaccacaatgagaaggactgtgtgttcaagaaccacacagaagatgagagcctggagggcatccagccccctgtgggggagcacggcctgaacacccccttctctgtgcggcgctcctgggacagcctgaatgaagatgtggagacagaggtgctgagcatctgcttcaatgagaagggccctgtgcacgccatgcctgtggtggacagcggcaaccggcaggaggacacccacggcagtgatggagatggagatggagaaattgtggatgaagatgctgctgtggccgaggccctggccgccctggaggccgccacagctggggaggacctggatgaaacagactag

SEQ ID NO: 36833 - DNA, 945 bp, Artificial Sequence; identical to SEQ ID NO: 36832
  Description of Artificial Sequence: Synthetic coding sequence

SEQ ID NO: 36834 - DNA, 702 bp, Artificial Sequence
  Description of Artificial Sequence: Synthetic coding sequence
atggaccaggaggagggcctgaaggccctggacaacatcgtgacccagttcaatgcctatgaggacttcctggacagccagatcaccaccgtggacctgtactacctggaggatgagaccctggcccggcagctggtggagctgggctaccggggcactggagagcgggtgaagcgggaggactttgaggccaggaaggccgccattgaaattgcccggctggccgagcgggcccagcagaagaccctgaccagcgctgggaaggacctgcaggacaacttcctgacagccctggccatgagggaggaggacaacagaagtggcaagctgagcagcgtcatcttcatccgggacaggaacagccacggccaggagatcagcggctacatcgactatgcccaccggctgaagacagaagattttgaggtgtacttcaccgggaagaagaggctgctgccccggcccacagacatctccttctacaactgggatgctgacattgctgtgagcaacagcagccccaactaccaggtgattgctgacaaccctgagggcctgctcttccgctacaagagggacaggaagatcctgaatgtggaccccaaggcccagcccggggacaacagcacccgcatcaccatcctgacagagctgtatgtgcaggccgtcatctttgaccacatcagcaggaggaagacctag

SEQ ID NO: 36835 - DNA, 753 bp, Artificial Sequence
  Description of Artificial Sequence: Synthetic coding sequence
atggaccaggaggagggcctgaaggccctggacaacatcgtgacccagttcaatgcctatgaggacttcctggacagccagatcaccaccgtggacctgtactacctggaggatgagaccctggcccggcagctggtggagctgggctaccggggcactggagagcgggtgaagcgggaggactttgaggccaggaaggccgccattgaaattgcccggctggccgagcgggcccagcagaagaccctgaccagcgctgggaaggacctgcaggacaacttcctgacagccctggccatgagggaggaggacaacagaagtggcaagctgagcctgaaccagcaggagacagatgctgcccacatcctgaagaagcagctggccagcgtcatcttcatccgggacaggaacagccacggccaggagatcagcggctacattgattatgcccaccggctgaagacagaggactttgaggtgtacttcaccgggaagaagaggctgctgccccggcccacagacatctccttctacaactgggatgctgacattgctgtgagcaacagcagccccaactaccaggtgattgctgacaaccctgagggcctgctcttccgctacaagagggacaggaagatcctgaatgtggaccccaaggcccagcccggggacaacagcacccgcatcaccatcctgacagagctgtatgtgcaggccgtcatctttgaccacatcagcaggaggaagacctag

SEQ ID NO: 36836 - DNA, 600 bp, Artificial Sequence
  Description of Artificial Sequence: Synthetic coding sequence
atggacttcaagattgagcacacctgggatggcttccctgtgaagcatgagcccgtcttcatccggctgaaccctggggacagaggagtgatgatggacatcagcgcccccttcttccgggaccccccagcccccctgggggagcccgggaagcccttcaatgagctgtgggactatgaggtggtggaggccttcttcctgaatgacatcacagagcagtacctggaggtggagctgtgcccccacggccagcacctggtgctgctgctgtctggaagaagaaatgtgtggaagcaggagctgcccctgtccttcaggatgagcagaggagagaccaagtgggagggcaaggcctacctgccctggagctacttcccccccaacgtgaccaagttcaacagctttgccatccacggcagcaaggacaagaggagctatgaggccctgtaccctgtgccccagcacgagctgcagcagggccagaagccagacttccactgcctggagtacttcaagagcttcaacttcaacaccctgctgggggaggagtggaagcagcctgagagtgacctgtggctgattgagaagtgtgacatctag

SEQ ID NO: 36837 - DNA, 600 bp, Artificial Sequence; identical to SEQ ID NO: 36836
  Description of Artificial Sequence: Synthetic coding sequence

SEQ ID NO: 36838 - DNA, 195 bp, Artificial Sequence
  Description of Artificial Sequence: Synthetic coding sequence
atggacttcaagattgagcacacctgggatggcttccctgtgaagcatgagcccgtcttcatccggctgaaccctggggacagaggagtgatgatggacatcagcgcccccttcttccgggaccccccagcccccctgggggagcccgggaagcccttcaatgagctgtgggactatgaggtggtggaggcctag

SEQ ID NO: 36839 - DNA, 354 bp, Artificial Sequence
  Description of Artificial Sequence: Synthetic coding sequence
atggcctatggagtgcccaggaagaacacagtgaagaccatcctgcggggcagctgctacaacgtgcaggagccctgggacatcgccctgctggccaagacctggagcaccaacctggccaacatcaagctgcccttcctggaggagatcagctttggaggctctgtgcagctgaccaagtgcaccaccatcaaggatggcctgctgcccagcgctgagagcatcaagctggagcgggagtatgaggtgaagaggctgtgcaagctgaagtgccaggagaacaccagcaaggagatccagctgctgctgcgggagaggcctgctggcctgcggcggcccctgcccagcaagtag

SEQ ID NO: 36840 - DNA, 354 bp, Artificial Sequence; identical to SEQ ID NO: 36839
  Description of Artificial Sequence: Synthetic coding sequence

SEQ ID NO: 36841 - DNA, 246 bp, Artificial Sequence
  Description of Artificial Sequence: Synthetic coding sequence
atggcctatggagtgcccaggaagaacacagtgaagaccatcctgcggggcagctgctacaacgtgcaggagccctgggacatcgccctgctggccaagacctggagcaccaacctggccaacatcaagctgcccttcctggaggagatcagctttggaggctctgtgcagctgaccaagtgcaccaccatcaaggatggcctgctgcccagcgctgagagcatcaagctggagcgggagtactag

SEQ ID NO: 36842 - DNA, 342 bp, Artificial Sequence
  Description of Artificial Sequence: Synthetic coding sequence
atggcctatggagtgcccaggaagaacacagtgaagaccatcctgcggggcagctgctacaacgtgcaggagccctgggacatcgccctgctggccaagacctggagcaccaacctggccaacatcaagctgcccttcctggaggagatcagctttggaggctctgtgcagctgaccaagtgcaccaccatcaaggatggcctgctgcccagcgctgagagcatcaagctggagcgggagtatgaggtgaagaggctgtgcaagctgaagtgccaggagaacaccagcaaggagatccagctgctgctgcgggagaggcctgctggcctgcggcggccctag

SEQ ID NO: 36843 - DNA, 1380 bp, Artificial Sequence
  Description of Artificial Sequence: Synthetic coding sequence
atgtatgaccgggccccccggctgctgaagctggccgagggcggcagcacagaggcccacgtgggccctggcagctaccaggtgcccttcctgaagcagcaggccaccggcagcaatgcccccttcctgagcctgacagcccgggagagcaccttcaccatcgccagcagcattgagaaggctgtgcccggccctggccactacaacgtgtctgaggcccagaagatcagccgcagccccaccctgaccaggtctgtggatgtgcccagcatccccagctgtgggaagagctatggctaccacatcaatgatgatggcagcatcatcaagtgcttccccccagcctgtgacagcaccctgggccctgcctactacaagccccagtttgatgtgtccaatgccaccctgaagtacaagggcatccactttggaaacagcagcggccggcaggagctgcccaagaagagcggccctggccctggccagtatgacatcgtgcagaagaagaccagctactatgaaaatgtgaacatcaagagggaccagcagcagaactactgcagcttcatcccccggctgtatgagatcatcgtgctgcaggagaagaagaagcgcttcctgcccatgaagagcatcaccccagcccctggcacctacaatgagcccaggacagccctgaagagcctgaagaagaccagcggcctgaagaacatccccttcggccagagcgctgtgcgcttcacccaggacatcagaacagaggagatgcctggccctggcttctacaacgtgctgaacaacaccatcatcgcctctgtgaggaacatctgcagcaagaagcagaagaagagcgccttcggcagctctgtgcccaggaccttcttctctgtgcagaaggaggcctgtgccaccccaggccctgctgactaccaggagttctggcacagccagggcgtgggcatcagtgatgagctgcccaacctgaccaacaagtatgctgccttcctgagccgggccaagaggaccatgaaggtgcctgacatggtgatcccagcccctggcagctatgatgtgcacaagagctatgagatgagccaggtgaagcacaagtacatgccacccaggagcctggtggccaagaggaagcacgccagcttcctgagcgccaccccccgctgcctggagaaggtgacagatggccctggccctgctgcctacaaccctgtgctgaggaagagctgccccatccccctgtttgtgaaggccagcaagagatttgaggagagcaaggagatcaccccaggccctgccacctatgagatcagccaggagaagaagaagggcaacctgattggagagatggctgctgacatcatgtag

SEQ ID NO: 36844 - DNA, 603 bp, Artificial Sequence
  Description of Artificial Sequence: Synthetic coding sequence
atgaccagcgctgagacagccagcagagctgctgagagcggcggcacccctgtgcggccctgcagccggccccaccgggcccccagccctgctgcccccagcaggcctggggccccagctgctggccccaggaagctgctggtgcccggcctgccctgcctggtgcggggcggctggccctggaccaggccagacagcagccccttccggcctgctgcccggcccaggatgagcccccacaggagccctgctgtggcccggcgctgtggccggccccggcggcgggaccccaggagaagaaggaccccagccctgccccggccctggccaggccggggcggccctggccgcagcctgctgcaccgccacctgttcatccagcagctgctgcggacctgctggccagccctgccccgggacaggaccccagcccctgggggcaccatgcctggggccgccctggccggccctggccggcaggccagcggcagccctgccccccagagcgagggcgccccaccccggccctggacccccctgcagcccggcctgcaccaccggccccccagcagcagcagcggcctgctgagcagcttcttctag

SEQ ID NO: 36845 - DNA, 474 bp, Artificial Sequence
  Description of Artificial Sequence: Synthetic coding sequence
atggagggctgtgctgtgagaagaggcagctgccccctgctgcccggccccagcgcctggagggccagccctgctggctgggccggccgggccaagctgcgctcctggtgccgggccagcggcctgcccaaccggccctacaccctgaccggcggccgccacggctctgtgtccctgctgcggcaccctggcaccaccacctttgtgcagcagaggagcctgcaccagagctgggagaagagaattgtgttttctgcctgccctgtgagccgctcctggtgcccagagaggaacttcagcggcagcatcccagctgtgaccccacccaagctgcccggccacagcaagtctgagggccccccaggcaaggtgaggaagaggaccaccatccgcagccagcccctgtttgtgaccaggacccggggctttggatctgctgtgggctggctgcccctgggcagccctgtgctgtag

SEQ ID NO: 36846 - DNA, 561 bp, Artificial Sequence
  Description of Artificial Sequence: Synthetic coding sequence
atgtggctggtggagtgcaccggccgggacctgaccggcctgagctgcctgctgtccatggaccggcagccccggcggcggcagcacgtggccggctgcagagatgtgcccccacccctgccccagggctcctggggccagaccagccccaggcacagcatcctgtgcagcaagagcggctgtgacctgctgggcggcggggagtacaacggggagaccagcggggaggagttcctggccccagcctggacctgccgggcccagcaggccgccacctggctgtctgtgcagcagaccagccacaaggccctgggccctgctggaggagctgccatgagcagcaagctgagccctgaggagcagttcctgagccgcatccacttcctgcggaccttcatgtgcagcgtggccggggctgagctgcccggcatcccccaggccacagaaaatggagagggctgcaggcctgcccgggaccctgccagcagccccagcagcctgtccatggcctctgtgtacacccagtgcagcagcgcccagctggtgtctgccctgtcctag

SEQ ID NO: 36847 - DNA, 612 bp, Artificial Sequence
  Description of Artificial Sequence: Synthetic coding sequence
atgcccaaggcccccaagggcaagtctgctggccgggagaagaaggtgatccacccctacagcaggaaggccgcccagatcacccgggaggcccacaagcaggagaagaaggagaagctgaagaatgagaaggccctgcggctgaacctggtgggggagaagctgcagtggttccagaaccacctggacccccagaagaagcgctacagcaagaaggatgcctgtgagctgattgaaagatacctgaaccgcttcagcagcgagctggagcagatcgagctgcacaacagcatccgggaccggcagggccgccgccactgcagccgggagaccgtcatcaagcagaccatggagcgggagcggcagcagtttgagggctacggcctggagatcccagacatcctgaatgccagcaacctgaagaccttccgggagtgggactttgacctgaagaagctgcccaacatcaagatgaggaagatctgtgccaatgatgccatccccaagacctgcaagaggaagaccatcatcaccgtggaccaggacctgggggagctggagctgaatgatgagagcagtgacagtgatgaggagatgacagctgtggcctag

SEQ ID NO: 36848 - DNA, 837 bp, Artificial Sequence
  Description of Artificial Sequence: Synthetic coding sequence
atggtgagaggagctggccctggccccagcctgagcgccctgagccaccccaccggggccagcggcatggctgctgctgagggccctggctacctggtgagcccccaggccgagaagcacagaagagccaggaactggacagatgctgagatgaggggcctgatgctggtgtgggaggagttctttgatgagctgaagcagaccaagagaaatgccaaggtgtatgagaagatggccagcaagctgtttgagatgaccggggagcggcggctgggggaggagatcaagatcaagatcaccaacatgaccttccagtacaggaagctgaagtgcatgacagattctgagagcgcccccccagactggccctactacctggccattgatggcatcctggccaaggtgcctgagagctgtgatggcaagctgcctgacagccagcccccaggccccagcaccagccagacagaggccagcctgagccccccagccaagagcacccccctgtacttcccctacaaccagtgcagctatgagggccgctttgaagatgacagaagtgacagcagcagcagcctgctgagcctgaagttccgctctgaggagaggcctgtgaagaagaggaaggtgcagagctgccacctgcagaagaagcagctgcggctgctggaggccatggtggaggagcagaggcggctgagcagagctgtggaggagacctgccgggaggtgagaagagtgctggaccagcagcacatcctgcaggtgcagagcctgcagctgcaggagaggatgatgagcctgctggagcgcatcatcaccaagagctctgtgtag

SEQ ID NO: 36849 - DNA, 561 bp, Artificial Sequence
  Description of Artificial Sequence: Synthetic coding sequence
atggcctctgtgtcctaccagaagcccaccagcaccaccgtgggcaagcagatgatcttcaccggccctgactacatcaaggactacctgcccaagatccaccagcacaccagctatgtgggggagcagcacctggccctggagaagacaggagacctgcgctacctgtggaggcctgccagcaacagaagcctgcctgccaagtacaagcatgaatatgtgtctgaaattggctggaggatcccccagtacaacttcatcaacaagagccggctgggcagcggcttccacatcaagtatgaggagctgagccaggccagcctggacagcatcacccaccgctaccagaacccctggcagcccaagccccacgtgctggacatgcagggcaagcagagccgggccagctttgcctggcacatgtctgcctttgaggacacagaccagaggaacagcaagtgggccatcctggtgcggcagtgcaagagcagcctgccccgggccagcaagccacccaagctgcccaagctgcccaagaaggagaagaagaggaagcactag

SEQ ID NO: 36850 - DNA, 342 bp, Artificial Sequence
  Description of Artificial Sequence: Synthetic coding sequence
atggctgaccctgaggagctgcaggtgagcagccccccacctcctccacccagcagccccagcagcagtgatgccagcgctgccagcagccctgggggccctgtgtccctgggctggcctgtgcccagccgcagcagcggccccaccgtggaccagctggaggaggtggagctgcagattggagatgctgccttcagcctgaccaagctgctggaggccaccagcgctgtgtctgcccaggtggaggagctggccttcaagtgcacagaaaatgcccgcttcctgaagacctggagggacctgctgaaggagggctatgacagcctgaagccagatgactag

SEQ ID NO: 36851 - DNA, 930 bp, Artificial Sequence
  Description of Artificial Sequence: Synthetic coding sequence
atgcctgctgagggcggcaagacagacatggagagaattggcctcttcagcgagatggagtacatcaccgtgggggacaagtatgtgtcccagttcaaccggcccttcaatgaagctgccagcaagaacaagcagatgctgcccggcggcagcaaggagatgtctgacctgcaggccggctactttgacccccactttgtgcgcatctttgaaggagagggctacatcaacctgaaccaggtgagaagaagagacatggtggaggccgccaagaagaacctgggcaaggccttcctgcccagcaatggagagaagaagccctgtggcctgggcagctactacggcaccatcggcggccctgtgcccttcttcagcgcccagagcaagccccgggagaagtacaaggcccctgggaagaacctgtacaccaaccctgggaagaagggcaccggctacggctacgccaacatcaccatcggcaagcagttcagccacagcgctgacttctatgatgctgccaagctgaagtacaagaaggccaatgaggagcaccaccggctgctgaagggggcccccttcaagctgaacctgcacccccgggactactttgatgccaacccctacttcagcgaggagagcctgccccccatcaagaaggaggagaagaagaagaccatcagcaacaccttcaagcccagcagccctgggaagaagccaggcggcatgaaggccggcacctttgacccctaccccagccacagcgctgacccctacgtggccaagctggccaacatcagcggcaaggatgacaagatcttccaccccccatctggccccaagagcaggcctgtggagagcatcatgaccctgaatgtgagaagagccctgaacagcaagaactacaagaccagctctgtgcccagctactag

SEQ ID NO: 36852 - DNA, 486 bp, Artificial Sequence
  Description of Artificial Sequence: Synthetic coding sequence
atgcctgctgagggcggcaagacagacatggagagaattggcctcttcagcgagatggagtacatcaccgtgggggacaagtatgtgtcccagttcaaccggcccttcaatgaagctgccagcaagaacaagcagatgctgcccggcggcagcaaggagatgtctgacctgcaggccggctactttgacccccactttgtgcgcatctttgaaggagagggctacatcaacctgaaccaggtgagaagaagagacatggtggaggccgccaagaagaacctgggcaaggccttcctgcccagcaatggagagaagaagccctgtggcctgggcagctactacggcaccatcggcggccctgtgcccttcttcagcgcccagagcaagccccgggagaagtacaaggcccctgggaagaacctgtacaccaaccctgggaagaagggcaccggctacggctacgccaacatcaccatcggcaagtag

SEQ ID NO: 36853 - DNA, 537 bp, Artificial Sequence
  Description of Artificial Sequence: Synthetic coding sequence
atgcctgctgagggcggcaagacagacatggagagaattggcctcttcagcgagatggagtacatcaccgtgggggacaagtatgtgtcccagttcaaccggcccttcaatgaagctgccagcaagaacaagcagatgctgcccggcggcagcaaggagatgtctgacctgcaggccggctactttgacccccactttgtgcgcatctttgaaggagagggctacatcaacctgaaccaggtgagaagaagagacatggtggaggccgccaagaagaacctgggcaaggccttcctgcccagcaatggagagaagaagccctgtggcctgggcagctactacggcaccatcggcggccctgtgcccttcttcagcgcccagagcaagccccgggagaagtacaaggcccctgggaagaacctgtacaccaaccctgggaagaagggcaccggctacggctacgccaacatcaccatcggcaagcagttcagccacagcgctgacttctatgatgctgccaagctgaagtacaagtag

SEQ ID NO: 36854 - DNA, 831 bp, Artificial Sequence
  Description of Artificial Sequence: Synthetic coding sequence
atgctgcgggacagcgaggccgaggtgacagaggaggacccccggctgcgggcccagcagctgcaccaccgggtgctgaccctgcagtgccagctgcgggaccagggcgccgcccaccaggccagcctggatgaggccacccggctgcaggaggagctgcaggccaagctggaggagctgcagaagaagcagcacgaggccaagctggccgtgacccccctgaaggccaagatcgccagcctggtgaggaagtgccgggagaggaacagactcatcacccacctgctgcaggagctgcaccgccacggcctgggcaacctgctgctgtctgagctggcccagaacatgctgaatgatgtggccctggccgagtacacagccaccttcctggcccctggggtgcctgagaccagccaccacctggatgtgaagtctgagatgacagctgccctgcgggcccagacctacctgctgaaccctgagatggacagcgtgctgcagagcagcctgagcagcgagagctggcccatccctgagcctgagtggccagcccagacagcccagctggacagcctgaagctgcccctgagcctggtgtccaccctggaccccggcacctgcctggccgctgtgacagtggagcccggcctgcctgcccagaggctgcaggagaagggcggcatgccctgcccagccctgcaggtggacaacgtgcctgcccccagcgagctgctgagccctgcccgcatcctggccttccaccaggagctgcggcagagcatctgcagcaacagccaggtgcacaagagccccctggagctggagatgtag

SEQ ID NO: 36855 - DNA, 2253 bp, Artificial Sequence
  Description of Artificial Sequence: Synthetic coding sequence
atgctgttctttgctggggagaccggcctgcccctcttccccaggtttgccctgtctgtggagggcgctgagcccacagaccacggccacccccaggccgtgtccaagggccacaacagatgtgccctgaccattgatgagctggcccaggatgtggaggcctgcttccagcagctgagcaccctgcagcccggcagccggggctggcagtgcagcgccagcgcctgcagaggagagaactggagctttgcccagaagtggcacagcggctgggagcgggcccacagccagcaggtgtggggcaactggggcatctgcagcaatgaggaggccaagagcaaggagagcggggagggggacaagccaggcaagaccacagccctgggcaccagcgaggtgcccggcaaccctggcaccctgccccactgggatgaggccagccccaaccccccccagggccctgctgagccctggggcgccctggagcgggtgcgcagccgcttccaccagctgatcagcggcctgaagaagcagaggagccagatcctgcatgacaacaccaagctgcacggggaccaggagcgcttccacgagcgggtgtgtgccctggagcgggagcgggagcgggaggtgaccaagatcagccggctggagcgggacaaccaccggctggtgggggacatcagccagctgaagaaggagctggaccagtacctgcaggccatcagtgacctggaggactgcaatggcaagagctactgcaagatcctggagctggaggaggagaatgagaccctgaagggcaacctgggccagctgcagaaggccaccagcgagagcgtgaggaagagcaaggacaccatggagcaggtgaccctggagaactggaagctgcagaccctcatcagcgagctgggcgtgtcctacaaggagctgatcaaggacatcgtgctgggcatcgaggacatgatccgggccctgagcggggagaatgagcacctgctgcggcgggtgcacgtgctggagcgggaggtgaccctgcagaggagcacagaccagggccgcctggtgcggggccgggagcacctgcagggcaaggccaagatgcacgccctggacaaggaggtgcaggtgacccccctgaccggccagctgctgagccgggcctgtggcccccccctggaggaggagatgagcctggccgccggccagacaggccccagcactggaactggaaacagcagaagaggagctgacagccccccacccagcctggtgtggaggaacacaggagtggccaatgccctgcagggcaatgtgtctggagctgaggtgaaggaggcccacctggagaaggaggagaagaggccccgctgcagcgtggcccagggccaggccctgagcagcctgagcaatggccccatgctgcgggacagcgaggccgaggtgacagaggaggacccccggctgcgggcccagcagctgcaccaccgggtgctgaccctgcagtgccagctgcgggaccagggcgccgcccaccaggccagcctggatgaggccacccggctgcaggaggagctgcaggccaagctggaggagctgcagaagaagcagcacgaggccaagctggccgtgacccccctgaaggccaagatcgccagcctggtgaggaagtgccgggagaggaacagactcatcacccacctgctgcaggagctgcaccgccacggcctgggcaacctgctgctgtctgagctggcccagaacatgctgaatgatgtggccctggccgagtacacagccaccttcctggcccctggggtgcctgagaccagccaccacctggatgtgaagtctgagatgacagctgccctgcgggcccagacctacctgctgaaccctgagatggacagcgtgctgcagagcagcctgagcagcgagagctggcccatccctgagcctgagtggccagcccagacagcccagctggacagcctgaagctgcccctgagcctggtgtccaccctggaccccggcacctgcctggccgctgtgacagtggagcccggcctgcctgcccagaggctgcaggagaagggcggcatgccctgcccagccctgcaggtggacaacgtgcctgcccccagcgagctgctgagccctgcccgcatcctggccttccaccaggagctgcggcagagcatctgcagcaacagccaggtgcacaagagccccctggagctggagatgtag

SEQ ID NO: 36856 - DNA, 609 bp, Artificial Sequence
  Description of Artificial Sequence: Synthetic coding sequence
atgagccactacttctacctgaccccccagatcctgctgcccttcagccccctgaccagccaggagtttgacctgatccggaggaaggccggggcctcctggcaggatgagacccgctggagcgacagctctgtgaccacctacacaggcagctacaggaagaagcagctggacaagtccatgtgcagccagttctccttccgggccggccagcacgagcctgagtgcaagcagatgagcctgaccaacagcagcgcctgccacctgctgtgctgggccggcacccaggagaccacagacatcaagggcctcttcccagacatcacccggcccttcaagaagagctttgatgtgaagcacggcgtggcccaccagatctgggactttggagactgcttccccaccccacccaactacggcaagtactgtgtgcggcccaagaagccagcccaggaggccctgatcaactacagcagaagaggcaagggcgtgctgaagcacctgcacggccgctgtgacagcgagagcaaggtgtgcagcagcgaggacagcgaggccgaccgctacagcgactatggctggggcggccccagcagccccttcaactag

SEQ ID NO: 36857 - DNA, 489 bp, Artificial Sequence
  Description of Artificial Sequence: Synthetic coding sequence
tgagacagctctgtgaccacctacacaggcagctacaggaagaagcagctggacaagtccatgtgcagccagttctccttccgggccggccagcacgagcctgagtgcaagcagatgagcctgaccaacagcagcgcctgccacctgctgtgctgggccggcacccaggagaccacagacatcaagggcctcttcccagacatcacccggcccttcaagaagagctttgatgtgaagcacggcgtggcccaccagatctgggactttggagactgcttccccaccccacccaactacggcaagtactgtgtgcggcccaagaagccagcccaggaggccctgatcaactacagcagaagaggcaagggcgtgctgaagcacctgcacggccgctgtgacagcgagagcaaggtgtgcagcagcgaggacagcgaggccgaccgctacagcgactatggctggggcggccccagcagccccttcaactag

SEQ ID NO: 36858 - DNA, 507 bp, Artificial Sequence
  Description of Artificial Sequence: Synthetic coding sequence
atggtgaaggaggtgtggagggtgctgcgggaggagcctggaagaaggaaggagagccggcagaacagagcccggggcaacagagtgcagcagaacagcagcaacctgaaccccaccccagcccctggcccccacagcacagagagccggggcagaagaagagctggcagcgaggcccctcctgtgcccggcagcgagagcctgagcaccagcagcgagcggggccacggccctgctgtgggcaacctggtgtctgagagcgctggccgctctgctggccagggcagccctggcccagatgccatgagcaggaacctgaggacagccctgatctttggaggcttcatcagcctgattggagctgccttctaccccatctacttccggcccctgatgaggctggaggagtacaagaaggagcaggccatcaacagagctggcatcgtgcaggaggatgtgcagcccccaggcctgaaggtgtggagcgacccctttggaaggaagtag

SEQ ID NO: 36859 - DNA, 204 bp, Artificial Sequence
  Description of Artificial Sequence: Synthetic coding sequence
atgagcaggaacctgaggacagccctgatctttggaggcttcatcagcctcatcggggccgccttctaccccatctacttccggcccctgatgaggctggaggagtacaagaaggagcaggccatcaacagagctggcatcgtgcaggaggatgtgcagcccccaggcctgaaggtgtggagcgaccccttcggcaggaagtag

SEQ ID NO: 36860 - DNA, 282 bp, Artificial Sequence
  Description of Artificial Sequence: Synthetic coding sequence
atggacacccagaagcagatccacaagacccacaacagcaagaaccagttcttcaccatcttcttcttcctgtctgtggagtttgggaaggagggcaccaggaagaacttctacctgctgctgagcatcggccactacggcaggaagagcagaagagctgacctgggcacagctgacacagctgacaagacagagccagaatgttttgctgcctcctggacctttgaccccaaccccagcgtgacagtgtctggggcccacagcacagctgtgcaccagtag

SEQ ID NO: 36861 - DNA, 477 bp, Artificial Sequence
  Description of Artificial Sequence: Synthetic coding sequence
atgcctgagccccccacccccagcgtgggcagctgtgccgcccgggccagcaggatgtctgctgccccctgcagccgggcccccagccccatcgaccaccccagggctgaggagtgtggccgggccgcccgggactggcaggccgcccccccagctgcccctgtgcgggaccccctgggggaggcctcctgggcccctgagagcggggaggacatggagaacctgtatgtgcagctgaagctgcagagcgtgggcacctgcttcaaccgggaggagctgcccagcgtgctgcagggcgaggagctgggcgccacctctgtgaccaacaagccaggcctgagcgccatgaggaaggagacagaccagcaggtgggggagaggaagctgacctactgtggggaccaggtgaccctcttcacagaccaggccctgagccagatcctgagcagcgaggagggccgcatcaaggtgatgtag

SEQ ID NO: 36862 - DNA, 1329 bp, Artificial Sequence
  Description of Artificial Sequence: Synthetic coding sequence
atgtctgacagcgctgggggccgggccggcctgcggcgctaccccaagctgcctgtgtgggtggtggaggaccaccaggaggtgctgcccttcatctaccgggccatcggcagcaagcacctgcctgccagcaatgtgtccttcctgcactttgacagccacccagacctgctgatccctgtgaacatgcctgctgacacagtgtttgacaaggagaccctgtttggagagctgagcattgagaactggatcatgcctgctgtgtatgccggccacttcagccacgtgatctggttccaccccacctgggcccagcagatccgggagggccgccaccacttcctggtgggcaaggacaccagcaccaccaccatccgggtgaccagcacagaccactacttcctgagtgatggcctgtatgtgcctgaggaccagctggagaaccagaagcccctgcagctggatgtgatcatggtgaagccctacaagctgtgcaacaaccaggaggagaatgatgctgtgagcagcgccaagaagcccaagctggccctggaggacagcgagaacacagccagcaccaactgtgacagcagcagcgagggcctggagaaggacacagccacccagaggagtgaccagacctgcctggagcccagctgcagctgcagcagcgagaaccaggagtgccagacagctgccagcactggagagatcctggagatcctgaagaagggcaaggcctttgtgctggacatcgacctggacttcttctctgtgaagaaccccttcaaggagatgttcacccaggaggagtacaagatcctgcaggagctgtaccagttcaagaagccaggcaccaacctgacagaggaggacctggtggacatcgtggacacccgcatccaccagctggaggacctggaggccacctttgctgacctgtgtgatggagatgatgaggagaccgtgcagcgctgggccagcaaccctggcatggagagcctggtgcccctggtgcagagcctgaagaagaggatggaggtgcctgactatgagatggtgcaccaggccggcctgacctgtgactacagcgagctgccccaccacatcagcacagagcaggagattgaatgtctcatccagagcgtgcactacctgctgaagaacctgcccaaccccaccctggtgaccatcgcccggagcagcctggatgactactgccccagcgaccaggtggacaccatccaggagaaggtgctgaacatgctgcgggccctgtatggcaacctggacctgcaggtgtatgctgctgagagcccccccagctag

SEQ ID NO: 36863 - DNA, 492 bp, Artificial Sequence
  Description of Artificial Sequence: Synthetic coding sequence
atggaggtgcctgactatgagatgtttcctgccagcagcagcagccccagcgagaccaccagcgcctggatcagcctgtccatgagcctgagcgccttctggagcaagcccttcaacaagagcctgggcagcagcaagctgagcaacatcagcctgcccagcagcgagcccagcaagctgttccagcccctgcctgtgcccaagctgctgccccacttccaggtgcaccaggccggcctgacctgtgactacagcgagctgccccaccacatcagcacagagcaggagattgagtgcctgatccagagcgtgcactacctgctgaagaacctgcccaaccccaccctggtgaccatcgcccggagcagcctggatgactactgccccagcgaccaggtggacaccatccaggagaaggtgctgaacatgctgcgggccctgtatggcaacctggacctgcaggtgtatgctgctgagagcccccccagctag

SEQ ID NO: 36864 - DNA, 534 bp, Artificial Sequence
  Description of Artificial Sequence: Synthetic coding sequence
ctggtgtcccaggaggagtacaagatcctgcaggagctgtaccagttcaagaagccaggcaccaacctgacagaggaggacctggtggacatcgtggacacccgcatccaccagctggaggacctggaggccacctttgctgacctgtgtgatggagatgatgaggagaccgtgcagcgctgggccagcaaccctggcatggagagcctggtgcccctggtgcagagcctgaagaagaggatggaggtgcctgactatgagatggtgcaccaggccggcctgacctgtgactacagcgagctgccccaccacatcagcacagagcaggagattgagtgcctgatccagagcgtgcactacctgctgaagaacctgcccaaccccaccctggtgaccatcgcccggagcagcctggatgactactgccccagcgaccaggtggacaccatccaggagaaggtgctgaacatgctgcgggccctgtatggcaacctggacctgcaggtgtatgctgctgagagcccccccagctag

SEQ ID NO: 36865 - DNA, 567 bp, Artificial Sequence
  Description of Artificial Sequence: Synthetic coding sequence
atgatgcaccctgtggccagcagcaacccagccttctgtggccctgggaagcccagctgcctgaatgaagatgccatgagagctgctgaccagtttgacatctacagcagccagcagagcaagtacagccacacagtgaaccacaagcccatggtgtgccagaggcaggaccccctgaatgagacccacctgcagaccaccagcggccgcagcattgagatcaaggatgagctgaagaagaagaagaacctgaacagaagtggcaagaggggccggcccagcggcaccaccaagtctgctggctaccgcaccagcacaggccggcccctgggcaccaccaaggccgccggcttcaagaccagccctggccggcccctgggcaccaccaaggccgccggctacaaggtgtccccaggccggcccccaggcagcatcaaggccctgagccggctggccgacctgggctacggctgcggcacagctgccttcccctaccccatgatgcacggccgggctgtgcacggcgtggaggagaccagcagcgaggtgaagcccccaaatgaatag

SEQ ID NO: 36866 - DNA, 567 bp, Artificial Sequence; identical to SEQ ID NO: 36865
  Description of Artificial Sequence: Synthetic coding sequence

SEQ ID NO: 36867 - DNA, 567 bp, Artificial Sequence; identical to SEQ ID NO: 36865
  Description of Artificial Sequence: Synthetic coding sequence

SEQ ID NO: 36868 - DNA, 24 bp, Artificial Sequence
  Description of Artificial Sequence: Synthetic coding sequence
atgatgcaccctgtggccagctag

SEQ ID NO: 36869 - DNA, 1002 bp, Artificial Sequence
  Description of Artificial Sequence: Synthetic coding sequence
atgcccaggagctttgagcaggtgatcatcctgaagaagtggttcctgaagccctacaagggccagaccctgcccggccgggtgctcttcctgcgctacgtggtgcagaccctggaggatgacttccagcagaccctgcggcggcagaggcagcacctgcagcagagcatcgccaacatggtgctgagctgtgacaagcagccccacaacgtgagagatgtgatcaagtggctggtgaaggctgtgacagaagatggcctgacccagccccccaacggcaaccagaccagcagcggcaccggcatcctgaaggccagcagcagccaccccagcagccagcccaacctgaccaagaacaccaaccagctgattgtgtgccagctgcagaggatgctgagcattgctgtggaggtggacaggacccccacctgcagcagcaacaagattgctgagatgatgtttggatttgtgctggacatccctgagaggagccagcgggagatgttcttcaccaccatggagagccacctgctgcgctgcaaggtgctggagatcatcttcctgcacagctgtgagacccccacccggctgcccctgagcctggcccaggccctgtacttcctgaacaacagcaccagcctgctgaagtgccagagcgacaagagccagtggcagacctgggatgagctggtggagcacctgcagttcctgctgagcagctaccagcacgtgctgcgggagcacctgcggagcagcgtcatcgacaggaaggacctgatcatcaagaggatcaagcccaagccccagcagggagatgacatcaccgtggtggatgtggagaagcagatcgaggccttccgcagccgcctcatccagatgctgggggagcccctggtgccccagctgcaggacaaggtgcacctgctgaagctgctgctcttctacgccgctgacctgaacccagatgctgagcccttccagaagggctggagcggcagctag

SEQ ID NO: 36870 - DNA, 1374 bp, Artificial Sequence
  Description of Artificial Sequence: Synthetic coding sequence
atggaggacttcatcgtcatcagtgatgattctggcagcgagagcagcggcggggcccggcccggccgcagcagaagaccccggcgggccctgagcaggaccagcggggccctgcccaggagaacagtgaacaagggccagaagctggagcccatcccccaccggcggctgaggatggtgaccaacaccatcgaggagaacttccccctgggcaccgtgcagttcctgatggactttgtgagcccccagcactacccaccccgggagatcgtggcccacatcatccagaagatcctgctgagcggcagcgagaccgtggatgtgctgaaggaggcctacatgctgctgatgaagatccagcagctgcacccagccaatgccaagacagtggagtgggactggaagctgctgacctacgtgatggaggaggagggccagaccctgcccggccgggtgctcttcctgcgctacgtggtgcagaccctggaggatgacttccagcagaccctgcggcggcagaggcagcacctgcagcagagcatcgccaacatggtgctgagctgtgacaagcagccccacaacgtgagagatgtgatcaagtggctggtgaaggctgtgacagaagatggcctgacccagccccccaacggcaaccagaccagcagcggcaccggcatcctgaaggccagcagcagccaccccagcagccagcccaacctgaccaagaacaccaaccagctgattgtgtgccagctgcagaggatgctgagcattgctgtggaggtggacaggacccccacctgcagcagcaacaagattgctgagatgatgtttggatttgtgctggacatccctgagaggagccagcgggagatgttcttcaccaccatggagagccacctgctgcgctgcaaggtgctggagatcatcttcctgcacagctgtgagacccccacccggctgcccctgagcctggcccaggccctgtacttcctgaacaacagcaccagcctgctgaagtgccagagcgacaagagccagtggcagacctgggatgagctggtggagcacctgcagttcctgctgagcagctaccagcacgtgctgcgggagcacctgcggagcagcgtcatcgacaggaaggacctgatcatcaagaggatcaagcccaagccccagcagggagatgacatcaccgtggtggatgtggagaagcagatcgaggccttccgcagccgcctcatccagatgctgggggagcccctggtgccccagctgcaggacaaggtgcacctgctgaagctgctgctcttctacgccgctgacctgaacccagatgctgagcccttccagaagggctggagcggcagctag

SEQ ID NO: 36871 - DNA, 978 bp, Artificial Sequence
  Description of Artificial Sequence: Synthetic coding sequence
atggagggccacgtggacaggagcagccagcccacagcccggcgcatcatcaacagcgaccctgtggacctggacctggtggaggagaacacctttgtgggccccccaccagccaccagcatcagcggcggctctgtgtaccccacagagcccaactgcagcagcgccaccttcaccggcaacctgtccttcctggccagcctgcagctgagcagtgatgtgagcagcctgagccccaccagcaacaacagccgcagcagcagcagcagcagcaaccagaaggcccccctgccctgcccccagcaggatgtgtccaggcctccccaggccctgccctgccccctgcggcccctgccctgccccccccgggccagcccctgccccccccgggccagcagctgccccccccgggccctgagctgccccagccagaccatgcagtgccagctgcctgccctgacccaccccccccaggaggtgccctgcccccggcagaacatccctggccccccccaggacagcctgggcctgccccaggatgtgcccggcctgccccagagcatcctgcacccccaggatgtggcctacctgcaggacatgcccaggagccctggagatgtgccccagagccccagtgatgtgagccccagcccagatgccccccagagccctgggggcatgccccacctgcctggagatgtgctgcacagccctggggacatgccccacagcagtggagatgtgacccacagcccccgggacatcccccacctgcccggggacagaccagacttcacccagaatgatgtgcagaacagagacatgcccatggacatcagcgccctgagcagccccagctgcagccccacctggggcacagagcaggacagcgtgaagaagaagaagaagaagaagaggaaggagatcccccccaacttcctgctcttcaacctgtaccgcaccagggtgaagaactag

SEQ ID NO: 36872 - DNA, 1836 bp, Artificial Sequence
  Description of Artificial Sequence: Synthetic coding sequence
atggaggacttcatcgtcatcagtgatgattctggcagcgagagcagcggcggggcccggcccggccgcagcagaagaccccggcgggccctgagcaggaccagcggggccctgcccaggagaacagtggacttcatcgacctgacccgggagacccggcccaggaccaaggacaggagcggcctgtatgtgattgacctgaccagggcagaaggagaaaatcggcccatcgccaccctggacctgaccctggagcctgtgacccccagccagaaggagcccaccagcctgcagacctgtgccagcctgagcggcaaggctgtgatggagggccacgtggacaggagcagccagcccacagcccggcgcatcatcaacagcgaccctgtggacctggacctggtggaggagaacacctttgtgggccccccaccagccaccagcatcagcggcggctctgtgtaccccacagagcccaactgcagcagcgccaccttcaccggcaacctgtccttcctggccagcctgcagctgagcagtgatgtgagcagcctgagccccaccagcaacaacagccgcagcagcagcagcagcagcaaccagaaggcccccctgccctgcccccagcaggatgtgtccaggcctccccaggccctgccctgccccctgcggcccctgccctgccccccccgggccagcccctgccccccccgggccagcagctgccccccccgggccctgagctgccccagccagaccatgcagtgccagctgcctgccctgacccaccccccccaggaggtgccctgcccccggcagaacatccctggccccccccaggacagcctgggcctgccccaggatgtgcccggcctgccccagagcatcctgcacccccaggatgtggcctacctgcaggacatgcccaggagccctggagatgtgccccagagccccagtgatgtgagccccagcccagatgccccccagagccctgggggcatgccccacctgcctggagatgtgctgcacagccctggggacatgccccacagcagtggagatgtgacccacagcccccgggacatcccccacctgcccggggacagaccagacttcacccagaatgatgtgcagaacagagacatgcccatggacatcagcgccctgagcagccccagctgcagccccagcccccagagcgagacccccctggagaaggtgccctggctgtctgtgatggagaccccagccaggaaggagatcagcctgtctgagcccgccaagccaggcagcgcccacgtgcagagcaggaccccccagggcggcctgtacaaccggccctgcctgcaccggctgaagtacttcctgcggccccctgtgcaccacctgttcttccagaccctcatcccagacaaggacaccagagaaaataaaggccagaagctggagcccatcccccaccggcggctgaggatggtgaccaacaccatcgaggagaacttccccctgggcaccgtgcagttcctgatggactttgtgagcccccagcactacccaccccgggagatcgtggcccacatcatccagaagatcctgctgagcggcagcgagaccgtggatgtgctgaaggaggcctacatgctgctgatgaagatccagcagctgcacccagccaatgccaagacagtggagtgggactggaagctgctgacctacgtgatggaggaggagccagcagaatgtctgcggctgcaggcccgggccaccaccccagactggttctggtggaggcggggctttgctgtgctggccggccctgtgagcagcccctag

SEQ ID NO: 36873 - DNA, 1374 bp, Artificial Sequence; identical to SEQ ID NO: 36870
  Description of Artificial Sequence: Synthetic coding sequence

SEQ ID NO: 36874 - DNA, 2619 bp, Artificial Sequence
  Description of Artificial Sequence: Synthetic coding sequence
atggccccagccagcgccagcggggaggacctgaggaagctgcccaccatggccgaggtgaatggagagcaggacttcatcgacctgacccgggagacccggcccaggaccaaggacagaagtggcctgtatgtgattgacctgaccagggctgagggggagaaccggcccatcgccaccctggacctgaccctggagcctgtgacccccagccagaaggagcccaccagcctgcagacctgtgccagcctgagcggcaaggctgtgatggagggccacgtggacaggagcagccagcccacagcccggcgcatcatcaacagcgaccctgtggacctggacctggtggaggagaacacctttgtgggccccccaccagccaccagcatcagcggcggctctgtgtaccccacagagcccaactgcagcagcgccaccttcaccggcaacctgtccttcctggccagcctgcagctgagcagtgatgtgagcagcctgagccccaccagcaacaacagccgcagcagcagcagcagcagcaaccagaaggcccccctgccctgcccccagcaggatgtgtcccggcccccccaggccctgccctgccccctgcggcccctgccctgccccccccgggccagcccctgccccccccgggccagcagctgccccccccgggccctgagctgccccagccagaccatgcagtgccagctgcctgccctgacccaccccccccaggaggtgccctgcccccggcagaacatccctggccccccccaggacagcctgggcctgccccaggatgtgcccggcctgccccagagcatcctgcacccccaggatgtggcctacctgcaggacatgcccaggagccctggagatgtgccccagagccccagtgatgtgagccccagcccagatgccccccagagccctgggggcatgccccacctgcctggagatgtgctgcacagccctggggacatgccccacagcagtggagatgtgacccacagcccccgggacatcccccacctgcccggggacagaccagacttcacccagaatgatgtgcagaacagagacatgcccatggacatcagcgccctgagcagccccagctgcagccccagcccccagagcgagacccccctggagaaggtgccctggctgtctgtgatggagaccccagccaggaaggagatcagcctgtctgagcccgccaagccaggcagcgcccacgtgcagagcaggaccccccagggcggcctgtacaaccggccctgcctgcaccggctgaagtacttcctgcggccccctgtgcaccacctgttcttccagaccctcatcccagacaaggacacccgggagaacaagggccagaagctggagcccatcccccaccggcggctgaggatggtgaccaacaccatcgaggagaacttccccctgggcaccgtgcagttcctgatggactttgtgagcccccagcactacccaccccgggagatcgtggcccacatcatccagaagatcctgctgagcggcagcgagaccgtggatgtgctgaaggaggcctacatgctgctgatgaagatccagcagctgcacccagccaatgccaagacagtggagtgggactggaagctgctgacctacgtgatggaggaggagggccagaccctgcccggccgggtgctcttcctgcgctacgtggtgcagaccctggaggatgacttccagcagaccctgcggcggcagaggcagcacctgcagcagagcatcgccaacatggtgctgagctgtgacaagcagccccacaacgtgagagatgtgatcaagtggctggtgaaggctgtgacagaagatggcctgacccagcccccaaatggaaaccagaccagcagcggcaccggcatcctgaaggccagcagcagccaccccagcagccagcccaacctgaccaagaacaccaaccagctgattgtgtgccagctgcagaggatgctgagcattgctgtggaggtggacaggacccccacctgcagcagcaacaagattgctgagatgatgtttggatttgtgctggacatccctgagaggagccagcgggagatgttcttcaccaccatggagagccacctgctgcgctgcaaggtgctggagatcatcttcctgcacagctgtgagacccccacccggctgcccctgagcctggcccaggccctgtacttcctgaacaacagcaccagcctgctgaagtgccagagcgacaagagccagtggcagacctgggatgagctggtggagcacctgcagttcctgctgagcagctaccagcacgtgctgcgggagcacctgcggagctctgtgattgacaggaaggacctgatcatcaagaggatcaagcccaagccccagcagggagatgacatcaccgtggtggatgtggagaagcagatcgaggccttccgcagccgcctcatccagatgctgggggagcccctggtgccccagctgcaggacaaggtgcacctgctgaagctgctgctcttctatgctgctgacctgaacccagatgctgagcccttccagaagggctggagcggcagctag

SEQ ID NO: 36875 - DNA, 291 bp, Artificial Sequence
  Description of Artificial Sequence: Synthetic coding sequence
atgaccccctgcctggagagcttctgccagagggccaaggactgcaagcagaacatccccctgcccttcctgatccaggactggcccctgtctgagagcaagccccagggccaggacttctggaccccccagcccctgcaggccgccgcccccagccatgagttccagcaggtggccctgcacccagcccggacccggctggccagccggccccagggcggccgcctgatgagcagccgggaggtgggcctgcgggccccccgctgcagctgtgggaagaggaagaggtag

SEQ ID NO: 36876 - DNA, 291 bp, Artificial Sequence; identical to SEQ ID NO: 36875
  Description of Artificial Sequence: Synthetic coding sequence

SEQ ID NO: 36877 - DNA, 621 bp, Artificial Sequence
  Description of Artificial Sequence: Synthetic coding sequence
atggaggtggacatcaacggggagagccgcagcaccctgaccaccctgcccttccctggagctgaggccaacagccctgggaaggccgaggccgagaagccccgctgcagcagcaccccctgcagccccatgagaagaacagtgtctggctaccagatcctgcacatggacagcaactacctggtgggcttcaccaccggggaggagctgctgaagctggcccagaagtgcaccggcggggaggagagcaaggccgaggccatgcccagcctgcggagcaagcagctggatgctggcctggcccggagcagccggctgtacaagaccaggagccgctactaccagccctatgagatcccagctgtgaatggaagaagaagaagaaggatgcccagcagcggggacaagtgcaccaagagcctgccctatgagccctacaaggccctgcacggccccctgcccctgtgcctgctgaagggcaagagggcccacagcaagagcctggactacctgaacctggacaagatgatcaaggagcctgctgacacagaggtgctgcagtaccagctgcagcacctgaccctgcggggggacagagtgtttgccaggaacaacacctag

SEQ ID NO: 36878 - DNA, 621 bp, Artificial Sequence; identical to SEQ ID NO: 36877
  Description of Artificial Sequence: Synthetic coding sequence

SEQ ID NO: 36879 - DNA, 621 bp, Artificial Sequence; identical to SEQ ID NO: 36877
  Description of Artificial Sequence: Synthetic coding sequence

SEQ ID NO: 36880 - DNA, 621 bp, Artificial Sequence; identical to SEQ ID NO: 36877
  Description of Artificial Sequence: Synthetic coding sequence

SEQ ID NO: 36881 - DNA, 294 bp, Artificial Sequence
  Description of Artificial Sequence: Synthetic coding sequence
atgaaccaggagaaccccccaccctacccaggccctggccccacagccccctacccaccctacccaccccagcccatgggccctggccccatgggcggcccctaccccccaccccagggctacccctaccagggctacccccagtatggctggcagggcggcccccaggagccccccaagaccaccgtgtatgtggtggaggaccagaggagagatgagctgggccccagcacctgcctgacagcctgctggacagccctgtgctgctgctgcctgtgggacatgctgacctag

SEQ ID NO: 36882 - DNA, 1917 bp, Artificial Sequence
  Description of Artificial Sequence: Synthetic coding sequence
atggctgctgagctgaggatgatcctgtatgaagatgacagcgtgcaggtgcagtatgtggatggcagcaccctgcagctgagcccctgtggcacagagttcctgtttgagaagagcccccctgtgtctgcccaccccctggagcagcctgagcgcatccggcagaggacccactttgtgatcagcacctaccgggagcagctgcagagggccctggacttcaggaacagcagcgccacctgccccttcctgtctgagaccatcatccccagcgagaggaagaagcacatcttcatcgacatcacagaggtgcgctggcccagcctggacacagatggcaccatgatctacatggagagcggcatcgtgaagatcaccagcctggatggccacgcctacctgtgcctgcccaggagccagcacgagttcaccgtgcacttcctgtgcaaggtgtcccagaagagtgacagcagcgctgtgctgtctgagaccaacaacaaggcccccaaggacaagctggtggagaagacaggcaagatctgcatccggggcaacctgcccggccagaggctgaagaacaaggaaaatgagttccactgccagatcatgaagagcaaggagaccctgaagaagatgagctgtgtgaatggaacagagggccgggaggagctgcccagccctggcaccaagcacacctgtgtgtacacctgggtgaagcagtgctggagcgtggccgcctgcccagaggagtggaagtaccccctgagcctggccctgcacttccacaacaagatcagcaacatgagcaagattgatgcccacatcacccagagccgcttcctgaccagtgacatcagcgaggagcggggcaaggtggtgtctgtgctgccccgggccctgagcctgagctgccctgtgccccacctgcaccgctggaacttctgtgacagcctgctgcagaggcagagtgatgagtacagctacccagagctggtgaagatggtgtggtacaagggcgtgacctaccgcctgacccaccagaacatgaacagcattgagatctacagcggagatggcagcgtcttcaagtctgagggcgcctactttggaaactacttcacctactacagcatccaggagggcagcggcaagcgggaggagaagacctacagcgtgaacaacctgcccccagaccggcccggcagccccttcaccgtgggcagcctcatcaagcaggccacccgcatcctgcagcactgtgtgaagatgaggctgagcctgagccacaactaccgcatctgctgctggaagatggtgcccggcatcaatgacagcaacatcctgcccctggtgctgaaggagagcctcatccccagcgtgggccgcttcctggcctacagtgatgacaaggtgcacgccatcttcctggatggcatcaccctgaccctgaactggaacttcagcagccccatcgagaagaggcaggtgaaccagggcctgaacctgggctggtgcaagctgaccttcccagatggccaggagcagctgatccagatcgagcaccctgagccctatgagcgctacgtgaccaccgtgacctcctggtgccggcggctgacccagaccagcccccgggagatgcccacccacagcagcagctctgtgctgcaggagaactggagcgtggccagcgagctggagaagatccagaagttcaacctgctgctggagaacagcggcatcctgaaccagatcagcaacaagaagaatgagcagcagagctttgaccactacaagccaggcagcagcgagaccctgctgggggaggtgaatgaaaatagagtgtccatcgccctgaagaagaccagcgagatcctgcatgacatcgactgcctgctgagcaacagcaagaagtag

SEQ ID NO: 36883 - DNA, 900 bp, Artificial Sequence
  Description of Artificial Sequence: Synthetic coding sequence
atgcctggccgcctgctgcggggcctgtggcagcgctggaggcgctacaagtacagatttgtgccctggatcgccctgaacctgagccacaaccccaggaccctgcgctacgtgcctgaggagagcaaggacaaggtgatcagtgatgaagatgtgctgggcaccctgctgaaggtgttccaggccctcttcctgaatgacttcaacaagcagagcgagatcctgtccatgctgcctgagagcgtgaagagcaagtaccaggacctgctggccgtggagcaccagggcgtgaagctgctggagaacagacaccagcagcagagcaccttcaagccagaggagatcctgtacaagaccctgggcttctctgtggcccaggccaccagcagcctcatctctgctgggaagggcgtgtttgtgaccaagggcctggtgcccaagggagctgtggtgtccatgtacccaggcaccgtgtaccagaagtatgagcccatcttcttccagagcatcggcaaccccttcatcttccgctgcctggatggagtgctgattgatggaaatgacaagggcatcagcaaggtggtgtaccgcagctgcaatggccgggaccggctgggccccctgaagatgtctgacagcacctggctgaccagcgagatccacaaccccctggccgtgggccagtatgtgaacaactgcagcaatgaccgggccgccaacgtgtgctaccaggagtttgatgtgcctgctgtgttccccatcgagctgaagcagtacctgcccaacatcgcctacagctatgacaagcagagccccctgcgctgtgtggtgctggtggccctgcgggacatcaaccagggcgaggagctgttcagcaactactacaccatcgtgtcctag

SEQ ID NO: 36884 - DNA, 816 bp, Artificial Sequence
  Description of Artificial Sequence: Synthetic coding sequence
atgcctggccgcctgctgcggggcctgtggcagcgctggaggcgctacaagtacagatttgtgccctggatcgccctgaacctgagccacaaccccaggaccctgcgctacgtgcctgaggagagcaaggacaaggtgatcagtgatgaagatgtgctgggcaccctgctgaaggtgttccaggccctcttcctgaatgacttcaacaagcagagcgagatcctgtccatgctgcctgagagcgtgaagagcaagtaccaggacctgctggccgtggagcaccagggcgtgaagctgctggagaacagacaccagcagcagagcaccttcaagccagaggagatcctgtacaagaccctgggcttctctgtggcccaggccaccagcagcctcatctctgctgggaagggcgtgtttgtgaccaagggcctggtgcccaagggagctgtggtgtccatgtacccaggcaccgtgtaccagaagtatgagcccatcttcttccagagcatcggcaaccccttcatcttccgctgcctggatggagtgctgattgatggaaatgacaagggcatcagcaaggtggtgtaccgcagctgcaatggccgggaccggctgggccccctgaagatgtctgacagcacctggctgaccagcgagatccacaaccccctggccgtgggccagtatgtgaacaactgcagcaatgaccgggccgccaacgtgtgctaccaggagtttgatgtgcctgctgtgttccccatcgagctgaagcagtacctgcccaacatcgcctacagctatgacaagcagaggtag

SEQ ID NO: 36885 - DNA, 582 bp, Artificial Sequence
  Description of Artificial Sequence: Synthetic coding sequence
atggagcagcacttcctgggctgtgtgaagagggcctgggacagcgctgaggtggcccctgagccccagcccccacccatcgtgtccagtgaagatcggggcccctggcccctgcccctgtaccctgtgctgggggagtacagcctggacagctgtgacctgggcctgctgagcagcccctgctggaggctgcccggggtgtactggcagaatggcctgagccctggggtgcagagcaccctggagcccagcacagccaagcccacagagttctcctggccaggcacccagaagcagcaggaggcccctgtggaggaggtgggccaggccgaggagccagaccggctgcggctgcagcagctgccctggagcagccccctgcacccctgggaccggcagcaggacacagaggtgtgtgacagcggctgcctgctggagaggaggcaccccccagccctgcagccctggaggcacctgcccggcttcagtgactgcctggagtggatcctgcgggtgggctttgctgccttctctgtgctgtgggcctgctgcagccgcatctgtggggccaagcagccctag

SEQ ID NO: 36886 - DNA, 1920 bp, Artificial Sequence
  Description of Artificial Sequence: Synthetic coding sequence
atgccccagcccagcgtgtctggcatggaccccccatttggagatgccttccgcagccacaccttcagcgagcagaccctgatgagcacagacctgctggccaacagcagtgaccctgacttcatgtatgagctggaccgggagatgaactaccagcagaacccccgggacaacttcctgagcctggaggactgcaaggacatcgagaacctggagagcttcacagatgtgctggacaatgaaggagccctgaccagcaactgggagcagtgggacacctactgtgaggacctgaccaagtacaccaagctgaccagctgtgacatctggggcaccaaggaggtggactacctgggcctggatgacttcagcagcccctaccaggatgaggaggtgatcagcaagacccccaccctggcccagctgaacagcgaggacagccagagcgtgtctgacagcctgtactacccagacagcctcttctctgtgaagcagaaccccctgcccagcagcttccctgggaagaagatcaccagcagagctgctgcccctgtgtgcagcagcaagaccctgcaggccgaggtgcccctgagtgactgtgtgcagaaggccagcaagcccaccagcagcacccagatcatggtgaagaccaacatgtaccacaatgagaaggtgaacttccacgtggagtgcaaggactatgtgaagaaggccaaggtgaagatcaaccctgtgcagcagagccggcccctgctgagccagatccacacagatgctgccaaggagaacacctgctactgtggggctgtggccaagaggcaggagaagaagggcatggagcccctgcagggccacgccaccccagccctgcccttcaaggagacccaggagctgctgctgagccccctgccccaggagggccctggcagcctggccgccggggagagcagcagcctgagcgccagcacctctgtgtctgacagcagccagaagaaggaggagcacaactacagcctgtttgtgtctgacaacctgggggagcagcccaccaagtgcagccctgaggaggatgaagaagatgaggaggatgtggatgatgaagatcatgatgagggctttggaagtgaacatgagctgtctgaaaatgaggaggaggaggaggaggaggaggactatgaagatgacaaggatgatgacatcagtgacaccttcagcgagcccggctatgaaaatgattctgtggaggacctgaaggaggtgaccagcatcagcagcaggaagaggggcaagaggcgctacttctgggagtacagcgagcagctgacccccagccagcaggagaggatgctgcggcccagcgagtggaacagagacaccctgcccagcaacatgtaccagaagaatggcctgcaccacggcaagtatgctgtgaagaagagcagaagaacagatgtggaggacctgacccccaaccccaagaagctgctgcagattggaaatgagctgaggaagctgaacaaggtgatcagtgacctgacccctgtgtctgagctgcccctgacagcccggcccaggagcaggaaggagaagaacaagctggccagccgggcctgccgcctgaagaagaaggcccagtatgaggccaacaaggtgaagctgtggggcctgaacacagaatatgacaacctgctgtttgtgatcaacagcatcaagcaggagatcgtgaacagagtgcagaaccccagagatgagcggggccccaacatgggccagaagctggagatcctgatcaaggacaccctgggcctgcctgtggccggccagaccagcgagtttgtgaaccaggtgctggagaagacagctgagggcaaccccaccggcggcctggtgggcctgcgcatccccaccagcaaggtgtag

SEQ ID NO: 36887 - DNA, 1920 bp, Artificial Sequence
  Description of Artificial Sequence: Synthetic coding sequence
atccccaagcccagcgtgtctggcatggaccccccatttggagatgccttccgcagccacaccttcagcgagcagaccctgatgagcacagacctgctggccaacagcagtgaccctgacttcatgtatgagctggaccgggagatgaactaccagcagaacccccgggacaacttcctgagcctggaggactgcaaggacatcgagaacctggagagcttcacagatgtgctggacaatgaaggagccctgaccagcaactgggagcagtgggacacctactgtgaggacctgaccaagtacaccaagctgaccagctgtgacatctggggcaccaaggaggtggactacctgggcctggatgacttcagcagcccctaccaggatgaggaggtgatcagcaagacccccaccctggcccagctgaacagcgaggacagccagagcgtgtctgacagcctgtactacccagacagcctcttctctgtgaagcagaaccccctgcccagcagcttccctgggaagaagatcaccagcagagctgctgcccctgtgtgcagcagcaagaccctgcaggccgaggtgcccctgagtgactgtgtgcagaaggccagcaagcccaccagcagcacccagatcatggtgaagaccaacatgtaccacaatgagaaggtgaacttccacgtggagtgcaaggactatgtgaagaaggccaaggtgaagatcaaccctgtgcagcagagccggcccctgctgagccagatccacacagatgctgccaaggagaacacctgctactgtggggctgtggccaagaggcaggagaagaagggcatggagcccctgcagggccacgccaccccagccctgcccttcaaggagacccaggagctgctgctgagccccctgccccaggagggccctggcagcctggccgccggggagagcagcagcctgagcgccagcacctctgtgtctgacagcagccagaagaaggaggagcacaactacagcctgtttgtgtctgacaacctgggggagcagcccaccaagtgcagccctgaggaggatgaagaagatgaggaggatgtggatgatgaagatcatgatgagggctttggaagtgaacatgagctgtctgaaaatgaggaggaggaggaggaggaggaggactatgaagatgacaaggatgatgacatcagtgacaccttcagcgagcccggctatgaaaatgattctgtggaggacctgaaggaggtgaccagcatcagcagcaggaagaggggcaagaggcgctacttctgggagtacagcgagcagctgacccccagccagcaggagaggatgctgcggcccagcgagtggaacagagacaccctgcccagcaacatgtaccagaagaatggcctgcaccacggcaagtatgctgtgaagaagagcagaagaacagatgtggaggacctgacccccaaccccaagaagctgctgcagattggaaatgagctgaggaagctgaacaaggtgatcagtgacctgacccctgtgtctgagctgcccctgacagcccggcccaggagcaggaaggagaagaacaagctggccagccgggcctgccgcctgaagaagaaggcccagtatgaggccaacaaggtgaagctgtggggcctgaacacagaatatgacaacctgctgtttgtgatcaacagcatcaagcaggagatcgtgaacagagtgcagaaccccagagatgagcggggccccaacatgggccagaagctggagatcctgatcaaggacaccctgggcctgcctgtggccggccagaccagcgagtttgtgaaccaggtgctggagaagacagctgagggcaaccccaccggcggcctggtgggcctgcgcatccccaccagcaaggtgtag

SEQ ID NO: 36888 - DNA, 1254 bp, Artificial Sequence
  Description of Artificial Sequence: Synthetic coding sequence
atgccccagcccagcgtgtctggcatggaccccccatttggagatgccttccgcagccacaccttcagcgagcagaccctgatgagcacagacctgctggccaacagcagtgaccctgacttcatgtatgagctggaccgggagatgaactaccagcagaacccccgggacaacttcctgagcctggaggactgcaaggacatcgagaacctggagagcttcacagatgtgctggacaatgaaggagccctgaccagcaactgggagcagtgggacacctactgtgaggacctgaccaagtacaccaagctgaccagctgtgacatctggggcaccaaggaggtggactacctgggcctggatgacttcagcagcccctaccaggatgaggaggtgatcagcaagacccccaccctggcccagctgaacagcgaggacagccagagcgtgtctgacagcctgtactacccagacagcctcttctctgtgaagcagaaccccctgcccagcagcttccctgggaagaagatcaccagcagagctgctgcccctgtgtgcagcagcaagaccctgcaggccgaggtgcccctgagtgactgtgtgcagaaggccagcaagcccaccagcagcacccagatcatggtgaagaccaacatgtaccacaatgagaaggtgaacttccacgtggagtgcaaggactatgtgaagaaggccaaggtgaagatcaaccctgtgcagcagagccggcccctgctgagccagatccacacagatgctgccaaggagaacacctgctactgtggggctgtggccaagaggcaggagaagaagggcatggagcccctgcagggccacgccaccccagccctgcccttcaaggagacccaggagctgctgctgagccccctgccccaggagggccctggcagcctggccgccggggagagcagcagcctgagcgccagcacctctgtgtctgacagcagccagaagaaggaggagcacaactacagcctgtttgtgtctgacaacctgggggagcagcccaccaagtgcagccctgaggaggatgaagaagatgaggaggatgtggatgatgaagatcatgatgagggctttggaagtgaacatgagctgtctgaaaatgaggaggaggaggaggaggaggaggactatgaagatgacaaggatgatgacatcagtgacaccttcagcgagcccggcatcatcatgctggccagcctgcctgactag

SEQ ID NO: 36889 - DNA, 1254 bp, Artificial Sequence; identical to SEQ ID NO: 36888
  Description of Artificial Sequence: Synthetic coding sequence

SEQ ID NO: 36890 - DNA, 81 bp, Artificial Sequence
  Description of Artificial Sequence: Synthetic coding sequence
atgccccagcccagcgtgtctggcatggaccccccatttggagatgccttccgcagccacaccttcagcgagcagacctag

SEQ ID NO: 36891 - DNA, 1962 bp, Artificial Sequence
  Description of Artificial Sequence: Synthetic coding sequence
atgccccagcccagcgtgtctggcatggaccccccatttggagatgccttccgcagccacaccttcagcgagcagaccctgatgagcacagacctgctggccaacagcagtgaccctgacttcatgtatgagctggaccgggagatgaactaccagcagaacccccgggacaacttcctgagcctggaggactgcaaggacatcgagaacctggagagcttcacagatgtgctggacaatgaaggagccctgaccagcaactgggagcagtgggacacctactgtgaggacctgaccaagtacaccaagctgaccagctgtgacatctggggcaccaaggaggtggactacctgggcctggatgacttcagcagcccctaccaggatgaggaggtgatcagcaagacccccaccctggcccagctgaacagcgaggacagccagagcgtgtctgacagcctgtactacccagacagcctcttctctgtgaagcagaaccccctgcccagcagcttccctgggaagaagatcaccagcagagctgctgcccctgtgtgcagcagcaagaccctgcaggccgaggtgcccctgagtgactgtgtgcagaaggccagcaagcccaccagcagcacccagatcatggtgaagaccaacatgtaccacaatgagaaggtgaacttccacgtggagtgcaaggactatgtgaagaaggccaaggtgaagatcaaccctgtgcagcagagccggcccctgctgagccagatccacacagatgctgccaaggagaacacctgctactgtggggctgtggccaagaggcaggagaagaagggcatggagcccctgcagggccacgccaccccagccctgcccttcaaggagacccaggagctgctgctgagccccctgccccaggagggccctggcagcctggccgccggggagagcagcagcctgagcgccagcacctctgtgtctgacagcagccagaagaaggaggagcacaactacagcctgtttgtgtctgacaacctgggggagcagcccaccaagtgcagccctgaggaggatgaagaagatgaggaggatgtggatgatgaagatcatgatgagggctttggaagtgaacatgagctgtctgaaaatgaggaggaggaggaggaggaggaggactatgaagatgacaaggatgatgacatcagtgacaccttcagcgagcccggctatgaaaatgattctgtggaggacctgaaggaggtgaccagcatcagcagcaggaagaggggcaagaggcgctacttctgggagtacagcgagcagctgacccccagccagcaggagaggatgctgcggcccagcgagtggaacagagacaccctgcccagcaacatgtaccagaagaatggcctgcaccacggcaagtatgctgtgaagaagagcagaagaacagatgtggaggacctgacccccaaccccaagaagctgctgcagattggaaatgagctgaggaagctgaacaaggtgatcagtgacctgacccctgtgtctgagctgcccctgacagcccggcccaggagcaggaaggagaagaacaagctggccagccgggcctgccgcctgaagaagaaggcccagtatgaggccaacaaggtgaagctgtggggcctgaacacagaatatgacaacctgctgtttgtgatcaacagcatcaagcaggagatcgtgaacagagtgcagaaccccagagatgagcggggccccaacatgggccagaagctggagatcctgatcaaggacaccctgggcctgcctgtggccggccagaccagcgagtttgtgaaccaggtgctggagaagacagctgagggcaaccccaccggcggcctggtgttctggggcaacagcaagacaggcaacatcctgtatgatgagaaccccaatgagaagaagcaggacatctag

SEQ ID NO: 36892 - DNA, 1926 bp, Artificial Sequence
  Description of Artificial Sequence: Synthetic coding sequence
atgccccagcccagcgtgtctggcatggaccccccatttggagatgccttccgcagccacaccttcagcgagcagaccctgatgagcacagacctgctggccaacagcagtgaccctgacttcatgtatgagctggaccgggagatgaactaccagcagaacccccgggacaacttcctgagcctggaggactgcaaggacatcgagaacctggagagcttcacagatgtgctggacaatgaaggagccctgaccagcaactgggagcagtgggacacctactgtgaggacctgaccaagtacaccaagctgaccagctgtgacatctggggcaccaaggaggtggactacctgggcctggatgacttcagcagcccctaccaggatgaggaggtgatcagcaagacccccaccctggcccagctgaacagcgaggacagccagagcgtgtctgacagcctgtactacccagacagcctcttctctgtgaagcagaaccccctgcccagcagcttccctgggaagaagatcaccagcagagctgctgcccctgtgtgcagcagcaagaccctgcaggccgaggtgcccctgagtgactgtgtgcagaaggccagcaagcccaccagcagcacccagatcatggtgaagaccaacatgtaccacaatgagaaggtgaacttccacgtggagtgcaaggactatgtgaagaaggccaaggtgaagatcaaccctgtgcagcagagccggcccctgctgagccagatccacacagatgctgccaaggagaacacctgctactgtggggctgtggccaagaggcaggagaagaagggcatggagcccctgcagggccacgccaccccagccctgcccttcaaggagacccaggagctgctgctgagccccctgccccaggagggccctggcagcctggccgccggggagagcagcagcctgagcgccagcacctctgtgtctgacagcagccagaagaaggaggagcacaactacagcctgtttgtgtctgacaacctgggggagcagcccaccaagtgcagccctgaggaggatgaagaagatgaggaggatgtggatgatgaagatcatgatgagggctttggaagtgaacatgagctgtctgaaaatgaggaggaggaggaggaggaggaggactatgaagatgacaaggatgatgacatcagtgacaccttcagcgagcccggctatgaaaatgattctgtggaggacctgaaggaggtgaccagcatcagcagcaggaagaggggcaagaggcgctacttctgggagtacagcgagcagctgacccccagccagcaggagaggatgctgcggcccagcgagtggaacagagacaccctgcccagcaacatgtaccagaagaatggcctgcaccacggcagcggcaagtatgctgtgaagaagagcagaagaacagatgtggaggacctgacccccaaccccaagaagctgctgcagattggaaatgagctgaggaagctgaacaaggtgatcagtgacctgacccctgtgtctgagctgcccctgacagcccggcccaggagcaggaaggagaagaacaagctggccagccgggcctgccgcctgaagaagaaggcccagtatgaggccaacaaggtgaagctgtggggcctgaacacagaatatgacaacctgctgtttgtgatcaacagcatcaagcaggagatcgtgaacagagtgcagaaccccagagatgagcggggccccaacatgggccagaagctggagatcctgatcaaggacaccctgggcctgcctgtggccggccagaccagcgagtttgtgaaccaggtgctggagaagacagctgagggcaaccccaccggcggcctggtgggcctgcgcatccccaccagcaaggtgtag

SEQ ID NO: 36893 - DNA, 6288 bp, Artificial Sequence
  Description of Artificial Sequence: Synthetic coding sequence
atggctgatgctgacatcctgtctgagaccttccagctgctgattgattctgccaaggacttcagcaagaggctgtggggcctggtgcccttcggcctgtacctgcctgccccacccctgtactgcccccagcctgccatcctgtctgaagaagatggagatgacctgctgctgaaggccgagaagaacaaccggcagaaggtgtctggcatcctgcagagggtgctgctgctcttccgggccgcccagtgcagcttccctgtggcccagtggtacatcctgcagctgcgctgggccaggaaggtgatgcagaagatccgcatgaagggcagcctgcccagcctgagccccttcccccagagcctgctgaactactgcaagggcggcatcgccttcttccggcctggagctgctggggaccacaagctggatgaggtgtccatccgggccatcggctgcttccgggagctgtgtgccctgtgctggatgctgcacgtgcgggacaagctgagctacagctgccggcagtaccagaaggcccgggagaatgtgaagggggagaaggacctggaggtggagtttgacagctgcatgattgagcactgcctgtctgctgtggagtgggcctacaggatgctgcccttcagccgcttcttcaacatggaggagctgatccaggacatcatcctgagcctgattggagagctgccccccatcaggaaggtggccgagatctttgtgaaggccttcccctacccagaagatgtgcgggtgcccctgcgggacaagtaccacagcctgcaccagaggctgcggcactgtgtggtgaagggcccccagacagaggagatgatgtctgtggtgatgcacagcatccagaaggtgcgggtgaaggccctgaagagggtgcagagaaatattggcagctttgaggtgaacatctgggagcccatcgaggaggagaagccagatgaggcccctggggtggaccgctacagcctgggcaccagcctgagccgcagcaccctgacagagctgggggacagcgtggtgcacagtgatgctgacaccttcagcgaggccctgtctgtggaggagaagagccgcatcaacatctaccagagaaatgcccccaaccacatggagctgaccagcatccacaagcccacagacaagaggaagatgtgcaaccagaaggagaaccccaccaagaaggaggaccacgagaagctgagccagaacaccctgcctgtgattggagtgtgggagtttgaaagagatgatgatgagtacatcaagttcctggacctcttcctgagctacatcctggagcgggacctgccctacagcagagatgctgacatccccttcctgaccagcttcagcggcaagctgcgggagcacgagctgaacagcctgctgtttgatgtgcacaccaccctgaagaggcaccagagcaagaccaagagccagaatgtgttccgggccggcagctgctttgtggtggcccctgagagctatgaaagtgagaagagcagcagcctgaatgatgaatatggcatgcacctggagaaccagaagctgagcagctctgtgctggtgaaccagggcatcaagcccttcctgcagtaccccagcaatgaggtgaacaagaatgaaggcatgagcggcctgtttggcctgaagcagaggagcatctacaagatccaggatgacacccgggagaagtgcctgatccagaggagcagcaaccacatcttctggacccccaagagcatcaagacccggcgctgcatcttcaaggccatccagtgcaatgacatcaacccccaggaggacctgcccctggccctgaacaccttcggcagcatcggccgcctgctggagtggatgatccgctggagcaacagaaggctgctgtgtgacagcggcatcacagagagcagcagcgagtacagccctgtgatccgggtgaagaccagcacagctgccatcctgaccagcctgtggctgctggagcagccctactttgccacctacaaggccaagaatgccatcatcaagatggtggagaacagagacaccggctgccagatcggccccaacatcgagcgggagagcaagagtgatgctgggggctctgtggccgtggccacccctgggggcacagaggagagaaatggccagaacaagagctgccagaacatcctgaagatgcccacagaggccaagaacccagacatcaaggagatcaatgatgacatcatcagcatcacccacaacaccaagaaggagttcattgatattgatgagaacctgctggaggtggaggccttcacagaggaggagatggacatgcacatcagtgactatgaagaagatattgaggagagcgtgggcggcttccgcagccccagcctggccatctgcatgatgaccctgccccagcagctggaggaggagttcacagaggaggtgcagtgccagcgggaggagcccctggagaccatcatggaggagaagagcacagagcagaagggcatgattgaggccttcagccaccctggccacaccaccccccagagcatgcaggtggacaccagcagcgagatcagcagcgcccagatcagcacctacaaggagaagagcagctctgtgcccctgctgatcagcaatggagtgaatgtggccagccagcccccagcccccaccccccagaagacccagagaaatgagttcaccgcccagctgcctgactgcagcgagagcgtgcggcagatgctgcaggatgagatgttcaagctggtgcagctgcagcagatcaacttcatgagcctgatgcagatcgtgggcagcagctttgccaacctgcctgacacccagcagctggtgcagcagagccagagcgtgcacctgggggagagccaggagagcaacctgcggggctgtggagatgtggaggacagcaacaagaacctgaaggagcgcttcttcatcaagccccagagcatgggagaaaatgcccgggagcccaggaagaacagcccccactgccacgagggcaccatccccagcggccagaacagcactggaaatgtgcagaatgtgccccacggcagcatccccctgtgccagctgaatggccagcccaggaagaagggccccatccccagcagccagaacctgcccagcaccagcttctacccagccccagctggcaacacccacctgtacctgctgagcacccccagcgtggtgcagaaggcccccaggctcatcccccacgccaagaccttcagccctggagatggcttccccctgctgcagttcaagagcaagcaggagttccagcccctcttcctgcacacaggcagcatcccccaggtgcccttccggcccctgccccagccccgggaggcctggggcctgagtgacagcttccagcctgccctgccccagagagctgcccagaccaccccagccagccacctgaatgtgtcccagtacaacacagaggccaggaagaaggaggtggagcagaagacctgggccgagaccgtcatcacagagatccccaaccacgtgaacctggaccagtatgtgggccaggagaacctgaccccccagcaggacagctctgtgttcatcaagccagagaagctgtttgatgtgaagccaggcaccctggagatcagcccccaccacagctttggcctgcccctgctgtacctgcccctgaagccacccaacatgttccccagcaccagccgggccagcatcaccgtgcccagcacccccatccagcccatcgccgaggagaggaagtacccccggctgagcctgctgcacagccacctgagcccagaaaatcgctgcaagaagacccagctgatccccctggagaacctgattgccttcaagcagagccagcagaagctgacccacaacctgtttgagcagggagatgctggccacctgcagctgctgaaggtgaagattgagcccccagaggtgcggcagggcaaggacagcaagaagaggcagaggcggcgggcagagaaggagctgcaggagaagagatgtgagaagctgcggaggaagcccaacgtgaccttccggccagaaaattccatcatcaacaatgatgacagcgagatcatcaagaagcccaaggagcagcaggagcactgcggcagccaccccctggatgactttgatgtgccctttgagatgctgcaggatgacaacaccagcgctggcctgcacttcatggcctctgtgaagaagaaggccatcggcagccaggatgccagcaccaacacagatcctgagcacgagcccctgacagccccccagctgctggtgcctgatgtgtacctgaacctgaagctgagcagcgagatgtctgagaagccctggagccccagcatcccccacacagtgaccaacctggtgggccacacctacatcaacgtgattgatattgaggccaatgacctgctgcaggagctgcctgtgcgggaggagcccagcaatgacaacgtcatcaagcagcagagcgaccacctggccgtgcccagcagcgctgagctgcactacatggccgcctctgtgaccaatgctgtgcccccccacaacttcaagagccagggcctgcccaagccagagttccgcttcaagggccagagcaccaagagtgacagcgctgaggactacctgctgtggaagaggctgcagggcgtgtctgctgcctgcccagcccccagcagcgctgcccaccagctggagcacctgagcgccaagctgcagaagattgatgagcagctgctggccatccagaacattgctgaaaatattgagcaggacttccccaagccagagatgctggacctgcactgtgacaagattggccctgtggaccacatcgagttcagcagcggccctgagttcaagaagaccctggccagcaagaccatcagcatcagcgaggaggtgcgcttcctgacccacatggatgaggaggaccagagcgacaagaaggagaccagcgagcctgagttcagcatcacagagaactacagcggccagaagacctgtgtgttccccacagctgacagcgctgtgtccctgagcagcagcagtgaccagaacaccaccagccctggcatgaacagcagtgatgagctgtgtgagagcgtgtctgtgcaccccctgcagatgacaggcctgacagacattgctgacatcattgatgacctgatcatcaaggatggagtgtcctctgaggagctgggcctgacagagcaggccatgggcaccagccgcatccagcactacagcggccgccacagccagaggacagacaaggagcggcgggagatccaggcctggatgaagaggaagaggaaggagaggatggccaagtacctgaatgagctggccgagaagaggggccaggagcatgaccccttctgccccaggagcaaccccctgtacatgaccagccgggagatccggctgcggcagaagatgaagcatgagaaggaccggctgctgctgtctgagcactacagccgccgcatcagccaggcctacggcctgatgaatgagctgctgtctgagagcgtgcagctgcccaccctgccccagaagcccctgcccaacaagcccagccccacccagagcagcagctgccagcactgccccagccccagaggagagaaccagcacggccacagcttcctgatcaacagacctgggaaggtgaagtacatgagcaagcccagctacatccacaagaggaagagctttggccagccccagggcagcccctggccccatggaacagccaccttcaccatccagaagaaggccggcggggccaaggctgctgtgaggaaggccacccagagccctgtgaccttccagaagggcagcaatgccccctgccacagcctgcagcacaccaagaagcacggcagcgctggcctggccccccagaccaagcaggtgtgtgtggagtatgaaagagaggagaccgtggtgagcccctggaccatccccagcgagatccacaagatcctgcacgagagccacaacagcctgctgcaggacctgagccccacagaggaggaggagcctgagcacccctttggagtgggcggcgtggacagcgtgtctgagagcacaggcagcatcctgagcaagctggactggaatgccatcgaggacatggtggcctctgtggaggaccagggcctgtctgtgcactgggccctggacctgtag

SEQ ID NO: 36894 - DNA, 5442 bp, Artificial Sequence
  Description of Artificial Sequence: Synthetic coding sequence
atggctgatgctgacatcctgtctgagaccttccagctgctgattgattctgccaaggacttcagcaagaggctgtggggcctggtgcccttcggcctgtacctgcctgccccacccctgtactgcccccagcctgccatcctgtctgaagaagatggagatgacctgctgctgaaggccgagaagaacaaccggcagaaggtgtctggcatcctgcagagggtgctgctgctcttccgggccgcccagtgcagcttccctgtggcccagtggtacatcctgcagctgcgctgggccaggaaggtgatgcagaagatccgcatgaagggcagcctgcccagcctgagccccttcccccagagcctgctgaactactgcaagggcggcatcgccttcttccggcctggagctgctggggaccacaagctggatgaggtgtccatccgggccatcggctgcttccgggagctgtgtgccctgtgctggatgctgcacgtgcgggacaagctgagctacagctgccggcagtaccagaaggcccgggagaatgtgaagggggagaaggacctggaggtggagtttgacagctgcatgattgagcactgcctgtctgctgtggagtgggcctacaggatgctgcccttcagccgcttcttcaacatggaggagctgatccaggacatcatcctgagcctgattggagagctgccccccatcaggaaggtggccgagatctttgtgaaggccttcccctacccagaagatgtgcgggtgcccctgcgggacaagtaccacagcctgcaccagaggctgcggcactgtgtggtgaagggcccccagacagaggagatgatgtctgtggtgatgcacagcatccagaaggtgcgggtgaaggccctgaagagggtgcagagaaatattggcagctttgaggtgaacatctgggagcccatcgaggaggagaagccagatgaggcccctggggtggaccgctacagcctgggcaccagcctgagccgcagcaccctgacagagctgggggacagcgtggtgcacagtgatgctgacaccttcagcgaggccctgtctgtggaggagaagagccgcatcaacatctaccagagaaatgcccccaaccacatggagctgaccagcatccacaagcccacagacaagaggaagatgtgcaaccagaaggagaaccccaccaagaaggaggaccacgagaagctgagccagaacaccctgcctgtgattggagtgtgggagtttgaaagagatgatgatgagtacatcaagttcctggacctcttcctgagctacatcctggagcgggacctgccctacagcagagatgctgacatccccttcctgaccagcttcagcggcaagctgcgggagcacgagctgaacagcctgctgtttgatgtgcacaccaccctgaagaggcaccagagcaagaccaagagccagaatgtgttccgggccggcagctgctttgtggtggcccctgagagctatgaaagtgagaagagcagcagcctgaatgatgaatatggcatgcacctggagaaccagaagctgagcagctctgtgctggtgaaccagggcatcaagcccttcctgcagtaccccagcaatgaggtgaacaagaatgaaggcatgagcggcctgtttggcctgaagcagaggagcatctacaagatccaggatgacacccgggagaagtgcctgatccagaggagcagcaaccacatcttctggacccccaagagcatcaagacccggcgctgcatcttcaaggccatccagtgcaatgacatcaacccccaggaggacctgcccctggccctgaacaccttcggcagcatcggccgcctgctggagtggatgatccgctggagcaacagaaggctgctgtgtgacagcggcatcacagagagcagcagcgagtacagccctgtgatccgggtgaagaccagcacagctgccatcctgaccagcctgtggctgctggagcagccctactttgccacctacaaggccaagaatgccatcatcaagatggtggagaacagagacaccggctgccagatcggccccaacatcgagcgggagagcaagagtgatgctgggggctctgtggccgtggccacccctgggggcacagaggagagaaatggccagaacaagagctgccagaacatcctgaagatgcccacagaggccaagaacccagacatcaaggagatcaatgatgacatcatcagcatcacccacaacaccaagaaggagttcattgatattgatgagaacctgctggaggtggaggccttcacagaggaggagatggacatgcacatcagtgactatgaagaagatattgaggagagcgtgggcggcttccgcagccccagcctggccatctgcatgatgaccctgccccagcagctggaggaggagttcacagaggaggtgcagtgccagcgggaggagcccctggagaccatcatggaggagaagagcacagagcagaagggcatgattgaggccttcagccaccctggccacaccaccccccagagcatgcaggtggacaccagcagcgagatcagcagcgcccagatcagcacctacaaggagaagagcagctctgtgcccctgctgatcagcaatggagtgaatgtggccagccagcccccagcccccaccccccagaagacccagagaaatgagttcaccgcccagctgcctgactgcagcgagagcgtgcggcagatgctgcaggatgagatgttcaagctggtgcagctgcagcagatcaacttcatgagcctgatgcagatcgtgggcagcagctttgccaacctgcctgacacccagcagctggtgcagcagagccagagcgtgcacctgggggagagccaggagagcaacctgcggggctgtggagatgtggaggacagcaacaagaacctgaaggagcgcttcttcatcaagccccagagcatgggagaaaatgcccgggagcccaggaagaacagcccccactgccacgagggcaccatccccagcggccagaacagcactggaaatgtgcagaatgtgccccacggcagcatccccctgtgccagctgaatggccagcccaggaagaagggccccatccccagcagccagaacctgcccagcaccagcttctacccagccccagctggcaacacccacctgtacctgctgagcacccccagcgtggtgcagaaggcccccaggctcatcccccacgccaagaccttcagccctggagatggcttccccctgctgcagttcaagagcaagcaggagttccagcccctcttcctgcacacaggcagcatcccccaggtgcccttccggcccctgccccagccccgggaggcctggggcctgagtgacagcttccagcctgccctgccccagagagctgcccagaccaccccagccagccacctgaatgtgtcccagtacaacacagaggccaggaagaaggaggtggagcagaagacctgggccgagaccgtcatcacagagatccccaaccacgtgaacctggaccagtatgtgggccaggagaacctgaccccccagcaggacagctctgtgttcatcaagccagagaagctgtttgatgtgaagccaggcaccctggagatcagcccccaccacagctttggcctgcccctgctgtacctgcccctgaagccacccaacatgttccccagcaccagccgggccagcatcaccgtgcccagcacccccatccagcccatcgccgaggagaggaagtacccccggctgagcctgctgcacagccacctgagcccagaaaatcgctgcaagaagacccagctgatccccctggagaacctgattgccttcaagcagagccagcagaagctgacccacaacctgtttgagcagggagatgctggccacctgcagctgctgaaggtgaagattgagcccccagaggtgcggcagggcaaggacagcaagaagaggcagaggcggcgggcagagaaggagctgcaggagaagagatgtgagaagctgcggaggaagcccaacgtgaccttccggccagaaaattccatcatcaacaatgatgacagcgagatcatcaagaagcccaaggagcagcaggagcactgcggcagccaccccctggatgactttgatgtgccctttgagatgctgcaggatgacaacaccagcgctggcctgcacttcatggcctctgtgaagaagaaggccatcggcagccaggatgccagcaccaacacagatcctgagcacgagcccctgacagccccccagctgctggtgcctgatgtgtacctgaacctgaagctgagcagcgagatgtctgagaagccctggagccccagcatcccccacacagtgaccaacctggtgggccacacctacatcaacgtgattgatattgaggccaatgacctgctgcaggagctgcctgtgcgggaggagcccagcaatgacaacgtcatcaagcagcagagcgaccacctggccgtgcccagcagcgctgagctgcactacatggccgcctctgtgaccaatgctgtgcccccccacaacttcaagagccaggaggtgaccccagcctgcctggatggcaagagcctgcgggccggcatcacagaggtgaaggagcccagcgtgaccagccccacccccagcgacatccagcagaacaagggcctgcccaagccagagttccgcttcaagggccagagcaccaagagtgacagcgctgaggactacctgctgtggaagaggctgcagggcgtgtctgctgcctgcccagcccccagcagcgctgcccaccagctggagcacctgagcgccaagctgcagaagattgatgagcagctgctggccatccagaacattgctgaaaatattgagcaggacttccccaagccagagatgctggacctgcactgtgacaagattggccctgtggaccacatcgagttcagcagcggccctgagttcaagaagaccctggccagcaagaccatcagcatcagcgaggaggtgcgcttcctgacccacatggatgaggaggaccagagcgacaagaaggagaccagcgagcctgagttcagcatcacagagaactacagcggccagaagacctgtgtgttccccacagctgacagcgctgtgtccctgagcagcagcagtgaccagaacaccaccagccctggcatgaacagcagtgatgagctgtgtgagagcgtgtctgtgcaccccctgcagatgacaggcctgacagacattgctgacatcattgatgacctgatcatcaaggatggagtgtcctctgaggagctgggcctgacagagcaggccatgggcaccagccgcttctcctag

SEQ ID NO: 36895 - DNA, 9594 bp, Artificial Sequence
  Description of Artificial Sequence: Synthetic coding sequence
atggagatccggctggagatcctgaccagcacaggcatcaagcagaagaagccctggccccgggtgtcctggctgggcaaggagaaggaggccgtgttcctgctggatgacaagttcatcaatgagatcaacctgctgagcggcaagatcaagaagaagatccccagcctgcagcccttcctgaaggatgtgattgtgctgaccaccagcagcaatgatgcctggctggccggcgtgctgaccaccggggagctgttcctgtggaacaaggaccaggactgcctgaagaccatccccatcacagagaagcccaaggagatgatcaaggccaccgtggccagcagcctgcggctgtacctgtatgtgtctggaaatggcaagagaattgtgctgatcaccccatctggctgcatcttcctgtgggagtacctggagctgaagaacatcctgagcagcaagagcctgagcctggccggccgctggagccaggtgattcctgaggaggccgtgctgctgcccagcacagaggacaaggaggccgtggtgaatgctgtgttcatcaagaatgagctgtttggagactgctgcctgtgcagcttcaccttctacagcggggagtgcctgaagctgaccttcctggccatccgctggcatgaaaatgtgttcacctctgtgcgcagcctgccctaccacgtgcactgggcccagcaggactgccacctgtgcagcctcatccccaagtgtgagagcgtgaagagcagaggagccctgatcagcgccttcagcagagatggcctgaccctggccgtgaccctgaaccagaaggaccccaaggccacccaggtgctcttcatcaacaccctgaactttgtgaccctgtgtggcagcctgaagggctgcagcaacaagagccctgtggtgcctgccaccctcatccgcagctactgggtgggggacatctcctggacccatgacagcctcttcctggcctgcatgctgaagaggggcagcctggtgctgctgacctgccagggcgagctgctgaccctcatcaccttcggctgcagcattgaatttggacctgctgagttcatccccctgcaccccctcatcacctaccggccccagcagttcaccttccaggacagcaacaacagcgtggacagcagcgccagtgacagcgaccccatgaggcagcgcttcagcatcaaggcccacagccggctgccctacctggtgatcagtgatggctacatggtgaccaccctgcgcttcctggacagcctgagccccagcgtgcacatgaggagcctgctgctggacagcacccagaggctggagaagatctaccagagcgtcatcctgagcaagcccaagggcaagggcctgaacctgcggagcctgaacagcctgcggagcagcctgctggagcaccagggcaatgaaagcagcgctgacttcaccgtgcccaagttcctgcaggccgaggagaccatcaatgaaaatgctgctgacttccaggactttgaagctgaggagaccaatgaaggccgccacttcccagacaacctgtgccccttctggaacaagagagatgatgtgctgtgcagctccatgaaggagggccgcctggagtttgcctccatgtttgacaccatccacgccaaggatgattctgaggagacagacaggaccatcacagagctgcacagcatccagaagagcctgctggccgcctggaccatcggcatcagcaagacagtgacagagaagaacctgatgctgaactacatcgtggtgtgcatcacccacttcttctacatcctgcagttcatcaagtgccccttccccaagctggacctggtgctgagcaagagcagccgccacaatgcctggatcctgtgcatcttccagctgttccaccagtgcctgagcatccactactgggacatccgctacaagcaggatgtgggccacctgatcaagctgaccagcaacacagtgaagctgctgctgacccagcagcagaagggccagctgttcagcgagaagctgctggcctgcttctacctgctgaagatggtggccgacaacctgaatggagtgtacatcctgcagcctgaggtgatcagcgccagcgcagatggcagcaagatcacagcccaggacagcctggtggtgcccatcttccagatgttccaggacagcggcttccagaagaactggagctggaacagcttcttcaagatccacccccaggtggtgaaccctgtgcagcagcccggccaccggctgctgatcctgtggaggatcctgtacaagaagaccctgtggtaccaggcccagctgaacagaagagtgcctgaggccgacagccagctgacagagaagatgacccatgaggccagcacagtgaagagcctgctgtgccacctgcaggccaacctgcagagcactggagactgcctgaaccagaccctggagctgaagagcatcaatggagaggagtgcttcctgctgggcagctatgagaagtctgtgcagctgtggaagaaggccctgcaggagattgaggagaagggcggccgccgcacctacttcctgcagatccgctactacctgagcctgctgtactgccacctgtacagctacaacctgaatgatgcccagggcctgtgtgaccagctggcccgggagatcctgcgctggagccagctgcctgtgaaggagaacaaggacttctctggagctgccaagagccactttgaatgtggcatggtgggcggcgtgcaccctgaggccgctgtgcgggtggtgcagagcatggcccgcttcatggccgcctacttcaccaaccagcagctgtgcatcctgcccccccaccacgtgaatgtgctgccccccctgcacatcaagacagagcagagcttccgcctcatccccctgcagcacagcaaggtggcctctgtggtgcgggaccagaacctgagcaatgtgtggacagtggagtatgccctggagctgctcttcatcggcggcctggtgcctgaggccgtgtggctggcctacaagctgggggactggaagacctctgtgtccattggagtggccttccagctgttctgcaagagggacagcaacttcatgaggagcaagaagaagagcctgaacctgcccctgaggatgaccccagcccagatcttccaggagaagctgcagtgtgtgctgggccagcctgccagcctggaggccaagaatgagatgggcagcaagtacaagcagttcacagaccccatcgaggaggaggatgccaacctgctgtttggatctgtgcaggaggtgctgaaggcctctgtgatggctgatgctgacatcctgtctgagaccttccagctgctgattgacagcgccaaggacttcagcaagaggctgtggggcctggtgcccttcggcctgtacctgcctgccccacccctgtactgcccccagcctgccatcctgtctgaggaggatggagatgacctgctgctgaaggccgagaagaacaaccggcagaaggtgtctggcatcctgcagagggtgctgctgctcttccgggccgcccagtgcagcttccctgtggcccagtggtacatcctgcagctgcgctgggccaggaaggtgatgcagaagatccgcatgaagggcagcctgcccagcctgagccccttcccccagagcctgctgaactactgcaagggcggcatcgccttcttccggcctggagctgctggggaccacaagctggatgaggtgtccatccgggccatcggctgcttccgggagctgtgtgccctgtgctggatgctgcacgtgcgggacaagctgagctacagctgccggcagtaccagaaggccagagaaaatgtgaagggggagaaggacctggaggtggagtttgacagctgcatgattgagcactgcctgtctgctgtggagtgggcctacaggatgctgcccttcagccgcttcttcaacatggaggagctgatccaggacatcatcctgagcctcatcggggagctgccccccatcaggaaggtggccgagatctttgtgaaggccttcccctacccagaagatgtgcgggtgcccctgcgggacaagtaccacagcctgcaccagaggctgcggcactgtgtggtgaagggcccccagacagaggagatgatgtctgtggtgatgcacagcatccagaaggtgcgggtgaaggccctgaagagggtgcagaggaacatcggcagctttgaggtgaacatctgggagcccatcgaggaggagaagccagatgaggcccctggggtggaccgctacagcctgggcaccagcctgagccgcagcaccctgacagagctgggggacagcgtggtgcacagtgatgctgacaccttcagcgaggccctgtctgtggaggagaagagccgcatcaacatctaccagagaaatgcccccaaccacatggagctgaccagcatccacaagcccacagacaagaggaagatgtgcaaccagaaggagaaccccaccaagaaggaggaccacgagaagctgagccagaacaccctgcccgtcatcggcgtgtgggagtttgaaagagatgatgatgagtacatcaagttcctggacctcttcctgagctacatcctggagcgggacctgccctacagcagagatgctgacatccccttcctgaccagcttcagcggcaagctgcgggagcacgagctgaacagcctgctgtttgatgtgcacaccaccctgaagaggcaccagagcaagaccaagagccagaatgtgttccgggccggcagctgctttgtggtggcccctgagagctatgagagcgagaagagcagcagcctgaatgatgaatatggcatgcacctggagaaccagaagctgagcagctctgtgctggtgaaccagggcatcaagcccttcctgcagtaccccagcaatgaggtgaacaagaatgaaggcatgagcggcctgtttggcctgaagcagaggagcatctacaagatccaggatgacacccgggagaagtgcctgatccagaggagcagcaaccacatcttctggacccccaagagcatcaagacccggcgctgcatcttcaaggccatccagtgcaatgacatcaacccccaggaggacctgcccctggccctgaacaccttcggcagcatcggccgcctgctggagtggatgatccgctggagcaacagaaggctgctgtgtgacagcggcatcacagagagcagcagcgagtacagccctgtgatccgggtgaagaccagcacagctgccatcctgaccagcctgtggctgctggagcagccctactttgccacctacaaggccaagaatgccatcatcaagatggtggagaacagagacaccggctgccagatcggccccaacatcgagcgggagagcaagagtgatgctgggggctctgtggccgtggccaccccaggcggcacagaggagagaaatggccagaacaagagctgccagaacatcctgaacaggatgcccacagaggccaagaacccagacatcaaggagatcaatgatgacatcatcagcatcacccacaacaccaagaaggagttcattgatattgatgagaacctgctggaggtggaggccttcacagaggaggagatggacatgcacatcagtgactatgaagaagatattgaggagagcgtgggcggcttccgcagccccagcctggccatctgcatgatgaccctgccccagcagctggaggaggagttcacagaggaggtgcagtgccagcgggaggagcccctggagaccatcatggaggagaagagcacagagcagaagggcatgattgaggccttcagccaccctggccacaccaccccccagagcatgcaggtggacaccagcagcgagatcagcagcgcccagatcagcacctacaaggagaagagcagctctgtgcccctgctgatcagcaatggagtgaatgtggccagccagcccccagcccccaccccccagaagacccagagaaatgagttcaccgcccagctgcctgactgcagcgagagcgtgcggcagatgctgcaggatgagatgttcaagctggtgcagctgcagcagatcaacttcatgagcctgatgcagatcgtgggcagcagctttgccaacctgcctgacacccagcagctggtgcagcagagccagagcgtgcacctgggggagagccaggagagcaacctgcggggctgtggagatgtggaggacagcaacaagaacctgaaggagcgcttcttcatcaagccccagagcatgggagaaaatgcccgggagcccaggaagaacagcccccactgccacgagggcaccatccccagcggccagaacagcactggaaatgtgcagaatgtgccccacggcagcatccccctgtgccagctgaatggccagcccaggaagaagggccccatccccagcagccagaacctgcccagcaccagcttctacccagccccagctggcaacacccacctgtacctgctgagcacccccagcgtggtgcagaaggcccccaggctcatcccccacgccaagaccttcagccctggagatggcttccccctgctgcagttcaagagcaagcaggagttccagcccctcttcctgcacacaggcagcatcccccaggtgcccttccggcccctgccccagccccgggaggcctggggcctgagtgacagcttccagcctgccctgccccagagagctgcccagaccaccccagccagccacctgaatgtgtcccagtacaacacagaggccaggaagaaggaggtggagcagaagacctgggccgagaccgtcatcacagagatccccaaccacgtgaacctggaccagtatgtgggccaggagaacctgaccccccagcaggacagctctgtgttcatcaagccagagaagctgtttgatgtgaagccaggcaccctggagatcagcccccaccacagctttggcctgcccctgctgtacctgcccctgaagccacccaacatgttccccagcaccagccgggccagcatcaccgtgcccagcacccccatccagcccatcgccgaggagaggaagtacccccggctgagcctgctgcacagccacctgagcccagaaaatcgctgcaagaagacccagctgatccccctggagaacctgattgccttcaagcagagccagcagaagctgacccacaacctgtttgagcagggagatgctggccacctgcagctgctgaaggtgaagattgagcccccagaggtgcggcagggcaaggacagcaagaagaggcagaggcggcgggcagagaaggagctgcaggagaagagatgtgagaagctgcggaggaagcccaacgtgaccttccggccagaaaattccatcatcaacaatgatgacagcgagatcatcaagaagcccaaggagcagcaggagcactgcggcagccaccccctggatgactttgatgtgccctttgagatgctgcaggatgacaacaccagcgctggcctgcacttcatggcctctgtgaagaagaaggccatcggcagccaggatgccagcaccaacacagatcctgagcacgagcccctgacagccccccagctgctggtgcctgatgtgtacctgaacctgaagctgagcagcgagatgtctgagaagccctggagccccagcatcccccacacagtgaccaacctggagctgcctgtgcgggaggagcccagcaatgacaacgtcatcaagcagcagagcgaccacctggccgtgcccagcagcgctgagctgcactacatggccgcctctgtgaccaatgctgtgcccccccacaacttcaagagccagggcctgcccaagccagagttccgcttcaagggccagagcaccaagagtgacagcgctgaggactacctgctgtggaagaggctgcagggcgtgtctgctgcctgcccagcccccagcagcgctgcccaccagctggagcacctgagcgccaagctgcagaagattgatgagcagctgctggccatccagaacattgctgaaaatattgagcaggacttccccaagccagagatgctggacctgcactgtgacaagattggccctgtggaccacatcgagttcagcagcggccctgagttcaagaagaccctggccagcaagaccatcagcatcagcgaggaggtgcgcttcctgacccacatggatgaggaggaccagagcgacaagaaggagaccagcgagcctgagttcagcatcacagagaactacagcggccagaagacctgtgtgttccccacagctgacagcgctgtgtccctgagcagcagcagtgaccagaacaccaccagccctggcatgaacagcagtgatgagctgtgtgagagcgtgtctgtgcaccccctgcagatgacaggcctgacagacattgctgacatcattgatgacctgatcatcaaggatggagtgtcctctgaggagctgggcctgacagagcaggccatgggcaccagccgcatccagcactacagcggccgccacagccagaggacagacaaggagcggcgggagatccaggcctggatgaagaggaagaggaaggagaggatggccaagtacctgaatgagctggccgagaagaggggccaggagcatgaccccttctgccccaggagcaaccccctgtacatgaccagccgggagatccggctgcggcagaagatgaagcatgagaaggaccggctgctgctgtctgagcactacagccgccgcatcagccaggcctacggcctgatgaatgagctgctgtctgagagcgtgcagctgcccaccctgccccagaagcccctgcccaacaagcccagccccacccagagcagcagctgccagcactgccccagccccagaggagagaaccagcacggccacagcttcctgatcaacagacctgggaaggtgaagtacatgagcaagcccagctacatccacaagaggaagagctttggccagccccagggcagcccctggccccatggaacagccaccttcaccatccagaagaaggccggcggggccaaggctgctgtgaggaaggccacccagagccctgtgaccttccagaagggcagcaatgccccctgccacagcctgcagcacaccaagaagcacggcagcgctggcctggccccccagaccaagcaggtgtgtgtggagtatgaaagagaggagaccgtggtgagcccctggaccatccccagcgagatccacaagatcctgcacgagagccacaacagcctgctgcaggacctgagccccacagaggaggaggagcctgagcacccctttggagtgggcggcgtggacagcgtgtctgagagcacaggcagcatcctgagcaagctggactggaatgccatcgaggacatggtggcctctgtggaggaccagggcctgtctgtgcactgggccctggacctgtag

SEQ ID NO: 36896 - DNA, 9594 bp, Artificial Sequence; identical to SEQ ID NO: 36895
  Description of Artificial Sequence: Synthetic coding sequence

SEQ ID NO: 36897 - DNA, 1725 bp, Artificial Sequence
  Description of Artificial Sequence: Synthetic coding sequence
atggccaccctggtggtgaacaagctgggcgccggcgtggacagcggccggcagggcagccggggcacagctgtggtgaaggtgctggagtgtggggtgtgtgaagatgtgttcagcctgcagggcgacaaggtgccccggctgctgctgtgtggccacacagtgtgccacgactgcctgacccggctgcccctgcacggccgggccatccgctgcccctttgaccggcaggtgacagacctgggggacagcggcgtgtggggcctgaagaagaactttgccctgctggagctgctggagcggctgcagaatggccccatcggccagtacggggctgctgaggagagcatcggcatcagcggggagagcatcatccgctgtgatgaagatgaggcccacctggcctctgtgtactgcaccgtgtgtgccacccacctgtgcagtgaatgttcccaggtgacccacagcaccaagaccctggccaagcaccggcgggtgcccctggccgacaagccccatgagaagaccatgtgcagccagcaccaggtgcacgccatcgagtttgtgtgcctggaggagggctgccagaccagccccctgatgtgctgcgtgtgcaaggagtatggcaagcaccagggccacaagcacagcgtgctggagcctgaggccaaccagatccgggccagcatcctggacatggcccactgcatccgcaccttcacagaggagatcagtgactacagcaggaagctggtgggcatcgtgcagcacatcgagggcggggagcagatcgtggaggatggcatcggcatggcccacacagagcacgtgcccggcacagcagaaaatgcccggagctgcatccgggcctacttctatgacctgcacgagaccctgtgccggcaggaggagatggccctgtctgtggtggatgcccacgtgcgggagaagctgatctggctgcggcagcagcaggaggacatgaccatcctgctgtctgaggtgtctgctgcctgcctgcactgtgagaagaccctgcagcaggatgactgccgggtggtgctggccaagcaggagatcacccggctgctggagaccctgcagaagcagcagcagcagttcacagaggtggccgaccacatccagctggatgccagcatccctgtgaccttcaccaaggacaacagagtgcacatcggccccaagatggagatccgggtggtgaccctgggcctggatggagctgggaagaccaccatcctcttcaagctgaagcaggatgagttcatgcagcccatccccaccatcggcttcaacgtggagaccgtggagtacaagaacctgaagttcaccatctgggatgtgggcggcaagcacaagctgcggcccctgtggaagcactactacctgaacacccaggccgtggtgtttgtggtggacagcagccaccgggaccgcatcagcgaggcccacagcgagctggccaagctgctgacagagaaggagctgagagatgccctgctgctgatctttgccaacaagcaggatgtggccggggccctgtctgtggaggagatcacagagctgctgagcctgcacaagctgtgctgcggccgctcctggtacatccagggctgtgatgcccggagcggcatgggcctgtatgagggcctggactggctgagccggcagctggtggccgccggcgtgctggatgtggcctag

SEQ ID NO: 36898 - DNA, 1254 bp, Artificial Sequence
  Description of Artificial Sequence: Synthetic coding sequence
atggaggtgaacccccccaagcaggagcacctgctggccctgaaggtgatgaggctgaccaagcccaccctcttcaccaacatccctgtgacctgtgaggagaaggacctgcccggggacctcttcaaccagctgatgagagatgaccccagcacagtgaatggagctgaggtgctgatgctgggggagatgctgaccctgccccagaactttggaaacatcttcctgggggagaccttcagcagctacatctctgtgcacaatgacagcaaccaggtggtgaaggacatcctggtgaaggctgacctgcagaccagcagccagaggctgaacctgagcgccagcaatgctgctgtggccgagctgaagccagactgctgcattgatgatgtgatccaccacgaggtgaaggagatcggcacccacatcctggtgtgtgctgtgtcctacaccacccaggccggggagaagatgtacttcaggaagttcttcaagttccaggtgctgaagcccctggatgtgaagaccaagttctacaatgctgagagtgacctgagctctgtgacagatgaggtgttcctggaggcccagatccagaacatgaccaccagccccatgttcatggagaaggtgtccctggagcccagcatcatgtacaacgtgacagagctgaacagcgtgtcccaggccggggagtgtgtgtccaccttcggcagccgggcctacctgcagcccatggacacccggcagtacctgtactgcctgaagcccaagaatgaatttgctgagaaggccggcatcatcaagggcgtgaccgtcatcggcaagctggacatcgtgtggaagaccaacctgggggagcggggccgcctgcagaccagccagctgcagaggatggcccctggctatggagatgtgcggctgagcctggaggccatcccagacacagtgaacctggaggagcccttccacatcacctgcaagatcaccaactgcagcgagaggaccatggacctggtgctggagatgtgcaacaccaacagcatccactggtgtggcatcagcggccggcagctgggcaagctgcaccccagcagcagcctgtgcctggccctgaccctgctgagctctgtgcagggcctgcagagcatcagcggcctgcggctgacagacaccttcctgaagaggacctatgaatatgatgacatcgcccaggtgtgtgtggtgtcctctgccatcaaggtggagagctag

SEQ ID NO: 36899 - DNA, 1239 bp, Artificial Sequence
  Description of Artificial Sequence: Synthetic coding sequence
atggaggtgaacccccccaagcaggagcacctgctggccctgaaggtgatgaggctgaccaagcccaccctcttcaccaacatccctgtgacctgtgaggagaaggacctgcccggggacctcttcaaccagctgatgagagatgaccccagcacagtgaatggagctgaggtgctgatgctgggggagatgctgaccctgccccagaactttggaaacatcttcctgggggagaccttcagcagctacatctctgtgcacaatgacagcaaccaggtggtgaaggacatcctggtgaaggctgacctgcagaccagcagccagaggctgaacctgagcgccagcaatgctgctgtggccgagctgaagccagactgctgcattgatgatgtgatccaccacgaggtgaaggagatcggcacccacatcctggtgtgtgctgtgtcctacaccacccaggccggggagaagatgtacttcaggaagttcttcaagttccaggtgctgaagcccctggatgtgaagaccaagttctacaatgctgagacagatgaggtgttcctggaggcccagatccagaacatgaccaccagccccatgttcatggagaaggtgtccctggagcccagcatcatgtacaacgtgacagagctgaacagcgtgtcccaggccggggagtgtgtgtccaccttcggcagccgggcctacctgcagcccatggacacccggcagtacctgtactgcctgaagcccaagaatgaatttgctgagaaggccggcatcatcaagggcgtgaccgtcatcggcaagctggacatcgtgtggaagaccaacctgggggagcggggccgcctgcagaccagccagctgcagaggatggcccctggctatggagatgtgcggctgagcctggaggccatcccagacacagtgaacctggaggagcccttccacatcacctgcaagatcaccaactgcagcagcgagaggaccatggacctggtgctggagatgtgcaacaccaacagcatccactggtgtggcatcagcggccggcagctgggcaagctgcaccccagcagcagcctgtgcctggccctgaccctgctgagctctgtgcagggcctgcagagcatcagcggcctgcggctgacagacaccttcctgaagaggacctatgaatatgatgacatcgcccaggtgtgtgtggtgagcagcgccatcaaggtggagagctag

SEQ ID NO: 36900 - DNA, 1260 bp, Artificial Sequence
  Description of Artificial Sequence: Synthetic coding sequence
atggaggtgaacccccccaagcaggagcacctgctggccctgaaggtgatgaggctgaccaagcccaccctcttcaccaacatccctgtgacctgtgaggagaaggacctgcccggggacctcttcaaccagctgatgagagatgaccccagcacagtgaatggagctgaggtgctgatgctgggggagatgctgaccctgccccagaactttggaaacatcttcctgggggagaccttcagcagctacatctctgtgcacaatgacagcaaccaggtggtgaaggacatcctggtgaaggctgacctgcagaccagcagccagaggctgaacctgagcgccagcaatgctgctgtggccgagctgaagccagactgctgcattgatgatgtgatccaccacgaggtgaaggagatcggcacccacatcctggtgtgtgctgtgtcctacaccacccaggccggggagaagatgtacttcaggaagttcttcaagttccaggtgctgaagcccctggatgtgaagaccaagttctacaatgctgagaagcagatcgccaacgtgaccacagatgaggtgttcctggaggcccagatccagaacatgaccaccagccccatgttcatggagaaggtgtccctggagcccagcatcatgtacaacgtgacagagctgaacagcgtgtcccaggccggagaatgtgtgtccaccttcggcagccgggcctacctgcagcccatggacacccggcagtacctgtactgcctgaagcccaagaatgaatttgctgagaaggccggcatcatcaagggcgtgacagtgattggcaagctggacatcgtgtggaagaccaacctgggggagcggggccgcctgcagaccagccagctgcagaggatggcccctggctatggagatgtgcggctgagcctggaggccatcccagacacagtgaacctggaggagcccttccacatcacctgcaagatcaccaactgcagcagcgagaggaccatggacctggtgctggagatgtgcaacaccaacagcatccactggtgtggcatcagcggccggcagctgggcaagctgcaccccagcagcagcctgtgcctggccctgaccctgctgagctctgtgcagggcctgcagagcatcagcggcctgcggctgacagacaccttcctgaagaggacctatgaatatgatgacatcgcccaggtgtgtgtggtgtcctctgccatcaaggtggagagctag

SEQ ID NO: 36901 - DNA, 1257 bp, Artificial Sequence
  Description of Artificial Sequence: Synthetic coding sequence
atggaggtgaacccccccaagcaggagcacctgctggccctgaaggtgatgaggctgaccaagcccaccctcttcaccaacatccctgtgacctgtgaggagaaggacctgcccggggacctcttcaaccagctgatgagagatgaccccagcacagtgaatggagctgaggtgctgatgctgggggagatgctgaccctgccccagaactttggaaacatcttcctgggggagaccttcagcagctacatctctgtgcacaatgacagcaaccaggtggtgaaggacatcctggtgaaggctgacctgcagaccagcagccagaggctgaacctgagcgccagcaatgctgctgtggccgagctgaagccagactgctgcattgatgatgtgatccaccacgaggtgaaggagatcggcacccacatcctggtgtgtgctgtgtcctacaccacccaggccggggagaagatgtacttcaggaagttcttcaagttccaggtgctgaagcccctggatgtgaagaccaagttctacaatgctgagagtgacctgagctctgtgacagatgaggtgttcctggaggcccagatccagaacatgaccaccagccccatgttcatggagaaggtgtccctggagcccagcatcatgtacaacgtgacagagctgaacagcgtgtcccaggccggggagtgtgtgtccaccttcggcagccgggcctacctgcagcccatggacacccggcagtacctgtactgcctgaagcccaagaatgaatttgctgagaaggccggcatcatcaagggcgtgaccgtcatcggcaagctggacatcgtgtggaagaccaacctgggggagcggggccgcctgcagaccagccagctgcagaggatggcccctggctatggagatgtgcggctgagcctggaggccatcccagacacagtgaacctggaggagcccttccacatcacctgcaagatcaccaactgcagcagcgagaggaccatggacctggtgctggagatgtgcaacaccaacagcatccactggtgtggcatcagcggccggcagctgggcaagctgcaccccagcagcagcctgtgcctggccctgaccctgctgagctctgtgcagggcctgcagagcatcagcggcctgcggctgacagacaccttcctgaagaggacctatgaatatgatgacatcgcccaggtgtgtgtggtgagcagcgccatcaaggtggagagctag

SEQ ID NO: 36902 - DNA, 1032 bp, Artificial Sequence
  Description of Artificial Sequence: Synthetic coding sequence
atggccagcctgcagaggagccgggtgctgcgctgctgcagctgccgcctcttccaggcccaccaggtgaagaagtctgtgaagtggacctgcaaggcctgtggggagaagcagagcttcctgcaggcctacggggagggcagcggggctgactgcagaagacatgtgcagaagctgaacctgctgcagggccaggtgtctgagctgcccctgcggagcctggaggagaccgtgtctgccagcgaggaggagaatgtgggccaccagcaggccggaaatgtgaagcagcaggagaagagccagcccagcgagagccgctggctgaagtacctggagaaggacagccaggagctggagctggagggcactggagtgtgcttcagcaagcagcccagcagcaagatggaggagcccggcccccgcttcagccaggacctgcccaggaagaggaagtggagccgcagcacagtgcagcccccctgcagccggggcgtgcaggacagcggcggcagcgaggtggcctggggcccccagaagggccaggccggcctgacctggaaggtgaagcagggcagcagcccctgcctgcaggagaacagcgctgactgcagcgctggggagctgcggggccctgggaaggagctgtggagccccatccagcaggtgacagccaccagcagcaagtgggcccagtttgtgctgccccccaggaagagcagccacgtggacagcgagcagcccaggagcctgcagagggaccccaggcctgctggccctgcccaggccaagcagggcaccccccgggcccaggccagccgggagggcctgagccggcccacagctgctgtgcagctgccccgggccacccaccctgtgaccagcggcagcgagcggccctgtgggaagacctcctgggatgcccggaccccctgggccgagggcggccccctggtgctggaggcccagaacccccggcccacccggctgtgtgacctcttcatcactggagaagattttgatgatgatgtgtag

SEQ ID NO: 36903 - DNA, 867 bp, Artificial Sequence
  Description of Artificial Sequence: Synthetic coding sequence
atggccagcctgcagaggagccgggtgctgcgctgctgcagctgccgcctcttccaggcccaccaggtgaagaagtctgtgaagtggacctgcaaggcctgtggggagaagcagagcttcctgcaggagaagagccagcccagcgagagccgctggctgaagtacctggagaaggacagccaggagctggagctggagggcaccggggtgtgcttcagcaagcagcccagcagcaagatggaggagcccggcccccgcttcagccaggacctgcccaggaagaggaagtggagccgcagcacagtgcagcccccctgcagcagaggagtgcaggacagcggcggcagcgaggtggcctggggcccccagaagggccaggccggcctgacctggaaggtgaagcagggcagcagcccctgcctgcaggagaacagcgctgactgcagcgctggggagctgcggggccctgggaaggagctgtggagccccatccagcaggtgacagccaccagcagcaagtgggcccagtttgtgctgccccccaggaagagcagccacgtggacagcgagcagcccaggagcctgcagagggaccccaggcctgctggccctgcccaggccaagcagggcaccccccgggcccaggccagccgggagggcctgagccggcccacagctgctgtgcagctgccccgggccacccaccctgtgaccagcggcagcgagcggccctgtgggaagacctcctgggatgcccggaccccctgggccgagggcggccccctggtgctggaggcccagaacccccggcccacccggctgtgtgacctcttcatcaccggggaggactttgatgatgatgtgtag

SEQ ID NO: 36904 - DNA, 816 bp, Artificial Sequence
  Description of Artificial Sequence: Synthetic coding sequence
atgcagagcgcccgggcctggctgcccggggactgcaccagcagagatggagtggccagcgccttcagcggggccaccctgctgcagctgccccccctgcccggggcccctgggaagaaggagtgccaggtggacatgcagagcctgtggagggaggccgtgctgtttgctgagttccccaggcatggagccccagccagcgagctgcctgtgcccagcggcagcgagatggatggagctgagagcggcaaggcctacggggagggcagcggggctgactgcagaagacatgtgcagaagctgaacctgctgcagggccaggtgtctgagctgcccctgcggagcctggaggagaccgtgtctgccagcgaggaggagaatgtgggccaccagcaggccggaaatgtgaagcagcaggagaagagccagcccagcgagagccgctggctgaagtacctggagaaggacagccaggagctggagctggagggcactggagtgtgcttcagcaagcagcccagcagcaagatggaggagcccggcccccgcttcagccaggacctgcccaggaagaggaagtggagccgcagcacagtgcagcccccctgcagccggggcgtgcaggacagcggcggcagcgaggtggcctggggcccccagaagggccaggccggcctgacctggaaggtgaagcagggcagcagcccctgcctgcaggagaacagcgctgactgcagcgctggggagctgcggggccctgggaaggagctgtggagccccatccagcaggacggctacaaggagatcctcttctag

SEQ ID NO: 36905 - DNA, 531 bp, Artificial Sequence
  Description of Artificial Sequence: Synthetic coding sequence
atggctgctgctggccggggccgggagcaggacagcgccaggtttgtgtatgtgaccaggtttggcagccaccagtgcagcggcgtgctgcagctgggcggccgcggggcccagggcctgtggggccagggccctggagctggctgccggcaggagaagccccgggaggccatggctgtggccggcgtgcagggcggcagcgagctgcccctgggcagccagctgcgggtgcccaccaccccaggagtggaggccgccgccagcgccagcagccagctgcgggccagccgggtgcagagcggcacccggcagagcgcccgggccggcctcatccagaaggatgctgccaagaagtatgacttccccatccccctgaatgaggccagcaagatcatgaagaagaagaagaaggtgctggtgtggaacagagtgtacaaggtgatcagcaggatgctggaggagaatgagaagtaccgccaccggctgaagtgccagaggctgagcagcgagagcagcaactacaccaggtag

SEQ ID NO: 36906 - DNA, 405 bp, Artificial Sequence
  Description of Artificial Sequence: Synthetic coding sequence
atggccagcggcaaggacacctgccccaccctgcccaagctgaccaacaactgcagtgatgagagcctgtacaagagcgccaacaagtatgaggagatccacctgccccgcttcagcctgaagcagggcatgatccccaggagatatgtgatgccctggaaggagaacatgatcttcagaaatgtgaacctgaagcaggccgaggtgtgtggcatccacacaggccccctggaggacagcctcttcctgaaccacagcgagcggctgtgccacggggaggacaggaaggtggtgttccagaagggccccccagagatcaagattgctgacatgcccctgcacagccccctgagccgctaccagagcaccgtcatcagccacggcttcagaagaaggctggtgtag

SEQ ID NO: 36907 - DNA, 444 bp, Artificial Sequence
  Description of Artificial Sequence: Synthetic coding sequence
atggaggatgatgaggaggagaccacagccagcaccctgcggggcaagcccaggcctcctcctgtgtctgcccagagcgccttctcctacatccccccccggcggctggaccccaaggagcacagctactactacagacctgccaggacaggcatcatcagcctgtatgactgcatcttcaagaggcggctggactatgaccagaagctgcacagagatgaccgggagcacgccaagagcctgggcctgcacgtgaatgaggaggagcaggagaggcctgtgggcgtgctgaccagctctgtgtatggcaagaggatcaaccagcccatcgagcccctgaacagagactttggccgggccaaccacgtgcaggccgacttctacaggaagaatgacatccccagcctgaaggagcccggcttcggccacatcgcccccagctag

SEQ ID NO: 36908 - DNA, 471 bp, Artificial Sequence
  Description of Artificial Sequence: Synthetic coding sequence
atggccacccagcaggtggacagccggcggcaggtggccgctgagcaggtggccgcccagctgctggagaggagaagaggcagccactgtgatgatgagaagcagaccctgctggccctgctgatcctggtgctgtacctgagcacagagatctggggcagctcctgggaggtgtctgagcgcatccgggagtgcaactactaccagaacctggccgtgccccagggcctggagtaccagaccaatgagcccagcgaggagcccatcaagaccatccggaactggctgaaggagaagctgcacgtgttcagcgagaagctggaggaggaggtgcagcagctggagcagctggcctgggacctggagctgtggctggatgccctgctgggggagccccaccaggaggagcactgcagcacctacaagagccacctgcacctggagcacgaggtgtccatccgggaccactag

SEQ ID NO: 36909 - DNA, 885 bp, Artificial Sequence
  Description of Artificial Sequence: Synthetic coding sequence
atggctgctgctgtgtcctctgtggtgcggcgggtggaggagctgggggacctggcccaggcccacatccagcagctgtctgaggccgccggggaggatgaccacttcctgatccgggccagcgctgccctggagaagctgaagctgctgtgtggggaggagaaggagtgcagcaaccccagcaacctgctggagctgtacacccaggccatcctggacatgacctactttgaggagaacaagctggtggatgaggacttccctgaggacagcagcagccagaaggtgaaggagctgatctccttcctgtctgagcctgagatcctggtgaaggagaacaacatgcaccccaagcactgcaacctgctgggagatgagctgctggagtgcctgtcctggaggagaggagccctgctgtacatgtactgccacagcctgaccaagagaagagagtggctgctgaggaagagcagcctgctgaagaagtacctgctggatggcatctcctacctgctgcagatgctgaactaccgctgccccatccagctgaatgaaggagtgtccttccaggacctggacacagccaagctgctgtctgctggcatcttcagtgacatccacctgctggccatgatgtacagcggggagatgtgctactggggcagcaagtactgtgccgaccagcagccagaaaatcatgaggtggacacctctgtgtctggggccggctgcaccacctacaaggagcccctggacttccgggaggtgggggagaagatcctgaagaagtatgtgtctgtgtgtgagggccccctgaaggagcaggagtggaacaccaccaatgccaagcagatcctgaacttcttccaccaccgctgcaactag

SEQ ID NO: 36910 - DNA, 480 bp, Artificial Sequence
  Description of Artificial Sequence: Synthetic coding sequence
atgacccagcccacccggcccagcgtgacctgtgaccagggcagcagcaccatcggcggcacagctgcccaggccaccaccagcagcagcgccaccagcggcagcaactaccagagggaccggctgggccggcggcctgagattggagtgggcggccagccccagatctgcttcccccggcccaggtctgcccagcagcctgtgctcttcagcctgatgaacagcagcgaggccgccatgaagaagaccctgcccaagagccacctgagcagggtcatcatccatgacaaccgcatcacccagaggatctatgagatggaggtgtctgccctggagaagaccaagaagaagatcagccactactatgagcacctgaagaagaagttcatgacagagcagctgaggaagctgggccgctggagggaggagagcgtgaacagcaaccgctacctgaccttcggcatccccccacctgtgtag

SEQ ID NO: 36911 - DNA, 1785 bp, Artificial Sequence
  Description of Artificial Sequence: Synthetic coding sequence
atgagcaagaagaggaagtgggatgatgattatgtgcgctactggttcacctgcaccacagaggtggatggcacccagaggccccagtgtgtgctgtgcaacagcgtcttcagcaatgctgacctgcggcccagcaagctgagtgaccacttcaaccggcagcacggcggcgtggccggccatgacctgaacagcctgaagcacatgcctgcccccagcgaccagagcgagaccctgaaggccttcggcgtggccagccatgaggacaccctgctgcaggccagctaccagtttgcctacctgtgtgccaaggagaagaacccccacacagtggccgagaagctggtgaagccctgtgccctggagatcgcccagatcgtgctgggcccagatgcccagaagaagctgcagcaggtgcccctgagtgatgatgtgatccacagcagaattgatgagatgagccaggacatcctgcagcaggtgctggaggacatcaaggccagccccctgaaggtgggcatccagctggccgagaccacagacatggatgactgcagccagctgatggcctttgtgcgctacatcaaggagcgggagatcgtggaggagttcctgttctgtgagcccctgcagctgtccatgaagggcattgatgtgttcaacctcttccgggacttcttcctgaagcacaagatcgccctggatgtgtgtggctctgtgtgcacagatggagccagctccatgctgggagaaaattctgaatttgtggcctacgtgaagaaggagatcccccacatcgtggtgacccactgcctgctgaacccccacgccctggtgatcaagaccctgcccaccaagctgagagatgccctcttcaccgtggtgcgggtcatcaacttcatcaagggccgggcccccaaccacaggctcttccaggccttctttgaggagatcggcatcgagtacagcgtgctgctcttccacacagagatgcgctggctgagccggggccagatcctgacccacatctttgagatgtatgaggagatcaaccagttcctgcaccacaagagcagcaacctggtggatggctttgagaacaaggagttcaagatccacctggcctacctggccgacctcttcaagcacctgaatgagctgagcgcctccatgcagaggacaggcatgaacacagtgtctgcccgggagaagctgagcgcctttgtgaggaagttccccttctggcagaagagaattgagaagaggaacttcaccaacttccccttcctggaggagatcatcgtgtctgacaatgaaggcatcttcatcgctgctgagatcaccctgcacctgcagcagctgagcaacttcttccacggctacttcagcatcggggacctgaatgaggccagcaagtggatcctggaccccttcctgttcaacatcgactttgtggatgacagctacctgatgaagaatgacctggccgagctgcgggccagcggccagatcctgatggagtttgagaccatgaagctggaggacttctggtgtgcccagttcaccgccttccccaacctggccaagacagccctggagatcctgatgccctttgccaccacctacctgtgtgagctgggcttcagcagcctgctgcacttcaagaccaagagccgcagctgcttcaacctgagtgatgacatccgggtggccatcagcaagaaggtgccccgcttcagtgacatcatcgagcagaagctgcagctgcagcagaagagcctgtag

SEQ ID NO: 36912 - DNA, 1785 bp, Artificial Sequence; identical to SEQ ID NO: 36911
  Description of Artificial Sequence: Synthetic coding sequence

SEQ ID NO: 36913 - DNA, 309 bp, Artificial Sequence
  Description of Artificial Sequence: Synthetic coding sequence
atgagagaaattgctgagatcctgcctgcccaggagaaggtggaggccagaattgacctgaagatgggcaagaagagggtgacagaccacaagctgaatgtggacaaggtgatcaagaacatcaacaccatcagcagcgagctgaagaagatcaaggagctgagccagctgctgctgtgtgacctgatcctgcacttcaaccaccccatcaagacagagaacctggccgaggccgagaggaacaaccccctgtttgaggagagcaagatcagtgatgtgtccctggtgagcaacagcttcagcatctag

SEQ ID NO: 36914 - DNA, 309 bp, Artificial Sequence; identical to SEQ ID NO: 36913
  Description of Artificial Sequence: Synthetic coding sequence

SEQ ID NO: 36915 - DNA, 834 bp, Artificial Sequence
  Description of Artificial Sequence: Synthetic coding sequence
atgccccgggcccagctgcctgaggacagcagcgctgtggacatggacatcctcttccccctggacagcgtgattggaacagagctgtgccccagccccatcccccagatcatccactttgtgctgtttgtggtgttcagcctggtgatcctgatcatcctgcggctgtacatcccccgggagcccagctctgtgcccccccgggaggaggacagtgaaaatgaccaggccgaggtgggggagtggctgagaattggcaacaagtacatcaccctgaaggactaccgcatcctgctgaaggagctggagaacctggagatctacaccttcctgagcaagaagtgcctgaagaagctgagccgggagggcagcagccaccacctgccccggcaggtgcggcccggccctgtgtacaagccagccccagccaggaaccaccggccccggggcggccggggcaaggccagccccaccagcttccacgtgagcccccgggcccccctggcccccctggcctccatgcccagctctgtgcccaagacctctgtggagagcctgggcagccccagcagcctgagcagcagcaagccccgggagcccctgtgccccctgaagcaccccagccaccagcccccagccagcaccctgagccccaaccccaccagcagcacagagagcctgggggagacccctcatgctggccgctggaggcagggcagccgcttcccccagcccggctgtgccaatgctgctggccgcatccgccaccagaaccccaggcacagccacggccaccgcatcagtgacatccacgagcagctgggcatctcctag

SEQ ID NO: 36916 - DNA, 348 bp, Artificial Sequence
  Description of Artificial Sequence: Synthetic coding sequence
atgctgtggttccagggcaacagcatgcagctggcccggagcagctttggcctcttcctgaggaactgcagcgccagcaagaccaccctgcctgtgctgaccctcttcaccaaggacccctgccccctgtgtgatgaggccaaggaggtgctgaagccctatgaaaatcgcttcatcctgcaggaggtgaacatcaccctgcctgaaaattctgtgtggtatgaaagatacaagtttgacatccctgtgttccacctgaatggccagttcctgatgatgcaccgggtgaacaccagcaagctggagaagcagctgctgaagctggagcagcagagcactggaggatag

SEQ ID NO: 36917 - DNA, 417 bp, Artificial Sequence
  Description of Artificial Sequence: Synthetic coding sequence
atgctgtggttccagggcaacagcatgcagctggcccggagcagctttggcctcttcctgaggaactgcagcgccagcaagaccaccctgcctgtgctgaccctcttcaccaaggacccctgccccctgtgtgatgaggccaaggaggtgctgaagccctatgaaaatcggcagccctacaaggaccagaagctgcccggcaccaggagaagaagaagccccagcagccccagccacccccacatggccagccagagcggcaagcgctacaacctgaccctgaaccaggtgctgagctttgattatgacatgggcctggatgcccccaagaccatcagcagtgactgtggggccttctactgcctgaggatgttcaagagcccagacatgacctgctgcttctaccccaagcagtag

SEQ ID NO: 36918 - DNA, 3048 bp, Artificial Sequence
  Description of Artificial Sequence: Synthetic coding sequence
atgctgacagccctggcccccccagccctgcccggcatcccccggcagctgcccacagccccagcccggcggcaggacagcagcggcagcagcggcagctactacacagcccctggcagccctgagcccccagatgtgggcccagatgccaagggccctgccaactggccctgggtggcccctggaagaggagctggggcccagccccggctgtctgtgtctgcccagaacagccggcagagacatggccctggcagcggcttcccccggggccctggcagcggcccccggcccccccagccccagctgcggaccctgcccagcggggagatggaggtgatctttggagtgggccccctgtttggctgcagcggggctgatgaccgggaggcccagcagcagttcacagagcccgccttcatcagccccctgcccccaggccctgccagccctgctgctgtgccccggcagagccaggtgcctgatggcggcagccgctgggccacctacctggagctgcggccccggggccccagccctgctgccccagcccagtttgaatgtgtggaggtggccctggaggagggcgccgccccagcccggcccaggacagtgcccaagaggcagatcgagctgcggccccggccccagagcccccccagggctgctggggccccccggccccggctgctgctgaggacaggcagcctggatgagagcctgggccccctgcaggccgccgccggctttgtgcagacagccctggccaggaagctgagccctgaggccccagcccccagcagcgccaccttcggcagcacaggccgctctgagcctgagacccgggagacagcccggagcacccacgtggtgctggagaaggccaagagccggcccctgcgggtgcgggacaacagcgccccagccaaggccccccggccctggcccagcctgcgggagcgggccatccggcgggacaagccagcccctggaacagagcccctgggccctgtgagcagcagcatcttcctgcagagcgaggagaagatccaggaggccaggaagacccgcttcccccgggaggccccagacagaacagtgcagagggcccggagccccccatttgagtgccgcatccccagcgaggtgcccagcagagctgtgcggcccaggagccccagccccccccggcagaccccaaatggagctgtgcggggcccccgctgccccagcccccagaacctgagcccctgggacaggaccaccaggagagtgagcagccccctcttccctgaggccagcagcgagtgggagaaccagaacccagctgtggaggagaccgtgagccgccgcagccccagcccccccatcctgagccagtggaaccagtgtgtggccggggagaggagccccagcctggaggcccccagcctgtgggagatcccccacagcgctgtggctgatgctgtggagcccaggagcagccccagccccccagccttcttcccctgggaggccccagaccggcccatcggcacctggggccccagcccccaggagacctgggaccccatgggccctggcagcagcatcgccttcacccaggaggcccagaatggcctgacccaggaggagctggccccacccacccccagcgcccctggcaccccagagcccacagagatgcagagccccagcacccgggagatcagtgacctggcctttggaggcagccagcagagccctgaggtggccgcccctgagcccccaggcagccaccctgtgggcaccctggatgctgacaagtgcccagaggtgctgggccctggagaggccgccagcggccggcccaggatggccatcccccggcccagagatgtgaggaagctggtgaagaccacctacgcccctggcttccctgctggggcccagggcagcggcctgcctgcccctcctgctgacccctgtggggaggagggcggggagagcaagacccaggagcccccagccctgggccccccagccccagcccactacacctctgtgttcatcaaggacttcctgcctgtggtgccccacccctatgagcccccagagcccagctttgacacagtggccagagatgccagccagcccaatggagtgctgcggcggcgggcagagaacagcacagccaagcccttcaagaggacagagatccggctgcccggggccctggccctgggcagaagacctgaggtgaccagccgggtgcgggcccggggccctggaggagaaaatagagatgtggaggcccagaggctggtgcctgatggagatggccgcaccagccccctgggcggggcccggagcagcagccagaggagccctgtgggccctgctggggtgcgcagccccaggcctggcagcccccagatgcaggccagccccagccctggcatcgcccccaagcccaagaccccacccacagcccctgagcctgctgctgctgtgcaggcccccctgccccgggagcccctggccctggccggccgcacagccccagcccagcccagggctgccagcgccccacccacagacaggagcccccagagccccagccagggcgcccggcggcagcccggggccgcccccctgggcaaggtgctggtggaccctgagagcggccgctactactttgtggaggccccccggcagccccggctgcgggtgctgtttgatcctgagagcggccagtatgtggaggtgctgctgccccccagcagccctggccccccccaccgggtgtacacccccctggccctgggcctgggcctgtaccccccagcctacggccccatccccagcctgagcctgccccccagccctggcccccaggccctgggcagcccccagctgccctgggtgtctgaggccggccccctggatggcacctactacctgcctgtgtctggcacccccaacccagccccacccctgctgctgtgtgccccacccagcagcagcggccccacccagcccgggaagggcagcctcttccccctgtag

SEQ ID NO: 36919 - DNA, 1689 bp, Artificial Sequence
  Description of Artificial Sequence: Synthetic coding sequence
atgacagtgctggagatcaccctggccgtcatcctgaccctgctgggcctggccatcctggccatcctgctgacccgctgggcccggaggaagcagagcgagatgtacatcagccgctacagcagcgagcagagcgcccggctgctggactatgaagatggccggggcagcagacatgcctacagcacccagagcgacaccagctatgacaaccgggagaggagcaagagggactacacccccagcaccaacagcctggccctgagccgcagcagcatcgccctgccccagggctccatgagcagcatcaagtgcctgcagaccacagaggagccccccagcaggacagctggggccatgatgcagttcaccgcccccatccctggggccaccggccccatcaagctgagccagaagaccatcgtgcagaccctgggccccatcgtgcagtacccaggcagcaatgtgcgcagccacccccacaccatcaccggcccccccagcgccccccggggcccccccatggcccccatcatcatcagccagaggacagccagccagctggccgcccccatccgcatcccccaggtgcacaccatggacagcagcggcaagatcaccctgacccctgtggtgatcctgaccggctacatggatgaggagctggccaagaagagctgcagcaagatccagatcctgaagtgtggcggcacagcccggagccagaacagccgggaggagaacaaggaggccctgaagaatgacatcatcttcaccaacagcgtggagagcctgaagagcgcccacatcaaggagcctgagcgggagggcaagggcacagacctggagaaggacaagattggcatggaggtgaaggtggacagtgatgctggcatccccaagaggcaggagacccagctgaagatcagcgagatgagcatcccccagggccagggcgcccagatcaagaagtctgtgtctgatgtgccccggggccaggagagccaggtgaagaagtctgagagcggcgtgcccaagggccaggaggcccaggtgaccaagagcggcctggtggtgctgaagggccaggaggcccaggtggagaagtctgagatgggcgtgccccggcggcaggagagccaggtgaagaagagccagagcggcgtgtccaagggccaggaggcccaggtgaagaagcgggagagcgtggtgctgaagggccaggaggcccaggtggagaagtctgagctgaaggtgcccaagggccaggagggccaggtggagaagacagaagcagatgtgcccaaggagcaggaggtgcaggagaagaagtctgaggccggcgtgctgaagggccctgagagccaggtgaagaacacagaggtgtctgtgcctgagaccctggagagccaggtgaagaagtctgagagcggcgtgctgaagggccaggaggcccaggagaagaaggagagctttgaagataaaggaaataatgacaaggagaaggagagagatgctgagaaggaccccaacaagaaggagaagggggacaagaacaccaagggggacaagggcaaggacaaggtgaagggcaagcgggagagcgagatcaacggggagaagagcaagggcagcaagagggccaaggccaacacaggcaggaagtacaacaagaaggtggaggagtag

SEQ ID NO: 36920 - DNA, 1692 bp, Artificial Sequence
  Description of Artificial Sequence: Synthetic coding sequence
atgacagtgctggagatcaccctggccgtcatcctgaccctgctgggcctggccatcctggccatcctgctgacccgctgggcccggaggaagcagagcgagatgtacatcagccgctacagcagcgagcagagcgcccggctgctggactatgaagatggccggggcagcagacatgcctacagcacccagagcgacaccagctatgacaaccgggagaggagcaagagggactacacccccagcaccaacagcctggtgtccatggccagcaagttcagcctgggccagacagagctgatcctgctgctgatgtgcttcatcctggccctgagccgcagcagcatcggcagcatcaagtgcctgcagaccacagaggagccccccagcaggacagctggggccatgatgcagttcaccgcccccatccctggggccaccggccccatcaagctgagccagaagaccatcgtgcagaccctgggccccatcgtgcagtacccaggcagcaatgccggcccccccagcgccccccggggcccccccatggcccccatcatcatcagccagaggacagcccgcatcccccaggtgcacaccatggacagcagcggcaagatcaccctgacccctgtggtgatcctgaccggctacatggatgaggagctggccaagaagagctgcagcaagatccagatcctgaagtgtggcggcacagcccggagccagaacagccgggaggagaacaaggaggccctgaagaatgacatcatcttcaccaacagcgtggagagcctgaagagcgcccacatcaaggagcctgagcgggagggcaaaggaacagacctggagaaggacaagattggcatggaggtgaaggtggacagtgatgctggcatccccaagaggcaggagacccagctgaagatcagcgagatgagcatcccccagggccagggcgcccagatcaagaagtctgtgtctgatgtgccccggggccaggagagccaggtgaagaagtctgagagcggcgtgcccaagggccaggaggcccaggtgaccaagagcggcctggtggtgctgaagggccaggaggcccaggtggagaagtctgagatgggcgtgccccggcggcaggagagccaggtgaagaagagccagagcggcgtgtccaagggccaggaggcccaggtgaagaagcgggagagcgtggtgctgaagggccaggaggcccaggtggagaagtctgagctgaaggtgcccaagggccaggagggccaggtggagaagacagaagcagatgtgcccaaggagcaggaggtgcaggagaagaagtctgaggccggcgtgctgaagggccctgagagccaggtgaagaacacagaggtgtctgtgcctgagaccctggagagccaggtgaagaagtctgagagcggcgtgctgaagggccaggaggcccaggagaagaaggagagctttgaggacaagggcaacaatgacaaggagaaggagagagatgctgagaaggaccccaacaagaaggagaagggggacaagaacaccaagggggacaagggcaaggacaaggtgaagggcaagcgggagagcgagatcaatggagagaagagcaagggcagcaagagggccaaggccaacacaggcaggaagtacaacaagaaggtggaggagtag

SEQ ID NO: 36921 - DNA, 582 bp, Artificial Sequence
  Description of Artificial Sequence: Synthetic coding sequence
atgacagtgctggagatcaccctggccgtcatcctgaccctgctgggcctggccatcctggccatcctgctgacccgctgggcccggaggaagcagagcgagatgcacatcagccgctacagcagcgagcagagcgcccggctgctggactatgaagatggccggggcagcagacatgcctacagcacccagagcgacaccagctgtgacaaccgggagaggagcaagagggactacacccccagcaccaacagcctggtgtccatggccagcaagttcagcctgggccagacagagctgatcctgctgctgatgtgcttcatcctggccctgagccgcagcagcatcggcagcatcaagtgcctgcagaccacagaggagctgcccagcaggacagctggggccatgatgcagttcaccgcccccatccctggggccaccggccccatcaagctgagccagaagaccatcgtgcagaccccaggccccatcgtgcagtacccaggccccaatgccggcccccccagcgccccccggggcccccccatggcccccatcatcatcagccagaggacagcctag

SEQ ID NO: 36922 - DNA, 579 bp, Artificial Sequence
  Description of Artificial Sequence: Synthetic coding sequence
atgacagtgctggagatcaccctggccgtcatcctgaccctgctgggcctggccatcctggccatcctgctgacccgctgggcccggaggaagcagagcgagatgcacatcagccgctacagcagcgagcagagcgcccggctgctggactatgaagatggccggggcagcagacatgcctacagcacccagagcgacaccagctgtgacaaccgggagaggagcaagagggactacacccccagcaccaacagcctggccctgagccgcagcagcatcgccctgccccagggctccatgagcagcatcaagtgcctgcagaccacagaggagctgcccagcaggacagctggggccatgatgcagttcaccgcccccatccctggggccaccggccccatcaagctgagccagaagaccatcgtgcagaccccaggccccatcgtgcagtacccaggccccaacgtgcgcagccacccccacaccatcaccggcccccccagcgccccccggggcccccccatggcccccatcatcatcagccagaggacagccagccagctggccgcccccatctag

SEQ ID NO: 36923 - DNA, 579 bp, Artificial Sequence; identical to SEQ ID NO: 36922
  Description of Artificial Sequence: Synthetic coding sequence

SEQ ID NO: 36924 - DNA, 1689 bp, Artificial Sequence
  Description of Artificial Sequence: Synthetic coding sequence
atgacagtgctggagatcaccctggccgtcatcctgaccctgctgggcctggccatcctggccatcctgctgacccgctgggcccggaggaagcagagcgagatgtacatcagccgctacagcagcgagcagagcgcccggctgctggactatgaagatggccggggcagcagacatgcctacagcacccagagcgacaccagctatgacaaccgggagaggagcaagagggactacacccccagcaccaacagcctggccctgagccgcagcagcatcgccctgccccagggctccatgagcagcatcaagtgcctgcagaccacagaggagccccccagcaggacagctggggccatgatgcagttcaccgcccccatccctggggccaccggccccatcaagctgagccagaagaccatcgtgcagaccctgggccccatcgtgcagtacccaggcagcaatgtgcgcagccacccccacaccatcaccggcccccccagcgccccccggggcccccccatggcccccatcatcatcagccagaggacagccagccagctggccgcccccatccgcatcccccaggtgcacaccatggacagcagcggcaagatcaccctgacccctgtggtgatcctgaccggctacatggatgaggagctggccaagaagagctgcagcaagatccagatcctgaagtgtggcggcacagcccggagccagaacagccgggaggagaacaaggaggccctgaagaatgacatcatcttcaccaacagcgtggagagcctgaagagcgcccacatcaaggagcctgagcgggagggcaagggcacagacctggagaaggacaagattggcatggaggtgaaggtggacagtgatgctggcatccccaagaggcaggagacccagctgaagatcagcgagatgtctgtgccccagggccagggcgcccagatcaagaagtctgtgtctgatgtgccccggggccaggagagccaggtgaagaagtctgagagcggcgtgcccaagggccaggaggcccaggtgaccaagagcggcctggtggtgctgaagggccaggaggcccaggtggagaagtctgagatgggcgtgccccggcggcaggagagccaggtgaagaagagccagagcggcgtgtccaagggccaggaggcccaggtgaagaagcgggagagcgtggtgctgaagggccaggaggcccaggtggagaagtctgagctgaaggtgcccaagggccaggagggccaggtggagaagacagaagcagatgtgcccaaggagcaggaggtgcaggagaagaagtctgaggccggcgtgctgaagggccctgagagccaggtgaagaacacagaggtgtctgtgcctgagaccctggagagccaggtgaagaagtctgagagcggcgtgctgaagggccaggaggcccaggagaagaaggagagctttgaagataaaggaaataatgacaaggagaaggagagagatgctgagaaggaccccaacaagaaggagaagggggacaagaacaccaagggggacaagggcaaggacaaggtgaagggcaagcgggagagcgagatcaacggggagaagagcaagggcagcaagagggccaaggccaacacaggcaggaagtacaacaagaaggtggaggagtag

SEQ ID NO: 36925 - DNA, 582 bp, Artificial Sequence; identical to SEQ ID NO: 36921
  Description of Artificial Sequence: Synthetic coding sequence

SEQ ID NO: 36926 - DNA, 1689 bp, Artificial Sequence
  Description of Artificial Sequence: Synthetic coding sequence
atgacagtgctggagatcaccctggccgtcatcctgaccctgctgggcctggccatcctggccatcctgctgacccgctgggcccggaggaagcagagcgagatgtacatcagccgctacagcagcgagcagagcgcccggctgctggactatgaagatggccggggcagcagacatgcctacagcacccagagcgacaccagctatgacaaccgggagaggagcaagagggactacacccccagcaccaacagcctggccctgagccgcagcagcatcgccctgccccagggctccatgagcagcatcaagtgcctgcagaccacagaggagccccccagcaggacagctggggccatgatgcagttcaccgcccccatccctggggccaccggccccttcaagctgagccagaagaccatcgtgcagaccctgggccccatcgtgcagtacccaggcagcaatgtgcgcagccacccccacaccatcaccggcccccccagcgccccccggggcccccccatggcccccatcatcatcagccagaggacagccagccagctggccgcccccatccgcatcccccaggtgcacaccatggacagcagcggcaagatcaccctgacccctgtggtgatcctgaccggctacatggatgaggagctggccaagaagagctgcagcaagatccagatcctgaagtgtggcggcacagcccggagccagaacagccgggaggagaacaaggaggccctgaagaatgacatcatcttcaccaacagcgtggagagcctgaagagcgcccacatcaaggagcctgagcgggagggcaagggcacagacctggagaaggacaagattggcatggaggtgaaggtggacagtgatgctggcatccccaagaggcaggagacccagctgaagatcagcgagatgtctgtgccccagggccagggcgcccagatcaagaagtctgtgtctgatgtgccccggggccaggagagccaggtgaagaagtctgagagcggcgtgcccaagggccaggaggcccaggtgaccaagagcggcctggtggtgctgaagggccaggaggcccaggtggagaagtctgagatgggcgtgccccggcggcaggagagccaggtgaagaagagccagagcggcgtgtccaagggccaggaggcccaggtgaagcagcgggagagcgtggtgctgaagggccaggaggcccaggtggagaagtctgagctgaaggtgcccaagggccaggagggccaggtggagaagacagaagcagatgtgcccaaggagcaggaggtgcaggagaagaagtctgaggccggcgtgctgaagggccctgagagccaggtgaagaacacagaggtgtctgtgcctgagaccctggagagccaggtgaagaagtctgagagcggcgtgctgaagggccaggaggcccaggagaagaaggagagctttgaagataaaggaaataatgacaaggagaaggagagagatgctgagaaggaccccaacaagaaggagaagggggacaagaacaccaagggggacaagggcaaggacaaggtgaagggcaagcgggagagcgagatcaacggggagaagagcaagggcagcaagagggccaaggccaacacaggcaggaagtacaacaagaaggtggaggagtag

SEQ ID NO: 36927 - DNA, 1692 bp, Artificial Sequence
  Description of Artificial Sequence: Synthetic coding sequence
atgacagtgctggagatcaccctggccgtcatcctgaccctgctgggcctggccatcctggccatcctgctgacccgctgggcccggaggaagcagagcgagatgtacatcagccgctacagcagcgagcagagcgcccggctgctggactatgaagatggccggggcagcagacatgcctacagcacccagagcgacaccagctatgacaaccgggagaggagcaagagggactacacccccagcaccaacagcctggtgtccatggccagcaagttcagcctgggccagacagagctgatcctgctgctgatgtgcttcatcctggccctgagccgcagcagcatcggcagcatcaagtgcctgcagaccacagaggagccccccagcaggacagctggggccatgatgcagttcaccgcccccatccctggggccaccggccccatcaagctgagccagaagaccatcgtgcagaccctgggccccatcgtgcagtacccaggcagcaatgccggcccccccagcgccccccggggcccccccatggcccccatcatcatcagccagaggacagcccgcatcccccaggtgcacaccatggacagcagcggcaagatcaccctgacccctgtggtgatcctgaccggctacatggatgaggagctggccaagaagagctgcagcaagatccagatcctgaagtgtggcggcacagcccggagccagaacagccgggaggagaacaaggaggccctgaagaatgacatcatcttcaccaacagcgtggagagcctgaagagcgcccacatcaaggagcctgagcgggagggcaaaggaacagacctggagaaggacaagattggcatggaggtgaaggtggacagtgatgctggcatccccaagaggcaggagacccagctgaagatcagcgagatgtctgtgccccagggccagggcgcccagatcaagaagtctgtgtctgatgtgccccggggccaggagagccaggtgaagaagtctgagagcggcgtgcccaagggccaggaggcccaggtgaccaagagcggcctggtggtgctgaagggccaggaggcccaggtggagaagtctgagatgggcgtgccccggcggcaggagagccaggtgaagaagagccagagcggcgtgtccaagggccaggaggcccaggtgaagaagcgggagagcgtggtgctgaagggccaggaggcccaggtggagaagtctgagctgaaggtgcccaagggccaggagggccaggtggagaagacagaagcagatgtgcccaaggagcaggaggtgcaggagaagaagtctgaggccggcgtgctgaagggccctgagagccaggtgaagaacacagaggtgtctgtgcctgagaccctggagagccaggtgaagaagtctgagagcggcgtgctgaagggccaggaggcccaggagaagaaggagagctttgaggacaagggcaacaatgacaaggagaaggagagagatgctgagaaggaccccaacaagaaggagaagggggacaagaacaccaagggggacaagggcaaggacaaggtgaagggcaagcgggagagcgagatcaatggagagaagagcaagggcagcaagagggccaaggccaacacaggcaggaagtacaacaagaaggtggaggagtag

SEQ ID NO: 36928 - DNA, 1692 bp, Artificial Sequence
  Description of Artificial Sequence: Synthetic coding sequence
atgacagtgctggagatcaccctggccgtcatcctgaccctgctgggcctggccatcctggccatcctgctgacccgctgggcccggaggaagcagagcgagatgtacatcagccgctacagcagcgagcagagcgcccggctgctggactatgaagatggccggggcagcagacatgcctacagcacccagagcgacaccagctatgacaaccgggagaggagcaagagggactacacccccagcaccaacagcctggtgtccatggccagcaagttcagcctgggccagacagagctgatcctgctgctgatgtgcttcatcctggccctgagccgcagcagcatcggcagcatcaagtgcctgcagaccacagaggagccccccagcaggacagctggggccatgatgcagttcaccgcccccatccctggggccaccggccccttcaagctgagccagaagaccatcgtgcagaccctgggccccatcgtgcagtacccaggcagcaatgccggcccccccagcgccccccggggcccccccatggcccccatcatcatcagccagaggacagcccgcatcccccaggtgcacaccatggacagcagcggcaagatcaccctgacccctgtggtgatcctgaccggctacatggatgaggagctggccaagaagagctgcagcaagatccagatcctgaagtgtggcggcacagcccggagccagaacagccgggaggagaacaaggaggccctgaagaatgacatcatcttcaccaacagcgtggagagcctgaagagcgcccacatcaaggagcctgagcgggagggcaaaggaacagacctggagaaggacaagattggcatggaggtgaaggtggacagtgatgctggcatccccaagaggcaggagacccagctgaagatcagcgagatgtctgtgccccagggccagggcgcccagatcaagaagtctgtgtctgatgtgccccggggccaggagagccaggtgaagaagtctgagagcggcgtgcccaagggccaggaggcccaggtgaccaagagcggcctggtggtgctgaagggccaggaggcccaggtggagaagtctgagatgggcgtgccccggcggcaggagagccaggtgaagaagagccagagcggcgtgtccaagggccaggaggcccaggtgaagcagcgggagagcgtggtgctgaagggccaggaggcccaggtggagaagtctgagctgaaggtgcccaagggccaggagggccaggtggagaagacagaagcagatgtgcccaaggagcaggaggtgcaggagaagaagtctgaggccggcgtgctgaagggccctgagagccaggtgaagaacacagaggtgtctgtgcctgagaccctggagagccaggtgaagaagtctgagagcggcgtgctgaagggccaggaggcccaggagaagaaggagagctttgaggacaagggcaacaatgacaaggagaaggagagagatgctgagaaggaccccaacaagaaggagaagggggacaagaacaccaagggggacaagggcaaggacaaggtgaagggcaagcgggagagcgagatcaatggagagaagagcaagggcagcaagagggccaaggccaacacaggcaggaagtacaacaagaaggtggaggagtag

SEQ ID NO: 36929 - DNA, 1689 bp, Artificial Sequence
  Description of Artificial Sequence: Synthetic coding sequence
atgacagtgctggagatcaccctggccgtcatcctgaccctgctgggcctggccatcctggccatcctgctgacccgctgggcccggaggaagcagagcgagatgcacatcagccgctacagcagcgagcagagcgcccggctgctggactatgaagatggccggggcagcagacatgcctacagcacccagagcgacaccagctgtgacaaccgggagaggagcaagagggactacacccccagcaccaacagcctggccctgagccgcagcagcatcgccctgccccagggctccatgagcagcatcaagtgcctgcagaccacagaggagctgcccagcaggacagctggggccatgatgcagttcaccgcccccatccctggggccaccggccccatcaagctgagccagaagaccatcgtgcagaccccaggccccatcgtgcagtacccaggccccaacgtgcgcagccacccccacaccatcaccggcccccccagcgccccccggggcccccccatggcccccatcatcatcagccagaggacagccagccagctggccgcccccatccgcatcccccaggtgcacaccatggacagcagcggcaagatcaccctgacccctgtggtgatcctgaccggctacatggatgaggagctggccaagaagccctgcagcaagatccagatcctgaagtgtggcggcacagcccggagccagaacagccgggaggagaacaaggaggccctgaagaatgacatcatcttcaccaacagcgtggagagcctgaagagcgcccacatcaaggagcctgagcgggagggcaagggcacagacctggagaaggacaagattggcatggaggtgaaggtggacagtgatgctggcatccccaagaggcaggagacccagctgaagatcagcgagatgagcatcccccagggccagggcgcccagatcaagaagtctgtgtctgatgtgccccggggccaggagagccaggtgaagaagtctgagagcggcgtgcccaagggccaggaggcccaggtgaccaagagcggcctggtggtgctgaagggccaggaggcccaggtggagaagtctgagatgggcgtgccccggcggcaggagagccaggtgaagaagagccagagcggcgtgtccaagggccaggaggcccaggtgaagaagcgggagagcgtggtgctgaagggccaggaggcccaggtggagaagtctgagctgaaggtgcccaagggccaggagggccaggtggagaagacagaagcagatgtgcccaaggagcaggaggtgcaggagaagaagtctgaggccggcgtgctgaagggccctgagagccaggtgaagaacacagaggtgtctgtgcctgagaccctggagagccaggtgaagaagtctgagagcggcgtgctgaagggccaggaggcccaggagaagaaggagagctttgaagataaaggaaataatgacaaggagaaggagagagatgctgagaaggaccccaacaagaaggagaagggggacaagaacaccaagggggacaagggcaaggacaaggtgaagggcaagcgggagagcgagatcaacggggagaagagcaagggcagcaagagggccaaggccaacacaggcaggaagtacaacaagaaggtggaggagtag

SEQ ID NO: 36930 - DNA, 1692 bp, Artificial Sequence
  Description of Artificial Sequence: Synthetic coding sequence
atgacagtgctggagatcaccctggccgtcatcctgaccctgctgggcctggccatcctggccatcctgctgacccgctgggcccggaggaagcagagcgagatgcacatcagccgctacagcagcgagcagagcgcccggctgctggactatgaagatggccggggcagcagacatgcctacagcacccagagcgacaccagctgtgacaaccgggagaggagcaagagggactacacccccagcaccaacagcctggtgtccatggccagcaagttcagcctgggccagacagagctgatcctgctgctgatgtgcttcatcctggccctgagccgcagcagcatcggcagcatcaagtgcctgcagaccacagaggagctgcccagcaggacagctggggccatgatgcagttcaccgcccccatccctggggccaccggccccatcaagctgagccagaagaccatcgtgcagaccccaggccccatcgtgcagtacccaggccccaatgccggcccccccagcgccccccggggcccccccatggcccccatcatcatcagccagaggacagcccgcatcccccaggtgcacaccatggacagcagcggcaagatcaccctgacccctgtggtgatcctgaccggctacatggatgaggagctggccaagaagccctgcagcaagatccagatcctgaagtgtggcggcacagcccggagccagaacagccgggaggagaacaaggaggccctgaagaatgacatcatcttcaccaacagcgtggagagcctgaagagcgcccacatcaaggagcctgagcgggagggcaaaggaacagacctggagaaggacaagattggcatggaggtgaaggtggacagtgatgctggcatccccaagaggcaggagacccagctgaagatcagcgagatgagcatcccccagggccagggcgcccagatcaagaagtctgtgtctgatgtgccccggggccaggagagccaggtgaagaagtctgagagcggcgtgcccaagggccaggaggcccaggtgaccaagagcggcctggtggtgctgaagggccaggaggcccaggtggagaagtctgagatgggcgtgccccggcggcaggagagccaggtgaagaagagccagagcggcgtgtccaagggccaggaggcccaggtgaagaagcgggagagcgtggtgctgaagggccaggaggcccaggtggagaagtctgagctgaaggtgcccaagggccaggagggccaggtggagaagacagaagcagatgtgcccaaggagcaggaggtgcaggagaagaagtctgaggccggcgtgctgaagggccctgagagccaggtgaagaacacagaggtgtctgtgcctgagaccctggagagccaggtgaagaagtctgagagcggcgtgctgaagggccaggaggcccaggagaagaaggagagctttgaggacaagggcaacaatgacaaggagaaggagagagatgctgagaaggaccccaacaagaaggagaagggggacaagaacaccaagggggacaagggcaaggacaaggtgaagggcaagcgggagagcgagatcaatggagagaagagcaagggcagcaagagggccaaggccaacacaggcaggaagtacaacaagaaggtggaggagtag

SEQ ID NO: 36931 - DNA, 1644 bp, Artificial Sequence
  Description of Artificial Sequence: Synthetic coding sequence
atgacagtgctggagatcaccctggccgtcatcctgaccctgctgggcctggccatcctggccatcctgctgacccgctgggcccggaggaagcagagcgagatgcacatcagccgctacagcagcgagcagagcgcccggctgctggactatgaagatggccggggcagcagacatgcctacagcacccagagcgagaggagcaagagggactacacccccagcaccaacagcctggccctgagccgcagcagcatcgccctgccccagggctccatgagcagcatcaagtgcctgcagaccacagaggagctgcccagcaggacagctggggccatgatgcagttcaccgcccccatccctggggccaccggccccatcaagctgagccagaagaccatcgtgcagaccccaggccccatcgtgcagtacccaggccccaatgccggccccccatctgccccccggggcccccccatggcccccatcatcatcagccagaggacagccagccagctggccgcccccatccgcatcccccaggtgcacaccatggacagcagcggcaagatcaccctgacccctgtggtgatcctgaccggctacatggatgaggagctggccaagaagccctgcagcaagatccagatcctgaagtgtggcggcacagcccggagccagaacagccgggaggagaacaaggaggccctgaagaatgacatcatcttcaccaacagcgtggagagcctgaagagcgcccacatcaaggagcctgagcgggagggcaaaggaacagacctggagaaggacaagattggcatggaggtgaaggtggacagtgatgctggcatccccaagaggcaggagacccagctgaagatcagcgagatgagcatcccccagggccagggcgcccagatcaagaagtctgtgtctgatgtgccccggggccaggagagccaggtgaagaagtctgagagcggcgtgcccaagggccaggaggcccaggtgaccaagagcggcctggtggtgctgaagggccaggaggcccaggtggagaagtctgagatgggcgtgccccggcggcaggagagccaggtgaagaagagccagagcggcgtgtccaagggccaggaggcccaggtgaagaagcgggagagcgtggtgctgaagggccaggaggcccaggtggagaagtctgagctgaaggtgcccaagggccaggagggccaggtggagaagacagaagcagatgtgcccaaggagcaggaggtgcaggagaagaagtctgaggccggcgtgctgaagggccctgagagccaggtgaagaacacagaggtgtctgtgcctgagaccctggagagccaggtgaagaagtctgagagcggcgtgctgaagggccaggaggcccaggagaagaaggagagctttgaggacaagggcaacaatgacaaggagaaggagagagatgctgagaaggaccccaacaagaaggagaagggggacaagaacaccaagggggacaagggcaaggacaaggtgaagggcaagcgggagagcgagatcaatggagagaagagcaagggcagcaagagggccaaggccaacacaggcaggaagtacaacaagaaggtggaggagtag

SEQ ID NO: 36932 - DNA, 189 bp, Artificial Sequence
  Description of Artificial Sequence: Synthetic coding sequence
atgctgcaggtggtgcaggagggcaacccagcccccttcatcatcaacacagtgaagaggggccggcgggaccgggagcggcagaggaccccctgggccccccaccccctgggcttccagggccgccgctacatctatgagagccccaaccaccggggcaaggacagcagcttcctggcccagaagtag

SEQ ID NO: 36933 - DNA, 189 bp, Artificial Sequence; identical to SEQ ID NO: 36932
  Description of Artificial Sequence: Synthetic coding sequence

SEQ ID NO: 36934 - DNA, 189 bp, Artificial Sequence; identical to SEQ ID NO: 36932
  Description of Artificial Sequence: Synthetic coding sequence

SEQ ID NO: 36935 - DNA, 189 bp, Artificial Sequence
  Description of Artificial Sequence: Synthetic coding sequence
atgctgcaggtggtgcaggagggcaacccagcccccttcatcatcaacacagtgaagaggggccggcgggaccgggagcggcagaggaccccctgggccccccaccccctgggcttccaggagcggcgctacatctatgagagccccaaccaccggggcaaggacagcagcttcctggcccagaagtag

SEQ ID NO: 36936 - DNA, 189 bp, Artificial Sequence; identical to SEQ ID NO: 36935
  Description of Artificial Sequence: Synthetic coding sequence

SEQ ID NO: 36937 - DNA, 189 bp, Artificial Sequence; identical to SEQ ID NO: 36935
  Description of Artificial Sequence: Synthetic coding sequence

SEQ ID NO: 36938 - DNA, 708 bp, Artificial Sequence
  Description of Artificial Sequence: Synthetic coding sequence
atgcatgagcacgccacccctgtgaccagcgcctacggggagagacatgaggagctgatcaacctgggcagcccagacagccacaccatcagcgagggccagaagagctctgtgaccagcaagaccaccaggaagggcaaggagaagagcagcgagaaggagaagacagccaaggagaagcaggcccccaggtttgagccccagatcagcacagtgcacccccagcaggaggaccccaacaagccctactggatcctgcggctggtgacagagcacaatgaaagtgagctgtttgaggtgaagaaggacacagaaagagcagatgagatccgggccatgaagcaggcctgggagaccacagagcccggccgggccatcaaggccagccaggcccggctgcactacctgagcggcttcatcaagaagaccagtgatgctgagagcccccccatcagcgagagccagaccaagcccaaggaggaggtggagacagctgcccggggcgtgaaggagcccaacagcaagaacagcgctggcagcgagagcaaggagatgacccagacaggcagcggcagcgctgtgtggaagaagtggcagctgaccaagggcctgagagatgtggccaagagcaccagcagcgagagcggaggagtgagcagccctgggaaggaggagcgggagcagagcaccaggaaagaaaacatctag

SEQ ID NO: 36939 - DNA, 2142 bp, Artificial Sequence
  Description of Artificial Sequence: Synthetic coding sequence
acagatgagcagacagactttggcctgggagatgcccaccagagtgatggcctgaacctggagcgggagatcgtgtcccagaccacagccacccaggagaagagccaggaggagctgcccaccaccaacaacagcgtgtccaaggagatctggctggactttgaggacttctgtgtgtgcttccagaacatctacatcttccacaagcccagcagctactgcctgaacttccagaagtctgagttcaagttcagcgaggagcgggtgtcctactacctgtttgtggacagcctgaagcccatcgagctgctggtgtgcttcagcgccctggtgcgctggggcgagtatggagccctgaccaaggacagcccccccatcgagcccggcctgctgacagctgagaccttctcctggaagagcctgaagccaggcagcctggtgctgaagatccacacctacgccaccaaggccaccgtggtgcggctgcctgtgggccgccacatgctgctcttcaatgcctacagccctgtgggccacagcatccacatctgcagcatggtgtcctttgtgattggagatgaacatgtggtgctgcccaactttgagcctgagagctgccgcttcacagagcagagcctgctgatcatgaaggccatcggaaatgtgattgccaacttcaaggacaagggcaagctgtctgctgccctgaaggacctgcagacagcccactaccctgtgcccttccatgacaaggagctgacagcccagcacttccgggtcttccacctgagcctgtggaggctgatgaagaaggtgcagatcaccaagcccccacccaacttcaagtttgccttccgggccatggtgctggacctggagctgctgaacagcagcctggaggaggtgtccctggtggagtggctggatgtgaagtactgcatgcccaccagtgacaaggagtacagcgctgaggaggtggccgccgccatcaagatccaggccatgtggaggggcacctacgtgcggctgctgatgaaggcccgcatcccagacaccaaggagaacatctctgtggccgacaccctgcagaaggtgtgggccgtgctggagatgaacctggagcagtatgctgtgtccctgctgcggctgatgttcaagagcaagtgcaagagcctggagagctacccctgctaccaggatgaggagaccaagatcgcctttgctgactacacagtgacctaccaggagcagccccccaacagctggttcatcgtgttccgggagaccttcctggtgcaccaggacatgatcctggtgcccaaggtgtacaccaccctgcccatctgcatcctgcacatcgtgaacaatgacaccatggagcaggtgcccaaggtgttccagaaggtggtgccctacctgtacaccaagaacaagaagggctacacctttgtggccgaggccttcaccggggacacctacgtggccgccagccgctggaagctgcggctcatcggcagcagcgcccccctgccctgcctgagccgggacagcccctgcaacagctttgccatcaaggagatccgggactactacatccccaatgacaagaagatcctcttccgctacagcgtgaaggtgctgaccccccagcctgccaccatccaggtgaggaccagcaagccagatgccttcatcaagctgcaggtgctggagaatgaggagaccatggtgagcagcacaggcaagggccaggccatcatcccagccttccacttcctgaagtctgagaagggcctgagcagccagagctatggagagagacatgaggagctgatcaacctgggcagcccagacagccacaccatcagcgagggccagaagagctctgtgaccagcaagaccaccaggaagggcaaggagaagagcagcgagaaggagaagacagccaaggagaagcaggcccccaggtttgagccccagatcagcacagtgcacccccagcaggaggaccccaacaagccctactggatcctgcggctgctgcggctggtgtgcatcaccctggccggcagcctgaggaagcacctgatgctgcgggtgcggctgtacctgaaggccaagctgaaccagaagaagaagtag

SEQ ID NO: 36940 - DNA, 5004 bp, Artificial Sequence
  Description of Artificial Sequence: Synthetic coding sequence
atggccagcaagcagaccaagaagaaggaggtgcaccgcatcaacagcgcccacggcagtgacaagagcaaggacttctaccccttcggcagcaatgtgcagagcggcagcacagagcagaagaagggcaagttccccctgtggccagagtggagcgaggccgacatcaacagcgagaagtgggatgctggaaaaggagccaaggagaaggacaagacaggcaagagccctgtgttccacttctttgaagatcctgagggcaagattgagctgccccccagcctgaagatctacagctggaagaggccccaggacatcctcttcagccagacccctgtggtggtgaagaatgagatcacctttgacctcttcagcgccaatgagcacctgctgtgcagcgagctgatgcgctggatcatcagcgagatctatgctgtgtggaagatcttcaatggaggcatcctgagcaactacttcaagggcaccagcggggagccccccctgctgccctggaagccctgggagcacatctacagcctgtgcaaggctgtgaagggccacatgcccctcttcaacagctatggcaagtatgtggtgaagctgtactggatgggctgctggaggaagatcaccattgatgacttcctgccctttgatgaggacaacaacctgctgctgcctgccaccacctatgaatttgagctgtggcccatgctgctgagcaaggccatcatcaagctggccaacatcgacatccacgtggccgacagaagagagctgggggagttcaccgtcatccacgccctgaccggctggctgcctgaggtgatcagcctgcaccctggctacatggacaaggtgtgggagctgctgaaggagatcctgcctgagttcaagctgagtgatgaggccagcagcgagagcaagattgctgtgctggacagcaagctgaaggagcccgggaaggagggcaaggagggcaaggagatcaaggatggcaaggaggtgaaggatgtgaaggagttcaagccagagagcagcctgaccaccctgaaggcccctgagaagagtgacaaggtgcccaaggagaaggcagatgcccgggacatcggcaagaagaggagcaaggatggagagaaggagaagttcaagttcagcctgcacggcagccggcccagcagcgaggtgcagtacagcgtgcagagcctgagtgactgcagcagcgccatccagaccagccacatggtggtgtatgccaccttcacccccctgtacctgtttgagaacaagatcttcagcctggagaagatggctgacagcgctgagaagctgcgggagtatggcctgagccacatctgcagccaccctgtgctggtgaccaggagccgcagctgccccctggtggccccacccaagcccccacccctgcccccctggaagctgatccggcagaagaaggagaccgtcatcacagatgaggcccaggagctgattgtgaagaagccagagcgcttcctggagatcagcagccccttcctgaactacaggatgacccccttcaccatccccacagagatgcactttgtgcgcagcctcatcaagaagggcatccccccaggcagtgacctgcccagcgtgtctgaaacagatgaaacagccacccacagccagacagacctgagccagatcaccaaggccaccagccagggcaacacagccagccaggtgatcctgggcaagggcacagatgagcagacagactttggcctgggagatgcccaccagagtgatggcctgaacctggagcgggagatcgtgtcccagaccacagccacccaggagaagagccaggaggagctgcccaccaccaacaacagcgtgtccaaggagatctggctggactttgaggacttctgtgtgtgcttccagaacatctacatcttccacaagcccagcagctactgcctgaacttccagaagtctgagttcaagttcagcgaggagcgggtgtcctactacctgtttgtggacagcctgaagcccatcgagctgctggtgtgcttcagcgccctggtgcgctggggcgagtatggagccctgaccaaggacagcccccccatcgagcccggcctgctgacagctgagaccttctcctggaagagcctgaagccaggcagcctggtgctgaagatccacacctacgccaccaaggccaccgtggtgcggctgcctgtgggccgccacatgctgctcttcaatgcctacagccctgtgggccacagcatccacatctgcagcatggtgtcctttgtgattggagatgagcacgtggtgctgcccaactttgagcctgagagctgccgcttcacagagcagagcctgctgatcatgaaggccatcggaaatgtcatcgccaacttcaaggacaagggcaagctgtctgctgccctgaaggacctgcagacagcccactaccctgtgcccttccatgacaaggagctgacagcccagcacttccgggtcttccacctgagcctgtggaggctgatgaagaaggtgcagatcaccaagcccccacccaacttcaagtttgccttccgggccatggtgctggacctggagctgctgaacagcagcctggaggaggtgtccctggtggagtggctggatgtgaagtactgcatgcccaccagtgacaaggagtacagcgctgaggaggtggccgccgccatcaagatccaggccatgtggaggggcacctacgtgcggctgctgatgaaggcccgcatcccagacaccaaggagaacatctctgtggccgacaccctgcagaaggtgtgggccgtgctggagatgaacctggagcagtatgctgtgtccctgctgcggctgatgttcaagagcaagtgcaagagcctggagagctacccctgctaccaggatgaggagaccaagatcgcctttgctgactacacagtgacctaccaggagcagccccccaacagctggttcatcgtgttccgggagaccttcctggtgcaccaggacatgatcctggtgcccaaggtgtacaccaccctgcccatctgcatcctgcacatcgtgaacaatgacaccatggagcaggtgcccaaggtgttccagaaggtggtgccctacctgtacaccaagaacaagaagggctacacctttgtggccgaggccttcaccggggacacctacgtggccgccagccgctggaagctgcggctgattggcagcagcgcccccctgccctgcctgagccgggacagcccctgcaacagctttgccatcaaggagatccgggactactacatccccaatgacaagaagatcctcttccgctacagcgtgaaggtgctgaccccccagcctgccaccatccaggtgaggaccagcaagccagatgccttcatcaagctgcaggtgctggagaatgaggagaccatggtgagcagcacaggcaagggccaggccatcatcccagccttccacttcctgaagtctgagaagggcctgagcagccagagcagcaagcacatcctgtccttccacagcgccagcaagaaggagcaggaggtgtatgtgaagaagaaggccgcccagggcatccagaagagccccaagggccgggctgtgtctgccatccaggacatcggcctgcccctggtggaggaggagaccaccagcacccccacccgggaggacagcagcagcacccccctgcagaactacaagtacatcatccagtgcagcgtgctgtacaacagctggcccctgacagagagccagctgacctttgtgcaggccctgaaggacctgaagaagagcaacaccaaggcctatggagagagacatgaggagctgatcaacctgggcagcccagacagccacaccatcagcgagggccagaagagctctgtgaccagcaagaccaccaggaagggcaaggagaagagcagcgagaaggagaagacagccaaggagaagcaggcccccaggtttgagccccagatcagcacagtgcacccccagcaggaggaccccaacaagccctactggatcctgcggctggtgacagagcacaatgaaagtgagctgtttgaggtgaagaaggacacagagcgggcagatgagatccgggccatgaagcaggcctgggagaccacagagcccggccgggccatcaaggccagccaggcccggctgcactacctgagcggcttcatcaagaagaccagtgatgctgagagcccccccatcagcgagagccagaccaagcccaaggaggaggtggagacagctgcccggggcgtgaaggagcccaacagcaagaacagcgctggcagcgagagcaaggagatgacccagacaggcagcggcagcgctgtgtggaagaagtggcagctgaccaagggcctgagagatgtggccaagagcaccagcagcgagagcggcggcgtgagcagccctgggaaggaggagcgggagcagagcaccaggaaggagaacatccagacaggccccaggaccaggagccccaccatcctggagaccagccccaggctcatcaggaaggccctggagttcatggacctgagccagtatgtgaggaagacagacacagaccccctgctgcagacagatgagctgaaccagcagcaggccatgcagaaggccgaggagatccaccagttccggcagcacaggaccagggtgctgagcatccggaacatcgaccaggaggagcggctgaagctgaaggatgaggtgctggacatgtacaaggagatgcaggacagcctggatgaggcccggcagaagatctttgacatccgggaggagtacagaaacaagctgctggaggccgagcacctgaagctggagaccctggccgcccaggaggccgccatgaagctggagacagagaagatgaccccagccccagacacccagaagaagaagaagggcaagaagaagtag

SEQ ID NO: 36941 - DNA, 153 bp, Artificial Sequence
  Description of Artificial Sequence: Synthetic coding sequence
atgctgcggagcaccttcaccgtgcactggaccaccatcctgggcatctgccggcccatcaagcccatctacaagagccaggcctgccccctgtctgagaagagaaatgctgacaaccacctggtgtctgaggacaacaccttcaaggtgtag

SEQ ID NO: 36942 - DNA, 297 bp, Artificial Sequence
  Description of Artificial Sequence: Synthetic coding sequence
atgctgcggagcaccttcaccgtgcactggaccaccatcctgggcatctgccggcccatcaagcccatctacaagagccaggcctgccccctgtctgagaagagaaatgctgacaaccacctggtgtctgaggacaacaccttcaaggagcctgagcgctacatcagcagcagctgtgtgctgaccagcatcctgtacctgggggagaagaccttctccttccgcaccctcatcagcccccggggcatgaagctggtggagatcctgcagcagcccagcctgaccatggtggcctag

SEQ ID NO: 36943 - DNA, 246 bp, Artificial Sequence
  Description of Artificial Sequence: Synthetic coding sequence
atgaatgtggaccacgaggtgaacctgctggtggaggagatccaccggctgggcagcaagaatgctgatggcaagctgtctgtgaagtttggagtgctcttcagagatgacaagtgtgccaacctgtttgaggccctggtgggcaccctgaaggccgccaagaggaggaagatcgtgacctacccaggagagctgctgctgcagggcgtgcatgatgatgtggacatcatcctgctgcaggactag

SEQ ID NO: 36944 - DNA, 204 bp, Artificial Sequence
  Description of Artificial Sequence: Synthetic coding sequence
atgaatgtggaccacgaggtgaacctgctggtggaggagatccaccggctgggcagcaagagcaagtacctgacagaaattgagtacttctcctggctgtacctgggcactggagagaccggcatgctggagaagcccatgaagggcagcccccgggccagcggccacaggagcggcagcagcgcccacagcccccggctgtag

SEQ ID NO: 36945 - DNA, 1374 bp, Artificial Sequence
  Description of Artificial Sequence: Synthetic coding sequence
atggacaggagcctgagaaatgtgctggtggtgtcctttggcttcctgctgctcttcaccgcctacggcggcctgcagagcctgcagagcagcctgtacagcgaggagggcctgggcgtgacagccctgagcaccctgtatggaggcatgctgctgagctccatgttcctgccccccctgctgattgaaaggctgggctgcaagggcaccatcatcctgtccatgtgtggctacgtggccttctctgtgggcaacttctttgcctcctggtacaccctcatccccaccagcatcctgctgggcctgggcgccgcccccctgtggagcgcccagtgcacctacctgaccatcaccggcaacacccatgctgagaaggccggcaagaggggcaaggacatggtgaaccagtacttcggcatcttcttcctgatcttccagagcagcggcgtgtggggcaacctgatcagcagcctggtgtttggccagacccccagccaggagaccctgcctgaggagcagctgaccagctgtggggccagtgactgcctgatggccaccaccaccaccaacagcacccagaggcccagccagcagctggtgtacaccctgctgggcatctacacaggcagcggcgtgctggccgtgctgatgattgctgccttcctgcagcccatcagagatgtgcagcgggagagcgagggggagaagaagtctgtgcccttctggagcaccctgctgagcaccttcaagctgtacagagacaagaggctgtgcctgctgatcctgctgcccctgtacagcggcctgcagcagggcttcctgagcagcgagtacaccaggagctatgtgacctgcaccctgggcatccagtttgtgggctacgtgatgatctgcttcagcgccacagatgccctgtgcagcgtgctgtatggcaaggtgtcccagtacacaggccgggctgtgctgtatgtgctgggcgctgtgacccacgtgtcctgcatgattgccctgctgctgtggaggcccagggctgaccacctggccgtgttctttgtgttcagcggcctgtggggcgtggctgatgctgtgtggcagacccagaacaatgccctgtatggagtgctgtttgagaagagcaaggaggccgcctttgccaactaccgcctgtgggaggccctgggctttgtgattgccttcggctacagcatgttcctgtgtgtgcacgtgaagctgtacatcctgctgggcgtgctgagcctgaccatggtggcctacggcctggtggagtgtgtggagagcaagaaccccatccggccccacgcccctggccaggtgaaccaggctgaagatgaggagatccagaccaagatgtag

SEQ ID NO: 36946 - DNA, 912 bp, Artificial Sequence
  Description of Artificial Sequence: Synthetic coding sequence
atgaaggaggccctggcccacttcaccatccacacagccctggtgcccagcgaggcccaggacacccccctcttccgctacctgaacccccaggccagcctgagccacaccagcgaggaggacttcctgcctgtggaggccgtgcgggagggcaaggaggagaagaagggcggccccccaggccggggccccccaggctggaggagaagagaggagctgcggctgcctgacctgaaggtgctgtgctaccaggaggccggcagccggggcacccgggacagacaccactacgtgagcagctacctggccggggccaccagcgctgaccgctacaggatgttcctgcgcttccagaaggaggtgctggccaagcaggacctgctgaagaatgacttcaccggcagcaaggctgctgctggccacgagaggaagctgcagcaggagctgcagaagatctgcacctgcagcccccagcagttcaaccggctgcacgtgtttgggaaggtgtttgaggacatctgcaacagcagcctcatctttggagacctgctgaagaaggtgaaggatgaatatgagctgtacatggccaccctgctggagagccagcctgctgcccagtatgaggccctgctggcccagctgaaggccctgggccagaggcctgtgaagacagctgacatggacctggcccgggaggagctgaggatgctggtgacagccaccaaggccgccctggagcagaatgaccggctgcggtctgagctggagatggaggtggccctgctgcagagcgccaaggagaggagcggccgctgcctgtgtgatgtgctgccctacggctgctttgctgtgaccttcatcatctctgctgctgctgtgtggctgcctgtgtgccagctgggccgctgctag

SEQ ID NO: 36947 - DNA, 174 bp, Artificial Sequence
  Description of Artificial Sequence: Synthetic coding sequence
atgggcacagctgtgggcccccaccacagccctgcccctcatgacagcgccctgcctgcccggctgctgaccagtgacttcccctacggccgcagctgccagatcgagcaggtgaagtacagcgtgcctgacaccggcctcttccagcactgggagggcagcatccccacctag

SEQ ID NO: 36948 - DNA, 174 bp, Artificial Sequence; identical to SEQ ID NO: 36947
  Description of Artificial Sequence: Synthetic coding sequence

SEQ ID NO: 36949 - DNA, 462 bp, Artificial Sequence
  Description of Artificial Sequence: Synthetic coding sequence
atggctgctgccctggccctggtggccggcgtgctgtctggagctgtgctgcccctgtggagcgccctgccccagtacaagaagaagatcacagaccgctgcttccaccacagcgagtgctacagcggctgctgcctgatggacctggacagcggcggggccttctgtgccccccgggcccgcatcaccatgatctgcctgccccagtggctggagctgttcaagggccgggaccgcatcatcttcatctatgaggcccccacccccagcctggtgtctgcccacaaccagggcagctaccagcaccacctgcccctgcctgatggcctggatgtgcacatccagggcctggatgtgtttcctcctgtgccctatgacctggaggaggatgctggctggagcctgctgccctggggccaccggccctggctgccccccacctgcagcaagagcagcagctag

SEQ ID NO: 36950 - DNA, 546 bp, Artificial Sequence
  Description of Artificial Sequence: Synthetic coding sequence
atgtaccagcccagcagaggagctgcccggcggctgggcccctgcctgcgggcctaccaggcccggccccagctgcccaagctgttcctgcagagccatgactacagcctgtacagcctggatgtggagttcatcaatgagatcctgaacatccgcaccaagggccgcacctggtacatcctgagcctgaccctgtgccgcttcctggcctggaactactttgcccacctgcggctggaggtgctgcagctgaccaggcaccctgagaactggaccctgcaggcccgctggaggctggtgggcctgcctgtgcacctgctcttcctgcgcttctacaagagggacaaggatgagcactaccgcacctatgatgcctacagcaccttctacctgaacagcagcggcctcatctgccgccaccggctggacaagctgatgcccagccacagcccccccacccctgtgaagaagctgctggtgggcgccctggtggccctgggcctgtctgagcctgagccagacctgaacctgtgcagcaagccctag

SEQ ID NO: 36951 - DNA, 948 bp, Artificial Sequence
  Description of Artificial Sequence: Synthetic coding sequence
atgtaccagcccagcagaggagctgcccggcggctgggcccctgcctgcgggcctaccaggcccggccccaggaccagctgtacccaggcaccctgcccttcccccccctgtggccccacagcaccaccaccaccagccccagcagccccctcttctggagccccctgcccccccggctgcccacccagaggctgccccaggtgccccccctgcccctgccccagatccaggccctgagcagcgcctgggtggtgctgcccccaggcaagggggaggagggccctggccctgagctgcacagcggctgcctggatggcctgcggagcctgtttgagggccccccctgcccctacccaggggcctggatccccttccaggtgcccggcacagcccaccccagccctgccaccccatctggggaccccagcatggaggagcacctgtctgtgatgtatgaaaggctgcggcaggagctgcccaagctgttcctgcagagccatgactacagcctgtacagcctggatgtggagttcatcaatgagatcctgaacatccgcaccaagggccgcacctggtacatcctgagcctgaccctgtgccgcttcctggcctggaactactttgcccacctgcggctggaggtgctgcagctgaccaggcaccctgagaactggaccctgcaggcccgctggaggctggtgggcctgcctgtgcacctgctcttcctgcgcttctacaagagggacaaggatgagcactaccgcacctatgatgcctacagcaccttctacctgaacagcagcggcctcatctgccgccaccggctggacaagctgatgcccagccacagcccccccacccctgtgaagaagctgctggtgggcgccctggtggccctgggcctgtctgagcctgagccagacctgaacctgtgcagcaagccctag

SEQ ID NO: 36952 - DNA, 1302 bp, Artificial Sequence
  Description of Artificial Sequence: Synthetic coding sequence
ctgcccacctgtgccctgcagagggtggaccggctgggcgtggccggggccggcggccgccgctgccgggcctgccgggcccggacctctgtgctgcccggcctgcgggctgtgagaagaggccagggccaggccgccggccgggtgtgtgtggccccagacagcccccggctgcctgtgcccaggggggacctgaagggccggggccgggagatccgcagccctgctgctgcccccagccgcagcagccctgcccagaccaggcctgctggccggccccagcagcctgcccggctggccctgggggagaggtcctggcaggagggccggcctgtgtgcacccgcttcggccccctgcggcccggctggcaggacggccacgcccccagcagagatggagccagcaggaccccatctggaacagaggaccagctgtacccaggcaccctgcccttcccccccctgtggccccacagcaccaccaccaccagccccagcagccccctcttctggagccccctgcccccccggctgcccacccagaggctgccccaggtgccccccctgcccctgccccagatccaggccctgagcagcgcctgggtggtgctgcccccaggcaagggggaggagggccctggccctgagctgcacagcggctgcctggatggcctgcggagcctgtttgagggccccccctgcccctacccaggggcctggatccccttccaggtgcccggcacagcccaccccagccctgccaccccatctggggaccccagcatggaggagcacctgtctgtgatgtatgaaaggctgcggcaggagctgcccaagctgttcctgcagagccatgactacagcctgtacagcctggatgtggagttcatcaatgagatcctgaacatccgcaccaagggccgcacctggtacatcctgagcctgaccctgtgccgcttcctggcctggaactactttgcccacctgcggctggaggtgctgcagctgaccaggcaccctgagaactggaccctgcaggcccgctggaggctggtgggcctgcctgtgcacctgctcttcctgcgcttctacaagagggacaaggatgagcactaccgcacctatgatgcctacagcaccttctacctgaacagcagcggcctcatctgccgccaccggctggacaagctgatgcccagccacagcccccccacccctgtgaagaagctgctggtgggcgccctggtggccctgggcctgtctgagcctgagccagacctgaacctgtgcagcaagccctag

SEQ ID NO: 36953 - DNA, 546 bp, Artificial Sequence; identical to SEQ ID NO: 36950
  Description of Artificial Sequence: Synthetic coding sequence

SEQ ID NO: 36954 - DNA, 546 bp, Artificial Sequence; identical to SEQ ID NO: 36950
  Description of Artificial Sequence: Synthetic coding sequence

SEQ ID NO: 36955 - DNA, 546 bp, Artificial Sequence; identical to SEQ ID NO: 36950
  Description of Artificial Sequence: Synthetic coding sequence

SEQ ID NO: 36956 - DNA, 948 bp, Artificial Sequence; identical to SEQ ID NO: 36951
  Description of Artificial Sequence: Synthetic coding sequence

SEQ ID NO: 36957 - DNA, 948 bp, Artificial Sequence; identical to SEQ ID NO: 36951
  Description of Artificial Sequence: Synthetic coding sequence

SEQ ID NO: 36958 - DNA, 1302 bp, Artificial Sequence; identical to SEQ ID NO: 36952
  Description of Artificial Sequence: Synthetic coding sequence

SEQ ID NO: 36959 - DNA, 948 bp, Artificial Sequence; identical to SEQ ID NO: 36951
  Description of Artificial Sequence: Synthetic coding sequence

SEQ ID NO: 36960 - DNA, 948 bp, Artificial Sequence; identical to SEQ ID NO: 36951
  Description of Artificial Sequence: Synthetic coding sequence

SEQ ID NO: 36961 - DNA, 1302 bp, Artificial Sequence; identical to SEQ ID NO: 36952
  Description of Artificial Sequence: Synthetic coding sequence

SEQ ID NO: 36962 - DNA, 1302 bp, Artificial Sequence; identical to SEQ ID NO: 36952
  Description of Artificial Sequence: Synthetic coding sequence

SEQ ID NO: 36963 - DNA, 948 bp, Artificial Sequence; identical to SEQ ID NO: 36951
  Description of Artificial Sequence: Synthetic coding sequence

SEQ ID NO: 36964 - DNA, 1302 bp, Artificial Sequence
  Description of Artificial Sequence: Synthetic coding sequence
ctgcccacctgtgccctgcagagggtggaccggctgggcgtggccgaggccggcggccgccgctgccgggcctgccgggcccggacctctgtgctgcccggcctgcgggctgtgagaagaggccagggccaggccgccggccgggtgtgtgtggccccagacagcccccggctgcctgtgcccaggggggacctgaagggccggggccgggagatccgcagccctgctgctgcccccagccgcagcagccctgcccagaccaggcctgctggccggccccagcagcctgcccggctggccctgggggagaggtcctggcaggagggccggcctgtgtgcacccgcttcggccccctgcggcccggctggcaggacggccacgcccccagcagagatggagccagcaggaccccatctggaacagaggaccagctgtacccaggcaccctgcccttcccccccctgtggccccacagcaccaccaccaccagccccagcagccccctcttctggagccccctgcccccccggctgcccacccagaggctgccccaggtgccccccctgcccctgccccagatccaggccctgagcagcgcctgggtggtgctgcccccaggcaagggggaggagggccctggccctgagctgcacagcggctgcctggatggcctgcggagcctgtttgagggccccccctgcccctacccaggggcctggatccccttccaggtgcccggcacagcccaccccagccctgccaccccatctggggaccccagcatggaggagcacctgtctgtgatgtatgaaaggctgcggcaggagctgcccaagctgttcctgcagagccatgactacagcctgtacagcctggatgtggagttcatcaatgagatcctgaacatccgcaccaagggccgcacctggtacatcctgagcctgaccctgtgccgcttcctggcctggaactactttgcccacctgcggctggaggtgctgcagctgaccaggcaccctgagaactggaccctgcaggcccgctggaggctggtgggcctgcctgtgcacctgctcttcctgcgcttctacaagagggacaaggatgagcactaccgcacctatgatgcctacagcaccttctacctgaacagcagcggcctcatctgccgccaccggctggacaagctgatgcccagccacagcccccccacccctgtgaagaagctgctggtgggcgccctggtggccctgggcctgtctgagcctgagccagacctgaacctgtgcagcaagccctag

SEQ ID NO: 36965 - DNA, 1302 bp, Artificial Sequence; identical to SEQ ID NO: 36952
  Description of Artificial Sequence: Synthetic coding sequence

SEQ ID NO: 36966 - DNA, 546 bp, Artificial Sequence; identical to SEQ ID NO: 36950
  Description of Artificial Sequence: Synthetic coding sequence

SEQ ID NO: 36967 - DNA, 546 bp, Artificial Sequence; identical to SEQ ID NO: 36950
  Description of Artificial Sequence: Synthetic coding sequence

SEQ ID NO: 36968 - DNA, 1491 bp, Artificial Sequence
  Description of Artificial Sequence: Synthetic coding sequence
atgtaccagcccagcagaggagctgcccggcggctgggcccctgcctgcgggcctaccaggcccggccccaggtgtctggaggagaggagggcggcagaagaggaggaggagagcggcccagcagcaagcctgtgagaggagctgagcgggccctgggcagcgcccaggcccagaggcaccccccacccctgcccacctgtgccctgcagagggtggaccggctgggcgtggccggggccggcggccgccgctgccgggcctgccgggcccggacctctgtgctgcccggcctgcgggctgtgcggcggggccagggccaggccgccggccgggtgtgtgtggccccagacagcccccggctgcctgtgcccaggggggacctgaagggccggggccgggagatccgcagccctgctgctgcccccagccgcagcagccctgcccagaccaggcctgctggccggccccagcagcctgcccggctggccctgggggagaggtcctggcaggagggccggcctgtgtgcaccaggtttggccccctgcggcccggctggcaggacggccacgcccccagcagagatggagccagcaggacccccagcggcacagaggaccagctgtacccaggcaccctgcccttcccccccctgtggccccacagcaccaccaccaccagccccagcagccccctcttctggagccccctgcccccccggctgcccacccagaggctgccccaggtgccccccctgcccctgccccagatccaggccctgagcagcgcctgggtggtgctgcccccaggaaaaggagaggagggccctggccctgagctgcacagcggctgcctggatggcctgcggagcctgtttgagggccccccctgcccctacccaggggcctggatccccttccaggtgcctggaacagcccaccccagccctgccacccccagcggggaccccagcatggaggagcacctgtctgtgatgtatgagcggctgcggcaggagctgcccaagctgttcctgcagagccatgactacagcctgtacagcctggatgtggagttcatcaatgagatcctgaacatccgcaccaagggccgcacctggtacatcctgagcctgaccctgtgccgcttcctggcctggaactactttgcccacctgcggctggaggtgctgcagctgaccaggcaccctgagaactggaccctgcaggcccgctggaggctggtgggcctgcctgtgcacctgctcttcctgcgcttctacaagagggacaaggatgagcactaccgcacctatgatgcctacagcaccttctacctgaacagcagcggcctcatctgccgccaccggctggacaagctgatgcccagccacagcccccccacccctgtgaagaagctgctggtgggcgccctggtggccctgggcctgtctgagcctgagccagacctgaacctgtgcagcaagccctag

SEQ ID NO: 36969 - DNA, 1491 bp, Artificial Sequence; identical to SEQ ID NO: 36968
  Description of Artificial Sequence: Synthetic coding sequence

SEQ ID NO: 36970 - DNA, 1491 bp, Artificial Sequence; identical to SEQ ID NO: 36968
  Description of Artificial Sequence: Synthetic coding sequence

SEQ ID NO: 36971 - DNA, 1491 bp, Artificial Sequence; identical to SEQ ID NO: 36968
  Description of Artificial Sequence: Synthetic coding sequence

SEQ ID NO: 36972 - DNA, 1491 bp, Artificial Sequence
  Description of Artificial Sequence: Synthetic coding sequence
atgtaccagcccagcagaggagctgcccggcggctgggcccctgcctgcgggcctaccaggcccggccccaggtgtctggaggagaggagggcggcagaagaggaggaggagagcggcccagcagcaagcctgtgagaggagctgagcgggccctgggcagcgcccaggcccagaggcaccccccacccctgcccacctgtgccctgcagagggtggaccggctgggcgtggccgaggccggcggccgccgctgccgggcctgccgggcccggacctctgtgctgcccggcctgcgggctgtgcggcggggccagggccaggccgccggccgggtgtgtgtggccccagacagcccccggctgcctgtgcccaggggggacctgaagggccggggccgggagatccgcagccctgctgctgcccccagccgcagcagccctgcccagaccaggcctgctggccggccccagcagcctgcccggctggccctgggggagaggtcctggcaggagggccggcctgtgtgcaccaggtttggccccctgcggcccggctggcaggacggccacgcccccagcagagatggagccagcaggacccccagcggcacagaggaccagctgtacccaggcaccctgcccttcccccccctgtggccccacagcaccaccaccaccagccccagcagccccctcttctggagccccctgcccccccggctgcccacccagaggctgccccaggtgccccccctgcccctgccccagatccaggccctgagcagcgcctgggtggtgctgcccccaggaaaaggagaggagggccctggccctgagctgcacagcggctgcctggatggcctgcggagcctgtttgagggccccccctgcccctacccaggggcctggatccccttccaggtgcctggaacagcccaccccagccctgccacccccagcggggaccccagcatggaggagcacctgtctgtgatgtatgagcggctgcggcaggagctgcccaagctgttcctgcagagccatgactacagcctgtacagcctggatgtggagttcatcaatgagatcctgaacatccgcaccaagggccgcacctggtacatcctgagcctgaccctgtgccgcttcctggcctggaactactttgcccacctgcggctggaggtgctgcagctgaccaggcaccctgagaactggaccctgcaggcccgctggaggctggtgggcctgcctgtgcacctgctcttcctgcgcttctacaagagggacaaggatgagcactaccgcacctatgatgcctacagcaccttctacctgaacagcagcggcctcatctgccgccaccggctggacaagctgatgcccagccacagcccccccacccctgtgaagaagctgctggtgggcgccctggtggccctgggcctgtctgagcctgagccagacctgaacctgtgcagcaagccctag

SEQ ID NO: 36973 - DNA, 1491 bp, Artificial Sequence; identical to SEQ ID NO: 36968
  Description of Artificial Sequence: Synthetic coding sequence

SEQ ID NO: 36974 - DNA, 735 bp, Artificial Sequence
  Description of Artificial Sequence: Synthetic coding sequence
atgaatgacccctttgccaggatggagacccggggcccccagggcgccgccaaccccatggacagcagccgcagcctgggggacctgggccccttcccccgggaggtgggccgcggggcccccctggcccctggggccagaaatcctgccacagctggggccagccgcagccagggcggcggccacgaggacagaacagctgaccgggccctgggccccagggctggggaggagctggaccgggagagctgggtgcgggagaaggtgctcttcctgctgcaccctgagcgctggctgggcaccaggggggaccctgcccgggaggaggtggccggggctgaggacctgccccatgctggaggagaggaccacggggaggagcccaactaccccagcgtcttccagaggcagaagaggatctctggaagaagagtggcccccccaagagatgctgctgacccccccaagtatgtgctggtgcgggtggaggactaccaggtgacccaggaggtgctgcagacctcctgggccaagggccgcatgaccaccaggacagaggagcactttgtgacagccctgaccttccgcagcagccgggagggccagcctggagagcgctggggccctgctgagagccgggccctgcaggccaggactggagccagccgggtgcacgccgccggcagaagagtgagccccagccctggcacctggctggaggagatcaagctgtag

SEQ ID NO: 36975 - DNA, 1527 bp, Artificial Sequence
  Description of Artificial Sequence: Synthetic coding sequence
atgggcagaagaaatgaaaactgtgccaacagcctgcgggtgagcaacatcagccaggagaacctgagccactggaacctggacagcgaggtgcctgtgtctgagaacaagaacctgcctgctggaagagatggagctgctgggggcaagatcaacaagaactacctggagatccctgtggagcagctgatgctggagcccaacctgtctgtgcacagccagaagagcacccagaacagcaagcagggcatcttccagctgtggaactgccccctgaatgaaggcagcaccatcgagaagcgggagttcaagaagagctctgtggagaccggcttcaacgtcatcaaccaccccatccgggtcttcaccctgaaccaccccctgaccatcgcctctgtggacaagcaggtgggcccctacccaggcctgcccatgcccctgggcctgtgctggccctatgcagatggagacttcttcaagaacagaaatgagatccacgtgagcagctgcagcaccatcgagaacaatgatggagagaccctgcctgcccccaactggaacctgaagcacggcaacagctctgtggaggagaacttcacagatgaaagtgacctgtctgaaaatgagaagaccaatgacaccctgctgagctacttcaagaaggtggacctgaacctgaagccagagaccatcaagaatgtggaggagcccttcacagaggagcccaatgaggtgttcccctacccagacttcctgcccccacccttcagcgccctggacctgcacaacctggccctgagcaagagtgacaactggaaggtgacagtggaccctgctgagacctctgtggagcacctgatcacccggctgctggagctggagcggctgcagcacatgaccatccagaaggagcggccccggctgcagaccaccttctgcaccccagctgtgacagagcggcccagcagcagcaaggccacccccaaggtgcggcagcccaagctgtgtgacagcctgagcctgcagatcccctgtgtggacaagagccaggagaagagcaagaacaacagcggcagctgcaagctggagcagaatgccctgaagaggaactggagcaatgctgggaagtaccgctggaacagccggcccctgagcctgaagagcagcagcacccccaagcagctgattgagacctatgacaagaaccccaagagcagcatcctgagcccctgccaggagctgtccttcaagcccaccatcggccacaccaaccagagcatggtgaagatggtgtccacccgctgcctgccctggaggagccccatgcctgtgagccccatccccctgaccttccctgagaaccagaaggaggagatcaaggcccccaagaggaactttggcaccaagaagaagctgtaccggcagaacatcgtgctgaaccggcccttcagcatccagaagctgaactgcctgagccccagcctcatcgccaaggacaagtgctgcagccccatcgagcagaagtag

SEQ ID NO: 36976 - DNA, 1068 bp, Artificial Sequence
  Description of Artificial Sequence: Synthetic coding sequence
atgctgatggagttcttcaagaacagaaatgagatccacgtgagcagctgcagcaccattgaaaataatgatggagagaccctgcctgcccccaactggaacctgaagcacggcaacagctctgtggaggagaacttcacagatgaaagtgacctgtctgaaaatgagaagaccaatgacaccctgctgagctacttcaagaaggtggacctgaacctgaagccagagaccatcaagaatgtggaggagcccttcacagaggagcccaatgaggtgttcccctacccagacttcctgcccccacccttcagcgccctggacctgcacaacctggccctgagcaagagtgacaactggaaggtgacagtggaccctgctgagacctctgtggagcacctgatcacccggctgctggagctggagcggctgcagcacatgaccatccagaaggagcggccccggctgcagaccaccttctgcaccccagctgtgacagagcggcccagcagcagcaaggccacccccaaggtgcggcagcccaagctgtgtgacagcctgagcctgcagatcccctgtgtggacaagagccaggagaagagcaagaacaacagcggcagctgcaagctggagcagaatgccctgaagaggaactggagcaatgccggcaagtaccgctggaacagccggcccctgagcctgaagagcagcagcacccccaagcagctgattgagacctatgacaagaaccccaagagcagcatcctgagcccctgccaggagctgtccttcaagcccaccatcggccacaccaaccagagcatggtgaagatggtgtccacccgctgcctgccctggaggagccccatgcctgtgagccccatccccctgaccttccctgagaaccagaaggaggagatcaaggcccccaagaggaactttggcaccaagaagaagctgtaccggcagaacatcgtgctgaaccggcccttcagcatccagaagctgaactgcctgagccccagcctgattgccaaggacaagtgctgcagccccatcgagcagaagtag

SEQ ID NO: 36977 - DNA, 978 bp, Artificial Sequence
  Description of Artificial Sequence: Synthetic coding sequence
atgcagggccgggtggccggcagctgtgcccccctgggcctgctgctggtgtgcctgcacctgcccggcctgtttgcccggagcattggagtggtggaggagaaggtgtcccagaactttggaacagacctgccccagctgggccagcccagcagcacaggccccagcaacagcgagcacccccagcctgccctggaccccaggagcaatgacctggcccgggtgcccctgaagctgtctgtgcccccatctgatggcttccccccagctgggggcagcgctgtgcagcgctggcccccatcctggggcctgcctgccatggacagctggcccccagaggacccctggcagatgatggctgctgctgctgaggaccggctgggggaggccctgcctgaggagctgagctacctgagcagcgctgctgccctggcccctggcagcggccccctgcccggggagagcagcccagatgccaccggcctgagccctgaggccagcctgctgcaccaggacagcgagagccggcggctgcccaggagcaacagcctgggcgctgggggcaagatcctgagccagaggcctccctggagcctcatccaccgggtgctgcctgaccacccctggggcaccctgaaccccagcgtgtcctggggcggcggcggccctggcaccggctggggcacccggcccatgccccaccctgagggcatctggggcatcaacaaccagcccccaggcacctcctggggcaacatcaaccgctacccaggcggctcctggggcaacatcaaccgctacccaggcggctcctggggcaacatcaaccgctacccaggcggctcctggggcaacatccacctgtacccaggcatcaacaaccccttccccccaggagtgctgcggcccccaggcagctcctggaacatcccagctggcttccccaacccccccagcccccggctgcagtggggctag

SEQ ID NO: 36978 - DNA, 978 bp, Artificial Sequence
  Description of Artificial Sequence: Synthetic coding sequence
atgcagggccgggtggccggcagctgtgcccccctgggcctgctgctggtgtgcctgcacctgcccggcctgtttgcccggagcattggagtggtggaggagaaggtgtcccagaactttggcaccaacctgccccagctgggccagcccagcagcacaggccccagcaacagcgagcacccccagcctgccctggaccccaggagcaatgacctggcccgggtgcccctgaagctgtctgtgcccccatctgatggcttccccccagctgggggcagcgctgtgcagcgctggcccccatcctggggcctgcctgccatggacagctggcccccagaggacccctggcagatgatggctgctgctgctgaggaccggctgggggaggccctgcctgaggagctgagctacctgagcagcgctgctgccctggcccctggcagcggccccctgcccggggagagcagcccagatgccaccggcctgagccctgaggccagcctgctgcaccaggacagcgagagccggcggctgcccaggagcaacagcctgggcgctgggggcaagatcctgagccagaggcctccctggagcctcatccaccgggtgctgcctgaccacccctggggcaccctgaaccccagcgtgtcctggggcggcggcggccctggcaccggctggggcacccggcccatgccccaccctgagggcatctggggcatcaacaaccagcccccaggcacctcctggggcaacatcaaccgctacccaggcggctcctggggcaacatcaaccgctacccaggcggctcctggggcaacatcaaccgctacccaggcggctcctggggcaacatccacctgtacccaggcatcaacaaccccttccccccaggagtgctgcggcccccaggcagctcctggaacatcccagctggcttccccaacccccccagcccccggctgcagtggggctag

SEQ ID NO: 36979 - DNA, 612 bp, Artificial Sequence
  Description of Artificial Sequence: Synthetic coding sequence
atgtaccagaacatggatgatgagatgaagcgggagcacctggccgctgagcagaggatggtgcaccgcatccagaggatcatgatggagtgccaccgggagaaggtggaggccgtggagaaggcccgggcagaggagcggcacatcgcccaggaggccatccaggcccagaagagcaaggctgtggaggagatcgtgaacacaggagtgaccgtcatcaaggatgagaagacctctgtggcccggctgatgagggagaaggagcacgagatgagcatcctgtatggaattgcccagaggcagaggcaggaggaggtgcaggaggtgctgcaggaggccgagaagacccaccaggccaccctgggcaacatgatggacaagctggccaacacccagggcgagctgctgagcatcgccaagcagctgggcatcatgaccaactggaaggacttcctggaggaggagctgcaggagaccaggatggccttccagaagtacatcaactacaccttccccaagctgagccctggccatgctgacttcatcctgcctgagaggaagaagacccccagcaacctggtgatcaaggagaacaagaccaccctggactag

SEQ ID NO: 36980 - DNA, 990 bp, Artificial Sequence
  Description of Artificial Sequence: Synthetic coding sequence
atgatccggaacagcgactacaagaactttgtgtgctgtgctgtgtgcaacaagatcatccccccagccccctttgggaagaccttcaagagaattcatgagtacaagcccctgaagacccgcttctacacccacaaggacatcctggacattggagccaacatcctgaagaaggaggagcagttccaggaggacatcctgcgggagcacatcgccaaggccgaggccgaggtgtgggcccaggccaatgaaaggcagaagcaggccgtggagaaggccctggaggaggccaatgacagacacaagattgagatccagatcctgaaggaggagcaccagaaggacctgcaggaggtgacagccaagaccaagacagagatgtaccagaacatggatgatgagatgaagcgggagcacctggccgctgagcagaggatggtgcaccgcatccagaggatcatgatggagtgccaccgggagaaggtggaggccgtggagaaggcccgggcagaggagcggcacatcgcccaggaggccatccaggcccagaagagcaaggctgtggaggagatcgtgaacacaggagtgaccgtcatcaaggatgagaagacctctgtggcccggctgatgagggagaaggagcacgagatgagcatcctgtatggaattgcccagaggcagaggcaggaggaggtgcaggaggtgctgcaggaggccgagaagacccaccaggccaccctgggcaacatgatggacaagctggccaacacccagggcgagctgctgagcatcgccaagcagctgggcatcatgaccaactggaaggacttcctggaggaggagctgcaggagaccaggatggccttccagaagtacatcaactacaccttccccaagctgagccctggccatgctgacttcatcctgcctgagaggaagaagacccccagcaacctggtgatcaaggagaacaagaccaccctggactag

SEQ ID NO: 36981 - DNA, 231 bp, Artificial Sequence
  Description of Artificial Sequence: Synthetic coding sequence
atgagccacctgcctgctgtgtcccctgtgttcttccagctgcctgccccccaccccccaacagtgctgcggccccagctgggcctgcaccccaacccagaatgtgaccgggagaagatgtctgtgcgggaccatgaccctgaggtgctgaccaggaacagcgcctgcaagccccggggccagctgagcggccacctgctgaagccccgggcccccctggaggccgcctag

SEQ ID NO: 36982 - DNA, 180 bp, Artificial Sequence
  Description of Artificial Sequence: Synthetic coding sequence
atgagccacctgcctgctgtgtcccctgtgttcttccagctgcctgccccccaccccccaacagtgctgcggccccagctgggcctgcaccccaacccagaatgtgaccgggagaagatgtctgtgcgggaccatgaccctgaggtgctgaccaggaacagcggcagcctgcaggcctag

SEQ ID NO: 36983 - DNA, 1869 bp, Artificial Sequence
  Description of Artificial Sequence: Synthetic coding sequence
atgccacccacccaggccgagagcgtcatccgcagcatcatccgggagatcggccaggagtgtgccgcccacggggagatcgtgtctgagaccctgattgccttcatggtgaaggctgtggtgctggaccccagcaatggcttcaacatggacaggaccctgatgaagagtgatgtgcagaacctggtgaagctgtgcatgacccggctgctggacaccaagaaccccagcctggacaccatcaagatgcaggtgtactttgacatgaactacaccaacagagtggagttcctggaggagcaccaccgggtgctggagagccggctgggctctgtgacccgggagatcacagacaacagagcctgtgccaaggaggagctggagagcctgtacaggaagatcatctcctatgtgctgctgcggagcggcctgggcagccccacagacatcaagacagtgcgggaggtgacagctgccctgcagagcgtcttcccccaggccgagctgggcaccttcctgaccctgagcaagaaggacaaggagcggcagctgaaggagctgaccatgattgtgacaggcatccgcctcttcaacagagactgtgggaaaggaggagagggcattgatgacctgcctgctgtgctgcacgtggccatcccagccaccatgcagcacatcgactaccagctggagacagcccggagccaggtgtaccgctacacagccatcctggagaaggccgccaatgaccccctgatgagagctgagctgcagccctacatgctgaaggaggccctgtacaacatccggcagtatgaggtgttcctgcagatcatcctgagtgacatcatcactggagcccaggaggtggagatgatgaccaagcagctgggcgcccacctggagcagctgaagatgaccatcaagagcaagattgctgtgcccaccagccaggtgttccccatcttcatcgccctgagcaccctgtggaccagcctgcaggatgagaccatcgtggtgggcgtgctgagcaacctcttcacccacatccagcccttcctgggcgcccacgagctgtacttccctgagcgggtgatgcagtgccacctgaatggagccaccgtgaagacagatgtgtgcaggatgaaggagcacatggaggacagagtgaatgtggccgacttcaggaagctggagtggctgtttcctgagaccacagccaactttgacaagctgctgatccagtaccggggcttctgtgcctacacctttgctgccacagatggcctgctgctgcccggcaacccagccatcggcatcctgaagtacaaggagaagtactacaccttcaacagcaaggatgctgcctacagctttgctgaaaatcctgagcactacattgatattgtgcgggagaaggccaagaagaacacagagctgatccagctgctggagctgcaccagcagtttgagaccttcatcccctacagccagatgagagatgctgacaagcactacatcaagcccatcaccaagtgtgagagcagcacccagaccaacacccacatcctgccccccaccatcgtgcgctcctatgagtggaatgagtgggagctgcggaggaaggccatcaagctggccaacctgcggcagaaggtgacccacagcgtgcagacagacctgagccacctgcggcgggagaactgcagccaggtgtacccacccaaggacaccagcacccagagcatgagggaggacagcactggagtgccccggccccagatctacctggccggcctgcggggcggcaagtctgagatcacagatgaggtgaaggtgaacctgaccagagatgtggatgagacctag

SEQ ID NO: 36984 - DNA, 759 bp, Artificial Sequence
  Description of Artificial Sequence: Synthetic coding sequence
atgccacccacccaggccgagagcgtcatccgcagcatcatccgggagatcggccaggagtgtgccgcccacggggagatcgtgtctgagaccctgattgccttcatggtgaaggctgtggtgctggaccccagcaatggcttcaacatggacaggaccctgatgaagagtgatgtgcagaacctggtgaagctgtgcatgacccggctgctggacaccaagaaccccagcctggacaccatcaagatgcaggtgtactttgacatgaactacaccaacagagtggagttcctggaggagcaccaccgggtgctggagagccggctgggctctgtgacccgggagatcacagacaacagagcctgtgccaaggaggagctggagagcctgtacaggaagatcatctcctatgtgctgctgcggagcggcctgggcagccccacagacatcaagacagtgcgggaggtgacagctgccctgcagagcgtcttcccccaggccgagctgggcaccttcctgaccctgagcaagaaggacaaggagcggcagctgaaggagctgaccatgattgtgacaggcatccgcctcttcaacagagactgtgggaaaggaggagagggcattgatgacctgcctgctgtgctgcacgtggccatcccagccaccatgcagcacatcgactaccagctggagacagcccggagccaggtgtaccgctacacagccatcctggagaaggccgccaatgaccccctgtag

SEQ ID NO: 36985 - DNA, 1230 bp, Artificial Sequence
  Description of Artificial Sequence: Synthetic coding sequence
atgcactggggcgtgggctttgccagcagccggccctgtgtggtggacctgtcctggaaccagagcatctccttcttcggctggtgggccggcagcgaggagcccttctccttctatggagacatcatcgccttccccctgcaggactatggaggcatcatggccggcctgggcagtgacccctggtggaagaagaccctgtacctgaccggcggggccctgctggccgccgccgcctacctgctgcacgagctgctggtgatcaggaagcagcaggagattgacagcaaggatgccatcatcctgcaccagtttgcccggcccaacaacggggtgcccagcctgagccccttctgcctgaagatggagacctacctgaggatggctgacctgccctaccagaactactttggaggcaagctgagcgcccagggcaagatgccctggattgagtacaaccacgagaaggtgtctggaacagagttcatcatcgacttcctggaggagaagctgggcgtgaacctgaacaagaacctgggcccccatgagcgggccatcagcagagctgtgaccaagatggtggaggagcacttctactggaccctggcctactgccagtgggtggacaacctgaatgagaccaggaagatgctgagcctgagcggcggcggccccttcagcaacctgctgcgctgggtggtgtgccacatcaccaagggcatcgtgaagcgggagatgcacggccatggaattggccgcttcagcgaggaggagatctacatgctgatggagaaggacatgaggagcctggccggcctgctgggggacaagaagtacatcatgggccccaagctgagcaccctggatgccaccgtgtttggccacctggcccaggccatgtggaccctgcccggcaccaggcctgagcggctcatcaagggggagctgatcaacctggccatgtactgtgagcgcatccggaggaagttctggccagagtggcaccatgatgatgacaacaccatctatgaaagtgaggagagcagcgagggcagcaagacccacacccccctgctggacttctccttctacagcaggacagagacctttgaagatgagggcgctgagaacagcttcagcaggaccccagacacagacttcaccggccacagcctgtttgacagtgatgtggacatggatgactacacagaccacgagcagtgcaagtag

SEQ ID NO: 36986 - DNA, 390 bp, Artificial Sequence
  Description of Artificial Sequence: Synthetic coding sequence
atgggccccaagctgagcaccctggatgccaccgtgtttggccacctggcccaggccatgtggaccctgcccggcaccaggcctgagcggctcatcaagggggagctgatcaacctggccatgtactgtgagcgcatccggaggaagttctggccagagtggcaccatgatgatgacaacaccatctatgaaagtgaggagagcagcgagggcagcaagacccacacccccctgctggacttctccttctacagcaggacagagacctttgaagatgagggcgctgagaacagcttcagcaggaccccagacacagacttcaccggccacagcctgtttgacagtgatgtggacatggatgactacacagaccacgagcagtgcaagtag

SEQ ID NO: 36987 - DNA, 384 bp, Artificial Sequence
  Description of Artificial Sequence: Synthetic coding sequence
atgatctaccccctggacctcttcaggaacatcccctggaagcagggcaaatgttttgccagcctgagccctgagggggagcgggcctttgatggcatggagcccctgtgccagcccggggcccggcctgccctgcggggcctgcagcacgccagtgactgctaccgcctgctgagccccccaggcagcggcctggtgggcaccaaccccagcgtgcctgcccccagcccccactgcggctgctgccaggcctggagcatcagcagcttcaccttcaccggccccacccccttcaagatcaacagcgaccaggccaccccctgccacctgcggagccctgagaccatcttccggcagcgggagatcagcaatgaggccttctag

SEQ ID NO: 36988 - DNA, 432 bp, Artificial Sequence
  Description of Artificial Sequence: Synthetic coding sequence
atggccagcggccccctgggccctggggcccggcccacccggctgcacccccccttccccccaccagcccacatcaagccaggggcccctcctggagaaaatcctgagctgagcggcctggagcgcatcctggcccggcaccagctgcccaaggagatcaacctgacccccaagcccaacaggatgccaccctggaagaggaagatcatcaacaacgtgacagatggctggaagaagtgccacctgctgaagaggaacaccaaggagccccccatgagcaccatcgtggtgaggaagctgatccagaagaatgtgcccaggaggcacagcctgaggaacaccagcaggaagctgaggaacctgcccaccacagccaagggcacccagacaggcaagagccagtgcctgctgggcatcagcgagcccacctag

SEQ ID NO: 36989 - DNA, 387 bp, Artificial Sequence
  Description of Artificial Sequence: Synthetic coding sequence
atgctgagcaacctgcacgagctgctgcccaaccacctgatggagaccctgtacagcaggaagtctgaggaggacaagaagaagtgtgagaaccctgagctgagcggcctggagcgcatcctggcccggcaccagctgcccaaggagatcaacctgacccccaagcccaacaggatgccaccctggaagaggaagatcatcaacaacgtgacagatggctggaagaagtgccacctgctgaagaggaacaccaaggagccccccatgagcaccatcgtggtgaggaagctgatccagaagaatgtgccccggcggcacagcctgaggaacaccagcaggaagctgaggaacctgcccaccacagccaagggcacccagacagaatag

SEQ ID NO: 36990 - DNA, 591 bp, Artificial Sequence
  Description of Artificial Sequence: Synthetic coding sequence
atgctgagcaacctgcacgagctgctgcccaaccacctgatggagaccctgtacagcaggaagtctgaggaggacaagaagaagtgtgagaaccctgagctgagcggcctggagcgcatcctggcccggcaccagctgcccaaggagatcaacctgacccccaagcccaacaggatgccaccctggaagaggaagatcatcaacaacgtgacagatggctggaagaagtgccacctgctgaagaggaacaccaaggagccccccatgagcaccatcgtggtgcgctggctgaagaagaacatgcagcccacagaggacctgaagagcgtcatctgccgcctgagcgccttcggccccatccagagcgccaccgtgtgtggccggcagagcgccatcgtggccttcaaggacatgaccagcgcctgcaatgctgtgtctgccttccagagcaggaccccaggcaccatgttccagtgctcctggcagcagcgcttcatgagcaaggacaagacctacagcaagaagtgcacccagaagacccagcccaaggagtacaagcaggagacagagaagccagccaacaacagctag
